United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 59

SEQ ID NO: 2672918 - RNA, 19 nt, Human
auauuauuauaaucuuaua

SEQ ID NO: 2672919 - RNA, 21 nt, Human
auauuauuauaaucuuauaau

SEQ ID NO: 2672920 - RNA, 23 nt, Human
auauuauuauaaucuuauaauug

SEQ ID NO: 2672921 - RNA, 15 nt, Human
auauuagaaaggcuc

SEQ ID NO: 2672922 - RNA, 18 nt, Human
auauuuauugacucuuga

SEQ ID NO: 2672923 - RNA, 16 nt, Human
auauuuauugacucuu

SEQ ID NO: 2672924 - RNA, 13 nt, Human
auauuuauugacu

SEQ ID NO: 2672925 - RNA, 13 nt, Human
auaucaugcaaaa

SEQ ID NO: 2672926 - RNA, 20 nt, Human
auaucaugcaaaauauguuu

SEQ ID NO: 2672927 - RNA, 21 nt, Human
auaucaaauuaauugugugaa

SEQ ID NO: 2672928 - RNA, 20 nt, Human
auaucaaauuaauuguguga

SEQ ID NO: 2672929 - RNA, 19 nt, Human
auaucaaauuaauugugug

SEQ ID NO: 2672930 - RNA, 18 nt, Human
auaucaaauuaauugugu

SEQ ID NO: 2672931 - RNA, 13 nt, Human
auaucaaauuaau

SEQ ID NO: 2672932 - RNA, 13 nt, Human
auaucaaagucau

SEQ ID NO: 2672933 - RNA, 21 nt, Human
auaucaaagucauuaaagaca

SEQ ID NO: 2672934 - RNA, 14 nt, Human
auaaaggauaaaga

SEQ ID NO: 2672935 - RNA, 22 nt, Human
auaaauuuugaaaaguaauauu

SEQ ID NO: 2672936 - RNA, 16 nt, Human
auaacauaaauuuuuu

SEQ ID NO: 2672937 - RNA, 11 nt, Human
auaacauauau

SEQ ID NO: 2672938 - RNA, 14 nt, Human
auaacauauaugga

SEQ ID NO: 2672939 - RNA, 20 nt, Human
auaacauauauggaagagga

SEQ ID NO: 2672940 - RNA, 17 nt, Human
auaacauccagagcuuu

SEQ ID NO: 2672941 - RNA, 16 nt, Human
auaaagcaguauuuuu

SEQ ID NO: 2672942 - RNA, 14 nt, Human
auaaagcaguauuu

SEQ ID NO: 2672943 - RNA, 13 nt, Human
auaaagcuuguug

SEQ ID NO: 2672944 - RNA, 23 nt, Human
auaaagaaggaugaugucuuuuu

SEQ ID NO: 2672945 - RNA, 12 nt, Human
auaaaaauauau

SEQ ID NO: 2672946 - RNA, 18 nt, Human
auaaagaaaaaaauacua

SEQ ID NO: 2672947 - RNA, 13 nt, Human
auaaaaauauauu

SEQ ID NO: 2672948 - RNA, 17 nt, Human
auaaacuuuagaguaga

SEQ ID NO: 2672949 - RNA, 13 nt, Human
auaaaagaaacac

SEQ ID NO: 2672950 - RNA, 13 nt, Human
auaaaagaaauaa

SEQ ID NO: 2672951 - RNA, 18 nt, Human
auaccauuuaguaagaau

SEQ ID NO: 2672952 - RNA, 22 nt, Human
auaccauuuaguaagaauacca

SEQ ID NO: 2672953 - RNA, 17 nt, Human
auaauguccauaugcua

SEQ ID NO: 2672954 - RNA, 18 nt, Human
auaaggaaagcaauaaau

SEQ ID NO: 2672955 - RNA, 22 nt, Human
auaagcuuccauuuuaauuuua

SEQ ID NO: 2672956 - RNA, 13 nt, Human
auaaggauuuuuc

SEQ ID NO: 2672957 - RNA, 12 nt, Human
auaaggaaauuu

SEQ ID NO: 2672958 - RNA, 14 nt, Human
auaaugcuacaauu

SEQ ID NO: 2672959 - RNA, 15 nt, Human
auaaugcuacaauuu

SEQ ID NO: 2672960 - RNA, 17 nt, Human
auaaugcuacaauuuua

SEQ ID NO: 2672961 - RNA, 20 nt, Human
auaaugcuacaauuuuaaga

SEQ ID NO: 2672962 - RNA, 15 nt, Human
auaccuccaacccug

SEQ ID NO: 2672963 - RNA, 17 nt, Human
auaccuccaacccugcc

SEQ ID NO: 2672964 - RNA, 18 nt, Human
agugucccccacccccac

SEQ ID NO: 2672965 - RNA, 14 nt, Human
agugucccccaggu

SEQ ID NO: 2672966 - RNA, 22 nt, Human
agugucccccagguuccgaaga

SEQ ID NO: 2672967 - RNA, 17 nt, Human
aguguauguagaagcau

SEQ ID NO: 2672968 - RNA, 12 nt, Human
aguguauuuauu

SEQ ID NO: 2672969 - RNA, 18 nt, Human
aguguaugacugcacaug

SEQ ID NO: 2672970 - RNA, 19 nt, Human
aguggcgugggagccagcc

SEQ ID NO: 2672971 - RNA, 17 nt, Human
aguguauuaggaagugu

SEQ ID NO: 2672972 - RNA, 19 nt, Human
aguugaaaauucauaguaa

SEQ ID NO: 2672973 - RNA, 19 nt, Human
aguuaaggugggcccggcc

SEQ ID NO: 2672974 - RNA, 16 nt, Human
aguuaaggugggcccg

SEQ ID NO: 2672975 - RNA, 21 nt, Human
aguuaaaagaauguaaaauau

SEQ ID NO: 2672976 - RNA, 20 nt, Human
aguuaaaauuguuaucaaaa

SEQ ID NO: 2672977 - RNA, 22 nt, Human
aguuaaaauuguuaucaaaaua

SEQ ID NO: 2672978 - RNA, 15 nt, Human
aguguuuuugugaau

SEQ ID NO: 2672979 - RNA, 16 nt, Human
aguguuuuugugaauu

SEQ ID NO: 2672980 - RNA, 19 nt, Human
aguguuuuuuuauuucuac

SEQ ID NO: 2672981 - RNA, 17 nt, Human
agucaaaguugaaaauu

SEQ ID NO: 2672982 - RNA, 20 nt, Human
agucaaaguugaaaauucau

SEQ ID NO: 2672983 - RNA, 23 nt, Human
aguaugguaaucuuuaccuguau

SEQ ID NO: 2672984 - RNA, 19 nt, Human
agucaacaguacccugguu

SEQ ID NO: 2672985 - RNA, 12 nt, Human
agucaacaguac

SEQ ID NO: 2672986 - RNA, 15 nt, Human
aguaucucagggccu

SEQ ID NO: 2672987 - RNA, 19 nt, Human
aguaugaaaauggaaauuu

SEQ ID NO: 2672988 - RNA, 13 nt, Human
aguccugugaaug

SEQ ID NO: 2672989 - RNA, 18 nt, Human
aguccugugaaugccacu

SEQ ID NO: 2672990 - RNA, 19 nt, Human
aguccugugaaugccacug

SEQ ID NO: 2672991 - RNA, 20 nt, Human
aguccugugaaugccacugc

SEQ ID NO: 2672992 - RNA, 20 nt, Human
agugaacuugggccacugug

SEQ ID NO: 2672993 - RNA, 19 nt, Human
agugacaguugcagcccuu

SEQ ID NO: 2672994 - RNA, 17 nt, Human
auguauuauuuauaauu

SEQ ID NO: 2672995 - RNA, 16 nt, Human
auguauuauuuauaau

SEQ ID NO: 2672996 - RNA, 15 nt, Human
auguauuauuuauaa

SEQ ID NO: 2672997 - RNA, 17 nt, Human
auguauucuuuucucag

SEQ ID NO: 2672998 - RNA, 23 nt, Human
auggucgagaaagaggcaccagg

SEQ ID NO: 2672999 - RNA, 21 nt, Human
augguauauuugguacuguau

SEQ ID NO: 2673000 - RNA, 12 nt, Human
augguauauaua

SEQ ID NO: 2673001 - RNA, 14 nt, Human
augguauauauaca

SEQ ID NO: 2673002 - RNA, 16 nt, Human
augguauauauacaua

SEQ ID NO: 2673003 - RNA, 17 nt, Human
augguauauauacauau

SEQ ID NO: 2673004 - RNA, 19 nt, Human
augguauauauacauauau

SEQ ID NO: 2673005 - RNA, 24 nt, Human
auggucacguuuggugcuucucag

SEQ ID NO: 2673006 - RNA, 21 nt, Human
auggucacguuuggugcuucu

SEQ ID NO: 2673007 - RNA, 20 nt, Human
auggucacguuuggugcuuc

SEQ ID NO: 2673008 - RNA, 13 nt, Human
augucuuuuaaaa

SEQ ID NO: 2673009 - RNA, 14 nt, Human
augucuuuuaaaau

SEQ ID NO: 2673010 - RNA, 23 nt, Human
augucaaaaguagaacuuuguau

SEQ ID NO: 2673011 - RNA, 22 nt, Human
augucaaaaguagaacuuugua

SEQ ID NO: 2673012 - RNA, 20 nt, Human
augucaaaaguagaacuuug

SEQ ID NO: 2673013 - RNA, 17 nt, Human
augucaaaaguagaacu

SEQ ID NO: 2673014 - RNA, 15 nt, Human
augucaaaaguagaa

SEQ ID NO: 2673015 - RNA, 14 nt, Human
augugaauuauuga

SEQ ID NO: 2673016 - RNA, 16 nt, Human
augugaauuauugaca

SEQ ID NO: 2673017 - RNA, 18 nt, Human
augugaauuauugacacu

SEQ ID NO: 2673018 - RNA, 19 nt, Human
augugaauuauugacacug

SEQ ID NO: 2673019 - RNA, 20 nt, Human
augugaauuauugacacuga

SEQ ID NO: 2673020 - RNA, 21 nt, Human
augugaauuauugacacugaa

SEQ ID NO: 2673021 - RNA, 21 nt, Human
auguucuagucugcuuuggua

SEQ ID NO: 2673022 - RNA, 22 nt, Human
augugugcaacaggguauggac

SEQ ID NO: 2673023 - RNA, 12 nt, Human
auuaaauacaua

SEQ ID NO: 2673024 - RNA, 13 nt, Human
auuaaauacauau

SEQ ID NO: 2673025 - RNA, 19 nt, Human
auuaaauacauauggaugu

SEQ ID NO: 2673026 - RNA, 23 nt, Human
auuaaauacauauggauguuacu

SEQ ID NO: 2673027 - RNA, 16 nt, Human
auguuuucaaaaggua

SEQ ID NO: 2673028 - RNA, 22 nt, Human
auguuuucaaaagguauuauac

SEQ ID NO: 2673029 - RNA, 15 nt, Human
auguuuccagacuuc

SEQ ID NO: 2673030 - RNA, 17 nt, Human
augugggauauugaaug

SEQ ID NO: 2673031 - RNA, 19 nt, Human
augugggauauugaauguu

SEQ ID NO: 2673032 - RNA, 16 nt, Human
auggaaaguaacucau

SEQ ID NO: 2673033 - RNA, 20 nt, Human
auggaggaagaacugaaagg

SEQ ID NO: 2673034 - RNA, 18 nt, Human
auggaggaagaacugaaa

SEQ ID NO: 2673035 - RNA, 19 nt, Human
auggaggaucucuaaagag

SEQ ID NO: 2673036 - RNA, 21 nt, Human
auggaggaucucuaaagagca

SEQ ID NO: 2673037 - RNA, 15 nt, Human
auggauuuccagcca

SEQ ID NO: 2673038 - RNA, 23 nt, Human
auggaaagcagaguuuucauuaa

SEQ ID NO: 2673039 - RNA, 18 nt, Human
auggaaaaguguccuucu

SEQ ID NO: 2673040 - RNA, 19 nt, Human
augcugcaggacuugagaa

SEQ ID NO: 2673041 - RNA, 18 nt, Human
augcugcaggacuugaga

SEQ ID NO: 2673042 - RNA, 14 nt, Human
auggauuucagaag

SEQ ID NO: 2673043 - RNA, 17 nt, Human
auggauuucagaagccu

SEQ ID NO: 2673044 - RNA, 22 nt, Human
auggcuguguugguguggccca

SEQ ID NO: 2673045 - RNA, 14 nt, Human
augauuaaaaauau

SEQ ID NO: 2673046 - RNA, 17 nt, Human
augauuaaaaauaucaa

SEQ ID NO: 2673047 - RNA, 15 nt, Human
augcauauaaugaau

SEQ ID NO: 2673048 - RNA, 18 nt, Human
augcauauaaugaauaaa

SEQ ID NO: 2673049 - RNA, 19 nt, Human
augcauauaaugaauaaau

SEQ ID NO: 2673050 - RNA, 21 nt, Human
augcauauaaugaauaaauca

SEQ ID NO: 2673051 - RNA, 13 nt, Human
augcaucuuugau

SEQ ID NO: 2673052 - RNA, 12 nt, Human
augcaucuuuga

SEQ ID NO: 2673053 - RNA, 21 nt, Human
augcaucuuugauguguuguu

SEQ ID NO: 2673054 - RNA, 19 nt, Human
augcaucuuugauguguug

SEQ ID NO: 2673055 - RNA, 16 nt, Human
augcaucuuugaugug

SEQ ID NO: 2673056 - RNA, 15 nt, Human
augcaucuuugaugu

SEQ ID NO: 2673057 - RNA, 18 nt, Human
aucuauuaauauauguau

SEQ ID NO: 2673058 - RNA, 15 nt, Human
aucuauuaauauaug

SEQ ID NO: 2673059 - RNA, 12 nt, Human
aucuauuaauau

SEQ ID NO: 2673060 - RNA, 14 nt, Human
aucuauuaauauau

SEQ ID NO: 2673061 - RNA, 13 nt, Human
aucuaucugugcu

SEQ ID NO: 2673062 - RNA, 17 nt, Human
aucuauggucgggagac

SEQ ID NO: 2673063 - RNA, 14 nt, Human
aucucccucccaca

SEQ ID NO: 2673064 - RNA, 13 nt, Human
aucucccugccug

SEQ ID NO: 2673065 - RNA, 14 nt, Human
aucucccugccugg

SEQ ID NO: 2673066 - RNA, 15 nt, Human
aucucccugccuggc

SEQ ID NO: 2673067 - RNA, 17 nt, Human
aucucccugccuggccc

SEQ ID NO: 2673068 - RNA, 18 nt, Human
aucucccugccuggcccc

SEQ ID NO: 2673069 - RNA, 20 nt, Human
aucucccugccuggccccca

SEQ ID NO: 2673070 - RNA, 20 nt, Human
aucuccccucagcucggcuc

SEQ ID NO: 2673071 - RNA, 14 nt, Human
aucuccccucagcu

SEQ ID NO: 2673072 - RNA, 16 nt, Human
aucuccccucagcucg

SEQ ID NO: 2673073 - RNA, 15 nt, Human
aucuccccucagcuc

SEQ ID NO: 2673074 - RNA, 17 nt, Human
aucuauucugagaaaac

SEQ ID NO: 2673075 - RNA, 18 nt, Human
aucuauucugagaaaaca

SEQ ID NO: 2673076 - RNA, 22 nt, Human
aucuauucugagaaaacaagca

SEQ ID NO: 2673077 - RNA, 16 nt, Human
aucuaucuaguucuaa

SEQ ID NO: 2673078 - RNA, 14 nt, Human
aucuaucuauuuga

SEQ ID NO: 2673079 - RNA, 15 nt, Human
aucuaucuauuugag

SEQ ID NO: 2673080 - RNA, 16 nt, Human
aucuaucuauuugagg

SEQ ID NO: 2673081 - RNA, 19 nt, Human
aucuaucucaucuaucuca

SEQ ID NO: 2673082 - RNA, 13 nt, Human
aucucugugccuu

SEQ ID NO: 2673083 - RNA, 14 nt, Human
aucucugugccuuc

SEQ ID NO: 2673084 - RNA, 15 nt, Human
aucucugugccuucg

SEQ ID NO: 2673085 - RNA, 18 nt, Human
aucucugugccuucgucu

SEQ ID NO: 2673086 - RNA, 21 nt, Human
aucuggccccagguagaaacu

SEQ ID NO: 2673087 - RNA, 20 nt, Human
aucuugaauccuuccauucc

SEQ ID NO: 2673088 - RNA, 20 nt, Human
augaaaaauagugucuuugu

SEQ ID NO: 2673089 - RNA, 18 nt, Human
augaaaaauuggggagga

SEQ ID NO: 2673090 - RNA, 19 nt, Human
augaaaaauagugucuuug

SEQ ID NO: 2673091 - RNA, 22 nt, Human
augagcucgcauuugucaauga

SEQ ID NO: 2673092 - RNA, 21 nt, Human
augagcucgcauuugucaaug

SEQ ID NO: 2673093 - RNA, 13 nt, Human
augaggaggaugc

SEQ ID NO: 2673094 - RNA, 18 nt, Human
augaggaggaugcuaaaa

SEQ ID NO: 2673095 - RNA, 12 nt, Human
augaggagggga

SEQ ID NO: 2673096 - RNA, 13 nt, Human
augaggaggggag

SEQ ID NO: 2673097 - RNA, 14 nt, Human
augaggaggggagg

SEQ ID NO: 2673098 - RNA, 15 nt, Human
augaggaggggaggg

SEQ ID NO: 2673099 - RNA, 17 nt, Human
augaggaggggagggua

SEQ ID NO: 2673100 - RNA, 21 nt, Human
augaggaacuguagaugaugu

SEQ ID NO: 2673101 - RNA, 22 nt, Human
augaggaacuguagaugaugua

SEQ ID NO: 2673102 - RNA, 12 nt, Human
augaggagggug

SEQ ID NO: 2673103 - RNA, 14 nt, Human
augaggaggguggg

SEQ ID NO: 2673104 - RNA, 22 nt, Human
augaggagggugggggagggag

SEQ ID NO: 2673105 - RNA, 21 nt, Human
aucacagccucugaaaaccaa

SEQ ID NO: 2673106 - RNA, 18 nt, Human
aucagccugcuccagcug

SEQ ID NO: 2673107 - RNA, 17 nt, Human
aucagccugcuccagcu

SEQ ID NO: 2673108 - RNA, 19 nt, Human
aucagccugcuccagcugu

SEQ ID NO: 2673109 - RNA, 14 nt, Human
aucacauuucuaug

SEQ ID NO: 2673110 - RNA, 15 nt, Human
aucacccucuuccug

SEQ ID NO: 2673111 - RNA, 15 nt, Human
aucagcaugaaaaug

SEQ ID NO: 2673112 - RNA, 16 nt, Human
aucagccaaguuuuau

SEQ ID NO: 2673113 - RNA, 19 nt, Human
aucagccaaguuuuauaau

SEQ ID NO: 2673114 - RNA, 16 nt, Human
aucacccucuuccugu

SEQ ID NO: 2673115 - RNA, 15 nt, Human
auccccuguagagug

SEQ ID NO: 2673116 - RNA, 17 nt, Human
auccagcugccuauuga

SEQ ID NO: 2673117 - RNA, 14 nt, Human
auccccgccuggcc

SEQ ID NO: 2673118 - RNA, 17 nt, Human
auccccgccuggccagg

SEQ ID NO: 2673119 - RNA, 18 nt, Human
auccccgccuggccagga

SEQ ID NO: 2673120 - RNA, 20 nt, Human
auccccgccuggccaggagc

SEQ ID NO: 2673121 - RNA, 21 nt, Human
auccccgccuggccaggagca

SEQ ID NO: 2673122 - RNA, 19 nt, Human
auccuccaaccaggcuccu

SEQ ID NO: 2673123 - RNA, 18 nt, Human
auccagaaaacugugauu

SEQ ID NO: 2673124 - RNA, 15 nt, Human
aucccauuuaaaaaa

SEQ ID NO: 2673125 - RNA, 14 nt, Human
aucccauuuaaaaa

SEQ ID NO: 2673126 - RNA, 20 nt, Human
aucggagaacaugaaucaaa

SEQ ID NO: 2673127 - RNA, 16 nt, Human
aucgcugugaugcugg

SEQ ID NO: 2673128 - RNA, 13 nt, Human
auccccuaaaaua

SEQ ID NO: 2673129 - RNA, 21 nt, Human
aucggccaucaagggaagaac

SEQ ID NO: 2673130 - RNA, 16 nt, Human
aaaaaccgaauaaaug

SEQ ID NO: 2673131 - RNA, 17 nt, Human
aaaaaccgaauaaaugu

SEQ ID NO: 2673132 - RNA, 15 nt, Human
aaaaaauauuuuccu

SEQ ID NO: 2673133 - RNA, 16 nt, Human
uuuguguaaugaaaau

SEQ ID NO: 2673134 - RNA, 21 nt, Human
uuuguguaacucccagugaug

SEQ ID NO: 2673135 - RNA, 13 nt, Human
ccaccccccaggc

SEQ ID NO: 2673136 - RNA, 12 nt, Human
ccacccccagcc

SEQ ID NO: 2673137 - RNA, 13 nt, Human
ccacccccagccc

SEQ ID NO: 2673138 - RNA, 14 nt, Human
ccacccccagcccc

SEQ ID NO: 2673139 - RNA, 15 nt, Human
ccacccccagccccg

SEQ ID NO: 2673140 - RNA, 16 nt, Human
ccacccccagccccga

SEQ ID NO: 2673141 - RNA, 15 nt, Human
ccaccccccaggccu

SEQ ID NO: 2673142 - RNA, 13 nt, Human
ccacccccugccc

SEQ ID NO: 2673143 - RNA, 14 nt, Human
ccacccccugcccu

SEQ ID NO: 2673144 - RNA, 15 nt, Human
ccacccccugcccug

SEQ ID NO: 2673145 - RNA, 18 nt, Human
ccacccccugcccugcac

SEQ ID NO: 2673146 - RNA, 16 nt, Human
ccacccccugcccugc

SEQ ID NO: 2673147 - RNA, 17 nt, Human
ccacccccugcccugca

SEQ ID NO: 2673148 - RNA, 13 nt, Human
ccaccccugcccc

SEQ ID NO: 2673149 - RNA, 22 nt, Human
ccaccccugcccccagccccgg

SEQ ID NO: 2673150 - RNA, 13 nt, Human
ccacccugagccg

SEQ ID NO: 2673151 - RNA, 15 nt, Human
ccacccugagccggc

SEQ ID NO: 2673152 - RNA, 14 nt, Human
ccaccucggucacu

SEQ ID NO: 2673153 - RNA, 19 nt, Human
ccaccucggucacuccaac

SEQ ID NO: 2673154 - RNA, 21 nt, Human
ccacccugagccggccccagg

SEQ ID NO: 2673155 - RNA, 22 nt, Human
ccacccugagccggccccaggc

SEQ ID NO: 2673156 - RNA, 13 nt, Human
ccacccugccccu

SEQ ID NO: 2673157 - RNA, 13 nt, Human
ccacccugccugc

SEQ ID NO: 2673158 - RNA, 15 nt, Human
ccagaccagauuaaa

SEQ ID NO: 2673159 - RNA, 22 nt, Human
ccagaauaaguuauugcaguuu

SEQ ID NO: 2673160 - RNA, 23 nt, Human
ccagaauaaguuauugcaguuua

SEQ ID NO: 2673161 - RNA, 23 nt, Human
ccagaauacugauggaauuuuuu

SEQ ID NO: 2673162 - RNA, 21 nt, Human
ccagaauacugauggaauuuu

SEQ ID NO: 2673163 - RNA, 15 nt, Human
ccagaauacugaugg

SEQ ID NO: 2673164 - RNA, 12 nt, Human
ccagaauacuga

SEQ ID NO: 2673165 - RNA, 15 nt, Human
ccagaauaaguuauu

SEQ ID NO: 2673166 - RNA, 19 nt, Human
ccagaauaaguuauugcag

SEQ ID NO: 2673167 - RNA, 21 nt, Human
ccagaauaaguuauugcaguu

SEQ ID NO: 2673168 - RNA, 20 nt, Human
ccacugguccccaacaaugu

SEQ ID NO: 2673169 - RNA, 15 nt, Human
ccacugugaagagaa

SEQ ID NO: 2673170 - RNA, 14 nt, Human
ccacugugaagaga

SEQ ID NO: 2673171 - RNA, 13 nt, Human
ccacugccagcag

SEQ ID NO: 2673172 - RNA, 14 nt, Human
ccacugccagcagc

SEQ ID NO: 2673173 - RNA, 15 nt, Human
ccacugccagcagca

SEQ ID NO: 2673174 - RNA, 16 nt, Human
ccacugccagcagcag

SEQ ID NO: 2673175 - RNA, 17 nt, Human
ccacugccagcagcagc

SEQ ID NO: 2673176 - RNA, 23 nt, Human
ccacugccagcagcagcagguga

SEQ ID NO: 2673177 - RNA, 12 nt, Human
ccacugccuucg

SEQ ID NO: 2673178 - RNA, 20 nt, Human
ccacugccagcagcagcagg

SEQ ID NO: 2673179 - RNA, 23 nt, Human
ccacugcaucguuucaucuucca

SEQ ID NO: 2673180 - RNA, 21 nt, Human
ccacugcaucguuucaucuuc

SEQ ID NO: 2673181 - RNA, 19 nt, Human
ccagaacucacuggggccu

SEQ ID NO: 2673182 - RNA, 22 nt, Human
ccagaaccacacuugaaaccuu

SEQ ID NO: 2673183 - RNA, 19 nt, Human
ccagaaccaccccggcccc

SEQ ID NO: 2673184 - RNA, 17 nt, Human
ccacuguuucucuugag

SEQ ID NO: 2673185 - RNA, 18 nt, Human
ccacuguuucucuugagc

SEQ ID NO: 2673186 - RNA, 19 nt, Human
ccacuguuucucuugagcu

SEQ ID NO: 2673187 - RNA, 21 nt, Human
ccacuguuucucuugagcugg

SEQ ID NO: 2673188 - RNA, 22 nt, Human
ccacuguuucucuugagcuggc

SEQ ID NO: 2673189 - RNA, 23 nt, Human
ccacuguuucucuugagcuggcc

SEQ ID NO: 2673190 - RNA, 15 nt, Human
ccacugugcuuucag

SEQ ID NO: 2673191 - RNA, 12 nt, Human
ccagauuugucu

SEQ ID NO: 2673192 - RNA, 15 nt, Human
ccagauuugucuuuu

SEQ ID NO: 2673193 - RNA, 23 nt, Human
ccagauuugucuuuuuguuguaa

SEQ ID NO: 2673194 - RNA, 22 nt, Human
ccagcaaaagagcuauugccaa

SEQ ID NO: 2673195 - RNA, 22 nt, Human
ccagcaacacagccugggcccc

SEQ ID NO: 2673196 - RNA, 13 nt, Human
ccagcacagcuug

SEQ ID NO: 2673197 - RNA, 17 nt, Human
ccagcacagcuugaccu

SEQ ID NO: 2673198 - RNA, 14 nt, Human
ccagcaacacagcc

SEQ ID NO: 2673199 - RNA, 15 nt, Human
ccagcaacacagccu

SEQ ID NO: 2673200 - RNA, 16 nt, Human
ccagcaacacagccug

SEQ ID NO: 2673201 - RNA, 17 nt, Human
ccagcaacacagccugg

SEQ ID NO: 2673202 - RNA, 19 nt, Human
ccagcaacacagccugggc

SEQ ID NO: 2673203 - RNA, 20 nt, Human
ccagcaacacagccugggcc

SEQ ID NO: 2673204 - RNA, 15 nt, Human
ccagcaccuggcauc

SEQ ID NO: 2673205 - RNA, 14 nt, Human
ccagcaccuugugc

SEQ ID NO: 2673206 - RNA, 15 nt, Human
ccagcaccuugugcc

SEQ ID NO: 2673207 - RNA, 16 nt, Human
ccagcaccuugugccu

SEQ ID NO: 2673208 - RNA, 18 nt, Human
ccagcaccuugugccugg

SEQ ID NO: 2673209 - RNA, 19 nt, Human
ccagcaccuugugccuggg

SEQ ID NO: 2673210 - RNA, 20 nt, Human
ccagcaccuugugccugggg

SEQ ID NO: 2673211 - RNA, 18 nt, Human
ccagcaccucagccugca

SEQ ID NO: 2673212 - RNA, 17 nt, Human
ccagcaccucagccugc

SEQ ID NO: 2673213 - RNA, 21 nt, Human
ccagcccagggcuccugcacu

SEQ ID NO: 2673214 - RNA, 17 nt, Human
ccagcccagggcuccug

SEQ ID NO: 2673215 - RNA, 19 nt, Human
ccagcccagggcuccugca

SEQ ID NO: 2673216 - RNA, 12 nt, Human
ccagcccugcug

SEQ ID NO: 2673217 - RNA, 13 nt, Human
ccagcccugcugg

SEQ ID NO: 2673218 - RNA, 14 nt, Human
ccagcccugcuggg

SEQ ID NO: 2673219 - RNA, 16 nt, Human
ccagcccugcugggga

SEQ ID NO: 2673220 - RNA, 17 nt, Human
ccagcccugcuggggau

SEQ ID NO: 2673221 - RNA, 19 nt, Human
ccagcccugcuggggaucc

SEQ ID NO: 2673222 - RNA, 20 nt, Human
ccagcccugcuggggauccc

SEQ ID NO: 2673223 - RNA, 22 nt, Human
ccagcccugcuggggauccccg

SEQ ID NO: 2673224 - RNA, 14 nt, Human
ccagccaugccagc

SEQ ID NO: 2673225 - RNA, 16 nt, Human
ccagccaugccagcug

SEQ ID NO: 2673226 - RNA, 17 nt, Human
ccagccaugccagcugg

SEQ ID NO: 2673227 - RNA, 18 nt, Human
ccagccaugccagcuggc

SEQ ID NO: 2673228 - RNA, 13 nt, Human
ccagcccagggcu

SEQ ID NO: 2673229 - RNA, 14 nt, Human
ccagcccagggcuc

SEQ ID NO: 2673230 - RNA, 15 nt, Human
ccagcccagggcucc

SEQ ID NO: 2673231 - RNA, 14 nt, Human
ccagccugcgccug

SEQ ID NO: 2673232 - RNA, 13 nt, Human
ccagccugcgccu

SEQ ID NO: 2673233 - RNA, 19 nt, Human
ccagccugcgccugcugca

SEQ ID NO: 2673234 - RNA, 17 nt, Human
ccagccugcgccugcug

SEQ ID NO: 2673235 - RNA, 16 nt, Human
ccagccugcgccugcu

SEQ ID NO: 2673236 - RNA, 15 nt, Human
ccagccugcgccugc

SEQ ID NO: 2673237 - RNA, 16 nt, Human
ccagcucccucuauuu

SEQ ID NO: 2673238 - RNA, 21 nt, Human
ccagccuggggcugaggcuga

SEQ ID NO: 2673239 - RNA, 17 nt, Human
ccagccuugagcccugg

SEQ ID NO: 2673240 - RNA, 18 nt, Human
ccagccuugagcccuggc

SEQ ID NO: 2673241 - RNA, 19 nt, Human
ccagccuugagcccuggcu

SEQ ID NO: 2673242 - RNA, 20 nt, Human
ccagccuugagcccuggcug

SEQ ID NO: 2673243 - RNA, 21 nt, Human
ccagccuugagcccuggcugu

SEQ ID NO: 2673244 - RNA, 13 nt, Human
ccagccuggguga

SEQ ID NO: 2673245 - RNA, 21 nt, Human
ccagccugcuagcuagcucaa

SEQ ID NO: 2673246 - RNA, 19 nt, Human
ccagccugcuagcuagcuc

SEQ ID NO: 2673247 - RNA, 15 nt, Human
ccagccugcuagcua

SEQ ID NO: 2673248 - RNA, 14 nt, Human
ccagccugcuagcu

SEQ ID NO: 2673249 - RNA, 13 nt, Human
ccagccugcuagc

SEQ ID NO: 2673250 - RNA, 12 nt, Human
ccagccugcuag

SEQ ID NO: 2673251 - RNA, 10 nt, Human
ccagccugcu

SEQ ID NO: 2673252 - RNA, 21 nt, Human
ccagccugcgccugcugcaug

SEQ ID NO: 2673253 - RNA, 17 nt, Human
ccauuagccagauuugu

SEQ ID NO: 2673254 - RNA, 20 nt, Human
ccauucguacauaauacuga

SEQ ID NO: 2673255 - RNA, 21 nt, Human
ccauucguacauaauacugaa

SEQ ID NO: 2673256 - RNA, 23 nt, Human
ccauucucccagguaccagcugc

SEQ ID NO: 2673257 - RNA, 22 nt, Human
ccauucucccagguaccagcug

SEQ ID NO: 2673258 - RNA, 12 nt, Human
ccauucugacuc

SEQ ID NO: 2673259 - RNA, 13 nt, Human
ccauucugacucg

SEQ ID NO: 2673260 - RNA, 14 nt, Human
ccauuuuaauuuua

SEQ ID NO: 2673261 - RNA, 21 nt, Human
ccauuuuaauuuuaaagugca

SEQ ID NO: 2673262 - RNA, 19 nt, Human
ccauuugcucuucagaugc

SEQ ID NO: 2673263 - RNA, 22 nt, Human
ccauuugcucuucagaugccac

SEQ ID NO: 2673264 - RNA, 22 nt, Human
ccauucugccgcccccuccuga

SEQ ID NO: 2673265 - RNA, 20 nt, Human
ccauucugacucgguuucuc

SEQ ID NO: 2673266 - RNA, 18 nt, Human
ccauuugcaauaacagcu

SEQ ID NO: 2673267 - RNA, 19 nt, Human
ccauuugcaauaacagcug

SEQ ID NO: 2673268 - RNA, 20 nt, Human
ccauuugcaauaacagcugc

SEQ ID NO: 2673269 - RNA, 21 nt, Human
ccauuugcaauaacagcugca

SEQ ID NO: 2673270 - RNA, 22 nt, Human
ccauuugcaauaacagcugcaa

SEQ ID NO: 2673271 - RNA, 22 nt, Human
ccauuugccaauuuuccuacuc

SEQ ID NO: 2673272 - RNA, 20 nt, Human
ccaucuugcuucccuaaucu

SEQ ID NO: 2673273 - RNA, 21 nt, Human
ccaucuugcuucccuaaucua

SEQ ID NO: 2673274 - RNA, 18 nt, Human
ccauguuuuguuuacggu

SEQ ID NO: 2673275 - RNA, 22 nt, Human
ccauuacagagguauuaaaacu

SEQ ID NO: 2673276 - RNA, 23 nt, Human
ccauuacagagguauuaaaacua

SEQ ID NO: 2673277 - RNA, 15 nt, Human
ccauuaaggggaaga

SEQ ID NO: 2673278 - RNA, 20 nt, Human
ccauuaaggggaagaaugaa

SEQ ID NO: 2673279 - RNA, 15 nt, Human
ccauuaaaguucuca

SEQ ID NO: 2673280 - RNA, 18 nt, Human
ccauuuuuuaauuuacuu

SEQ ID NO: 2673281 - RNA, 18 nt, Human
cccaaccccaagccagcc

SEQ ID NO: 2673282 - RNA, 20 nt, Human
cccaaccaggcaccucuucc

SEQ ID NO: 2673283 - RNA, 15 nt, Human
cccacaguugcucua

SEQ ID NO: 2673284 - RNA, 18 nt, Human
cccacauccaacuccagc

SEQ ID NO: 2673285 - RNA, 19 nt, Human
cccacauccaacuccagca

SEQ ID NO: 2673286 - RNA, 21 nt, Human
cccacagucuccggccucucc

SEQ ID NO: 2673287 - RNA, 23 nt, Human
cccacagacaaaagcgcuuuucc

SEQ ID NO: 2673288 - RNA, 20 nt, Human
cccacggagucguggggugu

SEQ ID NO: 2673289 - RNA, 22 nt, Human
cccagaauaaguuauugcaguu

SEQ ID NO: 2673290 - RNA, 14 nt, Human
cccagaauacugau

SEQ ID NO: 2673291 - RNA, 19 nt, Human
cccagaauaaguuauugca

SEQ ID NO: 2673292 - RNA, 17 nt, Human
cccaccucggucacucc

SEQ ID NO: 2673293 - RNA, 21 nt, Human
cccaccuagaacacuaacuca

SEQ ID NO: 2673294 - RNA, 20 nt, Human
cccaccguggaggaggaagg

SEQ ID NO: 2673295 - RNA, 21 nt, Human
cccaccgguccagcuggccug

SEQ ID NO: 2673296 - RNA, 14 nt, Human
cccacauguccagc

SEQ ID NO: 2673297 - RNA, 15 nt, Human
cccacauguccagca

SEQ ID NO: 2673298 - RNA, 19 nt, Human
cccaccguggaggaggaag

SEQ ID NO: 2673299 - RNA, 13 nt, Human
ccagguagaaacu

SEQ ID NO: 2673300 - RNA, 14 nt, Human
ccagggaggggccg

SEQ ID NO: 2673301 - RNA, 23 nt, Human
ccagggaggggccggcccugugu

SEQ ID NO: 2673302 - RNA, 22 nt, Human
ccagggagccuuugguucuggc

SEQ ID NO: 2673303 - RNA, 18 nt, Human
ccagggagccuuugguuc

SEQ ID NO: 2673304 - RNA, 20 nt, Human
ccagggcaagcuccgcagga

SEQ ID NO: 2673305 - RNA, 17 nt, Human
ccagggcaagcuccgca

SEQ ID NO: 2673306 - RNA, 22 nt, Human
ccagggcaagcuccgcaggacu

SEQ ID NO: 2673307 - RNA, 13 nt, Human
ccagggcccucgg

SEQ ID NO: 2673308 - RNA, 16 nt, Human
ccaggccaccucccca

SEQ ID NO: 2673309 - RNA, 17 nt, Human
ccaggccaccuccccag

SEQ ID NO: 2673310 - RNA, 13 nt, Human
ccaggccaccucc

SEQ ID NO: 2673311 - RNA, 21 nt, Human
ccaggccaccuccccagcauu

SEQ ID NO: 2673312 - RNA, 18 nt, Human
ccaggcccuccucuccca

SEQ ID NO: 2673313 - RNA, 19 nt, Human
ccaggcccuccucucccau

SEQ ID NO: 2673314 - RNA, 20 nt, Human
ccaucaucuauagaaagcua

SEQ ID NO: 2673315 - RNA, 21 nt, Human
ccaucuagacuagcaaucucu

SEQ ID NO: 2673316 - RNA, 14 nt, Human
ccaucuagccagcc

SEQ ID NO: 2673317 - RNA, 23 nt, Human
ccaucuagccagccccucuuccc

SEQ ID NO: 2673318 - RNA, 21 nt, Human
ccaucuaggggagccuugauu

SEQ ID NO: 2673319 - RNA, 14 nt, Human
ccagguagaaacuu

SEQ ID NO: 2673320 - RNA, 13 nt, Human
ccaggugcagagg

SEQ ID NO: 2673321 - RNA, 14 nt, Human
ccaggugcagaggu

SEQ ID NO: 2673322 - RNA, 20 nt, Human
ccaggugcagagguacccug

SEQ ID NO: 2673323 - RNA, 22 nt, Human
ccaggugcagagguacccuggg

SEQ ID NO: 2673324 - RNA, 23 nt, Human
ccaggugcagagguacccugggu

SEQ ID NO: 2673325 - RNA, 13 nt, Human
ccagguuuaagcu

SEQ ID NO: 2673326 - RNA, 14 nt, Human
ccagugcaaaugca

SEQ ID NO: 2673327 - RNA, 17 nt, Human
ccagugcaaaugcaugc

SEQ ID NO: 2673328 - RNA, 23 nt, Human
ccagugagggacgucagacuugg

SEQ ID NO: 2673329 - RNA, 15 nt, Human
ccagugcaugguggc

SEQ ID NO: 2673330 - RNA, 18 nt, Human
ccagugcaugguggccag

SEQ ID NO: 2673331 - RNA, 19 nt, Human
ccagugcaugguggccaga

SEQ ID NO: 2673332 - RNA, 15 nt, Human
ccagugcagaaugua

SEQ ID NO: 2673333 - RNA, 16 nt, Human
ccagugcagaauguaa

SEQ ID NO: 2673334 - RNA, 13 nt, Human
ccagugaccucuc

SEQ ID NO: 2673335 - RNA, 19 nt, Human
ccagugaccucucucucug

SEQ ID NO: 2673336 - RNA, 19 nt, Human
cccucuaaccucgcccucu

SEQ ID NO: 2673337 - RNA, 20 nt, Human
cccucucccaaaaaacuacu

SEQ ID NO: 2673338 - RNA, 14 nt, Human
cccucugccccucc

SEQ ID NO: 2673339 - RNA, 20 nt, Human
cccucuguguauuugcuuuu

SEQ ID NO: 2673340 - RNA, 18 nt, Human
cccucuguguauuugcuu

SEQ ID NO: 2673341 - RNA, 14 nt, Human
cccucuuccuguga

SEQ ID NO: 2673342 - RNA, 15 nt, Human
cccucuuccugugau

SEQ ID NO: 2673343 - RNA, 13 nt, Human
cccucuugcccau

SEQ ID NO: 2673344 - RNA, 15 nt, Human
cccucuugcccaucc

SEQ ID NO: 2673345 - RNA, 16 nt, Human
cccucuugcccauccu

SEQ ID NO: 2673346 - RNA, 17 nt, Human
cccucuugcccauccug

SEQ ID NO: 2673347 - RNA, 22 nt, Human
cccucuugcccauccugacuga

SEQ ID NO: 2673348 - RNA, 19 nt, Human
cccucccacacccaaagcu

SEQ ID NO: 2673349 - RNA, 10 nt, Human
cccucccacu

SEQ ID NO: 2673350 - RNA, 15 nt, Human
cccucccacuuugcu

SEQ ID NO: 2673351 - RNA, 15 nt, Human
cccucccacccccag

SEQ ID NO: 2673352 - RNA, 16 nt, Human
cccucccacccccagc

SEQ ID NO: 2673353 - RNA, 17 nt, Human
cccucccacccccagcc

SEQ ID NO: 2673354 - RNA, 20 nt, Human
cccucccacccccagccccg

SEQ ID NO: 2673355 - RNA, 18 nt, Human
cccuugcuugccugcagg

SEQ ID NO: 2673356 - RNA, 19 nt, Human
cccuugcuugccugcaggg

SEQ ID NO: 2673357 - RNA, 22 nt, Human
cccuugcuugccugcagggcca

SEQ ID NO: 2673358 - RNA, 23 nt, Human
cccuugcuugccugcagggccau

SEQ ID NO: 2673359 - RNA, 13 nt, Human
cccuugcuggccc

SEQ ID NO: 2673360 - RNA, 15 nt, Human
cccuugcuggcccca

SEQ ID NO: 2673361 - RNA, 16 nt, Human
cccuugcuggccccag

SEQ ID NO: 2673362 - RNA, 20 nt, Human
cccuugcuggccccagcccu

SEQ ID NO: 2673363 - RNA, 21 nt, Human
cccuugcuggccccagcccug

SEQ ID NO: 2673364 - RNA, 23 nt, Human
cccuugcuggccccagcccugcu

SEQ ID NO: 2673365 - RNA, 24 nt, Human
cccuugcuggccccagcccugcug

SEQ ID NO: 2673366 - RNA, 12 nt, Human
cccuugccuccc

SEQ ID NO: 2673367 - RNA, 20 nt, Human
cccuugccuccccauuuccc

SEQ ID NO: 2673368 - RNA, 23 nt, Human
cccuugccuccccauuucccauc

SEQ ID NO: 2673369 - RNA, 13 nt, Human
cccuugccucccc

SEQ ID NO: 2673370 - RNA, 15 nt, Human
cccuugccuccccau

SEQ ID NO: 2673371 - RNA, 18 nt, Human
cccuugccuccccauuuc

SEQ ID NO: 2673372 - RNA, 19 nt, Human
cccuugccuccccauuucc

SEQ ID NO: 2673373 - RNA, 17 nt, Human
cccuugagggcugcagu

SEQ ID NO: 2673374 - RNA, 13 nt, Human
cccuuauaaaauc

SEQ ID NO: 2673375 - RNA, 21 nt, Human
cccuuacuggcuuaccuccuc

SEQ ID NO: 2673376 - RNA, 13 nt, Human
cccuuccagauca

SEQ ID NO: 2673377 - RNA, 20 nt, Human
cccuuccagaucacugccac

SEQ ID NO: 2673378 - RNA, 21 nt, Human
cccuguagagugggagcugag

SEQ ID NO: 2673379 - RNA, 13 nt, Human
cccugggcuggaa

SEQ ID NO: 2673380 - RNA, 14 nt, Human
cccugggcuggaau

SEQ ID NO: 2673381 - RNA, 17 nt, Human
cccugggcuuggccugc

SEQ ID NO: 2673382 - RNA, 22 nt, Human
cccugggcuuggccugcuguga

SEQ ID NO: 2673383 - RNA, 18 nt, Human
cccugggcuuggccugcu

SEQ ID NO: 2673384 - RNA, 19 nt, Human
cccugggcuuggccugcug

SEQ ID NO: 2673385 - RNA, 20 nt, Human
cccugggcuuggccugcugu

SEQ ID NO: 2673386 - RNA, 21 nt, Human
cccugggcuuggccugcugug

SEQ ID NO: 2673387 - RNA, 16 nt, Human
cccugcuuccaggaaa

SEQ ID NO: 2673388 - RNA, 14 nt, Human
cccugcuuccagga

SEQ ID NO: 2673389 - RNA, 15 nt, Human
cccugcuuccaggaa

SEQ ID NO: 2673390 - RNA, 13 nt, Human
cccugcugcuggu

SEQ ID NO: 2673391 - RNA, 15 nt, Human
cccugcugcuggugc

SEQ ID NO: 2673392 - RNA, 16 nt, Human
cccugcugcuggugca

SEQ ID NO: 2673393 - RNA, 19 nt, Human
cccugcugcuggugcacag

SEQ ID NO: 2673394 - RNA, 18 nt, Human
cccugcgccuuuccuuuu

SEQ ID NO: 2673395 - RNA, 16 nt, Human
cccugcgcucucuuug

SEQ ID NO: 2673396 - RNA, 22 nt, Human
cccugcgcucucuuugcaacug

SEQ ID NO: 2673397 - RNA, 15 nt, Human
cccugcgccuuuccu

SEQ ID NO: 2673398 - RNA, 14 nt, Human
cccugcgccuuucc

SEQ ID NO: 2673399 - RNA, 15 nt, Human
cccugccgucaccac

SEQ ID NO: 2673400 - RNA, 16 nt, Human
cccugccgucaccacc

SEQ ID NO: 2673401 - RNA, 17 nt, Human
cccugccgucaccacca

SEQ ID NO: 2673402 - RNA, 19 nt, Human
cccugccgucaccaccacc

SEQ ID NO: 2673403 - RNA, 20 nt, Human
cccugccgucaccaccaccc

SEQ ID NO: 2673404 - RNA, 22 nt, Human
cccugccgucaccaccaccccu

SEQ ID NO: 2673405 - RNA, 18 nt, Human
cccugcagaugccacccu

SEQ ID NO: 2673406 - RNA, 15 nt, Human
cccugcagaugccac

SEQ ID NO: 2673407 - RNA, 20 nt, Human
cccugcagaugccacccuag

SEQ ID NO: 2673408 - RNA, 14 nt, Human
ccgacugcuuugga

SEQ ID NO: 2673409 - RNA, 20 nt, Human
ccgacugaaaauauuguuuu

SEQ ID NO: 2673410 - RNA, 10 nt, Human
ccgacuccag

SEQ ID NO: 2673411 - RNA, 11 nt, Human
ccgacuccagc

SEQ ID NO: 2673412 - RNA, 12 nt, Human
ccgacuccagcc

SEQ ID NO: 2673413 - RNA, 13 nt, Human
ccgacuccagcca

SEQ ID NO: 2673414 - RNA, 14 nt, Human
ccgacuccagccag

SEQ ID NO: 2673415 - RNA, 15 nt, Human
ccgacuccagccagc

SEQ ID NO: 2673416 - RNA, 16 nt, Human
ccgacuccagccagcg

SEQ ID NO: 2673417 - RNA, 13 nt, Human
ccgaccuggccgc

SEQ ID NO: 2673418 - RNA, 14 nt, Human
ccgacgucauguau

SEQ ID NO: 2673419 - RNA, 13 nt, Human
ccgacgcccaccc

SEQ ID NO: 2673420 - RNA, 13 nt, Human
ccgagagggagag

SEQ ID NO: 2673421 - RNA, 15 nt, Human
ccgagaggugggcca

SEQ ID NO: 2673422 - RNA, 19 nt, Human
ccgagaggugggccagucu

SEQ ID NO: 2673423 - RNA, 21 nt, Human
ccgagaggugggccagucugu

SEQ ID NO: 2673424 - RNA, 16 nt, Human
ccgacugcuuuggacc

SEQ ID NO: 2673425 - RNA, 19 nt, Human
ccgagauugcaccacugca

SEQ ID NO: 2673426 - RNA, 15 nt, Human
ccgagauugcaccac

SEQ ID NO: 2673427 - RNA, 21 nt, Human
ccgagauugcaccacugcacu

SEQ ID NO: 2673428 - RNA, 17 nt, Human
ccgaguagaaaauguga

SEQ ID NO: 2673429 - RNA, 18 nt, Human
ccgaguagaaaaugugac

SEQ ID NO: 2673430 - RNA, 21 nt, Human
ccgaguagaaaaugugacccu

SEQ ID NO: 2673431 - RNA, 15 nt, Human
ccgcagacaccuugg

SEQ ID NO: 2673432 - RNA, 16 nt, Human
ccgcagacaccuugga

SEQ ID NO: 2673433 - RNA, 14 nt, Human
ccgcagacaccuug

SEQ ID NO: 2673434 - RNA, 13 nt, Human
ccgaggacccagg

SEQ ID NO: 2673435 - RNA, 17 nt, Human
ccgaggacccaggaaag

SEQ ID NO: 2673436 - RNA, 19 nt, Human
ccgagcuuugaaaauucag

SEQ ID NO: 2673437 - RNA, 17 nt, Human
ccggcucuacgggggcc

SEQ ID NO: 2673438 - RNA, 15 nt, Human
ccggcucccagccuc

SEQ ID NO: 2673439 - RNA, 14 nt, Human
ccggcucccagccu

SEQ ID NO: 2673440 - RNA, 13 nt, Human
ccggcucccagcc

SEQ ID NO: 2673441 - RNA, 13 nt, Human
ccggagggcugcg

SEQ ID NO: 2673442 - RNA, 23 nt, Human
ccggagcuggaggauccccucca

SEQ ID NO: 2673443 - RNA, 21 nt, Human
ccgggguggccacagcgccag

SEQ ID NO: 2673444 - RNA, 13 nt, Human
ccgccuggccagg

SEQ ID NO: 2673445 - RNA, 14 nt, Human
ccgccuggccagga

SEQ ID NO: 2673446 - RNA, 15 nt, Human
ccgccuggccaggag

SEQ ID NO: 2673447 - RNA, 16 nt, Human
ccgccuggccaggagc

SEQ ID NO: 2673448 - RNA, 17 nt, Human
ccgccuggccaggagca

SEQ ID NO: 2673449 - RNA, 20 nt, Human
ccgccuggccaggagcaggc

SEQ ID NO: 2673450 - RNA, 21 nt, Human
ccgccuggccaggagcaggca

SEQ ID NO: 2673451 - RNA, 23 nt, Human
ccgccuggccaggagcaggcacg

SEQ ID NO: 2673452 - RNA, 23 nt, Human
ccgccucuccucgguucaagguc

SEQ ID NO: 2673453 - RNA, 23 nt, Human
ccgcugccgugccgccugcacuc

SEQ ID NO: 2673454 - RNA, 14 nt, Human
ccgcugcugugcaa

SEQ ID NO: 2673455 - RNA, 18 nt, Human
ccuaaccccuuccagauc

SEQ ID NO: 2673456 - RNA, 15 nt, Human
ccuaaccccuuccag

SEQ ID NO: 2673457 - RNA, 16 nt, Human
ccuaaccccuuccaga

SEQ ID NO: 2673458 - RNA, 23 nt, Human
ccguggcuguugacgcaccugug

SEQ ID NO: 2673459 - RNA, 14 nt, Human
ccuaaccccuucca

SEQ ID NO: 2673460 - RNA, 17 nt, Human
ccguugcugacuuagaa

SEQ ID NO: 2673461 - RNA, 15 nt, Human
ccguugcugacuuag

SEQ ID NO: 2673462 - RNA, 14 nt, Human
ccguugcugacuua

SEQ ID NO: 2673463 - RNA, 17 nt, Human
ccguuccaccccaagag

SEQ ID NO: 2673464 - RNA, 18 nt, Human
ccguuccaccccaagaga

SEQ ID NO: 2673465 - RNA, 20 nt, Human
ccguuccaccccaagagaac

SEQ ID NO: 2673466 - RNA, 21 nt, Human
ccguuccaccccaagagaacu

SEQ ID NO: 2673467 - RNA, 22 nt, Human
ccguuccaccccaagagaacuc

SEQ ID NO: 2673468 - RNA, 23 nt, Human
ccuacucaagcggguggcucugg

SEQ ID NO: 2673469 - RNA, 23 nt, Human
ccuaggcauuugcugaauacaga

SEQ ID NO: 2673470 - RNA, 18 nt, Human
ccuacucggcucugcagu

SEQ ID NO: 2673471 - RNA, 21 nt, Human
ccuacucuccuugaguguaug

SEQ ID NO: 2673472 - RNA, 20 nt, Human
ccuacucccugcagaugcca

SEQ ID NO: 2673473 - RNA, 21 nt, Human
ccuacaguugaaaaacagcug

SEQ ID NO: 2673474 - RNA, 16 nt, Human
ccuacuagucaccaga

SEQ ID NO: 2673475 - RNA, 13 nt, Human
ccuacucccugca

SEQ ID NO: 2673476 - RNA, 15 nt, Human
ccuacucccugcaga

SEQ ID NO: 2673477 - RNA, 16 nt, Human
ccuaccgacccagggu

SEQ ID NO: 2673478 - RNA, 12 nt, Human
ccccucucacca

SEQ ID NO: 2673479 - RNA, 18 nt, Human
ccccucgcaacuguccac

SEQ ID NO: 2673480 - RNA, 20 nt, Human
ccccuccugaaccgcacagc

SEQ ID NO: 2673481 - RNA, 13 nt, Human
ccccuccuucaga

SEQ ID NO: 2673482 - RNA, 19 nt, Human
ccccuccuaguuugggagg

SEQ ID NO: 2673483 - RNA, 19 nt, Human
ccccuccgcccugccacuc

SEQ ID NO: 2673484 - RNA, 17 nt, Human
ccccuccgcccugccac

SEQ ID NO: 2673485 - RNA, 18 nt, Human
ccccuccgcccugccacu

SEQ ID NO: 2673486 - RNA, 18 nt, Human
ccccucagcucggcucag

SEQ ID NO: 2673487 - RNA, 15 nt, Human
ccccucagcucggcu

SEQ ID NO: 2673488 - RNA, 14 nt, Human
ccccucagcucggc

SEQ ID NO: 2673489 - RNA, 16 nt, Human
ccccuccgcccugcca

SEQ ID NO: 2673490 - RNA, 12 nt, Human
ccccucccaccc

SEQ ID NO: 2673491 - RNA, 17 nt, Human
ccccucccacccccagc

SEQ ID NO: 2673492 - RNA, 21 nt, Human
ccccucccacacccaaagcug

SEQ ID NO: 2673493 - RNA, 16 nt, Human
ccccggggacccugug

SEQ ID NO: 2673494 - RNA, 22 nt, Human
ccccggggugaguccauucucc

SEQ ID NO: 2673495 - RNA, 17 nt, Human
ccccggggacccuguga

SEQ ID NO: 2673496 - RNA, 17 nt, Human
ccccggcuuccuuuccc

SEQ ID NO: 2673497 - RNA, 18 nt, Human
ccccgguggcggccccag

SEQ ID NO: 2673498 - RNA, 20 nt, Human
ccccgguggcggccccagca

SEQ ID NO: 2673499 - RNA, 21 nt, Human
ccccuagccgguuccuguccc

SEQ ID NO: 2673500 - RNA, 19 nt, Human
ccccuagccgguuccuguc

SEQ ID NO: 2673501 - RNA, 17 nt, Human
ccccuagccgguuccug

SEQ ID NO: 2673502 - RNA, 15 nt, Human
ccccucaacaccucu

SEQ ID NO: 2673503 - RNA, 16 nt, Human
ccccucaacaccucug

SEQ ID NO: 2673504 - RNA, 17 nt, Human
cccccguggggcaggga

SEQ ID NO: 2673505 - RNA, 16 nt, Human
cccccucccaccccca

SEQ ID NO: 2673506 - RNA, 19 nt, Human
cccccuccgcccugccacu

SEQ ID NO: 2673507 - RNA, 20 nt, Human
cccccaccgguccagcuggc

SEQ ID NO: 2673508 - RNA, 21 nt, Human
cccccaccgguccagcuggcc

SEQ ID NO: 2673509 - RNA, 16 nt, Human
cccccaccgguccagc

SEQ ID NO: 2673510 - RNA, 18 nt, Human
cccccaccgguccagcug

SEQ ID NO: 2673511 - RNA, 19 nt, Human
cccccaccgguccagcugg

SEQ ID NO: 2673512 - RNA, 20 nt, Human
cccccaccccggggacccug

SEQ ID NO: 2673513 - RNA, 22 nt, Human
cccccacuugccucuuccuuga

SEQ ID NO: 2673514 - RNA, 21 nt, Human
ccccaguuccucccaggaagc

SEQ ID NO: 2673515 - RNA, 15 nt, Human
ccccaggcucgugga

SEQ ID NO: 2673516 - RNA, 18 nt, Human
ccccaggcucguggacug

SEQ ID NO: 2673517 - RNA, 19 nt, Human
ccccaguccccaccccugc

SEQ ID NO: 2673518 - RNA, 18 nt, Human
ccccaguccccaccccug

SEQ ID NO: 2673519 - RNA, 12 nt, Human
ccccuggccucu

SEQ ID NO: 2673520 - RNA, 13 nt, Human
ccccugcuucagu

SEQ ID NO: 2673521 - RNA, 16 nt, Human
ccccugcuucaguccc

SEQ ID NO: 2673522 - RNA, 13 nt, Human
ccccugcccugca

SEQ ID NO: 2673523 - RNA, 14 nt, Human
ccccugcccugcac

SEQ ID NO: 2673524 - RNA, 12 nt, Human
ccccugcccugc

SEQ ID NO: 2673525 - RNA, 17 nt, Human
ccccucugcacccagaa

SEQ ID NO: 2673526 - RNA, 18 nt, Human
ccccucugcacccagaac

SEQ ID NO: 2673527 - RNA, 19 nt, Human
ccccucugcacccagaaca

SEQ ID NO: 2673528 - RNA, 13 nt, Human
cccgcagagcgcg

SEQ ID NO: 2673529 - RNA, 16 nt, Human
cccgcagcccuggcag

SEQ ID NO: 2673530 - RNA, 22 nt, Human
cccgcagagcgcgccccuagcc

SEQ ID NO: 2673531 - RNA, 13 nt, Human
cccgcagcccugg

SEQ ID NO: 2673532 - RNA, 15 nt, Human
cccgcagacaccuug

SEQ ID NO: 2673533 - RNA, 16 nt, Human
cccgcagacaccuugg

SEQ ID NO: 2673534 - RNA, 12 nt, Human
cccgacauggcu

SEQ ID NO: 2673535 - RNA, 15 nt, Human
cccgacuccagccag

SEQ ID NO: 2673536 - RNA, 16 nt, Human
cccgacuccagccagc

SEQ ID NO: 2673537 - RNA, 17 nt, Human
cccgacuccagccagcg

SEQ ID NO: 2673538 - RNA, 20 nt, Human
cccgacuccagccagcgccu

SEQ ID NO: 2673539 - RNA, 23 nt, Human
ccccugucuccuuauucggcagc

SEQ ID NO: 2673540 - RNA, 15 nt, Human
ccccuggucuuugag

SEQ ID NO: 2673541 - RNA, 14 nt, Human
ccccuggccucugu

SEQ ID NO: 2673542 - RNA, 22 nt, Human
ccccuuccagaucacugccaca

SEQ ID NO: 2673543 - RNA, 23 nt, Human
cccaugacaauguuguagugucc

SEQ ID NO: 2673544 - RNA, 16 nt, Human
cccaugcaagcagagg

SEQ ID NO: 2673545 - RNA, 17 nt, Human
cccaugcaagcagagga

SEQ ID NO: 2673546 - RNA, 18 nt, Human
cccaugcaagcagaggac

SEQ ID NO: 2673547 - RNA, 21 nt, Human
cccaugcaagcagaggaccag

SEQ ID NO: 2673548 - RNA, 20 nt, Human
cccaugcuuacgugauccuc

SEQ ID NO: 2673549 - RNA, 19 nt, Human
cccagagacuuuguagauc

SEQ ID NO: 2673550 - RNA, 21 nt, Human
cccagagacuuuguagauccu

SEQ ID NO: 2673551 - RNA, 11 nt, Human
cccagagacuu

SEQ ID NO: 2673552 - RNA, 16 nt, Human
cccaucuccccucagc

SEQ ID NO: 2673553 - RNA, 12 nt, Human
cccaucucccug

SEQ ID NO: 2673554 - RNA, 19 nt, Human
cccaucucuacaaaaagca

SEQ ID NO: 2673555 - RNA, 14 nt, Human
cccaucucccugcc

SEQ ID NO: 2673556 - RNA, 15 nt, Human
cccaucucccugccu

SEQ ID NO: 2673557 - RNA, 17 nt, Human
cccaucucccugccugg

SEQ ID NO: 2673558 - RNA, 18 nt, Human
cccaucucccugccuggc

SEQ ID NO: 2673559 - RNA, 20 nt, Human
cccaucucccugccuggccc

SEQ ID NO: 2673560 - RNA, 19 nt, Human
cccaucugcaccccuucuc

SEQ ID NO: 2673561 - RNA, 18 nt, Human
cccaucugccccacaguc

SEQ ID NO: 2673562 - RNA, 20 nt, Human
cccaucugccccacagucuc

SEQ ID NO: 2673563 - RNA, 13 nt, Human
cccaucugcaccc

SEQ ID NO: 2673564 - RNA, 12 nt, Human
ccccacccuggg

SEQ ID NO: 2673565 - RNA, 14 nt, Human
ccccacccugggcc

SEQ ID NO: 2673566 - RNA, 15 nt, Human
ccccacccugggccc

SEQ ID NO: 2673567 - RNA, 20 nt, Human
ccccacccugggcccugggc

SEQ ID NO: 2673568 - RNA, 12 nt, Human
cccauuccaggc

SEQ ID NO: 2673569 - RNA, 20 nt, Human
cccauuccaggcagccucug

SEQ ID NO: 2673570 - RNA, 18 nt, Human
cccaugacaauguuguag

SEQ ID NO: 2673571 - RNA, 19 nt, Human
ccccacucccuugcuggcc

SEQ ID NO: 2673572 - RNA, 21 nt, Human
ccccacucccuugcuggcccc

SEQ ID NO: 2673573 - RNA, 23 nt, Human
ccccacucccuugcuggccccag

SEQ ID NO: 2673574 - RNA, 13 nt, Human
ccccacuugccuc

SEQ ID NO: 2673575 - RNA, 14 nt, Human
ccccacuugccucu

SEQ ID NO: 2673576 - RNA, 15 nt, Human
ccccacuugccucuu

SEQ ID NO: 2673577 - RNA, 16 nt, Human
ccccacuugccucuuc

SEQ ID NO: 2673578 - RNA, 21 nt, Human
ccccacuugccucuuccuuga

SEQ ID NO: 2673579 - RNA, 17 nt, Human
ccccaccgguccagcug

SEQ ID NO: 2673580 - RNA, 18 nt, Human
ccccaccgguccagcugg

SEQ ID NO: 2673581 - RNA, 19 nt, Human
ccccaccgguccagcuggc

SEQ ID NO: 2673582 - RNA, 21 nt, Human
ccccaccgguccagcuggccu

SEQ ID NO: 2673583 - RNA, 22 nt, Human
ccccaccgguccagcuggccug

SEQ ID NO: 2673584 - RNA, 17 nt, Human
cucauuuguuaaaauua

SEQ ID NO: 2673585 - RNA, 13 nt, Human
cucauuucaucuc

SEQ ID NO: 2673586 - RNA, 15 nt, Human
cucauuucaucucau

SEQ ID NO: 2673587 - RNA, 16 nt, Human
cucauuucaucucauu

SEQ ID NO: 2673588 - RNA, 18 nt, Human
cucauuucaucucauuua

SEQ ID NO: 2673589 - RNA, 18 nt, Human
cuccaaacugaagcagcc

SEQ ID NO: 2673590 - RNA, 22 nt, Human
cuccaaacugaagcagccucuc

SEQ ID NO: 2673591 - RNA, 16 nt, Human
cucauugcugagccuc

SEQ ID NO: 2673592 - RNA, 15 nt, Human
cucauugcugagccu

SEQ ID NO: 2673593 - RNA, 12 nt, Human
cucauugacuuu

SEQ ID NO: 2673594 - RNA, 14 nt, Human
cucauugacuuuua

SEQ ID NO: 2673595 - RNA, 21 nt, Human
cucauugacuuuuauaaagca

SEQ ID NO: 2673596 - RNA, 22 nt, Human
cucauugacuuuuauaaagcau

SEQ ID NO: 2673597 - RNA, 11 nt, Human
cuccaccccag

SEQ ID NO: 2673598 - RNA, 12 nt, Human
cuccaccccagg

SEQ ID NO: 2673599 - RNA, 13 nt, Human
cuccaccccagga

SEQ ID NO: 2673600 - RNA, 14 nt, Human
cuccaccccaggac

SEQ ID NO: 2673601 - RNA, 22 nt, Human
cuccaccccaggacgccacuca

SEQ ID NO: 2673602 - RNA, 20 nt, Human
cuccaccagcaucaccugcc

SEQ ID NO: 2673603 - RNA, 22 nt, Human
cuccaccagcaucaccugccug

SEQ ID NO: 2673604 - RNA, 23 nt, Human
cuccaccagcaucaccugccugu

SEQ ID NO: 2673605 - RNA, 17 nt, Human
cuccagauguuuccaga

SEQ ID NO: 2673606 - RNA, 19 nt, Human
cuccagauguuuccagacu

SEQ ID NO: 2673607 - RNA, 16 nt, Human
cuccagccccgcgacc

SEQ ID NO: 2673608 - RNA, 16 nt, Human
cuccagcaacacagcc

SEQ ID NO: 2673609 - RNA, 11 nt, Human
cuccccugagg

SEQ ID NO: 2673610 - RNA, 12 nt, Human
cuccccugagga

SEQ ID NO: 2673611 - RNA, 12 nt, Human
cuccccugccac

SEQ ID NO: 2673612 - RNA, 13 nt, Human
cuccccugccacc

SEQ ID NO: 2673613 - RNA, 18 nt, Human
cuccccugccaccaggcc

SEQ ID NO: 2673614 - RNA, 23 nt, Human
cuccccugccaccaggccaccuc

SEQ ID NO: 2673615 - RNA, 21 nt, Human
cuccccagcauuccagccccu

SEQ ID NO: 2673616 - RNA, 22 nt, Human
cuccccagcauuccagccccuc

SEQ ID NO: 2673617 - RNA, 23 nt, Human
cuccccagcauuccagccccucu

SEQ ID NO: 2673618 - RNA, 13 nt, Human
cucccugccuggc

SEQ ID NO: 2673619 - RNA, 15 nt, Human
cucccugccuggccc

SEQ ID NO: 2673620 - RNA, 16 nt, Human
cucccugccuggcccc

SEQ ID NO: 2673621 - RNA, 18 nt, Human
cucccugccuggccccca

SEQ ID NO: 2673622 - RNA, 18 nt, Human
cucccgagaccgggcccu

SEQ ID NO: 2673623 - RNA, 23 nt, Human
cucccgagaccgggcccuggguu

SEQ ID NO: 2673624 - RNA, 15 nt, Human
cucccacaaaggaga

SEQ ID NO: 2673625 - RNA, 22 nt, Human
cuccauuugagaaaauaaagcu

SEQ ID NO: 2673626 - RNA, 13 nt, Human
cuccauuugcucu

SEQ ID NO: 2673627 - RNA, 15 nt, Human
cuccauuugcucuuc

SEQ ID NO: 2673628 - RNA, 17 nt, Human
cuccauuugcucuucag

SEQ ID NO: 2673629 - RNA, 18 nt, Human
cuccauuugcucuucaga

SEQ ID NO: 2673630 - RNA, 18 nt, Human
cucccacacccaaagcug

SEQ ID NO: 2673631 - RNA, 21 nt, Human
cucccacacccaaagcugagc

SEQ ID NO: 2673632 - RNA, 22 nt, Human
cucccacacccaaagcugagcc

SEQ ID NO: 2673633 - RNA, 15 nt, Human
cuccccaccuccagg

SEQ ID NO: 2673634 - RNA, 16 nt, Human
cuccccaccuccaggc

SEQ ID NO: 2673635 - RNA, 19 nt, Human
cucaggaggcgcccuuggc

SEQ ID NO: 2673636 - RNA, 18 nt, Human
cucaggcaggugggaugg

SEQ ID NO: 2673637 - RNA, 20 nt, Human
cucaggaggcgcccuuggcu

SEQ ID NO: 2673638 - RNA, 15 nt, Human
cucaggcagguggga

SEQ ID NO: 2673639 - RNA, 19 nt, Human
cucagggccaugcugaggc

SEQ ID NO: 2673640 - RNA, 20 nt, Human
cucagggccaugcugaggcc

SEQ ID NO: 2673641 - RNA, 15 nt, Human
cucagggccaugcug

SEQ ID NO: 2673642 - RNA, 17 nt, Human
cucagggccaugcugag

SEQ ID NO: 2673643 - RNA, 18 nt, Human
cucagggccaugcugagg

SEQ ID NO: 2673644 - RNA, 13 nt, Human
cucagggccaugc

SEQ ID NO: 2673645 - RNA, 14 nt, Human
cucaggugggcccu

SEQ ID NO: 2673646 - RNA, 14 nt, Human
cucagggccugguc

SEQ ID NO: 2673647 - RNA, 15 nt, Human
cucaggguggucucu

SEQ ID NO: 2673648 - RNA, 16 nt, Human
cucaggguggucucuu

SEQ ID NO: 2673649 - RNA, 18 nt, Human
cucagcucggcucagcuc

SEQ ID NO: 2673650 - RNA, 15 nt, Human
cucagcucggggagc

SEQ ID NO: 2673651 - RNA, 18 nt, Human
cucagcucggggagccuu

SEQ ID NO: 2673652 - RNA, 19 nt, Human
cucagcucggggagccuua

SEQ ID NO: 2673653 - RNA, 13 nt, Human
cucagcucggcuc

SEQ ID NO: 2673654 - RNA, 17 nt, Human
cucagcucggcucagcu

SEQ ID NO: 2673655 - RNA, 16 nt, Human
cucagcucggcucagc

SEQ ID NO: 2673656 - RNA, 15 nt, Human
cucagcucggcucag

SEQ ID NO: 2673657 - RNA, 14 nt, Human
cucagcucggcuca

SEQ ID NO: 2673658 - RNA, 22 nt, Human
cucagcuuugagaagccuucag

SEQ ID NO: 2673659 - RNA, 13 nt, Human
cucagcuuugaga

SEQ ID NO: 2673660 - RNA, 16 nt, Human
cucagcuuugagaagc

SEQ ID NO: 2673661 - RNA, 21 nt, Human
cucagcuuugagaagccuuca

SEQ ID NO: 2673662 - RNA, 12 nt, Human
cucagcuuugag

SEQ ID NO: 2673663 - RNA, 15 nt, Human
cucagagcucucucu

SEQ ID NO: 2673664 - RNA, 18 nt, Human
cucacuggggccuacagc

SEQ ID NO: 2673665 - RNA, 16 nt, Human
cucacuggggccuaca

SEQ ID NO: 2673666 - RNA, 13 nt, Human
cucacuggggccu

SEQ ID NO: 2673667 - RNA, 10 nt, Human
cucacuguga

SEQ ID NO: 2673668 - RNA, 12 nt, Human
cucacugugauc

SEQ ID NO: 2673669 - RNA, 22 nt, Human
cucacugugaucaauauuuuua

SEQ ID NO: 2673670 - RNA, 11 nt, Human
cucacugccag

SEQ ID NO: 2673671 - RNA, 12 nt, Human
cucacagaguca

SEQ ID NO: 2673672 - RNA, 13 nt, Human
cucacagagucaa

SEQ ID NO: 2673673 - RNA, 17 nt, Human
cucacagagucaaggcc

SEQ ID NO: 2673674 - RNA, 19 nt, Human
cucacagagucaaggccug

SEQ ID NO: 2673675 - RNA, 20 nt, Human
cucacagagucaaggccugc

SEQ ID NO: 2673676 - RNA, 22 nt, Human
cucacagagucaaggccugcuc

SEQ ID NO: 2673677 - RNA, 14 nt, Human
cucagcucaaugca

SEQ ID NO: 2673678 - RNA, 18 nt, Human
cucagcccccugcuucag

SEQ ID NO: 2673679 - RNA, 20 nt, Human
cucagcaucaaaauauuuca

SEQ ID NO: 2673680 - RNA, 21 nt, Human
cucagcaaaagaugcuucuca

SEQ ID NO: 2673681 - RNA, 20 nt, Human
cucagcaaaagaugcuucuc

SEQ ID NO: 2673682 - RNA, 19 nt, Human
cucagcaaaagaugcuucu

SEQ ID NO: 2673683 - RNA, 20 nt, Human
cuauuuauuaauauuuaaca

SEQ ID NO: 2673684 - RNA, 17 nt, Human
cuauuuauuaauauuua

SEQ ID NO: 2673685 - RNA, 19 nt, Human
cuauuuauugacucugggu

SEQ ID NO: 2673686 - RNA, 15 nt, Human
cuauuuauuaauauu

SEQ ID NO: 2673687 - RNA, 14 nt, Human
cuauuuauuaauau

SEQ ID NO: 2673688 - RNA, 13 nt, Human
cuauuuauuaaua

SEQ ID NO: 2673689 - RNA, 10 nt, Human
cuauuuaaga

SEQ ID NO: 2673690 - RNA, 11 nt, Human
cuauuuaagau

SEQ ID NO: 2673691 - RNA, 14 nt, Human
cuauuuaagaugug

SEQ ID NO: 2673692 - RNA, 15 nt, Human
cuauuuaagauguga

SEQ ID NO: 2673693 - RNA, 21 nt, Human
cuauuuaaaaaaaaagucaga

SEQ ID NO: 2673694 - RNA, 16 nt, Human
cuauugcugcuugagg

SEQ ID NO: 2673695 - RNA, 14 nt, Human
cuauugcuucacca

SEQ ID NO: 2673696 - RNA, 21 nt, Human
cuauugcuucaccauggccuu

SEQ ID NO: 2673697 - RNA, 15 nt, Human
cuauugccaaccagu

SEQ ID NO: 2673698 - RNA, 21 nt, Human
cuauuuauuaauauuuaacau

SEQ ID NO: 2673699 - RNA, 13 nt, Human
cuauuuauuuucc

SEQ ID NO: 2673700 - RNA, 16 nt, Human
cuauuuauuuuccuaa

SEQ ID NO: 2673701 - RNA, 17 nt, Human
cuauuuauuuuccuaaa

SEQ ID NO: 2673702 - RNA, 21 nt, Human
cuauuuauuuuccuaaagaga

SEQ ID NO: 2673703 - RNA, 18 nt, Human
cuauuuauuuuccuaaag

SEQ ID NO: 2673704 - RNA, 19 nt, Human
cuauuuauuuuccuaaaga

SEQ ID NO: 2673705 - RNA, 14 nt, Human
cuauuugaacaagu

SEQ ID NO: 2673706 - RNA, 23 nt, Human
cucacacggacacucaaaagcug

SEQ ID NO: 2673707 - RNA, 18 nt, Human
cucacacuccccuagggg

SEQ ID NO: 2673708 - RNA, 21 nt, Human
cucacacugguucucaaugaa

SEQ ID NO: 2673709 - RNA, 23 nt, Human
cucacacugguucucaaugaaaa

SEQ ID NO: 2673710 - RNA, 14 nt, Human
cuaggaaacucaca

SEQ ID NO: 2673711 - RNA, 14 nt, Human
cuauauaauuuauu

SEQ ID NO: 2673712 - RNA, 16 nt, Human
cuauauaauuuauuuc

SEQ ID NO: 2673713 - RNA, 20 nt, Human
cuauauaauuuauuuccacu

SEQ ID NO: 2673714 - RNA, 19 nt, Human
cuauauaagacaagaacuc

SEQ ID NO: 2673715 - RNA, 15 nt, Human
cuauagcuugcagaa

SEQ ID NO: 2673716 - RNA, 21 nt, Human
cuauagcuugcagaacuguag

SEQ ID NO: 2673717 - RNA, 14 nt, Human
cuaugcaaaaagcu

SEQ ID NO: 2673718 - RNA, 17 nt, Human
cuauugauuuaagcuuu

SEQ ID NO: 2673719 - RNA, 17 nt, Human
cuauucugagaaaacaa

SEQ ID NO: 2673720 - RNA, 15 nt, Human
cuauucugagaaaac

SEQ ID NO: 2673721 - RNA, 16 nt, Human
cuauucugagaaaaca

SEQ ID NO: 2673722 - RNA, 16 nt, Human
cuauuauuuuuauaau

SEQ ID NO: 2673723 - RNA, 18 nt, Human
cuauuauuuuuauaauug

SEQ ID NO: 2673724 - RNA, 19 nt, Human
cuauuauuuuuauaauugu

SEQ ID NO: 2673725 - RNA, 15 nt, Human
cuauuauggaaaacu

SEQ ID NO: 2673726 - RNA, 16 nt, Human
cuauuauggaaaacug

SEQ ID NO: 2673727 - RNA, 17 nt, Human
cuauuauggaaaacugu

SEQ ID NO: 2673728 - RNA, 18 nt, Human
cuauuauggaaaacugug

SEQ ID NO: 2673729 - RNA, 19 nt, Human
cuauuaguguuauaugaac

SEQ ID NO: 2673730 - RNA, 18 nt, Human
cuauuaguguuauaugaa

SEQ ID NO: 2673731 - RNA, 17 nt, Human
cuauuaguguuauauga

SEQ ID NO: 2673732 - RNA, 13 nt, Human
cuauguauaaaau

SEQ ID NO: 2673733 - RNA, 15 nt, Human
cuauguauaaaauac

SEQ ID NO: 2673734 - RNA, 17 nt, Human
cuauguauaaaauacau

SEQ ID NO: 2673735 - RNA, 18 nt, Human
cuauguauaaaauacaua

SEQ ID NO: 2673736 - RNA, 24 nt, Human
cuauguauaaaauacauagugaaa

SEQ ID NO: 2673737 - RNA, 15 nt, Human
cuaccgacccagggu

SEQ ID NO: 2673738 - RNA, 21 nt, Human
cuaccgacccaggguucccgc

SEQ ID NO: 2673739 - RNA, 22 nt, Human
cuacucccugcagaugccaccc

SEQ ID NO: 2673740 - RNA, 17 nt, Human
cuacucccugcagaugc

SEQ ID NO: 2673741 - RNA, 18 nt, Human
cuacucccugcagaugcc

SEQ ID NO: 2673742 - RNA, 13 nt, Human
cuacucccugcag

SEQ ID NO: 2673743 - RNA, 14 nt, Human
cuacucccugcaga

SEQ ID NO: 2673744 - RNA, 17 nt, Human
cuacugcacuccagccu

SEQ ID NO: 2673745 - RNA, 18 nt, Human
cuacugcacuccagccug

SEQ ID NO: 2673746 - RNA, 19 nt, Human
cuacugcacuccagccugg

SEQ ID NO: 2673747 - RNA, 20 nt, Human
cuacugcacuccagccuggg

SEQ ID NO: 2673748 - RNA, 21 nt, Human
cuacugcacuccagccugggg

SEQ ID NO: 2673749 - RNA, 23 nt, Human
cuacugcacuccagccuggggga

SEQ ID NO: 2673750 - RNA, 21 nt, Human
cuacucucacacugguucuca

SEQ ID NO: 2673751 - RNA, 23 nt, Human
cuacucucacacugguucucaau

SEQ ID NO: 2673752 - RNA, 16 nt, Human
cuacugcauuuaggga

SEQ ID NO: 2673753 - RNA, 19 nt, Human
cuacugcauuuagggagua

SEQ ID NO: 2673754 - RNA, 17 nt, Human
cuacugcauuuagggag

SEQ ID NO: 2673755 - RNA, 20 nt, Human
cuagaggcccuuugcugucc

SEQ ID NO: 2673756 - RNA, 22 nt, Human
cuacuguuguaagaauucugau

SEQ ID NO: 2673757 - RNA, 17 nt, Human
cuacugucaaaugaugu

SEQ ID NO: 2673758 - RNA, 18 nt, Human
cuacugucaaaugaugug

SEQ ID NO: 2673759 - RNA, 20 nt, Human
cuacugucaaaugaugugca

SEQ ID NO: 2673760 - RNA, 21 nt, Human
cuacugucaaaugaugugcaa

SEQ ID NO: 2673761 - RNA, 17 nt, Human
cuacuuuguggcaaucu

SEQ ID NO: 2673762 - RNA, 20 nt, Human
cuacuuuguuaggauuuuca

SEQ ID NO: 2673763 - RNA, 17 nt, Human
cuacuuuugcaugaaaa

SEQ ID NO: 2673764 - RNA, 18 nt, Human
cuacuuuugcaugaaaau

SEQ ID NO: 2673765 - RNA, 13 nt, Human
cuagacucggggu

SEQ ID NO: 2673766 - RNA, 22 nt, Human
cuagacucggggugcuuccuug

SEQ ID NO: 2673767 - RNA, 16 nt, Human
cuagacucggggugcu

SEQ ID NO: 2673768 - RNA, 15 nt, Human
cuagcuccuccccuu

SEQ ID NO: 2673769 - RNA, 12 nt, Human
cuagcuagcuca

SEQ ID NO: 2673770 - RNA, 16 nt, Human
cuagcuagcucaacua

SEQ ID NO: 2673771 - RNA, 13 nt, Human
cuagcuucugcuu

SEQ ID NO: 2673772 - RNA, 14 nt, Human
cuagcuucugcuuu

SEQ ID NO: 2673773 - RNA, 15 nt, Human
cuagcuucugcuuuu

SEQ ID NO: 2673774 - RNA, 16 nt, Human
cuagcuucugcuuuuc

SEQ ID NO: 2673775 - RNA, 18 nt, Human
cuagcuucugcuuuucug

SEQ ID NO: 2673776 - RNA, 21 nt, Human
cuagcuucugcuuuucugccc

SEQ ID NO: 2673777 - RNA, 22 nt, Human
cuagcuucugcuuuucugcccu

SEQ ID NO: 2673778 - RNA, 20 nt, Human
cuagcuugggaggcuucccc

SEQ ID NO: 2673779 - RNA, 23 nt, Human
cuagcuucugcuuuucugcccug

SEQ ID NO: 2673780 - RNA, 15 nt, Human
cuagcuuuagacccu

SEQ ID NO: 2673781 - RNA, 19 nt, Human
cuagcuuuagacccugggu

SEQ ID NO: 2673782 - RNA, 18 nt, Human
cuagcuuuagacccuggg

SEQ ID NO: 2673783 - RNA, 14 nt, Human
cuagauaucgacuu

SEQ ID NO: 2673784 - RNA, 18 nt, Human
cuagaguuuuauagccug

SEQ ID NO: 2673785 - RNA, 16 nt, Human
cuagauaggaggaugg

SEQ ID NO: 2673786 - RNA, 21 nt, Human
cuagauaucgacuuguuuuug

SEQ ID NO: 2673787 - RNA, 16 nt, Human
cuagcgaucucuccug

SEQ ID NO: 2673788 - RNA, 17 nt, Human
cuagcgaucucuccugg

SEQ ID NO: 2673789 - RNA, 18 nt, Human
cuagcgaucucuccuggc

SEQ ID NO: 2673790 - RNA, 19 nt, Human
cuagcgaucucuccuggcc

SEQ ID NO: 2673791 - RNA, 20 nt, Human
cuagcgaucucuccuggccu

SEQ ID NO: 2673792 - RNA, 14 nt, Human
cuagcuaauuauuu

SEQ ID NO: 2673793 - RNA, 15 nt, Human
cuagcuaauuauuua

SEQ ID NO: 2673794 - RNA, 16 nt, Human
cuagcuaauuauuuaa

SEQ ID NO: 2673795 - RNA, 17 nt, Human
cuaauauauaugaauaa

SEQ ID NO: 2673796 - RNA, 15 nt, Human
cuaauauauaugaau

SEQ ID NO: 2673797 - RNA, 18 nt, Human
cuaauauauaugaauaaa

SEQ ID NO: 2673798 - RNA, 13 nt, Human
cuaauauauauga

SEQ ID NO: 2673799 - RNA, 18 nt, Human
cuaauagugaucaagaag

SEQ ID NO: 2673800 - RNA, 23 nt, Human
cuaauagugaucaagaagacuuu

SEQ ID NO: 2673801 - RNA, 15 nt, Human
cuaauaaucuuguuu

SEQ ID NO: 2673802 - RNA, 19 nt, Human
cuaauaaucuuguuucuga

SEQ ID NO: 2673803 - RNA, 20 nt, Human
cuaauaaucuuguuucugaa

SEQ ID NO: 2673804 - RNA, 21 nt, Human
cuaauaaucuuguuucugaaa

SEQ ID NO: 2673805 - RNA, 22 nt, Human
cuaauaagcuaguugaauacuu

SEQ ID NO: 2673806 - RNA, 17 nt, Human
cuaauaagcuaguugaa

SEQ ID NO: 2673807 - RNA, 11 nt, Human
cuaaggaccuu

SEQ ID NO: 2673808 - RNA, 23 nt, Human
cuaaggccauggcaucccuuuuu

SEQ ID NO: 2673809 - RNA, 15 nt, Human
cuacaccuugccuug

SEQ ID NO: 2673810 - RNA, 13 nt, Human
cuacaccuggcug

SEQ ID NO: 2673811 - RNA, 15 nt, Human
cuacaccuggcugag

SEQ ID NO: 2673812 - RNA, 12 nt, Human
cuacaccuggcu

SEQ ID NO: 2673813 - RNA, 16 nt, Human
cuaauuauacuacuuu

SEQ ID NO: 2673814 - RNA, 18 nt, Human
cuaauuauacuacuuugu

SEQ ID NO: 2673815 - RNA, 21 nt, Human
cuaauuauacuacuuuguuag

SEQ ID NO: 2673816 - RNA, 14 nt, Human
cuaauuauuuaauu

SEQ ID NO: 2673817 - RNA, 18 nt, Human
cuaauuauuuaauugucc

SEQ ID NO: 2673818 - RNA, 23 nt, Human
cguuuuaaggacugacugaggca

SEQ ID NO: 2673819 - RNA, 16 nt, Human
cguuuuaaggacugac

SEQ ID NO: 2673820 - RNA, 13 nt, Human
cguuuuaaggacu

SEQ ID NO: 2673821 - RNA, 13 nt, Human
cuaaaaaguauaa

SEQ ID NO: 2673822 - RNA, 15 nt, Human
cuaaaaaguauaaaa

SEQ ID NO: 2673823 - RNA, 16 nt, Human
cuaaaaaguauaaaau

SEQ ID NO: 2673824 - RNA, 17 nt, Human
cuaaaaaguauaaaaua

SEQ ID NO: 2673825 - RNA, 14 nt, Human
cgggacagaguagc

SEQ ID NO: 2673826 - RNA, 19 nt, Human
cgggacaucacaggguggg

SEQ ID NO: 2673827 - RNA, 21 nt, Human
cgggacaucacagggugggcc

SEQ ID NO: 2673828 - RNA, 22 nt, Human
cgggacaucacagggugggccu

SEQ ID NO: 2673829 - RNA, 23 nt, Human
cgggacaucacagggugggccuc

SEQ ID NO: 2673830 - RNA, 16 nt, Human
cgggaccacccugagc

SEQ ID NO: 2673831 - RNA, 17 nt, Human
cgggaccacccugagcc

SEQ ID NO: 2673832 - RNA, 18 nt, Human
cgggaccacccugagccg

SEQ ID NO: 2673833 - RNA, 14 nt, Human
cgggacccagggcc

SEQ ID NO: 2673834 - RNA, 22 nt, Human
cgggacccagggcccucggugg

SEQ ID NO: 2673835 - RNA, 18 nt, Human
cguuuggugcuucucaga

SEQ ID NO: 2673836 - RNA, 12 nt, Human
cuaaaaucauga

SEQ ID NO: 2673837 - RNA, 13 nt, Human
cuaaaaucaugaa

SEQ ID NO: 2673838 - RNA, 18 nt, Human
cuaaauaagaaaauaaca

SEQ ID NO: 2673839 - RNA, 15 nt, Human
cuaaauaaaauuugu

SEQ ID NO: 2673840 - RNA, 20 nt, Human
cuaaauaaaauuuguugcau

SEQ ID NO: 2673841 - RNA, 17 nt, Human
cuaaccucgcccucucc

SEQ ID NO: 2673842 - RNA, 16 nt, Human
cuaaccucgcccucuc

SEQ ID NO: 2673843 - RNA, 13 nt, Human
cuaaccucgcccu

SEQ ID NO: 2673844 - RNA, 19 nt, Human
cuaaccccuuccagaucac

SEQ ID NO: 2673845 - RNA, 13 nt, Human
cuaaccccuucca

SEQ ID NO: 2673846 - RNA, 14 nt, Human
cuaaccccuuccag

SEQ ID NO: 2673847 - RNA, 19 nt, Human
cuaagagaaguuauuuucu

SEQ ID NO: 2673848 - RNA, 22 nt, Human
cuaagagaaguuauuuucuaca

SEQ ID NO: 2673849 - RNA, 21 nt, Human
cuaagagaaguuguaaaguau

SEQ ID NO: 2673850 - RNA, 19 nt, Human
cuaacauaccguuuauaau

SEQ ID NO: 2673851 - RNA, 20 nt, Human
cuaacagugaaguuuuacug

SEQ ID NO: 2673852 - RNA, 13 nt, Human
cuaccaauauuag

SEQ ID NO: 2673853 - RNA, 20 nt, Human
cuaccaaggucuucuuaaua

SEQ ID NO: 2673854 - RNA, 18 nt, Human
cuaccauccccuguagag

SEQ ID NO: 2673855 - RNA, 13 nt, Human
cuacaugugagug

SEQ ID NO: 2673856 - RNA, 12 nt, Human
cuaccaaaaugg

SEQ ID NO: 2673857 - RNA, 15 nt, Human
cuacccucagugagc

SEQ ID NO: 2673858 - RNA, 17 nt, Human
cuacccucuuagaaaaa

SEQ ID NO: 2673859 - RNA, 17 nt, Human
cuacccuccguuuuucu

SEQ ID NO: 2673860 - RNA, 19 nt, Human
cuacagcuuugaucccuga

SEQ ID NO: 2673861 - RNA, 22 nt, Human
cuacaguauuacucuuacaaga

SEQ ID NO: 2673862 - RNA, 16 nt, Human
cgaagucauuaaacug

SEQ ID NO: 2673863 - RNA, 19 nt, Human
cgaagucauuaaacugguu

SEQ ID NO: 2673864 - RNA, 15 nt, Human
cgaagaguucccuug

SEQ ID NO: 2673865 - RNA, 12 nt, Human
cgaaucucugug

SEQ ID NO: 2673866 - RNA, 16 nt, Human
cgaaucucugugccuu

SEQ ID NO: 2673867 - RNA, 22 nt, Human
cgagaccgggcccuggguuccu

SEQ ID NO: 2673868 - RNA, 17 nt, Human
cgagaccauccuggcua

SEQ ID NO: 2673869 - RNA, 20 nt, Human
cgagaccccggcuuccuuuc

SEQ ID NO: 2673870 - RNA, 19 nt, Human
cgaacauccaaccuuccca

SEQ ID NO: 2673871 - RNA, 15 nt, Human
cgaaauaucaaaguc

SEQ ID NO: 2673872 - RNA, 17 nt, Human
cgaaauaucaaagucau

SEQ ID NO: 2673873 - RNA, 13 nt, Human
ccuugugccuggg

SEQ ID NO: 2673874 - RNA, 14 nt, Human
ccuugugccugggg

SEQ ID NO: 2673875 - RNA, 15 nt, Human
ccuugugccuggggu

SEQ ID NO: 2673876 - RNA, 12 nt, Human
ccuuguggcuuc

SEQ ID NO: 2673877 - RNA, 11 nt, Human
ccuugugccug

SEQ ID NO: 2673878 - RNA, 12 nt, Human
ccuugugccugg

SEQ ID NO: 2673879 - RNA, 11 nt, Human
ccuuugggggu

SEQ ID NO: 2673880 - RNA, 12 nt, Human
ccuuuggggguu

SEQ ID NO: 2673881 - RNA, 14 nt, Human
ccuuugguucuggc

SEQ ID NO: 2673882 - RNA, 20 nt, Human
ccuuugguucuggccagaau

SEQ ID NO: 2673883 - RNA, 15 nt, Human
ccuuugguucuggcc

SEQ ID NO: 2673884 - RNA, 16 nt, Human
ccuuugguuuuuuucu

SEQ ID NO: 2673885 - RNA, 17 nt, Human
ccuuugguccugucccc

SEQ ID NO: 2673886 - RNA, 18 nt, Human
ccuuuguccuuuuucagg

SEQ ID NO: 2673887 - RNA, 15 nt, Human
ccuuuguucccggcu

SEQ ID NO: 2673888 - RNA, 13 nt, Human
ccuuuguucuggg

SEQ ID NO: 2673889 - RNA, 15 nt, Human
ccuuuguucuggggg

SEQ ID NO: 2673890 - RNA, 14 nt, Human
ccuuuguucccggc

SEQ ID NO: 2673891 - RNA, 12 nt, Human
ccuuuuuucaaa

SEQ ID NO: 2673892 - RNA, 14 nt, Human
ccuuuuuucuuuuu

SEQ ID NO: 2673893 - RNA, 16 nt, Human
ccuucgucuuucccau

SEQ ID NO: 2673894 - RNA, 17 nt, Human
ccuucgucuuucccaug

SEQ ID NO: 2673895 - RNA, 17 nt, Human
ccuucucccuagcuccu

SEQ ID NO: 2673896 - RNA, 22 nt, Human
ccuucucccuagcuccuccccu

SEQ ID NO: 2673897 - RNA, 15 nt, Human
ccuucucagaagcac

SEQ ID NO: 2673898 - RNA, 18 nt, Human
ccuucucagaagcacaga

SEQ ID NO: 2673899 - RNA, 15 nt, Human
ccugucccuugaccu

SEQ ID NO: 2673900 - RNA, 21 nt, Human
ccuguggcgccgucuccaggg

SEQ ID NO: 2673901 - RNA, 20 nt, Human
ccuguggaugauaaaacaca

SEQ ID NO: 2673902 - RNA, 13 nt, Human
ccuguggcugucg

SEQ ID NO: 2673903 - RNA, 22 nt, Human
ccuguggcgccgucuccagggg

SEQ ID NO: 2673904 - RNA, 13 nt, Human
ccugucccugcgc

SEQ ID NO: 2673905 - RNA, 23 nt, Human
ccugucccugcgccuuuccuuuu

SEQ ID NO: 2673906 - RNA, 22 nt, Human
ccugugggggguaaucccugcu

SEQ ID NO: 2673907 - RNA, 15 nt, Human
ccuuccagaugguca

SEQ ID NO: 2673908 - RNA, 20 nt, Human
ccuuccagaucacugccaca

SEQ ID NO: 2673909 - RNA, 13 nt, Human
ccuuccagaucac

SEQ ID NO: 2673910 - RNA, 13 nt, Human
ccuuggccugggc

SEQ ID NO: 2673911 - RNA, 13 nt, Human
ccuugagcccugg

SEQ ID NO: 2673912 - RNA, 14 nt, Human
ccuugagcccuggc

SEQ ID NO: 2673913 - RNA, 15 nt, Human
ccuugagcccuggcu

SEQ ID NO: 2673914 - RNA, 16 nt, Human
ccuugagcccuggcug

SEQ ID NO: 2673915 - RNA, 17 nt, Human
ccuugagcccuggcugu

SEQ ID NO: 2673916 - RNA, 22 nt, Human
ccuugagcccuggcuguucugu

SEQ ID NO: 2673917 - RNA, 17 nt, Human
ccuuggcuucugugaug

SEQ ID NO: 2673918 - RNA, 21 nt, Human
ccuugguugucuggcaaggac

SEQ ID NO: 2673919 - RNA, 22 nt, Human
ccuugguugucuggcaaggacu

SEQ ID NO: 2673920 - RNA, 13 nt, Human
cgagagggagaga

SEQ ID NO: 2673921 - RNA, 14 nt, Human
cgagagggagagag

SEQ ID NO: 2673922 - RNA, 16 nt, Human
cgagagggagagagag

SEQ ID NO: 2673923 - RNA, 15 nt, Human
cgaggacccaggaaa

SEQ ID NO: 2673924 - RNA, 23 nt, Human
cgaggccuaccccgcagacaccu

SEQ ID NO: 2673925 - RNA, 17 nt, Human
cgaggccuaccccgcag

SEQ ID NO: 2673926 - RNA, 23 nt, Human
cgaggauuuuaauuuuuuuuagu

SEQ ID NO: 2673927 - RNA, 14 nt, Human
cgaggauuuuaauu

SEQ ID NO: 2673928 - RNA, 23 nt, Human
cgcacuucgggaggucgaggcag

SEQ ID NO: 2673929 - RNA, 21 nt, Human
cgcagagcgcgccccuagccg

SEQ ID NO: 2673930 - RNA, 21 nt, Human
cgcaccggagugucuggaauu

SEQ ID NO: 2673931 - RNA, 15 nt, Human
cggcccugugugcag

SEQ ID NO: 2673932 - RNA, 20 nt, Human
cggccgccccuccucgugaa

SEQ ID NO: 2673933 - RNA, 15 nt, Human
cggccgcuccaccag

SEQ ID NO: 2673934 - RNA, 13 nt, Human
cggccucugccuu

SEQ ID NO: 2673935 - RNA, 17 nt, Human
cggccucugccuuugca

SEQ ID NO: 2673936 - RNA, 14 nt, Human
cggcuggcagccca

SEQ ID NO: 2673937 - RNA, 15 nt, Human
cggauaguugcuauu

SEQ ID NO: 2673938 - RNA, 17 nt, Human
cggauaguugcuauuuu

SEQ ID NO: 2673939 - RNA, 20 nt, Human
cggauaguugcuauuuuugu

SEQ ID NO: 2673940 - RNA, 18 nt, Human
cggagugucuggaauugu

SEQ ID NO: 2673941 - RNA, 19 nt, Human
cggaguguguaugccaaga

SEQ ID NO: 2673942 - RNA, 17 nt, Human
cggaucaggcucccagg

SEQ ID NO: 2673943 - RNA, 16 nt, Human
cggaucaggcucccag

SEQ ID NO: 2673944 - RNA, 16 nt, Human
cggcccguggcuguug

SEQ ID NO: 2673945 - RNA, 19 nt, Human
cggcuuccuuucccaagcc

SEQ ID NO: 2673946 - RNA, 14 nt, Human
cggcuuccuuuccc

SEQ ID NO: 2673947 - RNA, 15 nt, Human
cggcuuccuuuccca

SEQ ID NO: 2673948 - RNA, 16 nt, Human
cgggaacaugcccccu

SEQ ID NO: 2673949 - RNA, 17 nt, Human
cgggaacaugcccccug

SEQ ID NO: 2673950 - RNA, 16 nt, Human
cgggaaccuccccagc

SEQ ID NO: 2673951 - RNA, 22 nt, Human
cgggaaccuccccagccugcgc

SEQ ID NO: 2673952 - RNA, 21 nt, Human
cgggaaccuccccagccugcg

SEQ ID NO: 2673953 - RNA, 20 nt, Human
cgggaaccuccccagccugc

SEQ ID NO: 2673954 - RNA, 19 nt, Human
cgggaaccuccccagccug

SEQ ID NO: 2673955 - RNA, 18 nt, Human
cgggaaccuccccagccu

SEQ ID NO: 2673956 - RNA, 17 nt, Human
cgggaaccuccccagcc

SEQ ID NO: 2673957 - RNA, 23 nt, Human
cggcuggcagcccaccccucaac

SEQ ID NO: 2673958 - RNA, 20 nt, Human
cgcggggcugucggcgcugc

SEQ ID NO: 2673959 - RNA, 13 nt, Human
cgcgguggcucac

SEQ ID NO: 2673960 - RNA, 15 nt, Human
cgcuaaagagcccuu

SEQ ID NO: 2673961 - RNA, 19 nt, Human
cgcuaaagagcccuugccu

SEQ ID NO: 2673962 - RNA, 21 nt, Human
cgcuaaagagcccuugccucc

SEQ ID NO: 2673963 - RNA, 22 nt, Human
cgcuaaagagcccuugccuccc

SEQ ID NO: 2673964 - RNA, 19 nt, Human
cgcgguggcucacgccugu

SEQ ID NO: 2673965 - RNA, 23 nt, Human
cgcgggagccaugcgcccccucc

SEQ ID NO: 2673966 - RNA, 23 nt, Human
cgccuuuccuuuucgccuuuccu

SEQ ID NO: 2673967 - RNA, 19 nt, Human
cgccuuuccucucuauauu

SEQ ID NO: 2673968 - RNA, 13 nt, Human
cgccuuuccucuc

SEQ ID NO: 2673969 - RNA, 12 nt, Human
cgcccguccugc

SEQ ID NO: 2673970 - RNA, 14 nt, Human
cgcccguccugccu

SEQ ID NO: 2673971 - RNA, 17 nt, Human
cgcccgggguggccaca

SEQ ID NO: 2673972 - RNA, 15 nt, Human
cgcccguccugccug

SEQ ID NO: 2673973 - RNA, 23 nt, Human
cgccaugugauggacacuccagg

SEQ ID NO: 2673974 - RNA, 16 nt, Human
cgcagcccuggcaggg

SEQ ID NO: 2673975 - RNA, 23 nt, Human
cgcagcccuggcagggggcaugc

SEQ ID NO: 2673976 - RNA, 23 nt, Human
cgcagccucucagugcccuccag

SEQ ID NO: 2673977 - RNA, 14 nt, Human
cggacuuuucugca

SEQ ID NO: 2673978 - RNA, 15 nt, Human
cggacuuuucugcaa

SEQ ID NO: 2673979 - RNA, 16 nt, Human
cggacuuuucugcaaa

SEQ ID NO: 2673980 - RNA, 22 nt, Human
cggagucguggggugugcuggg

SEQ ID NO: 2673981 - RNA, 23 nt, Human
cggagucguggggugugcuggga

SEQ ID NO: 2673982 - RNA, 16 nt, Human
cgcuucuugccucugu

SEQ ID NO: 2673983 - RNA, 17 nt, Human
cgcuucuugccucugug

SEQ ID NO: 2673984 - RNA, 23 nt, Human
cgcuccgggcuuucacggaaacu

SEQ ID NO: 2673985 - RNA, 15 nt, Human
cgcuucuugccucug

SEQ ID NO: 2673986 - RNA, 14 nt, Human
cgcuucugccugca

SEQ ID NO: 2673987 - RNA, 19 nt, Human
ccuguauauuuguaaagcu

SEQ ID NO: 2673988 - RNA, 20 nt, Human
ccuguauauuuguaaagcua

SEQ ID NO: 2673989 - RNA, 14 nt, Human
ccuguauacagugc

SEQ ID NO: 2673990 - RNA, 15 nt, Human
ccuguauacagugca

SEQ ID NO: 2673991 - RNA, 16 nt, Human
ccuguauacagugcag

SEQ ID NO: 2673992 - RNA, 18 nt, Human
ccuguauacagugcagag

SEQ ID NO: 2673993 - RNA, 21 nt, Human
ccuguauacagugcagagccu

SEQ ID NO: 2673994 - RNA, 22 nt, Human
ccuguacaguagauuuuccaaa

SEQ ID NO: 2673995 - RNA, 14 nt, Human
ccuguacaguagau

SEQ ID NO: 2673996 - RNA, 20 nt, Human
ccuggucuuugagcucccac

SEQ ID NO: 2673997 - RNA, 13 nt, Human
ccuggucuuugag

SEQ ID NO: 2673998 - RNA, 20 nt, Human
ccuguacaguagauuuucca

SEQ ID NO: 2673999 - RNA, 21 nt, Human
ccuguacaguagauuuuccaa

SEQ ID NO: 2674000 - RNA, 17 nt, Human
ccuguagcacuuacugg

SEQ ID NO: 2674001 - RNA, 16 nt, Human
ccuguagagugggagc

SEQ ID NO: 2674002 - RNA, 15 nt, Human
ccuguagagugggag

SEQ ID NO: 2674003 - RNA, 14 nt, Human
ccuggguguccccg

SEQ ID NO: 2674004 - RNA, 20 nt, Human
ccuggguguccccgcugcug

SEQ ID NO: 2674005 - RNA, 21 nt, Human
ccuggguguccccgcugcugu

SEQ ID NO: 2674006 - RNA, 18 nt, Human
ccugggguguuaguggca

SEQ ID NO: 2674007 - RNA, 20 nt, Human
ccugggguguuaguggcacc

SEQ ID NO: 2674008 - RNA, 21 nt, Human
ccugggguguuaguggcaccg

SEQ ID NO: 2674009 - RNA, 18 nt, Human
ccugggacggcggcagua

SEQ ID NO: 2674010 - RNA, 22 nt, Human
ccugggaggucaaggcugcagu

SEQ ID NO: 2674011 - RNA, 16 nt, Human
ccuggcccacugcauc

SEQ ID NO: 2674012 - RNA, 12 nt, Human
ccuggcucccuc

SEQ ID NO: 2674013 - RNA, 14 nt, Human
ccuggcucccuccu

SEQ ID NO: 2674014 - RNA, 15 nt, Human
ccuggcucccuccuc

SEQ ID NO: 2674015 - RNA, 20 nt, Human
ccuggcucccuccuccaggc

SEQ ID NO: 2674016 - RNA, 22 nt, Human
ccuggcucccuccuccaggccu

SEQ ID NO: 2674017 - RNA, 23 nt, Human
ccuggcucccuccuccaggccug

SEQ ID NO: 2674018 - RNA, 23 nt, Human
ccugcuagcuagcucaacuagug

SEQ ID NO: 2674019 - RNA, 15 nt, Human
ccugcuagcuagcuc

SEQ ID NO: 2674020 - RNA, 23 nt, Human
ccugccuguggcgccgucuccag

SEQ ID NO: 2674021 - RNA, 21 nt, Human
ccuggcaguccgugggacggg

SEQ ID NO: 2674022 - RNA, 21 nt, Human
ccuggcaucgcaccauucuga

SEQ ID NO: 2674023 - RNA, 23 nt, Human
ccuggcaucgcaccauucugacu

SEQ ID NO: 2674024 - RNA, 14 nt, Human
ccuggcccacugca

SEQ ID NO: 2674025 - RNA, 13 nt, Human
ccuggcccacugc

SEQ ID NO: 2674026 - RNA, 11 nt, Human
ccuggccagga

SEQ ID NO: 2674027 - RNA, 12 nt, Human
ccuggccaggag

SEQ ID NO: 2674028 - RNA, 13 nt, Human
ccugcccucaagg

SEQ ID NO: 2674029 - RNA, 14 nt, Human
ccugcccucaaggg

SEQ ID NO: 2674030 - RNA, 18 nt, Human
ccugcccucaagggugug

SEQ ID NO: 2674031 - RNA, 14 nt, Human
ccugcccguucuug

SEQ ID NO: 2674032 - RNA, 13 nt, Human
ccugccaggcagg

SEQ ID NO: 2674033 - RNA, 14 nt, Human
ccugccaggcaggg

SEQ ID NO: 2674034 - RNA, 15 nt, Human
ccugccaggcagggg

SEQ ID NO: 2674035 - RNA, 19 nt, Human
ccugccaggcagggguggg

SEQ ID NO: 2674036 - RNA, 22 nt, Human
ccugccaggcaggggugggggu

SEQ ID NO: 2674037 - RNA, 21 nt, Human
ccugccacgaauuucugugcc

SEQ ID NO: 2674038 - RNA, 12 nt, Human
ccugccaggcau

SEQ ID NO: 2674039 - RNA, 21 nt, Human
ccugccacucacuaggccccc

SEQ ID NO: 2674040 - RNA, 22 nt, Human
ccugccacucacuaggccccca

SEQ ID NO: 2674041 - RNA, 13 nt, Human
ccugccacucacu

SEQ ID NO: 2674042 - RNA, 15 nt, Human
ccugccacucacuag

SEQ ID NO: 2674043 - RNA, 16 nt, Human
ccugccacucacuagg

SEQ ID NO: 2674044 - RNA, 18 nt, Human
ccugccacucacuaggcc

SEQ ID NO: 2674045 - RNA, 11 nt, Human
ccugcccugca

SEQ ID NO: 2674046 - RNA, 13 nt, Human
ccugcccugcacg

SEQ ID NO: 2674047 - RNA, 19 nt, Human
ccugaaacuauauuuuguc

SEQ ID NO: 2674048 - RNA, 14 nt, Human
ccugaaacuauauu

SEQ ID NO: 2674049 - RNA, 14 nt, Human
ccugaaagcccuga

SEQ ID NO: 2674050 - RNA, 13 nt, Human
ccugaaagcccug

SEQ ID NO: 2674051 - RNA, 13 nt, Human
ccugaagagcauu

SEQ ID NO: 2674052 - RNA, 18 nt, Human
ccugaaagcccugagcuu

SEQ ID NO: 2674053 - RNA, 13 nt, Human
ccucuuccuguga

SEQ ID NO: 2674054 - RNA, 21 nt, Human
ccucuuccugugauccaccca

SEQ ID NO: 2674055 - RNA, 14 nt, Human
ccuaguaagaagac

SEQ ID NO: 2674056 - RNA, 18 nt, Human
ccugagcuaggaagaguc

SEQ ID NO: 2674057 - RNA, 17 nt, Human
ccugagcccuacucccu

SEQ ID NO: 2674058 - RNA, 19 nt, Human
ccugagcccuacucccugc

SEQ ID NO: 2674059 - RNA, 21 nt, Human
ccugagcccuacucccugcag

SEQ ID NO: 2674060 - RNA, 22 nt, Human
ccugagcccuacucccugcaga

SEQ ID NO: 2674061 - RNA, 16 nt, Human
ccugagccggccccag

SEQ ID NO: 2674062 - RNA, 17 nt, Human
ccugagccggccccagg

SEQ ID NO: 2674063 - RNA, 17 nt, Human
ccugaagaugggagccu

SEQ ID NO: 2674064 - RNA, 15 nt, Human
ccugaauaaagagcc

SEQ ID NO: 2674065 - RNA, 13 nt, Human
ccugcauuuccuc

SEQ ID NO: 2674066 - RNA, 14 nt, Human
ccugcacuuacuug

SEQ ID NO: 2674067 - RNA, 17 nt, Human
ccugcacuuacuugcuu

SEQ ID NO: 2674068 - RNA, 12 nt, Human
ccugccaccagg

SEQ ID NO: 2674069 - RNA, 13 nt, Human
ccugccaccaggc

SEQ ID NO: 2674070 - RNA, 14 nt, Human
ccugccaccaggcc

SEQ ID NO: 2674071 - RNA, 15 nt, Human
ccugccaccaggcca

SEQ ID NO: 2674072 - RNA, 18 nt, Human
ccugccaccaggccaccu

SEQ ID NO: 2674073 - RNA, 19 nt, Human
ccugccaccaggccaccuc

SEQ ID NO: 2674074 - RNA, 21 nt, Human
ccugaucccauuuuccucuga

SEQ ID NO: 2674075 - RNA, 19 nt, Human
ccugcacagugucccccag

SEQ ID NO: 2674076 - RNA, 20 nt, Human
ccugcacagugucccccagg

SEQ ID NO: 2674077 - RNA, 22 nt, Human
gaaaaugaauaucuauuaauau

SEQ ID NO: 2674078 - RNA, 17 nt, Human
gaaacaagugaaagcau

SEQ ID NO: 2674079 - RNA, 19 nt, Human
gaaacuccacaucugccuu

SEQ ID NO: 2674080 - RNA, 20 nt, Human
gaaacuccacaucugccuua

SEQ ID NO: 2674081 - RNA, 13 nt, Human
gaaacuaaagcaa

SEQ ID NO: 2674082 - RNA, 19 nt, Human
gaaacuaaagcaauagaaa

SEQ ID NO: 2674083 - RNA, 22 nt, Human
gaaacuaaagcaauagaaacaa

SEQ ID NO: 2674084 - RNA, 18 nt, Human
gaaacuccacaucugccu

SEQ ID NO: 2674085 - RNA, 21 nt, Human
gaaaccgaguagaaaauguga

SEQ ID NO: 2674086 - RNA, 23 nt, Human
gaaaccauguagcagugagucau

SEQ ID NO: 2674087 - RNA, 16 nt, Human
gaaaccugggauucag

SEQ ID NO: 2674088 - RNA, 13 nt, Human
gaaagaggaagca

SEQ ID NO: 2674089 - RNA, 16 nt, Human
gaaagaggcaccagga

SEQ ID NO: 2674090 - RNA, 17 nt, Human
gaaagaggcaccaggaa

SEQ ID NO: 2674091 - RNA, 20 nt, Human
gaaagaggcaccaggaagcc

SEQ ID NO: 2674092 - RNA, 21 nt, Human
gaaagaggcaccaggaagccg

SEQ ID NO: 2674093 - RNA, 22 nt, Human
gaaagcagaguuuucauuaaau

SEQ ID NO: 2674094 - RNA, 23 nt, Human
gaaagcauauggguuagauguug

SEQ ID NO: 2674095 - RNA, 17 nt, Human
gaaagcccugagcuuuc

SEQ ID NO: 2674096 - RNA, 22 nt, Human
gaaagcccugagcuuucugcua

SEQ ID NO: 2674097 - RNA, 21 nt, Human
gaaagcccugagcuuucugcu

SEQ ID NO: 2674098 - RNA, 20 nt, Human
gaaagcgcggacgugcuggg

SEQ ID NO: 2674099 - RNA, 19 nt, Human
gaaagcuauauaagacaag

SEQ ID NO: 2674100 - RNA, 17 nt, Human
gaaagcucacuguagcu

SEQ ID NO: 2674101 - RNA, 20 nt, Human
gaaaaugaauaucuauuaau

SEQ ID NO: 2674102 - RNA, 14 nt, Human
gaaaaugaaaugca

SEQ ID NO: 2674103 - RNA, 17 nt, Human
gaaaaugaaaugcauau

SEQ ID NO: 2674104 - RNA, 18 nt, Human
gaaaaugaaaugcauauu

SEQ ID NO: 2674105 - RNA, 22 nt, Human
gaaaaucagccugcuccagcug

SEQ ID NO: 2674106 - RNA, 20 nt, Human
gaaaaucagccugcuccagc

SEQ ID NO: 2674107 - RNA, 15 nt, Human
gaaaauauuguuuua

SEQ ID NO: 2674108 - RNA, 22 nt, Human
gaaaauauuguuuuacaauagu

SEQ ID NO: 2674109 - RNA, 23 nt, Human
gaaaaguggcgugggagccagcc

SEQ ID NO: 2674110 - RNA, 18 nt, Human
gaaaacaguguguaaaca

SEQ ID NO: 2674111 - RNA, 15 nt, Human
gaaaaaggaggaaga

SEQ ID NO: 2674112 - RNA, 12 nt, Human
gaaaaaggagga

SEQ ID NO: 2674113 - RNA, 15 nt, Human
cuuuuuguguuuuuu

SEQ ID NO: 2674114 - RNA, 17 nt, Human
cuuuuuguuguaaaaca

SEQ ID NO: 2674115 - RNA, 12 nt, Human
cuuuuuauuuau

SEQ ID NO: 2674116 - RNA, 13 nt, Human
cuuuuuauuaaaa

SEQ ID NO: 2674117 - RNA, 16 nt, Human
cuuuuuauuaaaauau

SEQ ID NO: 2674118 - RNA, 18 nt, Human
cuuuuuauuaaaauauuu

SEQ ID NO: 2674119 - RNA, 15 nt, Human
cuuuuuaugcuauuu

SEQ ID NO: 2674120 - RNA, 23 nt, Human
cuuuuuaugcuauuucuguauau

SEQ ID NO: 2674121 - RNA, 13 nt, Human
cuuuuuauuuaua

SEQ ID NO: 2674122 - RNA, 17 nt, Human
cuuuuuauuuauaugua

SEQ ID NO: 2674123 - RNA, 14 nt, Human
cuuuuuauuuauau

SEQ ID NO: 2674124 - RNA, 19 nt, Human
cuuuuuauuuauauguacu

SEQ ID NO: 2674125 - RNA, 20 nt, Human
cuuuuuauuuauauguacug

SEQ ID NO: 2674126 - RNA, 19 nt, Human
cuuuuuauuuauauguaug

SEQ ID NO: 2674127 - RNA, 18 nt, Human
cuuuuuauuuauauguau

SEQ ID NO: 2674128 - RNA, 23 nt, Human
cuuggggggcugaggugggagga

SEQ ID NO: 2674129 - RNA, 12 nt, Human
cuugaguuuguc

SEQ ID NO: 2674130 - RNA, 22 nt, Human
cuugaguuguuuuuguauauug

SEQ ID NO: 2674131 - RNA, 21 nt, Human
cuugaguuguuuuuguauauu

SEQ ID NO: 2674132 - RNA, 20 nt, Human
cuugaguuguuuuuguauau

SEQ ID NO: 2674133 - RNA, 19 nt, Human
cuugaguuguuuuuguaua

SEQ ID NO: 2674134 - RNA, 18 nt, Human
cuugaguuguuuuuguau

SEQ ID NO: 2674135 - RNA, 23 nt, Human
cuugaguuguuuuuguauauugg

SEQ ID NO: 2674136 - RNA, 13 nt, Human
cuugaguuugucg

SEQ ID NO: 2674137 - RNA, 14 nt, Human
cuuggggggguggc

SEQ ID NO: 2674138 - RNA, 22 nt, Human
cuuggggggcugaggugggagg

SEQ ID NO: 2674139 - RNA, 16 nt, Human
cuuggggggguggccg

SEQ ID NO: 2674140 - RNA, 18 nt, Human
cuuggggggguggccgcu

SEQ ID NO: 2674141 - RNA, 19 nt, Human
cuuggggggguggccgcug

SEQ ID NO: 2674142 - RNA, 22 nt, Human
cuuggggggguggccgcugagu

SEQ ID NO: 2674143 - RNA, 14 nt, Human
cuuguauaaauuau

SEQ ID NO: 2674144 - RNA, 21 nt, Human
cuuguauagcaugaaauaaaa

SEQ ID NO: 2674145 - RNA, 20 nt, Human
cuuguaguucuuuaaacugu

SEQ ID NO: 2674146 - RNA, 15 nt, Human
cuuguaguucuuuaa

SEQ ID NO: 2674147 - RNA, 13 nt, Human
cuuguaguucuuu

SEQ ID NO: 2674148 - RNA, 13 nt, Human
cuuuacugccuga

SEQ ID NO: 2674149 - RNA, 18 nt, Human
cuuuacugccugaauaaa

SEQ ID NO: 2674150 - RNA, 19 nt, Human
cuuuacugccugaauaaag

SEQ ID NO: 2674151 - RNA, 23 nt, Human
cuuuacugccugaauaaagagcc

SEQ ID NO: 2674152 - RNA, 16 nt, Human
cuuuaaaaggaaagaa

SEQ ID NO: 2674153 - RNA, 17 nt, Human
cuuuaaaaggaaagaaa

SEQ ID NO: 2674154 - RNA, 14 nt, Human
cuuuaaaauauugu

SEQ ID NO: 2674155 - RNA, 18 nt, Human
cuuuaaaaggaaagaaaa

SEQ ID NO: 2674156 - RNA, 14 nt, Human
cuuuaaaagugauc

SEQ ID NO: 2674157 - RNA, 16 nt, Human
cuuguucaucauccag

SEQ ID NO: 2674158 - RNA, 22 nt, Human
cuuguucaucauccagaugugg

SEQ ID NO: 2674159 - RNA, 16 nt, Human
cuuguuauucaacagc

SEQ ID NO: 2674160 - RNA, 12 nt, Human
cuuuaugugaau

SEQ ID NO: 2674161 - RNA, 13 nt, Human
cuuuaugugaauu

SEQ ID NO: 2674162 - RNA, 14 nt, Human
cuuuaugugaauuu

SEQ ID NO: 2674163 - RNA, 15 nt, Human
cuuuaugugaauuuu

SEQ ID NO: 2674164 - RNA, 17 nt, Human
cuuuaugugaauuuuua

SEQ ID NO: 2674165 - RNA, 22 nt, Human
cuuuccaggcuauguauaaaau

SEQ ID NO: 2674166 - RNA, 23 nt, Human
cuuuccaggcuauguauaaaaua

SEQ ID NO: 2674167 - RNA, 11 nt, Human
cuuucccucac

SEQ ID NO: 2674168 - RNA, 14 nt, Human
cuuucccucacccc

SEQ ID NO: 2674169 - RNA, 16 nt, Human
cuuucccucacccccu

SEQ ID NO: 2674170 - RNA, 18 nt, Human
cuuucccucacccccucc

SEQ ID NO: 2674171 - RNA, 19 nt, Human
cuuucccucacccccuccc

SEQ ID NO: 2674172 - RNA, 16 nt, Human
cuuugucaaaaggaag

SEQ ID NO: 2674173 - RNA, 22 nt, Human
cuuuguauuguccuauuagugu

SEQ ID NO: 2674174 - RNA, 13 nt, Human
cuuuguauuuuga

SEQ ID NO: 2674175 - RNA, 17 nt, Human
cuuuguauuuugauuau

SEQ ID NO: 2674176 - RNA, 18 nt, Human
cuuuguauuuugauuauu

SEQ ID NO: 2674177 - RNA, 22 nt, Human
cuuuguauuguauauuacaaug

SEQ ID NO: 2674178 - RNA, 16 nt, Human
cuuuguauuguccuau

SEQ ID NO: 2674179 - RNA, 15 nt, Human
cuuuguauuguccua

SEQ ID NO: 2674180 - RNA, 12 nt, Human
cuuuguauuguc

SEQ ID NO: 2674181 - RNA, 13 nt, Human
cuucaaagccuuc

SEQ ID NO: 2674182 - RNA, 15 nt, Human
cuucaaagccuucuc

SEQ ID NO: 2674183 - RNA, 18 nt, Human
cuuauuuggcgugacccg

SEQ ID NO: 2674184 - RNA, 15 nt, Human
cuucacaguagagcc

SEQ ID NO: 2674185 - RNA, 17 nt, Human
cuucacaguagagccag

SEQ ID NO: 2674186 - RNA, 16 nt, Human
cuucaccaucaauccu

SEQ ID NO: 2674187 - RNA, 17 nt, Human
cuucaccaucaauccug

SEQ ID NO: 2674188 - RNA, 20 nt, Human
cuucaccaucaauccugauu

SEQ ID NO: 2674189 - RNA, 19 nt, Human
cuucaccauggccuuauga

SEQ ID NO: 2674190 - RNA, 14 nt, Human
cuucacacagacac

SEQ ID NO: 2674191 - RNA, 19 nt, Human
cuucacacagaccccucgc

SEQ ID NO: 2674192 - RNA, 13 nt, Human
cuguucugguaau

SEQ ID NO: 2674193 - RNA, 21 nt, Human
cuuauaucuggccucugcuuu

SEQ ID NO: 2674194 - RNA, 16 nt, Human
cuuauaucuggccucu

SEQ ID NO: 2674195 - RNA, 22 nt, Human
cuuauaucuggccucugcuuuc

SEQ ID NO: 2674196 - RNA, 17 nt, Human
cuuauaugggaaaccau

SEQ ID NO: 2674197 - RNA, 17 nt, Human
cuuaguuuguguguugu

SEQ ID NO: 2674198 - RNA, 22 nt, Human
cuuaguuuguguguugucucuu

SEQ ID NO: 2674199 - RNA, 14 nt, Human
cuuauaaaacagag

SEQ ID NO: 2674200 - RNA, 12 nt, Human
cuuauaaaacag

SEQ ID NO: 2674201 - RNA, 23 nt, Human
cuuaguuuguguguugucucuug

SEQ ID NO: 2674202 - RNA, 15 nt, Human
cuuauaaaacagagu

SEQ ID NO: 2674203 - RNA, 15 nt, Human
cuucacccuggagcc

SEQ ID NO: 2674204 - RNA, 18 nt, Human
cuucacaguagagccagc

SEQ ID NO: 2674205 - RNA, 23 nt, Human
cuucaguaagccgugauuuucau

SEQ ID NO: 2674206 - RNA, 16 nt, Human
cuucaguaagccguga

SEQ ID NO: 2674207 - RNA, 15 nt, Human
cuucaguaagccgug

SEQ ID NO: 2674208 - RNA, 13 nt, Human
cuuccaggaaacu

SEQ ID NO: 2674209 - RNA, 22 nt, Human
cuuccaggaaacuccacaucug

SEQ ID NO: 2674210 - RNA, 23 nt, Human
cuuccaggaaacuccacaucugc

SEQ ID NO: 2674211 - RNA, 17 nt, Human
cuuccaggaaacuccac

SEQ ID NO: 2674212 - RNA, 18 nt, Human
cuuccaggaaacuccaca

SEQ ID NO: 2674213 - RNA, 19 nt, Human
cuuccaggaaacuccacau

SEQ ID NO: 2674214 - RNA, 21 nt, Human
cuuccaggaaacuccacaucu

SEQ ID NO: 2674215 - RNA, 12 nt, Human
cuuccccucacu

SEQ ID NO: 2674216 - RNA, 18 nt, Human
cuuccccggagggcugcg

SEQ ID NO: 2674217 - RNA, 17 nt, Human
cuucccuacaguugaaa

SEQ ID NO: 2674218 - RNA, 12 nt, Human
cuucccuaaucu

SEQ ID NO: 2674219 - RNA, 18 nt, Human
cuugaaaagagacaggca

SEQ ID NO: 2674220 - RNA, 15 nt, Human
cuugaaaagagacag

SEQ ID NO: 2674221 - RNA, 21 nt, Human
cuugaaaagagacaggcaggu

SEQ ID NO: 2674222 - RNA, 17 nt, Human
cuucuuuaauugaucua

SEQ ID NO: 2674223 - RNA, 16 nt, Human
cuugaaacuuugggaa

SEQ ID NO: 2674224 - RNA, 18 nt, Human
cuugaaacuuugggaaaa

SEQ ID NO: 2674225 - RNA, 23 nt, Human
cuugaaacuuugggaaaacaugu

SEQ ID NO: 2674226 - RNA, 18 nt, Human
cuugaacauguuuuguau

SEQ ID NO: 2674227 - RNA, 21 nt, Human
cuucugugcccagaauacuga

SEQ ID NO: 2674228 - RNA, 20 nt, Human
cuucugugcccagaauacug

SEQ ID NO: 2674229 - RNA, 17 nt, Human
cuucugugaugagcuga

SEQ ID NO: 2674230 - RNA, 19 nt, Human
cuucugugcccagaauacu

SEQ ID NO: 2674231 - RNA, 14 nt, Human
cuucugugcccaga

SEQ ID NO: 2674232 - RNA, 15 nt, Human
cuucugugaugagcu

SEQ ID NO: 2674233 - RNA, 16 nt, Human
cuucugugaugagcug

SEQ ID NO: 2674234 - RNA, 19 nt, Human
cuucugugaugagcugauc

SEQ ID NO: 2674235 - RNA, 14 nt, Human
cuucugugaugagc

SEQ ID NO: 2674236 - RNA, 12 nt, Human
cuucuuuaaaca

SEQ ID NO: 2674237 - RNA, 16 nt, Human
cuucuugccucugugc

SEQ ID NO: 2674238 - RNA, 17 nt, Human
cuucuugccucugugcu

SEQ ID NO: 2674239 - RNA, 18 nt, Human
cuucuugccucugugcug

SEQ ID NO: 2674240 - RNA, 11 nt, Human
cuucuugggau

SEQ ID NO: 2674241 - RNA, 18 nt, Human
cuucuuggggcccagugc

SEQ ID NO: 2674242 - RNA, 19 nt, Human
cuucuuggggcccagugca

SEQ ID NO: 2674243 - RNA, 21 nt, Human
cuucuuggggcccagugcaug

SEQ ID NO: 2674244 - RNA, 22 nt, Human
cuucuuggggcccagugcaugg

SEQ ID NO: 2674245 - RNA, 23 nt, Human
cuucuuggggcccagugcauggu

SEQ ID NO: 2674246 - RNA, 24 nt, Human
cuucuuggggcccagugcauggug

SEQ ID NO: 2674247 - RNA, 11 nt, Human
cuucuguguuu

SEQ ID NO: 2674248 - RNA, 14 nt, Human
cuucuguguuuaua

SEQ ID NO: 2674249 - RNA, 23 nt, Human
cuucugugcccagaauacugaug

SEQ ID NO: 2674250 - RNA, 13 nt, Human
cuucuugccucug

SEQ ID NO: 2674251 - RNA, 15 nt, Human
cuucuugccucugug

SEQ ID NO: 2674252 - RNA, 21 nt, Human
cuugaguugauucagcucugc

SEQ ID NO: 2674253 - RNA, 14 nt, Human
cuugagcuggccuc

SEQ ID NO: 2674254 - RNA, 16 nt, Human
cuugagcuggccucuc

SEQ ID NO: 2674255 - RNA, 17 nt, Human
cuugagcuggccucucu

SEQ ID NO: 2674256 - RNA, 23 nt, Human
cuugagcuggccucucuagcaca

SEQ ID NO: 2674257 - RNA, 13 nt, Human
cuugagcuggccu

SEQ ID NO: 2674258 - RNA, 12 nt, Human
cuugagcuggcc

SEQ ID NO: 2674259 - RNA, 16 nt, Human
cuugagccugggaggu

SEQ ID NO: 2674260 - RNA, 14 nt, Human
cuugaccugaggcu

SEQ ID NO: 2674261 - RNA, 23 nt, Human
cuugaccugaggcuguggucaca

SEQ ID NO: 2674262 - RNA, 17 nt, Human
cuugaccugaggcugug

SEQ ID NO: 2674263 - RNA, 20 nt, Human
cuugaccugaggcugugguc

SEQ ID NO: 2674264 - RNA, 17 nt, Human
cuugaaccauaaaaugu

SEQ ID NO: 2674265 - RNA, 14 nt, Human
cuugaaccauaaaa

SEQ ID NO: 2674266 - RNA, 12 nt, Human
cuugaagaacug

SEQ ID NO: 2674267 - RNA, 17 nt, Human
cuugaagaacugcaggc

SEQ ID NO: 2674268 - RNA, 18 nt, Human
cuugaagaacugcaggcc

SEQ ID NO: 2674269 - RNA, 20 nt, Human
cuugaagaacugcaggcccu

SEQ ID NO: 2674270 - RNA, 22 nt, Human
cuugaagaacugcaggcccugg

SEQ ID NO: 2674271 - RNA, 15 nt, Human
cuucugguacuuucu

SEQ ID NO: 2674272 - RNA, 22 nt, Human
cuucuguauuuuuuuuucuaag

SEQ ID NO: 2674273 - RNA, 20 nt, Human
cuucuguauuuuuuuuucua

SEQ ID NO: 2674274 - RNA, 21 nt, Human
cuucucugacuucugccugga

SEQ ID NO: 2674275 - RNA, 12 nt, Human
cuucugccugca

SEQ ID NO: 2674276 - RNA, 13 nt, Human
cuucugccuggag

SEQ ID NO: 2674277 - RNA, 14 nt, Human
cuucugccuggaga

SEQ ID NO: 2674278 - RNA, 15 nt, Human
cuucugccuggagac

SEQ ID NO: 2674279 - RNA, 16 nt, Human
cuucugccuggagacu

SEQ ID NO: 2674280 - RNA, 21 nt, Human
cuucuggggcaggcugggcca

SEQ ID NO: 2674281 - RNA, 22 nt, Human
cuucuggggcaggcugggccau

SEQ ID NO: 2674282 - RNA, 15 nt, Human
cuucuggggcaggcu

SEQ ID NO: 2674283 - RNA, 16 nt, Human
cuucuggggcaggcug

SEQ ID NO: 2674284 - RNA, 19 nt, Human
cuucuggggcaggcugggc

SEQ ID NO: 2674285 - RNA, 20 nt, Human
cuucuggggcaggcugggcc

SEQ ID NO: 2674286 - RNA, 14 nt, Human
cuucuggggcaggc

SEQ ID NO: 2674287 - RNA, 13 nt, Human
cuucucuccuccc

SEQ ID NO: 2674288 - RNA, 15 nt, Human
cuucucuccucccca

SEQ ID NO: 2674289 - RNA, 12 nt, Human
cuucucugacuu

SEQ ID NO: 2674290 - RNA, 14 nt, Human
cuucucugacuucu

SEQ ID NO: 2674291 - RNA, 15 nt, Human
cuucucugacuucug

SEQ ID NO: 2674292 - RNA, 16 nt, Human
cuucucugacuucugc

SEQ ID NO: 2674293 - RNA, 20 nt, Human
cuucugccauuucugagauc

SEQ ID NO: 2674294 - RNA, 17 nt, Human
cuucucugacuucugcc

SEQ ID NO: 2674295 - RNA, 20 nt, Human
cuucucugacuucugccugg

SEQ ID NO: 2674296 - RNA, 23 nt, Human
cuucuccuacauaucccuuccag

SEQ ID NO: 2674297 - RNA, 16 nt, Human
cuucucccuagcuccu

SEQ ID NO: 2674298 - RNA, 19 nt, Human
cuucucccuagcuccuccc

SEQ ID NO: 2674299 - RNA, 12 nt, Human
cuucuccgccag

SEQ ID NO: 2674300 - RNA, 13 nt, Human
cuucuccgccagc

SEQ ID NO: 2674301 - RNA, 14 nt, Human
cuucuccgccagcc

SEQ ID NO: 2674302 - RNA, 15 nt, Human
cuucuccgccagccu

SEQ ID NO: 2674303 - RNA, 16 nt, Human
cuucuccgccagccuc

SEQ ID NO: 2674304 - RNA, 17 nt, Human
cuucuccgccagccucc

SEQ ID NO: 2674305 - RNA, 18 nt, Human
cuucuccgccagccuccu

SEQ ID NO: 2674306 - RNA, 19 nt, Human
cuucuccgccagccuccuc

SEQ ID NO: 2674307 - RNA, 21 nt, Human
cuucuccgccagccuccucug

SEQ ID NO: 2674308 - RNA, 23 nt, Human
cuucuccgccagccuccucugga

SEQ ID NO: 2674309 - RNA, 24 nt, Human
cuucuccgccagccuccucuggac

SEQ ID NO: 2674310 - RNA, 20 nt, Human
cugccgguuugaaaauaugc

SEQ ID NO: 2674311 - RNA, 14 nt, Human
cugccgguuugaaa

SEQ ID NO: 2674312 - RNA, 16 nt, Human
cugccgucaccaccac

SEQ ID NO: 2674313 - RNA, 18 nt, Human
cugccgucaccaccaccc

SEQ ID NO: 2674314 - RNA, 19 nt, Human
cugccgucaccaccacccc

SEQ ID NO: 2674315 - RNA, 20 nt, Human
cugccgucaccaccaccccu

SEQ ID NO: 2674316 - RNA, 22 nt, Human
cugccgucaccaccaccccuac

SEQ ID NO: 2674317 - RNA, 13 nt, Human
cugccguggggcc

SEQ ID NO: 2674318 - RNA, 17 nt, Human
cugccgugccgccugca

SEQ ID NO: 2674319 - RNA, 19 nt, Human
cugccgugccgccugcacu

SEQ ID NO: 2674320 - RNA, 20 nt, Human
cugccguggggccgccgccu

SEQ ID NO: 2674321 - RNA, 21 nt, Human
cugccguggggccgccgccuc

SEQ ID NO: 2674322 - RNA, 14 nt, Human
cugccgucucugga

SEQ ID NO: 2674323 - RNA, 15 nt, Human
cugccgucucuggag

SEQ ID NO: 2674324 - RNA, 17 nt, Human
cugccgucucuggagcg

SEQ ID NO: 2674325 - RNA, 15 nt, Human
cugccgugccgccug

SEQ ID NO: 2674326 - RNA, 13 nt, Human
cugcccuugggcc

SEQ ID NO: 2674327 - RNA, 12 nt, Human
cugcccuugggc

SEQ ID NO: 2674328 - RNA, 15 nt, Human
cugcccuuccgcagu

SEQ ID NO: 2674329 - RNA, 18 nt, Human
cugcccuuccgcagugug

SEQ ID NO: 2674330 - RNA, 16 nt, Human
cugcccuggcugcugc

SEQ ID NO: 2674331 - RNA, 12 nt, Human
cugcccuggcug

SEQ ID NO: 2674332 - RNA, 14 nt, Human
cugcccuggcugcu

SEQ ID NO: 2674333 - RNA, 15 nt, Human
cugccucuucucuac

SEQ ID NO: 2674334 - RNA, 14 nt, Human
cugccucuuucccu

SEQ ID NO: 2674335 - RNA, 18 nt, Human
cugccucuuucccuagga

SEQ ID NO: 2674336 - RNA, 19 nt, Human
cugccucuuucccuaggaa

SEQ ID NO: 2674337 - RNA, 14 nt, Human
cugccuuggcucag

SEQ ID NO: 2674338 - RNA, 22 nt, Human
cugccuuggcucagacauguuu

SEQ ID NO: 2674339 - RNA, 18 nt, Human
cugccuuggcucagacau

SEQ ID NO: 2674340 - RNA, 17 nt, Human
cugccuuggcucagaca

SEQ ID NO: 2674341 - RNA, 15 nt, Human
cugccuuggcucaga

SEQ ID NO: 2674342 - RNA, 13 nt, Human
cugccucccaugc

SEQ ID NO: 2674343 - RNA, 12 nt, Human
cugccuggccuu

SEQ ID NO: 2674344 - RNA, 15 nt, Human
cugccuggcccccaa

SEQ ID NO: 2674345 - RNA, 19 nt, Human
cugccuggcccccaaccuc

SEQ ID NO: 2674346 - RNA, 22 nt, Human
cugccuggcccccaaccucagg

SEQ ID NO: 2674347 - RNA, 23 nt, Human
cugccuggcccccaaccucaggg

SEQ ID NO: 2674348 - RNA, 11 nt, Human
cugccuggccc

SEQ ID NO: 2674349 - RNA, 12 nt, Human
cugccuggcccc

SEQ ID NO: 2674350 - RNA, 12 nt, Human
cugccucccacu

SEQ ID NO: 2674351 - RNA, 14 nt, Human
cugccucccacuuc

SEQ ID NO: 2674352 - RNA, 15 nt, Human
cugccucccacuuca

SEQ ID NO: 2674353 - RNA, 18 nt, Human
cugccucccacuucacug

SEQ ID NO: 2674354 - RNA, 22 nt, Human
cugccgugccgccugcacuccu

SEQ ID NO: 2674355 - RNA, 21 nt, Human
cugcugcagagcaguaaggga

SEQ ID NO: 2674356 - RNA, 15 nt, Human
cugcugcagagcagu

SEQ ID NO: 2674357 - RNA, 14 nt, Human
cugcugcagagcag

SEQ ID NO: 2674358 - RNA, 14 nt, Human
cugcugcccccacc

SEQ ID NO: 2674359 - RNA, 15 nt, Human
cugcugcccccaccc

SEQ ID NO: 2674360 - RNA, 22 nt, Human
cugcugcccccaccccggggac

SEQ ID NO: 2674361 - RNA, 21 nt, Human
cugcugcccccaccccgggga

SEQ ID NO: 2674362 - RNA, 21 nt, Human
cugcugcaugcccucucaggc

SEQ ID NO: 2674363 - RNA, 17 nt, Human
cugcugcaugcccucuc

SEQ ID NO: 2674364 - RNA, 14 nt, Human
cugcugcaugcccu

SEQ ID NO: 2674365 - RNA, 16 nt, Human
cugcugcaugcccucu

SEQ ID NO: 2674366 - RNA, 15 nt, Human
cugcugcaugcccuc

SEQ ID NO: 2674367 - RNA, 20 nt, Human
cugcgacuuucugccuggag

SEQ ID NO: 2674368 - RNA, 18 nt, Human
cugcgacuuucugccugg

SEQ ID NO: 2674369 - RNA, 19 nt, Human
cugcgacuuucugccugga

SEQ ID NO: 2674370 - RNA, 19 nt, Human
cugcuccagcuguucagcu

SEQ ID NO: 2674371 - RNA, 20 nt, Human
cugcuccagcuguucagcug

SEQ ID NO: 2674372 - RNA, 14 nt, Human
cugcgacuuucugc

SEQ ID NO: 2674373 - RNA, 16 nt, Human
cugcgacuuucugccu

SEQ ID NO: 2674374 - RNA, 17 nt, Human
cugcgacuuucugccug

SEQ ID NO: 2674375 - RNA, 13 nt, Human
cugcgacccuggg

SEQ ID NO: 2674376 - RNA, 14 nt, Human
cugcgacccugggg

SEQ ID NO: 2674377 - RNA, 15 nt, Human
cugcgacccuggggg

SEQ ID NO: 2674378 - RNA, 21 nt, Human
cugcgacccugggggcacagg

SEQ ID NO: 2674379 - RNA, 22 nt, Human
cugcgacccugggggcacagga

SEQ ID NO: 2674380 - RNA, 13 nt, Human
cugcuggggaucc

SEQ ID NO: 2674381 - RNA, 14 nt, Human
cugcuggggauccc

SEQ ID NO: 2674382 - RNA, 14 nt, Human
cugcuggcacccac

SEQ ID NO: 2674383 - RNA, 16 nt, Human
cugcuggcacccaccg

SEQ ID NO: 2674384 - RNA, 17 nt, Human
cugcuggcacccaccgu

SEQ ID NO: 2674385 - RNA, 16 nt, Human
cugcugcuacaauguc

SEQ ID NO: 2674386 - RNA, 21 nt, Human
cuggcacuggaugcagaaaca

SEQ ID NO: 2674387 - RNA, 17 nt, Human
cuggcacuggaccccag

SEQ ID NO: 2674388 - RNA, 19 nt, Human
cuggcacuggaccccagca

SEQ ID NO: 2674389 - RNA, 18 nt, Human
cuggcacuggaccccagc

SEQ ID NO: 2674390 - RNA, 15 nt, Human
cuggcccacugcauc

SEQ ID NO: 2674391 - RNA, 22 nt, Human
cuggccaguccaggcugccgug

SEQ ID NO: 2674392 - RNA, 23 nt, Human
cuggccaguccaggcugccgugg

SEQ ID NO: 2674393 - RNA, 18 nt, Human
cuggccaguccaggcugc

SEQ ID NO: 2674394 - RNA, 16 nt, Human
cuggcaguccguggga

SEQ ID NO: 2674395 - RNA, 19 nt, Human
cuggcaguccgugggacgg

SEQ ID NO: 2674396 - RNA, 20 nt, Human
cuggcaucgcaccauucuga

SEQ ID NO: 2674397 - RNA, 22 nt, Human
cuggcaucgcaccauucugacu

SEQ ID NO: 2674398 - RNA, 17 nt, Human
cuggcaucgcaccauuc

SEQ ID NO: 2674399 - RNA, 18 nt, Human
cuggcaucgcaccauucu

SEQ ID NO: 2674400 - RNA, 19 nt, Human
cuggcaucgcaccauucug

SEQ ID NO: 2674401 - RNA, 19 nt, Human
cuggccaguccaggcugcc

SEQ ID NO: 2674402 - RNA, 21 nt, Human
cuggccaguccaggcugccgu

SEQ ID NO: 2674403 - RNA, 13 nt, Human
cuggccagaaugc

SEQ ID NO: 2674404 - RNA, 12 nt, Human
cuggccccagcc

SEQ ID NO: 2674405 - RNA, 14 nt, Human
cuggccccagcccu

SEQ ID NO: 2674406 - RNA, 15 nt, Human
cuggccccagcccug

SEQ ID NO: 2674407 - RNA, 16 nt, Human
cuggccccagcccugc

SEQ ID NO: 2674408 - RNA, 18 nt, Human
cuggccccagcccugcug

SEQ ID NO: 2674409 - RNA, 19 nt, Human
cuggccccagcccugcugg

SEQ ID NO: 2674410 - RNA, 23 nt, Human
cuggccccagcccugcuggggau

SEQ ID NO: 2674411 - RNA, 15 nt, Human
cuggccuuguccuca

SEQ ID NO: 2674412 - RNA, 19 nt, Human
cuggccuuguccucagcca

SEQ ID NO: 2674413 - RNA, 21 nt, Human
cuggccuuguccucagccagu

SEQ ID NO: 2674414 - RNA, 17 nt, Human
cuggcugagguuccucu

SEQ ID NO: 2674415 - RNA, 19 nt, Human
cuggcugagguuccucugc

SEQ ID NO: 2674416 - RNA, 20 nt, Human
cuggcugagguuccucugcc

SEQ ID NO: 2674417 - RNA, 21 nt, Human
cuggcugagguuccucugccu

SEQ ID NO: 2674418 - RNA, 22 nt, Human
cuggcugagguuccucugccug

SEQ ID NO: 2674419 - RNA, 23 nt, Human
cuggcugagguuccucugccugc

SEQ ID NO: 2674420 - RNA, 14 nt, Human
cuggagcccuaacc

SEQ ID NO: 2674421 - RNA, 22 nt, Human
cuggagcccuaaccccuuccag

SEQ ID NO: 2674422 - RNA, 23 nt, Human
cuggagauccuccugcagaccac

SEQ ID NO: 2674423 - RNA, 18 nt, Human
cuggagauccuccugcag

SEQ ID NO: 2674424 - RNA, 20 nt, Human
cuggagauccuccugcagac

SEQ ID NO: 2674425 - RNA, 14 nt, Human
cuggagauccuccu

SEQ ID NO: 2674426 - RNA, 15 nt, Human
cuggagauccuccug

SEQ ID NO: 2674427 - RNA, 16 nt, Human
cuggagauccuccugc

SEQ ID NO: 2674428 - RNA, 17 nt, Human
cuggagauccuccugca

SEQ ID NO: 2674429 - RNA, 13 nt, Human
cuggagucuccug

SEQ ID NO: 2674430 - RNA, 15 nt, Human
cuggagucuccugag

SEQ ID NO: 2674431 - RNA, 16 nt, Human
cuggagucuccugagg

SEQ ID NO: 2674432 - RNA, 17 nt, Human
cuggagguugaagccaa

SEQ ID NO: 2674433 - RNA, 19 nt, Human
cuggagguugaagccaagu

SEQ ID NO: 2674434 - RNA, 13 nt, Human
cuggaggggaggg

SEQ ID NO: 2674435 - RNA, 16 nt, Human
cuggagguugaagcca

SEQ ID NO: 2674436 - RNA, 15 nt, Human
cugcuuccuccugga

SEQ ID NO: 2674437 - RNA, 16 nt, Human
cugcuuccuccuggaa

SEQ ID NO: 2674438 - RNA, 15 nt, Human
cugcuucccuuacuu

SEQ ID NO: 2674439 - RNA, 20 nt, Human
cugcuucccuuacuuugcug

SEQ ID NO: 2674440 - RNA, 21 nt, Human
cugcuucccuuacuuugcuga

SEQ ID NO: 2674441 - RNA, 12 nt, Human
cugcuuccuccu

SEQ ID NO: 2674442 - RNA, 13 nt, Human
cugcuuccuccug

SEQ ID NO: 2674443 - RNA, 14 nt, Human
cugcuuccuccugg

SEQ ID NO: 2674444 - RNA, 12 nt, Human
cuggaccccagc

SEQ ID NO: 2674445 - RNA, 14 nt, Human
cuggacggcaggcu

SEQ ID NO: 2674446 - RNA, 20 nt, Human
cuggacggcaggcucacugc

SEQ ID NO: 2674447 - RNA, 21 nt, Human
cuggacggcaggcucacugcc

SEQ ID NO: 2674448 - RNA, 15 nt, Human
cuggaccuguauauu

SEQ ID NO: 2674449 - RNA, 16 nt, Human
cuggaccuguauauuu

SEQ ID NO: 2674450 - RNA, 13 nt, Human
cuggacggcaggc

SEQ ID NO: 2674451 - RNA, 16 nt, Human
cuggacccuuauaaaa

SEQ ID NO: 2674452 - RNA, 17 nt, Human
cuggacccuuauaaaau

SEQ ID NO: 2674453 - RNA, 18 nt, Human
cuggacccuuauaaaauc

SEQ ID NO: 2674454 - RNA, 15 nt, Human
cuggacccuguggau

SEQ ID NO: 2674455 - RNA, 16 nt, Human
cuguauauuuguaaag

SEQ ID NO: 2674456 - RNA, 19 nt, Human
cuguauauuuguaaagcua

SEQ ID NO: 2674457 - RNA, 20 nt, Human
cuguauauuuguaaagcuau

SEQ ID NO: 2674458 - RNA, 13 nt, Human
cuguauacagugc

SEQ ID NO: 2674459 - RNA, 21 nt, Human
cuguauacagugcagagccuu

SEQ ID NO: 2674460 - RNA, 22 nt, Human
cuguauacagugcagagccuuc

SEQ ID NO: 2674461 - RNA, 22 nt, Human
cuguagucccagcuacucggga

SEQ ID NO: 2674462 - RNA, 14 nt, Human
cuguagucccagcu

SEQ ID NO: 2674463 - RNA, 21 nt, Human
cuguauuuuauuuagacaaga

SEQ ID NO: 2674464 - RNA, 22 nt, Human
cuguauuuuauuuagacaagag

SEQ ID NO: 2674465 - RNA, 16 nt, Human
cuguaucauuuucuuu

SEQ ID NO: 2674466 - RNA, 20 nt, Human
cuguaugaaaaauuggggag

SEQ ID NO: 2674467 - RNA, 21 nt, Human
cuguaugaaaaauuggggagg

SEQ ID NO: 2674468 - RNA, 16 nt, Human
cugucaaugagagcau

SEQ ID NO: 2674469 - RNA, 22 nt, Human
cugucaaugagagcauaauuua

SEQ ID NO: 2674470 - RNA, 15 nt, Human
cugucaaugggaccu

SEQ ID NO: 2674471 - RNA, 19 nt, Human
cugucaaugggaccugugg

SEQ ID NO: 2674472 - RNA, 14 nt, Human
cugucaaaugaugu

SEQ ID NO: 2674473 - RNA, 18 nt, Human
cugucaaaugaugugcaa

SEQ ID NO: 2674474 - RNA, 15 nt, Human
cuguccccgcagccc

SEQ ID NO: 2674475 - RNA, 14 nt, Human
cuguccgagcuuug

SEQ ID NO: 2674476 - RNA, 13 nt, Human
cugucccugcgcc

SEQ ID NO: 2674477 - RNA, 11 nt, Human
cugucccugcg

SEQ ID NO: 2674478 - RNA, 17 nt, Human
cuguccccgcagcccug

SEQ ID NO: 2674479 - RNA, 23 nt, Human
cuguccccgcagcccuggcaggg

SEQ ID NO: 2674480 - RNA, 15 nt, Human
cuguccgagcuuuga

SEQ ID NO: 2674481 - RNA, 18 nt, Human
cugucccugcgccuuucc

SEQ ID NO: 2674482 - RNA, 18 nt, Human
cugucucaaaaaaagaaa

SEQ ID NO: 2674483 - RNA, 16 nt, Human
cugucucaaaaaaaga

SEQ ID NO: 2674484 - RNA, 15 nt, Human
cuguacaaaagcaau

SEQ ID NO: 2674485 - RNA, 20 nt, Human
cuguaauccuagcacuuugg

SEQ ID NO: 2674486 - RNA, 18 nt, Human
cuguaaucauuuguuuac

SEQ ID NO: 2674487 - RNA, 20 nt, Human
cuguaaucauuuguuuacau

SEQ ID NO: 2674488 - RNA, 12 nt, Human
cuguaauaauag

SEQ ID NO: 2674489 - RNA, 20 nt, Human
cuguaaucgcccuacuauuc

SEQ ID NO: 2674490 - RNA, 15 nt, Human
cugguccgugggacg

SEQ ID NO: 2674491 - RNA, 16 nt, Human
cugguccgugggacgg

SEQ ID NO: 2674492 - RNA, 17 nt, Human
cuggugcugcagcaccg

SEQ ID NO: 2674493 - RNA, 19 nt, Human
cugguccgugggacggugc

SEQ ID NO: 2674494 - RNA, 21 nt, Human
cugguccgugggacggugccc

SEQ ID NO: 2674495 - RNA, 14 nt, Human
cuggggggacccag

SEQ ID NO: 2674496 - RNA, 16 nt, Human
cuggggggacccagug

SEQ ID NO: 2674497 - RNA, 17 nt, Human
cuggggggacccagugc

SEQ ID NO: 2674498 - RNA, 18 nt, Human
cuggggggacccagugca

SEQ ID NO: 2674499 - RNA, 19 nt, Human
cuggggggacccagugcag

SEQ ID NO: 2674500 - RNA, 20 nt, Human
cuggggggacccagugcaga

SEQ ID NO: 2674501 - RNA, 21 nt, Human
cuggggggacccagugcagaa

SEQ ID NO: 2674502 - RNA, 20 nt, Human
cugggggacccaauguagga

SEQ ID NO: 2674503 - RNA, 15 nt, Human
cugggggaagaagcu

SEQ ID NO: 2674504 - RNA, 13 nt, Human
cugggggcacagg

SEQ ID NO: 2674505 - RNA, 14 nt, Human
cugggggcacagga

SEQ ID NO: 2674506 - RNA, 19 nt, Human
cugggggcacaggaggcag

SEQ ID NO: 2674507 - RNA, 17 nt, Human
cugggggcaacuggcca

SEQ ID NO: 2674508 - RNA, 13 nt, Human
cugggcuuggccu

SEQ ID NO: 2674509 - RNA, 13 nt, Human
cugggggaagaag

SEQ ID NO: 2674510 - RNA, 15 nt, Human
cuggggcugcuguga

SEQ ID NO: 2674511 - RNA, 20 nt, Human
cugggcuuggccugcuguga

SEQ ID NO: 2674512 - RNA, 14 nt, Human
cugggcuuggccug

SEQ ID NO: 2674513 - RNA, 15 nt, Human
cugggcuuggccugc

SEQ ID NO: 2674514 - RNA, 16 nt, Human
cugggcuuggccugcu

SEQ ID NO: 2674515 - RNA, 17 nt, Human
cugggcuuggccugcug

SEQ ID NO: 2674516 - RNA, 18 nt, Human
cugggcuuggccugcugu

SEQ ID NO: 2674517 - RNA, 16 nt, Human
cugguacaacggaggc

SEQ ID NO: 2674518 - RNA, 18 nt, Human
cugguacaacggaggccu

SEQ ID NO: 2674519 - RNA, 19 nt, Human
cugguacaacggaggccug

SEQ ID NO: 2674520 - RNA, 20 nt, Human
cuggguaacuagggaagaua

SEQ ID NO: 2674521 - RNA, 22 nt, Human
cuggguaacuagggaagauaau

SEQ ID NO: 2674522 - RNA, 16 nt, Human
cuguguuuauaaaaua

SEQ ID NO: 2674523 - RNA, 17 nt, Human
cuguguuuauaaaauau

SEQ ID NO: 2674524 - RNA, 19 nt, Human
cuguguuuauaaaauauaa

SEQ ID NO: 2674525 - RNA, 18 nt, Human
cuguguuuuauaaaauag

SEQ ID NO: 2674526 - RNA, 21 nt, Human
cugugugugugugugugcgug

SEQ ID NO: 2674527 - RNA, 23 nt, Human
cugugugugugugugugcgugug

SEQ ID NO: 2674528 - RNA, 23 nt, Human
cugugggcuacaugcugggguca

SEQ ID NO: 2674529 - RNA, 20 nt, Human
cuguucccauguagcccccu

SEQ ID NO: 2674530 - RNA, 21 nt, Human
cuguucagcugguugagguuu

SEQ ID NO: 2674531 - RNA, 19 nt, Human
cuguucagcugguugaggu

SEQ ID NO: 2674532 - RNA, 18 nt, Human
cuguucagcugguugagg

SEQ ID NO: 2674533 - RNA, 16 nt, Human
cuguucaguaauaaaa

SEQ ID NO: 2674534 - RNA, 14 nt, Human
cuguuacugggccc

SEQ ID NO: 2674535 - RNA, 15 nt, Human
cuguuacugggcccu

SEQ ID NO: 2674536 - RNA, 16 nt, Human
cuguuacugggcccug

SEQ ID NO: 2674537 - RNA, 20 nt, Human
cuguuacugggcccugaguc

SEQ ID NO: 2674538 - RNA, 13 nt, Human
cuguucggaaggg

SEQ ID NO: 2674539 - RNA, 18 nt, Human
cuguucggaagggguucc

SEQ ID NO: 2674540 - RNA, 22 nt, Human
cuguucggaagggguuccucaa

SEQ ID NO: 2674541 - RNA, 23 nt, Human
cuguucggaagggguuccucaaa

SEQ ID NO: 2674542 - RNA, 16 nt, Human
cuguuccuguucagua

SEQ ID NO: 2674543 - RNA, 18 nt, Human
cugugccucccuccccag

SEQ ID NO: 2674544 - RNA, 19 nt, Human
cugugccucccuccccagu

SEQ ID NO: 2674545 - RNA, 21 nt, Human
cugugccucccuccccagugc

SEQ ID NO: 2674546 - RNA, 23 nt, Human
cugugccucccuccccagugcaa

SEQ ID NO: 2674547 - RNA, 15 nt, Human
cugugcacacccacc

SEQ ID NO: 2674548 - RNA, 17 nt, Human
cugugcacacccaccuu

SEQ ID NO: 2674549 - RNA, 18 nt, Human
cugugcagucacuggagg

SEQ ID NO: 2674550 - RNA, 17 nt, Human
cugugcaacgccguggg

SEQ ID NO: 2674551 - RNA, 19 nt, Human
cugugauccacccaacccu

SEQ ID NO: 2674552 - RNA, 18 nt, Human
cugugcaacgccgugggc

SEQ ID NO: 2674553 - RNA, 21 nt, Human
cugugcaacgccgugggcugc

SEQ ID NO: 2674554 - RNA, 18 nt, Human
cugugcaacggucuccug

SEQ ID NO: 2674555 - RNA, 19 nt, Human
cugugcaacggucuccuga

SEQ ID NO: 2674556 - RNA, 22 nt, Human
cugugcaacggucuccugacug

SEQ ID NO: 2674557 - RNA, 16 nt, Human
cugugcaaggccuggu

SEQ ID NO: 2674558 - RNA, 21 nt, Human
cugugcaauagacacauacau

SEQ ID NO: 2674559 - RNA, 14 nt, Human
cugugagggagggg

SEQ ID NO: 2674560 - RNA, 15 nt, Human
cugugagggagggga

SEQ ID NO: 2674561 - RNA, 22 nt, Human
cugugagggaggggaaaagcau

SEQ ID NO: 2674562 - RNA, 20 nt, Human
cugugaucaauauuuuuaua

SEQ ID NO: 2674563 - RNA, 23 nt, Human
cugugaucaauauuuuuauauca

SEQ ID NO: 2674564 - RNA, 21 nt, Human
cugugcuucgguaggcgacca

SEQ ID NO: 2674565 - RNA, 17 nt, Human
cugugcuuccuccugcc

SEQ ID NO: 2674566 - RNA, 11 nt, Human
cugugcugugu

SEQ ID NO: 2674567 - RNA, 13 nt, Human
cugugcugugugu

SEQ ID NO: 2674568 - RNA, 18 nt, Human
cugugcugugugugacgu

SEQ ID NO: 2674569 - RNA, 17 nt, Human
cuguggaugauaaaaca

SEQ ID NO: 2674570 - RNA, 16 nt, Human
cuguggaugccagggc

SEQ ID NO: 2674571 - RNA, 15 nt, Human
cuguggcacuugccu

SEQ ID NO: 2674572 - RNA, 14 nt, Human
cuguggcauaaauu

SEQ ID NO: 2674573 - RNA, 15 nt, Human
cuguggcauaaauug

SEQ ID NO: 2674574 - RNA, 17 nt, Human
cuguggcauaaauugca

SEQ ID NO: 2674575 - RNA, 18 nt, Human
cuguggcauaaauugcau

SEQ ID NO: 2674576 - RNA, 21 nt, Human
cuguggcacuugccuggguca

SEQ ID NO: 2674577 - RNA, 16 nt, Human
cuguggcacuugccug

SEQ ID NO: 2674578 - RNA, 17 nt, Human
cuguggcacuugccugg

SEQ ID NO: 2674579 - RNA, 19 nt, Human
cuguggcacuugccugggu

SEQ ID NO: 2674580 - RNA, 20 nt, Human
cuguggcacuugccuggguc

SEQ ID NO: 2674581 - RNA, 17 nt, Human
cuguggcgccgucucca

SEQ ID NO: 2674582 - RNA, 19 nt, Human
cuguggcgccgucuccagg

SEQ ID NO: 2674583 - RNA, 20 nt, Human
cuguggcgccgucuccaggg

SEQ ID NO: 2674584 - RNA, 15 nt, Human
cuguggcuagugaca

SEQ ID NO: 2674585 - RNA, 15 nt, Human
cuguggcuccaggcc

SEQ ID NO: 2674586 - RNA, 16 nt, Human
cuguggcuccaggcca

SEQ ID NO: 2674587 - RNA, 18 nt, Human
cuguggcuccaggccaaa

SEQ ID NO: 2674588 - RNA, 21 nt, Human
cuguggcgccgucuccagggg

SEQ ID NO: 2674589 - RNA, 24 nt, Human
cuguggcgccgucuccaggggcug

SEQ ID NO: 2674590 - RNA, 12 nt, Human
gaaugugucagg

SEQ ID NO: 2674591 - RNA, 13 nt, Human
gaauguuaaaggg

SEQ ID NO: 2674592 - RNA, 23 nt, Human
gaauguauuuauuugggagaccg

SEQ ID NO: 2674593 - RNA, 14 nt, Human
gaauguacguccag

SEQ ID NO: 2674594 - RNA, 19 nt, Human
gaauucuguuuaauuuuca

SEQ ID NO: 2674595 - RNA, 11 nt, Human
gaauugaaggu

SEQ ID NO: 2674596 - RNA, 14 nt, Human
gaauugaagcagga

SEQ ID NO: 2674597 - RNA, 23 nt, Human
gaauguuagaguaaugaaaugga

SEQ ID NO: 2674598 - RNA, 18 nt, Human
gaauugaagguuuuugau

SEQ ID NO: 2674599 - RNA, 14 nt, Human
gaauguugggacug

SEQ ID NO: 2674600 - RNA, 23 nt, Human
gaauguugggacugcuaaauaaa

SEQ ID NO: 2674601 - RNA, 16 nt, Human
gaauccuuccauucca

SEQ ID NO: 2674602 - RNA, 21 nt, Human
gaaucaggaauauuuuccaaa

SEQ ID NO: 2674603 - RNA, 23 nt, Human
gaaucaggaauauuuuccaaaga

SEQ ID NO: 2674604 - RNA, 18 nt, Human
gaaucauucagaaauguu

SEQ ID NO: 2674605 - RNA, 15 nt, Human
gaaucucugugccuu

SEQ ID NO: 2674606 - RNA, 13 nt, Human
gaaucucugugcc

SEQ ID NO: 2674607 - RNA, 14 nt, Human
gaaucucugugccu

SEQ ID NO: 2674608 - RNA, 12 nt, Human
gaaucuggagac

SEQ ID NO: 2674609 - RNA, 12 nt, Human
gacaacugugac

SEQ ID NO: 2674610 - RNA, 13 nt, Human
gacaacugugacu

SEQ ID NO: 2674611 - RNA, 17 nt, Human
gacaacguuucagcgac

SEQ ID NO: 2674612 - RNA, 14 nt, Human
gacaacauguuuaa

SEQ ID NO: 2674613 - RNA, 20 nt, Human
gacaacauguuuaauaaaua

SEQ ID NO: 2674614 - RNA, 19 nt, Human
gaauuucugugcccuccug

SEQ ID NO: 2674615 - RNA, 10 nt, Human
gaauuugcau

SEQ ID NO: 2674616 - RNA, 17 nt, Human
gaauuugcauacuuacc

SEQ ID NO: 2674617 - RNA, 18 nt, Human
gaauuugcauacuuaccu

SEQ ID NO: 2674618 - RNA, 18 nt, Human
gacaauguuguagugucc

SEQ ID NO: 2674619 - RNA, 17 nt, Human
gacaauguuguaguguc

SEQ ID NO: 2674620 - RNA, 19 nt, Human
gacaauguuguaguguccc

SEQ ID NO: 2674621 - RNA, 13 nt, Human
gacaauucuguuu

SEQ ID NO: 2674622 - RNA, 20 nt, Human
gacaaugugaaaagaaaaau

SEQ ID NO: 2674623 - RNA, 19 nt, Human
gacaaugugaaaagaaaaa

SEQ ID NO: 2674624 - RNA, 20 nt, Human
gacaauggacccuuuuuguu

SEQ ID NO: 2674625 - RNA, 18 nt, Human
gacaaugugaaaagaaaa

SEQ ID NO: 2674626 - RNA, 12 nt, Human
gacaaugugaaa

SEQ ID NO: 2674627 - RNA, 20 nt, Human
gacaagcuggcuuacacugg

SEQ ID NO: 2674628 - RNA, 14 nt, Human
gacaagcuggcuua

SEQ ID NO: 2674629 - RNA, 18 nt, Human
gaccgcccuuuuccccua

SEQ ID NO: 2674630 - RNA, 17 nt, Human
gaccgcccuuuuccccu

SEQ ID NO: 2674631 - RNA, 12 nt, Human
gacccuuugggg

SEQ ID NO: 2674632 - RNA, 21 nt, Human
gacccugggugggcucugugc

SEQ ID NO: 2674633 - RNA, 22 nt, Human
gacccugguuauugauguggcc

SEQ ID NO: 2674634 - RNA, 12 nt, Human
gacccugucuca

SEQ ID NO: 2674635 - RNA, 17 nt, Human
gacccugggugggcucu

SEQ ID NO: 2674636 - RNA, 11 nt, Human
gacccuggggg

SEQ ID NO: 2674637 - RNA, 17 nt, Human
gacccugggggcacagg

SEQ ID NO: 2674638 - RNA, 18 nt, Human
gacccugggggcacagga

SEQ ID NO: 2674639 - RNA, 21 nt, Human
gacccugggggcacaggaggc

SEQ ID NO: 2674640 - RNA, 18 nt, Human
gacccugggugggcucug

SEQ ID NO: 2674641 - RNA, 19 nt, Human
gacccugggugggcucugu

SEQ ID NO: 2674642 - RNA, 22 nt, Human
gacccugggugggcucugugca

SEQ ID NO: 2674643 - RNA, 19 nt, Human
gaccauuuuuuaauuuacu

SEQ ID NO: 2674644 - RNA, 20 nt, Human
gaccauuuuuuaauuuacuu

SEQ ID NO: 2674645 - RNA, 23 nt, Human
gaccauuuuuuaauuuacuuguu

SEQ ID NO: 2674646 - RNA, 19 nt, Human
gacccaauguaggagcugc

SEQ ID NO: 2674647 - RNA, 18 nt, Human
gacccaauguaggagcug

SEQ ID NO: 2674648 - RNA, 22 nt, Human
gaccacgcccguccugccugug

SEQ ID NO: 2674649 - RNA, 15 nt, Human
gaccacuugaggccu

SEQ ID NO: 2674650 - RNA, 16 nt, Human
gaccacuugaggccug

SEQ ID NO: 2674651 - RNA, 17 nt, Human
gaccacuugaggccuga

SEQ ID NO: 2674652 - RNA, 17 nt, Human
gaccacgcccguccugc

SEQ ID NO: 2674653 - RNA, 19 nt, Human
gaccacgcccguccugccu

SEQ ID NO: 2674654 - RNA, 21 nt, Human
gaccacgcccguccugccugu

SEQ ID NO: 2674655 - RNA, 14 nt, Human
gaccacccugagcc

SEQ ID NO: 2674656 - RNA, 15 nt, Human
gaccacccugagccg

SEQ ID NO: 2674657 - RNA, 19 nt, Human
gaccaccgccccuggccgc

SEQ ID NO: 2674658 - RNA, 20 nt, Human
gacaguguauguagaagcau

SEQ ID NO: 2674659 - RNA, 22 nt, Human
gacaggaaccuuaaguaaucau

SEQ ID NO: 2674660 - RNA, 22 nt, Human
gacauacuccuuccaucaaaua

SEQ ID NO: 2674661 - RNA, 15 nt, Human
gacauccuccuccca

SEQ ID NO: 2674662 - RNA, 18 nt, Human
gacauccuccucccaccc

SEQ ID NO: 2674663 - RNA, 15 nt, Human
gacaugcaauaaaau

SEQ ID NO: 2674664 - RNA, 17 nt, Human
gacaugcaauaaaauuu

SEQ ID NO: 2674665 - RNA, 19 nt, Human
gacaugcaauaaaauuuaa

SEQ ID NO: 2674666 - RNA, 20 nt, Human
gacaugcaauaaaauuuaaa

SEQ ID NO: 2674667 - RNA, 22 nt, Human
gacagcuugagccgggccccug

SEQ ID NO: 2674668 - RNA, 15 nt, Human
gacagcuuuucucaa

SEQ ID NO: 2674669 - RNA, 15 nt, Human
gacagauaccuccaa

SEQ ID NO: 2674670 - RNA, 17 nt, Human
gacagauaccuccaacc

SEQ ID NO: 2674671 - RNA, 21 nt, Human
gacagauaccuccaacccugc

SEQ ID NO: 2674672 - RNA, 22 nt, Human
gacagauaccuccaacccugcc

SEQ ID NO: 2674673 - RNA, 23 nt, Human
gacagauaccuccaacccugccg

SEQ ID NO: 2674674 - RNA, 19 nt, Human
gacagagaggacuguaggg

SEQ ID NO: 2674675 - RNA, 15 nt, Human
gacagagaggacugu

SEQ ID NO: 2674676 - RNA, 16 nt, Human
gacagagaggacugua

SEQ ID NO: 2674677 - RNA, 21 nt, Human
gacagagcaagugagacccug

SEQ ID NO: 2674678 - RNA, 16 nt, Human
gacuuaaaaaaaccau

SEQ ID NO: 2674679 - RNA, 21 nt, Human
gacugcuuuggaccuaaaugg

SEQ ID NO: 2674680 - RNA, 14 nt, Human
gacugagugggaag

SEQ ID NO: 2674681 - RNA, 15 nt, Human
gacugcccggcaggg

SEQ ID NO: 2674682 - RNA, 13 nt, Human
gacugcccggcag

SEQ ID NO: 2674683 - RNA, 13 nt, Human
gacucgacucugu

SEQ ID NO: 2674684 - RNA, 16 nt, Human
gacucgacucugugcc

SEQ ID NO: 2674685 - RNA, 17 nt, Human
gacucgacucugugccu

SEQ ID NO: 2674686 - RNA, 17 nt, Human
gacuccguuggccacuc

SEQ ID NO: 2674687 - RNA, 16 nt, Human
gacuccguuggccacu

SEQ ID NO: 2674688 - RNA, 13 nt, Human
gaccuacucucau

SEQ ID NO: 2674689 - RNA, 18 nt, Human
gacucagagcucucucua

SEQ ID NO: 2674690 - RNA, 20 nt, Human
gacucagccuucagacagag

SEQ ID NO: 2674691 - RNA, 15 nt, Human
gacucagccuucaga

SEQ ID NO: 2674692 - RNA, 19 nt, Human
gacucagccuucagacaga

SEQ ID NO: 2674693 - RNA, 12 nt, Human
gacucagccuuc

SEQ ID NO: 2674694 - RNA, 14 nt, Human
gacucagccuucag

SEQ ID NO: 2674695 - RNA, 22 nt, Human
gacuugaaaagagacaggcagg

SEQ ID NO: 2674696 - RNA, 21 nt, Human
gacuugaaaagagacaggcag

SEQ ID NO: 2674697 - RNA, 17 nt, Human
gacuugaaaagagacag

SEQ ID NO: 2674698 - RNA, 11 nt, Human
gacuugaaaag

SEQ ID NO: 2674699 - RNA, 15 nt, Human
gacuucuaccugccc

SEQ ID NO: 2674700 - RNA, 21 nt, Human
gacuugccagagccgggcaca

SEQ ID NO: 2674701 - RNA, 22 nt, Human
gacuuguauagcaugaaauaaa

SEQ ID NO: 2674702 - RNA, 23 nt, Human
gacuuguauagcaugaaauaaaa

SEQ ID NO: 2674703 - RNA, 17 nt, Human
gacuucugccuggagac

SEQ ID NO: 2674704 - RNA, 15 nt, Human
gacuucugccuggag

SEQ ID NO: 2674705 - RNA, 16 nt, Human
gacuucugccuggaga

SEQ ID NO: 2674706 - RNA, 13 nt, Human
gacuucugccugg

SEQ ID NO: 2674707 - RNA, 14 nt, Human
gacuucugccugga

SEQ ID NO: 2674708 - RNA, 20 nt, Human
gacuuccuugagacacggag

SEQ ID NO: 2674709 - RNA, 16 nt, Human
gacuuccuugagacac

SEQ ID NO: 2674710 - RNA, 20 nt, Human
gacuuaacugcauuuuuaga

SEQ ID NO: 2674711 - RNA, 23 nt, Human
gacuuaacauagccaaaauguga

SEQ ID NO: 2674712 - RNA, 21 nt, Human
gacuuaacauagccaaaaugu

SEQ ID NO: 2674713 - RNA, 17 nt, Human
gacuuaacauagccaaa

SEQ ID NO: 2674714 - RNA, 15 nt, Human
gacuuccuugagaca

SEQ ID NO: 2674715 - RNA, 16 nt, Human
gagaagcagaggaagg

SEQ ID NO: 2674716 - RNA, 20 nt, Human
gagaagaaaggugaguuuga

SEQ ID NO: 2674717 - RNA, 22 nt, Human
gagaagcaaguaaaaaggcuaa

SEQ ID NO: 2674718 - RNA, 20 nt, Human
gagaacucgcgcucaguaaa

SEQ ID NO: 2674719 - RNA, 22 nt, Human
gagaacucgcgcucaguaaacg

SEQ ID NO: 2674720 - RNA, 14 nt, Human
gagaacucuggcuu

SEQ ID NO: 2674721 - RNA, 13 nt, Human
gagaaaugaaaac

SEQ ID NO: 2674722 - RNA, 14 nt, Human
gagaaaugaaaaca

SEQ ID NO: 2674723 - RNA, 19 nt, Human
gagaaagaggcaccaggaa

SEQ ID NO: 2674724 - RNA, 14 nt, Human
gagagagagaggac

SEQ ID NO: 2674725 - RNA, 12 nt, Human
gagagagaggac

SEQ ID NO: 2674726 - RNA, 13 nt, Human
gagagagaggaca

SEQ ID NO: 2674727 - RNA, 14 nt, Human
gagagagagagaga

SEQ ID NO: 2674728 - RNA, 14 nt, Human
gagagagagagagg

SEQ ID NO: 2674729 - RNA, 13 nt, Human
gagagagagagga

SEQ ID NO: 2674730 - RNA, 13 nt, Human
gagaggggcacag

SEQ ID NO: 2674731 - RNA, 15 nt, Human
gagagucuggcccua

SEQ ID NO: 2674732 - RNA, 17 nt, Human
gagaguauuuuuauaca

SEQ ID NO: 2674733 - RNA, 22 nt, Human
gagaguauuuuuauacaaaccu

SEQ ID NO: 2674734 - RNA, 14 nt, Human
gagagucuggcccu

SEQ ID NO: 2674735 - RNA, 13 nt, Human
gagagucuggccc

SEQ ID NO: 2674736 - RNA, 15 nt, Human
gagaagagcgcagug

SEQ ID NO: 2674737 - RNA, 20 nt, Human
gagaauggcgugaacccggg

SEQ ID NO: 2674738 - RNA, 20 nt, Human
gagaauggugugaacccggg

SEQ ID NO: 2674739 - RNA, 21 nt, Human
gagaauggugugaacccggga

SEQ ID NO: 2674740 - RNA, 23 nt, Human
gagaauggugugaacccgggagc

SEQ ID NO: 2674741 - RNA, 12 nt, Human
gagaccauccug

SEQ ID NO: 2674742 - RNA, 14 nt, Human
gagaccauccuggc

SEQ ID NO: 2674743 - RNA, 15 nt, Human
gagaccauccuggcu

SEQ ID NO: 2674744 - RNA, 16 nt, Human
gagaccauccuggcua

SEQ ID NO: 2674745 - RNA, 15 nt, Human
gagacuggguaggaa

SEQ ID NO: 2674746 - RNA, 22 nt, Human
gagagaaagugugagcaaacua

SEQ ID NO: 2674747 - RNA, 12 nt, Human
gagauccuccug

SEQ ID NO: 2674748 - RNA, 13 nt, Human
gagauccaaagac

SEQ ID NO: 2674749 - RNA, 14 nt, Human
gagccauacauaaa

SEQ ID NO: 2674750 - RNA, 18 nt, Human
gagcccagcccuccccau

SEQ ID NO: 2674751 - RNA, 15 nt, Human
gagcccagcccuccc

SEQ ID NO: 2674752 - RNA, 24 nt, Human
gagcagagacaugacucagccugu

SEQ ID NO: 2674753 - RNA, 15 nt, Human
gagcaugucguggac

SEQ ID NO: 2674754 - RNA, 14 nt, Human
gagggugggggagg

SEQ ID NO: 2674755 - RNA, 15 nt, Human
gagggugggggaggg

SEQ ID NO: 2674756 - RNA, 17 nt, Human
gagggugggggagggag

SEQ ID NO: 2674757 - RNA, 17 nt, Human
gaggucaaggcugcagu

SEQ ID NO: 2674758 - RNA, 13 nt, Human
gagguacccuggg

SEQ ID NO: 2674759 - RNA, 14 nt, Human
gagguauuaaaacu

SEQ ID NO: 2674760 - RNA, 15 nt, Human
gaggucacuggaaag

SEQ ID NO: 2674761 - RNA, 16 nt, Human
gaggucacuggaaagg

SEQ ID NO: 2674762 - RNA, 17 nt, Human
gaggucacuggaaaggg

SEQ ID NO: 2674763 - RNA, 13 nt, Human
gagggugggaagg

SEQ ID NO: 2674764 - RNA, 12 nt, Human
gaggguggaaua

SEQ ID NO: 2674765 - RNA, 21 nt, Human
gaggguaggagggugggaagg

SEQ ID NO: 2674766 - RNA, 13 nt, Human
gagggagagagag

SEQ ID NO: 2674767 - RNA, 15 nt, Human
gagggagagagagag

SEQ ID NO: 2674768 - RNA, 16 nt, Human
gagggagagagagaga

SEQ ID NO: 2674769 - RNA, 22 nt, Human
gagggagagagagagagagagg

SEQ ID NO: 2674770 - RNA, 13 nt, Human
gagggagagggag

SEQ ID NO: 2674771 - RNA, 23 nt, Human
gaggcuguggucacagcggaggu

SEQ ID NO: 2674772 - RNA, 12 nt, Human
gagggaggggaa

SEQ ID NO: 2674773 - RNA, 21 nt, Human
gagggaggggaaaagcauuuu

SEQ ID NO: 2674774 - RNA, 13 nt, Human
gagggcagcugcu

SEQ ID NO: 2674775 - RNA, 14 nt, Human
gagggcagcugcua

SEQ ID NO: 2674776 - RNA, 18 nt, Human
gagggauucugguuccag

SEQ ID NO: 2674777 - RNA, 21 nt, Human
gagggauucugguuccagggu

SEQ ID NO: 2674778 - RNA, 20 nt, Human
gaggggucccuagcagccca

SEQ ID NO: 2674779 - RNA, 14 nt, Human
gagggguguggcag

SEQ ID NO: 2674780 - RNA, 17 nt, Human
gagggguguggcagugg

SEQ ID NO: 2674781 - RNA, 18 nt, Human
gagggguguggcaguggu

SEQ ID NO: 2674782 - RNA, 15 nt, Human
gaggguaaauaaacc

SEQ ID NO: 2674783 - RNA, 14 nt, Human
gagggggccgggcg

SEQ ID NO: 2674784 - RNA, 21 nt, Human
gagggggccgggcgcgguggc

SEQ ID NO: 2674785 - RNA, 17 nt, Human
gagggggcuugaagcca

SEQ ID NO: 2674786 - RNA, 18 nt, Human
gagggggcuugaagccaa

SEQ ID NO: 2674787 - RNA, 13 nt, Human
gaggaucucuuga

SEQ ID NO: 2674788 - RNA, 19 nt, Human
gaggaucucuugagccugg

SEQ ID NO: 2674789 - RNA, 16 nt, Human
gaggaucucuugagcc

SEQ ID NO: 2674790 - RNA, 22 nt, Human
gaggaucucuugagccugggag

SEQ ID NO: 2674791 - RNA, 20 nt, Human
gaggcaaagcuggcucaccu

SEQ ID NO: 2674792 - RNA, 16 nt, Human
gaggcaaagcuggcuc

SEQ ID NO: 2674793 - RNA, 17 nt, Human
gaggaugcuaaaaaugu

SEQ ID NO: 2674794 - RNA, 20 nt, Human
gaggauugcuugagcucagg

SEQ ID NO: 2674795 - RNA, 16 nt, Human
gaggcagggaggcagc

SEQ ID NO: 2674796 - RNA, 17 nt, Human
gaggcagggaggcagcc

SEQ ID NO: 2674797 - RNA, 18 nt, Human
gaggcagggaggcagccg

SEQ ID NO: 2674798 - RNA, 14 nt, Human
gaggcaggcuccag

SEQ ID NO: 2674799 - RNA, 21 nt, Human
gaggccguugcugacuuagaa

SEQ ID NO: 2674800 - RNA, 18 nt, Human
gaggccuaccccgcagac

SEQ ID NO: 2674801 - RNA, 22 nt, Human
gaggcgcccuuggcuucuguga

SEQ ID NO: 2674802 - RNA, 14 nt, Human
gaggcgcggaguga

SEQ ID NO: 2674803 - RNA, 12 nt, Human
gaggccccaggg

SEQ ID NO: 2674804 - RNA, 14 nt, Human
gaggccccaggggg

SEQ ID NO: 2674805 - RNA, 14 nt, Human
gaggccaugugcau

SEQ ID NO: 2674806 - RNA, 21 nt, Human
gaggccaugugcauaguuucu

SEQ ID NO: 2674807 - RNA, 22 nt, Human
gaggccaugugcauaguuucuu

SEQ ID NO: 2674808 - RNA, 20 nt, Human
gaucacaaaugacuuuauua

SEQ ID NO: 2674809 - RNA, 16 nt, Human
gaucacaaaugacuuu

SEQ ID NO: 2674810 - RNA, 13 nt, Human
gaucacaaaugac

SEQ ID NO: 2674811 - RNA, 12 nt, Human
gaucacaaauga

SEQ ID NO: 2674812 - RNA, 18 nt, Human
gaucacuguuuagauuug

SEQ ID NO: 2674813 - RNA, 14 nt, Human
gaucacuguuuaga

SEQ ID NO: 2674814 - RNA, 21 nt, Human
gaucacuguuuagauuugcca

SEQ ID NO: 2674815 - RNA, 16 nt, Human
gauagcuaacuguaaa

SEQ ID NO: 2674816 - RNA, 19 nt, Human
gauagcuaacuguaaauca

SEQ ID NO: 2674817 - RNA, 20 nt, Human
gauagcuaacuguaaaucau

SEQ ID NO: 2674818 - RNA, 14 nt, Human
gauauaaauuuuua

SEQ ID NO: 2674819 - RNA, 18 nt, Human
gauauaaauuuuuaagag

SEQ ID NO: 2674820 - RNA, 21 nt, Human
gauauaaauuuuuaagagaaa

SEQ ID NO: 2674821 - RNA, 16 nt, Human
gauaacuuuacagaaa

SEQ ID NO: 2674822 - RNA, 19 nt, Human
gauaacuuuacagaaaugg

SEQ ID NO: 2674823 - RNA, 17 nt, Human
gagugucuggaauugug

SEQ ID NO: 2674824 - RNA, 18 nt, Human
gagugucuggaauugugg

SEQ ID NO: 2674825 - RNA, 20 nt, Human
gagugugccugaagucccag

SEQ ID NO: 2674826 - RNA, 13 nt, Human
gaguguaugagua

SEQ ID NO: 2674827 - RNA, 15 nt, Human
gaguguagacugugg

SEQ ID NO: 2674828 - RNA, 17 nt, Human
gaguguagacuguggcu

SEQ ID NO: 2674829 - RNA, 13 nt, Human
gagugggugaaua

SEQ ID NO: 2674830 - RNA, 13 nt, Human
gaguuaagguggg

SEQ ID NO: 2674831 - RNA, 21 nt, Human
gagucguggggugugcuggga

SEQ ID NO: 2674832 - RNA, 22 nt, Human
gagucguggggugugcugggag

SEQ ID NO: 2674833 - RNA, 18 nt, Human
gagucuaauagucuuugc

SEQ ID NO: 2674834 - RNA, 19 nt, Human
gagucuaauagucuuugcc

SEQ ID NO: 2674835 - RNA, 20 nt, Human
gaguauucuaauaagcuagu

SEQ ID NO: 2674836 - RNA, 21 nt, Human
gaguauucucggauaguugcu

SEQ ID NO: 2674837 - RNA, 18 nt, Human
gaguauugaaugguggug

SEQ ID NO: 2674838 - RNA, 20 nt, Human
gaguauuguuuaaaauguaa

SEQ ID NO: 2674839 - RNA, 12 nt, Human
gaguauucuaau

SEQ ID NO: 2674840 - RNA, 21 nt, Human
gaguagccagguucugccggu

SEQ ID NO: 2674841 - RNA, 22 nt, Human
gagucuguugugugucaugcca

SEQ ID NO: 2674842 - RNA, 18 nt, Human
gagucuggcccuagacuc

SEQ ID NO: 2674843 - RNA, 16 nt, Human
gagucuguucugguaa

SEQ ID NO: 2674844 - RNA, 20 nt, Human
gagucuguugugugucaugc

SEQ ID NO: 2674845 - RNA, 15 nt, Human
gagugaaaaagagaa

SEQ ID NO: 2674846 - RNA, 19 nt, Human
gagugaaccccacgcccug

SEQ ID NO: 2674847 - RNA, 15 nt, Human
gaguagaaaauguga

SEQ ID NO: 2674848 - RNA, 16 nt, Human
gaguagaaaaugugac

SEQ ID NO: 2674849 - RNA, 23 nt, Human
gaguagaaaaugugacccuccaa

SEQ ID NO: 2674850 - RNA, 17 nt, Human
gaguaaucuuguugguu

SEQ ID NO: 2674851 - RNA, 16 nt, Human
gagguugugcacuguu

SEQ ID NO: 2674852 - RNA, 16 nt, Human
gagguuucaaaccucc

SEQ ID NO: 2674853 - RNA, 13 nt, Human
gagguugaagcca

SEQ ID NO: 2674854 - RNA, 15 nt, Human
gagguugaagccaag

SEQ ID NO: 2674855 - RNA, 15 nt, Human
gagguugcagugagc

SEQ ID NO: 2674856 - RNA, 18 nt, Human
gagguuccucugccugcc

SEQ ID NO: 2674857 - RNA, 19 nt, Human
gagguuccucugccugccc

SEQ ID NO: 2674858 - RNA, 18 nt, Human
gagguugaaaaacaaaau

SEQ ID NO: 2674859 - RNA, 16 nt, Human
gagguuccucugccug

SEQ ID NO: 2674860 - RNA, 17 nt, Human
gagguuccucugccugc

SEQ ID NO: 2674861 - RNA, 16 nt, Human
gagguguggagccgag

SEQ ID NO: 2674862 - RNA, 21 nt, Human
gaggugggccagucuguggau

SEQ ID NO: 2674863 - RNA, 21 nt, Human
gaggucacuggaaaggggaga

SEQ ID NO: 2674864 - RNA, 18 nt, Human
gaggucacuggaaagggg

SEQ ID NO: 2674865 - RNA, 20 nt, Human
gaggucacuggaaaggggag

SEQ ID NO: 2674866 - RNA, 14 nt, Human
gcaccuugugccug

SEQ ID NO: 2674867 - RNA, 15 nt, Human
gcaccuugugccugg

SEQ ID NO: 2674868 - RNA, 18 nt, Human
gcaccuugugccuggggu

SEQ ID NO: 2674869 - RNA, 19 nt, Human
gcaccuugugccuggggug

SEQ ID NO: 2674870 - RNA, 15 nt, Human
gcaccuguaguccca

SEQ ID NO: 2674871 - RNA, 16 nt, Human
gcaccuguagucccag

SEQ ID NO: 2674872 - RNA, 17 nt, Human
gcaccuguagucccagc

SEQ ID NO: 2674873 - RNA, 18 nt, Human
gcaccuguagucccagcu

SEQ ID NO: 2674874 - RNA, 12 nt, Human
gcaccauaacuu

SEQ ID NO: 2674875 - RNA, 16 nt, Human
gcacagugaagugcug

SEQ ID NO: 2674876 - RNA, 12 nt, Human
gcacauguuucc

SEQ ID NO: 2674877 - RNA, 14 nt, Human
gcacauugagcugu

SEQ ID NO: 2674878 - RNA, 18 nt, Human
gcacauugagcugugcaa

SEQ ID NO: 2674879 - RNA, 18 nt, Human
gcaccaggcgcugcccac

SEQ ID NO: 2674880 - RNA, 18 nt, Human
gcaccaggaagccguccu

SEQ ID NO: 2674881 - RNA, 16 nt, Human
gcaccagggguuucuc

SEQ ID NO: 2674882 - RNA, 18 nt, Human
gcaccagggguuucucgc

SEQ ID NO: 2674883 - RNA, 19 nt, Human
gcaccagggguuucucgca

SEQ ID NO: 2674884 - RNA, 14 nt, Human
gcaccaggaagccg

SEQ ID NO: 2674885 - RNA, 15 nt, Human
gcagacaccuuggac

SEQ ID NO: 2674886 - RNA, 17 nt, Human
gcacugacugggcauag

SEQ ID NO: 2674887 - RNA, 14 nt, Human
gcacagaauauuuu

SEQ ID NO: 2674888 - RNA, 18 nt, Human
gcaauugaauuaaauuag

SEQ ID NO: 2674889 - RNA, 17 nt, Human
gcaauguaagcauacuu

SEQ ID NO: 2674890 - RNA, 14 nt, Human
gcaaugugauaaaa

SEQ ID NO: 2674891 - RNA, 14 nt, Human
gcaacucaucuuag

SEQ ID NO: 2674892 - RNA, 23 nt, Human
gcaacgaucacaaaugacuuuau

SEQ ID NO: 2674893 - RNA, 22 nt, Human
gcaacgccgugggcugcguccu

SEQ ID NO: 2674894 - RNA, 22 nt, Human
gcaacggucuccugacuggugc

SEQ ID NO: 2674895 - RNA, 22 nt, Human
gcaacgaucacaaaugacuuua

SEQ ID NO: 2674896 - RNA, 21 nt, Human
gcaacgaucacaaaugacuuu

SEQ ID NO: 2674897 - RNA, 20 nt, Human
gcaacgaucacaaaugacuu

SEQ ID NO: 2674898 - RNA, 16 nt, Human
gcaacgaucacaaaug

SEQ ID NO: 2674899 - RNA, 14 nt, Human
gcaacacagccugg

SEQ ID NO: 2674900 - RNA, 15 nt, Human
gcaacacagccuggg

SEQ ID NO: 2674901 - RNA, 19 nt, Human
gcaaugguaguuucugugg

SEQ ID NO: 2674902 - RNA, 17 nt, Human
gcaaugguaguuucugu

SEQ ID NO: 2674903 - RNA, 18 nt, Human
gaugccaguuacuugcuu

SEQ ID NO: 2674904 - RNA, 17 nt, Human
gaugccagggccgacca

SEQ ID NO: 2674905 - RNA, 23 nt, Human
gaucacuuagcgaacccuuuauu

SEQ ID NO: 2674906 - RNA, 12 nt, Human
gauggccccagc

SEQ ID NO: 2674907 - RNA, 14 nt, Human
gauggccccagcac

SEQ ID NO: 2674908 - RNA, 15 nt, Human
gauggccccagcaca

SEQ ID NO: 2674909 - RNA, 22 nt, Human
gauggccgggcgcgguggcuca

SEQ ID NO: 2674910 - RNA, 21 nt, Human
gauguuacaaguuuauauaua

SEQ ID NO: 2674911 - RNA, 23 nt, Human
gauguggcccuggcugccggcac

SEQ ID NO: 2674912 - RNA, 21 nt, Human
gauguggcuacugacauaucu

SEQ ID NO: 2674913 - RNA, 16 nt, Human
gaugguguggccugug

SEQ ID NO: 2674914 - RNA, 19 nt, Human
gaugguguggccuguggcu

SEQ ID NO: 2674915 - RNA, 15 nt, Human
gaugguaucauauau

SEQ ID NO: 2674916 - RNA, 13 nt, Human
gauggucauccag

SEQ ID NO: 2674917 - RNA, 14 nt, Human
gauuacacacguga

SEQ ID NO: 2674918 - RNA, 12 nt, Human
gauuaaauacau

SEQ ID NO: 2674919 - RNA, 13 nt, Human
gauuaaauacaua

SEQ ID NO: 2674920 - RNA, 19 nt, Human
gauuaaauacauauggaug

SEQ ID NO: 2674921 - RNA, 22 nt, Human
gauuaaaaauaucaaauuaauu

SEQ ID NO: 2674922 - RNA, 19 nt, Human
gauguugccauguguuuua

SEQ ID NO: 2674923 - RNA, 14 nt, Human
gauguuuaaaacac

SEQ ID NO: 2674924 - RNA, 23 nt, Human
gauguuuaaaacaccuucuauag

SEQ ID NO: 2674925 - RNA, 22 nt, Human
gauguuuaaaacaccuucuaua

SEQ ID NO: 2674926 - RNA, 17 nt, Human
gauguugccauguguuu

SEQ ID NO: 2674927 - RNA, 13 nt, Human
gauguugccaugu

SEQ ID NO: 2674928 - RNA, 15 nt, Human
gauguugccaugugu

SEQ ID NO: 2674929 - RNA, 12 nt, Human
gcaaauguuaaa

SEQ ID NO: 2674930 - RNA, 23 nt, Human
gcaaauguuaaaaguuuuauaug

SEQ ID NO: 2674931 - RNA, 22 nt, Human
gcaaagggccugcccagacaag

SEQ ID NO: 2674932 - RNA, 15 nt, Human
gcaacaacaauuggu

SEQ ID NO: 2674933 - RNA, 21 nt, Human
gcaacaacaauugguaaaacu

SEQ ID NO: 2674934 - RNA, 22 nt, Human
gcaacaacaauugguaaaacuc

SEQ ID NO: 2674935 - RNA, 22 nt, Human
gcaacaagaccaccacuucgaa

SEQ ID NO: 2674936 - RNA, 16 nt, Human
gcaaagauuuaaucug

SEQ ID NO: 2674937 - RNA, 23 nt, Human
gcaaaggaaacuuugcagaugug

SEQ ID NO: 2674938 - RNA, 20 nt, Human
gcaaaggaagguggauggcc

SEQ ID NO: 2674939 - RNA, 15 nt, Human
gcaaaggaaggugga

SEQ ID NO: 2674940 - RNA, 17 nt, Human
gauuuuuaaaaaauauu

SEQ ID NO: 2674941 - RNA, 21 nt, Human
gauuuuuaaaaaauauuuucu

SEQ ID NO: 2674942 - RNA, 17 nt, Human
gauuuucuuuugccuuu

SEQ ID NO: 2674943 - RNA, 22 nt, Human
gauuuuaauagggaauauaucu

SEQ ID NO: 2674944 - RNA, 23 nt, Human
gauuuuaauagggaauauaucuc

SEQ ID NO: 2674945 - RNA, 11 nt, Human
gauuugcaaua

SEQ ID NO: 2674946 - RNA, 15 nt, Human
gauuuuaacuuaacu

SEQ ID NO: 2674947 - RNA, 20 nt, Human
gauuuuaacuuaacugaaau

SEQ ID NO: 2674948 - RNA, 17 nt, Human
gauuuuacagagcgcac

SEQ ID NO: 2674949 - RNA, 15 nt, Human
gauuuucuuuugccu

SEQ ID NO: 2674950 - RNA, 12 nt, Human
gauuuaaaucag

SEQ ID NO: 2674951 - RNA, 12 nt, Human
gauuuaaaugcc

SEQ ID NO: 2674952 - RNA, 22 nt, Human
gauuuccucccucugccccucc

SEQ ID NO: 2674953 - RNA, 18 nt, Human
gauucucaaaggagcgag

SEQ ID NO: 2674954 - RNA, 18 nt, Human
gauuaaagcuaaggaccu

SEQ ID NO: 2674955 - RNA, 13 nt, Human
gauugccucugaa

SEQ ID NO: 2674956 - RNA, 14 nt, Human
gauugccucugaaa

SEQ ID NO: 2674957 - RNA, 14 nt, Human
gauugagugagggc

SEQ ID NO: 2674958 - RNA, 19 nt, Human
gauugauaucuauaaaaua

SEQ ID NO: 2674959 - RNA, 18 nt, Human
ggaugcaggcuccccuga

SEQ ID NO: 2674960 - RNA, 13 nt, Human
ggaugauuuaagu

SEQ ID NO: 2674961 - RNA, 17 nt, Human
ggauccgacugcuuugg

SEQ ID NO: 2674962 - RNA, 19 nt, Human
ggauccgacugcuuuggac

SEQ ID NO: 2674963 - RNA, 21 nt, Human
ggauccgacugcuuuggaccu

SEQ ID NO: 2674964 - RNA, 18 nt, Human
ggauauugaauguuaaag

SEQ ID NO: 2674965 - RNA, 16 nt, Human
ggauaguugcuauuuu

SEQ ID NO: 2674966 - RNA, 19 nt, Human
ggauauauaggcuauuuuc

SEQ ID NO: 2674967 - RNA, 15 nt, Human
ggauugccucugaaa

SEQ ID NO: 2674968 - RNA, 20 nt, Human
ggcacccaccguggaggagg

SEQ ID NO: 2674969 - RNA, 21 nt, Human
ggcacccaccguggaggagga

SEQ ID NO: 2674970 - RNA, 18 nt, Human
ggcaaugguaguuucugu

SEQ ID NO: 2674971 - RNA, 17 nt, Human
ggcaaugguaguuucug

SEQ ID NO: 2674972 - RNA, 16 nt, Human
ggcaaugguaguuucu

SEQ ID NO: 2674973 - RNA, 19 nt, Human
ggcaauaaauuuugaaaag

SEQ ID NO: 2674974 - RNA, 17 nt, Human
ggcaauaaauuuugaaa

SEQ ID NO: 2674975 - RNA, 16 nt, Human
ggcaauaaauuuugaa

SEQ ID NO: 2674976 - RNA, 14 nt, Human
ggcaauauuaaccu

SEQ ID NO: 2674977 - RNA, 12 nt, Human
ggccacauggcg

SEQ ID NO: 2674978 - RNA, 16 nt, Human
ggccacauggcggaga

SEQ ID NO: 2674979 - RNA, 22 nt, Human
ggccagccuccgagagggagag

SEQ ID NO: 2674980 - RNA, 23 nt, Human
ggccacgugggcaaacaggcagu

SEQ ID NO: 2674981 - RNA, 13 nt, Human
ggccacuccgaga

SEQ ID NO: 2674982 - RNA, 16 nt, Human
ggcauggcccugggcg

SEQ ID NO: 2674983 - RNA, 13 nt, Human
ggccaccaaagcu

SEQ ID NO: 2674984 - RNA, 15 nt, Human
ggccaccaaagcugc

SEQ ID NO: 2674985 - RNA, 16 nt, Human
ggccaccaaagcugcc

SEQ ID NO: 2674986 - RNA, 17 nt, Human
ggccaccaaagcugccc

SEQ ID NO: 2674987 - RNA, 18 nt, Human
ggccaccaaagcugccca

SEQ ID NO: 2674988 - RNA, 14 nt, Human
ggccauucugccgc

SEQ ID NO: 2674989 - RNA, 20 nt, Human
ggccauucugccgcccccuc

SEQ ID NO: 2674990 - RNA, 14 nt, Human
ggccauuugcaaua

SEQ ID NO: 2674991 - RNA, 18 nt, Human
ggccauuugcaauaacag

SEQ ID NO: 2674992 - RNA, 20 nt, Human
ggccauuugcaauaacagcu

SEQ ID NO: 2674993 - RNA, 21 nt, Human
ggccauuugcaauaacagcug

SEQ ID NO: 2674994 - RNA, 22 nt, Human
ggccauuugcaauaacagcugc

SEQ ID NO: 2674995 - RNA, 23 nt, Human
ggccauuugcaauaacagcugca

SEQ ID NO: 2674996 - RNA, 16 nt, Human
ggccauguaugaagcc

SEQ ID NO: 2674997 - RNA, 13 nt, Human
ggccauguccaaa

SEQ ID NO: 2674998 - RNA, 15 nt, Human
ggccauguccaaaga

SEQ ID NO: 2674999 - RNA, 16 nt, Human
ggccauguccaaagag

SEQ ID NO: 2675000 - RNA, 23 nt, Human
ggccaugugcauaguuucuuuau

SEQ ID NO: 2675001 - RNA, 22 nt, Human
ggccauguccaaagaggcugcc

SEQ ID NO: 2675002 - RNA, 23 nt, Human
ggccauguccaaagaggcugccc

SEQ ID NO: 2675003 - RNA, 13 nt, Human
ggccagcguggcu

SEQ ID NO: 2675004 - RNA, 16 nt, Human
ggcaccuuuuacugug

SEQ ID NO: 2675005 - RNA, 17 nt, Human
ggcacgcacuggguugc

SEQ ID NO: 2675006 - RNA, 14 nt, Human
ggcacggguggucc

SEQ ID NO: 2675007 - RNA, 15 nt, Human
ggcacgggugguccc

SEQ ID NO: 2675008 - RNA, 17 nt, Human
ggcacgggugguccccg

SEQ ID NO: 2675009 - RNA, 16 nt, Human
ggcacuagccaaagcg

SEQ ID NO: 2675010 - RNA, 17 nt, Human
ggcaugcggucgggcag

SEQ ID NO: 2675011 - RNA, 16 nt, Human
ggcaugcggucgggca

SEQ ID NO: 2675012 - RNA, 13 nt, Human
ggcccuggcugcc

SEQ ID NO: 2675013 - RNA, 17 nt, Human
ggcccuggccuccccug

SEQ ID NO: 2675014 - RNA, 13 nt, Human
ggcccuggccucc

SEQ ID NO: 2675015 - RNA, 14 nt, Human
ggcccuggccuccc

SEQ ID NO: 2675016 - RNA, 18 nt, Human
ggcccugagucugggcag

SEQ ID NO: 2675017 - RNA, 19 nt, Human
ggcccugagucugggcagc

SEQ ID NO: 2675018 - RNA, 22 nt, Human
ggcccacgccuguaaucccagc

SEQ ID NO: 2675019 - RNA, 18 nt, Human
ggccaggcugccuggccu

SEQ ID NO: 2675020 - RNA, 16 nt, Human
ggccucugugccuucu

SEQ ID NO: 2675021 - RNA, 14 nt, Human
ggccuauuucauca

SEQ ID NO: 2675022 - RNA, 15 nt, Human
ggcccuggguuccuc

SEQ ID NO: 2675023 - RNA, 14 nt, Human
ggcccugggcugga

SEQ ID NO: 2675024 - RNA, 15 nt, Human
ggcccugggcuggaa

SEQ ID NO: 2675025 - RNA, 12 nt, Human
ggcccugggcug

SEQ ID NO: 2675026 - RNA, 13 nt, Human
ggcccugggcugg

SEQ ID NO: 2675027 - RNA, 16 nt, Human
ggccguaucuccggcu

SEQ ID NO: 2675028 - RNA, 22 nt, Human
ggccguaucuccggcucccagc

SEQ ID NO: 2675029 - RNA, 21 nt, Human
ggccguaucuccggcucccag

SEQ ID NO: 2675030 - RNA, 20 nt, Human
ggccguaucuccggcuccca

SEQ ID NO: 2675031 - RNA, 19 nt, Human
ggccguaucuccggcuccc

SEQ ID NO: 2675032 - RNA, 18 nt, Human
ggccguaucuccggcucc

SEQ ID NO: 2675033 - RNA, 23 nt, Human
ggccuacagcuuugaucccugac

SEQ ID NO: 2675034 - RNA, 20 nt, Human
ggccuacagcuuugaucccu

SEQ ID NO: 2675035 - RNA, 16 nt, Human
ggccuaccccgcagac

SEQ ID NO: 2675036 - RNA, 20 nt, Human
ggccuaccccgcagacaccu

SEQ ID NO: 2675037 - RNA, 23 nt, Human
ggccuaccccgcagacaccuugg

SEQ ID NO: 2675038 - RNA, 19 nt, Human
ggccuagcgaucucuccug

SEQ ID NO: 2675039 - RNA, 21 nt, Human
ggccuagcgaucucuccuggc

SEQ ID NO: 2675040 - RNA, 22 nt, Human
ggccuagcgaucucuccuggcc

SEQ ID NO: 2675041 - RNA, 23 nt, Human
ggccuagcgaucucuccuggccu

SEQ ID NO: 2675042 - RNA, 18 nt, Human
ggcucacacaccuguagc

SEQ ID NO: 2675043 - RNA, 20 nt, Human
ggcuagcuucugcuuuucug

SEQ ID NO: 2675044 - RNA, 18 nt, Human
ggcuauuuucuaaagacu

SEQ ID NO: 2675045 - RNA, 20 nt, Human
ggcuauuuucuaaagacuug

SEQ ID NO: 2675046 - RNA, 22 nt, Human
ggcuagggagacgccaugugau

SEQ ID NO: 2675047 - RNA, 22 nt, Human
ggcuagcuucugcuuuucugcc

SEQ ID NO: 2675048 - RNA, 20 nt, Human
ggcgccgucuccaggggcug

SEQ ID NO: 2675049 - RNA, 14 nt, Human
ggccucggccccuc

SEQ ID NO: 2675050 - RNA, 15 nt, Human
ggcgcggagugaacc

SEQ ID NO: 2675051 - RNA, 21 nt, Human
ggcgccgucuccaggggcugc

SEQ ID NO: 2675052 - RNA, 20 nt, Human
ggcggagcuugcagugagcc

SEQ ID NO: 2675053 - RNA, 21 nt, Human
ggcggagcuugcagugagccg

SEQ ID NO: 2675054 - RNA, 20 nt, Human
ggcggaucaucuaauucucu

SEQ ID NO: 2675055 - RNA, 13 nt, Human
ggcggccccagca

SEQ ID NO: 2675056 - RNA, 17 nt, Human
ggcggcaggggccugga

SEQ ID NO: 2675057 - RNA, 18 nt, Human
ggcggcaggggccuggag

SEQ ID NO: 2675058 - RNA, 23 nt, Human
ggaccucaggugagaagcagagg

SEQ ID NO: 2675059 - RNA, 19 nt, Human
ggaccucaggugagaagca

SEQ ID NO: 2675060 - RNA, 15 nt, Human
ggaccacccugagcc

SEQ ID NO: 2675061 - RNA, 16 nt, Human
ggaccacccugagccg

SEQ ID NO: 2675062 - RNA, 18 nt, Human
ggaccacccugagccggc

SEQ ID NO: 2675063 - RNA, 16 nt, Human
ggaccaagcaucuugg

SEQ ID NO: 2675064 - RNA, 21 nt, Human
ggacagauugccuguuucuga

SEQ ID NO: 2675065 - RNA, 22 nt, Human
ggacacucaaaagcugggcagg

SEQ ID NO: 2675066 - RNA, 17 nt, Human
ggacacucaaaagcugg

SEQ ID NO: 2675067 - RNA, 19 nt, Human
ggacgccacucauuucauc

SEQ ID NO: 2675068 - RNA, 20 nt, Human
ggacgccacucauuucaucu

SEQ ID NO: 2675069 - RNA, 19 nt, Human
ggacgcuccgcugccgugc

SEQ ID NO: 2675070 - RNA, 23 nt, Human
ggacugcuaccuuucaaagcuug

SEQ ID NO: 2675071 - RNA, 18 nt, Human
ggagaagcggcuggcagc

SEQ ID NO: 2675072 - RNA, 17 nt, Human
ggagaagcggcuggcag

SEQ ID NO: 2675073 - RNA, 19 nt, Human
ggacuguggcacuugccug

SEQ ID NO: 2675074 - RNA, 13 nt, Human
ggagauccuccug

SEQ ID NO: 2675075 - RNA, 15 nt, Human
ggagauccuccugca

SEQ ID NO: 2675076 - RNA, 19 nt, Human
ggagauaauuacugccuug

SEQ ID NO: 2675077 - RNA, 15 nt, Human
ggagacaaaagagca

SEQ ID NO: 2675078 - RNA, 22 nt, Human
ggagaauggugugaacccggga

SEQ ID NO: 2675079 - RNA, 18 nt, Human
ggagaagcccgugugaga

SEQ ID NO: 2675080 - RNA, 14 nt, Human
ggagacagcaucag

SEQ ID NO: 2675081 - RNA, 17 nt, Human
ggagacagcaucagggu

SEQ ID NO: 2675082 - RNA, 18 nt, Human
ggagacagcaucaggguu

SEQ ID NO: 2675083 - RNA, 15 nt, Human
ggaauguguggccug

SEQ ID NO: 2675084 - RNA, 19 nt, Human
ggaauuacgugcucugugg

SEQ ID NO: 2675085 - RNA, 13 nt, Human
ggaauuguggcua

SEQ ID NO: 2675086 - RNA, 21 nt, Human
ggaauuguggcuauccugauu

SEQ ID NO: 2675087 - RNA, 23 nt, Human
ggaauuguggcuauccugauuau

SEQ ID NO: 2675088 - RNA, 13 nt, Human
ggaauuuuuuugu

SEQ ID NO: 2675089 - RNA, 12 nt, Human
ggacaaagugcc

SEQ ID NO: 2675090 - RNA, 17 nt, Human
ggacaaagugccaaaga

SEQ ID NO: 2675091 - RNA, 18 nt, Human
ggacaaagugccaaagaa

SEQ ID NO: 2675092 - RNA, 18 nt, Human
ggaaguauguauauuaaa

SEQ ID NO: 2675093 - RNA, 19 nt, Human
ggaagggguuccucaaauu

SEQ ID NO: 2675094 - RNA, 21 nt, Human
ggaagggguuccucaaauuuu

SEQ ID NO: 2675095 - RNA, 22 nt, Human
ggaagggguuccucaaauuuuu

SEQ ID NO: 2675096 - RNA, 15 nt, Human
ggaaggguuucucua

SEQ ID NO: 2675097 - RNA, 15 nt, Human
ggaagggaaaguuuu

SEQ ID NO: 2675098 - RNA, 17 nt, Human
ggaagggaaaguuuuuu

SEQ ID NO: 2675099 - RNA, 21 nt, Human
ggaaccuccccagccugcgcc

SEQ ID NO: 2675100 - RNA, 19 nt, Human
ggaaccuccccagccugcg

SEQ ID NO: 2675101 - RNA, 18 nt, Human
ggaaccuccccagccugc

SEQ ID NO: 2675102 - RNA, 17 nt, Human
ggaaccuccccagccug

SEQ ID NO: 2675103 - RNA, 16 nt, Human
ggaaccuccccagccu

SEQ ID NO: 2675104 - RNA, 21 nt, Human
ggaaaggggagagccugcugg

SEQ ID NO: 2675105 - RNA, 12 nt, Human
ggaaaggggaga

SEQ ID NO: 2675106 - RNA, 13 nt, Human
ggaaaggggagag

SEQ ID NO: 2675107 - RNA, 14 nt, Human
ggaaaggggagagc

SEQ ID NO: 2675108 - RNA, 18 nt, Human
ggaaaggggagagccugc

SEQ ID NO: 2675109 - RNA, 19 nt, Human
ggaaaggggagagccugcu

SEQ ID NO: 2675110 - RNA, 19 nt, Human
ggaaaaucagccugcucca

SEQ ID NO: 2675111 - RNA, 23 nt, Human
ggaaaaucagccugcuccagcug

SEQ ID NO: 2675112 - RNA, 23 nt, Human
ggaaauauauacaaaaagaaaau

SEQ ID NO: 2675113 - RNA, 14 nt, Human
ggaacaugcccccu

SEQ ID NO: 2675114 - RNA, 15 nt, Human
ggaacaugcccccug

SEQ ID NO: 2675115 - RNA, 14 nt, Human
ggaacauacuguuc

SEQ ID NO: 2675116 - RNA, 14 nt, Human
ggaaccuccccagc

SEQ ID NO: 2675117 - RNA, 14 nt, Human
gcuuuagacccugg

SEQ ID NO: 2675118 - RNA, 20 nt, Human
gcuuucacggaaacucccga

SEQ ID NO: 2675119 - RNA, 16 nt, Human
gcuuuauuuuuuugaa

SEQ ID NO: 2675120 - RNA, 24 nt, Human
gcuuuagacuugaaaagagacagg

SEQ ID NO: 2675121 - RNA, 21 nt, Human
gcuuuagacuugaaaagagac

SEQ ID NO: 2675122 - RNA, 17 nt, Human
gcuuuagacccugggug

SEQ ID NO: 2675123 - RNA, 12 nt, Human
gcuuuagacuug

SEQ ID NO: 2675124 - RNA, 15 nt, Human
gcuuuagacccuggg

SEQ ID NO: 2675125 - RNA, 16 nt, Human
gcuuuagacccugggu

SEQ ID NO: 2675126 - RNA, 18 nt, Human
gcuuuagacuugaaaaga

SEQ ID NO: 2675127 - RNA, 17 nt, Human
gcuuuagacuugaaaag

SEQ ID NO: 2675128 - RNA, 15 nt, Human
gcuuuagacuugaaa

SEQ ID NO: 2675129 - RNA, 14 nt, Human
gcuuuagacuugaa

SEQ ID NO: 2675130 - RNA, 15 nt, Human
gcuuucagaagugcc

SEQ ID NO: 2675131 - RNA, 19 nt, Human
gcuuugucguauuuggcac

SEQ ID NO: 2675132 - RNA, 16 nt, Human
ggaaaaggcugguaca

SEQ ID NO: 2675133 - RNA, 12 nt, Human
ggaaaacauuug

SEQ ID NO: 2675134 - RNA, 13 nt, Human
ggaaaacauuugc

SEQ ID NO: 2675135 - RNA, 14 nt, Human
ggaaaacauuugcu

SEQ ID NO: 2675136 - RNA, 21 nt, Human
gcuuuguuuguugucagcuga

SEQ ID NO: 2675137 - RNA, 18 nt, Human
gcugucggcgcugcccca

SEQ ID NO: 2675138 - RNA, 15 nt, Human
gcugucggcgcugcc

SEQ ID NO: 2675139 - RNA, 13 nt, Human
gcuguucagcugg

SEQ ID NO: 2675140 - RNA, 14 nt, Human
gcuguucagcuggu

SEQ ID NO: 2675141 - RNA, 22 nt, Human
gcuguucccauguagcccccug

SEQ ID NO: 2675142 - RNA, 12 nt, Human
gcuguucugugg

SEQ ID NO: 2675143 - RNA, 21 nt, Human
gcuguucugugguuccucugc

SEQ ID NO: 2675144 - RNA, 21 nt, Human
gcuguuccuguucaguaauaa

SEQ ID NO: 2675145 - RNA, 19 nt, Human
gcuguggucaaggcuacag

SEQ ID NO: 2675146 - RNA, 16 nt, Human
gcuuagagaggacaau

SEQ ID NO: 2675147 - RNA, 12 nt, Human
gcuuaguuugug

SEQ ID NO: 2675148 - RNA, 14 nt, Human
gcuuaguuugugug

SEQ ID NO: 2675149 - RNA, 16 nt, Human
gcuuaguuuguguguu

SEQ ID NO: 2675150 - RNA, 21 nt, Human
gcuuccaggaaacuccacauc

SEQ ID NO: 2675151 - RNA, 19 nt, Human
gcuuccaggaaacuccaca

SEQ ID NO: 2675152 - RNA, 20 nt, Human
gcuucuccgccagccuccuc

SEQ ID NO: 2675153 - RNA, 21 nt, Human
gcuucuccgccagccuccucu

SEQ ID NO: 2675154 - RNA, 14 nt, Human
gcuucuccgccagc

SEQ ID NO: 2675155 - RNA, 15 nt, Human
gcuucuccgccagcc

SEQ ID NO: 2675156 - RNA, 16 nt, Human
gcuucuccgccagccu

SEQ ID NO: 2675157 - RNA, 17 nt, Human
gcuucuccgccagccuc

SEQ ID NO: 2675158 - RNA, 18 nt, Human
gcuucuccgccagccucc

SEQ ID NO: 2675159 - RNA, 19 nt, Human
gcuucuccgccagccuccu

SEQ ID NO: 2675160 - RNA, 12 nt, Human
gcuucugccugc

SEQ ID NO: 2675161 - RNA, 19 nt, Human
gcuuaucucaggggugugc

SEQ ID NO: 2675162 - RNA, 13 nt, Human
gcuuaucucaggg

SEQ ID NO: 2675163 - RNA, 12 nt, Human
gcuuauaaaaca

SEQ ID NO: 2675164 - RNA, 19 nt, Human
gcuuauaaaacagaguaau

SEQ ID NO: 2675165 - RNA, 13 nt, Human
gcuuauaaaacag

SEQ ID NO: 2675166 - RNA, 20 nt, Human
gcuuaguuuguguguugucu

SEQ ID NO: 2675167 - RNA, 21 nt, Human
gcuuaguuuguguguugucuc

SEQ ID NO: 2675168 - RNA, 22 nt, Human
gcuuauaaaacagaguaaucuu

SEQ ID NO: 2675169 - RNA, 16 nt, Human
gccugauccuccaaca

SEQ ID NO: 2675170 - RNA, 19 nt, Human
gccugaugagauuuuuaaa

SEQ ID NO: 2675171 - RNA, 20 nt, Human
gccugaugagauuuuuaaaa

SEQ ID NO: 2675172 - RNA, 13 nt, Human
gccugaucugccc

SEQ ID NO: 2675173 - RNA, 15 nt, Human
gccugaucugcccau

SEQ ID NO: 2675174 - RNA, 23 nt, Human
gccugaucugcccaucgugaaga

SEQ ID NO: 2675175 - RNA, 19 nt, Human
gccugaugacaauaaagcu

SEQ ID NO: 2675176 - RNA, 20 nt, Human
gccugaugacaauaaagcuu

SEQ ID NO: 2675177 - RNA, 21 nt, Human
gccugaugacaauaaagcuug

SEQ ID NO: 2675178 - RNA, 11 nt, Human
gccugaauaaa

SEQ ID NO: 2675179 - RNA, 12 nt, Human
gccugaauaaag

SEQ ID NO: 2675180 - RNA, 16 nt, Human
gccugaauaaagagcc

SEQ ID NO: 2675181 - RNA, 23 nt, Human
gccugaauaaagagcccuaaguu

SEQ ID NO: 2675182 - RNA, 18 nt, Human
gccugcuccagcuguuca

SEQ ID NO: 2675183 - RNA, 16 nt, Human
gccugcuccagcuguu

SEQ ID NO: 2675184 - RNA, 21 nt, Human
gccugcuuugaauaaaugugu

SEQ ID NO: 2675185 - RNA, 22 nt, Human
gccugcugugauuccacuacac

SEQ ID NO: 2675186 - RNA, 15 nt, Human
gccugcuccagcugu

SEQ ID NO: 2675187 - RNA, 17 nt, Human
gccugcacuccucaggg

SEQ ID NO: 2675188 - RNA, 20 nt, Human
gccuggcaguccgugggacg

SEQ ID NO: 2675189 - RNA, 24 nt, Human
gccuggaguguaugacugcacaug

SEQ ID NO: 2675190 - RNA, 15 nt, Human
gccuggccaggagca

SEQ ID NO: 2675191 - RNA, 17 nt, Human
gccuggccaggagcagg

SEQ ID NO: 2675192 - RNA, 14 nt, Human
gccuggccaggagc

SEQ ID NO: 2675193 - RNA, 23 nt, Human
gccugggugacaaagugagacuc

SEQ ID NO: 2675194 - RNA, 20 nt, Human
gccugggggacagaaagaga

SEQ ID NO: 2675195 - RNA, 22 nt, Human
gccuggggcugaggcugaggca

SEQ ID NO: 2675196 - RNA, 14 nt, Human
gccuccccugccac

SEQ ID NO: 2675197 - RNA, 15 nt, Human
gccuccccugccacc

SEQ ID NO: 2675198 - RNA, 16 nt, Human
gccuccccugccacca

SEQ ID NO: 2675199 - RNA, 19 nt, Human
gccuccccugccaccaggc

SEQ ID NO: 2675200 - RNA, 21 nt, Human
gccucccacgacugcccggca

SEQ ID NO: 2675201 - RNA, 14 nt, Human
gccucccacgacug

SEQ ID NO: 2675202 - RNA, 13 nt, Human
gccucggccccuc

SEQ ID NO: 2675203 - RNA, 18 nt, Human
gccucggccccucccaca

SEQ ID NO: 2675204 - RNA, 19 nt, Human
gcccuuuuccccuaccaau

SEQ ID NO: 2675205 - RNA, 22 nt, Human
gccuauaagccaaaauuaaggu

SEQ ID NO: 2675206 - RNA, 18 nt, Human
gccgaggccaugugcaua

SEQ ID NO: 2675207 - RNA, 19 nt, Human
gccuauaagccaaaauuaa

SEQ ID NO: 2675208 - RNA, 13 nt, Human
gccuauccgcugc

SEQ ID NO: 2675209 - RNA, 18 nt, Human
gccuauccgcugccagcc

SEQ ID NO: 2675210 - RNA, 19 nt, Human
gccucacuaauuuuuguau

SEQ ID NO: 2675211 - RNA, 13 nt, Human
gccucacuggggc

SEQ ID NO: 2675212 - RNA, 14 nt, Human
gccucacuggggca

SEQ ID NO: 2675213 - RNA, 17 nt, Human
gccucacuggggcagac

SEQ ID NO: 2675214 - RNA, 21 nt, Human
gccucaccaugugagcucuuc

SEQ ID NO: 2675215 - RNA, 18 nt, Human
gccucagcgcggcccucc

SEQ ID NO: 2675216 - RNA, 16 nt, Human
gccucagcgcggcccu

SEQ ID NO: 2675217 - RNA, 13 nt, Human
gcccuuuuccccu

SEQ ID NO: 2675218 - RNA, 14 nt, Human
gcccuuugcugucc

SEQ ID NO: 2675219 - RNA, 13 nt, Human
gcccuuugcuguc

SEQ ID NO: 2675220 - RNA, 17 nt, Human
gccgagauugcaccacu

SEQ ID NO: 2675221 - RNA, 18 nt, Human
gccgagauugcaccacug

SEQ ID NO: 2675222 - RNA, 21 nt, Human
gcccuuuccccgacgcccacc

SEQ ID NO: 2675223 - RNA, 22 nt, Human
gcccuuuccccgacgcccaccc

SEQ ID NO: 2675224 - RNA, 19 nt, Human
gcccuggccuccccugcca

SEQ ID NO: 2675225 - RNA, 20 nt, Human
gcccuggccuccccugccac

SEQ ID NO: 2675226 - RNA, 21 nt, Human
gcccuggccuccccugccacc

SEQ ID NO: 2675227 - RNA, 24 nt, Human
gcccuggccuccccugccaccagg

SEQ ID NO: 2675228 - RNA, 10 nt, Human
gcccuggcug

SEQ ID NO: 2675229 - RNA, 15 nt, Human
gcccuggcagggggc

SEQ ID NO: 2675230 - RNA, 16 nt, Human
gcccuggcagggggca

SEQ ID NO: 2675231 - RNA, 17 nt, Human
gcccuggcagggggcau

SEQ ID NO: 2675232 - RNA, 12 nt, Human
gcccuggccucc

SEQ ID NO: 2675233 - RNA, 14 nt, Human
gcccuggccucccc

SEQ ID NO: 2675234 - RNA, 16 nt, Human
gcccuggccuccccug

SEQ ID NO: 2675235 - RNA, 17 nt, Human
gcccuggccuccccugc

SEQ ID NO: 2675236 - RNA, 17 nt, Human
gcccuggcugcugcccc

SEQ ID NO: 2675237 - RNA, 19 nt, Human
gcccuggcugcugccccca

SEQ ID NO: 2675238 - RNA, 22 nt, Human
gcccuggcugcugcccccaccc

SEQ ID NO: 2675239 - RNA, 15 nt, Human
gcccuggcuguucug

SEQ ID NO: 2675240 - RNA, 23 nt, Human
gcccuggcuguucugugguuccu

SEQ ID NO: 2675241 - RNA, 11 nt, Human
gcccuggcugc

SEQ ID NO: 2675242 - RNA, 16 nt, Human
gcccuggcugccggca

SEQ ID NO: 2675243 - RNA, 12 nt, Human
gcccuggcugcu

SEQ ID NO: 2675244 - RNA, 14 nt, Human
gcccuggcugcugc

SEQ ID NO: 2675245 - RNA, 15 nt, Human
gcccuggcugcugcc

SEQ ID NO: 2675246 - RNA, 16 nt, Human
gcccuggcugcugccc

SEQ ID NO: 2675247 - RNA, 16 nt, Human
gcccugggcuggaauc

SEQ ID NO: 2675248 - RNA, 18 nt, Human
gcccugggcuggaaucag

SEQ ID NO: 2675249 - RNA, 11 nt, Human
gcccugggcug

SEQ ID NO: 2675250 - RNA, 12 nt, Human
gcccugggcugg

SEQ ID NO: 2675251 - RNA, 13 nt, Human
gcccugggcugga

SEQ ID NO: 2675252 - RNA, 14 nt, Human
gcccugggcuggaa

SEQ ID NO: 2675253 - RNA, 15 nt, Human
gccccucucaccaaa

SEQ ID NO: 2675254 - RNA, 14 nt, Human
gccccucucaccaa

SEQ ID NO: 2675255 - RNA, 15 nt, Human
gcccgcgccacagga

SEQ ID NO: 2675256 - RNA, 16 nt, Human
gcccgcgccacaggac

SEQ ID NO: 2675257 - RNA, 20 nt, Human
gcccggccgcuccaccagca

SEQ ID NO: 2675258 - RNA, 16 nt, Human
gcccgacauggcuccg

SEQ ID NO: 2675259 - RNA, 19 nt, Human
gcccgacauggcuccggcc

SEQ ID NO: 2675260 - RNA, 22 nt, Human
gcccgacauggcuccggccucu

SEQ ID NO: 2675261 - RNA, 24 nt, Human
gcccgacauggcuccggccucugc

SEQ ID NO: 2675262 - RNA, 16 nt, Human
gcccucuccuuuguuc

SEQ ID NO: 2675263 - RNA, 22 nt, Human
gcccucuccuuuguucccggcu

SEQ ID NO: 2675264 - RNA, 16 nt, Human
gcccugagcuuucugc

SEQ ID NO: 2675265 - RNA, 17 nt, Human
gcccucugaacuugccu

SEQ ID NO: 2675266 - RNA, 19 nt, Human
gcccucucaggccggcagc

SEQ ID NO: 2675267 - RNA, 17 nt, Human
gcccugagucugggcag

SEQ ID NO: 2675268 - RNA, 19 nt, Human
gcuccauaguuuggcauuu

SEQ ID NO: 2675269 - RNA, 22 nt, Human
gcuccaucccaaccaggcaccu

SEQ ID NO: 2675270 - RNA, 20 nt, Human
gcuccagcuguucagcuggu

SEQ ID NO: 2675271 - RNA, 11 nt, Human
gcuccagcugu

SEQ ID NO: 2675272 - RNA, 14 nt, Human
gcucccuccuccag

SEQ ID NO: 2675273 - RNA, 16 nt, Human
gcucccuccuccaggc

SEQ ID NO: 2675274 - RNA, 18 nt, Human
gcucccuccuccaggccu

SEQ ID NO: 2675275 - RNA, 19 nt, Human
gcucccuccuccaggccug

SEQ ID NO: 2675276 - RNA, 22 nt, Human
gcucccuccuccaggccugccu

SEQ ID NO: 2675277 - RNA, 16 nt, Human
gcuccaagccccaucu

SEQ ID NO: 2675278 - RNA, 19 nt, Human
gcuccaagccccaucuucu

SEQ ID NO: 2675279 - RNA, 23 nt, Human
gcucagcaaaagaugcuucucac

SEQ ID NO: 2675280 - RNA, 22 nt, Human
gcucagcaaaagaugcuucuca

SEQ ID NO: 2675281 - RNA, 20 nt, Human
gcucagcaaaagaugcuucu

SEQ ID NO: 2675282 - RNA, 17 nt, Human
gcucagcaaaagaugcu

SEQ ID NO: 2675283 - RNA, 11 nt, Human
gcuaugacuua

SEQ ID NO: 2675284 - RNA, 15 nt, Human
gcucaccgcccauca

SEQ ID NO: 2675285 - RNA, 16 nt, Human
gcucaccgcccaucag

SEQ ID NO: 2675286 - RNA, 17 nt, Human
gcucaccgcccaucagg

SEQ ID NO: 2675287 - RNA, 19 nt, Human
gcucaguguuuuugugaau

SEQ ID NO: 2675288 - RNA, 12 nt, Human
gcucaguaaacg

SEQ ID NO: 2675289 - RNA, 18 nt, Human
gcucaguaaacgggaaca

SEQ ID NO: 2675290 - RNA, 22 nt, Human
gcucaguaaacgggaacaugcc

SEQ ID NO: 2675291 - RNA, 14 nt, Human
gcuacuagcaaaau

SEQ ID NO: 2675292 - RNA, 16 nt, Human
gcuacuagcaaaauaa

SEQ ID NO: 2675293 - RNA, 14 nt, Human
gcuagcuagcucaa

SEQ ID NO: 2675294 - RNA, 12 nt, Human
gcuagcucaacu

SEQ ID NO: 2675295 - RNA, 17 nt, Human
gcuagcuagcucaacua

SEQ ID NO: 2675296 - RNA, 12 nt, Human
gcuaugaauuuu

SEQ ID NO: 2675297 - RNA, 14 nt, Human
gcuaacaaagacaa

SEQ ID NO: 2675298 - RNA, 19 nt, Human
gcgugacccgaccuggccg

SEQ ID NO: 2675299 - RNA, 16 nt, Human
gcuaaaugugaaugau

SEQ ID NO: 2675300 - RNA, 21 nt, Human
gcuaaauaaaauuuguugcau

SEQ ID NO: 2675301 - RNA, 13 nt, Human
gcuaaaugugaau

SEQ ID NO: 2675302 - RNA, 19 nt, Human
gcuaaauaaaauuuguugc

SEQ ID NO: 2675303 - RNA, 20 nt, Human
gcuaaauaaaauuuguugca

SEQ ID NO: 2675304 - RNA, 23 nt, Human
gcgugaacccgggaggcggagcu

SEQ ID NO: 2675305 - RNA, 14 nt, Human
gcgucccaagaugu

SEQ ID NO: 2675306 - RNA, 17 nt, Human
gcgucccaagauguuga

SEQ ID NO: 2675307 - RNA, 18 nt, Human
gcguauggcuuuauuuuu

SEQ ID NO: 2675308 - RNA, 14 nt, Human
gcgucagcugcucc

SEQ ID NO: 2675309 - RNA, 17 nt, Human
gcgucagcugcucccug

SEQ ID NO: 2675310 - RNA, 22 nt, Human
gcgucagcugcucccuggcauu

SEQ ID NO: 2675311 - RNA, 19 nt, Human
gcucuccggggccauuugc

SEQ ID NO: 2675312 - RNA, 21 nt, Human
gcucuccggggccauuugcaa

SEQ ID NO: 2675313 - RNA, 22 nt, Human
gcucuccggggccauuugcaau

SEQ ID NO: 2675314 - RNA, 17 nt, Human
gcucccuguagggucca

SEQ ID NO: 2675315 - RNA, 23 nt, Human
gcucccuguaggguccaaccaga

SEQ ID NO: 2675316 - RNA, 19 nt, Human
gcucgaaucucugugccuu

SEQ ID NO: 2675317 - RNA, 18 nt, Human
gcucgacuauagaaaacu

SEQ ID NO: 2675318 - RNA, 15 nt, Human
gcucgaaucucugug

SEQ ID NO: 2675319 - RNA, 16 nt, Human
gcucgaaucucugugc

SEQ ID NO: 2675320 - RNA, 16 nt, Human
gcucugccgucucugg

SEQ ID NO: 2675321 - RNA, 17 nt, Human
gcucugccgucucugga

SEQ ID NO: 2675322 - RNA, 16 nt, Human
gcucugccugacagag

SEQ ID NO: 2675323 - RNA, 18 nt, Human
gcucugccgucucuggag

SEQ ID NO: 2675324 - RNA, 14 nt, Human
gcugcauccagagg

SEQ ID NO: 2675325 - RNA, 15 nt, Human
gcugcaugcccucuc

SEQ ID NO: 2675326 - RNA, 16 nt, Human
gcugcaugcccucuca

SEQ ID NO: 2675327 - RNA, 18 nt, Human
gcugcaugcccucucagg

SEQ ID NO: 2675328 - RNA, 17 nt, Human
gcugcaugcccucucag

SEQ ID NO: 2675329 - RNA, 22 nt, Human
gcugcaugcccucucaggccgg

SEQ ID NO: 2675330 - RNA, 21 nt, Human
gcugcaugcccucucaggccg

SEQ ID NO: 2675331 - RNA, 20 nt, Human
gcugcaugcccucucaggcc

SEQ ID NO: 2675332 - RNA, 19 nt, Human
gcugcaugcccucucaggc

SEQ ID NO: 2675333 - RNA, 22 nt, Human
gcugaugguguggccuguggcu

SEQ ID NO: 2675334 - RNA, 17 nt, Human
gcugaugucaauuucug

SEQ ID NO: 2675335 - RNA, 20 nt, Human
gcugaugucaauuucugugu

SEQ ID NO: 2675336 - RNA, 23 nt, Human
gcugaugucaauuucuguguugc

SEQ ID NO: 2675337 - RNA, 21 nt, Human
gcugaguggcaggggacagga

SEQ ID NO: 2675338 - RNA, 23 nt, Human
gcugagugggggaucacagccuc

SEQ ID NO: 2675339 - RNA, 22 nt, Human
gcugagugggggaucacagccu

SEQ ID NO: 2675340 - RNA, 17 nt, Human
gcugaguggcaggggac

SEQ ID NO: 2675341 - RNA, 19 nt, Human
gcugaguggcaggggacag

SEQ ID NO: 2675342 - RNA, 19 nt, Human
gcucuuccuaucccucucc

SEQ ID NO: 2675343 - RNA, 20 nt, Human
gcucuuccuaucccucuccu

SEQ ID NO: 2675344 - RNA, 22 nt, Human
gcugaccaugcucaucugcugg

SEQ ID NO: 2675345 - RNA, 21 nt, Human
gcugaccaugcucaucugcug

SEQ ID NO: 2675346 - RNA, 17 nt, Human
guaaugaaaaugaauau

SEQ ID NO: 2675347 - RNA, 17 nt, Human
guaaucuuuaccuguau

SEQ ID NO: 2675348 - RNA, 19 nt, Human
guaaucuuuaccuguauac

SEQ ID NO: 2675349 - RNA, 20 nt, Human
guaaucuuuaccuguauaca

SEQ ID NO: 2675350 - RNA, 17 nt, Human
guaaucuuguugguuca

SEQ ID NO: 2675351 - RNA, 14 nt, Human
guaagugggcccac

SEQ ID NO: 2675352 - RNA, 16 nt, Human
guaagugggcccaccc

SEQ ID NO: 2675353 - RNA, 17 nt, Human
guaagugggcccacccg

SEQ ID NO: 2675354 - RNA, 21 nt, Human
guaaugaauuuuuaugauauu

SEQ ID NO: 2675355 - RNA, 16 nt, Human
guaaugcuucaaucag

SEQ ID NO: 2675356 - RNA, 16 nt, Human
guaaugugaauaaauu

SEQ ID NO: 2675357 - RNA, 14 nt, Human
guaaugugaauaaa

SEQ ID NO: 2675358 - RNA, 13 nt, Human
guaauugugaaaa

SEQ ID NO: 2675359 - RNA, 23 nt, Human
guaauucuaccaaggucuucuua

SEQ ID NO: 2675360 - RNA, 14 nt, Human
guaauugugaaaaa

SEQ ID NO: 2675361 - RNA, 13 nt, Human
guacaggcuggcg

SEQ ID NO: 2675362 - RNA, 14 nt, Human
guacauaauacuga

SEQ ID NO: 2675363 - RNA, 19 nt, Human
guacauaauacugaaccac

SEQ ID NO: 2675364 - RNA, 18 nt, Human
guacauaauacugaacca

SEQ ID NO: 2675365 - RNA, 16 nt, Human
guacauaauacugaac

SEQ ID NO: 2675366 - RNA, 15 nt, Human
guacauaauacugaa

SEQ ID NO: 2675367 - RNA, 17 nt, Human
guacauacgauuuaagg

SEQ ID NO: 2675368 - RNA, 19 nt, Human
guacgacgucagauguuua

SEQ ID NO: 2675369 - RNA, 13 nt, Human
guacccugggugu

SEQ ID NO: 2675370 - RNA, 18 nt, Human
guacccggggcccagggc

SEQ ID NO: 2675371 - RNA, 17 nt, Human
guacccggggcccaggg

SEQ ID NO: 2675372 - RNA, 13 nt, Human
guaccuaagggag

SEQ ID NO: 2675373 - RNA, 18 nt, Human
guagaaaagaacuggaaa

SEQ ID NO: 2675374 - RNA, 20 nt, Human
guacuuuuuuaaauauuuuc

SEQ ID NO: 2675375 - RNA, 21 nt, Human
guacuuuuuuaaauauuuucu

SEQ ID NO: 2675376 - RNA, 13 nt, Human
guagaaaauguga

SEQ ID NO: 2675377 - RNA, 15 nt, Human
guagaaaaugugacc

SEQ ID NO: 2675378 - RNA, 17 nt, Human
guagaaaaugugacccu

SEQ ID NO: 2675379 - RNA, 18 nt, Human
guagaaaaugugacccuc

SEQ ID NO: 2675380 - RNA, 23 nt, Human
guacuuuuauuuuacacagaaac

SEQ ID NO: 2675381 - RNA, 23 nt, Human
guacuuuuuaguaauuucuuuuu

SEQ ID NO: 2675382 - RNA, 16 nt, Human
guacuuuuaaaaacau

SEQ ID NO: 2675383 - RNA, 17 nt, Human
guacuuuuaaaaacaua

SEQ ID NO: 2675384 - RNA, 16 nt, Human
guacuuuucauucucu

SEQ ID NO: 2675385 - RNA, 17 nt, Human
guacuuuucauucucuu

SEQ ID NO: 2675386 - RNA, 18 nt, Human
guacuuuucauucucuuu

SEQ ID NO: 2675387 - RNA, 20 nt, Human
guacuuuucauucucuuuua

SEQ ID NO: 2675388 - RNA, 21 nt, Human
guacuuuucauucucuuuuaa

SEQ ID NO: 2675389 - RNA, 22 nt, Human
guacuuuucauucucuuuuaau

SEQ ID NO: 2675390 - RNA, 17 nt, Human
guacuuucuauuuuaau

SEQ ID NO: 2675391 - RNA, 21 nt, Human
guacuuucuguuaugggcuuu

SEQ ID NO: 2675392 - RNA, 15 nt, Human
guacuuggccuuugg

SEQ ID NO: 2675393 - RNA, 12 nt, Human
guaagucuuuuu

SEQ ID NO: 2675394 - RNA, 20 nt, Human
guaagcguauggcuuuauuu

SEQ ID NO: 2675395 - RNA, 14 nt, Human
guaagcguauggcu

SEQ ID NO: 2675396 - RNA, 22 nt, Human
guaagauaucucaaugaaccau

SEQ ID NO: 2675397 - RNA, 20 nt, Human
guaagaucacuguuuagauu

SEQ ID NO: 2675398 - RNA, 18 nt, Human
guaagaucacuguuuaga

SEQ ID NO: 2675399 - RNA, 13 nt, Human
guaagaucacugu

SEQ ID NO: 2675400 - RNA, 17 nt, Human
guaagauugauaucuau

SEQ ID NO: 2675401 - RNA, 11 nt, Human
guaagaaggca

SEQ ID NO: 2675402 - RNA, 13 nt, Human
guaagaaggcaau

SEQ ID NO: 2675403 - RNA, 16 nt, Human
guaagaagacaaacug

SEQ ID NO: 2675404 - RNA, 13 nt, Human
guaagaauucuga

SEQ ID NO: 2675405 - RNA, 21 nt, Human
guaacuguccuguccugcuca

SEQ ID NO: 2675406 - RNA, 19 nt, Human
guaacuuuuguaaauacac

SEQ ID NO: 2675407 - RNA, 18 nt, Human
guaacuuccaaauaaaua

SEQ ID NO: 2675408 - RNA, 19 nt, Human
guaacuuccaaauaaauaa

SEQ ID NO: 2675409 - RNA, 20 nt, Human
guaacuugcuuaaauuucuu

SEQ ID NO: 2675410 - RNA, 21 nt, Human
guaacuugcuuaaauuucuua

SEQ ID NO: 2675411 - RNA, 20 nt, Human
guaagaaagugaagcaaauc

SEQ ID NO: 2675412 - RNA, 11 nt, Human
guaaauguuuc

SEQ ID NO: 2675413 - RNA, 13 nt, Human
guaaauguuucuu

SEQ ID NO: 2675414 - RNA, 14 nt, Human
guaaauguuucuuu

SEQ ID NO: 2675415 - RNA, 15 nt, Human
guaaaguuaaaagaa

SEQ ID NO: 2675416 - RNA, 14 nt, Human
guaaagugucagaa

SEQ ID NO: 2675417 - RNA, 21 nt, Human
guaaaguuuccgugcguggca

SEQ ID NO: 2675418 - RNA, 23 nt, Human
guaaaguuuccgugcguggcacu

SEQ ID NO: 2675419 - RNA, 14 nt, Human
guaaauaaaccacu

SEQ ID NO: 2675420 - RNA, 15 nt, Human
guaaauaauucuuuu

SEQ ID NO: 2675421 - RNA, 14 nt, Human
guaaauaauucuuu

SEQ ID NO: 2675422 - RNA, 13 nt, Human
guaaauaauucuu

SEQ ID NO: 2675423 - RNA, 17 nt, Human
guaaauaggaaucauuc

SEQ ID NO: 2675424 - RNA, 21 nt, Human
guaaauaggaaucauucagaa

SEQ ID NO: 2675425 - RNA, 16 nt, Human
guaaauacaugcauau

SEQ ID NO: 2675426 - RNA, 17 nt, Human
guaaauacaugcauaua

SEQ ID NO: 2675427 - RNA, 15 nt, Human
guaaauaauuuauuu

SEQ ID NO: 2675428 - RNA, 20 nt, Human
guaaauaggauuuuuagaau

SEQ ID NO: 2675429 - RNA, 12 nt, Human
guaaauguguac

SEQ ID NO: 2675430 - RNA, 12 nt, Human
guaaauguaaac

SEQ ID NO: 2675431 - RNA, 13 nt, Human
guaaauguaaacu

SEQ ID NO: 2675432 - RNA, 21 nt, Human
gguggccgcugaguggcaggg

SEQ ID NO: 2675433 - RNA, 20 nt, Human
gguggccgcugaguggcagg

SEQ ID NO: 2675434 - RNA, 19 nt, Human
gguggcccacgccuguaau

SEQ ID NO: 2675435 - RNA, 19 nt, Human
gguuguaauuaaauucuga

SEQ ID NO: 2675436 - RNA, 13 nt, Human
gguuuaagcuguu

SEQ ID NO: 2675437 - RNA, 14 nt, Human
gguugugcacuguu

SEQ ID NO: 2675438 - RNA, 13 nt, Human
gguuggugggggc

SEQ ID NO: 2675439 - RNA, 17 nt, Human
gguugcgggacagagua

SEQ ID NO: 2675440 - RNA, 18 nt, Human
gguuggcaaaaaggcagg

SEQ ID NO: 2675441 - RNA, 20 nt, Human
gguuuuguaauuuguuugaa

SEQ ID NO: 2675442 - RNA, 21 nt, Human
gguuuuggcaaacgcuaaaga

SEQ ID NO: 2675443 - RNA, 13 nt, Human
gguuuugugccau

SEQ ID NO: 2675444 - RNA, 17 nt, Human
gguuuugugccaucugu

SEQ ID NO: 2675445 - RNA, 12 nt, Human
gguuuuucccug

SEQ ID NO: 2675446 - RNA, 21 nt, Human
guaaaagacaguguauguaga

SEQ ID NO: 2675447 - RNA, 14 nt, Human
guaaaagaaaucau

SEQ ID NO: 2675448 - RNA, 20 nt, Human
guaaaagaaaucauguccau

SEQ ID NO: 2675449 - RNA, 19 nt, Human
guaaaaaguauuuuuucaa

SEQ ID NO: 2675450 - RNA, 14 nt, Human
guaaaacaaaauuu

SEQ ID NO: 2675451 - RNA, 17 nt, Human
guaaaaauggaaacuau

SEQ ID NO: 2675452 - RNA, 13 nt, Human
guaaaaaaaccac

SEQ ID NO: 2675453 - RNA, 23 nt, Human
guaaaaaaaccaccaaaaacaaa

SEQ ID NO: 2675454 - RNA, 16 nt, Human
gggcugaggugggagg

SEQ ID NO: 2675455 - RNA, 14 nt, Human
gggcuuauaucugg

SEQ ID NO: 2675456 - RNA, 19 nt, Human
gggcuuauaucuggccucu

SEQ ID NO: 2675457 - RNA, 20 nt, Human
gggcuuaauggaguucuugu

SEQ ID NO: 2675458 - RNA, 16 nt, Human
gggcugucggcgcugc

SEQ ID NO: 2675459 - RNA, 16 nt, Human
gggcugagcugccugu

SEQ ID NO: 2675460 - RNA, 16 nt, Human
gggcucugugcaguca

SEQ ID NO: 2675461 - RNA, 11 nt, Human
gggcuccugca

SEQ ID NO: 2675462 - RNA, 18 nt, Human
gggcuccugcacuuacuu

SEQ ID NO: 2675463 - RNA, 22 nt, Human
gggcuccugcacuuacuugcuu

SEQ ID NO: 2675464 - RNA, 20 nt, Human
gggccuuuguucugggggga

SEQ ID NO: 2675465 - RNA, 18 nt, Human
gggccuuuucuggcaccg

SEQ ID NO: 2675466 - RNA, 21 nt, Human
gggccuuuucuggcaccgcag

SEQ ID NO: 2675467 - RNA, 16 nt, Human
gggcgcgguggcucac

SEQ ID NO: 2675468 - RNA, 18 nt, Human
gggccuggucguuuucaa

SEQ ID NO: 2675469 - RNA, 13 nt, Human
ggcucccagccuc

SEQ ID NO: 2675470 - RNA, 16 nt, Human
ggcucccagccucagc

SEQ ID NO: 2675471 - RNA, 15 nt, Human
ggcucccagccucag

SEQ ID NO: 2675472 - RNA, 17 nt, Human
ggcucccagccucagcg

SEQ ID NO: 2675473 - RNA, 17 nt, Human
ggcuauguauaaaauac

SEQ ID NO: 2675474 - RNA, 12 nt, Human
gggccuggagau

SEQ ID NO: 2675475 - RNA, 21 nt, Human
gggccuggagauccuccugca

SEQ ID NO: 2675476 - RNA, 23 nt, Human
gggcccggcccgcgccacaggac

SEQ ID NO: 2675477 - RNA, 18 nt, Human
ggggagccaaaaucucaa

SEQ ID NO: 2675478 - RNA, 18 nt, Human
ggggagacuuugauguca

SEQ ID NO: 2675479 - RNA, 14 nt, Human
ggggagagccugcu

SEQ ID NO: 2675480 - RNA, 16 nt, Human
ggggagagccugcugg

SEQ ID NO: 2675481 - RNA, 18 nt, Human
ggggagagccugcuggca

SEQ ID NO: 2675482 - RNA, 13 nt, Human
ggggauccccgcc

SEQ ID NO: 2675483 - RNA, 21 nt, Human
ggggauccccgccuggccagg

SEQ ID NO: 2675484 - RNA, 22 nt, Human
ggggauccccgccuggccagga

SEQ ID NO: 2675485 - RNA, 23 nt, Human
ggggauccccgccuggccaggag

SEQ ID NO: 2675486 - RNA, 17 nt, Human
ggggaucacagccucug

SEQ ID NO: 2675487 - RNA, 21 nt, Human
ggggcagacaauaaacccuca

SEQ ID NO: 2675488 - RNA, 13 nt, Human
gggcuugaagcca

SEQ ID NO: 2675489 - RNA, 16 nt, Human
gggcuucugugcccag

SEQ ID NO: 2675490 - RNA, 15 nt, Human
gggcuugaagccaaa

SEQ ID NO: 2675491 - RNA, 17 nt, Human
gggcuugaagccaaaga

SEQ ID NO: 2675492 - RNA, 13 nt, Human
gggcuuggccugc

SEQ ID NO: 2675493 - RNA, 16 nt, Human
gggcuuggccugcugu

SEQ ID NO: 2675494 - RNA, 17 nt, Human
gggcuuggccugcugug

SEQ ID NO: 2675495 - RNA, 19 nt, Human
gggcuuccucuagaagcca

SEQ ID NO: 2675496 - RNA, 18 nt, Human
ggggcugcccuugggcca

SEQ ID NO: 2675497 - RNA, 13 nt, Human
ggggcagggagcu

SEQ ID NO: 2675498 - RNA, 17 nt, Human
ggggcagggagcugggc

SEQ ID NO: 2675499 - RNA, 19 nt, Human
ggggcagggagcugggccc

SEQ ID NO: 2675500 - RNA, 16 nt, Human
ggggcugcuuccuccu

SEQ ID NO: 2675501 - RNA, 18 nt, Human
ggggcugcuuccuccugg

SEQ ID NO: 2675502 - RNA, 19 nt, Human
ggggcugcuuccuccugga

SEQ ID NO: 2675503 - RNA, 13 nt, Human
ggggcaggcuggg

SEQ ID NO: 2675504 - RNA, 14 nt, Human
ggggcaggcugggc

SEQ ID NO: 2675505 - RNA, 15 nt, Human
ggggcaggcugggcc

SEQ ID NO: 2675506 - RNA, 16 nt, Human
ggggcaggcugggcca

SEQ ID NO: 2675507 - RNA, 18 nt, Human
ggggcuggggaaggaagc

SEQ ID NO: 2675508 - RNA, 22 nt, Human
ggggcuuagggucggaacccaa

SEQ ID NO: 2675509 - RNA, 17 nt, Human
ggggcuugaagccaaag

SEQ ID NO: 2675510 - RNA, 17 nt, Human
ggggcuggcacugacug

SEQ ID NO: 2675511 - RNA, 22 nt, Human
gggguucccuugagggcugcag

SEQ ID NO: 2675512 - RNA, 18 nt, Human
gggguuccucaaauuuuu

SEQ ID NO: 2675513 - RNA, 12 nt, Human
ggggucuuugug

SEQ ID NO: 2675514 - RNA, 20 nt, Human
gguagagaggcgcggaguga

SEQ ID NO: 2675515 - RNA, 23 nt, Human
ggucaaggcaguagaacuccagg

SEQ ID NO: 2675516 - RNA, 22 nt, Human
ggucaaguugucagguuauuua

SEQ ID NO: 2675517 - RNA, 15 nt, Human
ggucacagcggaggu

SEQ ID NO: 2675518 - RNA, 13 nt, Human
ggucacaacuuga

SEQ ID NO: 2675519 - RNA, 19 nt, Human
gguacccggggcccagggc

SEQ ID NO: 2675520 - RNA, 17 nt, Human
gguacccggggcccagg

SEQ ID NO: 2675521 - RNA, 18 nt, Human
gguacuaauaaucuuguu

SEQ ID NO: 2675522 - RNA, 16 nt, Human
gguacuuuuaaaaaca

SEQ ID NO: 2675523 - RNA, 11 nt, Human
gguacccuggg

SEQ ID NO: 2675524 - RNA, 13 nt, Human
gguacccugggug

SEQ ID NO: 2675525 - RNA, 23 nt, Human
ggguucccuugagggcugcaguu

SEQ ID NO: 2675526 - RNA, 14 nt, Human
ggguucauuugugu

SEQ ID NO: 2675527 - RNA, 13 nt, Human
ggguucauuugug

SEQ ID NO: 2675528 - RNA, 17 nt, Human
ggguggaucacgagguc

SEQ ID NO: 2675529 - RNA, 16 nt, Human
ggguggaggcuuccug

SEQ ID NO: 2675530 - RNA, 14 nt, Human
ggguggaggggugu

SEQ ID NO: 2675531 - RNA, 20 nt, Human
gggugcuuuuauagaggcua

SEQ ID NO: 2675532 - RNA, 21 nt, Human
gggugcuuuuauagaggcuag

SEQ ID NO: 2675533 - RNA, 22 nt, Human
gggugcuuuuauagaggcuagc

SEQ ID NO: 2675534 - RNA, 17 nt, Human
ggguuccucaaauuuuu

SEQ ID NO: 2675535 - RNA, 15 nt, Human
ggugccugagaggca

SEQ ID NO: 2675536 - RNA, 17 nt, Human
ggugccugagaggcagg

SEQ ID NO: 2675537 - RNA, 18 nt, Human
ggugccugagaggcaggc

SEQ ID NO: 2675538 - RNA, 20 nt, Human
ggugcucggagaagagcgca

SEQ ID NO: 2675539 - RNA, 21 nt, Human
ggugcucggagaagagcgcag

SEQ ID NO: 2675540 - RNA, 21 nt, Human
ggugaguuugagcugccuucc

SEQ ID NO: 2675541 - RNA, 13 nt, Human
ggugaauauuuuc

SEQ ID NO: 2675542 - RNA, 15 nt, Human
ggugaggcaauaaaa

SEQ ID NO: 2675543 - RNA, 17 nt, Human
ggugaggggcuggcacu

SEQ ID NO: 2675544 - RNA, 16 nt, Human
ggugaggguuggcgcu

SEQ ID NO: 2675545 - RNA, 18 nt, Human
ggugaguccauucuccca

SEQ ID NO: 2675546 - RNA, 19 nt, Human
ggugaguuugagcugccuu

SEQ ID NO: 2675547 - RNA, 20 nt, Human
ggugaguuugagcugccuuc

SEQ ID NO: 2675548 - RNA, 11 nt, Human
ggucucccugg

SEQ ID NO: 2675549 - RNA, 12 nt, Human
ggucucccuggc

SEQ ID NO: 2675550 - RNA, 13 nt, Human
ggucucccuggcu

SEQ ID NO: 2675551 - RNA, 14 nt, Human
ggucucccuggcuc

SEQ ID NO: 2675552 - RNA, 15 nt, Human
ggucucccuggcucc

SEQ ID NO: 2675553 - RNA, 16 nt, Human
ggucucccuggcuccc

SEQ ID NO: 2675554 - RNA, 17 nt, Human
ggucucccuggcucccu

SEQ ID NO: 2675555 - RNA, 24 nt, Human
ggucucccuggcucccuccuccag

SEQ ID NO: 2675556 - RNA, 23 nt, Human
ggucuccugacuggugcugcagc

SEQ ID NO: 2675557 - RNA, 13 nt, Human
gguccgugggacg

SEQ ID NO: 2675558 - RNA, 22 nt, Human
gguccccguuccaccccaagag

SEQ ID NO: 2675559 - RNA, 21 nt, Human
gguccuaaggcaucuaucugu

SEQ ID NO: 2675560 - RNA, 23 nt, Human
gguccuagaaauuccccacccug

SEQ ID NO: 2675561 - RNA, 20 nt, Human
ggucccuccagaaccacccc

SEQ ID NO: 2675562 - RNA, 14 nt, Human
ggucccucugugua

SEQ ID NO: 2675563 - RNA, 12 nt, Human
guauuauuuaua

SEQ ID NO: 2675564 - RNA, 16 nt, Human
guauuauuuacauuua

SEQ ID NO: 2675565 - RNA, 20 nt, Human
guagaguguagacuguggcu

SEQ ID NO: 2675566 - RNA, 20 nt, Human
guauuauacaugugauacau

SEQ ID NO: 2675567 - RNA, 22 nt, Human
guauuauacaugugauacauuu

SEQ ID NO: 2675568 - RNA, 16 nt, Human
guauuaucaaagggau

SEQ ID NO: 2675569 - RNA, 22 nt, Human
guauuaucaaagggauaaagaa

SEQ ID NO: 2675570 - RNA, 13 nt, Human
guagagugggagc

SEQ ID NO: 2675571 - RNA, 14 nt, Human
guagaggcuuguuu

SEQ ID NO: 2675572 - RNA, 15 nt, Human
guagaggcuuguuua

SEQ ID NO: 2675573 - RNA, 12 nt, Human
guagagucugag

SEQ ID NO: 2675574 - RNA, 21 nt, Human
guagagucugagggcuuguag

SEQ ID NO: 2675575 - RNA, 14 nt, Human
guagagucugaggg

SEQ ID NO: 2675576 - RNA, 15 nt, Human
guagagugggagcug

SEQ ID NO: 2675577 - RNA, 16 nt, Human
guauuuauuuauguac

SEQ ID NO: 2675578 - RNA, 14 nt, Human
guauuuauuuaugu

SEQ ID NO: 2675579 - RNA, 17 nt, Human
guauuugaaagugccuu

SEQ ID NO: 2675580 - RNA, 12 nt, Human
guauuugcuuuu

SEQ ID NO: 2675581 - RNA, 22 nt, Human
guauuugcuuuuuuguuuuggc

SEQ ID NO: 2675582 - RNA, 15 nt, Human
gucaaggccugcucc

SEQ ID NO: 2675583 - RNA, 16 nt, Human
gucaaggccugcuccc

SEQ ID NO: 2675584 - RNA, 18 nt, Human
gucaagugaaaaaggagg

SEQ ID NO: 2675585 - RNA, 16 nt, Human
gucaagugaaaaagga

SEQ ID NO: 2675586 - RNA, 19 nt, Human
gucaagugaaaaaggagga

SEQ ID NO: 2675587 - RNA, 20 nt, Human
gucacccaggcuggacugca

SEQ ID NO: 2675588 - RNA, 15 nt, Human
gucaaguugucaggu

SEQ ID NO: 2675589 - RNA, 18 nt, Human
gucaaguugucagguuau

SEQ ID NO: 2675590 - RNA, 13 nt, Human
gucaauggcuugu

SEQ ID NO: 2675591 - RNA, 21 nt, Human
gucaauggcuuguucaucauc

SEQ ID NO: 2675592 - RNA, 17 nt, Human
gucaaugggaccugugg

SEQ ID NO: 2675593 - RNA, 19 nt, Human
gucaaugggaccuguggcu

SEQ ID NO: 2675594 - RNA, 14 nt, Human
gucccagcuacucg

SEQ ID NO: 2675595 - RNA, 17 nt, Human
gucccagauacuugggg

SEQ ID NO: 2675596 - RNA, 13 nt, Human
guccaggcugccg

SEQ ID NO: 2675597 - RNA, 14 nt, Human
guccaggcugccgu

SEQ ID NO: 2675598 - RNA, 16 nt, Human
guccaggcugccgugg

SEQ ID NO: 2675599 - RNA, 20 nt, Human
guccaggcugccguggggcc

SEQ ID NO: 2675600 - RNA, 19 nt, Human
guccagcuggccuggacag

SEQ ID NO: 2675601 - RNA, 19 nt, Human
guccagcugcccuuccgca

SEQ ID NO: 2675602 - RNA, 21 nt, Human
guccagcugcccuuccgcagu

SEQ ID NO: 2675603 - RNA, 22 nt, Human
guccagcugcccuuccgcagug

SEQ ID NO: 2675604 - RNA, 12 nt, Human
guccagcuggcc

SEQ ID NO: 2675605 - RNA, 13 nt, Human
guccagcuggccu

SEQ ID NO: 2675606 - RNA, 14 nt, Human
guccagcuggccug

SEQ ID NO: 2675607 - RNA, 17 nt, Human
guccagcuggccuggac

SEQ ID NO: 2675608 - RNA, 18 nt, Human
guccagcuggccuggaca

SEQ ID NO: 2675609 - RNA, 12 nt, Human
guccagcucugg

SEQ ID NO: 2675610 - RNA, 13 nt, Human
guccagcucugga

SEQ ID NO: 2675611 - RNA, 14 nt, Human
guccagcucuggag

SEQ ID NO: 2675612 - RNA, 16 nt, Human
guccagcucuggaggg

SEQ ID NO: 2675613 - RNA, 21 nt, Human
guccagcucuggaggggaggg

SEQ ID NO: 2675614 - RNA, 13 nt, Human
gucauguauguuu

SEQ ID NO: 2675615 - RNA, 14 nt, Human
gucauguauguuuc

SEQ ID NO: 2675616 - RNA, 14 nt, Human
gucauaucaaauaa

SEQ ID NO: 2675617 - RNA, 22 nt, Human
gucauaucaaauaaagagagaa

SEQ ID NO: 2675618 - RNA, 17 nt, Human
gucaucggcguggccca

SEQ ID NO: 2675619 - RNA, 18 nt, Human
gucauccagacucagagc

SEQ ID NO: 2675620 - RNA, 19 nt, Human
gucagccaggaccauaccg

SEQ ID NO: 2675621 - RNA, 23 nt, Human
gucagcaguugcugguaaaauga

SEQ ID NO: 2675622 - RNA, 14 nt, Human
gucagcaguugcug

SEQ ID NO: 2675623 - RNA, 21 nt, Human
gucacccaaaccggcaggugc

SEQ ID NO: 2675624 - RNA, 18 nt, Human
gucauacucgagucugag

SEQ ID NO: 2675625 - RNA, 20 nt, Human
gucauacucgagucugaggc

SEQ ID NO: 2675626 - RNA, 19 nt, Human
gucauacucgagucugagg

SEQ ID NO: 2675627 - RNA, 21 nt, Human
gucuaaucuagauaucgacuu

SEQ ID NO: 2675628 - RNA, 21 nt, Human
gucuaaacaaugcugauuugg

SEQ ID NO: 2675629 - RNA, 16 nt, Human
gucuaaacaaugcuga

SEQ ID NO: 2675630 - RNA, 19 nt, Human
gucguggggugugcuggga

SEQ ID NO: 2675631 - RNA, 21 nt, Human
gucguggggugugcugggagc

SEQ ID NO: 2675632 - RNA, 17 nt, Human
gucguggggugugcugg

SEQ ID NO: 2675633 - RNA, 21 nt, Human
gucugagggcuuguaguucuu

SEQ ID NO: 2675634 - RNA, 18 nt, Human
gucugaggccguugcuga

SEQ ID NO: 2675635 - RNA, 20 nt, Human
gucugagggcuuguaguucu

SEQ ID NO: 2675636 - RNA, 22 nt, Human
gucugaggccguugcugacuua

SEQ ID NO: 2675637 - RNA, 13 nt, Human
gucugauuucuua

SEQ ID NO: 2675638 - RNA, 13 nt, Human
guccucagccagu

SEQ ID NO: 2675639 - RNA, 20 nt, Human
gucucggaucaggcucccag

SEQ ID NO: 2675640 - RNA, 18 nt, Human
guccugugaaugccacug

SEQ ID NO: 2675641 - RNA, 14 nt, Human
guccuguccugcuc

SEQ ID NO: 2675642 - RNA, 19 nt, Human
guccugugaaugccacugc

SEQ ID NO: 2675643 - RNA, 22 nt, Human
guccuggcgccuggcaguccgu

SEQ ID NO: 2675644 - RNA, 22 nt, Human
guccuagaggcccuuugcuguc

SEQ ID NO: 2675645 - RNA, 23 nt, Human
guccuagcuugggaggcuucccc

SEQ ID NO: 2675646 - RNA, 14 nt, Human
guccuaguaagaag

SEQ ID NO: 2675647 - RNA, 17 nt, Human
guccuaguaagaagaca

SEQ ID NO: 2675648 - RNA, 22 nt, Human
guccuauuaguguuauaugaac

SEQ ID NO: 2675649 - RNA, 21 nt, Human
guccuauuaguguuauaugaa

SEQ ID NO: 2675650 - RNA, 20 nt, Human
guccuauuaguguuauauga

SEQ ID NO: 2675651 - RNA, 17 nt, Human
guccuauuaguguuaua

SEQ ID NO: 2675652 - RNA, 23 nt, Human
guccuagaaauuccccacccuga

SEQ ID NO: 2675653 - RNA, 20 nt, Human
guccuagaggcccuuugcug

SEQ ID NO: 2675654 - RNA, 19 nt, Human
guccuagaggcccuuugcu

SEQ ID NO: 2675655 - RNA, 17 nt, Human
gucccuggcgcaggugg

SEQ ID NO: 2675656 - RNA, 21 nt, Human
gucccugcgccuuuccuuuuc

SEQ ID NO: 2675657 - RNA, 16 nt, Human
gucccauagucccugc

SEQ ID NO: 2675658 - RNA, 12 nt, Human
gucccagugccg

SEQ ID NO: 2675659 - RNA, 18 nt, Human
gugaucccguuuucccca

SEQ ID NO: 2675660 - RNA, 22 nt, Human
gugauuccacuacaccuggcug

SEQ ID NO: 2675661 - RNA, 23 nt, Human
gugauuccacuacaccuggcuga

SEQ ID NO: 2675662 - RNA, 12 nt, Human
gugauuuucauu

SEQ ID NO: 2675663 - RNA, 14 nt, Human
gugcaacaggguau

SEQ ID NO: 2675664 - RNA, 14 nt, Human
gugcagucacugga

SEQ ID NO: 2675665 - RNA, 16 nt, Human
gugcccagaauaaguu

SEQ ID NO: 2675666 - RNA, 12 nt, Human
gugcccaagcca

SEQ ID NO: 2675667 - RNA, 19 nt, Human
gugcccaagccagaggcug

SEQ ID NO: 2675668 - RNA, 20 nt, Human
gugcccaagccagaggcugg

SEQ ID NO: 2675669 - RNA, 20 nt, Human
gugaaauugcauacuuugua

SEQ ID NO: 2675670 - RNA, 22 nt, Human
gugaaagugcauuuuuguaaau

SEQ ID NO: 2675671 - RNA, 13 nt, Human
gugaauauuuuca

SEQ ID NO: 2675672 - RNA, 22 nt, Human
gugaauacugcuugaauaaaca

SEQ ID NO: 2675673 - RNA, 17 nt, Human
gugaauuuuuaagcugc

SEQ ID NO: 2675674 - RNA, 15 nt, Human
gugaauuuuuauugu

SEQ ID NO: 2675675 - RNA, 16 nt, Human
gugaauuuuuauuguu

SEQ ID NO: 2675676 - RNA, 19 nt, Human
gugaauuuuuauuguugua

SEQ ID NO: 2675677 - RNA, 17 nt, Human
gugaaagcauauggguu

SEQ ID NO: 2675678 - RNA, 21 nt, Human
gugaaacuuuucuagaauuau

SEQ ID NO: 2675679 - RNA, 22 nt, Human
gugaaacuuuucuagaauuauu

SEQ ID NO: 2675680 - RNA, 15 nt, Human
gugaaaacggagcug

SEQ ID NO: 2675681 - RNA, 23 nt, Human
gugaaaagaaaaaugagccuggc

SEQ ID NO: 2675682 - RNA, 14 nt, Human
gugaaaagaaaaau

SEQ ID NO: 2675683 - RNA, 14 nt, Human
gugaaauuauuuug

SEQ ID NO: 2675684 - RNA, 23 nt, Human
gugagcucuuccuaucccucucc

SEQ ID NO: 2675685 - RNA, 14 nt, Human
gugaggaaaucaaa

SEQ ID NO: 2675686 - RNA, 22 nt, Human
gugaggaaaucaaagugcuauu

SEQ ID NO: 2675687 - RNA, 18 nt, Human
gugaggaaaucaaagugc

SEQ ID NO: 2675688 - RNA, 16 nt, Human
gugacccgaccuggcc

SEQ ID NO: 2675689 - RNA, 12 nt, Human
gugacccuccaa

SEQ ID NO: 2675690 - RNA, 20 nt, Human
gugacccuccaaauggagaa

SEQ ID NO: 2675691 - RNA, 13 nt, Human
gugaccucucucu

SEQ ID NO: 2675692 - RNA, 16 nt, Human
gugaccucucucucug

SEQ ID NO: 2675693 - RNA, 21 nt, Human
gugaccggacuuuucugcaaa

SEQ ID NO: 2675694 - RNA, 15 nt, Human
gugaccggacuuuuc

SEQ ID NO: 2675695 - RNA, 19 nt, Human
gugaccggacuuuucugca

SEQ ID NO: 2675696 - RNA, 22 nt, Human
guggacuguggcacuugccugg

SEQ ID NO: 2675697 - RNA, 14 nt, Human
guggacuguggcac

SEQ ID NO: 2675698 - RNA, 21 nt, Human
guggacuguggcacuugccug

SEQ ID NO: 2675699 - RNA, 20 nt, Human
guggagaagcggcuggcagc

SEQ ID NO: 2675700 - RNA, 21 nt, Human
guggaucagagaugcaccacc

SEQ ID NO: 2675701 - RNA, 22 nt, Human
guggaucacgaggucaggagau

SEQ ID NO: 2675702 - RNA, 15 nt, Human
guggagggguguggc

SEQ ID NO: 2675703 - RNA, 16 nt, Human
guggagggguguggca

SEQ ID NO: 2675704 - RNA, 23 nt, Human
guggagggguguggcagugguuu

SEQ ID NO: 2675705 - RNA, 12 nt, Human
guggagggaggc

SEQ ID NO: 2675706 - RNA, 15 nt, Human
guggagggaggcccc

SEQ ID NO: 2675707 - RNA, 12 nt, Human
guggagggaggg

SEQ ID NO: 2675708 - RNA, 13 nt, Human
guggaggcuuccu

SEQ ID NO: 2675709 - RNA, 14 nt, Human
guggaggcuuccug

SEQ ID NO: 2675710 - RNA, 15 nt, Human
guggaggcuuccugc

SEQ ID NO: 2675711 - RNA, 12 nt, Human
guggaggggugu

SEQ ID NO: 2675712 - RNA, 17 nt, Human
guggaggaggaaggcaa

SEQ ID NO: 2675713 - RNA, 19 nt, Human
guggaggaggaaggcaaga

SEQ ID NO: 2675714 - RNA, 16 nt, Human
guggaggcugcaguga

SEQ ID NO: 2675715 - RNA, 22 nt, Human
guggccacaauccacgcuucuc

SEQ ID NO: 2675716 - RNA, 23 nt, Human
guggccaagaagcaguggccuua

SEQ ID NO: 2675717 - RNA, 15 nt, Human
guggccaagaagcag

SEQ ID NO: 2675718 - RNA, 17 nt, Human
guggccaagaagcagug

SEQ ID NO: 2675719 - RNA, 22 nt, Human
guggccaagaagcaguggccuu

SEQ ID NO: 2675720 - RNA, 21 nt, Human
guggcagugguuuuggcaaac

SEQ ID NO: 2675721 - RNA, 16 nt, Human
guggccacagcgccag

SEQ ID NO: 2675722 - RNA, 17 nt, Human
guggccacagcgccagc

SEQ ID NO: 2675723 - RNA, 21 nt, Human
guggccacagcgccagccuca

SEQ ID NO: 2675724 - RNA, 21 nt, Human
guggccaggcugccuggccuu

SEQ ID NO: 2675725 - RNA, 13 nt, Human
guggccagaggug

SEQ ID NO: 2675726 - RNA, 19 nt, Human
guggccagaggugucaccc

SEQ ID NO: 2675727 - RNA, 15 nt, Human
guggccccacccugg

SEQ ID NO: 2675728 - RNA, 18 nt, Human
guggcccaaggcuggcag

SEQ ID NO: 2675729 - RNA, 19 nt, Human
guggcccaaggcuggcagg

SEQ ID NO: 2675730 - RNA, 18 nt, Human
guggccccacccugggcc

SEQ ID NO: 2675731 - RNA, 19 nt, Human
guggccccacccugggccc

SEQ ID NO: 2675732 - RNA, 20 nt, Human
guggccccacccugggcccu

SEQ ID NO: 2675733 - RNA, 20 nt, Human
guggcaggggacaggagucc

SEQ ID NO: 2675734 - RNA, 16 nt, Human
guggcaggggacagga

SEQ ID NO: 2675735 - RNA, 18 nt, Human
guggcaggggacaggagu

SEQ ID NO: 2675736 - RNA, 14 nt, Human
gugcugcagcaccg

SEQ ID NO: 2675737 - RNA, 22 nt, Human
gugcugcagcaccgaggggccu

SEQ ID NO: 2675738 - RNA, 20 nt, Human
gugcccuuccugcugcgcag

SEQ ID NO: 2675739 - RNA, 17 nt, Human
gugccuuugcagcucag

SEQ ID NO: 2675740 - RNA, 19 nt, Human
gugcugaauguugggacug

SEQ ID NO: 2675741 - RNA, 22 nt, Human
gugcuucacaguagagccagcu

SEQ ID NO: 2675742 - RNA, 13 nt, Human
gugcuuccuugua

SEQ ID NO: 2675743 - RNA, 22 nt, Human
gugcuucugccacccugcugag

SEQ ID NO: 2675744 - RNA, 21 nt, Human
gugcuucugccacccugcuga

SEQ ID NO: 2675745 - RNA, 16 nt, Human
gugcugcccugaagaa

SEQ ID NO: 2675746 - RNA, 11 nt, Human
gugcugcccug

SEQ ID NO: 2675747 - RNA, 11 nt, Human
gugcugugugu

SEQ ID NO: 2675748 - RNA, 18 nt, Human
gugcuuuuauagaggcua

SEQ ID NO: 2675749 - RNA, 19 nt, Human
gugcuuuuauagaggcuag

SEQ ID NO: 2675750 - RNA, 18 nt, Human
guggaaaaauagccugcc

SEQ ID NO: 2675751 - RNA, 18 nt, Human
uauuugaauuuuaaaucu

SEQ ID NO: 2675752 - RNA, 12 nt, Human
uauuugaauuuu

SEQ ID NO: 2675753 - RNA, 21 nt, Human
uauuugaauuuuaaaucuaaa

SEQ ID NO: 2675754 - RNA, 19 nt, Human
uauuugaauuuuaaaucua

SEQ ID NO: 2675755 - RNA, 21 nt, Human
uauuugacaacguuucagcga

SEQ ID NO: 2675756 - RNA, 23 nt, Human
uauuugauuuauuaacuuaauaa

SEQ ID NO: 2675757 - RNA, 19 nt, Human
uauuugauuuauuaacuua

SEQ ID NO: 2675758 - RNA, 16 nt, Human
uauuugauuuauuaac

SEQ ID NO: 2675759 - RNA, 15 nt, Human
uauuugauuuauuaa

SEQ ID NO: 2675760 - RNA, 13 nt, Human
uauuugauuuauu

SEQ ID NO: 2675761 - RNA, 15 nt, Human
uauuugcauguuaug

SEQ ID NO: 2675762 - RNA, 16 nt, Human
uauuugcauguuaugu

SEQ ID NO: 2675763 - RNA, 18 nt, Human
uauuugcauguuauguuu

SEQ ID NO: 2675764 - RNA, 19 nt, Human
uauuugcauguuauguuua

SEQ ID NO: 2675765 - RNA, 11 nt, Human
uauuugcaugu

SEQ ID NO: 2675766 - RNA, 12 nt, Human
uauuugcauguu

SEQ ID NO: 2675767 - RNA, 16 nt, Human
ucaaacuggggccucc

SEQ ID NO: 2675768 - RNA, 14 nt, Human
ucaaacuggggccu

SEQ ID NO: 2675769 - RNA, 23 nt, Human
ucaaacuggggccuccagaacuc

SEQ ID NO: 2675770 - RNA, 22 nt, Human
ucaaacuggggccuccagaacu

SEQ ID NO: 2675771 - RNA, 20 nt, Human
ucaaacuggggccuccagaa

SEQ ID NO: 2675772 - RNA, 19 nt, Human
ucaaacuggggccuccaga

SEQ ID NO: 2675773 - RNA, 17 nt, Human
ucaaacaugagaugugu

SEQ ID NO: 2675774 - RNA, 23 nt, Human
ucaaagagguuuuaaaaaaaucc

SEQ ID NO: 2675775 - RNA, 12 nt, Human
ucaaagagguuu

SEQ ID NO: 2675776 - RNA, 14 nt, Human
ucaaacuuccaguc

SEQ ID NO: 2675777 - RNA, 17 nt, Human
ucaaacuguagaaauga

SEQ ID NO: 2675778 - RNA, 20 nt, Human
ucaaacuguagaaaugauga

SEQ ID NO: 2675779 - RNA, 14 nt, Human
ucaaacuguagaaa

SEQ ID NO: 2675780 - RNA, 19 nt, Human
ucaaccucuucuggcucaa

SEQ ID NO: 2675781 - RNA, 18 nt, Human
ucaaccucgcgcuugcug

SEQ ID NO: 2675782 - RNA, 21 nt, Human
ucaaccucgcgcuugcuggcc

SEQ ID NO: 2675783 - RNA, 18 nt, Human
ucaaccucuucuggcuca

SEQ ID NO: 2675784 - RNA, 17 nt, Human
ucaaccucuucuggcuc

SEQ ID NO: 2675785 - RNA, 20 nt, Human
ucacauuggagucacugcca

SEQ ID NO: 2675786 - RNA, 10 nt, Human
ucaccaccac

SEQ ID NO: 2675787 - RNA, 12 nt, Human
ucaccaccaccc

SEQ ID NO: 2675788 - RNA, 13 nt, Human
ucaccaccacccc

SEQ ID NO: 2675789 - RNA, 18 nt, Human
ucaccaccaccccuacca

SEQ ID NO: 2675790 - RNA, 16 nt, Human
ucacauuguuaagaaa

SEQ ID NO: 2675791 - RNA, 18 nt, Human
ucacauuguuaagaaaaa

SEQ ID NO: 2675792 - RNA, 15 nt, Human
ucaccagagacuuua

SEQ ID NO: 2675793 - RNA, 14 nt, Human
ucaccagagacuuu

SEQ ID NO: 2675794 - RNA, 22 nt, Human
ucacccuuauagucuaagacua

SEQ ID NO: 2675795 - RNA, 13 nt, Human
ucacccuuguccu

SEQ ID NO: 2675796 - RNA, 18 nt, Human
ucacccucuuccugugau

SEQ ID NO: 2675797 - RNA, 22 nt, Human
ucaccgacugaaaauauuguuu

SEQ ID NO: 2675798 - RNA, 20 nt, Human
ucaauuaguaacauucaugu

SEQ ID NO: 2675799 - RNA, 12 nt, Human
ucacacaccugu

SEQ ID NO: 2675800 - RNA, 23 nt, Human
ucaauuaaaauagucucuuuaaa

SEQ ID NO: 2675801 - RNA, 14 nt, Human
ucacacagacacua

SEQ ID NO: 2675802 - RNA, 14 nt, Human
ucacauucuuggcu

SEQ ID NO: 2675803 - RNA, 21 nt, Human
ucacauucuuggcuuaaucau

SEQ ID NO: 2675804 - RNA, 14 nt, Human
ucacaguagagcca

SEQ ID NO: 2675805 - RNA, 21 nt, Human
ucacaguagagccagcuuggg

SEQ ID NO: 2675806 - RNA, 19 nt, Human
ucacaguagagccagcuug

SEQ ID NO: 2675807 - RNA, 20 nt, Human
ucacaguagagccagcuugg

SEQ ID NO: 2675808 - RNA, 15 nt, Human
ucacaguagagccag

SEQ ID NO: 2675809 - RNA, 16 nt, Human
ucacaguagagccagc

SEQ ID NO: 2675810 - RNA, 17 nt, Human
ucacaguagagccagcu

SEQ ID NO: 2675811 - RNA, 18 nt, Human
ucacaguagagccagcuu

SEQ ID NO: 2675812 - RNA, 12 nt, Human
ucacaggguggg

SEQ ID NO: 2675813 - RNA, 15 nt, Human
ucacagggugggccu

SEQ ID NO: 2675814 - RNA, 16 nt, Human
ucacagggugggccuc

SEQ ID NO: 2675815 - RNA, 17 nt, Human
ucacagggugggccucg

SEQ ID NO: 2675816 - RNA, 19 nt, Human
ucacagggugggccucggc

SEQ ID NO: 2675817 - RNA, 19 nt, Human
uauuguugacaacugugac

SEQ ID NO: 2675818 - RNA, 23 nt, Human
uauuguugacaacugugacugua

SEQ ID NO: 2675819 - RNA, 20 nt, Human
uauuguugacaacugugacu

SEQ ID NO: 2675820 - RNA, 20 nt, Human
uauuauuuuuauaauuguac

SEQ ID NO: 2675821 - RNA, 20 nt, Human
uauuauuuuuuuaaaauuuu

SEQ ID NO: 2675822 - RNA, 11 nt, Human
uauugcaguuu

SEQ ID NO: 2675823 - RNA, 13 nt, Human
uauugcaguuuau

SEQ ID NO: 2675824 - RNA, 15 nt, Human
uauugcaguuuauca

SEQ ID NO: 2675825 - RNA, 20 nt, Human
uauugcaguuuaucauucaa

SEQ ID NO: 2675826 - RNA, 19 nt, Human
uauugcaguuuaucauuca

SEQ ID NO: 2675827 - RNA, 13 nt, Human
uauuuauguuugc

SEQ ID NO: 2675828 - RNA, 22 nt, Human
uauuuaugggccccuggcacuc

SEQ ID NO: 2675829 - RNA, 15 nt, Human
uauuuauguacuuuu

SEQ ID NO: 2675830 - RNA, 14 nt, Human
uauuuauuauuuau

SEQ ID NO: 2675831 - RNA, 11 nt, Human
uauuuauuaaa

SEQ ID NO: 2675832 - RNA, 17 nt, Human
uauugugcucagagaca

SEQ ID NO: 2675833 - RNA, 14 nt, Human
uauuugaaagugcc

SEQ ID NO: 2675834 - RNA, 20 nt, Human
uauuugaaagugccuuugca

SEQ ID NO: 2675835 - RNA, 15 nt, Human
uauuugaaagugccu

SEQ ID NO: 2675836 - RNA, 15 nt, Human
uauuugaacaagugg

SEQ ID NO: 2675837 - RNA, 16 nt, Human
uauuugaacaaugaag

SEQ ID NO: 2675838 - RNA, 18 nt, Human
uauuugaacaaugaaguu

SEQ ID NO: 2675839 - RNA, 20 nt, Human
uauuugaacaaugaaguuga

SEQ ID NO: 2675840 - RNA, 16 nt, Human
uauuguuuaaaaugua

SEQ ID NO: 2675841 - RNA, 17 nt, Human
uauuguuuaaaauguaa

SEQ ID NO: 2675842 - RNA, 13 nt, Human
uauuuaacagaaa

SEQ ID NO: 2675843 - RNA, 14 nt, Human
uauuuaacagaaau

SEQ ID NO: 2675844 - RNA, 14 nt, Human
uauuuaaauuacaa

SEQ ID NO: 2675845 - RNA, 18 nt, Human
uauuuaaauuacaauuuu

SEQ ID NO: 2675846 - RNA, 12 nt, Human
uauuuaacagaa

SEQ ID NO: 2675847 - RNA, 21 nt, Human
uauuuaaauccugaagagcau

SEQ ID NO: 2675848 - RNA, 15 nt, Human
uauuuaucugauuaa

SEQ ID NO: 2675849 - RNA, 21 nt, Human
uauuuaucugauuaaguuguc

SEQ ID NO: 2675850 - RNA, 16 nt, Human
uauuuaucugauuaag

SEQ ID NO: 2675851 - RNA, 20 nt, Human
uauuuauccagaaaacugug

SEQ ID NO: 2675852 - RNA, 21 nt, Human
uauuuauccagaaaacuguga

SEQ ID NO: 2675853 - RNA, 23 nt, Human
uauuuauccagaaaacugugauu

SEQ ID NO: 2675854 - RNA, 18 nt, Human
uauuuauauuuauugacu

SEQ ID NO: 2675855 - RNA, 17 nt, Human
uauuuauauuuauugac

SEQ ID NO: 2675856 - RNA, 16 nt, Human
uauuuauauuuauuga

SEQ ID NO: 2675857 - RNA, 15 nt, Human
uauuuauauuuauug

SEQ ID NO: 2675858 - RNA, 22 nt, Human
uauuuauauguauguguuuaga

SEQ ID NO: 2675859 - RNA, 12 nt, Human
uauuuauaugua

SEQ ID NO: 2675860 - RNA, 15 nt, Human
uauuuauauguacug

SEQ ID NO: 2675861 - RNA, 16 nt, Human
uauuuauauguacugu

SEQ ID NO: 2675862 - RNA, 21 nt, Human
uauuuauauguauguguuuag

SEQ ID NO: 2675863 - RNA, 19 nt, Human
uauuuauauguauguguuu

SEQ ID NO: 2675864 - RNA, 18 nt, Human
uauuuauauguauguguu

SEQ ID NO: 2675865 - RNA, 17 nt, Human
uauuuauauguaugugu

SEQ ID NO: 2675866 - RNA, 16 nt, Human
uauuuauauguaugug

SEQ ID NO: 2675867 - RNA, 15 nt, Human
uauuuauauguaugu

SEQ ID NO: 2675868 - RNA, 14 nt, Human
uauuuauauguaug

SEQ ID NO: 2675869 - RNA, 17 nt, Human
uauuuauauguacuguu

SEQ ID NO: 2675870 - RNA, 15 nt, Human
uauuauuuauaauuc

SEQ ID NO: 2675871 - RNA, 22 nt, Human
uauuauuuauuuuuuuuaauug

SEQ ID NO: 2675872 - RNA, 18 nt, Human
uauuauguagguaagacu

SEQ ID NO: 2675873 - RNA, 15 nt, Human
uauuauguaguuguu

SEQ ID NO: 2675874 - RNA, 16 nt, Human
uauuauggaaaacugu

SEQ ID NO: 2675875 - RNA, 20 nt, Human
uauuauggaaaacuguguug

SEQ ID NO: 2675876 - RNA, 20 nt, Human
uauuaucaggggagaaaaau

SEQ ID NO: 2675877 - RNA, 14 nt, Human
uauuaucugggcuu

SEQ ID NO: 2675878 - RNA, 20 nt, Human
uauuaucaaagggauaaaga

SEQ ID NO: 2675879 - RNA, 22 nt, Human
uauuaucaaagggauaaagaaa

SEQ ID NO: 2675880 - RNA, 19 nt, Human
uauuauacaggaaagcaau

SEQ ID NO: 2675881 - RNA, 14 nt, Human
uauuauacauguga

SEQ ID NO: 2675882 - RNA, 19 nt, Human
uauuauacaugugauacau

SEQ ID NO: 2675883 - RNA, 21 nt, Human
uauuauacaugugauacauuu

SEQ ID NO: 2675884 - RNA, 14 nt, Human
uauuaaggaagaca

SEQ ID NO: 2675885 - RNA, 14 nt, Human
uauuauaaucuuau

SEQ ID NO: 2675886 - RNA, 19 nt, Human
uauuauaaucuuauaauug

SEQ ID NO: 2675887 - RNA, 16 nt, Human
uauguguuuagaauug

SEQ ID NO: 2675888 - RNA, 13 nt, Human
uauguguuuagaa

SEQ ID NO: 2675889 - RNA, 13 nt, Human
uauguuaaagaga

SEQ ID NO: 2675890 - RNA, 14 nt, Human
uauguuaaagagaa

SEQ ID NO: 2675891 - RNA, 13 nt, Human
uauggacuaucug

SEQ ID NO: 2675892 - RNA, 17 nt, Human
uauggacuaucugucug

SEQ ID NO: 2675893 - RNA, 18 nt, Human
uauggacuaucugucugg

SEQ ID NO: 2675894 - RNA, 21 nt, Human
uauggacuaucugucuggugg

SEQ ID NO: 2675895 - RNA, 16 nt, Human
uauguucagauuauug

SEQ ID NO: 2675896 - RNA, 18 nt, Human
uauguuguuuauaauaaa

SEQ ID NO: 2675897 - RNA, 18 nt, Human
uauuaacuuaauaaucaa

SEQ ID NO: 2675898 - RNA, 16 nt, Human
uauuaacuuaauaauc

SEQ ID NO: 2675899 - RNA, 20 nt, Human
uauuaacuuaauaaucaaga

SEQ ID NO: 2675900 - RNA, 15 nt, Human
uauuaacuuaauaau

SEQ ID NO: 2675901 - RNA, 20 nt, Human
uaucuaauauauaugaauaa

SEQ ID NO: 2675902 - RNA, 18 nt, Human
uaucuaauauauaugaau

SEQ ID NO: 2675903 - RNA, 17 nt, Human
uaucuaauauauaugaa

SEQ ID NO: 2675904 - RNA, 21 nt, Human
uaucuaauauauaugaauaaa

SEQ ID NO: 2675905 - RNA, 23 nt, Human
uaucugggauuaugguuuuguga

SEQ ID NO: 2675906 - RNA, 15 nt, Human
uaucuggccucugcu

SEQ ID NO: 2675907 - RNA, 22 nt, Human
uaucuggccccagguagaaacu

SEQ ID NO: 2675908 - RNA, 22 nt, Human
uauccugauuauaggauuuuaa

SEQ ID NO: 2675909 - RNA, 12 nt, Human
uauccucuguaa

SEQ ID NO: 2675910 - RNA, 13 nt, Human
uauauaaauguau

SEQ ID NO: 2675911 - RNA, 18 nt, Human
uauauuaaaaaagagaca

SEQ ID NO: 2675912 - RNA, 12 nt, Human
uaugaauaaagu

SEQ ID NO: 2675913 - RNA, 14 nt, Human
uaucuucugauuug

SEQ ID NO: 2675914 - RNA, 23 nt, Human
uaugaaugauuugcauaugaaag

SEQ ID NO: 2675915 - RNA, 16 nt, Human
uaugaaugauuugcau

SEQ ID NO: 2675916 - RNA, 14 nt, Human
uaugacaguaaaca

SEQ ID NO: 2675917 - RNA, 14 nt, Human
uaucuuacaauauu

SEQ ID NO: 2675918 - RNA, 22 nt, Human
uaucuuauaaaguggaaguaug

SEQ ID NO: 2675919 - RNA, 23 nt, Human
uaucuuauaaaguggaaguaugu

SEQ ID NO: 2675920 - RNA, 20 nt, Human
uaucuguuuccugacauugu

SEQ ID NO: 2675921 - RNA, 22 nt, Human
uaucuguuuccugacauugucu

SEQ ID NO: 2675922 - RNA, 11 nt, Human
uaugcaaaagg

SEQ ID NO: 2675923 - RNA, 14 nt, Human
uaugcacaguaaaa

SEQ ID NO: 2675924 - RNA, 15 nt, Human
uaugagacuuuaugu

SEQ ID NO: 2675925 - RNA, 15 nt, Human
uaugagaggcaauga

SEQ ID NO: 2675926 - RNA, 14 nt, Human
uaugagauugguuu

SEQ ID NO: 2675927 - RNA, 20 nt, Human
uaugagauugguuuuccugu

SEQ ID NO: 2675928 - RNA, 21 nt, Human
uaugagauugguuuuccugug

SEQ ID NO: 2675929 - RNA, 13 nt, Human
uaugacuuuuuau

SEQ ID NO: 2675930 - RNA, 19 nt, Human
uaugacuuuuuauaaaaug

SEQ ID NO: 2675931 - RNA, 22 nt, Human
uaugacuuuuuauaaaauggcu

SEQ ID NO: 2675932 - RNA, 17 nt, Human
uaugcaucauuucagga

SEQ ID NO: 2675933 - RNA, 18 nt, Human
uaugcaucauuucaggag

SEQ ID NO: 2675934 - RNA, 14 nt, Human
uaugcacuuggccu

SEQ ID NO: 2675935 - RNA, 13 nt, Human
uauggaaaacugu

SEQ ID NO: 2675936 - RNA, 15 nt, Human
uauggaaaacugugu

SEQ ID NO: 2675937 - RNA, 21 nt, Human
uaugcuuuccaaaccuuaucu

SEQ ID NO: 2675938 - RNA, 13 nt, Human
uaugcuuuauuaa

SEQ ID NO: 2675939 - RNA, 15 nt, Human
uauggaauuuugcaa

SEQ ID NO: 2675940 - RNA, 17 nt, Human
uauaauagcaacuuuug

SEQ ID NO: 2675941 - RNA, 12 nt, Human
uauaauaaauau

SEQ ID NO: 2675942 - RNA, 14 nt, Human
uauaauaaauauau

SEQ ID NO: 2675943 - RNA, 13 nt, Human
uauaauauaaaaa

SEQ ID NO: 2675944 - RNA, 22 nt, Human
uauaauauaaaaaauuuuaaaa

SEQ ID NO: 2675945 - RNA, 12 nt, Human
uauaaauguaua

SEQ ID NO: 2675946 - RNA, 14 nt, Human
uauaaauguauaaa

SEQ ID NO: 2675947 - RNA, 16 nt, Human
uauaaauguauaaaua

SEQ ID NO: 2675948 - RNA, 20 nt, Human
uauaaauguauaaauauaca

SEQ ID NO: 2675949 - RNA, 17 nt, Human
uaguugccuuaaaauaa

SEQ ID NO: 2675950 - RNA, 16 nt, Human
uaguugcaauugaauu

SEQ ID NO: 2675951 - RNA, 14 nt, Human
uaguugcaauugaa

SEQ ID NO: 2675952 - RNA, 12 nt, Human
uauaaagcagua

SEQ ID NO: 2675953 - RNA, 13 nt, Human
uauaauuguacaa

SEQ ID NO: 2675954 - RNA, 14 nt, Human
uauaauuguacaaa

SEQ ID NO: 2675955 - RNA, 16 nt, Human
uauaauuguacaaaau

SEQ ID NO: 2675956 - RNA, 23 nt, Human
uauaauuguacaaaauuaagcaa

SEQ ID NO: 2675957 - RNA, 17 nt, Human
uauaaucuuauaauugu

SEQ ID NO: 2675958 - RNA, 19 nt, Human
uauaauccuuaaaucuuaa

SEQ ID NO: 2675959 - RNA, 22 nt, Human
uauaauccuuaaaucuuaaugu

SEQ ID NO: 2675960 - RNA, 16 nt, Human
uauaaucuuauaauug

SEQ ID NO: 2675961 - RNA, 19 nt, Human
uauauguauuauuuauaau

SEQ ID NO: 2675962 - RNA, 22 nt, Human
uauauguauguguuuagaauug

SEQ ID NO: 2675963 - RNA, 19 nt, Human
uauauguauguguuuagaa

SEQ ID NO: 2675964 - RNA, 18 nt, Human
uauauguauguguuuaga

SEQ ID NO: 2675965 - RNA, 16 nt, Human
uauauguauguguuua

SEQ ID NO: 2675966 - RNA, 15 nt, Human
uauauguauguguuu

SEQ ID NO: 2675967 - RNA, 14 nt, Human
uauaucucuauuug

SEQ ID NO: 2675968 - RNA, 15 nt, Human
uauaucucuauuuga

SEQ ID NO: 2675969 - RNA, 16 nt, Human
uauauguauuauuuau

SEQ ID NO: 2675970 - RNA, 14 nt, Human
uauauguguaugca

SEQ ID NO: 2675971 - RNA, 14 nt, Human
uauauguauguguu

SEQ ID NO: 2675972 - RNA, 12 nt, Human
uauauaaaugua

SEQ ID NO: 2675973 - RNA, 14 nt, Human
uauaucuaucuauu

SEQ ID NO: 2675974 - RNA, 17 nt, Human
uauaucuaucuauuuga

SEQ ID NO: 2675975 - RNA, 19 nt, Human
uauaucuaucuauuugagg

SEQ ID NO: 2675976 - RNA, 17 nt, Human
uauaguguagaaaagaa

SEQ ID NO: 2675977 - RNA, 20 nt, Human
uauaguuauguaaauaauuc

SEQ ID NO: 2675978 - RNA, 16 nt, Human
uauaguuauguaaaua

SEQ ID NO: 2675979 - RNA, 22 nt, Human
uauaguuauguaaauaauucuu

SEQ ID NO: 2675980 - RNA, 22 nt, Human
uauacuggaacccuuuuaaagu

SEQ ID NO: 2675981 - RNA, 22 nt, Human
uauacugaaggaaaaacacaag

SEQ ID NO: 2675982 - RNA, 21 nt, Human
uauacuacuuuguuaggauuu

SEQ ID NO: 2675983 - RNA, 20 nt, Human
uauacugaaggaaaaacaca

SEQ ID NO: 2675984 - RNA, 12 nt, Human
uauacugaagga

SEQ ID NO: 2675985 - RNA, 23 nt, Human
uaggugaucccguuuuccccaug

SEQ ID NO: 2675986 - RNA, 15 nt, Human
uaguaucuauaugac

SEQ ID NO: 2675987 - RNA, 16 nt, Human
uaguaucuauaugacu

SEQ ID NO: 2675988 - RNA, 13 nt, Human
uaguaugaaaaug

SEQ ID NO: 2675989 - RNA, 22 nt, Human
uaguguuauaugaacauacaaa

SEQ ID NO: 2675990 - RNA, 18 nt, Human
uaguguuauaugaacaua

SEQ ID NO: 2675991 - RNA, 17 nt, Human
uaguguuauaugaacau

SEQ ID NO: 2675992 - RNA, 16 nt, Human
uaguguuauaugaaca

SEQ ID NO: 2675993 - RNA, 15 nt, Human
uaguguuauaugaac

SEQ ID NO: 2675994 - RNA, 13 nt, Human
uaguguuauauga

SEQ ID NO: 2675995 - RNA, 20 nt, Human
guggcucugggauccugggg

SEQ ID NO: 2675996 - RNA, 22 nt, Human
guggcugaugguguggccugug

SEQ ID NO: 2675997 - RNA, 17 nt, Human
uaggaaucauucagaaa

SEQ ID NO: 2675998 - RNA, 20 nt, Human
uaggaaucauucagaaaugu

SEQ ID NO: 2675999 - RNA, 22 nt, Human
uaggaaucauucagaaauguug

SEQ ID NO: 2676000 - RNA, 14 nt, Human
uaggaccaagaaag

SEQ ID NO: 2676001 - RNA, 17 nt, Human
uaggaccaagcaucuug

SEQ ID NO: 2676002 - RNA, 22 nt, Human
uaggaccaagcaucuugggggg

SEQ ID NO: 2676003 - RNA, 18 nt, Human
uaggaccaagcaucuugg

SEQ ID NO: 2676004 - RNA, 21 nt, Human
uaggcccccacuugccucuuc

SEQ ID NO: 2676005 - RNA, 14 nt, Human
uaggcccccacuug

SEQ ID NO: 2676006 - RNA, 19 nt, Human
uaggcccccacuugccucu

SEQ ID NO: 2676007 - RNA, 21 nt, Human
uaggccuuccucucuccagau

SEQ ID NO: 2676008 - RNA, 20 nt, Human
uagguagaagugagcaaaaa

SEQ ID NO: 2676009 - RNA, 15 nt, Human
uagguccucagaaag

SEQ ID NO: 2676010 - RNA, 15 nt, Human
uagguagagucugag

SEQ ID NO: 2676011 - RNA, 20 nt, Human
uaggcuauuuucuaaagacu

SEQ ID NO: 2676012 - RNA, 23 nt, Human
uaggccuuccucucuccagaugu

SEQ ID NO: 2676013 - RNA, 21 nt, Human
uagggaaaaaccagcguguga

SEQ ID NO: 2676014 - RNA, 20 nt, Human
uagggaaaaaccagcgugug

SEQ ID NO: 2676015 - RNA, 19 nt, Human
uagggaaaaaccagcgugu

SEQ ID NO: 2676016 - RNA, 17 nt, Human
uaggcucugccugacag

SEQ ID NO: 2676017 - RNA, 11 nt, Human
uagggaaaaac

SEQ ID NO: 2676018 - RNA, 19 nt, Human
uccaaaaagcuccuggggc

SEQ ID NO: 2676019 - RNA, 15 nt, Human
uccaaaccuuaucuc

SEQ ID NO: 2676020 - RNA, 19 nt, Human
uccaaagaggcugccccuc

SEQ ID NO: 2676021 - RNA, 13 nt, Human
uccaaagaggcug

SEQ ID NO: 2676022 - RNA, 14 nt, Human
uccaaagaggcugc

SEQ ID NO: 2676023 - RNA, 15 nt, Human
uccaaagaggcugcc

SEQ ID NO: 2676024 - RNA, 16 nt, Human
uccaaagaggcugccc

SEQ ID NO: 2676025 - RNA, 18 nt, Human
uccaaagaggcugccccu

SEQ ID NO: 2676026 - RNA, 14 nt, Human
ucauuuaagggaaa

SEQ ID NO: 2676027 - RNA, 15 nt, Human
ucauuuaagggaaaa

SEQ ID NO: 2676028 - RNA, 16 nt, Human
ucauuuaagggaaaaa

SEQ ID NO: 2676029 - RNA, 17 nt, Human
ucauuuaagggaaaaau

SEQ ID NO: 2676030 - RNA, 23 nt, Human
ucauuuaagggaaaaauauauau

SEQ ID NO: 2676031 - RNA, 19 nt, Human
ucauuuaagggaaagaaaa

SEQ ID NO: 2676032 - RNA, 23 nt, Human
ucaucaaucaaauaaguauuuau

SEQ ID NO: 2676033 - RNA, 21 nt, Human
ucaucaaucaaauaaguauuu

SEQ ID NO: 2676034 - RNA, 13 nt, Human
ucaucaaucaaau

SEQ ID NO: 2676035 - RNA, 15 nt, Human
ucaucacaagaacac

SEQ ID NO: 2676036 - RNA, 23 nt, Human
ucaucacaagaacacacacauau

SEQ ID NO: 2676037 - RNA, 14 nt, Human
ucaucucauuuaag

SEQ ID NO: 2676038 - RNA, 16 nt, Human
ucaucucauuuaaggg

SEQ ID NO: 2676039 - RNA, 20 nt, Human
ucaucucauuuaagggaaaa

SEQ ID NO: 2676040 - RNA, 21 nt, Human
ucaucucauuuaagggaaaaa

SEQ ID NO: 2676041 - RNA, 22 nt, Human
ucaucucauuuaagggaaaaau

SEQ ID NO: 2676042 - RNA, 23 nt, Human
ucaucucauuuaagggaaaaaua

SEQ ID NO: 2676043 - RNA, 23 nt, Human
ucagcucugcaagaauugaagca

SEQ ID NO: 2676044 - RNA, 13 nt, Human
ucaccgcccauca

SEQ ID NO: 2676045 - RNA, 15 nt, Human
ucaccgcccaucagg

SEQ ID NO: 2676046 - RNA, 20 nt, Human
ucaccgcccaucaggguucu

SEQ ID NO: 2676047 - RNA, 22 nt, Human
ucagcuccagggaauccaagcc

SEQ ID NO: 2676048 - RNA, 23 nt, Human
ucagcuccagggaauccaagccu

SEQ ID NO: 2676049 - RNA, 17 nt, Human
ucaggaauauuuuccaa

SEQ ID NO: 2676050 - RNA, 18 nt, Human
ucaggaauauuuuccaaa

SEQ ID NO: 2676051 - RNA, 23 nt, Human
ucaggccggcagccccagccugc

SEQ ID NO: 2676052 - RNA, 22 nt, Human
ucaggccggcagccccagccug

SEQ ID NO: 2676053 - RNA, 21 nt, Human
ucaggccggcagccccagccu

SEQ ID NO: 2676054 - RNA, 18 nt, Human
ucaggccggcagccccag

SEQ ID NO: 2676055 - RNA, 21 nt, Human
ucaggaguuacuggauuuguu

SEQ ID NO: 2676056 - RNA, 15 nt, Human
ucaggcugaaaacaa

SEQ ID NO: 2676057 - RNA, 16 nt, Human
ucaggcugaaaacaau

SEQ ID NO: 2676058 - RNA, 23 nt, Human
ucaggugagaagcagaggaagga

SEQ ID NO: 2676059 - RNA, 14 nt, Human
ucagugcauuugug

SEQ ID NO: 2676060 - RNA, 16 nt, Human
ucagugcauuugugcu

SEQ ID NO: 2676061 - RNA, 17 nt, Human
ucagucacauggcaugg

SEQ ID NO: 2676062 - RNA, 21 nt, Human
uccauuccacacagaaugcaa

SEQ ID NO: 2676063 - RNA, 22 nt, Human
uccauuccacacagaaugcaac

SEQ ID NO: 2676064 - RNA, 15 nt, Human
ucccaggaagcccag

SEQ ID NO: 2676065 - RNA, 16 nt, Human
ucccaggaagcccagg

SEQ ID NO: 2676066 - RNA, 20 nt, Human
uccccagcauuccagccccu

SEQ ID NO: 2676067 - RNA, 22 nt, Human
ucccauguagcccccuggccuc

SEQ ID NO: 2676068 - RNA, 15 nt, Human
uccagaucacugcca

SEQ ID NO: 2676069 - RNA, 22 nt, Human
uccacuuuguuucguggggagg

SEQ ID NO: 2676070 - RNA, 23 nt, Human
uccacuuuguuucguggggaggu

SEQ ID NO: 2676071 - RNA, 15 nt, Human
uccacuuuguuucgu

SEQ ID NO: 2676072 - RNA, 18 nt, Human
uccacuuuguuucguggg

SEQ ID NO: 2676073 - RNA, 19 nt, Human
uccacuuuguuucgugggg

SEQ ID NO: 2676074 - RNA, 14 nt, Human
uccagaaaacugug

SEQ ID NO: 2676075 - RNA, 15 nt, Human
uccagaaaacuguga

SEQ ID NO: 2676076 - RNA, 23 nt, Human
uccagaaaacugugauuucagga

SEQ ID NO: 2676077 - RNA, 17 nt, Human
uccaaagacucuuggga

SEQ ID NO: 2676078 - RNA, 16 nt, Human
uccagaucacugccac

SEQ ID NO: 2676079 - RNA, 17 nt, Human
uccagaucacugccaca

SEQ ID NO: 2676080 - RNA, 14 nt, Human
uccagcaccuugug

SEQ ID NO: 2676081 - RNA, 15 nt, Human
uccagcaccuugugc

SEQ ID NO: 2676082 - RNA, 18 nt, Human
uccagcaccuugugccug

SEQ ID NO: 2676083 - RNA, 19 nt, Human
uccagcaccuugugccugg

SEQ ID NO: 2676084 - RNA, 21 nt, Human
uccagcaccuugugccugggg

SEQ ID NO: 2676085 - RNA, 22 nt, Human
uccagcaccuugugccuggggu

SEQ ID NO: 2676086 - RNA, 12 nt, Human
uccagcucugga

SEQ ID NO: 2676087 - RNA, 13 nt, Human
uccagcucuggag

SEQ ID NO: 2676088 - RNA, 15 nt, Human
uccagcucuggaggg

SEQ ID NO: 2676089 - RNA, 20 nt, Human
uccagcucuggaggggaggg

SEQ ID NO: 2676090 - RNA, 23 nt, Human
uccaggggcugcuuccuccugga

SEQ ID NO: 2676091 - RNA, 21 nt, Human
uccaggggcugcuuccuccug

SEQ ID NO: 2676092 - RNA, 22 nt, Human
uccaggggcugcuuccuccugg

SEQ ID NO: 2676093 - RNA, 21 nt, Human
uccagcugcccuuccgcagug

SEQ ID NO: 2676094 - RNA, 17 nt, Human
uccagcugccuauugau

SEQ ID NO: 2676095 - RNA, 16 nt, Human
uccaucacuauaauaa

SEQ ID NO: 2676096 - RNA, 17 nt, Human
uccaucacccucuuccu

SEQ ID NO: 2676097 - RNA, 17 nt, Human
uccauauuuuauuacug

SEQ ID NO: 2676098 - RNA, 18 nt, Human
uccauauuuuauuacugu

SEQ ID NO: 2676099 - RNA, 19 nt, Human
uccauauuuuauuacuguu

SEQ ID NO: 2676100 - RNA, 20 nt, Human
uccauauuuuauuacuguuu

SEQ ID NO: 2676101 - RNA, 23 nt, Human
uccauauuuuauuacuguuuauu

SEQ ID NO: 2676102 - RNA, 23 nt, Human
uccaucacccucuuccugugauc

SEQ ID NO: 2676103 - RNA, 13 nt, Human
uccaguuauaaga

SEQ ID NO: 2676104 - RNA, 15 nt, Human
uccaguuauaagaag

SEQ ID NO: 2676105 - RNA, 16 nt, Human
uccaguuauaagaaga

SEQ ID NO: 2676106 - RNA, 20 nt, Human
uccaguucaucgauuuucua

SEQ ID NO: 2676107 - RNA, 21 nt, Human
uccaguucaucgauuuucuau

SEQ ID NO: 2676108 - RNA, 21 nt, Human
uccaguaagaucacuguuuag

SEQ ID NO: 2676109 - RNA, 17 nt, Human
uccaguuugucuuggau

SEQ ID NO: 2676110 - RNA, 13 nt, Human
uccauaaacauga

SEQ ID NO: 2676111 - RNA, 16 nt, Human
uccauaaacaugaaaa

SEQ ID NO: 2676112 - RNA, 20 nt, Human
uccagguuuaagcuguuacu

SEQ ID NO: 2676113 - RNA, 15 nt, Human
uccaguaagaucacu

SEQ ID NO: 2676114 - RNA, 20 nt, Human
uccaguaagaucacuguuua

SEQ ID NO: 2676115 - RNA, 19 nt, Human
uccaguaagaucacuguuu

SEQ ID NO: 2676116 - RNA, 18 nt, Human
uccaguaagaucacuguu

SEQ ID NO: 2676117 - RNA, 17 nt, Human
uccaguaagaucacugu

SEQ ID NO: 2676118 - RNA, 13 nt, Human
uccuccaggccug

SEQ ID NO: 2676119 - RNA, 17 nt, Human
uccuccaggccugccuc

SEQ ID NO: 2676120 - RNA, 19 nt, Human
uccuccaggccugccuccc

SEQ ID NO: 2676121 - RNA, 18 nt, Human
uccucauuagcauuuugc

SEQ ID NO: 2676122 - RNA, 13 nt, Human
uccuccaacagcu

SEQ ID NO: 2676123 - RNA, 13 nt, Human
uccuaguaagaag

SEQ ID NO: 2676124 - RNA, 14 nt, Human
uccuaguaagaaga

SEQ ID NO: 2676125 - RNA, 16 nt, Human
ucccuuccccaugcuu

SEQ ID NO: 2676126 - RNA, 19 nt, Human
uccuacacuugagagaaaa

SEQ ID NO: 2676127 - RNA, 18 nt, Human
uccuacauaucccuucca

SEQ ID NO: 2676128 - RNA, 19 nt, Human
uccuacauaucccuuccag

SEQ ID NO: 2676129 - RNA, 20 nt, Human
uccuacauaucccuuccaga

SEQ ID NO: 2676130 - RNA, 12 nt, Human
uccccccaucuu

SEQ ID NO: 2676131 - RNA, 15 nt, Human
uccccccaucuugcu

SEQ ID NO: 2676132 - RNA, 18 nt, Human
uccccccccaaccuuucc

SEQ ID NO: 2676133 - RNA, 19 nt, Human
uccccccccaaccuuuccc

SEQ ID NO: 2676134 - RNA, 22 nt, Human
uccccccaucuugcuucccuaa

SEQ ID NO: 2676135 - RNA, 15 nt, Human
ucccuugcuggcccc

SEQ ID NO: 2676136 - RNA, 16 nt, Human
ucccuugcuggcccca

SEQ ID NO: 2676137 - RNA, 17 nt, Human
ucccuugcuggccccag

SEQ ID NO: 2676138 - RNA, 19 nt, Human
ucccuugcuggccccagcc

SEQ ID NO: 2676139 - RNA, 21 nt, Human
ucccuugcuggccccagcccu

SEQ ID NO: 2676140 - RNA, 23 nt, Human
ucccuugcuggccccagcccugc

SEQ ID NO: 2676141 - RNA, 14 nt, Human
ucccuugcuugccu

SEQ ID NO: 2676142 - RNA, 20 nt, Human
ucccuugcuugccugcaggg

SEQ ID NO: 2676143 - RNA, 21 nt, Human
ucccuugcuugccugcagggc

SEQ ID NO: 2676144 - RNA, 23 nt, Human
ucccuugcuugccugcagggcca

SEQ ID NO: 2676145 - RNA, 17 nt, Human
uccgccagccuccucug

SEQ ID NO: 2676146 - RNA, 18 nt, Human
uccgccagccuccucugg

SEQ ID NO: 2676147 - RNA, 11 nt, Human
uccgccagccu

SEQ ID NO: 2676148 - RNA, 12 nt, Human
uccgccagccuc

SEQ ID NO: 2676149 - RNA, 13 nt, Human
uccgccagccucc

SEQ ID NO: 2676150 - RNA, 14 nt, Human
uccgccagccuccu

SEQ ID NO: 2676151 - RNA, 15 nt, Human
uccgccagccuccuc

SEQ ID NO: 2676152 - RNA, 16 nt, Human
uccgccagccuccucu

SEQ ID NO: 2676153 - RNA, 21 nt, Human
uccgcaucccuaccgacccag

SEQ ID NO: 2676154 - RNA, 14 nt, Human
uccgcaucccuacc

SEQ ID NO: 2676155 - RNA, 18 nt, Human
uccgcaguguggccaggc

SEQ ID NO: 2676156 - RNA, 19 nt, Human
uccgcaguguggccaggcu

SEQ ID NO: 2676157 - RNA, 12 nt, Human
uccgcaggacuu

SEQ ID NO: 2676158 - RNA, 14 nt, Human
uccgcgugugccug

SEQ ID NO: 2676159 - RNA, 18 nt, Human
uccgcgugugccugugug

SEQ ID NO: 2676160 - RNA, 19 nt, Human
uccgcgugugccugugugc

SEQ ID NO: 2676161 - RNA, 14 nt, Human
uccgcugccagccu

SEQ ID NO: 2676162 - RNA, 16 nt, Human
uccgcugccagccuug

SEQ ID NO: 2676163 - RNA, 19 nt, Human
uccgcugccagccuugagc

SEQ ID NO: 2676164 - RNA, 14 nt, Human
uccgcugccgugcc

SEQ ID NO: 2676165 - RNA, 14 nt, Human
uccuggccuauccg

SEQ ID NO: 2676166 - RNA, 18 nt, Human
uccuggccuauccgcugc

SEQ ID NO: 2676167 - RNA, 22 nt, Human
uccuggccuauccgcugccagc

SEQ ID NO: 2676168 - RNA, 23 nt, Human
uccuggccuauccgcugccagcc

SEQ ID NO: 2676169 - RNA, 12 nt, Human
uccuggcgccug

SEQ ID NO: 2676170 - RNA, 14 nt, Human
uccugccaggcaug

SEQ ID NO: 2676171 - RNA, 13 nt, Human
uccugccaggcau

SEQ ID NO: 2676172 - RNA, 13 nt, Human
uccugagcuagga

SEQ ID NO: 2676173 - RNA, 15 nt, Human
uccugacucucuccu

SEQ ID NO: 2676174 - RNA, 20 nt, Human
uccugacugaaaguaggggg

SEQ ID NO: 2676175 - RNA, 13 nt, Human
uccugacuggugc

SEQ ID NO: 2676176 - RNA, 14 nt, Human
uccugacuggugcu

SEQ ID NO: 2676177 - RNA, 15 nt, Human
uccugacuggugcug

SEQ ID NO: 2676178 - RNA, 20 nt, Human
uccucccacccggcugcaga

SEQ ID NO: 2676179 - RNA, 21 nt, Human
uccucccacccggcugcagag

SEQ ID NO: 2676180 - RNA, 14 nt, Human
uccuccucccaccc

SEQ ID NO: 2676181 - RNA, 20 nt, Human
uccuccucccacccggcugc

SEQ ID NO: 2676182 - RNA, 14 nt, Human
ucuacaaucucuuu

SEQ ID NO: 2676183 - RNA, 19 nt, Human
ucuacaaucucuuuuuguu

SEQ ID NO: 2676184 - RNA, 22 nt, Human
ucuacaaucucuuuuuguuugc

SEQ ID NO: 2676185 - RNA, 16 nt, Human
ucuacaaugacacaca

SEQ ID NO: 2676186 - RNA, 21 nt, Human
ucuacuuaauccaauggguuu

SEQ ID NO: 2676187 - RNA, 22 nt, Human
ucuacugucaaaugaugugcaa

SEQ ID NO: 2676188 - RNA, 23 nt, Human
ucuacugucaaaugaugugcaaa

SEQ ID NO: 2676189 - RNA, 12 nt, Human
ucuacguuucuu

SEQ ID NO: 2676190 - RNA, 13 nt, Human
ucuacguuucuuu

SEQ ID NO: 2676191 - RNA, 14 nt, Human
ucuacguuucuuua

SEQ ID NO: 2676192 - RNA, 20 nt, Human
uccuuagagguccucuggag

SEQ ID NO: 2676193 - RNA, 19 nt, Human
uccuuagaaaaaaaauuau

SEQ ID NO: 2676194 - RNA, 16 nt, Human
ucggagaagagcgcag

SEQ ID NO: 2676195 - RNA, 21 nt, Human
ucggagaagagcgcaguguuu

SEQ ID NO: 2676196 - RNA, 18 nt, Human
ucggauaguugcuauuuu

SEQ ID NO: 2676197 - RNA, 23 nt, Human
ucggauaguugcuauuuuuguaa

SEQ ID NO: 2676198 - RNA, 16 nt, Human
ucggaucaggcuccca

SEQ ID NO: 2676199 - RNA, 15 nt, Human
ucgugaagaagccug

SEQ ID NO: 2676200 - RNA, 21 nt, Human
ucgugaagaagccuguaacac

SEQ ID NO: 2676201 - RNA, 15 nt, Human
ucgucuuucccaugg

SEQ ID NO: 2676202 - RNA, 18 nt, Human
ucgucuuucccaugggga

SEQ ID NO: 2676203 - RNA, 20 nt, Human
ucgucuuucccauggggagg

SEQ ID NO: 2676204 - RNA, 22 nt, Human
ucgugaaagugcauuuuuguaa

SEQ ID NO: 2676205 - RNA, 22 nt, Human
ucguggacugagugggaagccc

SEQ ID NO: 2676206 - RNA, 22 nt, Human
ucguggacacacacagacuauu

SEQ ID NO: 2676207 - RNA, 20 nt, Human
ucguggacugagugggaagc

SEQ ID NO: 2676208 - RNA, 17 nt, Human
ucguggacacacacaga

SEQ ID NO: 2676209 - RNA, 18 nt, Human
ucguggacacacacagac

SEQ ID NO: 2676210 - RNA, 18 nt, Human
ucuaaagguggugaggca

SEQ ID NO: 2676211 - RNA, 14 nt, Human
ucuaaaguaaaaag

SEQ ID NO: 2676212 - RNA, 22 nt, Human
ucgugucauacucgagucugag

SEQ ID NO: 2676213 - RNA, 23 nt, Human
ucuaugcuuuccaaaccuuaucu

SEQ ID NO: 2676214 - RNA, 18 nt, Human
ucuaugcuuuccaaaccu

SEQ ID NO: 2676215 - RNA, 14 nt, Human
ucuccccucagcuc

SEQ ID NO: 2676216 - RNA, 18 nt, Human
ucuccacugugcuuucag

SEQ ID NO: 2676217 - RNA, 19 nt, Human
ucuccccagguccagcucu

SEQ ID NO: 2676218 - RNA, 20 nt, Human
ucuccccagguccagcucug

SEQ ID NO: 2676219 - RNA, 22 nt, Human
ucuccccagguccagcucugga

SEQ ID NO: 2676220 - RNA, 15 nt, Human
ucuccccagguccag

SEQ ID NO: 2676221 - RNA, 13 nt, Human
ucucccuggcucc

SEQ ID NO: 2676222 - RNA, 14 nt, Human
ucucccuggcuccc

SEQ ID NO: 2676223 - RNA, 15 nt, Human
ucucccuggcucccu

SEQ ID NO: 2676224 - RNA, 20 nt, Human
ucucccuggcucccuccucc

SEQ ID NO: 2676225 - RNA, 23 nt, Human
ucucccuggcucccuccuccagg

SEQ ID NO: 2676226 - RNA, 12 nt, Human
ucucccugccug

SEQ ID NO: 2676227 - RNA, 13 nt, Human
ucucccugccugg

SEQ ID NO: 2676228 - RNA, 14 nt, Human
ucucccugccuggc

SEQ ID NO: 2676229 - RNA, 15 nt, Human
ucucccugccuggcc

SEQ ID NO: 2676230 - RNA, 16 nt, Human
ucucccugccuggccc

SEQ ID NO: 2676231 - RNA, 17 nt, Human
ucucccugccuggcccc

SEQ ID NO: 2676232 - RNA, 13 nt, Human
ucuccccucagcu

SEQ ID NO: 2676233 - RNA, 14 nt, Human
ucuccagauguuuc

SEQ ID NO: 2676234 - RNA, 18 nt, Human
ucuccagauguuuccaga

SEQ ID NO: 2676235 - RNA, 15 nt, Human
ucuccagauguuucc

SEQ ID NO: 2676236 - RNA, 19 nt, Human
ucuccagauguuuccagac

SEQ ID NO: 2676237 - RNA, 10 nt, Human
ucuccacugu

SEQ ID NO: 2676238 - RNA, 19 nt, Human
ucuccacugugcacaccca

SEQ ID NO: 2676239 - RNA, 21 nt, Human
ucuccacugugcacacccacc

SEQ ID NO: 2676240 - RNA, 22 nt, Human
ucuccagccucagcccccugcu

SEQ ID NO: 2676241 - RNA, 23 nt, Human
ucuccagccucagcccccugcuu

SEQ ID NO: 2676242 - RNA, 21 nt, Human
ucuccagcgucagcugcuccc

SEQ ID NO: 2676243 - RNA, 14 nt, Human
ugacaauguuguag

SEQ ID NO: 2676244 - RNA, 13 nt, Human
ugacaauguugua

SEQ ID NO: 2676245 - RNA, 16 nt, Human
ugacaauuuuguacaa

SEQ ID NO: 2676246 - RNA, 16 nt, Human
ugacaauucuguuuuu

SEQ ID NO: 2676247 - RNA, 17 nt, Human
ugacaauucuguuuuua

SEQ ID NO: 2676248 - RNA, 22 nt, Human
ugacaauuuuguacaaauuugu

SEQ ID NO: 2676249 - RNA, 18 nt, Human
ugacaauuuuguacaaau

SEQ ID NO: 2676250 - RNA, 16 nt, Human
ugacaauauuccagau

SEQ ID NO: 2676251 - RNA, 24 nt, Human
ugacaauauuccagaucuuucaga

SEQ ID NO: 2676252 - RNA, 14 nt, Human
ugacaauaaagcuu

SEQ ID NO: 2676253 - RNA, 15 nt, Human
ugacaauaaagcuug

SEQ ID NO: 2676254 - RNA, 19 nt, Human
ugacaauaaagcuuguuga

SEQ ID NO: 2676255 - RNA, 15 nt, Human
ugacagaaggugcca

SEQ ID NO: 2676256 - RNA, 17 nt, Human
ugacagaaggugccacu

SEQ ID NO: 2676257 - RNA, 20 nt, Human
ugacagaaggugccacuuua

SEQ ID NO: 2676258 - RNA, 23 nt, Human
ugacaagcuggcuuacacuggca

SEQ ID NO: 2676259 - RNA, 21 nt, Human
ugacaagcuggcuuacacugg

SEQ ID NO: 2676260 - RNA, 14 nt, Human
ugacaagcuggcuu

SEQ ID NO: 2676261 - RNA, 22 nt, Human
ugacagagggauggaggaagaa

SEQ ID NO: 2676262 - RNA, 15 nt, Human
ugacauggugccuga

SEQ ID NO: 2676263 - RNA, 15 nt, Human
ugacauaucuacacu

SEQ ID NO: 2676264 - RNA, 16 nt, Human
ugacauggugccugag

SEQ ID NO: 2676265 - RNA, 17 nt, Human
ugacauggugccugaga

SEQ ID NO: 2676266 - RNA, 18 nt, Human
ugacauggugccugagag

SEQ ID NO: 2676267 - RNA, 21 nt, Human
ugacauggugccugagaggca

SEQ ID NO: 2676268 - RNA, 14 nt, Human
ugaccagaaauggu

SEQ ID NO: 2676269 - RNA, 16 nt, Human
ugaccacuugaggccu

SEQ ID NO: 2676270 - RNA, 17 nt, Human
ugaccacuugaggccug

SEQ ID NO: 2676271 - RNA, 18 nt, Human
ugaccacuugaggccuga

SEQ ID NO: 2676272 - RNA, 20 nt, Human
ugaccacuugaggccugauc

SEQ ID NO: 2676273 - RNA, 16 nt, Human
ugaccaggcugccucc

SEQ ID NO: 2676274 - RNA, 16 nt, Human
ugaccaggaucccaag

SEQ ID NO: 2676275 - RNA, 22 nt, Human
ugaccaggaucccaagccuccu

SEQ ID NO: 2676276 - RNA, 13 nt, Human
ugaagugcuugga

SEQ ID NO: 2676277 - RNA, 16 nt, Human
ugaaguugaaaaucau

SEQ ID NO: 2676278 - RNA, 18 nt, Human
ugaaguguauaauauaaa

SEQ ID NO: 2676279 - RNA, 20 nt, Human
ugaaguguauaauauaaaaa

SEQ ID NO: 2676280 - RNA, 18 nt, Human
ugaaggacuuuggcccua

SEQ ID NO: 2676281 - RNA, 17 nt, Human
ugaagauacuuuguauu

SEQ ID NO: 2676282 - RNA, 16 nt, Human
ugaagauacuuuguau

SEQ ID NO: 2676283 - RNA, 19 nt, Human
ugaagauacuuuguauugu

SEQ ID NO: 2676284 - RNA, 12 nt, Human
ugaagauacuuu

SEQ ID NO: 2676285 - RNA, 15 nt, Human
ugaagauacuuugua

SEQ ID NO: 2676286 - RNA, 14 nt, Human
ugaagauacuuugu

SEQ ID NO: 2676287 - RNA, 21 nt, Human
ugaauuauccacaugaaaaua

SEQ ID NO: 2676288 - RNA, 22 nt, Human
ugaauuauccacaugaaaauaa

SEQ ID NO: 2676289 - RNA, 15 nt, Human
ugaauuauauguuca

SEQ ID NO: 2676290 - RNA, 13 nt, Human
ugaauuauugaca

SEQ ID NO: 2676291 - RNA, 14 nt, Human
ugaauuauugacac

SEQ ID NO: 2676292 - RNA, 15 nt, Human
ugaauuauugacacu

SEQ ID NO: 2676293 - RNA, 16 nt, Human
ugaauuauugacacug

SEQ ID NO: 2676294 - RNA, 17 nt, Human
ugaauuauugacacuga

SEQ ID NO: 2676295 - RNA, 18 nt, Human
ugaauuauugacacugaa

SEQ ID NO: 2676296 - RNA, 21 nt, Human
ugaauuauugacacugaacuu

SEQ ID NO: 2676297 - RNA, 23 nt, Human
ugaaugagucuguugugugucau

SEQ ID NO: 2676298 - RNA, 18 nt, Human
ugaaugagucuguugugu

SEQ ID NO: 2676299 - RNA, 21 nt, Human
ugaaugagucuguuguguguc

SEQ ID NO: 2676300 - RNA, 21 nt, Human
ugaauguuaaagggauauuuu

SEQ ID NO: 2676301 - RNA, 12 nt, Human
ugaaugacaaag

SEQ ID NO: 2676302 - RNA, 16 nt, Human
ugaaugacaaaguaug

SEQ ID NO: 2676303 - RNA, 21 nt, Human
ugaaaggcuuuucaaccacaa

SEQ ID NO: 2676304 - RNA, 15 nt, Human
ugaaaggcuuuucaa

SEQ ID NO: 2676305 - RNA, 11 nt, Human
ugaaaggcuuu

SEQ ID NO: 2676306 - RNA, 16 nt, Human
ugaaagaugaucauuu

SEQ ID NO: 2676307 - RNA, 18 nt, Human
ugaaagcccugagcuuuc

SEQ ID NO: 2676308 - RNA, 17 nt, Human
ugaaaccccaaacagug

SEQ ID NO: 2676309 - RNA, 19 nt, Human
ugaaaccccaaacagugac

SEQ ID NO: 2676310 - RNA, 23 nt, Human
ugaaaccccaaacagugacugua

SEQ ID NO: 2676311 - RNA, 14 nt, Human
ugaaaagauucuuc

SEQ ID NO: 2676312 - RNA, 16 nt, Human
ugaaaagcagacauuu

SEQ ID NO: 2676313 - RNA, 12 nt, Human
ugaaaugugaau

SEQ ID NO: 2676314 - RNA, 20 nt, Human
ugaaaugugaauuuuuauug

SEQ ID NO: 2676315 - RNA, 21 nt, Human
ugaaaugugaauuuuuauugu

SEQ ID NO: 2676316 - RNA, 22 nt, Human
ugaaaugugaauuuuuauuguu

SEQ ID NO: 2676317 - RNA, 13 nt, Human
ugaaauguuacaa

SEQ ID NO: 2676318 - RNA, 20 nt, Human
ugaaauguuacaaaaauaaa

SEQ ID NO: 2676319 - RNA, 22 nt, Human
ugaaauguuacaaaaauaaacu

SEQ ID NO: 2676320 - RNA, 19 nt, Human
ugaaauuacggguaccuga

SEQ ID NO: 2676321 - RNA, 20 nt, Human
ugaaauuacggguaccugaa

SEQ ID NO: 2676322 - RNA, 22 nt, Human
ugaaauuacggguaccugaaga

SEQ ID NO: 2676323 - RNA, 14 nt, Human
ugaaauucuccugg

SEQ ID NO: 2676324 - RNA, 15 nt, Human
ugaaauucuccugga

SEQ ID NO: 2676325 - RNA, 16 nt, Human
ugaaauucuccuggag

SEQ ID NO: 2676326 - RNA, 23 nt, Human
ugaacaagugggccauuagccag

SEQ ID NO: 2676327 - RNA, 14 nt, Human
ugaacaaugaaguu

SEQ ID NO: 2676328 - RNA, 15 nt, Human
ugaacaaugaaguug

SEQ ID NO: 2676329 - RNA, 18 nt, Human
ugaacaaugaaguugaaa

SEQ ID NO: 2676330 - RNA, 23 nt, Human
ugaacaaugaaguugaaaaucau

SEQ ID NO: 2676331 - RNA, 17 nt, Human
ugaacaagcuucaguaa

SEQ ID NO: 2676332 - RNA, 22 nt, Human
ucuuguugcucaaaaaaugagc

SEQ ID NO: 2676333 - RNA, 18 nt, Human
ucuuguugcuguacaaaa

SEQ ID NO: 2676334 - RNA, 21 nt, Human
ucuuguugcucaaaaaaugag

SEQ ID NO: 2676335 - RNA, 11 nt, Human
ucuuguugguu

SEQ ID NO: 2676336 - RNA, 14 nt, Human
ucuuguuucugaaa

SEQ ID NO: 2676337 - RNA, 20 nt, Human
ucuuucaagcagucgugccu

SEQ ID NO: 2676338 - RNA, 21 nt, Human
ucuuucaagcagucgugccug

SEQ ID NO: 2676339 - RNA, 17 nt, Human
ucuuuauuuuguguaaa

SEQ ID NO: 2676340 - RNA, 18 nt, Human
ucuuuauuuuguguaaaa

SEQ ID NO: 2676341 - RNA, 18 nt, Human
ucuugcuucccuaaucua

SEQ ID NO: 2676342 - RNA, 22 nt, Human
ucuugcuucccuaaucuauggu

SEQ ID NO: 2676343 - RNA, 23 nt, Human
ucuugcuucccuaaucuaugguc

SEQ ID NO: 2676344 - RNA, 16 nt, Human
ucuugcaccaaauuau

SEQ ID NO: 2676345 - RNA, 21 nt, Human
ucuugcaccaaauuaucuuga

SEQ ID NO: 2676346 - RNA, 22 nt, Human
ucuugcaccaaauuaucuugau

SEQ ID NO: 2676347 - RNA, 10 nt, Human
ucuuucaugg

SEQ ID NO: 2676348 - RNA, 23 nt, Human
ucuuuccaggcuauguauaaaau

SEQ ID NO: 2676349 - RNA, 21 nt, Human
ucuuuccaguggaucauaaga

SEQ ID NO: 2676350 - RNA, 16 nt, Human
ucuuucaguacuuuuu

SEQ ID NO: 2676351 - RNA, 21 nt, Human
ucuuucaguacuuuuuuaaau

SEQ ID NO: 2676352 - RNA, 23 nt, Human
ucuuucaguacuuuuuuaaauau

SEQ ID NO: 2676353 - RNA, 14 nt, Human
ucuuucagaaagcu

SEQ ID NO: 2676354 - RNA, 18 nt, Human
ucuuucagaaauauaaca

SEQ ID NO: 2676355 - RNA, 23 nt, Human
ucuuucagaaauauaacacauuu

SEQ ID NO: 2676356 - RNA, 11 nt, Human
ucuuucagaaa

SEQ ID NO: 2676357 - RNA, 17 nt, Human
ucuuugauuauuugcau

SEQ ID NO: 2676358 - RNA, 18 nt, Human
ucuuugauuauuugcaug

SEQ ID NO: 2676359 - RNA, 19 nt, Human
ucuuugauuauuugcaugu

SEQ ID NO: 2676360 - RNA, 20 nt, Human
ucuuugauuauuugcauguu

SEQ ID NO: 2676361 - RNA, 16 nt, Human
ucuuugauguguuguu

SEQ ID NO: 2676362 - RNA, 14 nt, Human
ucuuugauguguug

SEQ ID NO: 2676363 - RNA, 13 nt, Human
ucuuugauguguu

SEQ ID NO: 2676364 - RNA, 23 nt, Human
ucuuucaaaggaacauugugucu

SEQ ID NO: 2676365 - RNA, 17 nt, Human
ucuuuggacacucacac

SEQ ID NO: 2676366 - RNA, 13 nt, Human
ugauuagcaaguu

SEQ ID NO: 2676367 - RNA, 18 nt, Human
ugauuagcaaguuacagu

SEQ ID NO: 2676368 - RNA, 22 nt, Human
ugauuauuuaagacuaaaaguu

SEQ ID NO: 2676369 - RNA, 16 nt, Human
ugauuauuuauuauuu

SEQ ID NO: 2676370 - RNA, 12 nt, Human
ugauuauuugca

SEQ ID NO: 2676371 - RNA, 13 nt, Human
ugauuauuugcau

SEQ ID NO: 2676372 - RNA, 14 nt, Human
ugauuauuugcaug

SEQ ID NO: 2676373 - RNA, 15 nt, Human
ugauuauuugcaugu

SEQ ID NO: 2676374 - RNA, 19 nt, Human
ugauuauuugcauguuaug

SEQ ID NO: 2676375 - RNA, 18 nt, Human
ugauuauuuuuuuuuucu

SEQ ID NO: 2676376 - RNA, 21 nt, Human
ugauuauuuuuuuuuucuucu

SEQ ID NO: 2676377 - RNA, 15 nt, Human
ugauugggaaaacau

SEQ ID NO: 2676378 - RNA, 16 nt, Human
ugauugggaaaacauu

SEQ ID NO: 2676379 - RNA, 17 nt, Human
ugauugggaaaacauuu

SEQ ID NO: 2676380 - RNA, 18 nt, Human
ugauugggaaaacauuug

SEQ ID NO: 2676381 - RNA, 20 nt, Human
ugauugggaaaacauuugcu

SEQ ID NO: 2676382 - RNA, 21 nt, Human
ugauugggaaaacauuugcug

SEQ ID NO: 2676383 - RNA, 16 nt, Human
ugauuggaccaggcca

SEQ ID NO: 2676384 - RNA, 17 nt, Human
ugauuggaccaggccau

SEQ ID NO: 2676385 - RNA, 19 nt, Human
ugauugaauaaugccacca

SEQ ID NO: 2676386 - RNA, 19 nt, Human
ugauuguuaauuuacagcu

SEQ ID NO: 2676387 - RNA, 14 nt, Human
ugauucuggcuuua

SEQ ID NO: 2676388 - RNA, 17 nt, Human
ugauucuggcuuuaagc

SEQ ID NO: 2676389 - RNA, 18 nt, Human
ugauucuggcuuuaagcc

SEQ ID NO: 2676390 - RNA, 21 nt, Human
ugauucuggcuuuaagccuuc

SEQ ID NO: 2676391 - RNA, 20 nt, Human
ugaugcugugcuaugaauuu

SEQ ID NO: 2676392 - RNA, 21 nt, Human
ugaugguguagcccucccacu

SEQ ID NO: 2676393 - RNA, 20 nt, Human
ugaugguguggccuguggcu

SEQ ID NO: 2676394 - RNA, 19 nt, Human
ugaugguucuucaccuccu

SEQ ID NO: 2676395 - RNA, 17 nt, Human
ugaugucaauuucugug

SEQ ID NO: 2676396 - RNA, 18 nt, Human
ugaugucagcaguugcug

SEQ ID NO: 2676397 - RNA, 23 nt, Human
ugaugucaauuucuguguugcca

SEQ ID NO: 2676398 - RNA, 18 nt, Human
ugaugucaauuucugugu

SEQ ID NO: 2676399 - RNA, 19 nt, Human
ugaugucaauuucuguguu

SEQ ID NO: 2676400 - RNA, 23 nt, Human
ugaugucagcaguugcugguaaa

SEQ ID NO: 2676401 - RNA, 22 nt, Human
ugaugucagcaguugcugguaa

SEQ ID NO: 2676402 - RNA, 19 nt, Human
ugauguggcccuggcugcc

SEQ ID NO: 2676403 - RNA, 23 nt, Human
ugauguggcccuggcugccggca

SEQ ID NO: 2676404 - RNA, 14 nt, Human
ugauguguuguucu

SEQ ID NO: 2676405 - RNA, 22 nt, Human
ugauguguuguucuuggcaaua

SEQ ID NO: 2676406 - RNA, 20 nt, Human
ugaugcugggaguucuaaca

SEQ ID NO: 2676407 - RNA, 13 nt, Human
ugaugcaugucuu

SEQ ID NO: 2676408 - RNA, 16 nt, Human
ugaugcaugucuuuua

SEQ ID NO: 2676409 - RNA, 14 nt, Human
ugaucauguacuuu

SEQ ID NO: 2676410 - RNA, 15 nt, Human
ugaucauguacuuuu

SEQ ID NO: 2676411 - RNA, 17 nt, Human
ugaucauguacuuuuua

SEQ ID NO: 2676412 - RNA, 19 nt, Human
ugaucauguacuuuuuagu

SEQ ID NO: 2676413 - RNA, 15 nt, Human
ugagaucagccuggg

SEQ ID NO: 2676414 - RNA, 14 nt, Human
ugagaucagccugg

SEQ ID NO: 2676415 - RNA, 15 nt, Human
ugagaucaaaacggu

SEQ ID NO: 2676416 - RNA, 19 nt, Human
ugaccggacuuuucugcaa

SEQ ID NO: 2676417 - RNA, 16 nt, Human
ugaccggacuuuucug

SEQ ID NO: 2676418 - RNA, 19 nt, Human
ugagacuacaagugugugc

SEQ ID NO: 2676419 - RNA, 15 nt, Human
ugagacucagugcag

SEQ ID NO: 2676420 - RNA, 16 nt, Human
ugagacucagugcaga

SEQ ID NO: 2676421 - RNA, 17 nt, Human
ugagacucagugcagau

SEQ ID NO: 2676422 - RNA, 18 nt, Human
ugagacucagugcagaug

SEQ ID NO: 2676423 - RNA, 18 nt, Human
ugagcuggccucucuagc

SEQ ID NO: 2676424 - RNA, 10 nt, Human
ugagcuggcc

SEQ ID NO: 2676425 - RNA, 12 nt, Human
ugagcugccuuc

SEQ ID NO: 2676426 - RNA, 15 nt, Human
ugagcugccuucccu

SEQ ID NO: 2676427 - RNA, 16 nt, Human
ugagcugccuucccua

SEQ ID NO: 2676428 - RNA, 17 nt, Human
ugagcugccuucccuag

SEQ ID NO: 2676429 - RNA, 19 nt, Human
ugagcugccuucccuagcu

SEQ ID NO: 2676430 - RNA, 14 nt, Human
ugagccugagcaga

SEQ ID NO: 2676431 - RNA, 13 nt, Human
ugagccugcaggg

SEQ ID NO: 2676432 - RNA, 15 nt, Human
ugagccugcagggaa

SEQ ID NO: 2676433 - RNA, 17 nt, Human
ugagccugcagggaagc

SEQ ID NO: 2676434 - RNA, 18 nt, Human
ugagccucugcuccccag

SEQ ID NO: 2676435 - RNA, 17 nt, Human
ugagccucugcucccca

SEQ ID NO: 2676436 - RNA, 16 nt, Human
ugagccucugcucccc

SEQ ID NO: 2676437 - RNA, 14 nt, Human
ugagccucugcucc

SEQ ID NO: 2676438 - RNA, 12 nt, Human
ugagccucugcu

SEQ ID NO: 2676439 - RNA, 12 nt, Human
ugagcccuggcu

SEQ ID NO: 2676440 - RNA, 13 nt, Human
ugagcccuggcug

SEQ ID NO: 2676441 - RNA, 13 nt, Human
ugauaaaaacuca

SEQ ID NO: 2676442 - RNA, 14 nt, Human
ugauaaaaacucag

SEQ ID NO: 2676443 - RNA, 19 nt, Human
ugaguuuuuacaagaugua

SEQ ID NO: 2676444 - RNA, 19 nt, Human
ugaguuugucgcucaugug

SEQ ID NO: 2676445 - RNA, 20 nt, Human
ugaguuugucgcucaugugu

SEQ ID NO: 2676446 - RNA, 16 nt, Human
ugaguuugagcugccu

SEQ ID NO: 2676447 - RNA, 17 nt, Human
ugaguuugagcugccuu

SEQ ID NO: 2676448 - RNA, 18 nt, Human
ugaguuugagcugccuuc

SEQ ID NO: 2676449 - RNA, 19 nt, Human
ugaguuugagcugccuucc

SEQ ID NO: 2676450 - RNA, 21 nt, Human
ugaguuugagcugccuucccu

SEQ ID NO: 2676451 - RNA, 14 nt, Human
ugagucugggcagc

SEQ ID NO: 2676452 - RNA, 21 nt, Human
ugagucugggcagcugucccu

SEQ ID NO: 2676453 - RNA, 21 nt, Human
ugagucuguacuaaacaguaa

SEQ ID NO: 2676454 - RNA, 16 nt, Human
ugagucuguucuggua

SEQ ID NO: 2676455 - RNA, 14 nt, Human
ugagucuguucugg

SEQ ID NO: 2676456 - RNA, 17 nt, Human
ugagucuguucugguaa

SEQ ID NO: 2676457 - RNA, 15 nt, Human
ugagucuguugugug

SEQ ID NO: 2676458 - RNA, 19 nt, Human
ugaguccagaaguuugaga

SEQ ID NO: 2676459 - RNA, 13 nt, Human
ugaguccagaagu

SEQ ID NO: 2676460 - RNA, 21 nt, Human
ugaggugggaggaucucuuga

SEQ ID NO: 2676461 - RNA, 17 nt, Human
ugaguccauucucccag

SEQ ID NO: 2676462 - RNA, 19 nt, Human
ugaguccauucucccaggu

SEQ ID NO: 2676463 - RNA, 20 nt, Human
ugaguccauucucccaggua

SEQ ID NO: 2676464 - RNA, 22 nt, Human
ugaguccauucucccagguacc

SEQ ID NO: 2676465 - RNA, 17 nt, Human
ugagggagaacaagacc

SEQ ID NO: 2676466 - RNA, 22 nt, Human
ugagggacgucagacuuggcuc

SEQ ID NO: 2676467 - RNA, 13 nt, Human
ugaggugggagga

SEQ ID NO: 2676468 - RNA, 12 nt, Human
ugaggugggagg

SEQ ID NO: 2676469 - RNA, 14 nt, Human
ugaggcaguuugag

SEQ ID NO: 2676470 - RNA, 21 nt, Human
ugagcuggccucucuagcaca

SEQ ID NO: 2676471 - RNA, 15 nt, Human
ugcgcaucuugccuc

SEQ ID NO: 2676472 - RNA, 20 nt, Human
ugcgcaucuugccuccaggu

SEQ ID NO: 2676473 - RNA, 22 nt, Human
ugcgcaucuugccuccaggugc

SEQ ID NO: 2676474 - RNA, 11 nt, Human
ugcgccugcug

SEQ ID NO: 2676475 - RNA, 12 nt, Human
ugcgccugcugc

SEQ ID NO: 2676476 - RNA, 17 nt, Human
ugcgcucucuuugcaac

SEQ ID NO: 2676477 - RNA, 23 nt, Human
ugcgcucagggccaugcugaggc

SEQ ID NO: 2676478 - RNA, 13 nt, Human
ugcgcucagggcc

SEQ ID NO: 2676479 - RNA, 14 nt, Human
ugcgcucagggcca

SEQ ID NO: 2676480 - RNA, 15 nt, Human
ugcgcucagggccau

SEQ ID NO: 2676481 - RNA, 19 nt, Human
ugcgcucagggccaugcug

SEQ ID NO: 2676482 - RNA, 21 nt, Human
ugcgcucagggccaugcugag

SEQ ID NO: 2676483 - RNA, 22 nt, Human
ugcgcucagggccaugcugagg

SEQ ID NO: 2676484 - RNA, 13 nt, Human
ugccuugcuguuu

SEQ ID NO: 2676485 - RNA, 20 nt, Human
ugccuugcuguuuguccuga

SEQ ID NO: 2676486 - RNA, 22 nt, Human
ugccuugcuguuuguccugaga

SEQ ID NO: 2676487 - RNA, 19 nt, Human
ugccuuggcucagacaugu

SEQ ID NO: 2676488 - RNA, 17 nt, Human
ugccuuggcucagacau

SEQ ID NO: 2676489 - RNA, 16 nt, Human
ugccuuggcucagaca

SEQ ID NO: 2676490 - RNA, 13 nt, Human
ugccuuggcucag

SEQ ID NO: 2676491 - RNA, 15 nt, Human
ugcuacugcacucca

SEQ ID NO: 2676492 - RNA, 18 nt, Human
ugcuacugcacuccagcc

SEQ ID NO: 2676493 - RNA, 20 nt, Human
ugcuacugcacuccagccug

SEQ ID NO: 2676494 - RNA, 21 nt, Human
ugcuacugcacuccagccugg

SEQ ID NO: 2676495 - RNA, 14 nt, Human
ugcuagaaauuuuc

SEQ ID NO: 2676496 - RNA, 15 nt, Human
ugcuagaaauuuuca

SEQ ID NO: 2676497 - RNA, 13 nt, Human
ugcuacuguugua

SEQ ID NO: 2676498 - RNA, 20 nt, Human
ugcuacuguuguaagaauuc

SEQ ID NO: 2676499 - RNA, 21 nt, Human
ugcuacuguuguaagaauucu

SEQ ID NO: 2676500 - RNA, 23 nt, Human
ugcuacuguuguaagaauucuga

SEQ ID NO: 2676501 - RNA, 12 nt, Human
ugcuaaaaaugu

SEQ ID NO: 2676502 - RNA, 14 nt, Human
ugcgcuugcuuuuc

SEQ ID NO: 2676503 - RNA, 19 nt, Human
ugcucuuguccuagcuugg

SEQ ID NO: 2676504 - RNA, 18 nt, Human
ugcucuuguccuagcuug

SEQ ID NO: 2676505 - RNA, 20 nt, Human
ugcucuacaaugacacacaa

SEQ ID NO: 2676506 - RNA, 19 nt, Human
ugcucggagaagagcgcag

SEQ ID NO: 2676507 - RNA, 20 nt, Human
ugcucggagaagagcgcagu

SEQ ID NO: 2676508 - RNA, 14 nt, Human
ugcucagaagggcu

SEQ ID NO: 2676509 - RNA, 19 nt, Human
ugcucaccgcccaucaggg

SEQ ID NO: 2676510 - RNA, 23 nt, Human
ugcucaccgcccaucaggguucu

SEQ ID NO: 2676511 - RNA, 15 nt, Human
ugcugggggcaacug

SEQ ID NO: 2676512 - RNA, 19 nt, Human
ugcugggggcaacuggcca

SEQ ID NO: 2676513 - RNA, 20 nt, Human
ugcugggggcaacuggccau

SEQ ID NO: 2676514 - RNA, 19 nt, Human
ugcugggcauuuucccaga

SEQ ID NO: 2676515 - RNA, 14 nt, Human
ugcugggcggcugu

SEQ ID NO: 2676516 - RNA, 16 nt, Human
ugcugggcggcugugc

SEQ ID NO: 2676517 - RNA, 18 nt, Human
ugcugggcggcugugcuu

SEQ ID NO: 2676518 - RNA, 17 nt, Human
ugcugggcuugucugua

SEQ ID NO: 2676519 - RNA, 13 nt, Human
ugcugguccgugg

SEQ ID NO: 2676520 - RNA, 16 nt, Human
ugcugguccgugggac

SEQ ID NO: 2676521 - RNA, 19 nt, Human
ugcugguaaaaugaagaau

SEQ ID NO: 2676522 - RNA, 18 nt, Human
ugcugguaaaaugaagaa

SEQ ID NO: 2676523 - RNA, 17 nt, Human
ugcugguaaaaugaaga

SEQ ID NO: 2676524 - RNA, 16 nt, Human
ugcugguaaaaugaag

SEQ ID NO: 2676525 - RNA, 14 nt, Human
ugcugguaaaauga

SEQ ID NO: 2676526 - RNA, 18 nt, Human
ugcugugugucccaggca

SEQ ID NO: 2676527 - RNA, 21 nt, Human
ugcugugugucccaggcaggg

SEQ ID NO: 2676528 - RNA, 23 nt, Human
ugcugugugucccaggcagggag

SEQ ID NO: 2676529 - RNA, 13 nt, Human
ugcuguguauaug

SEQ ID NO: 2676530 - RNA, 19 nt, Human
ugcuguguauaugguauau

SEQ ID NO: 2676531 - RNA, 23 nt, Human
ugcuguguauaugguauauauac

SEQ ID NO: 2676532 - RNA, 19 nt, Human
ugcuggggucaaggcagua

SEQ ID NO: 2676533 - RNA, 12 nt, Human
ugcugcucuuca

SEQ ID NO: 2676534 - RNA, 19 nt, Human
ugcugccucuuucccuagg

SEQ ID NO: 2676535 - RNA, 20 nt, Human
ugcucaguguuuuugugaau

SEQ ID NO: 2676536 - RNA, 19 nt, Human
ugcugcuugaggcaacuca

SEQ ID NO: 2676537 - RNA, 12 nt, Human
ugcugcugcugc

SEQ ID NO: 2676538 - RNA, 12 nt, Human
ugcugcuugagg

SEQ ID NO: 2676539 - RNA, 17 nt, Human
ugcugcugccucuuucc

SEQ ID NO: 2676540 - RNA, 17 nt, Human
ugcaggcuccccugagg

SEQ ID NO: 2676541 - RNA, 15 nt, Human
ugcaggcuccccuga

SEQ ID NO: 2676542 - RNA, 20 nt, Human
ugcaggcccuggccuccccu

SEQ ID NO: 2676543 - RNA, 20 nt, Human
ugauuuaagugucucacuaa

SEQ ID NO: 2676544 - RNA, 18 nt, Human
ugcaggcuccccugagga

SEQ ID NO: 2676545 - RNA, 19 nt, Human
ugcaggcuuugccauugug

SEQ ID NO: 2676546 - RNA, 15 nt, Human
ugcagggccauggcu

SEQ ID NO: 2676547 - RNA, 17 nt, Human
ugcaguucuacucaggc

SEQ ID NO: 2676548 - RNA, 10 nt, Human
ugcagggcca

SEQ ID NO: 2676549 - RNA, 13 nt, Human
ugcauauuauaaa

SEQ ID NO: 2676550 - RNA, 16 nt, Human
ugcauauuauaaagga

SEQ ID NO: 2676551 - RNA, 20 nt, Human
ugcauauuauaaaggauaaa

SEQ ID NO: 2676552 - RNA, 23 nt, Human
ugcauauuauaaaggauaaagaa

SEQ ID NO: 2676553 - RNA, 13 nt, Human
ugcauaguuucuu

SEQ ID NO: 2676554 - RNA, 14 nt, Human
ugcauaguuucuuu

SEQ ID NO: 2676555 - RNA, 15 nt, Human
ugcauaguuucuuua

SEQ ID NO: 2676556 - RNA, 18 nt, Human
ugcauaguuucuuuauuu

SEQ ID NO: 2676557 - RNA, 23 nt, Human
ugcauaguuucuuuauuuugugu

SEQ ID NO: 2676558 - RNA, 10 nt, Human
ugcaguuuau

SEQ ID NO: 2676559 - RNA, 12 nt, Human
ugcaguuuauca

SEQ ID NO: 2676560 - RNA, 16 nt, Human
ugcaguuuaucauuca

SEQ ID NO: 2676561 - RNA, 17 nt, Human
ugcaguuuaucauucaa

SEQ ID NO: 2676562 - RNA, 19 nt, Human
ugcaguuuaucauucaagu

SEQ ID NO: 2676563 - RNA, 13 nt, Human
ugcaugguggcca

SEQ ID NO: 2676564 - RNA, 14 nt, Human
ugcaugguggccag

SEQ ID NO: 2676565 - RNA, 15 nt, Human
ugcaugguggccaga

SEQ ID NO: 2676566 - RNA, 21 nt, Human
ugcaucacuguaucauuuucu

SEQ ID NO: 2676567 - RNA, 13 nt, Human
ugcaucagaaagc

SEQ ID NO: 2676568 - RNA, 19 nt, Human
ugcaucagaaagcuuuauu

SEQ ID NO: 2676569 - RNA, 17 nt, Human
ugccaaaauucauuucu

SEQ ID NO: 2676570 - RNA, 19 nt, Human
ugccaaaauucauuucuaa

SEQ ID NO: 2676571 - RNA, 15 nt, Human
ugccaaagaaagugg

SEQ ID NO: 2676572 - RNA, 23 nt, Human
ugccacgaauuucugugcccucc

SEQ ID NO: 2676573 - RNA, 16 nt, Human
ugccacgaauuucugu

SEQ ID NO: 2676574 - RNA, 15 nt, Human
ugccacgaauuucug

SEQ ID NO: 2676575 - RNA, 22 nt, Human
ugccacguuggagaagcccgug

SEQ ID NO: 2676576 - RNA, 19 nt, Human
ugccacuaaacuacauugu

SEQ ID NO: 2676577 - RNA, 20 nt, Human
ugccaggacaugcaauaaaa

SEQ ID NO: 2676578 - RNA, 23 nt, Human
ugccaggacaugcaauaaaauuu

SEQ ID NO: 2676579 - RNA, 14 nt, Human
ugccaggcauggug

SEQ ID NO: 2676580 - RNA, 10 nt, Human
ugccaggcau

SEQ ID NO: 2676581 - RNA, 14 nt, Human
ugccaggccagccu

SEQ ID NO: 2676582 - RNA, 15 nt, Human
ugccaggccagccuc

SEQ ID NO: 2676583 - RNA, 16 nt, Human
ugccaggccagccucc

SEQ ID NO: 2676584 - RNA, 17 nt, Human
ugccaggccagccuccg

SEQ ID NO: 2676585 - RNA, 18 nt, Human
ugccaggccagccuccga

SEQ ID NO: 2676586 - RNA, 15 nt, Human
ugccccucucaccaa

SEQ ID NO: 2676587 - RNA, 12 nt, Human
ugccccucucac

SEQ ID NO: 2676588 - RNA, 14 nt, Human
ugccccucucacca

SEQ ID NO: 2676589 - RNA, 18 nt, Human
ugcccuggcugcugcccc

SEQ ID NO: 2676590 - RNA, 20 nt, Human
ugcccuggcugcugccccca

SEQ ID NO: 2676591 - RNA, 14 nt, Human
ugcccuggcugcug

SEQ ID NO: 2676592 - RNA, 15 nt, Human
ugcccuggcugcugc

SEQ ID NO: 2676593 - RNA, 16 nt, Human
ugcccuggcugcugcc

SEQ ID NO: 2676594 - RNA, 17 nt, Human
ugcccuggcugcugccc

SEQ ID NO: 2676595 - RNA, 11 nt, Human
ugcccuggcug

SEQ ID NO: 2676596 - RNA, 12 nt, Human
ugcccuggcugc

SEQ ID NO: 2676597 - RNA, 15 nt, Human
ugccucaagaggaau

SEQ ID NO: 2676598 - RNA, 17 nt, Human
ugccucaagaggaauga

SEQ ID NO: 2676599 - RNA, 18 nt, Human
ugccucaagaggaaugaa

SEQ ID NO: 2676600 - RNA, 21 nt, Human
ugccuauaagccaaaauuaag

SEQ ID NO: 2676601 - RNA, 20 nt, Human
ugccuauaagccaaaauuaa

SEQ ID NO: 2676602 - RNA, 17 nt, Human
ugccuauaagccaaaau

SEQ ID NO: 2676603 - RNA, 16 nt, Human
ugccuauaagccaaaa

SEQ ID NO: 2676604 - RNA, 14 nt, Human
ugccccacagucuc

SEQ ID NO: 2676605 - RNA, 19 nt, Human
uggacugagugggaagccc

SEQ ID NO: 2676606 - RNA, 22 nt, Human
uggacugcuaccuuucaaagcu

SEQ ID NO: 2676607 - RNA, 23 nt, Human
uggacugcuaccuuucaaagcuu

SEQ ID NO: 2676608 - RNA, 17 nt, Human
uggacugagugggaagc

SEQ ID NO: 2676609 - RNA, 13 nt, Human
uggagaagcugca

SEQ ID NO: 2676610 - RNA, 14 nt, Human
uggagaagcugcag

SEQ ID NO: 2676611 - RNA, 15 nt, Human
uggagaagcugcagg

SEQ ID NO: 2676612 - RNA, 18 nt, Human
uggagaagcugcaggcuu

SEQ ID NO: 2676613 - RNA, 22 nt, Human
uggagacguuuauaaacagaaa

SEQ ID NO: 2676614 - RNA, 13 nt, Human
uggacacuccagg

SEQ ID NO: 2676615 - RNA, 14 nt, Human
uggacacuccaggg

SEQ ID NO: 2676616 - RNA, 16 nt, Human
uggacacuccagggac

SEQ ID NO: 2676617 - RNA, 18 nt, Human
uggacacuccagggacac

SEQ ID NO: 2676618 - RNA, 19 nt, Human
uggacacuccagggacaca

SEQ ID NO: 2676619 - RNA, 22 nt, Human
uggacacuccagggacacacag

SEQ ID NO: 2676620 - RNA, 23 nt, Human
uggacacuccagggacacacagc

SEQ ID NO: 2676621 - RNA, 24 nt, Human
uggacacuccagggacacacagcc

SEQ ID NO: 2676622 - RNA, 14 nt, Human
uggacauccuccuc

SEQ ID NO: 2676623 - RNA, 12 nt, Human
ugcuguugcuua

SEQ ID NO: 2676624 - RNA, 15 nt, Human
ugcuguuccuuacuu

SEQ ID NO: 2676625 - RNA, 23 nt, Human
ugcuguuguccaacuauuuauug

SEQ ID NO: 2676626 - RNA, 18 nt, Human
ugcuguuguccaacuauu

SEQ ID NO: 2676627 - RNA, 14 nt, Human
ugcuguuguucucg

SEQ ID NO: 2676628 - RNA, 20 nt, Human
uggcaaaacucuacuuaauc

SEQ ID NO: 2676629 - RNA, 16 nt, Human
uggcaaaaaggcagga

SEQ ID NO: 2676630 - RNA, 12 nt, Human
uggcaaaaaggc

SEQ ID NO: 2676631 - RNA, 17 nt, Human
uggcaaacgcuaaagag

SEQ ID NO: 2676632 - RNA, 24 nt, Human
uggcaaacgcuaaagagcccuugc

SEQ ID NO: 2676633 - RNA, 21 nt, Human
uggcaauaaauuuugaaaagu

SEQ ID NO: 2676634 - RNA, 20 nt, Human
uggcaauaaauuuugaaaag

SEQ ID NO: 2676635 - RNA, 18 nt, Human
uggcaauaaauuuugaaa

SEQ ID NO: 2676636 - RNA, 17 nt, Human
uggcaauaaauuuugaa

SEQ ID NO: 2676637 - RNA, 13 nt, Human
uggaggaggaagg

SEQ ID NO: 2676638 - RNA, 14 nt, Human
uggaggaggaaggc

SEQ ID NO: 2676639 - RNA, 15 nt, Human
uggaggaggaaggca

SEQ ID NO: 2676640 - RNA, 16 nt, Human
uggaggaggaaggcaa

SEQ ID NO: 2676641 - RNA, 17 nt, Human
uggaggaggaaggcaag

SEQ ID NO: 2676642 - RNA, 21 nt, Human
uggaggaggaaggcaagaggg

SEQ ID NO: 2676643 - RNA, 21 nt, Human
uggaggauccccuccaagccu

SEQ ID NO: 2676644 - RNA, 17 nt, Human
uggaguuuuaacuguaa

SEQ ID NO: 2676645 - RNA, 14 nt, Human
uggccuccccugcc

SEQ ID NO: 2676646 - RNA, 15 nt, Human
uggccuccccugcca

SEQ ID NO: 2676647 - RNA, 17 nt, Human
uggccuccccugccacc

SEQ ID NO: 2676648 - RNA, 18 nt, Human
uggccucauguggcugga

SEQ ID NO: 2676649 - RNA, 19 nt, Human
uggccucauguggcuggaa

SEQ ID NO: 2676650 - RNA, 20 nt, Human
uggccucauguggcuggaag

SEQ ID NO: 2676651 - RNA, 21 nt, Human
uggccucauguggcuggaaga

SEQ ID NO: 2676652 - RNA, 13 nt, Human
uggccucaugugg

SEQ ID NO: 2676653 - RNA, 15 nt, Human
uggccucauguggcu

SEQ ID NO: 2676654 - RNA, 17 nt, Human
uggccucauguggcugg

SEQ ID NO: 2676655 - RNA, 19 nt, Human
uggccuccccugccaccag

SEQ ID NO: 2676656 - RNA, 20 nt, Human
uggccuccccugccaccagg

SEQ ID NO: 2676657 - RNA, 21 nt, Human
uggccuccccugccaccaggc

SEQ ID NO: 2676658 - RNA, 23 nt, Human
uggccuccccugccaccaggcca

SEQ ID NO: 2676659 - RNA, 13 nt, Human
uggcgcuuagaga

SEQ ID NO: 2676660 - RNA, 20 nt, Human
uggcgcuuagagaggacaau

SEQ ID NO: 2676661 - RNA, 14 nt, Human
uggcggagaguuuu

SEQ ID NO: 2676662 - RNA, 14 nt, Human
uggcggccccagca

SEQ ID NO: 2676663 - RNA, 12 nt, Human
uggcugcugccc

SEQ ID NO: 2676664 - RNA, 15 nt, Human
uggccccguuucugg

SEQ ID NO: 2676665 - RNA, 16 nt, Human
uggccccguuucuggu

SEQ ID NO: 2676666 - RNA, 15 nt, Human
uggccccuacuuugu

SEQ ID NO: 2676667 - RNA, 23 nt, Human
uggccccuacuuuguggcaaucu

SEQ ID NO: 2676668 - RNA, 19 nt, Human
uggccaggcugccuggccu

SEQ ID NO: 2676669 - RNA, 15 nt, Human
uggccuauccgcugc

SEQ ID NO: 2676670 - RNA, 16 nt, Human
uggccuauccgcugcc

SEQ ID NO: 2676671 - RNA, 18 nt, Human
uggccuauccgcugccag

SEQ ID NO: 2676672 - RNA, 19 nt, Human
uggccuauccgcugccagc

SEQ ID NO: 2676673 - RNA, 21 nt, Human
uggccuauccgcugccagccu

SEQ ID NO: 2676674 - RNA, 11 nt, Human
uggccaggagc

SEQ ID NO: 2676675 - RNA, 18 nt, Human
ugguauuuuuuuaaauca

SEQ ID NO: 2676676 - RNA, 19 nt, Human
ugggucacacacggaggca

SEQ ID NO: 2676677 - RNA, 19 nt, Human
ugguccccaacaaugugag

SEQ ID NO: 2676678 - RNA, 17 nt, Human
ugguccccguuccaccc

SEQ ID NO: 2676679 - RNA, 17 nt, Human
ugguccuaguaagaaga

SEQ ID NO: 2676680 - RNA, 20 nt, Human
ugguccgugggacggugccc

SEQ ID NO: 2676681 - RNA, 22 nt, Human
ugguccuagaggcccuuugcug

SEQ ID NO: 2676682 - RNA, 21 nt, Human
ugguccuagaggcccuuugcu

SEQ ID NO: 2676683 - RNA, 17 nt, Human
ugguccuagaggcccuu

SEQ ID NO: 2676684 - RNA, 22 nt, Human
uggucccuccagaaccaccccg

SEQ ID NO: 2676685 - RNA, 14 nt, Human
uggugaugcagucu

SEQ ID NO: 2676686 - RNA, 13 nt, Human
uggucgcuccugc

SEQ ID NO: 2676687 - RNA, 15 nt, Human
uggucgcuccugccc

SEQ ID NO: 2676688 - RNA, 23 nt, Human
uggucgagaaagaggcaccagga

SEQ ID NO: 2676689 - RNA, 16 nt, Human
ugguccuguccccgca

SEQ ID NO: 2676690 - RNA, 14 nt, Human
ugggcagagcuggc

SEQ ID NO: 2676691 - RNA, 12 nt, Human
ugggcagagcug

SEQ ID NO: 2676692 - RNA, 21 nt, Human
ugggcccugagucugggcagc

SEQ ID NO: 2676693 - RNA, 22 nt, Human
ugggcccugagucugggcagcu

SEQ ID NO: 2676694 - RNA, 12 nt, Human
ugggccccuggc

SEQ ID NO: 2676695 - RNA, 15 nt, Human
ugggccccuggcacu

SEQ ID NO: 2676696 - RNA, 15 nt, Human
uggcugcugccccca

SEQ ID NO: 2676697 - RNA, 16 nt, Human
uggcugcugcccccac

SEQ ID NO: 2676698 - RNA, 20 nt, Human
uggcugcugcccccaccccg

SEQ ID NO: 2676699 - RNA, 14 nt, Human
uggcugcuguugcu

SEQ ID NO: 2676700 - RNA, 18 nt, Human
uggggauccccgccuggc

SEQ ID NO: 2676701 - RNA, 21 nt, Human
uggggauccccgccuggccag

SEQ ID NO: 2676702 - RNA, 22 nt, Human
uggggauccccgccuggccagg

SEQ ID NO: 2676703 - RNA, 23 nt, Human
uggggauccccgccuggccagga

SEQ ID NO: 2676704 - RNA, 12 nt, Human
ugggcuucugug

SEQ ID NO: 2676705 - RNA, 16 nt, Human
ugggcuucugugccca

SEQ ID NO: 2676706 - RNA, 14 nt, Human
ugggcuugaccagg

SEQ ID NO: 2676707 - RNA, 22 nt, Human
ugggcuugaccaggcuuggccu

SEQ ID NO: 2676708 - RNA, 13 nt, Human
uggggggguggcc

SEQ ID NO: 2676709 - RNA, 14 nt, Human
uggggggguggccg

SEQ ID NO: 2676710 - RNA, 23 nt, Human
uggggggguggccgcugaguggc

SEQ ID NO: 2676711 - RNA, 18 nt, Human
uggggguggaggcuuccu

SEQ ID NO: 2676712 - RNA, 20 nt, Human
ugggggacagaaagagacuc

SEQ ID NO: 2676713 - RNA, 20 nt, Human
ugggggaggggagacuuuga

SEQ ID NO: 2676714 - RNA, 19 nt, Human
uggggguggaggcuuccug

SEQ ID NO: 2676715 - RNA, 15 nt, Human
uuaauauauguauua

SEQ ID NO: 2676716 - RNA, 19 nt, Human
uuaauauauguauuauuua

SEQ ID NO: 2676717 - RNA, 23 nt, Human
uuaauauaaaguaguccugugaa

SEQ ID NO: 2676718 - RNA, 16 nt, Human
uuaagccuucaaaacu

SEQ ID NO: 2676719 - RNA, 21 nt, Human
uuaagcuguuccuguucagua

SEQ ID NO: 2676720 - RNA, 19 nt, Human
uuaagcugcagagauuucu

SEQ ID NO: 2676721 - RNA, 23 nt, Human
uuaagcugcagagauuucucauu

SEQ ID NO: 2676722 - RNA, 17 nt, Human
uuaagcuguggucaagg

SEQ ID NO: 2676723 - RNA, 19 nt, Human
uuaagcugcaaaucugaug

SEQ ID NO: 2676724 - RNA, 17 nt, Human
uuaagcuguuacugucu

SEQ ID NO: 2676725 - RNA, 14 nt, Human
uuaauguuuucaaa

SEQ ID NO: 2676726 - RNA, 15 nt, Human
uuaauguuuucaaaa

SEQ ID NO: 2676727 - RNA, 16 nt, Human
uuaauguuuucaaaag

SEQ ID NO: 2676728 - RNA, 16 nt, Human
uuacaagggaagauuu

SEQ ID NO: 2676729 - RNA, 18 nt, Human
uuacaagggaagauuuau

SEQ ID NO: 2676730 - RNA, 20 nt, Human
uuacaagggaagauuuaugu

SEQ ID NO: 2676731 - RNA, 20 nt, Human
uuacaagggcauaaaguaaa

SEQ ID NO: 2676732 - RNA, 15 nt, Human
uuaaugcacuuucua

SEQ ID NO: 2676733 - RNA, 11 nt, Human
uuaaugcacuu

SEQ ID NO: 2676734 - RNA, 12 nt, Human
uuaaugcacuuu

SEQ ID NO: 2676735 - RNA, 13 nt, Human
uuaaugcacuuuc

SEQ ID NO: 2676736 - RNA, 14 nt, Human
uuaaugcacuuucu

SEQ ID NO: 2676737 - RNA, 16 nt, Human
uuaacuuaauaaucaa

SEQ ID NO: 2676738 - RNA, 14 nt, Human
uuaacuuaauaauc

SEQ ID NO: 2676739 - RNA, 17 nt, Human
uuaacuuaauaaucaag

SEQ ID NO: 2676740 - RNA, 17 nt, Human
uuaaccacuucagcuga

SEQ ID NO: 2676741 - RNA, 21 nt, Human
uuaaccgguaagaguuucagu

SEQ ID NO: 2676742 - RNA, 14 nt, Human
uuaaccugcauaaa

SEQ ID NO: 2676743 - RNA, 21 nt, Human
uuaaccuuacuaauuauacua

SEQ ID NO: 2676744 - RNA, 15 nt, Human
uuaaccuuguauaaa

SEQ ID NO: 2676745 - RNA, 21 nt, Human
uuaaccuuguauaaauuauuc

SEQ ID NO: 2676746 - RNA, 12 nt, Human
uuaaagacagag

SEQ ID NO: 2676747 - RNA, 12 nt, Human
uuaaaauagaaa

SEQ ID NO: 2676748 - RNA, 20 nt, Human
uuaaagaauaugacuuuuua

SEQ ID NO: 2676749 - RNA, 18 nt, Human
uuaaagacaggagacaaa

SEQ ID NO: 2676750 - RNA, 20 nt, Human
uuaaagacccuccuauucua

SEQ ID NO: 2676751 - RNA, 13 nt, Human
uuaaauguuauua

SEQ ID NO: 2676752 - RNA, 12 nt, Human
uuaaauuacaau

SEQ ID NO: 2676753 - RNA, 15 nt, Human
uuaaauuacaauuuu

SEQ ID NO: 2676754 - RNA, 16 nt, Human
uuaaauuacaauuuua

SEQ ID NO: 2676755 - RNA, 17 nt, Human
uuaaauuacaauuuuau

SEQ ID NO: 2676756 - RNA, 18 nt, Human
uuaaauuacaauuuuauc

SEQ ID NO: 2676757 - RNA, 12 nt, Human
uuaaaagaauga

SEQ ID NO: 2676758 - RNA, 13 nt, Human
uuaaaagaaugac

SEQ ID NO: 2676759 - RNA, 14 nt, Human
uuaaaagaaugacu

SEQ ID NO: 2676760 - RNA, 15 nt, Human
uuaaaagaaugacua

SEQ ID NO: 2676761 - RNA, 14 nt, Human
uuaaagaaguauuu

SEQ ID NO: 2676762 - RNA, 19 nt, Human
uuaaagaaguauuuuuaga

SEQ ID NO: 2676763 - RNA, 20 nt, Human
uuaaacugucgugucauacu

SEQ ID NO: 2676764 - RNA, 17 nt, Human
uuaaaauagaaauuuug

SEQ ID NO: 2676765 - RNA, 20 nt, Human
uuaaaauagaaauuuuguaa

SEQ ID NO: 2676766 - RNA, 21 nt, Human
uuaaaauagaaauuuuguaag

SEQ ID NO: 2676767 - RNA, 15 nt, Human
uguuuuuuuguuugu

SEQ ID NO: 2676768 - RNA, 18 nt, Human
uguuuuuuuguuauuaaa

SEQ ID NO: 2676769 - RNA, 16 nt, Human
uguuuuuuuguuauua

SEQ ID NO: 2676770 - RNA, 18 nt, Human
uguuuuuuguuuuucugc

SEQ ID NO: 2676771 - RNA, 23 nt, Human
uguuuagaauugaagguuuuuga

SEQ ID NO: 2676772 - RNA, 17 nt, Human
uguuuagaauugaaggu

SEQ ID NO: 2676773 - RNA, 15 nt, Human
uguuuagaauugaag

SEQ ID NO: 2676774 - RNA, 14 nt, Human
uguuuagaauugaa

SEQ ID NO: 2676775 - RNA, 12 nt, Human
uguuuagaauug

SEQ ID NO: 2676776 - RNA, 14 nt, Human
uggugccaucccca

SEQ ID NO: 2676777 - RNA, 16 nt, Human
uggugccauccccagg

SEQ ID NO: 2676778 - RNA, 21 nt, Human
uggugccauccccagggggca

SEQ ID NO: 2676779 - RNA, 22 nt, Human
uguuucagguucaguauuaugu

SEQ ID NO: 2676780 - RNA, 15 nt, Human
uguuugucccuucua

SEQ ID NO: 2676781 - RNA, 20 nt, Human
uguuuccagacuuccuugag

SEQ ID NO: 2676782 - RNA, 23 nt, Human
uguuuccagacuuccuugagaca

SEQ ID NO: 2676783 - RNA, 15 nt, Human
uguuucguggggagg

SEQ ID NO: 2676784 - RNA, 23 nt, Human
uguuucgcggguaacugggguug

SEQ ID NO: 2676785 - RNA, 12 nt, Human
uguuugguaaau

SEQ ID NO: 2676786 - RNA, 14 nt, Human
uguuugguaaaugu

SEQ ID NO: 2676787 - RNA, 15 nt, Human
uguuugguaaauguu

SEQ ID NO: 2676788 - RNA, 20 nt, Human
uuaggcaaggcuaugugauu

SEQ ID NO: 2676789 - RNA, 16 nt, Human
uuaggauuuucacauu

SEQ ID NO: 2676790 - RNA, 18 nt, Human
uuagcuggccacauggcg

SEQ ID NO: 2676791 - RNA, 20 nt, Human
uuaggaaguguuuauguugu

SEQ ID NO: 2676792 - RNA, 16 nt, Human
uuaggccuuccucucu

SEQ ID NO: 2676793 - RNA, 15 nt, Human
uuaggcuuaaaaacu

SEQ ID NO: 2676794 - RNA, 15 nt, Human
uuaguguuauaugaa

SEQ ID NO: 2676795 - RNA, 14 nt, Human
uuaguguuauauga

SEQ ID NO: 2676796 - RNA, 16 nt, Human
uuaguguuuuuuuauu

SEQ ID NO: 2676797 - RNA, 20 nt, Human
uuaguauuuauuuauguacu

SEQ ID NO: 2676798 - RNA, 19 nt, Human
uuaguauuuauuuauguac

SEQ ID NO: 2676799 - RNA, 16 nt, Human
uuagaucauaguuuua

SEQ ID NO: 2676800 - RNA, 15 nt, Human
uuagaucauaguuuu

SEQ ID NO: 2676801 - RNA, 17 nt, Human
uuagaucauaguuuuau

SEQ ID NO: 2676802 - RNA, 16 nt, Human
uuagcugaagaauuga

SEQ ID NO: 2676803 - RNA, 14 nt, Human
uuagcuccuguggc

SEQ ID NO: 2676804 - RNA, 13 nt, Human
uuagcuccugugg

SEQ ID NO: 2676805 - RNA, 21 nt, Human
uuagacucaucaaucaaauaa

SEQ ID NO: 2676806 - RNA, 13 nt, Human
uuacuuugcugag

SEQ ID NO: 2676807 - RNA, 20 nt, Human
uuagacuugaaaagagacag

SEQ ID NO: 2676808 - RNA, 19 nt, Human
uuagacuugaaaagagaca

SEQ ID NO: 2676809 - RNA, 13 nt, Human
uuagacuugaaaa

SEQ ID NO: 2676810 - RNA, 12 nt, Human
uuagacuugaaa

SEQ ID NO: 2676811 - RNA, 17 nt, Human
uuagaccccauacaagu

SEQ ID NO: 2676812 - RNA, 13 nt, Human
uuagacccugggu

SEQ ID NO: 2676813 - RNA, 20 nt, Human
uuacuuuacugccugaauaa

SEQ ID NO: 2676814 - RNA, 15 nt, Human
uuacuuguuuuggau

SEQ ID NO: 2676815 - RNA, 23 nt, Human
uuacuuguugccuauaagccaaa

SEQ ID NO: 2676816 - RNA, 17 nt, Human
uuacuuguugccuauaa

SEQ ID NO: 2676817 - RNA, 13 nt, Human
uuacuuuguaaau

SEQ ID NO: 2676818 - RNA, 11 nt, Human
uuacuuuguaa

SEQ ID NO: 2676819 - RNA, 22 nt, Human
uuacuuuguaaauucugauuuc

SEQ ID NO: 2676820 - RNA, 20 nt, Human
uuacuuuguaaauucugauu

SEQ ID NO: 2676821 - RNA, 19 nt, Human
uuacuuuguaaauucugau

SEQ ID NO: 2676822 - RNA, 18 nt, Human
uuacuuuguaaauucuga

SEQ ID NO: 2676823 - RNA, 17 nt, Human
uuacuuuguaaauucug

SEQ ID NO: 2676824 - RNA, 14 nt, Human
uuacuuuguaaauu

SEQ ID NO: 2676825 - RNA, 18 nt, Human
uuacuugcuuuaccuuuu

SEQ ID NO: 2676826 - RNA, 13 nt, Human
uuacuucuucucu

SEQ ID NO: 2676827 - RNA, 23 nt, Human
uuacuuuguaaauucugauuucu

SEQ ID NO: 2676828 - RNA, 17 nt, Human
uuacuaauuauacuacu

SEQ ID NO: 2676829 - RNA, 13 nt, Human
uuacaauuuuauc

SEQ ID NO: 2676830 - RNA, 18 nt, Human
uuacaauuuuaucuguuu

SEQ ID NO: 2676831 - RNA, 14 nt, Human
uuacuguguuuuau

SEQ ID NO: 2676832 - RNA, 20 nt, Human
uuacuguguuuuauaaaaua

SEQ ID NO: 2676833 - RNA, 21 nt, Human
uuacuuaaaccgccaaggcug

SEQ ID NO: 2676834 - RNA, 17 nt, Human
uuacuguuuauuacuuc

SEQ ID NO: 2676835 - RNA, 23 nt, Human
uuacuguuuauuacuuccaugaa

SEQ ID NO: 2676836 - RNA, 14 nt, Human
uuacuguguaaacu

SEQ ID NO: 2676837 - RNA, 16 nt, Human
uuacuguguaaacuca

SEQ ID NO: 2676838 - RNA, 14 nt, Human
uuacuuccaugaau

SEQ ID NO: 2676839 - RNA, 15 nt, Human
uuacuuccaugaauu

SEQ ID NO: 2676840 - RNA, 18 nt, Human
uuacuuagguguggggga

SEQ ID NO: 2676841 - RNA, 14 nt, Human
uuccuauauccugu

SEQ ID NO: 2676842 - RNA, 13 nt, Human
uuccucauuagca

SEQ ID NO: 2676843 - RNA, 17 nt, Human
uuccuccauuugagaaa

SEQ ID NO: 2676844 - RNA, 14 nt, Human
uuccucaaauuuuu

SEQ ID NO: 2676845 - RNA, 20 nt, Human
uuccucaaauuuuuugacuu

SEQ ID NO: 2676846 - RNA, 22 nt, Human
uuccucaaauuuuuugacuuuu

SEQ ID NO: 2676847 - RNA, 19 nt, Human
uuccucaaaauaaagaagu

SEQ ID NO: 2676848 - RNA, 20 nt, Human
uuccucaaaauaaagaagua

SEQ ID NO: 2676849 - RNA, 21 nt, Human
uuccucaaaauaaagaaguau

SEQ ID NO: 2676850 - RNA, 18 nt, Human
uuccucaaagcuuggauu

SEQ ID NO: 2676851 - RNA, 14 nt, Human
uucccuugaaacuu

SEQ ID NO: 2676852 - RNA, 22 nt, Human
uucccuugaaacuuugggaaaa

SEQ ID NO: 2676853 - RNA, 16 nt, Human
uucccugcuuccagga

SEQ ID NO: 2676854 - RNA, 14 nt, Human
uucccugcuuccag

SEQ ID NO: 2676855 - RNA, 15 nt, Human
uucccugcuuccagg

SEQ ID NO: 2676856 - RNA, 13 nt, Human
uucccugcuucca

SEQ ID NO: 2676857 - RNA, 18 nt, Human
uucgggcgucugugugcg

SEQ ID NO: 2676858 - RNA, 20 nt, Human
uucgggaggucgaggcagga

SEQ ID NO: 2676859 - RNA, 24 nt, Human
uuccuugagacacggagcccagcc

SEQ ID NO: 2676860 - RNA, 23 nt, Human
uuccuugguccuaguaagaagac

SEQ ID NO: 2676861 - RNA, 17 nt, Human
uucguucuguacuguua

SEQ ID NO: 2676862 - RNA, 14 nt, Human
uucuaaaaacuucu

SEQ ID NO: 2676863 - RNA, 17 nt, Human
uuccugccaggcauggu

SEQ ID NO: 2676864 - RNA, 22 nt, Human
uuccuugagacacggagcccag

SEQ ID NO: 2676865 - RNA, 20 nt, Human
uuccuugaguugauucagcu

SEQ ID NO: 2676866 - RNA, 12 nt, Human
uuccccaugaca

SEQ ID NO: 2676867 - RNA, 21 nt, Human
uuccccaugcuuccuugccug

SEQ ID NO: 2676868 - RNA, 19 nt, Human
uuccccagcuuugcugccu

SEQ ID NO: 2676869 - RNA, 23 nt, Human
uucccccaccgguccagcuggcc

SEQ ID NO: 2676870 - RNA, 22 nt, Human
uucccccaccgguccagcuggc

SEQ ID NO: 2676871 - RNA, 18 nt, Human
uucccccaccgguccagc

SEQ ID NO: 2676872 - RNA, 14 nt, Human
uuccagauguggau

SEQ ID NO: 2676873 - RNA, 19 nt, Human
uuccagauggucauccaga

SEQ ID NO: 2676874 - RNA, 23 nt, Human
uuccagauggucauccagacuca

SEQ ID NO: 2676875 - RNA, 13 nt, Human
uuccauugcuuau

SEQ ID NO: 2676876 - RNA, 14 nt, Human
uuccauuccacaca

SEQ ID NO: 2676877 - RNA, 12 nt, Human
uucccaucugca

SEQ ID NO: 2676878 - RNA, 14 nt, Human
uucccaucugcacc

SEQ ID NO: 2676879 - RNA, 17 nt, Human
uucccauguagcccccu

SEQ ID NO: 2676880 - RNA, 23 nt, Human
uucccauggggagggauucuggu

SEQ ID NO: 2676881 - RNA, 14 nt, Human
uucccauggggagg

SEQ ID NO: 2676882 - RNA, 15 nt, Human
uucccauggggaggg

SEQ ID NO: 2676883 - RNA, 16 nt, Human
uuccagaucuuucaga

SEQ ID NO: 2676884 - RNA, 20 nt, Human
uuccagaucuuucagaaaua

SEQ ID NO: 2676885 - RNA, 17 nt, Human
uuccacuacaccuggcu

SEQ ID NO: 2676886 - RNA, 18 nt, Human
uuccacuacaccuggcug

SEQ ID NO: 2676887 - RNA, 19 nt, Human
uuccacuacaccuggcuga

SEQ ID NO: 2676888 - RNA, 22 nt, Human
uuccacuacaccuggcugaggu

SEQ ID NO: 2676889 - RNA, 16 nt, Human
uuccacuccauugucg

SEQ ID NO: 2676890 - RNA, 19 nt, Human
uuccacucguguguuucua

SEQ ID NO: 2676891 - RNA, 21 nt, Human
uuccaaauguaauaaacuuua

SEQ ID NO: 2676892 - RNA, 15 nt, Human
uuccacuacaccugg

SEQ ID NO: 2676893 - RNA, 16 nt, Human
uuccacuacaccuggc

SEQ ID NO: 2676894 - RNA, 20 nt, Human
uuccaaaccuuaucuccaca

SEQ ID NO: 2676895 - RNA, 15 nt, Human
uuccaaaccuuaucu

SEQ ID NO: 2676896 - RNA, 14 nt, Human
uuccaaauaaauaa

SEQ ID NO: 2676897 - RNA, 16 nt, Human
uuccaaauaaauaauu

SEQ ID NO: 2676898 - RNA, 15 nt, Human
uucaugaaaauacca

SEQ ID NO: 2676899 - RNA, 17 nt, Human
uucaugaaaauaccauu

SEQ ID NO: 2676900 - RNA, 15 nt, Human
uucaugcacuuaaag

SEQ ID NO: 2676901 - RNA, 17 nt, Human
uucaugcacuuaaagaa

SEQ ID NO: 2676902 - RNA, 19 nt, Human
uucaugcacuuaaagaagu

SEQ ID NO: 2676903 - RNA, 23 nt, Human
uucaugcacuuaaagaaguauuu

SEQ ID NO: 2676904 - RNA, 15 nt, Human
uucauuucuaauuaa

SEQ ID NO: 2676905 - RNA, 16 nt, Human
uucaaaguuuuguugu

SEQ ID NO: 2676906 - RNA, 20 nt, Human
uucaaaguuuuguuguacuu

SEQ ID NO: 2676907 - RNA, 21 nt, Human
uucaaaguuuuguuguacuua

SEQ ID NO: 2676908 - RNA, 16 nt, Human
uuauuuuacacagaaa

SEQ ID NO: 2676909 - RNA, 17 nt, Human
uuauuuuacacagaaac

SEQ ID NO: 2676910 - RNA, 20 nt, Human
uuauuuuacagcucauuaaa

SEQ ID NO: 2676911 - RNA, 12 nt, Human
uucaaagccuuc

SEQ ID NO: 2676912 - RNA, 17 nt, Human
uucaaagccuucucccu

SEQ ID NO: 2676913 - RNA, 19 nt, Human
uuauuuuacacagaaacac

SEQ ID NO: 2676914 - RNA, 14 nt, Human
uucaaaggaacauu

SEQ ID NO: 2676915 - RNA, 16 nt, Human
uucaaaggaacauugu

SEQ ID NO: 2676916 - RNA, 14 nt, Human
uuauuguauuuaug

SEQ ID NO: 2676917 - RNA, 18 nt, Human
uucacucuaagucaugua

SEQ ID NO: 2676918 - RNA, 19 nt, Human
uucacucuaagucauguau

SEQ ID NO: 2676919 - RNA, 20 nt, Human
uucagacaucugagguuuua

SEQ ID NO: 2676920 - RNA, 13 nt, Human
uucacuccagccu

SEQ ID NO: 2676921 - RNA, 16 nt, Human
uucacucacucuaaag

SEQ ID NO: 2676922 - RNA, 18 nt, Human
uucacggaagagccuugc

SEQ ID NO: 2676923 - RNA, 14 nt, Human
uucaccuugaagaa

SEQ ID NO: 2676924 - RNA, 14 nt, Human
uucaauugucacuu

SEQ ID NO: 2676925 - RNA, 13 nt, Human
uuauuacuguuua

SEQ ID NO: 2676926 - RNA, 18 nt, Human
uuauuaaugcacuuucua

SEQ ID NO: 2676927 - RNA, 13 nt, Human
uuauuaaugcacu

SEQ ID NO: 2676928 - RNA, 17 nt, Human
uuauuaaugcacuuucu

SEQ ID NO: 2676929 - RNA, 12 nt, Human
uuauuaauguuu

SEQ ID NO: 2676930 - RNA, 13 nt, Human
uuauuaauguuuu

SEQ ID NO: 2676931 - RNA, 16 nt, Human
uuauuaauguuuucaa

SEQ ID NO: 2676932 - RNA, 17 nt, Human
uuauuaauguuuucaaa

SEQ ID NO: 2676933 - RNA, 13 nt, Human
uuauggaaaacug

SEQ ID NO: 2676934 - RNA, 16 nt, Human
uuauuaaacaaauaau

SEQ ID NO: 2676935 - RNA, 11 nt, Human
uuauuaaugca

SEQ ID NO: 2676936 - RNA, 18 nt, Human
uuauuaaucacuguguau

SEQ ID NO: 2676937 - RNA, 16 nt, Human
uuauuaaucacugugu

SEQ ID NO: 2676938 - RNA, 14 nt, Human
uuauuaaucacugu

SEQ ID NO: 2676939 - RNA, 11 nt, Human
uuauugacacu

SEQ ID NO: 2676940 - RNA, 12 nt, Human
uuauugacacug

SEQ ID NO: 2676941 - RNA, 13 nt, Human
uuauugacacuga

SEQ ID NO: 2676942 - RNA, 14 nt, Human
uuauugacacugaa

SEQ ID NO: 2676943 - RNA, 15 nt, Human
uuauugacacugaac

SEQ ID NO: 2676944 - RNA, 17 nt, Human
uuauugacacugaacuu

SEQ ID NO: 2676945 - RNA, 14 nt, Human
uuauugacucuuga

SEQ ID NO: 2676946 - RNA, 22 nt, Human
uuauugacucuggguccuuccu

SEQ ID NO: 2676947 - RNA, 16 nt, Human
uuauugacucuggguc

SEQ ID NO: 2676948 - RNA, 13 nt, Human
uuauugaccauuu

SEQ ID NO: 2676949 - RNA, 22 nt, Human
uuauugaccauuuuuuaauuua

SEQ ID NO: 2676950 - RNA, 14 nt, Human
uuauugcaguuuau

SEQ ID NO: 2676951 - RNA, 16 nt, Human
uuauugcaguuuauca

SEQ ID NO: 2676952 - RNA, 22 nt, Human
uuauugcaguuuaucauucaag

SEQ ID NO: 2676953 - RNA, 18 nt, Human
uuauugcaguuuaucauu

SEQ ID NO: 2676954 - RNA, 21 nt, Human
uuauugcaguuuaucauucaa

SEQ ID NO: 2676955 - RNA, 16 nt, Human
uuauugaauauaugau

SEQ ID NO: 2676956 - RNA, 21 nt, Human
uuauugacucuugaguuguuu

SEQ ID NO: 2676957 - RNA, 20 nt, Human
uuauugacucuugaguuguu

SEQ ID NO: 2676958 - RNA, 17 nt, Human
uuauugacucuugaguu

SEQ ID NO: 2676959 - RNA, 16 nt, Human
uuauugacucuugagu

SEQ ID NO: 2676960 - RNA, 22 nt, Human
uuaugccacuuccuuuuaacug

SEQ ID NO: 2676961 - RNA, 17 nt, Human
uuaugcucucacuguuu

SEQ ID NO: 2676962 - RNA, 19 nt, Human
uuaugcucucacuguuugu

SEQ ID NO: 2676963 - RNA, 16 nt, Human
uuaugcaucauuucag

SEQ ID NO: 2676964 - RNA, 14 nt, Human
uuaucuugauacau

SEQ ID NO: 2676965 - RNA, 16 nt, Human
uuaucuugauacauuc

SEQ ID NO: 2676966 - RNA, 17 nt, Human
uuaucuugauacauuca

SEQ ID NO: 2676967 - RNA, 18 nt, Human
uuaucuugauacauucaa

SEQ ID NO: 2676968 - RNA, 14 nt, Human
uuaucuuugaauau

SEQ ID NO: 2676969 - RNA, 11 nt, Human
uuaguuuagaa

SEQ ID NO: 2676970 - RNA, 14 nt, Human
uuaguuccuugagu

SEQ ID NO: 2676971 - RNA, 16 nt, Human
uuaguuccucauuagc

SEQ ID NO: 2676972 - RNA, 23 nt, Human
uuaucugggauuaugguuuugug

SEQ ID NO: 2676973 - RNA, 12 nt, Human
uuaucugggcuu

SEQ ID NO: 2676974 - RNA, 22 nt, Human
uuuagacucaucaaucaaauaa

SEQ ID NO: 2676975 - RNA, 23 nt, Human
uuuaguucaauauuuguuacugu

SEQ ID NO: 2676976 - RNA, 22 nt, Human
uuuagacccuauugcugcuuga

SEQ ID NO: 2676977 - RNA, 15 nt, Human
uuuagaccauuuauc

SEQ ID NO: 2676978 - RNA, 19 nt, Human
uuuagacccuauugcugcu

SEQ ID NO: 2676979 - RNA, 16 nt, Human
uuuacccaccuagaac

SEQ ID NO: 2676980 - RNA, 12 nt, Human
uuuauaaagcau

SEQ ID NO: 2676981 - RNA, 14 nt, Human
uuuauaaauccagu

SEQ ID NO: 2676982 - RNA, 16 nt, Human
uuuauacugaaggaaa

SEQ ID NO: 2676983 - RNA, 16 nt, Human
uuuauacuguuuacug

SEQ ID NO: 2676984 - RNA, 18 nt, Human
uuuauccagaaaacugug

SEQ ID NO: 2676985 - RNA, 19 nt, Human
uuuauccagaaaacuguga

SEQ ID NO: 2676986 - RNA, 18 nt, Human
uuuauagcaacaacaauu

SEQ ID NO: 2676987 - RNA, 17 nt, Human
uuuaucugggauuaugg

SEQ ID NO: 2676988 - RNA, 17 nt, Human
uuuaucuggccccaggu

SEQ ID NO: 2676989 - RNA, 13 nt, Human
uuuaucugauuaa

SEQ ID NO: 2676990 - RNA, 14 nt, Human
uuuaugagaaacuu

SEQ ID NO: 2676991 - RNA, 23 nt, Human
uuuaaccgguaagaguuucaguu

SEQ ID NO: 2676992 - RNA, 22 nt, Human
uuuaaacacucuucagagaaau

SEQ ID NO: 2676993 - RNA, 23 nt, Human
uuuaauauaaaguaguccuguga

SEQ ID NO: 2676994 - RNA, 12 nt, Human
uuuaacagaaau

SEQ ID NO: 2676995 - RNA, 19 nt, Human
uuuaaucauaguuacugug

SEQ ID NO: 2676996 - RNA, 22 nt, Human
uuuaaucauaguuacuguguaa

SEQ ID NO: 2676997 - RNA, 23 nt, Human
uuuaaucauaguuacuguguaaa

SEQ ID NO: 2676998 - RNA, 22 nt, Human
uuuaauauugagaaagaaacua

SEQ ID NO: 2676999 - RNA, 15 nt, Human
uuuaauauugagaaa

SEQ ID NO: 2677000 - RNA, 19 nt, Human
uuuacauauaaaauguaau

SEQ ID NO: 2677001 - RNA, 21 nt, Human
uuuacagcucauuaaacuuuu

SEQ ID NO: 2677002 - RNA, 17 nt, Human
uuuacagaugaauguau

SEQ ID NO: 2677003 - RNA, 17 nt, Human
uuuaaaaggaaagaaaa

SEQ ID NO: 2677004 - RNA, 15 nt, Human
uuuaaaauaaaauga

SEQ ID NO: 2677005 - RNA, 16 nt, Human
uuuaaaauaaaaugaa

SEQ ID NO: 2677006 - RNA, 17 nt, Human
uuuaaaauaaaaugaaa

SEQ ID NO: 2677007 - RNA, 18 nt, Human
uuuaaaauaaaaugaaaa

SEQ ID NO: 2677008 - RNA, 19 nt, Human
uuuaaaauaaaaugaaaau

SEQ ID NO: 2677009 - RNA, 22 nt, Human
uuuaaaauaaaaugaaaauugu

SEQ ID NO: 2677010 - RNA, 16 nt, Human
uuuaaaauauuuaucu

SEQ ID NO: 2677011 - RNA, 13 nt, Human
uuuaaaauagaaa

SEQ ID NO: 2677012 - RNA, 21 nt, Human
uuuaaaauagaaauuuuguaa

SEQ ID NO: 2677013 - RNA, 22 nt, Human
uuuaaaauagaaauuuuguaag

SEQ ID NO: 2677014 - RNA, 23 nt, Human
uuuaaaauagaaauuuuguaaga

SEQ ID NO: 2677015 - RNA, 16 nt, Human
uuuaaaacuggaccug

SEQ ID NO: 2677016 - RNA, 13 nt, Human
uuuaaaagaauga

SEQ ID NO: 2677017 - RNA, 12 nt, Human
uuuaaaauguaa

SEQ ID NO: 2677018 - RNA, 18 nt, Human
uuuaaaauguaauuuaaa

SEQ ID NO: 2677019 - RNA, 21 nt, Human
uuuaaaauguaauuuaaauga

SEQ ID NO: 2677020 - RNA, 22 nt, Human
uuuaaaauguaauuuaaaugaa

SEQ ID NO: 2677021 - RNA, 23 nt, Human
uuuaaaauguaauuuaaaugaaa

SEQ ID NO: 2677022 - RNA, 21 nt, Human
uuuaaaaucugagggaaaugu

SEQ ID NO: 2677023 - RNA, 10 nt, Human
uuuaaaauuu

SEQ ID NO: 2677024 - RNA, 17 nt, Human
uuuaaaauuuuguaugu

SEQ ID NO: 2677025 - RNA, 21 nt, Human
uuuaaaauuuuguauguuaaa

SEQ ID NO: 2677026 - RNA, 15 nt, Human
uuuaaacugucgugu

SEQ ID NO: 2677027 - RNA, 15 nt, Human
uuguuuaaaauguaa

SEQ ID NO: 2677028 - RNA, 21 nt, Human
uuguuuaaaauguaauuuaaa

SEQ ID NO: 2677029 - RNA, 15 nt, Human
uuguuauuaaacaaa

SEQ ID NO: 2677030 - RNA, 13 nt, Human
uuguuuuaaaacu

SEQ ID NO: 2677031 - RNA, 14 nt, Human
uuguuuuaaaacug

SEQ ID NO: 2677032 - RNA, 18 nt, Human
uuuaaaacaccuucuaua

SEQ ID NO: 2677033 - RNA, 16 nt, Human
uuuaaaacacauguuu

SEQ ID NO: 2677034 - RNA, 23 nt, Human
uuuaaaacacauguuuuuauaca

SEQ ID NO: 2677035 - RNA, 13 nt, Human
uuuaaaacacaug

SEQ ID NO: 2677036 - RNA, 13 nt, Human
uuguuuuacaaua

SEQ ID NO: 2677037 - RNA, 12 nt, Human
uuguuuuacaau

SEQ ID NO: 2677038 - RNA, 17 nt, Human
uuguuugguaaauguuu

SEQ ID NO: 2677039 - RNA, 19 nt, Human
uuguuugguaaauguuucu

SEQ ID NO: 2677040 - RNA, 15 nt, Human
uuguuuauaauaaaa

SEQ ID NO: 2677041 - RNA, 16 nt, Human
uuguuuauaauaaaaa

SEQ ID NO: 2677042 - RNA, 18 nt, Human
uuguuuauaauaaaaaua

SEQ ID NO: 2677043 - RNA, 12 nt, Human
uuguuucugaaa

SEQ ID NO: 2677044 - RNA, 21 nt, Human
uuugaacaaugaaguugaaaa

SEQ ID NO: 2677045 - RNA, 13 nt, Human
uuucugaaaagau

SEQ ID NO: 2677046 - RNA, 15 nt, Human
uuugaauaaaugugu

SEQ ID NO: 2677047 - RNA, 17 nt, Human
uuugagaucagccuggg

SEQ ID NO: 2677048 - RNA, 16 nt, Human
uuugagaucagccugg

SEQ ID NO: 2677049 - RNA, 22 nt, Human
uuugaaauuguuccuuggagaa

SEQ ID NO: 2677050 - RNA, 13 nt, Human
uuugaauaaaugu

SEQ ID NO: 2677051 - RNA, 20 nt, Human
uuugauaaaaauuuagaaca

SEQ ID NO: 2677052 - RNA, 22 nt, Human
uuugaggauuaguuuagaacag

SEQ ID NO: 2677053 - RNA, 19 nt, Human
uuugaggauuaguuuagaa

SEQ ID NO: 2677054 - RNA, 18 nt, Human
uuugaggauuaguuuaga

SEQ ID NO: 2677055 - RNA, 17 nt, Human
uuugaggauuaguuuag

SEQ ID NO: 2677056 - RNA, 23 nt, Human
uuugaggauuaguuuagaacagg

SEQ ID NO: 2677057 - RNA, 16 nt, Human
uuugaggauuaguuua

SEQ ID NO: 2677058 - RNA, 15 nt, Human
uuugagauguaaaaa

SEQ ID NO: 2677059 - RNA, 13 nt, Human
uuugguaaauguu

SEQ ID NO: 2677060 - RNA, 16 nt, Human
uuugguaaauguuucu

SEQ ID NO: 2677061 - RNA, 14 nt, Human
uuugguacuaauaa

SEQ ID NO: 2677062 - RNA, 16 nt, Human
uuuguauguuaaagag

SEQ ID NO: 2677063 - RNA, 22 nt, Human
uuuguaugccaagugagaagau

SEQ ID NO: 2677064 - RNA, 12 nt, Human
uuuguaugugug

SEQ ID NO: 2677065 - RNA, 14 nt, Human
uuuguaaagcuauu

SEQ ID NO: 2677066 - RNA, 14 nt, Human
uuuguaaauaggau

SEQ ID NO: 2677067 - RNA, 20 nt, Human
uuuguaaauaggauuuuuag

SEQ ID NO: 2677068 - RNA, 15 nt, Human
uuuguaaaguuuccg

SEQ ID NO: 2677069 - RNA, 13 nt, Human
uuuguaaacauuu

SEQ ID NO: 2677070 - RNA, 14 nt, Human
uuuguaaacauuua

SEQ ID NO: 2677071 - RNA, 19 nt, Human
uuuggaccuaaauggccuc

SEQ ID NO: 2677072 - RNA, 23 nt, Human
uuugccaaaauucauuucuaauu

SEQ ID NO: 2677073 - RNA, 21 nt, Human
uuugauauuauacaggaaagc

SEQ ID NO: 2677074 - RNA, 15 nt, Human
uuucuaauuaaccuu

SEQ ID NO: 2677075 - RNA, 16 nt, Human
uuucucuauuaaaaug

SEQ ID NO: 2677076 - RNA, 19 nt, Human
uuucuacagugguuuuaua

SEQ ID NO: 2677077 - RNA, 12 nt, Human
uuucucucucua

SEQ ID NO: 2677078 - RNA, 15 nt, Human
uuucucugaaagugu

SEQ ID NO: 2677079 - RNA, 15 nt, Human
uuucucuuugauuau

SEQ ID NO: 2677080 - RNA, 21 nt, Human
uuucucuuugauuauuugcau

SEQ ID NO: 2677081 - RNA, 22 nt, Human
uuucucuuugauuauuugcaug

SEQ ID NO: 2677082 - RNA, 17 nt, Human
uuuccucucuauauuuc

SEQ ID NO: 2677083 - RNA, 23 nt, Human
uuuccuggcacuggaccccagca

SEQ ID NO: 2677084 - RNA, 21 nt, Human
uuuccuggcacuggaccccag

SEQ ID NO: 2677085 - RNA, 22 nt, Human
uuuccucgcagccucucagugc

SEQ ID NO: 2677086 - RNA, 18 nt, Human
uuucagcgacuccguugg

SEQ ID NO: 2677087 - RNA, 23 nt, Human
uuucagcgacuccguuggccacu

SEQ ID NO: 2677088 - RNA, 14 nt, Human
uuuaucuguuuccu

SEQ ID NO: 2677089 - RNA, 16 nt, Human
uuucaguacuuuuuua

SEQ ID NO: 2677090 - RNA, 19 nt, Human
uuucaguacuuuuuuaaau

SEQ ID NO: 2677091 - RNA, 18 nt, Human
uuucagguuauauccaau

SEQ ID NO: 2677092 - RNA, 21 nt, Human
uuucagguucaguauuaugua

SEQ ID NO: 2677093 - RNA, 19 nt, Human
uuuccaccacagccagcac

SEQ ID NO: 2677094 - RNA, 23 nt, Human
uuuccaccacagccagcaccugg

SEQ ID NO: 2677095 - RNA, 16 nt, Human
uuuccacuaaaaauau

SEQ ID NO: 2677096 - RNA, 16 nt, Human
uuuccacuccauuguc

SEQ ID NO: 2677097 - RNA, 13 nt, Human
uugaaugugucag

SEQ ID NO: 2677098 - RNA, 14 nt, Human
uugaauguuaaagg

SEQ ID NO: 2677099 - RNA, 22 nt, Human
uugaauguuaaagggauauuuu

SEQ ID NO: 2677100 - RNA, 11 nt, Human
uugaagcauag

SEQ ID NO: 2677101 - RNA, 19 nt, Human
uugaagcauagauaauauu

SEQ ID NO: 2677102 - RNA, 23 nt, Human
uugaagcauagauaauauuguuu

SEQ ID NO: 2677103 - RNA, 14 nt, Human
uugaaaauaguuua

SEQ ID NO: 2677104 - RNA, 16 nt, Human
uugaaaauguccagga

SEQ ID NO: 2677105 - RNA, 23 nt, Human
uugaaaauaguuuauuuuaaaac

SEQ ID NO: 2677106 - RNA, 16 nt, Human
uucuuuaaccuuguau

SEQ ID NO: 2677107 - RNA, 19 nt, Human
uucuuuaaccuuguauaaa

SEQ ID NO: 2677108 - RNA, 18 nt, Human
uucuucagauauacugga

SEQ ID NO: 2677109 - RNA, 18 nt, Human
uucuuaggggaaggagaa

SEQ ID NO: 2677110 - RNA, 14 nt, Human
uucuuaugaggagg

SEQ ID NO: 2677111 - RNA, 18 nt, Human
uucuuaugaggaggggag

SEQ ID NO: 2677112 - RNA, 13 nt, Human
uucuuaugugaca

SEQ ID NO: 2677113 - RNA, 16 nt, Human
uucuuaugugacauua

SEQ ID NO: 2677114 - RNA, 19 nt, Human
uucuuaugugacauuaaca

SEQ ID NO: 2677115 - RNA, 20 nt, Human
uucuuaugugacauuaacaa

SEQ ID NO: 2677116 - RNA, 21 nt, Human
uucuuaugugacauuaacaaa

SEQ ID NO: 2677117 - RNA, 13 nt, Human
uucuguauuugaa

SEQ ID NO: 2677118 - RNA, 11 nt, Human
uucuguauuug

SEQ ID NO: 2677119 - RNA, 20 nt, Human
uucguuguguuuuuuaagau

SEQ ID NO: 2677120 - RNA, 17 nt, Human
uucugugaugagcugau

SEQ ID NO: 2677121 - RNA, 24 nt, Human
uucugugcccagaauacugaugga

SEQ ID NO: 2677122 - RNA, 23 nt, Human
uucugugcccagaauacugaugg

SEQ ID NO: 2677123 - RNA, 20 nt, Human
uucugugcccagaauacuga

SEQ ID NO: 2677124 - RNA, 19 nt, Human
uucugugcccagaauacug

SEQ ID NO: 2677125 - RNA, 18 nt, Human
uucugugaugagcugauc

SEQ ID NO: 2677126 - RNA, 13 nt, Human
uucugugcccucc

SEQ ID NO: 2677127 - RNA, 13 nt, Human
uugcaguuuauca

SEQ ID NO: 2677128 - RNA, 18 nt, Human
uugcaguuuaucauucaa

SEQ ID NO: 2677129 - RNA, 18 nt, Human
uugcagcucagaaccaca

SEQ ID NO: 2677130 - RNA, 16 nt, Human
uugcacuguuuaauca

SEQ ID NO: 2677131 - RNA, 21 nt, Human
uugcagcccuugugaugugau

SEQ ID NO: 2677132 - RNA, 15 nt, Human
uugcagcccuuguga

SEQ ID NO: 2677133 - RNA, 17 nt, Human
uugcacuugugauuauu

SEQ ID NO: 2677134 - RNA, 20 nt, Human
uugcacuugugauuauuuau

SEQ ID NO: 2677135 - RNA, 23 nt, Human
uugauucgguauccccccaucuu

SEQ ID NO: 2677136 - RNA, 18 nt, Human
uugccagcugacaucuug

SEQ ID NO: 2677137 - RNA, 15 nt, Human
uugccaggacaugca

SEQ ID NO: 2677138 - RNA, 16 nt, Human
uugccaggacaugcaa

SEQ ID NO: 2677139 - RNA, 17 nt, Human
uugccaggacaugcaau

SEQ ID NO: 2677140 - RNA, 23 nt, Human
uugcaguuuaucauucaagugua

SEQ ID NO: 2677141 - RNA, 19 nt, Human
uugcaguuuaucauucaag

SEQ ID NO: 2677142 - RNA, 20 nt, Human
uugcaguuuaucauucaagu

SEQ ID NO: 2677143 - RNA, 16 nt, Human
uugauaucuauaaaau

SEQ ID NO: 2677144 - RNA, 17 nt, Human
uugauaucuauaaaaua

SEQ ID NO: 2677145 - RNA, 16 nt, Human
uugauucagcucugca

SEQ ID NO: 2677146 - RNA, 15 nt, Human
uugaucauguacuuu

SEQ ID NO: 2677147 - RNA, 16 nt, Human
uugaucauguacuuuu

SEQ ID NO: 2677148 - RNA, 17 nt, Human
uugaucauguacuuuuu

SEQ ID NO: 2677149 - RNA, 23 nt, Human
uugaauuaaauuaggaauaaaua

SEQ ID NO: 2677150 - RNA, 22 nt, Human
uugaauuaaauuaggaauaaau

SEQ ID NO: 2677151 - RNA, 17 nt, Human
uugaauuaaauuaggaa

SEQ ID NO: 2677152 - RNA, 23 nt, Human
uugaauuauccacaugaaaauaa

SEQ ID NO: 2677153 - RNA, 14 nt, Human
uugagccugggagg

SEQ ID NO: 2677154 - RNA, 12 nt, Human
uugagcucccac

SEQ ID NO: 2677155 - RNA, 22 nt, Human
uugagcucccacuucugccaga

SEQ ID NO: 2677156 - RNA, 16 nt, Human
uugagcuaugacuuaa

SEQ ID NO: 2677157 - RNA, 15 nt, Human
uugagcuaugacuua

SEQ ID NO: 2677158 - RNA, 14 nt, Human
uugagcuaugacuu

SEQ ID NO: 2677159 - RNA, 11 nt, Human
uugagcuauga

SEQ ID NO: 2677160 - RNA, 20 nt, Human
uugaggccaagaauauugca

SEQ ID NO: 2677161 - RNA, 21 nt, Human
uugaggccaagaauauugcaa

SEQ ID NO: 2677162 - RNA, 19 nt, Human
uugaggauuaguuuagaac

SEQ ID NO: 2677163 - RNA, 18 nt, Human
uugaggauuaguuuagaa

SEQ ID NO: 2677164 - RNA, 17 nt, Human
uugaggauuaguuuaga

SEQ ID NO: 2677165 - RNA, 14 nt, Human
uugaggauuaguuu

SEQ ID NO: 2677166 - RNA, 23 nt, Human
uugggaaugaggaaaauucuuaa

SEQ ID NO: 2677167 - RNA, 21 nt, Human
uugggagagccauacauaaaa

SEQ ID NO: 2677168 - RNA, 22 nt, Human
uugggacugcuaaauaaaauuu

SEQ ID NO: 2677169 - RNA, 23 nt, Human
uuggcuucacggaagagccuugc

SEQ ID NO: 2677170 - RNA, 22 nt, Human
uuggcuucugugaugagcugau

SEQ ID NO: 2677171 - RNA, 11 nt, Human
uuggcuucugu

SEQ ID NO: 2677172 - RNA, 13 nt, Human
uuggcaggcuggc

SEQ ID NO: 2677173 - RNA, 14 nt, Human
uuggcaggcuggcc

SEQ ID NO: 2677174 - RNA, 20 nt, Human
uugguaauccccuaaaauaa

SEQ ID NO: 2677175 - RNA, 17 nt, Human
uugguccuguccccgca

SEQ ID NO: 2677176 - RNA, 14 nt, Human
uugguccugucccc

SEQ ID NO: 2677177 - RNA, 13 nt, Human
uugggaguuuuua

SEQ ID NO: 2677178 - RNA, 15 nt, Human
uuguacuuaaauggu

SEQ ID NO: 2677179 - RNA, 23 nt, Human
uuguacuuaaaugguaauaagca

SEQ ID NO: 2677180 - RNA, 15 nt, Human
uuguagauuugauuu

SEQ ID NO: 2677181 - RNA, 12 nt, Human
uuguaaacauuu

SEQ ID NO: 2677182 - RNA, 13 nt, Human
uuguaaacauuua

SEQ ID NO: 2677183 - RNA, 14 nt, Human
uuguaaacauuuau

SEQ ID NO: 2677184 - RNA, 20 nt, Human
uuguacauuugggaguuuuu

SEQ ID NO: 2677185 - RNA, 22 nt, Human
uugucuuaaaaaguggaaaaau

SEQ ID NO: 2677186 - RNA, 22 nt, Human
uugucaaacuguagaaaugaug

SEQ ID NO: 2677187 - RNA, 19 nt, Human
uuguauuuuuguuguuggg

SEQ ID NO: 2677188 - RNA, 16 nt, Human
uuguauuuuuguuguu

SEQ ID NO: 2677189 - RNA, 18 nt, Human
uuguauuuugauuauuuu

SEQ ID NO: 2677190 - RNA, 12 nt, Human
uuguaugaaaac

SEQ ID NO: 2677191 - RNA, 16 nt, Human
uuguauuuucaugaaa

SEQ ID NO: 2677192 - RNA, 17 nt, Human
uuguauuuucaugaaaa

SEQ ID NO: 2677193 - RNA, 18 nt, Human
uuguauuuucaugaaaau

SEQ ID NO: 2677194 - RNA, 21 nt, Human
uuggcaaugacucaaagucug

SEQ ID NO: 2677195 - RNA, 12 nt, Human
uuggcaggcugg

SEQ ID NO: 2677196 - RNA, 18 nt, Human
uuggcacuuauugaauau

SEQ ID NO: 2677197 - RNA, 22 nt, Human
uuggcaauaaauuuugaaaagu

SEQ ID NO: 2677198 - RNA, 20 nt, Human
uuggcaauaaauuuugaaaa

SEQ ID NO: 2677199 - RNA, 18 nt, Human
uuggcaauaaauuuugaa

SEQ ID NO: 2677200 - RNA, 22 nt, Human
uuggaagcacaccaaucuuacu

SEQ ID NO: 2677201 - RNA, 19 nt, Human
uugcuguuguccaacuauu

SEQ ID NO: 2677202 - RNA, 14 nt, Human
uugcuguuguccaa

SEQ ID NO: 2677203 - RNA, 20 nt, Human
uugcugugcuucaaacuacu

SEQ ID NO: 2677204 - RNA, 19 nt, Human
uugcugugugucccaggca

SEQ ID NO: 2677205 - RNA, 20 nt, Human
uugcugugugucccaggcag

SEQ ID NO: 2677206 - RNA, 14 nt, Human
uuggacauccuccu

SEQ ID NO: 2677207 - RNA, 12 nt, Human
uugcugcucuuc

SEQ ID NO: 2677208 - RNA, 15 nt, Human
uugcugcugccucuu

SEQ ID NO: 2677209 - RNA, 16 nt, Human
uugcugcuugaggcaa

SEQ ID NO: 2677210 - RNA, 14 nt, Human
uugcugcuugaggc

SEQ ID NO: 2677211 - RNA, 22 nt, Human
uugcuggccaguccacccugcc

SEQ ID NO: 2677212 - RNA, 13 nt, Human
uugcuggccccag

SEQ ID NO: 2677213 - RNA, 14 nt, Human
uugcuggccccagc

SEQ ID NO: 2677214 - RNA, 17 nt, Human
uugcuggccccagcccu

SEQ ID NO: 2677215 - RNA, 23 nt, Human
uugcuggccccagcccugcuggg

SEQ ID NO: 2677216 - RNA, 14 nt, Human
uugccauguguuuu

SEQ ID NO: 2677217 - RNA, 20 nt, Human
uugccaugugcuucugccac

SEQ ID NO: 2677218 - RNA, 13 nt, Human
uugccaugugcuu

SEQ ID NO: 2677219 - RNA, 21 nt, Human
uugccuguuucugauuugcug

SEQ ID NO: 2677220 - RNA, 13 nt, Human
uugccuuaaaaua

SEQ ID NO: 2677221 - RNA, 16 nt, Human
uugccuugcuguuugu

SEQ ID NO: 2677222 - RNA, 20 nt, Human
uugccuuccauuuccccucu

SEQ ID NO: 2677223 - RNA, 15 nt, Human
uugccuuuuaauuuu

SEQ ID NO: 2677224 - RNA, 19 nt, Human
uugccuuuuaauuuuuaau

SEQ ID NO: 2677225 - RNA, 19 nt, Human
uugccuuuugcaaccagga

SEQ ID NO: 2677226 - RNA, 21 nt, Human
caacuuuuguguaaugaaaau

SEQ ID NO: 2677227 - RNA, 20 nt, Human
caacuuuuguguaaugaaaa

SEQ ID NO: 2677228 - RNA, 19 nt, Human
caacuuuuucccucacuaa

SEQ ID NO: 2677229 - RNA, 14 nt, Human
caacuuuuguguaa

SEQ ID NO: 2677230 - RNA, 17 nt, Human
caagaacacacacauau

SEQ ID NO: 2677231 - RNA, 22 nt, Human
caagaagaaaugcuuuccaaaa

SEQ ID NO: 2677232 - RNA, 18 nt, Human
caagacucuuuggacacu

SEQ ID NO: 2677233 - RNA, 20 nt, Human
caacggaggccugcgacccu

SEQ ID NO: 2677234 - RNA, 16 nt, Human
caaccucgcugagggc

SEQ ID NO: 2677235 - RNA, 23 nt, Human
caacggucuccugacuggugcug

SEQ ID NO: 2677236 - RNA, 17 nt, Human
caaauuucaugaccagu

SEQ ID NO: 2677237 - RNA, 14 nt, Human
caaccgagaagguu

SEQ ID NO: 2677238 - RNA, 15 nt, Human
caacccugccgucac

SEQ ID NO: 2677239 - RNA, 20 nt, Human
caacccugccgucaccacca

SEQ ID NO: 2677240 - RNA, 20 nt, Human
caacccuaucuccugacaga

SEQ ID NO: 2677241 - RNA, 22 nt, Human
caacccuaucuccugacagaag

SEQ ID NO: 2677242 - RNA, 16 nt, Human
caacccuaucuccuga

SEQ ID NO: 2677243 - RNA, 19 nt, Human
caacccuaucuccugacag

SEQ ID NO: 2677244 - RNA, 15 nt, Human
caaggacuuuguaca

SEQ ID NO: 2677245 - RNA, 13 nt, Human
caagccagaggcu

SEQ ID NO: 2677246 - RNA, 15 nt, Human
caagccagaggcugg

SEQ ID NO: 2677247 - RNA, 16 nt, Human
caagccagaggcuggg

SEQ ID NO: 2677248 - RNA, 15 nt, Human
caagccuccacagcg

SEQ ID NO: 2677249 - RNA, 16 nt, Human
caagccuccacagcga

SEQ ID NO: 2677250 - RNA, 17 nt, Human
caagccuccacagcgag

SEQ ID NO: 2677251 - RNA, 14 nt, Human
caagccuccacagc

SEQ ID NO: 2677252 - RNA, 13 nt, Human
caagccuccacag

SEQ ID NO: 2677253 - RNA, 17 nt, Human
caagcuggcuuacacug

SEQ ID NO: 2677254 - RNA, 15 nt, Human
caaggcugcagugag

SEQ ID NO: 2677255 - RNA, 12 nt, Human
caaggcugcagu

SEQ ID NO: 2677256 - RNA, 21 nt, Human
caaguguaaaauauuuugaau

SEQ ID NO: 2677257 - RNA, 23 nt, Human
caaguguaaaauauuuugaauca

SEQ ID NO: 2677258 - RNA, 16 nt, Human
caagugugaauacugc

SEQ ID NO: 2677259 - RNA, 15 nt, Human
caagugugaauacug

SEQ ID NO: 2677260 - RNA, 14 nt, Human
caagugugaauacu

SEQ ID NO: 2677261 - RNA, 23 nt, Human
caaguggaccuuaggccuuccuc

SEQ ID NO: 2677262 - RNA, 22 nt, Human
caaguggaccuuaggccuuccu

SEQ ID NO: 2677263 - RNA, 21 nt, Human
caaguggaccuuaggccuucc

SEQ ID NO: 2677264 - RNA, 12 nt, Human
caaguggaccuu

SEQ ID NO: 2677265 - RNA, 21 nt, Human
caauuugcacuaaaucagaga

SEQ ID NO: 2677266 - RNA, 20 nt, Human
caauuugcacuaaaucagag

SEQ ID NO: 2677267 - RNA, 22 nt, Human
caauuucuguguugccaagcuc

SEQ ID NO: 2677268 - RNA, 16 nt, Human
caauucuagucauaua

SEQ ID NO: 2677269 - RNA, 18 nt, Human
caaugugaggggucccua

SEQ ID NO: 2677270 - RNA, 20 nt, Human
caaugugaggggucccuagc

SEQ ID NO: 2677271 - RNA, 17 nt, Human
caaugugauaaaacccc

SEQ ID NO: 2677272 - RNA, 15 nt, Human
caaugugauaaaacc

SEQ ID NO: 2677273 - RNA, 15 nt, Human
caaugacucaaaguc

SEQ ID NO: 2677274 - RNA, 20 nt, Human
caaugguaguuucugugguu

SEQ ID NO: 2677275 - RNA, 17 nt, Human
caaugguaguuucugug

SEQ ID NO: 2677276 - RNA, 16 nt, Human
caaugguaguuucugu

SEQ ID NO: 2677277 - RNA, 14 nt, Human
caaugguaguuucu

SEQ ID NO: 2677278 - RNA, 23 nt, Human
caauggguuuuucccuguacagu

SEQ ID NO: 2677279 - RNA, 13 nt, Human
caaugagagcaua

SEQ ID NO: 2677280 - RNA, 19 nt, Human
caaugagagcauaauuuaa

SEQ ID NO: 2677281 - RNA, 17 nt, Human
caauacacuaguuguuu

SEQ ID NO: 2677282 - RNA, 19 nt, Human
caauacacuaguuguuucu

SEQ ID NO: 2677283 - RNA, 18 nt, Human
caauaauauauuuucugu

SEQ ID NO: 2677284 - RNA, 20 nt, Human
caauaauauauuuucuguuu

SEQ ID NO: 2677285 - RNA, 13 nt, Human
caauaauauauuu

SEQ ID NO: 2677286 - RNA, 14 nt, Human
caauaauauauuuu

SEQ ID NO: 2677287 - RNA, 16 nt, Human
caauaauauauuuucu

SEQ ID NO: 2677288 - RNA, 17 nt, Human
caauaauauauuuucug

SEQ ID NO: 2677289 - RNA, 14 nt, Human
caaucuuacuuugu

SEQ ID NO: 2677290 - RNA, 15 nt, Human
caaucuuacuuugua

SEQ ID NO: 2677291 - RNA, 12 nt, Human
caaucugugggc

SEQ ID NO: 2677292 - RNA, 20 nt, Human
caauauagaaaaauaaaaau

SEQ ID NO: 2677293 - RNA, 22 nt, Human
caauauagaaaaauaaaaaucu

SEQ ID NO: 2677294 - RNA, 17 nt, Human
caauauucgcuguguca

SEQ ID NO: 2677295 - RNA, 14 nt, Human
caauauauugaacu

SEQ ID NO: 2677296 - RNA, 15 nt, Human
caauauauugaacuu

SEQ ID NO: 2677297 - RNA, 20 nt, Human
caauauauugaacuuuugua

SEQ ID NO: 2677298 - RNA, 15 nt, Human
caaucucuucauuau

SEQ ID NO: 2677299 - RNA, 22 nt, Human
caaucucuucauuauucucugc

SEQ ID NO: 2677300 - RNA, 14 nt, Human
caaucucuuuuugu

SEQ ID NO: 2677301 - RNA, 17 nt, Human
caaucucuuuuuguuug

SEQ ID NO: 2677302 - RNA, 16 nt, Human
caauauugauugggaa

SEQ ID NO: 2677303 - RNA, 17 nt, Human
caauauugauugggaaa

SEQ ID NO: 2677304 - RNA, 20 nt, Human
caauauugauugggaaaaca

SEQ ID NO: 2677305 - RNA, 21 nt, Human
caauauugauugggaaaacau

SEQ ID NO: 2677306 - RNA, 23 nt, Human
caauauugauugggaaaacauuu

SEQ ID NO: 2677307 - RNA, 14 nt, Human
caauguucucucuu

SEQ ID NO: 2677308 - RNA, 20 nt, Human
caaaaauuagccgggcgugg

SEQ ID NO: 2677309 - RNA, 17 nt, Human
caaaaauuagccgggcg

SEQ ID NO: 2677310 - RNA, 15 nt, Human
caaaaauuagccggg

SEQ ID NO: 2677311 - RNA, 23 nt, Human
caaaaauaaacuauaaaacaaaa

SEQ ID NO: 2677312 - RNA, 14 nt, Human
caaaaagcuucccc

SEQ ID NO: 2677313 - RNA, 13 nt, Human
caaaaagcuuccc

SEQ ID NO: 2677314 - RNA, 13 nt, Human
caaaaaggcuuau

SEQ ID NO: 2677315 - RNA, 14 nt, Human
auuuucuaaagacu

SEQ ID NO: 2677316 - RNA, 15 nt, Human
auuuucuaaagacuu

SEQ ID NO: 2677317 - RNA, 14 nt, Human
auuuucuacagugg

SEQ ID NO: 2677318 - RNA, 16 nt, Human
auuuucuacguuucuu

SEQ ID NO: 2677319 - RNA, 17 nt, Human
auuuucuacguuucuuu

SEQ ID NO: 2677320 - RNA, 18 nt, Human
auuuuggagauuauaaua

SEQ ID NO: 2677321 - RNA, 19 nt, Human
auuuuggagauuauaauaa

SEQ ID NO: 2677322 - RNA, 20 nt, Human
auuuuggagauuauaauaaa

SEQ ID NO: 2677323 - RNA, 21 nt, Human
auuuuggagauuauaauaaau

SEQ ID NO: 2677324 - RNA, 10 nt, Human
caaaaacaaa

SEQ ID NO: 2677325 - RNA, 16 nt, Human
caaaaaauuagccggg

SEQ ID NO: 2677326 - RNA, 18 nt, Human
caaaaaauuagccgggcg

SEQ ID NO: 2677327 - RNA, 15 nt, Human
caaaaaauguuuuaa

SEQ ID NO: 2677328 - RNA, 16 nt, Human
caaaaaauguuuuaaa

SEQ ID NO: 2677329 - RNA, 12 nt, Human
caaaaaccaaau

SEQ ID NO: 2677330 - RNA, 15 nt, Human
caaaaaccaaauguu

SEQ ID NO: 2677331 - RNA, 13 nt, Human
caaaaaggcagga

SEQ ID NO: 2677332 - RNA, 15 nt, Human
caaaaagaaaugaug

SEQ ID NO: 2677333 - RNA, 13 nt, Human
caaaaagaaauga

SEQ ID NO: 2677334 - RNA, 18 nt, Human
caaauauucacuggcccc

SEQ ID NO: 2677335 - RNA, 13 nt, Human
caaauuaucuuga

SEQ ID NO: 2677336 - RNA, 19 nt, Human
caaauuaucuugauacauu

SEQ ID NO: 2677337 - RNA, 22 nt, Human
caaauuaucuugauacauucaa

SEQ ID NO: 2677338 - RNA, 13 nt, Human
caaaccggcaggu

SEQ ID NO: 2677339 - RNA, 15 nt, Human
caaaccuaccaaaau

SEQ ID NO: 2677340 - RNA, 17 nt, Human
caaaccuaccaaaaugg

SEQ ID NO: 2677341 - RNA, 17 nt, Human
caaacgccuccccugcc

SEQ ID NO: 2677342 - RNA, 14 nt, Human
caaacgccuccccu

SEQ ID NO: 2677343 - RNA, 13 nt, Human
caaacgcuaaaga

SEQ ID NO: 2677344 - RNA, 21 nt, Human
caaacgcuaaagagcccuugc

SEQ ID NO: 2677345 - RNA, 22 nt, Human
caaacgcuaaagagcccuugcc

SEQ ID NO: 2677346 - RNA, 23 nt, Human
caaacgcuaaagagcccuugccu

SEQ ID NO: 2677347 - RNA, 21 nt, Human
caaaaugugagugguugaaua

SEQ ID NO: 2677348 - RNA, 19 nt, Human
caaaaugugagugguugaa

SEQ ID NO: 2677349 - RNA, 12 nt, Human
caaaaugugagu

SEQ ID NO: 2677350 - RNA, 23 nt, Human
caaaauguaggcuuaguuugugu

SEQ ID NO: 2677351 - RNA, 16 nt, Human
caaaauggaauaaaag

SEQ ID NO: 2677352 - RNA, 17 nt, Human
caaaauggaauaaaagg

SEQ ID NO: 2677353 - RNA, 13 nt, Human
caaaauaaaacau

SEQ ID NO: 2677354 - RNA, 14 nt, Human
caaaauaaaacaua

SEQ ID NO: 2677355 - RNA, 15 nt, Human
caaaauaaaacauag

SEQ ID NO: 2677356 - RNA, 17 nt, Human
caaaauaaaacauagca

SEQ ID NO: 2677357 - RNA, 18 nt, Human
caaaauaaaacauagcaa

SEQ ID NO: 2677358 - RNA, 19 nt, Human
caaaauaaaacauagcaaa

SEQ ID NO: 2677359 - RNA, 12 nt, Human
caaaauaaaaca

SEQ ID NO: 2677360 - RNA, 15 nt, Human
caaaauucauuucua

SEQ ID NO: 2677361 - RNA, 18 nt, Human
caaaauucauuucuaauu

SEQ ID NO: 2677362 - RNA, 19 nt, Human
caaaauucauuucuaauua

SEQ ID NO: 2677363 - RNA, 20 nt, Human
caaaauuaagguguuugaaa

SEQ ID NO: 2677364 - RNA, 19 nt, Human
caaaauuaagguguuugaa

SEQ ID NO: 2677365 - RNA, 16 nt, Human
caaaauuaagguguuu

SEQ ID NO: 2677366 - RNA, 16 nt, Human
caaaauuaagcaaaug

SEQ ID NO: 2677367 - RNA, 22 nt, Human
caaaauuaagcaaauguuaaaa

SEQ ID NO: 2677368 - RNA, 21 nt, Human
caaaggcauuauaaaaagaau

SEQ ID NO: 2677369 - RNA, 17 nt, Human
caaaggaagguggaugg

SEQ ID NO: 2677370 - RNA, 20 nt, Human
caaagcugcccacuguuucu

SEQ ID NO: 2677371 - RNA, 14 nt, Human
caaagcugcccacu

SEQ ID NO: 2677372 - RNA, 15 nt, Human
caaagcugcccacug

SEQ ID NO: 2677373 - RNA, 12 nt, Human
caaagcugagcc

SEQ ID NO: 2677374 - RNA, 13 nt, Human
caaagcugagccu

SEQ ID NO: 2677375 - RNA, 14 nt, Human
caaagcugagccug

SEQ ID NO: 2677376 - RNA, 17 nt, Human
caaagcugagccugcag

SEQ ID NO: 2677377 - RNA, 22 nt, Human
caaagcugagccugcagggaag

SEQ ID NO: 2677378 - RNA, 23 nt, Human
caaagcugagccugcagggaagc

SEQ ID NO: 2677379 - RNA, 24 nt, Human
caaagcugagccugcagggaagcc

SEQ ID NO: 2677380 - RNA, 21 nt, Human
caaacucaaugcuuuauuugu

SEQ ID NO: 2677381 - RNA, 23 nt, Human
caaacucaaugcuuuauuuguaa

SEQ ID NO: 2677382 - RNA, 13 nt, Human
caaacuguugauu

SEQ ID NO: 2677383 - RNA, 21 nt, Human
caaacuggggccuccagaacu

SEQ ID NO: 2677384 - RNA, 19 nt, Human
caaacuggggccuccagaa

SEQ ID NO: 2677385 - RNA, 16 nt, Human
caaacuggggccucca

SEQ ID NO: 2677386 - RNA, 15 nt, Human
caaacuggggccucc

SEQ ID NO: 2677387 - RNA, 18 nt, Human
caaagccuccuccagccg

SEQ ID NO: 2677388 - RNA, 17 nt, Human
caaagccuccuccagcc

SEQ ID NO: 2677389 - RNA, 16 nt, Human
caaagccuucucccua

SEQ ID NO: 2677390 - RNA, 18 nt, Human
cacauagcauguaauggu

SEQ ID NO: 2677391 - RNA, 14 nt, Human
cacaggaggcaggc

SEQ ID NO: 2677392 - RNA, 15 nt, Human
cacaggaggcaggca

SEQ ID NO: 2677393 - RNA, 19 nt, Human
cacaggaggcaggcauggc

SEQ ID NO: 2677394 - RNA, 21 nt, Human
cacaggaggcaggcauggccc

SEQ ID NO: 2677395 - RNA, 22 nt, Human
cacaggaggcaggcauggcccu

SEQ ID NO: 2677396 - RNA, 15 nt, Human
aagcugcagagauuu

SEQ ID NO: 2677397 - RNA, 17 nt, Human
aagcugcagagauuucu

SEQ ID NO: 2677398 - RNA, 23 nt, Human
aagcugcagagauuucucauuga

SEQ ID NO: 2677399 - RNA, 22 nt, Human
aagcugcacccucaggcaggug

SEQ ID NO: 2677400 - RNA, 20 nt, Human
aagcugcacccucaggcagg

SEQ ID NO: 2677401 - RNA, 21 nt, Human
aagcugcacccucaggcaggu

SEQ ID NO: 2677402 - RNA, 13 nt, Human
aagcugggcaggu

SEQ ID NO: 2677403 - RNA, 18 nt, Human
aagcuggcuuacacuggc

SEQ ID NO: 2677404 - RNA, 11 nt, Human
aagcugggcag

SEQ ID NO: 2677405 - RNA, 19 nt, Human
aaggacugacugaggcagu

SEQ ID NO: 2677406 - RNA, 12 nt, Human
aaggacugacug

SEQ ID NO: 2677407 - RNA, 12 nt, Human
aaggauuuuucu

SEQ ID NO: 2677408 - RNA, 17 nt, Human
aaggcaauauuaaccua

SEQ ID NO: 2677409 - RNA, 14 nt, Human
aagaaauguauaaa

SEQ ID NO: 2677410 - RNA, 15 nt, Human
aagaaaugauguugg

SEQ ID NO: 2677411 - RNA, 23 nt, Human
aagaaaugauguuggagaaggga

SEQ ID NO: 2677412 - RNA, 15 nt, Human
aagaacacacacaua

SEQ ID NO: 2677413 - RNA, 19 nt, Human
aagaacacacacauauaca

SEQ ID NO: 2677414 - RNA, 12 nt, Human
aagaacaggccu

SEQ ID NO: 2677415 - RNA, 13 nt, Human
aagaacaggccuc

SEQ ID NO: 2677416 - RNA, 19 nt, Human
aagauugcuuaauaaauug

SEQ ID NO: 2677417 - RNA, 15 nt, Human
aagaaauuuuuuaaa

SEQ ID NO: 2677418 - RNA, 12 nt, Human
aagauuuauguu

SEQ ID NO: 2677419 - RNA, 15 nt, Human
aagccagaggcuggg

SEQ ID NO: 2677420 - RNA, 16 nt, Human
aagccagaggcugggu

SEQ ID NO: 2677421 - RNA, 14 nt, Human
aagccagaggcugg

SEQ ID NO: 2677422 - RNA, 14 nt, Human
aagcagaggaagga

SEQ ID NO: 2677423 - RNA, 16 nt, Human
aagcagacauuuuaaa

SEQ ID NO: 2677424 - RNA, 16 nt, Human
aagcagcuuauuguuu

SEQ ID NO: 2677425 - RNA, 14 nt, Human
aauaaucuuguuuc

SEQ ID NO: 2677426 - RNA, 15 nt, Human
aauaaucuuguuucu

SEQ ID NO: 2677427 - RNA, 11 nt, Human
aauaaucaaga

SEQ ID NO: 2677428 - RNA, 15 nt, Human
aauaaucaagagccu

SEQ ID NO: 2677429 - RNA, 13 nt, Human
aauaaucaagagc

SEQ ID NO: 2677430 - RNA, 21 nt, Human
aauaagugugugguagaaaca

SEQ ID NO: 2677431 - RNA, 22 nt, Human
aauaagugugugguagaaacaa

SEQ ID NO: 2677432 - RNA, 23 nt, Human
aauaagugugugguagaaacaaa

SEQ ID NO: 2677433 - RNA, 18 nt, Human
aauaaguuauugcaguuu

SEQ ID NO: 2677434 - RNA, 13 nt, Human
aauaaguuauugc

SEQ ID NO: 2677435 - RNA, 14 nt, Human
aauaaguuauugca

SEQ ID NO: 2677436 - RNA, 19 nt, Human
aauaaugcuacaauuuuaa

SEQ ID NO: 2677437 - RNA, 21 nt, Human
aauaaugcuacaauuuuaaga

SEQ ID NO: 2677438 - RNA, 22 nt, Human
aagugguccuagaggcccuuug

SEQ ID NO: 2677439 - RNA, 19 nt, Human
aaguggucuuaagaaaugu

SEQ ID NO: 2677440 - RNA, 22 nt, Human
aaguguaaaauauuuugaauca

SEQ ID NO: 2677441 - RNA, 11 nt, Human
aauaaguuauu

SEQ ID NO: 2677442 - RNA, 17 nt, Human
aagucucuagguucuga

SEQ ID NO: 2677443 - RNA, 19 nt, Human
aagucuuaaggacaaagug

SEQ ID NO: 2677444 - RNA, 22 nt, Human
aagucuuaaggacaaagugcca

SEQ ID NO: 2677445 - RNA, 16 nt, Human
aagucuuacuacagaa

SEQ ID NO: 2677446 - RNA, 18 nt, Human
aaguaugugguuuuguaa

SEQ ID NO: 2677447 - RNA, 20 nt, Human
aaguccaguguuucuuuuuu

SEQ ID NO: 2677448 - RNA, 21 nt, Human
aaguauguauuauuuacauuu

SEQ ID NO: 2677449 - RNA, 14 nt, Human
aaguauguauuauu

SEQ ID NO: 2677450 - RNA, 19 nt, Human
aaguauguauauuaaaaaa

SEQ ID NO: 2677451 - RNA, 20 nt, Human
aaguauguauauuaaaaaag

SEQ ID NO: 2677452 - RNA, 21 nt, Human
aaguauguauauuaaaaaaga

SEQ ID NO: 2677453 - RNA, 22 nt, Human
aaguauguauauuaaaaaagag

SEQ ID NO: 2677454 - RNA, 16 nt, Human
aaguagaacuuuguau

SEQ ID NO: 2677455 - RNA, 22 nt, Human
aaguauagccuauggcagaaaa

SEQ ID NO: 2677456 - RNA, 15 nt, Human
aaguagaacuuugua

SEQ ID NO: 2677457 - RNA, 19 nt, Human
aagguggauggccccagca

SEQ ID NO: 2677458 - RNA, 14 nt, Human
aagguggauuuugu

SEQ ID NO: 2677459 - RNA, 22 nt, Human
aagguggauuuuguuuaaaaaa

SEQ ID NO: 2677460 - RNA, 15 nt, Human
aagguguuugaaaau

SEQ ID NO: 2677461 - RNA, 21 nt, Human
aagguguuugaaaauaguuua

SEQ ID NO: 2677462 - RNA, 20 nt, Human
aagguguuugaaaauaguuu

SEQ ID NO: 2677463 - RNA, 11 nt, Human
aaggugggagg

SEQ ID NO: 2677464 - RNA, 21 nt, Human
aaugaugauccuaggcauuug

SEQ ID NO: 2677465 - RNA, 18 nt, Human
aaugaagaauuuaaagaa

SEQ ID NO: 2677466 - RNA, 17 nt, Human
aaugaagaauuuaaaga

SEQ ID NO: 2677467 - RNA, 17 nt, Human
aaugaaccauaaauuca

SEQ ID NO: 2677468 - RNA, 18 nt, Human
aaugaaccauaaauucaa

SEQ ID NO: 2677469 - RNA, 16 nt, Human
aaugaagaauuuaaag

SEQ ID NO: 2677470 - RNA, 15 nt, Human
aaugaagaauuuaaa

SEQ ID NO: 2677471 - RNA, 14 nt, Human
aaugaagaauuuaa

SEQ ID NO: 2677472 - RNA, 13 nt, Human
aaugaagaauuua

SEQ ID NO: 2677473 - RNA, 17 nt, Human
aauccagugaccucucu

SEQ ID NO: 2677474 - RNA, 13 nt, Human
aauccaguuauaa

SEQ ID NO: 2677475 - RNA, 16 nt, Human
aauccaguuauaagaa

SEQ ID NO: 2677476 - RNA, 19 nt, Human
aauccaguuauaagaagaa

SEQ ID NO: 2677477 - RNA, 19 nt, Human
aaugaugacaaaaaauguu

SEQ ID NO: 2677478 - RNA, 21 nt, Human
aaugaugauguggaagaacuu

SEQ ID NO: 2677479 - RNA, 15 nt, Human
aaucaauucuaguca

SEQ ID NO: 2677480 - RNA, 16 nt, Human
aauauguaguaucuau

SEQ ID NO: 2677481 - RNA, 23 nt, Human
aauauaaggaaagcaauaaauga

SEQ ID NO: 2677482 - RNA, 21 nt, Human
aauauaaggaaagcaauaaau

SEQ ID NO: 2677483 - RNA, 19 nt, Human
aauauaaggaaagcaauaa

SEQ ID NO: 2677484 - RNA, 18 nt, Human
aauauaaggaaagcaaua

SEQ ID NO: 2677485 - RNA, 17 nt, Human
aauguuuuauacuguuu

SEQ ID NO: 2677486 - RNA, 16 nt, Human
aauguuuucaaaaggu

SEQ ID NO: 2677487 - RNA, 20 nt, Human
aauguuuggcauguaaaugu

SEQ ID NO: 2677488 - RNA, 21 nt, Human
aauguuuggcauguaaaugua

SEQ ID NO: 2677489 - RNA, 12 nt, Human
aauguuuuguaa

SEQ ID NO: 2677490 - RNA, 13 nt, Human
aauguuuuguaaa

SEQ ID NO: 2677491 - RNA, 16 nt, Human
aauguuuuguaaacau

SEQ ID NO: 2677492 - RNA, 18 nt, Human
aauguuuuguaaacauuu

SEQ ID NO: 2677493 - RNA, 19 nt, Human
aauguuuuguaaacauuua

SEQ ID NO: 2677494 - RNA, 20 nt, Human
aauguuuuguaaacauuuau

SEQ ID NO: 2677495 - RNA, 14 nt, Human
aauuaaauuaggaa

SEQ ID NO: 2677496 - RNA, 16 nt, Human
aauuaaaagucuuuuu

SEQ ID NO: 2677497 - RNA, 14 nt, Human
aauggcuuguucau

SEQ ID NO: 2677498 - RNA, 17 nt, Human
aauggcuguaaucauuu

SEQ ID NO: 2677499 - RNA, 13 nt, Human
aaugguaguuucu

SEQ ID NO: 2677500 - RNA, 12 nt, Human
aaugguaguuuc

SEQ ID NO: 2677501 - RNA, 20 nt, Human
aaugguaguuucugugguug

SEQ ID NO: 2677502 - RNA, 18 nt, Human
aaugguaguuucuguggu

SEQ ID NO: 2677503 - RNA, 17 nt, Human
aaugguaguuucugugg

SEQ ID NO: 2677504 - RNA, 14 nt, Human
aaugguaguuucug

SEQ ID NO: 2677505 - RNA, 16 nt, Human
aauggguuuuucccug

SEQ ID NO: 2677506 - RNA, 14 nt, Human
aaugguaauaagca

SEQ ID NO: 2677507 - RNA, 15 nt, Human
aaugggcucuccggg

SEQ ID NO: 2677508 - RNA, 19 nt, Human
aaugggcucuccggggcca

SEQ ID NO: 2677509 - RNA, 22 nt, Human
aaugucuaguuguaacaccaug

SEQ ID NO: 2677510 - RNA, 14 nt, Human
aaugucuguaaaua

SEQ ID NO: 2677511 - RNA, 16 nt, Human
aaugucuguaauaaua

SEQ ID NO: 2677512 - RNA, 17 nt, Human
aaugucuguaauaauag

SEQ ID NO: 2677513 - RNA, 18 nt, Human
aaugucuguaauaauaga

SEQ ID NO: 2677514 - RNA, 19 nt, Human
aaugucuguaauaauagac

SEQ ID NO: 2677515 - RNA, 23 nt, Human
aaugucuguaauaauagacugua

SEQ ID NO: 2677516 - RNA, 20 nt, Human
aaugucucaaggcaguuaau

SEQ ID NO: 2677517 - RNA, 13 nt, Human
aaugucuccuccc

SEQ ID NO: 2677518 - RNA, 20 nt, Human
aaauggaaaguaacucauuu

SEQ ID NO: 2677519 - RNA, 12 nt, Human
aaauggaaauuu

SEQ ID NO: 2677520 - RNA, 14 nt, Human
aaauggaaauuuug

SEQ ID NO: 2677521 - RNA, 13 nt, Human
aaauggaaacuau

SEQ ID NO: 2677522 - RNA, 21 nt, Human
aaauggaaagcagaguuuuca

SEQ ID NO: 2677523 - RNA, 15 nt, Human
aaauauuuugaauca

SEQ ID NO: 2677524 - RNA, 21 nt, Human
aaauauuuugaaucaauaaua

SEQ ID NO: 2677525 - RNA, 11 nt, Human
aaauauuuucu

SEQ ID NO: 2677526 - RNA, 12 nt, Human
aaauauuuucua

SEQ ID NO: 2677527 - RNA, 13 nt, Human
aaauauuuucuau

SEQ ID NO: 2677528 - RNA, 14 nt, Human
aaauauuuucuauu

SEQ ID NO: 2677529 - RNA, 15 nt, Human
aaauauuuucuauuu

SEQ ID NO: 2677530 - RNA, 17 nt, Human
aaauauuuucuauuuua

SEQ ID NO: 2677531 - RNA, 19 nt, Human
aaauauuuucuauuuuaag

SEQ ID NO: 2677532 - RNA, 12 nt, Human
aaauauuuucuc

SEQ ID NO: 2677533 - RNA, 15 nt, Human
aaauauuuucucugu

SEQ ID NO: 2677534 - RNA, 21 nt, Human
aaauauuuucucuguacuuuu

SEQ ID NO: 2677535 - RNA, 13 nt, Human
aaaucuucccaug

SEQ ID NO: 2677536 - RNA, 21 nt, Human
aaauggccucauguggcugga

SEQ ID NO: 2677537 - RNA, 22 nt, Human
aaauggccucauguggcuggaa

SEQ ID NO: 2677538 - RNA, 23 nt, Human
aaauggacuggagcucaucugca

SEQ ID NO: 2677539 - RNA, 11 nt, Human
aaauggccuca

SEQ ID NO: 2677540 - RNA, 15 nt, Human
aaauggccucaugug

SEQ ID NO: 2677541 - RNA, 19 nt, Human
aaauggcuguaaucauuug

SEQ ID NO: 2677542 - RNA, 21 nt, Human
aaauggcuguaaucauuuguu

SEQ ID NO: 2677543 - RNA, 14 nt, Human
aaauauaacacauu

SEQ ID NO: 2677544 - RNA, 16 nt, Human
aaauauaacacauuuu

SEQ ID NO: 2677545 - RNA, 17 nt, Human
aaauauaacacauuuuu

SEQ ID NO: 2677546 - RNA, 22 nt, Human
aaauauaaacaaagauucauga

SEQ ID NO: 2677547 - RNA, 23 nt, Human
aaauauaaacaaagauucaugau

SEQ ID NO: 2677548 - RNA, 13 nt, Human
aaauauaaaauua

SEQ ID NO: 2677549 - RNA, 18 nt, Human
aaauauaaaauuaugaga

SEQ ID NO: 2677550 - RNA, 13 nt, Human
aaauauaaacaaa

SEQ ID NO: 2677551 - RNA, 16 nt, Human
aaauaguaugaaaaug

SEQ ID NO: 2677552 - RNA, 19 nt, Human
aaauaguaugaaaauggaa

SEQ ID NO: 2677553 - RNA, 23 nt, Human
aaauagucucuuuaaaaggaaag

SEQ ID NO: 2677554 - RNA, 16 nt, Human
aaauagaagagagagg

SEQ ID NO: 2677555 - RNA, 12 nt, Human
aaauagaaauuu

SEQ ID NO: 2677556 - RNA, 14 nt, Human
aaauagaaauuuug

SEQ ID NO: 2677557 - RNA, 19 nt, Human
aaauagaaauuuuguaaga

SEQ ID NO: 2677558 - RNA, 16 nt, Human
aaauagaaccacuaug

SEQ ID NO: 2677559 - RNA, 12 nt, Human
aaauagaaacau

SEQ ID NO: 2677560 - RNA, 22 nt, Human
aaauaaagagagaacaggacua

SEQ ID NO: 2677561 - RNA, 15 nt, Human
aaauaaagagccaua

SEQ ID NO: 2677562 - RNA, 14 nt, Human
aaauaaagagagaa

SEQ ID NO: 2677563 - RNA, 15 nt, Human
aaauaaaauuuguug

SEQ ID NO: 2677564 - RNA, 16 nt, Human
aaauaaaauuuguugc

SEQ ID NO: 2677565 - RNA, 17 nt, Human
aaauaaaauuuguugca

SEQ ID NO: 2677566 - RNA, 11 nt, Human
aaauaaagaag

SEQ ID NO: 2677567 - RNA, 13 nt, Human
aaauaaagaagua

SEQ ID NO: 2677568 - RNA, 14 nt, Human
aaauaaagaaguau

SEQ ID NO: 2677569 - RNA, 14 nt, Human
aaauaaaauauauc

SEQ ID NO: 2677570 - RNA, 14 nt, Human
aaauaaaaugaaaa

SEQ ID NO: 2677571 - RNA, 15 nt, Human
aaauaaaaugaaaau

SEQ ID NO: 2677572 - RNA, 19 nt, Human
aaauaaaaugaaaauugua

SEQ ID NO: 2677573 - RNA, 21 nt, Human
aaauaaaaugaaaauuguauu

SEQ ID NO: 2677574 - RNA, 23 nt, Human
aaauaaaaugaaaauuguauuau

SEQ ID NO: 2677575 - RNA, 18 nt, Human
aaagucuuuuuuuuccug

SEQ ID NO: 2677576 - RNA, 13 nt, Human
aaagugaagcaaa

SEQ ID NO: 2677577 - RNA, 23 nt, Human
aaagugaagcaaaucagaaacuu

SEQ ID NO: 2677578 - RNA, 23 nt, Human
aaagucugcucucauauaagaca

SEQ ID NO: 2677579 - RNA, 16 nt, Human
aaagucugucuuuccu

SEQ ID NO: 2677580 - RNA, 18 nt, Human
aaagucugucuuuccuga

SEQ ID NO: 2677581 - RNA, 14 nt, Human
aaagggaauuauga

SEQ ID NO: 2677582 - RNA, 14 nt, Human
aaagggaagaaacu

SEQ ID NO: 2677583 - RNA, 17 nt, Human
aaaggcuugaagcugug

SEQ ID NO: 2677584 - RNA, 16 nt, Human
aaaggcuugaagcugu

SEQ ID NO: 2677585 - RNA, 17 nt, Human
aaaggcuuauaaaacag

SEQ ID NO: 2677586 - RNA, 14 nt, Human
aaaggcuuauaaaa

SEQ ID NO: 2677587 - RNA, 16 nt, Human
aaaacacauguuuuua

SEQ ID NO: 2677588 - RNA, 18 nt, Human
aaaauucauaguaagauu

SEQ ID NO: 2677589 - RNA, 19 nt, Human
aaaauucauaguaagauug

SEQ ID NO: 2677590 - RNA, 20 nt, Human
aaaauucauaguaagauuga

SEQ ID NO: 2677591 - RNA, 13 nt, Human
aaaauucauuucu

SEQ ID NO: 2677592 - RNA, 14 nt, Human
aaaauucauuucua

SEQ ID NO: 2677593 - RNA, 15 nt, Human
aaaauucauuucuaa

SEQ ID NO: 2677594 - RNA, 16 nt, Human
aaaauuggcaaaacua

SEQ ID NO: 2677595 - RNA, 13 nt, Human
aaacacugccuuu

SEQ ID NO: 2677596 - RNA, 17 nt, Human
aaacacugccuuuuuau

SEQ ID NO: 2677597 - RNA, 18 nt, Human
aaacacugccuuuuuauu

SEQ ID NO: 2677598 - RNA, 18 nt, Human
aaacagaguaaucuuguu

SEQ ID NO: 2677599 - RNA, 17 nt, Human
aaacagaguaaucuugu

SEQ ID NO: 2677600 - RNA, 15 nt, Human
aaagaugaaaggcag

SEQ ID NO: 2677601 - RNA, 22 nt, Human
aaacugaagcagccucucccca

SEQ ID NO: 2677602 - RNA, 17 nt, Human
aaagauagacagguccu

SEQ ID NO: 2677603 - RNA, 12 nt, Human
aaagaaaguggu

SEQ ID NO: 2677604 - RNA, 23 nt, Human
aaagaaaguggucuuaagaaaug

SEQ ID NO: 2677605 - RNA, 13 nt, Human
aaagaaauaaacc

SEQ ID NO: 2677606 - RNA, 12 nt, Human
aaagaaauacag

SEQ ID NO: 2677607 - RNA, 11 nt, Human
aaagagguuuu

SEQ ID NO: 2677608 - RNA, 20 nt, Human
aacuuuuguguaaugaaaau

SEQ ID NO: 2677609 - RNA, 11 nt, Human
aacuuuuguac

SEQ ID NO: 2677610 - RNA, 14 nt, Human
aacuuuuguacuga

SEQ ID NO: 2677611 - RNA, 17 nt, Human
aacuuuuguacugaauu

SEQ ID NO: 2677612 - RNA, 18 nt, Human
aacuuuuguacugaauuu

SEQ ID NO: 2677613 - RNA, 19 nt, Human
aacuuuuguacugaauuuu

SEQ ID NO: 2677614 - RNA, 20 nt, Human
aacuuuuguacugaauuuuu

SEQ ID NO: 2677615 - RNA, 14 nt, Human
aacuuuuguaaaua

SEQ ID NO: 2677616 - RNA, 14 nt, Human
aacuuuuaucuauu

SEQ ID NO: 2677617 - RNA, 12 nt, Human
aacuuuucuaga

SEQ ID NO: 2677618 - RNA, 19 nt, Human
aagaaauccggagaagcug

SEQ ID NO: 2677619 - RNA, 12 nt, Human
aagaaaugaugu

SEQ ID NO: 2677620 - RNA, 13 nt, Human
aagaaaugauguu

SEQ ID NO: 2677621 - RNA, 22 nt, Human
aacuuuguauaguuauguaaau

SEQ ID NO: 2677622 - RNA, 21 nt, Human
aacuuuguauaguuauguaaa

SEQ ID NO: 2677623 - RNA, 20 nt, Human
aacuuuguauaguuauguaa

SEQ ID NO: 2677624 - RNA, 12 nt, Human
aacuuugggaaa

SEQ ID NO: 2677625 - RNA, 16 nt, Human
aacuuugggaaaacau

SEQ ID NO: 2677626 - RNA, 22 nt, Human
aacuuugggaaaacauguuaau

SEQ ID NO: 2677627 - RNA, 14 nt, Human
aacuuuguaaaaau

SEQ ID NO: 2677628 - RNA, 18 nt, Human
aacuuuguaaaaaucuuu

SEQ ID NO: 2677629 - RNA, 21 nt, Human
aacuuuguaaaaaucuuuuga

SEQ ID NO: 2677630 - RNA, 15 nt, Human
aacuuuguauaguua

SEQ ID NO: 2677631 - RNA, 14 nt, Human
aacuuuguauaguu

SEQ ID NO: 2677632 - RNA, 13 nt, Human
aacuuuguauagu

SEQ ID NO: 2677633 - RNA, 22 nt, Human
aacuguuugaaaacuucagaag

SEQ ID NO: 2677634 - RNA, 14 nt, Human
aacuuaaauaauaa

SEQ ID NO: 2677635 - RNA, 13 nt, Human
aacuuaaauaaua

SEQ ID NO: 2677636 - RNA, 13 nt, Human
aacucaaugcuuu

SEQ ID NO: 2677637 - RNA, 16 nt, Human
aacucaaugcuuuauu

SEQ ID NO: 2677638 - RNA, 19 nt, Human
aacucaaugcuuuauuugu

SEQ ID NO: 2677639 - RNA, 20 nt, Human
aacucaaugcuuuauuugua

SEQ ID NO: 2677640 - RNA, 21 nt, Human
aacucaaugcuuuauuuguaa

SEQ ID NO: 2677641 - RNA, 20 nt, Human
aacucaccagccccacugcc

SEQ ID NO: 2677642 - RNA, 18 nt, Human
aacugaagcagccucucc

SEQ ID NO: 2677643 - RNA, 14 nt, Human
aacucaggcaaaga

SEQ ID NO: 2677644 - RNA, 15 nt, Human
aacucaggcaaagaa

SEQ ID NO: 2677645 - RNA, 17 nt, Human
aacucaggcaaagaaaa

SEQ ID NO: 2677646 - RNA, 18 nt, Human
aacucaggcaaagaaaau

SEQ ID NO: 2677647 - RNA, 19 nt, Human
aacuuauuuuaaauaugcc

SEQ ID NO: 2677648 - RNA, 20 nt, Human
aacacauuuuuuugcaugca

SEQ ID NO: 2677649 - RNA, 22 nt, Human
aacaagaaauaauagaaauguc

SEQ ID NO: 2677650 - RNA, 16 nt, Human
aacaaaaagcuucccc

SEQ ID NO: 2677651 - RNA, 14 nt, Human
aacaaaaagcuucc

SEQ ID NO: 2677652 - RNA, 19 nt, Human
aaauuggggaggagggggc

SEQ ID NO: 2677653 - RNA, 14 nt, Human
aacaaaaugaagcu

SEQ ID NO: 2677654 - RNA, 12 nt, Human
aaauugcauacu

SEQ ID NO: 2677655 - RNA, 14 nt, Human
aaauugcauacuuu

SEQ ID NO: 2677656 - RNA, 15 nt, Human
aaauugcauacuuug

SEQ ID NO: 2677657 - RNA, 17 nt, Human
aaauugcauacuuugua

SEQ ID NO: 2677658 - RNA, 23 nt, Human
aaauugcauacuuuguauuuuga

SEQ ID NO: 2677659 - RNA, 18 nt, Human
aaauugcuuuguauugua

SEQ ID NO: 2677660 - RNA, 19 nt, Human
aacaccuucuauagcauca

SEQ ID NO: 2677661 - RNA, 15 nt, Human
aacccugccgucacc

SEQ ID NO: 2677662 - RNA, 18 nt, Human
aacccugccgucaccacc

SEQ ID NO: 2677663 - RNA, 19 nt, Human
aacccugccgucaccacca

SEQ ID NO: 2677664 - RNA, 20 nt, Human
aacccugccgucaccaccac

SEQ ID NO: 2677665 - RNA, 21 nt, Human
aacccugccgucaccaccacc

SEQ ID NO: 2677666 - RNA, 22 nt, Human
aacccugccgucaccaccaccc

SEQ ID NO: 2677667 - RNA, 23 nt, Human
aacaugguuugacucaucuuaua

SEQ ID NO: 2677668 - RNA, 12 nt, Human
aaccacuagaaa

SEQ ID NO: 2677669 - RNA, 13 nt, Human
aacaugcccccug

SEQ ID NO: 2677670 - RNA, 14 nt, Human
aacaugcccccugc

SEQ ID NO: 2677671 - RNA, 22 nt, Human
aacaugcccccugcagacacgu

SEQ ID NO: 2677672 - RNA, 23 nt, Human
aacaugaguagauaauuucaggg

SEQ ID NO: 2677673 - RNA, 13 nt, Human
aacaucauuccuu

SEQ ID NO: 2677674 - RNA, 11 nt, Human
aacagcugcaa

SEQ ID NO: 2677675 - RNA, 19 nt, Human
aacagcugcaauucccugg

SEQ ID NO: 2677676 - RNA, 21 nt, Human
aacagcugcaauucccuggau

SEQ ID NO: 2677677 - RNA, 22 nt, Human
acaauguuguagugucccccac

SEQ ID NO: 2677678 - RNA, 20 nt, Human
acaauuugcacuaaaucaga

SEQ ID NO: 2677679 - RNA, 12 nt, Human
acaauuuuaaga

SEQ ID NO: 2677680 - RNA, 12 nt, Human
acacagaaacac

SEQ ID NO: 2677681 - RNA, 13 nt, Human
acacagaaacacu

SEQ ID NO: 2677682 - RNA, 14 nt, Human
acacagaaacacug

SEQ ID NO: 2677683 - RNA, 16 nt, Human
acacagaaacacugcc

SEQ ID NO: 2677684 - RNA, 17 nt, Human
acacagaaacacugccu

SEQ ID NO: 2677685 - RNA, 21 nt, Human
acacagaaacacugccuuuuu

SEQ ID NO: 2677686 - RNA, 18 nt, Human
acacaaacgggcucagca

SEQ ID NO: 2677687 - RNA, 15 nt, Human
acaauuuuguacaaa

SEQ ID NO: 2677688 - RNA, 12 nt, Human
acaauuuuguac

SEQ ID NO: 2677689 - RNA, 19 nt, Human
acacagccugggccccagc

SEQ ID NO: 2677690 - RNA, 18 nt, Human
acacagccugggccccag

SEQ ID NO: 2677691 - RNA, 20 nt, Human
acacagccugggccccagcu

SEQ ID NO: 2677692 - RNA, 14 nt, Human
acacagacuauuuu

SEQ ID NO: 2677693 - RNA, 16 nt, Human
acacagaaugcaacca

SEQ ID NO: 2677694 - RNA, 21 nt, Human
acacagacacuaacgaaauau

SEQ ID NO: 2677695 - RNA, 23 nt, Human
acaccaaucuuacuuuguaaauu

SEQ ID NO: 2677696 - RNA, 22 nt, Human
acaccaaucuuacuuuguaaau

SEQ ID NO: 2677697 - RNA, 20 nt, Human
acaccaaucuuacuuuguaa

SEQ ID NO: 2677698 - RNA, 15 nt, Human
acacggacacucaaa

SEQ ID NO: 2677699 - RNA, 22 nt, Human
acacggagcccagcccucccca

SEQ ID NO: 2677700 - RNA, 18 nt, Human
acacggagcccagcccuc

SEQ ID NO: 2677701 - RNA, 19 nt, Human
aauuuuaucuguuuccuga

SEQ ID NO: 2677702 - RNA, 17 nt, Human
acaaagacaaaagucug

SEQ ID NO: 2677703 - RNA, 18 nt, Human
acaaagacaaaagucugu

SEQ ID NO: 2677704 - RNA, 21 nt, Human
acaaaccuaccaaaauggaau

SEQ ID NO: 2677705 - RNA, 15 nt, Human
acaaacgggcucagc

SEQ ID NO: 2677706 - RNA, 22 nt, Human
aauuuugaaaaguaauauuuau

SEQ ID NO: 2677707 - RNA, 13 nt, Human
aauuuugaaaagu

SEQ ID NO: 2677708 - RNA, 21 nt, Human
aauuuugaaaaguaauauuua

SEQ ID NO: 2677709 - RNA, 20 nt, Human
aauuuugaaaaguaauauuu

SEQ ID NO: 2677710 - RNA, 23 nt, Human
aauuuugauaaaaauuuagaaca

SEQ ID NO: 2677711 - RNA, 18 nt, Human
acaaaccuaccaaaaugg

SEQ ID NO: 2677712 - RNA, 16 nt, Human
acaaguaguucuguau

SEQ ID NO: 2677713 - RNA, 23 nt, Human
acaaguaguucuguauuugaaag

SEQ ID NO: 2677714 - RNA, 22 nt, Human
acaaguaguucuguauuugaaa

SEQ ID NO: 2677715 - RNA, 21 nt, Human
acaaguaguucuguauuugaa

SEQ ID NO: 2677716 - RNA, 20 nt, Human
acaaguaguucuguauuuga

SEQ ID NO: 2677717 - RNA, 19 nt, Human
acaaguaguucuguauuug

SEQ ID NO: 2677718 - RNA, 18 nt, Human
acaaguaguucuguauuu

SEQ ID NO: 2677719 - RNA, 17 nt, Human
acaaguaguucuguauu

SEQ ID NO: 2677720 - RNA, 22 nt, Human
acaagucagcuccagcuuucug

SEQ ID NO: 2677721 - RNA, 13 nt, Human
acagccagcaccu

SEQ ID NO: 2677722 - RNA, 16 nt, Human
acagccagcaccuggc

SEQ ID NO: 2677723 - RNA, 16 nt, Human
acagccacuccccggc

SEQ ID NO: 2677724 - RNA, 16 nt, Human
acagccaaaggcuggc

SEQ ID NO: 2677725 - RNA, 13 nt, Human
acagcaucagggu

SEQ ID NO: 2677726 - RNA, 15 nt, Human
acagagucaaggccu

SEQ ID NO: 2677727 - RNA, 18 nt, Human
acagagucaaggccugcu

SEQ ID NO: 2677728 - RNA, 19 nt, Human
acagaguagccagguucug

SEQ ID NO: 2677729 - RNA, 15 nt, Human
acagaguaaucuugu

SEQ ID NO: 2677730 - RNA, 19 nt, Human
acagagguauuaaaacuaa

SEQ ID NO: 2677731 - RNA, 22 nt, Human
acagagguauuaaaacuaaauu

SEQ ID NO: 2677732 - RNA, 15 nt, Human
acagaauauuuuuau

SEQ ID NO: 2677733 - RNA, 16 nt, Human
acagaauauuuuuaua

SEQ ID NO: 2677734 - RNA, 22 nt, Human
acagaauauuuuuauauuuccu

SEQ ID NO: 2677735 - RNA, 23 nt, Human
acagaauauuuuuauauuuccuu

SEQ ID NO: 2677736 - RNA, 22 nt, Human
acacugccuuuuuauuuauaug

SEQ ID NO: 2677737 - RNA, 21 nt, Human
acacugcugcuccagugcagg

SEQ ID NO: 2677738 - RNA, 15 nt, Human
acacugccugccuua

SEQ ID NO: 2677739 - RNA, 20 nt, Human
acacugccugccuuaaguga

SEQ ID NO: 2677740 - RNA, 16 nt, Human
acacugccugccuuaa

SEQ ID NO: 2677741 - RNA, 12 nt, Human
acacugccuggg

SEQ ID NO: 2677742 - RNA, 13 nt, Human
acacugccugggc

SEQ ID NO: 2677743 - RNA, 14 nt, Human
acacugccugggcu

SEQ ID NO: 2677744 - RNA, 15 nt, Human
acacugccugggcug

SEQ ID NO: 2677745 - RNA, 16 nt, Human
acacugccugggcuga

SEQ ID NO: 2677746 - RNA, 19 nt, Human
acacugccuuuuuauuuau

SEQ ID NO: 2677747 - RNA, 20 nt, Human
acacugccuuuuuauuuaua

SEQ ID NO: 2677748 - RNA, 23 nt, Human
acacugccuuuuuauuuauaugu

SEQ ID NO: 2677749 - RNA, 23 nt, Human
acagaaauuguauauuguaauuu

SEQ ID NO: 2677750 - RNA, 14 nt, Human
acagaaauuguaua

SEQ ID NO: 2677751 - RNA, 15 nt, Human
acagaaauuguauau

SEQ ID NO: 2677752 - RNA, 16 nt, Human
acagaaauuguauauu

SEQ ID NO: 2677753 - RNA, 19 nt, Human
acagaaauuguauauugua

SEQ ID NO: 2677754 - RNA, 13 nt, Human
acagguccugauu

SEQ ID NO: 2677755 - RNA, 14 nt, Human
acauaaaagaaaua

SEQ ID NO: 2677756 - RNA, 15 nt, Human
acauaaaagaaauaa

SEQ ID NO: 2677757 - RNA, 17 nt, Human
acauaaaagaaauaaac

SEQ ID NO: 2677758 - RNA, 16 nt, Human
acauguuaaugacaau

SEQ ID NO: 2677759 - RNA, 20 nt, Human
acauguuaaugacaauauuc

SEQ ID NO: 2677760 - RNA, 21 nt, Human
acauccagagcuuugucguau

SEQ ID NO: 2677761 - RNA, 21 nt, Human
acauguuuaauaaauaaaaau

SEQ ID NO: 2677762 - RNA, 20 nt, Human
acauguugggaaacuuggcu

SEQ ID NO: 2677763 - RNA, 13 nt, Human
acaugcaauaaaa

SEQ ID NO: 2677764 - RNA, 14 nt, Human
acaugcaauaaaau

SEQ ID NO: 2677765 - RNA, 15 nt, Human
acaugcaauaaaauu

SEQ ID NO: 2677766 - RNA, 16 nt, Human
acaugcaauaaaauuu

SEQ ID NO: 2677767 - RNA, 18 nt, Human
acaugcaauaaaauuuaa

SEQ ID NO: 2677768 - RNA, 19 nt, Human
acaugcaauaaaauuuaaa

SEQ ID NO: 2677769 - RNA, 13 nt, Human
acauguuuauaaa

SEQ ID NO: 2677770 - RNA, 21 nt, Human
acauuaaaggcauaaaugacu

SEQ ID NO: 2677771 - RNA, 15 nt, Human
acauuugcugccauu

SEQ ID NO: 2677772 - RNA, 23 nt, Human
accaacugucacucauugcugag

SEQ ID NO: 2677773 - RNA, 20 nt, Human
acauuugggaguuuuuauga

SEQ ID NO: 2677774 - RNA, 21 nt, Human
acauuugggaguuuuuaugag

SEQ ID NO: 2677775 - RNA, 16 nt, Human
accagcaucaccugcc

SEQ ID NO: 2677776 - RNA, 17 nt, Human
accagcaucaccugccu

SEQ ID NO: 2677777 - RNA, 17 nt, Human
accagcagccuggaccc

SEQ ID NO: 2677778 - RNA, 14 nt, Human
accagcagccugga

SEQ ID NO: 2677779 - RNA, 13 nt, Human
accagcagccugg

SEQ ID NO: 2677780 - RNA, 22 nt, Human
accacgccucuugaccaggcug

SEQ ID NO: 2677781 - RNA, 18 nt, Human
accacgccucuugaccag

SEQ ID NO: 2677782 - RNA, 23 nt, Human
accacgcccguccugccuguggc

SEQ ID NO: 2677783 - RNA, 20 nt, Human
accacgcccguccugccugu

SEQ ID NO: 2677784 - RNA, 21 nt, Human
accacgcccguccugccugug

SEQ ID NO: 2677785 - RNA, 18 nt, Human
accacgcccguccugccu

SEQ ID NO: 2677786 - RNA, 19 nt, Human
accacgcccguccugccug

SEQ ID NO: 2677787 - RNA, 18 nt, Human
accagcaucaccugccug

SEQ ID NO: 2677788 - RNA, 19 nt, Human
accagcaucaccugccugu

SEQ ID NO: 2677789 - RNA, 19 nt, Human
accccgguggcggccccag

SEQ ID NO: 2677790 - RNA, 21 nt, Human
accccgguggcggccccagca

SEQ ID NO: 2677791 - RNA, 15 nt, Human
accccggggacccug

SEQ ID NO: 2677792 - RNA, 16 nt, Human
accccggggacccugu

SEQ ID NO: 2677793 - RNA, 17 nt, Human
accccggggacccugug

SEQ ID NO: 2677794 - RNA, 18 nt, Human
accccggggacccuguga

SEQ ID NO: 2677795 - RNA, 19 nt, Human
accccaaacagugacugua

SEQ ID NO: 2677796 - RNA, 22 nt, Human
accccggccggccacccaggag

SEQ ID NO: 2677797 - RNA, 15 nt, Human
accccgcagacaccu

SEQ ID NO: 2677798 - RNA, 17 nt, Human
accccgcagacaccuug

SEQ ID NO: 2677799 - RNA, 18 nt, Human
accccgcagacaccuugg

SEQ ID NO: 2677800 - RNA, 20 nt, Human
accccgcagacaccuuggac

SEQ ID NO: 2677801 - RNA, 15 nt, Human
acccaagcuuagaac

SEQ ID NO: 2677802 - RNA, 20 nt, Human
accccucaacaccucugcac

SEQ ID NO: 2677803 - RNA, 16 nt, Human
accccgucucuacuaa

SEQ ID NO: 2677804 - RNA, 13 nt, Human
agaaauaaaccaa

SEQ ID NO: 2677805 - RNA, 14 nt, Human
agaaauaaaccaaa

SEQ ID NO: 2677806 - RNA, 23 nt, Human
agaaauaaaccaaaggaaaaugu

SEQ ID NO: 2677807 - RNA, 18 nt, Human
agaaauaaaguuugcuua

SEQ ID NO: 2677808 - RNA, 13 nt, Human
agaaacaaacauc

SEQ ID NO: 2677809 - RNA, 13 nt, Human
agaaaauugaguu

SEQ ID NO: 2677810 - RNA, 22 nt, Human
agaaaauugaguugcacuuauu

SEQ ID NO: 2677811 - RNA, 11 nt, Human
agaaaauguga

SEQ ID NO: 2677812 - RNA, 19 nt, Human
agaaaaugugacccuccaa

SEQ ID NO: 2677813 - RNA, 18 nt, Human
agaaaauauauucuuuca

SEQ ID NO: 2677814 - RNA, 19 nt, Human
agaaaauauauucuuucaa

SEQ ID NO: 2677815 - RNA, 21 nt, Human
acuuuuaucuauucugagaaa

SEQ ID NO: 2677816 - RNA, 18 nt, Human
acuuuucuagaauuauuu

SEQ ID NO: 2677817 - RNA, 23 nt, Human
acuuuucuagaauuauuuuucac

SEQ ID NO: 2677818 - RNA, 14 nt, Human
acuuuuauaaagca

SEQ ID NO: 2677819 - RNA, 16 nt, Human
acuuuuauaaagcaug

SEQ ID NO: 2677820 - RNA, 17 nt, Human
acuuuuauaaagcaugu

SEQ ID NO: 2677821 - RNA, 13 nt, Human
acuuuauaaaucc

SEQ ID NO: 2677822 - RNA, 19 nt, Human
acuuuagggggugggauuc

SEQ ID NO: 2677823 - RNA, 20 nt, Human
acuuuguuucguggggaggu

SEQ ID NO: 2677824 - RNA, 15 nt, Human
acuuuguugcaagau

SEQ ID NO: 2677825 - RNA, 17 nt, Human
acuuuguugcaagaugu

SEQ ID NO: 2677826 - RNA, 20 nt, Human
acuuuguugcaagaugugaa

SEQ ID NO: 2677827 - RNA, 21 nt, Human
acuuuguugcaagaugugaau

SEQ ID NO: 2677828 - RNA, 22 nt, Human
acuuuguugcaagaugugaauu

SEQ ID NO: 2677829 - RNA, 19 nt, Human
acuucugccagauguccua

SEQ ID NO: 2677830 - RNA, 12 nt, Human
acuucugccaga

SEQ ID NO: 2677831 - RNA, 16 nt, Human
acuucugcaacaagca

SEQ ID NO: 2677832 - RNA, 18 nt, Human
acuucugcaacaagcaug

SEQ ID NO: 2677833 - RNA, 19 nt, Human
acuucugcaacaagcaugc

SEQ ID NO: 2677834 - RNA, 24 nt, Human
acuucugcaacaagcaugcagcuu

SEQ ID NO: 2677835 - RNA, 14 nt, Human
acuguuuuaucugg

SEQ ID NO: 2677836 - RNA, 21 nt, Human
acuguuuguuuuuauuuaaau

SEQ ID NO: 2677837 - RNA, 22 nt, Human
acuguuuguuuuuauuuaaauu

SEQ ID NO: 2677838 - RNA, 17 nt, Human
acuguuuuccaguucau

SEQ ID NO: 2677839 - RNA, 20 nt, Human
acuguuuagauuugccauag

SEQ ID NO: 2677840 - RNA, 19 nt, Human
acuguuuagauuugccaua

SEQ ID NO: 2677841 - RNA, 14 nt, Human
acuguuuauuacuu

SEQ ID NO: 2677842 - RNA, 20 nt, Human
acuguuuauuacuuccauga

SEQ ID NO: 2677843 - RNA, 24 nt, Human
acuguuuauuacuuccaugaauuu

SEQ ID NO: 2677844 - RNA, 13 nt, Human
acuguuuagauuu

SEQ ID NO: 2677845 - RNA, 14 nt, Human
acuguuuaaucaua

SEQ ID NO: 2677846 - RNA, 20 nt, Human
acuguuuaaucauaguuacu

SEQ ID NO: 2677847 - RNA, 22 nt, Human
acuguuuaaucauaguuacugu

SEQ ID NO: 2677848 - RNA, 13 nt, Human
acugucuuccuca

SEQ ID NO: 2677849 - RNA, 14 nt, Human
acugucuuccucaa

SEQ ID NO: 2677850 - RNA, 18 nt, Human
acugucuuccucaaaaua

SEQ ID NO: 2677851 - RNA, 20 nt, Human
acugucuuccucaaaauaaa

SEQ ID NO: 2677852 - RNA, 12 nt, Human
acugucuucagu

SEQ ID NO: 2677853 - RNA, 15 nt, Human
acugucugugaacag

SEQ ID NO: 2677854 - RNA, 13 nt, Human
acugugcacaccc

SEQ ID NO: 2677855 - RNA, 20 nt, Human
acugucucucuucucagagu

SEQ ID NO: 2677856 - RNA, 15 nt, Human
acuggguugcgggac

SEQ ID NO: 2677857 - RNA, 17 nt, Human
acugucuauuaauauuc

SEQ ID NO: 2677858 - RNA, 12 nt, Human
acuguccugucc

SEQ ID NO: 2677859 - RNA, 13 nt, Human
acuguccuguccu

SEQ ID NO: 2677860 - RNA, 15 nt, Human
acuguccuguccugc

SEQ ID NO: 2677861 - RNA, 17 nt, Human
acuguccuguccugcuc

SEQ ID NO: 2677862 - RNA, 15 nt, Human
acuggguaggaaaga

SEQ ID NO: 2677863 - RNA, 21 nt, Human
acugccacacucuccaucacc

SEQ ID NO: 2677864 - RNA, 16 nt, Human
acugcauuuagggagu

SEQ ID NO: 2677865 - RNA, 19 nt, Human
acugcauuuagggaguauu

SEQ ID NO: 2677866 - RNA, 14 nt, Human
acugcauuuaggga

SEQ ID NO: 2677867 - RNA, 18 nt, Human
acugccacacucuccauc

SEQ ID NO: 2677868 - RNA, 23 nt, Human
acugccaauauagaaaaauaaaa

SEQ ID NO: 2677869 - RNA, 21 nt, Human
acugaagucuuacuacagaaa

SEQ ID NO: 2677870 - RNA, 23 nt, Human
acugaagucuuacuacagaaaug

SEQ ID NO: 2677871 - RNA, 23 nt, Human
acugaaggaaaaacacaagcaaa

SEQ ID NO: 2677872 - RNA, 20 nt, Human
acugaaggaaaaacacaagc

SEQ ID NO: 2677873 - RNA, 22 nt, Human
acugaaggaaaaacacaagcaa

SEQ ID NO: 2677874 - RNA, 18 nt, Human
acugaaggaaaaacacaa

SEQ ID NO: 2677875 - RNA, 11 nt, Human
acucagccuuc

SEQ ID NO: 2677876 - RNA, 23 nt, Human
acucagccuucagacagagagga

SEQ ID NO: 2677877 - RNA, 11 nt, Human
acucagugcag

SEQ ID NO: 2677878 - RNA, 12 nt, Human
acucagugcaga

SEQ ID NO: 2677879 - RNA, 20 nt, Human
acucaguggguuaacaucag

SEQ ID NO: 2677880 - RNA, 14 nt, Human
acucccccaggugg

SEQ ID NO: 2677881 - RNA, 15 nt, Human
acucaaauacacauu

SEQ ID NO: 2677882 - RNA, 16 nt, Human
acucaaauacacauuu

SEQ ID NO: 2677883 - RNA, 19 nt, Human
acucaaauacacauuugcu

SEQ ID NO: 2677884 - RNA, 16 nt, Human
acucaaacucuuaaaa

SEQ ID NO: 2677885 - RNA, 17 nt, Human
acucaaacucuuaaaac

SEQ ID NO: 2677886 - RNA, 18 nt, Human
acucaaaagcugggcagg

SEQ ID NO: 2677887 - RNA, 14 nt, Human
acuauaaaacaaaa

SEQ ID NO: 2677888 - RNA, 15 nt, Human
acuauaaaacaaaaa

SEQ ID NO: 2677889 - RNA, 18 nt, Human
acuaggcccccacuugcc

SEQ ID NO: 2677890 - RNA, 20 nt, Human
acuaggcccccacuugccuc

SEQ ID NO: 2677891 - RNA, 18 nt, Human
acuaggagaaccaaaucu

SEQ ID NO: 2677892 - RNA, 15 nt, Human
acucuggguccuucc

SEQ ID NO: 2677893 - RNA, 18 nt, Human
acucuggguccuuccuga

SEQ ID NO: 2677894 - RNA, 16 nt, Human
acucuggguccuuccu

SEQ ID NO: 2677895 - RNA, 17 nt, Human
acucuggcuuuuggaag

SEQ ID NO: 2677896 - RNA, 19 nt, Human
acucuggguccuuccugaa

SEQ ID NO: 2677897 - RNA, 18 nt, Human
acucuuaaaacccaagug

SEQ ID NO: 2677898 - RNA, 11 nt, Human
acucuuaaaac

SEQ ID NO: 2677899 - RNA, 18 nt, Human
acucuacccucuuagaaa

SEQ ID NO: 2677900 - RNA, 13 nt, Human
acucuacccucuu

SEQ ID NO: 2677901 - RNA, 21 nt, Human
acucuacccucuuagaaaaac

SEQ ID NO: 2677902 - RNA, 16 nt, Human
acucccuugcuggccc

SEQ ID NO: 2677903 - RNA, 17 nt, Human
acucccuugcuggcccc

SEQ ID NO: 2677904 - RNA, 18 nt, Human
acucccuugcuggcccca

SEQ ID NO: 2677905 - RNA, 19 nt, Human
acucccuugcuggccccag

SEQ ID NO: 2677906 - RNA, 21 nt, Human
acucccuugcuggccccagcc

SEQ ID NO: 2677907 - RNA, 22 nt, Human
acucccuugcuggccccagccc

SEQ ID NO: 2677908 - RNA, 23 nt, Human
acucccuugcuggccccagcccu

SEQ ID NO: 2677909 - RNA, 14 nt, Human
accuguagucccag

SEQ ID NO: 2677910 - RNA, 16 nt, Human
accuguagucccagcu

SEQ ID NO: 2677911 - RNA, 16 nt, Human
accuguauacagugca

SEQ ID NO: 2677912 - RNA, 20 nt, Human
accuguauauuuguaaagcu

SEQ ID NO: 2677913 - RNA, 21 nt, Human
accuguauauuuguaaagcua

SEQ ID NO: 2677914 - RNA, 17 nt, Human
accuguauuuaaaaaua

SEQ ID NO: 2677915 - RNA, 18 nt, Human
accuguauuuaaaaauag

SEQ ID NO: 2677916 - RNA, 20 nt, Human
accuguauuuaaaaauagaa

SEQ ID NO: 2677917 - RNA, 21 nt, Human
accuguauuuaaaaauagaaa

SEQ ID NO: 2677918 - RNA, 23 nt, Human
accuguauuuaaaaauagaaaca

SEQ ID NO: 2677919 - RNA, 17 nt, Human
accuuguuacuucugag

SEQ ID NO: 2677920 - RNA, 14 nt, Human
accuugugccuggg

SEQ ID NO: 2677921 - RNA, 16 nt, Human
accuugugccuggggu

SEQ ID NO: 2677922 - RNA, 12 nt, Human
accuugugccug

SEQ ID NO: 2677923 - RNA, 12 nt, Human
accuuguauaaa

SEQ ID NO: 2677924 - RNA, 19 nt, Human
accuuguauaaauuauuca

SEQ ID NO: 2677925 - RNA, 15 nt, Human
accuuguuacuucug

SEQ ID NO: 2677926 - RNA, 16 nt, Human
accuuguuacuucuga

SEQ ID NO: 2677927 - RNA, 17 nt, Human
accuuuauuuuagaauu

SEQ ID NO: 2677928 - RNA, 14 nt, Human
accuuucaaagcuu

SEQ ID NO: 2677929 - RNA, 21 nt, Human
accucugcacaagcugcaccc

SEQ ID NO: 2677930 - RNA, 18 nt, Human
accucugcacaagcugca

SEQ ID NO: 2677931 - RNA, 16 nt, Human
accucugcacaagcug

SEQ ID NO: 2677932 - RNA, 16 nt, Human
accucuucuggcucaa

SEQ ID NO: 2677933 - RNA, 14 nt, Human
accucuucuggcuc

SEQ ID NO: 2677934 - RNA, 15 nt, Human
acgaugauguacaga

SEQ ID NO: 2677935 - RNA, 19 nt, Human
acgaucacaaaugacuuua

SEQ ID NO: 2677936 - RNA, 12 nt, Human
acgauuuaaggu

SEQ ID NO: 2677937 - RNA, 12 nt, Human
acgccacucauu

SEQ ID NO: 2677938 - RNA, 15 nt, Human
acgccacucauuuca

SEQ ID NO: 2677939 - RNA, 16 nt, Human
acgccacucauuucau

SEQ ID NO: 2677940 - RNA, 17 nt, Human
acgccacucauuucauc

SEQ ID NO: 2677941 - RNA, 20 nt, Human
acgccacucauuucaucuca

SEQ ID NO: 2677942 - RNA, 21 nt, Human
acgccacucauuucaucucau

SEQ ID NO: 2677943 - RNA, 23 nt, Human
acuaauaaucuuguuucugaaaa

SEQ ID NO: 2677944 - RNA, 15 nt, Human
auaaguauuuauaau

SEQ ID NO: 2677945 - RNA, 19 nt, Human
auaaguauuuauaauagca

SEQ ID NO: 2677946 - RNA, 20 nt, Human
auaagugugugguagaaaca

SEQ ID NO: 2677947 - RNA, 13 nt, Human
auaacagcugcaa

SEQ ID NO: 2677948 - RNA, 19 nt, Human
auaacagcugcaauucccu

SEQ ID NO: 2677949 - RNA, 21 nt, Human
auaacagcugcaauucccugg

SEQ ID NO: 2677950 - RNA, 22 nt, Human
auaacagcugcaauucccugga

SEQ ID NO: 2677951 - RNA, 12 nt, Human
auaacacauuuu

SEQ ID NO: 2677952 - RNA, 13 nt, Human
auaacacauuuuu

SEQ ID NO: 2677953 - RNA, 23 nt, Human
auaacacauuuuuuugcaugcau

SEQ ID NO: 2677954 - RNA, 19 nt, Human
auacuuaccuagugaaacu

SEQ ID NO: 2677955 - RNA, 20 nt, Human
auacuuaccuagugaaacuu

SEQ ID NO: 2677956 - RNA, 21 nt, Human
auacuuaccuagugaaacuuu

SEQ ID NO: 2677957 - RNA, 13 nt, Human
auauccugugacu

SEQ ID NO: 2677958 - RNA, 14 nt, Human
auauccugugacug

SEQ ID NO: 2677959 - RNA, 13 nt, Human
auaucccuuccag

SEQ ID NO: 2677960 - RNA, 16 nt, Human
auaucccuuaaugaaa

SEQ ID NO: 2677961 - RNA, 20 nt, Human
auauccugugacugucucac

SEQ ID NO: 2677962 - RNA, 19 nt, Human
auauggaauuuugcaaaga

SEQ ID NO: 2677963 - RNA, 19 nt, Human
auauggacauaucaucugu

SEQ ID NO: 2677964 - RNA, 15 nt, Human
auauggaauuuugca

SEQ ID NO: 2677965 - RNA, 14 nt, Human
auaugcuuuauuaa

SEQ ID NO: 2677966 - RNA, 19 nt, Human
auaugcuuuauuaauguuu

SEQ ID NO: 2677967 - RNA, 20 nt, Human
auaugcuuuauuaauguuuu

SEQ ID NO: 2677968 - RNA, 15 nt, Human
auauuuauuaaauuu

SEQ ID NO: 2677969 - RNA, 16 nt, Human
auauucagauguaugu

SEQ ID NO: 2677970 - RNA, 15 nt, Human
auauuaguauguaug

SEQ ID NO: 2677971 - RNA, 13 nt, Human
auauuauaaagga

SEQ ID NO: 2677972 - RNA, 19 nt, Human
auauuauaaaggauaaaga

SEQ ID NO: 2677973 - RNA, 20 nt, Human
auauuauaaaggauaaagaa

SEQ ID NO: 2677974 - RNA, 23 nt, Human
auauuauaaaggauaaagaagga

SEQ ID NO: 2677975 - RNA, 20 nt, Human
auauuauacaggaaagcaau

SEQ ID NO: 2677976 - RNA, 23 nt, Human
auaguauccauauuuuauuacug

SEQ ID NO: 2677977 - RNA, 16 nt, Human
auauacaugaagaaua

SEQ ID NO: 2677978 - RNA, 19 nt, Human
auauacaugaagaauagaa

SEQ ID NO: 2677979 - RNA, 22 nt, Human
auauaauuuauuuccacuaaaa

SEQ ID NO: 2677980 - RNA, 18 nt, Human
auauacauucaaacuuaa

SEQ ID NO: 2677981 - RNA, 14 nt, Human
auauacauauauau

SEQ ID NO: 2677982 - RNA, 19 nt, Human
aguuguauuuaacagaaau

SEQ ID NO: 2677983 - RNA, 20 nt, Human
aguuguauuuaacagaaauu

SEQ ID NO: 2677984 - RNA, 22 nt, Human
aguuguauuuaacagaaauugu

SEQ ID NO: 2677985 - RNA, 23 nt, Human
aguuguauuuaacagaaauugua

SEQ ID NO: 2677986 - RNA, 13 nt, Human
agugugaauacug

SEQ ID NO: 2677987 - RNA, 16 nt, Human
agugugaauacugcuu

SEQ ID NO: 2677988 - RNA, 14 nt, Human
agugugaauacugc

SEQ ID NO: 2677989 - RNA, 15 nt, Human
agugauauuacauuu

SEQ ID NO: 2677990 - RNA, 13 nt, Human
agucaaggccugc

SEQ ID NO: 2677991 - RNA, 14 nt, Human
agucaaggccugcu

SEQ ID NO: 2677992 - RNA, 15 nt, Human
agucaaggccugcuc

SEQ ID NO: 2677993 - RNA, 19 nt, Human
agucaaggccugcucccug

SEQ ID NO: 2677994 - RNA, 16 nt, Human
agucaagugaaaaagg

SEQ ID NO: 2677995 - RNA, 20 nt, Human
agucaagugaaaaaggagga

SEQ ID NO: 2677996 - RNA, 16 nt, Human
agucaauauguggaag

SEQ ID NO: 2677997 - RNA, 14 nt, Human
agucaauaagaaaa

SEQ ID NO: 2677998 - RNA, 22 nt, Human
agucauuaugagaggcaaugau

SEQ ID NO: 2677999 - RNA, 13 nt, Human
agucauucagcag

SEQ ID NO: 2678000 - RNA, 22 nt, Human
agucauucagcagcaaauuuuc

SEQ ID NO: 2678001 - RNA, 23 nt, Human
agucauucagcagcaaauuuuca

SEQ ID NO: 2678002 - RNA, 14 nt, Human
agucauuaaacugg

SEQ ID NO: 2678003 - RNA, 14 nt, Human
agucauuaaagaca

SEQ ID NO: 2678004 - RNA, 23 nt, Human
agucauuaaagacaggagacaaa

SEQ ID NO: 2678005 - RNA, 14 nt, Human
aguccacccugccu

SEQ ID NO: 2678006 - RNA, 16 nt, Human
aguccacccugccugc

SEQ ID NO: 2678007 - RNA, 17 nt, Human
aguccacccugccugcc

SEQ ID NO: 2678008 - RNA, 19 nt, Human
aguccacccugccugccgu

SEQ ID NO: 2678009 - RNA, 14 nt, Human
aguccacuuuguuu

SEQ ID NO: 2678010 - RNA, 24 nt, Human
agugacaaauaaauuaggaccaag

SEQ ID NO: 2678011 - RNA, 14 nt, Human
agugaucaaacuac

SEQ ID NO: 2678012 - RNA, 16 nt, Human
agugaucaagaagacu

SEQ ID NO: 2678013 - RNA, 23 nt, Human
auccuuuguuuucugacuaauua

SEQ ID NO: 2678014 - RNA, 21 nt, Human
auccuuuguuuucugacuaau

SEQ ID NO: 2678015 - RNA, 19 nt, Human
auccuuuguuuucugacua

SEQ ID NO: 2678016 - RNA, 21 nt, Human
aucgacuuguuuuugcacaug

SEQ ID NO: 2678017 - RNA, 15 nt, Human
aucgagaccauccug

SEQ ID NO: 2678018 - RNA, 16 nt, Human
aucgagaccauccugg

SEQ ID NO: 2678019 - RNA, 17 nt, Human
aucgagaccauccuggc

SEQ ID NO: 2678020 - RNA, 19 nt, Human
aucgagaccauccuggcua

SEQ ID NO: 2678021 - RNA, 22 nt, Human
aucgagugccgcaucucacagc

SEQ ID NO: 2678022 - RNA, 21 nt, Human
aucgagugccgcaucucacag

SEQ ID NO: 2678023 - RNA, 17 nt, Human
aucgcaccauucugacu

SEQ ID NO: 2678024 - RNA, 18 nt, Human
aucgcaccauucugacuc

SEQ ID NO: 2678025 - RNA, 15 nt, Human
aucaucuauagaaag

SEQ ID NO: 2678026 - RNA, 20 nt, Human
aucagccugcuccagcuguu

SEQ ID NO: 2678027 - RNA, 19 nt, Human
aucaucuauagaaagcuau

SEQ ID NO: 2678028 - RNA, 21 nt, Human
aucagccugggcaaugugaua

SEQ ID NO: 2678029 - RNA, 20 nt, Human
aucagccugggcaaugugau

SEQ ID NO: 2678030 - RNA, 11 nt, Human
aucagccuggg

SEQ ID NO: 2678031 - RNA, 12 nt, Human
aucaccugccug

SEQ ID NO: 2678032 - RNA, 14 nt, Human
aucaccugccuguu

SEQ ID NO: 2678033 - RNA, 15 nt, Human
aucaccugccuguua

SEQ ID NO: 2678034 - RNA, 17 nt, Human
augaaaauacaacuuaa

SEQ ID NO: 2678035 - RNA, 13 nt, Human
augaaaauacaac

SEQ ID NO: 2678036 - RNA, 22 nt, Human
augaaaauacaacuuaaauaau

SEQ ID NO: 2678037 - RNA, 14 nt, Human
augaaaauaccauu

SEQ ID NO: 2678038 - RNA, 24 nt, Human
augaaaauaccauuuaguaagaau

SEQ ID NO: 2678039 - RNA, 11 nt, Human
augaaaauugu

SEQ ID NO: 2678040 - RNA, 19 nt, Human
augaaaagauucuucugug

SEQ ID NO: 2678041 - RNA, 17 nt, Human
augaaaagauucuucug

SEQ ID NO: 2678042 - RNA, 14 nt, Human
augaaaauuguauu

SEQ ID NO: 2678043 - RNA, 15 nt, Human
augaaaauuguauua

SEQ ID NO: 2678044 - RNA, 21 nt, Human
aucuuuuuuguuaacugauuu

SEQ ID NO: 2678045 - RNA, 14 nt, Human
augacucaaagucu

SEQ ID NO: 2678046 - RNA, 17 nt, Human
augacuauauaauuuau

SEQ ID NO: 2678047 - RNA, 22 nt, Human
augacuauauaauuuauuucca

SEQ ID NO: 2678048 - RNA, 22 nt, Human
augacuaugcguggcuggaacc

SEQ ID NO: 2678049 - RNA, 16 nt, Human
augacucggggguggg

SEQ ID NO: 2678050 - RNA, 14 nt, Human
augagccuggcaag

SEQ ID NO: 2678051 - RNA, 13 nt, Human
augagccuggcaa

SEQ ID NO: 2678052 - RNA, 21 nt, Human
aucuggaagccaaaauguagg

SEQ ID NO: 2678053 - RNA, 21 nt, Human
aucuggaaucuggagaccagg

SEQ ID NO: 2678054 - RNA, 15 nt, Human
aucuuauaugggaaa

SEQ ID NO: 2678055 - RNA, 22 nt, Human
aucuuauaugggaaaccaugua

SEQ ID NO: 2678056 - RNA, 19 nt, Human
aucuuccaacucaaacucu

SEQ ID NO: 2678057 - RNA, 13 nt, Human
aucuucuaaaugg

SEQ ID NO: 2678058 - RNA, 15 nt, Human
aucugcuguauaugg

SEQ ID NO: 2678059 - RNA, 15 nt, Human
aucucuaaagagcau

SEQ ID NO: 2678060 - RNA, 17 nt, Human
aucugcugcagagcagu

SEQ ID NO: 2678061 - RNA, 16 nt, Human
aucugcugcagagcag

SEQ ID NO: 2678062 - RNA, 14 nt, Human
aucucuaggaaguc

SEQ ID NO: 2678063 - RNA, 19 nt, Human
augucagacagaacuugaa

SEQ ID NO: 2678064 - RNA, 16 nt, Human
augucagcaguugcug

SEQ ID NO: 2678065 - RNA, 13 nt, Human
augucagcaguug

SEQ ID NO: 2678066 - RNA, 16 nt, Human
augucacgaauaugga

SEQ ID NO: 2678067 - RNA, 16 nt, Human
augucaaguaccaaaa

SEQ ID NO: 2678068 - RNA, 21 nt, Human
augucaaacaugagaugugug

SEQ ID NO: 2678069 - RNA, 16 nt, Human
auguacaguugaaaua

SEQ ID NO: 2678070 - RNA, 14 nt, Human
auguacagauucuu

SEQ ID NO: 2678071 - RNA, 15 nt, Human
auguacagauucuuu

SEQ ID NO: 2678072 - RNA, 16 nt, Human
auguacagauucuuuc

SEQ ID NO: 2678073 - RNA, 18 nt, Human
auguacagauucuuucag

SEQ ID NO: 2678074 - RNA, 14 nt, Human
auguaauaaacuuu

SEQ ID NO: 2678075 - RNA, 15 nt, Human
auguaauaaacuuua

SEQ ID NO: 2678076 - RNA, 16 nt, Human
auguaauaaacuuuaa

SEQ ID NO: 2678077 - RNA, 14 nt, Human
auguaagugggccc

SEQ ID NO: 2678078 - RNA, 15 nt, Human
auguaagugggccca

SEQ ID NO: 2678079 - RNA, 18 nt, Human
auguaagugggcccaccc

SEQ ID NO: 2678080 - RNA, 15 nt, Human
auguaagcauacuuu

SEQ ID NO: 2678081 - RNA, 16 nt, Human
auguaagcauacuuug

SEQ ID NO: 2678082 - RNA, 19 nt, Human
auguaagcauacuuuguaa

SEQ ID NO: 2678083 - RNA, 22 nt, Human
auguaagcauacuuuguaaaua

SEQ ID NO: 2678084 - RNA, 19 nt, Human
auggugaaaccccgucucu

SEQ ID NO: 2678085 - RNA, 20 nt, Human
augucagcaguugcugguaa

SEQ ID NO: 2678086 - RNA, 16 nt, Human
auguuucuuuuaaaga

SEQ ID NO: 2678087 - RNA, 16 nt, Human
auguuugcacuuguga

SEQ ID NO: 2678088 - RNA, 12 nt, Human
auguuuuaaaga

SEQ ID NO: 2678089 - RNA, 13 nt, Human
auguuuuaaagaa

SEQ ID NO: 2678090 - RNA, 22 nt, Human
auguuuuaaagaauaugacuuu

SEQ ID NO: 2678091 - RNA, 16 nt, Human
auguuucuuuuguuug

SEQ ID NO: 2678092 - RNA, 21 nt, Human
auguuucuuuuguuugguaaa

SEQ ID NO: 2678093 - RNA, 18 nt, Human
auguuugaauuuuucucu

SEQ ID NO: 2678094 - RNA, 20 nt, Human
auguuugaauuuuucucuuc

SEQ ID NO: 2678095 - RNA, 20 nt, Human
auguguaugcacaguaaaaa

SEQ ID NO: 2678096 - RNA, 15 nt, Human
auggaugauuuaagu

SEQ ID NO: 2678097 - RNA, 12 nt, Human
auggauguuacu

SEQ ID NO: 2678098 - RNA, 23 nt, Human
auggagccagcucccucuauuua

SEQ ID NO: 2678099 - RNA, 15 nt, Human
auggcugcuguugcu

SEQ ID NO: 2678100 - RNA, 19 nt, Human
auggaaaacuguguugcca

SEQ ID NO: 2678101 - RNA, 19 nt, Human
auggaaaucagccaaguuu

SEQ ID NO: 2678102 - RNA, 16 nt, Human
auggaaauuuugcuau

SEQ ID NO: 2678103 - RNA, 14 nt, Human
augcuucuucucaa

SEQ ID NO: 2678104 - RNA, 15 nt, Human
augcuucuucucaaa

SEQ ID NO: 2678105 - RNA, 14 nt, Human
augcaauaaaauuu

SEQ ID NO: 2678106 - RNA, 18 nt, Human
augcaauaaaauuuaaaa

SEQ ID NO: 2678107 - RNA, 23 nt, Human
augcaauaaaauuuaaaaaauaa

SEQ ID NO: 2678108 - RNA, 19 nt, Human
augaugucuuuuuauuaaa

SEQ ID NO: 2678109 - RNA, 22 nt, Human
augaugugcaaaaccuuuuacu

SEQ ID NO: 2678110 - RNA, 24 nt, Human
augcaauguaagcauacuuuguaa

SEQ ID NO: 2678111 - RNA, 17 nt, Human
augcacaguaaaaaugg

SEQ ID NO: 2678112 - RNA, 17 nt, Human
augcaugcuucuucuca

SEQ ID NO: 2678113 - RNA, 13 nt, Human
augcaugcaaaug

SEQ ID NO: 2678114 - RNA, 16 nt, Human
augcaugcaaaugagc

SEQ ID NO: 2678115 - RNA, 17 nt, Human
agcugcucccuggcauu

SEQ ID NO: 2678116 - RNA, 18 nt, Human
agcugcuccgaggaccca

SEQ ID NO: 2678117 - RNA, 19 nt, Human
agcugcuccgaggacccag

SEQ ID NO: 2678118 - RNA, 20 nt, Human
agcugcuccgaggacccagg

SEQ ID NO: 2678119 - RNA, 22 nt, Human
agcugcuccgaggacccaggaa

SEQ ID NO: 2678120 - RNA, 13 nt, Human
agcuccuccccuu

SEQ ID NO: 2678121 - RNA, 19 nt, Human
agcuccuccccuuccucuu

SEQ ID NO: 2678122 - RNA, 22 nt, Human
agcuccuggggcguccaggccg

SEQ ID NO: 2678123 - RNA, 13 nt, Human
agcuccuggggcg

SEQ ID NO: 2678124 - RNA, 15 nt, Human
agcugacaucuugaa

SEQ ID NO: 2678125 - RNA, 16 nt, Human
agcugacaucuugaau

SEQ ID NO: 2678126 - RNA, 15 nt, Human
agcuucaguugcuug

SEQ ID NO: 2678127 - RNA, 16 nt, Human
agcuucaguugcuugu

SEQ ID NO: 2678128 - RNA, 19 nt, Human
agcuucaguugcuugucuu

SEQ ID NO: 2678129 - RNA, 23 nt, Human
agcuucaguugcuugucuucugg

SEQ ID NO: 2678130 - RNA, 21 nt, Human
agcuucaguaaguuaucuuug

SEQ ID NO: 2678131 - RNA, 22 nt, Human
agcuucaguaaguuaucuuuga

SEQ ID NO: 2678132 - RNA, 17 nt, Human
agcuucauauaccagca

SEQ ID NO: 2678133 - RNA, 17 nt, Human
aggagggggccgggcgc

SEQ ID NO: 2678134 - RNA, 19 nt, Human
aggagggggccgggcgcgg

SEQ ID NO: 2678135 - RNA, 14 nt, Human
aggaggggagggua

SEQ ID NO: 2678136 - RNA, 20 nt, Human
aggaccucaggugagaagca

SEQ ID NO: 2678137 - RNA, 14 nt, Human
aggaccucagguga

SEQ ID NO: 2678138 - RNA, 19 nt, Human
aggagaaccaaaucuggaa

SEQ ID NO: 2678139 - RNA, 22 nt, Human
aggagaaccaaaucuggaagcc

SEQ ID NO: 2678140 - RNA, 16 nt, Human
aggagaaccaaaucug

SEQ ID NO: 2678141 - RNA, 18 nt, Human
aggagaggggcacagggu

SEQ ID NO: 2678142 - RNA, 16 nt, Human
aggagaggggcacagg

SEQ ID NO: 2678143 - RNA, 14 nt, Human
aggagaggggcaca

SEQ ID NO: 2678144 - RNA, 13 nt, Human
aggagaagcugca

SEQ ID NO: 2678145 - RNA, 15 nt, Human
aggagagcuagcagc

SEQ ID NO: 2678146 - RNA, 17 nt, Human
aggaccaagcaucuugg

SEQ ID NO: 2678147 - RNA, 19 nt, Human
aggaccaagcaucuugggg

SEQ ID NO: 2678148 - RNA, 16 nt, Human
agggcaagggguuccc

SEQ ID NO: 2678149 - RNA, 15 nt, Human
aggggcacagggucu

SEQ ID NO: 2678150 - RNA, 13 nt, Human
aggggccggcccu

SEQ ID NO: 2678151 - RNA, 14 nt, Human
aggggccggcccug

SEQ ID NO: 2678152 - RNA, 15 nt, Human
aggggccggcccugu

SEQ ID NO: 2678153 - RNA, 17 nt, Human
aggggccggcccugugu

SEQ ID NO: 2678154 - RNA, 21 nt, Human
aggggccggcccugugugcag

SEQ ID NO: 2678155 - RNA, 19 nt, Human
agggcggcaggggccugga

SEQ ID NO: 2678156 - RNA, 23 nt, Human
agggcggcaggggccuggagauc

SEQ ID NO: 2678157 - RNA, 13 nt, Human
agggcggcagggg

SEQ ID NO: 2678158 - RNA, 15 nt, Human
agggcggcaggggcc

SEQ ID NO: 2678159 - RNA, 16 nt, Human
agggcggcaggggccu

SEQ ID NO: 2678160 - RNA, 18 nt, Human
agggcggcaggggccugg

SEQ ID NO: 2678161 - RNA, 19 nt, Human
agggacggccaagaaugua

SEQ ID NO: 2678162 - RNA, 20 nt, Human
agggacggccaagaauguac

SEQ ID NO: 2678163 - RNA, 19 nt, Human
agggacuacccauagacau

SEQ ID NO: 2678164 - RNA, 22 nt, Human
agggacuacccauagacaugaa

SEQ ID NO: 2678165 - RNA, 12 nt, Human
aggcugccccuc

SEQ ID NO: 2678166 - RNA, 15 nt, Human
aggcugccccucuca

SEQ ID NO: 2678167 - RNA, 17 nt, Human
aggcugccccucucacc

SEQ ID NO: 2678168 - RNA, 16 nt, Human
aggcuguggucacagc

SEQ ID NO: 2678169 - RNA, 21 nt, Human
aggcugugcugcccugaagaa

SEQ ID NO: 2678170 - RNA, 22 nt, Human
aggcugugcugcccugaagaau

SEQ ID NO: 2678171 - RNA, 15 nt, Human
aggcugugcugcccu

SEQ ID NO: 2678172 - RNA, 16 nt, Human
aggcugugcugcccug

SEQ ID NO: 2678173 - RNA, 17 nt, Human
aggcugugcugcccuga

SEQ ID NO: 2678174 - RNA, 20 nt, Human
aggcugugcugcccugaaga

SEQ ID NO: 2678175 - RNA, 21 nt, Human
aggcugaugucaauuucugug

SEQ ID NO: 2678176 - RNA, 14 nt, Human
aggcugaaaacaau

SEQ ID NO: 2678177 - RNA, 16 nt, Human
aggcuauguauaaaau

SEQ ID NO: 2678178 - RNA, 17 nt, Human
aggcuauguauaaaaua

SEQ ID NO: 2678179 - RNA, 18 nt, Human
aggcuauguauaaaauac

SEQ ID NO: 2678180 - RNA, 22 nt, Human
agguggaagaagggagaagaaa

SEQ ID NO: 2678181 - RNA, 16 nt, Human
agguggauggccccag

SEQ ID NO: 2678182 - RNA, 23 nt, Human
agguggauggccccagcacagcu

SEQ ID NO: 2678183 - RNA, 19 nt, Human
agguggauuuuguuuaaaa

SEQ ID NO: 2678184 - RNA, 15 nt, Human
agguggauggcccca

SEQ ID NO: 2678185 - RNA, 23 nt, Human
agguggauuuuguuuaaaaaauc

SEQ ID NO: 2678186 - RNA, 15 nt, Human
agguggaagaaggga

SEQ ID NO: 2678187 - RNA, 16 nt, Human
agguggaagaagggag

SEQ ID NO: 2678188 - RNA, 17 nt, Human
agguggaagaagggaga

SEQ ID NO: 2678189 - RNA, 18 nt, Human
agguggaagaagggagaa

SEQ ID NO: 2678190 - RNA, 19 nt, Human
agguggaagaagggagaag

SEQ ID NO: 2678191 - RNA, 22 nt, Human
aggugcuggagcacugggcucc

SEQ ID NO: 2678192 - RNA, 21 nt, Human
aggugcuggagcacugggcuc

SEQ ID NO: 2678193 - RNA, 14 nt, Human
aggucgaggcagga

SEQ ID NO: 2678194 - RNA, 19 nt, Human
agguccugauuucuagaac

SEQ ID NO: 2678195 - RNA, 13 nt, Human
aggugcugcuuaa

SEQ ID NO: 2678196 - RNA, 20 nt, Human
aggugcuggagcacugggcu

SEQ ID NO: 2678197 - RNA, 16 nt, Human
aggugcuggagcacug

SEQ ID NO: 2678198 - RNA, 20 nt, Human
agguucaguauuauguaguu

SEQ ID NO: 2678199 - RNA, 15 nt, Human
agguucagccaaggu

SEQ ID NO: 2678200 - RNA, 19 nt, Human
agguucagccaagguuuua

SEQ ID NO: 2678201 - RNA, 13 nt, Human
agguucagccaag

SEQ ID NO: 2678202 - RNA, 17 nt, Human
agguuccucugccugcc

SEQ ID NO: 2678203 - RNA, 18 nt, Human
agguuccucugccugccc

SEQ ID NO: 2678204 - RNA, 19 nt, Human
agguuccucugccugcccc

SEQ ID NO: 2678205 - RNA, 20 nt, Human
agguuccucugccugccccg

SEQ ID NO: 2678206 - RNA, 13 nt, Human
agguuccucugcc

SEQ ID NO: 2678207 - RNA, 14 nt, Human
agguuccucugccu

SEQ ID NO: 2678208 - RNA, 15 nt, Human
agguuccucugccug

SEQ ID NO: 2678209 - RNA, 16 nt, Human
agguuccucugccugc

SEQ ID NO: 2678210 - RNA, 13 nt, Human
agguaccagcugc

SEQ ID NO: 2678211 - RNA, 16 nt, Human
agguaccagcugcgcu

SEQ ID NO: 2678212 - RNA, 23 nt, Human
agguaccagcugcgcuugcuuuu

SEQ ID NO: 2678213 - RNA, 12 nt, Human
agguacccuggg

SEQ ID NO: 2678214 - RNA, 13 nt, Human
agguacccugggu

SEQ ID NO: 2678215 - RNA, 14 nt, Human
agguacccugggug

SEQ ID NO: 2678216 - RNA, 20 nt, Human
agguacccuggguguccccg

SEQ ID NO: 2678217 - RNA, 16 nt, Human
agagccuggugcugcu

SEQ ID NO: 2678218 - RNA, 18 nt, Human
agagccuggugcugcugc

SEQ ID NO: 2678219 - RNA, 13 nt, Human
agagccuuaaaac

SEQ ID NO: 2678220 - RNA, 13 nt, Human
agagccugcuggc

SEQ ID NO: 2678221 - RNA, 19 nt, Human
agagccugcuggcacccac

SEQ ID NO: 2678222 - RNA, 24 nt, Human
agagccugcuggcacccaccgugg

SEQ ID NO: 2678223 - RNA, 12 nt, Human
agagccugcugg

SEQ ID NO: 2678224 - RNA, 14 nt, Human
agagccuuaaaaca

SEQ ID NO: 2678225 - RNA, 16 nt, Human
agagccuuaaaacauc

SEQ ID NO: 2678226 - RNA, 15 nt, Human
agagccuuaaaacau

SEQ ID NO: 2678227 - RNA, 21 nt, Human
agagaagagauugugguuuca

SEQ ID NO: 2678228 - RNA, 10 nt, Human
agagaagaga

SEQ ID NO: 2678229 - RNA, 13 nt, Human
agagaggacagcu

SEQ ID NO: 2678230 - RNA, 20 nt, Human
agagaggaaauucuccacug

SEQ ID NO: 2678231 - RNA, 15 nt, Human
agagaagcaaguaaa

SEQ ID NO: 2678232 - RNA, 13 nt, Human
agacguuuauaaa

SEQ ID NO: 2678233 - RNA, 16 nt, Human
agacguuuauaaacag

SEQ ID NO: 2678234 - RNA, 21 nt, Human
agacguuuauaaacagaaaug

SEQ ID NO: 2678235 - RNA, 16 nt, Human
agacuaaaaguugcau

SEQ ID NO: 2678236 - RNA, 16 nt, Human
agaccaccacuucgaa

SEQ ID NO: 2678237 - RNA, 15 nt, Human
agaccagggagccuu

SEQ ID NO: 2678238 - RNA, 12 nt, Human
agacaauaaacc

SEQ ID NO: 2678239 - RNA, 17 nt, Human
agacaauaaacccucag

SEQ ID NO: 2678240 - RNA, 22 nt, Human
agacaauaaacccucagagccu

SEQ ID NO: 2678241 - RNA, 19 nt, Human
agauaguguaacuugcuua

SEQ ID NO: 2678242 - RNA, 13 nt, Human
agaugggaaugag

SEQ ID NO: 2678243 - RNA, 18 nt, Human
agaugggaaugagguggg

SEQ ID NO: 2678244 - RNA, 22 nt, Human
agauacuuuguauuguccuauu

SEQ ID NO: 2678245 - RNA, 20 nt, Human
agauacuuuguauuguccua

SEQ ID NO: 2678246 - RNA, 11 nt, Human
agauacuuugu

SEQ ID NO: 2678247 - RNA, 16 nt, Human
agauacuuuguauugu

SEQ ID NO: 2678248 - RNA, 15 nt, Human
agauacuuuguauug

SEQ ID NO: 2678249 - RNA, 13 nt, Human
agauacuuuguau

SEQ ID NO: 2678250 - RNA, 12 nt, Human
agauacuuugua

SEQ ID NO: 2678251 - RNA, 22 nt, Human
agauacuuggggggcugaggug

SEQ ID NO: 2678252 - RNA, 12 nt, Human
agagggcuuccu

SEQ ID NO: 2678253 - RNA, 22 nt, Human
agagggcuuccucuagaagcca

SEQ ID NO: 2678254 - RNA, 13 nt, Human
agagggcuuccuc

SEQ ID NO: 2678255 - RNA, 13 nt, Human
agaggagaggggc

SEQ ID NO: 2678256 - RNA, 14 nt, Human
agaggagccuuuuu

SEQ ID NO: 2678257 - RNA, 11 nt, Human
agaggagccuu

SEQ ID NO: 2678258 - RNA, 23 nt, Human
agccggggaagagauccaaagac

SEQ ID NO: 2678259 - RNA, 21 nt, Human
agccgguuccugucccugcgc

SEQ ID NO: 2678260 - RNA, 14 nt, Human
agccgguuccuguc

SEQ ID NO: 2678261 - RNA, 13 nt, Human
agccgguuccugu

SEQ ID NO: 2678262 - RNA, 16 nt, Human
agccgguaacuguccu

SEQ ID NO: 2678263 - RNA, 17 nt, Human
agccgguaacuguccug

SEQ ID NO: 2678264 - RNA, 18 nt, Human
agccgguaacuguccugu

SEQ ID NO: 2678265 - RNA, 20 nt, Human
agccgguaacuguccugucc

SEQ ID NO: 2678266 - RNA, 21 nt, Human
agccgguaacuguccuguccu

SEQ ID NO: 2678267 - RNA, 20 nt, Human
agccgagauugcaccacugc

SEQ ID NO: 2678268 - RNA, 19 nt, Human
agccgagauugcaccacug

SEQ ID NO: 2678269 - RNA, 19 nt, Human
agccuccucuggacggcag

SEQ ID NO: 2678270 - RNA, 12 nt, Human
agccuccucugg

SEQ ID NO: 2678271 - RNA, 13 nt, Human
agccuccucugga

SEQ ID NO: 2678272 - RNA, 14 nt, Human
agccuccucuggac

SEQ ID NO: 2678273 - RNA, 18 nt, Human
agccuccucuggacggca

SEQ ID NO: 2678274 - RNA, 12 nt, Human
agccccagccug

SEQ ID NO: 2678275 - RNA, 17 nt, Human
agccccagccugcuagc

SEQ ID NO: 2678276 - RNA, 15 nt, Human
agccccagccugcua

SEQ ID NO: 2678277 - RNA, 14 nt, Human
agccccagccugcu

SEQ ID NO: 2678278 - RNA, 13 nt, Human
agccccagccugc

SEQ ID NO: 2678279 - RNA, 19 nt, Human
agccccacugccagcagca

SEQ ID NO: 2678280 - RNA, 20 nt, Human
agccccacugccagcagcag

SEQ ID NO: 2678281 - RNA, 12 nt, Human
agccccacugcc

SEQ ID NO: 2678282 - RNA, 14 nt, Human
agccccacugccag

SEQ ID NO: 2678283 - RNA, 15 nt, Human
agccccacugccagc

SEQ ID NO: 2678284 - RNA, 16 nt, Human
agccccacugccagca

SEQ ID NO: 2678285 - RNA, 17 nt, Human
agccccacugccagcag

SEQ ID NO: 2678286 - RNA, 18 nt, Human
agccccacugccagcagc

SEQ ID NO: 2678287 - RNA, 24 nt, Human
agcccuacucccugcagaugccac

SEQ ID NO: 2678288 - RNA, 15 nt, Human
agcccugagcuuucu

SEQ ID NO: 2678289 - RNA, 17 nt, Human
agcccuaagguccuaag

SEQ ID NO: 2678290 - RNA, 19 nt, Human
agcccuaagguccuaaggc

SEQ ID NO: 2678291 - RNA, 13 nt, Human
agcccuacucccu

SEQ ID NO: 2678292 - RNA, 17 nt, Human
agcccuaaccccuucca

SEQ ID NO: 2678293 - RNA, 18 nt, Human
agcccuaaccccuuccag

SEQ ID NO: 2678294 - RNA, 21 nt, Human
agcccuaaccccuuccagauc

SEQ ID NO: 2678295 - RNA, 20 nt, Human
agcccuacucccugcagaug

SEQ ID NO: 2678296 - RNA, 21 nt, Human
agcccuacucccugcagaugc

SEQ ID NO: 2678297 - RNA, 15 nt, Human
agcccuacucccugc

SEQ ID NO: 2678298 - RNA, 16 nt, Human
agcccuacucccugca

SEQ ID NO: 2678299 - RNA, 17 nt, Human
agcccuacucccugcag

SEQ ID NO: 2678300 - RNA, 18 nt, Human
agcccuacucccugcaga

SEQ ID NO: 2678301 - RNA, 10 nt, Human
agccccaggg

SEQ ID NO: 2678302 - RNA, 16 nt, Human
agccccaggggacaag

SEQ ID NO: 2678303 - RNA, 18 nt, Human
agccagauuugucuuuuu

SEQ ID NO: 2678304 - RNA, 19 nt, Human
agcagucgugccugugucc

SEQ ID NO: 2678305 - RNA, 21 nt, Human
agcagucgugccuguguccau

SEQ ID NO: 2678306 - RNA, 12 nt, Human
agcagcccaccc

SEQ ID NO: 2678307 - RNA, 13 nt, Human
agcagcccacccu

SEQ ID NO: 2678308 - RNA, 14 nt, Human
agcagcccacccug

SEQ ID NO: 2678309 - RNA, 16 nt, Human
agcagcccacccugcu

SEQ ID NO: 2678310 - RNA, 20 nt, Human
agcagcccacccugcugcug

SEQ ID NO: 2678311 - RNA, 15 nt, Human
agcacugggcucccg

SEQ ID NO: 2678312 - RNA, 12 nt, Human
agcacugggcuc

SEQ ID NO: 2678313 - RNA, 16 nt, Human
agcacugggcucccgg

SEQ ID NO: 2678314 - RNA, 16 nt, Human
agcaguugcugguaaa

SEQ ID NO: 2678315 - RNA, 22 nt, Human
agcaguugcugguaaaaugaag

SEQ ID NO: 2678316 - RNA, 21 nt, Human
agcaguugcugguaaaaugaa

SEQ ID NO: 2678317 - RNA, 20 nt, Human
agcaguugcugguaaaauga

SEQ ID NO: 2678318 - RNA, 17 nt, Human
agcaguugcugguaaaa

SEQ ID NO: 2678319 - RNA, 23 nt, Human
agcaguugcugguaaaaugaaga

SEQ ID NO: 2678320 - RNA, 14 nt, Human
agccaagggaaagg

SEQ ID NO: 2678321 - RNA, 23 nt, Human
agccaaggcccugaguuggcagu

SEQ ID NO: 2678322 - RNA, 17 nt, Human
agcaugcagcuuugcaa

SEQ ID NO: 2678323 - RNA, 16 nt, Human
agccaagggaaagggg

SEQ ID NO: 2678324 - RNA, 11 nt, Human
agccagaggcu

SEQ ID NO: 2678325 - RNA, 14 nt, Human
agccagaggcuggg

SEQ ID NO: 2678326 - RNA, 15 nt, Human
agccagaggcugggu

SEQ ID NO: 2678327 - RNA, 18 nt, Human
agccagaggcuggguuca

SEQ ID NO: 2678328 - RNA, 20 nt, Human
agccaagggaaaggggugcu

SEQ ID NO: 2678329 - RNA, 17 nt, Human
agcaugaaauaaaauau

SEQ ID NO: 2678330 - RNA, 19 nt, Human
agcaugaaauaaaauauau

SEQ ID NO: 2678331 - RNA, 14 nt, Human
agcaugaaauguga

SEQ ID NO: 2678332 - RNA, 15 nt, Human
agcaugaaaugugaa

SEQ ID NO: 2678333 - RNA, 16 nt, Human
agcaugaaaugugaau

SEQ ID NO: 2678334 - RNA, 17 nt, Human
agcaugaaaugugaauu

SEQ ID NO: 2678335 - RNA, 22 nt, Human
agcaugaaaugugaauuuuuau

SEQ ID NO: 2678336 - RNA, 19 nt, Human
agcaucuuggggggguggc

SEQ ID NO: 2678337 - RNA, 21 nt, Human
agcaucuuggggggguggccg

SEQ ID NO: 2678338 - RNA, 23 nt, Human
agcaucuuggggggguggccgcu

SEQ ID NO: 2678339 - RNA, 12 nt, Human
aaaacaaaauuu

SEQ ID NO: 2678340 - RNA, 22 nt, Human
aaaacaaaauuugacuaauuuu

SEQ ID NO: 2678341 - RNA, 18 nt, Human
aaaacaauggaguauucu

SEQ ID NO: 2678342 - RNA, 15 nt, Human
aaaacacaagcaaaa

SEQ ID NO: 2678343 - RNA, 18 nt, Human
aaaacaauaggaugggcu

SEQ ID NO: 2678344 - RNA, 17 nt, Human
aaaacaauaggaugggc

SEQ ID NO: 2678345 - RNA, 11 nt, Human
aaaaauuguua

SEQ ID NO: 2678346 - RNA, 19 nt, Human
aaaaagacuuuaaaaguga

SEQ ID NO: 2678347 - RNA, 12 nt, Human
aaaaagagacau

SEQ ID NO: 2678348 - RNA, 15 nt, Human
aaaaagagacaucca

SEQ ID NO: 2678349 - RNA, 14 nt, Human
aaaaagauguacag

SEQ ID NO: 2678350 - RNA, 17 nt, Human
aaaaagaaugaagccuc

SEQ ID NO: 2678351 - RNA, 19 nt, Human
aaaaaccaccaaaaacaaa

SEQ ID NO: 2678352 - RNA, 13 nt, Human
aaaaacauaacau

SEQ ID NO: 2678353 - RNA, 18 nt, Human
aaaaacauaacauaaauu

SEQ ID NO: 2678354 - RNA, 16 nt, Human
aaguaacucauuuguu

SEQ ID NO: 2678355 - RNA, 12 nt, Human
aaguaacucauu

SEQ ID NO: 2678356 - RNA, 14 nt, Human
aaguaacucauuug

SEQ ID NO: 2678357 - RNA, 21 nt, Human
aaguaacucauuuguuaaaau

SEQ ID NO: 2678358 - RNA, 23 nt, Human
aaguaacugggauuacaggcaug

SEQ ID NO: 2678359 - RNA, 16 nt, Human
aagguauuauacaugu

SEQ ID NO: 2678360 - RNA, 14 nt, Human
aaguaacugugaga

SEQ ID NO: 2678361 - RNA, 20 nt, Human
aagguuuuauaaggcugaug

SEQ ID NO: 2678362 - RNA, 13 nt, Human
aagguuuauuguu

SEQ ID NO: 2678363 - RNA, 14 nt, Human
aagguuuauuguua

SEQ ID NO: 2678364 - RNA, 17 nt, Human
aagguuuauuguuaaua

SEQ ID NO: 2678365 - RNA, 20 nt, Human
aagguuuauuguuaauacaa

SEQ ID NO: 2678366 - RNA, 21 nt, Human
aagguuuauuguuaauacaag

SEQ ID NO: 2678367 - RNA, 13 nt, Human
aagggguaaaagg

SEQ ID NO: 2678368 - RNA, 15 nt, Human
aagguauaauaaaau

SEQ ID NO: 2678369 - RNA, 16 nt, Human
aagguauaauaaaauu

SEQ ID NO: 2678370 - RNA, 18 nt, Human
aagguauaauaaaauuau

SEQ ID NO: 2678371 - RNA, 19 nt, Human
aaggggagagccugcuggc

SEQ ID NO: 2678372 - RNA, 12 nt, Human
aaggggagagcc

SEQ ID NO: 2678373 - RNA, 14 nt, Human
aaggggagagccug

SEQ ID NO: 2678374 - RNA, 15 nt, Human
aaggggagagccugc

SEQ ID NO: 2678375 - RNA, 18 nt, Human
aaggggagagccugcugg

SEQ ID NO: 2678376 - RNA, 22 nt, Human
aaggcugguacaacggaggccu

SEQ ID NO: 2678377 - RNA, 15 nt, Human
aaggcuuauaaaaca

SEQ ID NO: 2678378 - RNA, 14 nt, Human
aaggcuuauaaaac

SEQ ID NO: 2678379 - RNA, 17 nt, Human
aaggcugugcugcccug

SEQ ID NO: 2678380 - RNA, 21 nt, Human
aaggcugugcugcccugaaga

SEQ ID NO: 2678381 - RNA, 22 nt, Human
aaggcugggggaagaagcucuc

SEQ ID NO: 2678382 - RNA, 19 nt, Human
aaggcugggggaagaagcu

SEQ ID NO: 2678383 - RNA, 14 nt, Human
aaggcugggggaag

SEQ ID NO: 2678384 - RNA, 16 nt, Human
aaggcugggggaagaa

SEQ ID NO: 2678385 - RNA, 17 nt, Human
guuuauuacuuccauga

SEQ ID NO: 2678386 - RNA, 19 nt, Human
guuuauuacuuccaugaau

SEQ ID NO: 2678387 - RNA, 20 nt, Human
guuuauuacuuccaugaauu

SEQ ID NO: 2678388 - RNA, 21 nt, Human
guuuauuacuuccaugaauuu

SEQ ID NO: 2678389 - RNA, 17 nt, Human
aaggaaaauaguaaugu

SEQ ID NO: 2678390 - RNA, 16 nt, Human
aaggaaaacuaccugu

SEQ ID NO: 2678391 - RNA, 23 nt, Human
aaggaaaacuaccuguauuuaaa

SEQ ID NO: 2678392 - RNA, 19 nt, Human
guuuaaaaaccgaauaaau

SEQ ID NO: 2678393 - RNA, 20 nt, Human
guuuaaaaaccgaauaaaug

SEQ ID NO: 2678394 - RNA, 21 nt, Human
guuguuuuuguauauugguuu

SEQ ID NO: 2678395 - RNA, 14 nt, Human
guuguuuuuguaua

SEQ ID NO: 2678396 - RNA, 20 nt, Human
guuuuaugguuacuucuucu

SEQ ID NO: 2678397 - RNA, 12 nt, Human
guuuuauuuaua

SEQ ID NO: 2678398 - RNA, 17 nt, Human
guuuuauuuauauuuau

SEQ ID NO: 2678399 - RNA, 14 nt, Human
guuuuauuuauauu

SEQ ID NO: 2678400 - RNA, 22 nt, Human
guuuuauuuauauuuauugacu

SEQ ID NO: 2678401 - RNA, 18 nt, Human
guuuuauuuauauuuauu

SEQ ID NO: 2678402 - RNA, 12 nt, Human
guuuuauuucau

SEQ ID NO: 2678403 - RNA, 18 nt, Human
aaguaagaaagugaagca

SEQ ID NO: 2678404 - RNA, 17 nt, Human
guuuggaaaaguggcgu

SEQ ID NO: 2678405 - RNA, 16 nt, Human
guuuuaaacuuucaau

SEQ ID NO: 2678406 - RNA, 16 nt, Human
aaguaauugugaaaaa

SEQ ID NO: 2678407 - RNA, 11 nt, Human
aaguauuuucu

SEQ ID NO: 2678408 - RNA, 17 nt, Human
aaguauuuuuagaauaa

SEQ ID NO: 2678409 - RNA, 12 nt, Human
aagucagagaca

SEQ ID NO: 2678410 - RNA, 14 nt, Human
aagucagagacaga

SEQ ID NO: 2678411 - RNA, 15 nt, Human
aagucagagacagau

SEQ ID NO: 2678412 - RNA, 14 nt, Human
aaguauuuuuucaa

SEQ ID NO: 2678413 - RNA, 12 nt, Human
uaaaauuguuau

SEQ ID NO: 2678414 - RNA, 15 nt, Human
uaaaauuguuaucaa

SEQ ID NO: 2678415 - RNA, 16 nt, Human
uaaaauuguuaucaaa

SEQ ID NO: 2678416 - RNA, 10 nt, Human
uaaaauguaa

SEQ ID NO: 2678417 - RNA, 20 nt, Human
aaguuugagaucagccuggg

SEQ ID NO: 2678418 - RNA, 20 nt, Human
uaaaauguccaguaagauca

SEQ ID NO: 2678419 - RNA, 19 nt, Human
uaaaauguccaguaagauc

SEQ ID NO: 2678420 - RNA, 22 nt, Human
uaaaauguccaguaagaucacu

SEQ ID NO: 2678421 - RNA, 21 nt, Human
uaaaauguccaguaagaucac

SEQ ID NO: 2678422 - RNA, 15 nt, Human
uaaaauguaauuuaa

SEQ ID NO: 2678423 - RNA, 16 nt, Human
uaaaauguaauuuaaa

SEQ ID NO: 2678424 - RNA, 17 nt, Human
uaaaauguaauuuaaau

SEQ ID NO: 2678425 - RNA, 19 nt, Human
uaaaauguaauuuaaauga

SEQ ID NO: 2678426 - RNA, 20 nt, Human
uaaaauguaauuuaaaugaa

SEQ ID NO: 2678427 - RNA, 21 nt, Human
uaaaauguaauuuaaaugaaa

SEQ ID NO: 2678428 - RNA, 18 nt, Human
aaguuauuuucuacagug

SEQ ID NO: 2678429 - RNA, 21 nt, Human
aaguuauuuucuacagugguu

SEQ ID NO: 2678430 - RNA, 14 nt, Human
aaguuauuuucuac

SEQ ID NO: 2678431 - RNA, 19 nt, Human
aaguucaaucuguuuuuca

SEQ ID NO: 2678432 - RNA, 16 nt, Human
aaguuuccaucaucua

SEQ ID NO: 2678433 - RNA, 14 nt, Human
aagugcauuuuugu

SEQ ID NO: 2678434 - RNA, 16 nt, Human
aagugcauuuuuguaa

SEQ ID NO: 2678435 - RNA, 13 nt, Human
aagugccaaagaa

SEQ ID NO: 2678436 - RNA, 14 nt, Human
aagugccaaagaaa

SEQ ID NO: 2678437 - RNA, 15 nt, Human
aagugccaaagaaag

SEQ ID NO: 2678438 - RNA, 16 nt, Human
aagugccaaagaaagu

SEQ ID NO: 2678439 - RNA, 19 nt, Human
aagugccaaagaaaguggu

SEQ ID NO: 2678440 - RNA, 14 nt, Human
aaguguccuucuug

SEQ ID NO: 2678441 - RNA, 19 nt, Human
aagugucucacuaaagcau

SEQ ID NO: 2678442 - RNA, 21 nt, Human
aagugucucacuaaagcauga

SEQ ID NO: 2678443 - RNA, 18 nt, Human
aagugugaauacugcuug

SEQ ID NO: 2678444 - RNA, 16 nt, Human
aagugugaauacugcu

SEQ ID NO: 2678445 - RNA, 15 nt, Human
aagugugaauacugc

SEQ ID NO: 2678446 - RNA, 14 nt, Human
aagugugaauacug

SEQ ID NO: 2678447 - RNA, 13 nt, Human
aagugugagcaaa

SEQ ID NO: 2678448 - RNA, 20 nt, Human
aagugugaauacugcuugaa

SEQ ID NO: 2678449 - RNA, 13 nt, Human
aagugugguagag

SEQ ID NO: 2678450 - RNA, 15 nt, Human
aaguguguauauauu

SEQ ID NO: 2678451 - RNA, 16 nt, Human
aaguguguauauauuu

SEQ ID NO: 2678452 - RNA, 17 nt, Human
aaguguguauauauuuu

SEQ ID NO: 2678453 - RNA, 19 nt, Human
aaguguguauauauuuugu

SEQ ID NO: 2678454 - RNA, 21 nt, Human
aaguguguauauauuuugugu

SEQ ID NO: 2678455 - RNA, 16 nt, Human
uaaaauaguaugaaaa

SEQ ID NO: 2678456 - RNA, 18 nt, Human
aagugugugguagaaaca

SEQ ID NO: 2678457 - RNA, 13 nt, Human
aaguuaucuuuga

SEQ ID NO: 2678458 - RNA, 14 nt, Human
aaguuaucuuugaa

SEQ ID NO: 2678459 - RNA, 15 nt, Human
aaguuaucuuugaau

SEQ ID NO: 2678460 - RNA, 22 nt, Human
aaguuaucuuugaauauguagu

SEQ ID NO: 2678461 - RNA, 23 nt, Human
aaguuauugcaguuuaucauuca

SEQ ID NO: 2678462 - RNA, 23 nt, Human
aaguuaguuuguauauauuauua

SEQ ID NO: 2678463 - RNA, 17 nt, Human
aaguuaguuuguauaua

SEQ ID NO: 2678464 - RNA, 22 nt, Human
aaguuaguuuguauauauuauu

SEQ ID NO: 2678465 - RNA, 15 nt, Human
aaguuaguuuguaua

SEQ ID NO: 2678466 - RNA, 16 nt, Human
aaguguguguaguuuu

SEQ ID NO: 2678467 - RNA, 17 nt, Human
uaaaauaaggauuuuuc

SEQ ID NO: 2678468 - RNA, 22 nt, Human
uaaaauaaggauuuuucucuua

SEQ ID NO: 2678469 - RNA, 15 nt, Human
uaaaagugaucuaca

SEQ ID NO: 2678470 - RNA, 18 nt, Human
uaaaacuggaccuguaua

SEQ ID NO: 2678471 - RNA, 14 nt, Human
uaaaagaaauaaac

SEQ ID NO: 2678472 - RNA, 16 nt, Human
uaaaagaaauaaacca

SEQ ID NO: 2678473 - RNA, 13 nt, Human
uaaaagaaacacu

SEQ ID NO: 2678474 - RNA, 17 nt, Human
aagugauuuuuuugucc

SEQ ID NO: 2678475 - RNA, 22 nt, Human
aagugaucuacaugaggaacug

SEQ ID NO: 2678476 - RNA, 18 nt, Human
uaaaauagucucuuuaaa

SEQ ID NO: 2678477 - RNA, 15 nt, Human
uaaaauagauauaaa

SEQ ID NO: 2678478 - RNA, 16 nt, Human
uaaaauagauauaaau

SEQ ID NO: 2678479 - RNA, 18 nt, Human
uaaaauagauauaaauuu

SEQ ID NO: 2678480 - RNA, 19 nt, Human
uaaaauacauagugaaaau

SEQ ID NO: 2678481 - RNA, 14 nt, Human
uaaaauauaaacaa

SEQ ID NO: 2678482 - RNA, 15 nt, Human
aagucagcuccagcu

SEQ ID NO: 2678483 - RNA, 20 nt, Human
aagucagcuccagcuuucug

SEQ ID NO: 2678484 - RNA, 22 nt, Human
aagucagcuccagcuuucugcc

SEQ ID NO: 2678485 - RNA, 17 nt, Human
aagucaguacccaccac

SEQ ID NO: 2678486 - RNA, 14 nt, Human
uaaaaaguauuuuu

SEQ ID NO: 2678487 - RNA, 18 nt, Human
uaaaaaguauuuuuucaa

SEQ ID NO: 2678488 - RNA, 12 nt, Human
uaaaaauagaaa

SEQ ID NO: 2678489 - RNA, 13 nt, Human
uaaaaauagaaac

SEQ ID NO: 2678490 - RNA, 14 nt, Human
uaaaaauagaaaca

SEQ ID NO: 2678491 - RNA, 15 nt, Human
uaaaaauagaaacau

SEQ ID NO: 2678492 - RNA, 17 nt, Human
uaaaaaggaguauacaa

SEQ ID NO: 2678493 - RNA, 18 nt, Human
uaaaaaggaguauacaaa

SEQ ID NO: 2678494 - RNA, 20 nt, Human
uaaaaaggaguauacaaaca

SEQ ID NO: 2678495 - RNA, 17 nt, Human
uaaaaaggcuaaaugga

SEQ ID NO: 2678496 - RNA, 13 nt, Human
uaaaaaguauaaa

SEQ ID NO: 2678497 - RNA, 19 nt, Human
uaaaaaguauaaaauagua

SEQ ID NO: 2678498 - RNA, 23 nt, Human
uaaaaauaucaaauuaauugugu

SEQ ID NO: 2678499 - RNA, 15 nt, Human
uaaaaaucucuuuuc

SEQ ID NO: 2678500 - RNA, 11 nt, Human
uaaaaaucuuu

SEQ ID NO: 2678501 - RNA, 18 nt, Human
uaaaaaucuuuugaagca

SEQ ID NO: 2678502 - RNA, 13 nt, Human
uaaaacccaagug

SEQ ID NO: 2678503 - RNA, 16 nt, Human
uaaaacucacugugau

SEQ ID NO: 2678504 - RNA, 17 nt, Human
uaaaacucacugugauc

SEQ ID NO: 2678505 - RNA, 15 nt, Human
aagcacagaauauuu

SEQ ID NO: 2678506 - RNA, 16 nt, Human
aagcacagaauauuuu

SEQ ID NO: 2678507 - RNA, 18 nt, Human
aagcacaccaaucuuacu

SEQ ID NO: 2678508 - RNA, 22 nt, Human
aagcacaccaaucuuacuuugu

SEQ ID NO: 2678509 - RNA, 19 nt, Human
aagcacaccaaucuuacuu

SEQ ID NO: 2678510 - RNA, 20 nt, Human
aagcacagucugaugacaca

SEQ ID NO: 2678511 - RNA, 23 nt, Human
aagcacaccaaucuuacuuugua

SEQ ID NO: 2678512 - RNA, 23 nt, Human
aagcacuccugcuuaaucuucaa

SEQ ID NO: 2678513 - RNA, 19 nt, Human
aagcacuacaccuugccuu

SEQ ID NO: 2678514 - RNA, 23 nt, Human
aagcacuacaccuugccuugcug

SEQ ID NO: 2678515 - RNA, 13 nt, Human
aagccaagugggg

SEQ ID NO: 2678516 - RNA, 19 nt, Human
aagccaaguggggugcugg

SEQ ID NO: 2678517 - RNA, 23 nt, Human
aagccaagggaaaggggugcuuu

SEQ ID NO: 2678518 - RNA, 20 nt, Human
aagccaagggaaccuguguc

SEQ ID NO: 2678519 - RNA, 18 nt, Human
aagccaagggaaccugug

SEQ ID NO: 2678520 - RNA, 19 nt, Human
aagccaagggaaccugugu

SEQ ID NO: 2678521 - RNA, 13 nt, Human
aagccaagggaaa

SEQ ID NO: 2678522 - RNA, 14 nt, Human
aagccaagggaaag

SEQ ID NO: 2678523 - RNA, 16 nt, Human
aagccaagggaaaggg

SEQ ID NO: 2678524 - RNA, 19 nt, Human
aagcacucuggaugaugga

SEQ ID NO: 2678525 - RNA, 13 nt, Human
aagcaugaaaugu

SEQ ID NO: 2678526 - RNA, 14 nt, Human
aagcaugaaaugug

SEQ ID NO: 2678527 - RNA, 16 nt, Human
aagcaugaaaugugaa

SEQ ID NO: 2678528 - RNA, 17 nt, Human
aagcaugaaaugugaau

SEQ ID NO: 2678529 - RNA, 18 nt, Human
aagcaugaaaugugaauu

SEQ ID NO: 2678530 - RNA, 19 nt, Human
aagcauauggguuagaugu

SEQ ID NO: 2678531 - RNA, 21 nt, Human
aagcauauggguuagauguug

SEQ ID NO: 2678532 - RNA, 20 nt, Human
aagcaucuuggggggguggc

SEQ ID NO: 2678533 - RNA, 21 nt, Human
aagcaugcuugugaaaaugug

SEQ ID NO: 2678534 - RNA, 22 nt, Human
aagcaugcuugugaaaaugugu

SEQ ID NO: 2678535 - RNA, 17 nt, Human
aagcaaauguuaaaagu

SEQ ID NO: 2678536 - RNA, 19 nt, Human
aagcaaauguuaaaaguuu

SEQ ID NO: 2678537 - RNA, 18 nt, Human
aagauuuuuuaauuguuu

SEQ ID NO: 2678538 - RNA, 19 nt, Human
aagauuuuuuaauuguuua

SEQ ID NO: 2678539 - RNA, 20 nt, Human
aagauuuuuuaauuguuuaa

SEQ ID NO: 2678540 - RNA, 23 nt, Human
aagaucaaaaaggcuuauaaaac

SEQ ID NO: 2678541 - RNA, 21 nt, Human
aagaucaaaaaggcuuauaaa

SEQ ID NO: 2678542 - RNA, 15 nt, Human
gugugaacuuggaag

SEQ ID NO: 2678543 - RNA, 17 nt, Human
gugugaacuuggaagca

SEQ ID NO: 2678544 - RNA, 19 nt, Human
guguauucuaguuuuguca

SEQ ID NO: 2678545 - RNA, 19 nt, Human
gugucacccaaaccggcag

SEQ ID NO: 2678546 - RNA, 14 nt, Human
aagauaguguaacu

SEQ ID NO: 2678547 - RNA, 15 nt, Human
aagauaguguaacuu

SEQ ID NO: 2678548 - RNA, 21 nt, Human
aagauaguguaacuugcuuaa

SEQ ID NO: 2678549 - RNA, 15 nt, Human
aagaggcaccaggaa

SEQ ID NO: 2678550 - RNA, 18 nt, Human
aagaggcaccaggaagcc

SEQ ID NO: 2678551 - RNA, 13 nt, Human
gugguuccucugc

SEQ ID NO: 2678552 - RNA, 16 nt, Human
gugguuccucugcuca

SEQ ID NO: 2678553 - RNA, 18 nt, Human
gugguugaauaugauuaa

SEQ ID NO: 2678554 - RNA, 16 nt, Human
gugguugaauaugauu

SEQ ID NO: 2678555 - RNA, 14 nt, Human
gugcugcugcugcu

SEQ ID NO: 2678556 - RNA, 17 nt, Human
guguaaaauauuuugaa

SEQ ID NO: 2678557 - RNA, 18 nt, Human
guguaaaauauuuugaau

SEQ ID NO: 2678558 - RNA, 19 nt, Human
guguaaaauauuuugaauc

SEQ ID NO: 2678559 - RNA, 15 nt, Human
guguaaaaaaaccac

SEQ ID NO: 2678560 - RNA, 16 nt, Human
guguaacucccaguga

SEQ ID NO: 2678561 - RNA, 15 nt, Human
guguaacuugcuuaa

SEQ ID NO: 2678562 - RNA, 20 nt, Human
guguaacuugcuuaaauuuc

SEQ ID NO: 2678563 - RNA, 21 nt, Human
guguaacuugcuuaaauuucu

SEQ ID NO: 2678564 - RNA, 15 nt, Human
guuacuguguaaacu

SEQ ID NO: 2678565 - RNA, 17 nt, Human
guuacuguguaaacuca

SEQ ID NO: 2678566 - RNA, 18 nt, Human
guuacuguguaaacucau

SEQ ID NO: 2678567 - RNA, 13 nt, Human
guuagacagccaa

SEQ ID NO: 2678568 - RNA, 13 nt, Human
guuauugcaguuu

SEQ ID NO: 2678569 - RNA, 14 nt, Human
guuauugcaguuua

SEQ ID NO: 2678570 - RNA, 16 nt, Human
guuauugcaguuuauc

SEQ ID NO: 2678571 - RNA, 23 nt, Human
guuauugcaguuuaucauucaag

SEQ ID NO: 2678572 - RNA, 14 nt, Human
guuaauacaaggua

SEQ ID NO: 2678573 - RNA, 15 nt, Human
guuaauacaagguau

SEQ ID NO: 2678574 - RNA, 16 nt, Human
guuaauacaagguaua

SEQ ID NO: 2678575 - RNA, 19 nt, Human
aagccaaucuacaaucucu

SEQ ID NO: 2678576 - RNA, 22 nt, Human
aagccauucuccugccucagcc

SEQ ID NO: 2678577 - RNA, 12 nt, Human
guuaauuuaagu

SEQ ID NO: 2678578 - RNA, 19 nt, Human
guuaauuuaaguuuugaca

SEQ ID NO: 2678579 - RNA, 13 nt, Human
guuaauuuaaguu

SEQ ID NO: 2678580 - RNA, 23 nt, Human
guuaauuuaaguuuugacaagcu

SEQ ID NO: 2678581 - RNA, 22 nt, Human
guuacuggauuuguuguucuuu

SEQ ID NO: 2678582 - RNA, 14 nt, Human
guuacugggcccug

SEQ ID NO: 2678583 - RNA, 17 nt, Human
guuacugggcccugagu

SEQ ID NO: 2678584 - RNA, 19 nt, Human
aagccuucagcuccaggga

SEQ ID NO: 2678585 - RNA, 11 nt, Human
aagccuuccua

SEQ ID NO: 2678586 - RNA, 22 nt, Human
aagccuucgggcgucugugugc

SEQ ID NO: 2678587 - RNA, 16 nt, Human
aagccuucagcuccag

SEQ ID NO: 2678588 - RNA, 17 nt, Human
aagccuucagcuccagg

SEQ ID NO: 2678589 - RNA, 15 nt, Human
aagccuucagcucca

SEQ ID NO: 2678590 - RNA, 13 nt, Human
aagccuucaaaac

SEQ ID NO: 2678591 - RNA, 22 nt, Human
aagccuucaaaacuauagcuug

SEQ ID NO: 2678592 - RNA, 17 nt, Human
aagcuagucaacaguac

SEQ ID NO: 2678593 - RNA, 15 nt, Human
aagcuagucaacagu

SEQ ID NO: 2678594 - RNA, 15 nt, Human
aagcuaguugaauac

SEQ ID NO: 2678595 - RNA, 13 nt, Human
aagcuaguugaau

SEQ ID NO: 2678596 - RNA, 21 nt, Human
aagcuaguugaauacuugaac

SEQ ID NO: 2678597 - RNA, 20 nt, Human
aagcuaguugaauacuugaa

SEQ ID NO: 2678598 - RNA, 19 nt, Human
aagcuaguugaauacuuga

SEQ ID NO: 2678599 - RNA, 17 nt, Human
aagcuaguugaauacuu

SEQ ID NO: 2678600 - RNA, 17 nt, Human
aagccuguaacacuccu

SEQ ID NO: 2678601 - RNA, 21 nt, Human
aagccuguaacacuccucugc

SEQ ID NO: 2678602 - RNA, 15 nt, Human
aagccuccuccagcc

SEQ ID NO: 2678603 - RNA, 23 nt, Human
aagccuccacagcgagggcagcu

SEQ ID NO: 2678604 - RNA, 13 nt, Human
aagccuccacagc

SEQ ID NO: 2678605 - RNA, 15 nt, Human
aagccuccacagcga

SEQ ID NO: 2678606 - RNA, 12 nt, Human
aagccuccacag

SEQ ID NO: 2678607 - RNA, 16 nt, Human
aagccucccacgacug

SEQ ID NO: 2678608 - RNA, 18 nt, Human
guucaguauuauguaguu

SEQ ID NO: 2678609 - RNA, 21 nt, Human
aagccgugauuuucauugcug

SEQ ID NO: 2678610 - RNA, 13 nt, Human
aagccguccuggc

SEQ ID NO: 2678611 - RNA, 20 nt, Human
guuauuuucuacagugguuu

SEQ ID NO: 2678612 - RNA, 15 nt, Human
guuauuuucuacagu

SEQ ID NO: 2678613 - RNA, 17 nt, Human
guuauuuucuacagugg

SEQ ID NO: 2678614 - RNA, 12 nt, Human
guuauuuucuac

SEQ ID NO: 2678615 - RNA, 14 nt, Human
guuauuuucuacag

SEQ ID NO: 2678616 - RNA, 21 nt, Human
guucccuugaaacuuugggaa

SEQ ID NO: 2678617 - RNA, 22 nt, Human
guucccuugaaacuuugggaaa

SEQ ID NO: 2678618 - RNA, 20 nt, Human
guucccuugagggcugcagu

SEQ ID NO: 2678619 - RNA, 16 nt, Human
aagcuugguucuguga

SEQ ID NO: 2678620 - RNA, 17 nt, Human
aagcuugguucugugaa

SEQ ID NO: 2678621 - RNA, 21 nt, Human
aagcuugguucugugaacaag

SEQ ID NO: 2678622 - RNA, 11 nt, Human
aagcuuagaac

SEQ ID NO: 2678623 - RNA, 10 nt, Human
aagcuuagaa

SEQ ID NO: 2678624 - RNA, 18 nt, Human
aagcuuggauuaaauaca

SEQ ID NO: 2678625 - RNA, 20 nt, Human
aagcuauaaagcaguauuuu

SEQ ID NO: 2678626 - RNA, 13 nt, Human
aagcuauaaagca

SEQ ID NO: 2678627 - RNA, 15 nt, Human
aagcuauaaagcagu

SEQ ID NO: 2678628 - RNA, 20 nt, Human
guucuuggcaauaaauuuug

SEQ ID NO: 2678629 - RNA, 23 nt, Human
guucuuggcaauaaauuuugaaa

SEQ ID NO: 2678630 - RNA, 22 nt, Human
guucuuggcaauaaauuuugaa

SEQ ID NO: 2678631 - RNA, 21 nt, Human
guucuuggcaauaaauuuuga

SEQ ID NO: 2678632 - RNA, 16 nt, Human
aaggaaaaacacaagc

SEQ ID NO: 2678633 - RNA, 19 nt, Human
aaggaaaaacacaagcaaa

SEQ ID NO: 2678634 - RNA, 20 nt, Human
aaggaaaaacacaagcaaaa

SEQ ID NO: 2678635 - RNA, 15 nt, Human
guucucucuucucca

SEQ ID NO: 2678636 - RNA, 12 nt, Human
guauuuauaaua

SEQ ID NO: 2678637 - RNA, 17 nt, Human
aaauguagguccucaga

SEQ ID NO: 2678638 - RNA, 18 nt, Human
guauuguuuaaaauguaa

SEQ ID NO: 2678639 - RNA, 17 nt, Human
guauuuaacagaaauug

SEQ ID NO: 2678640 - RNA, 16 nt, Human
guauuuaaaaauagaa

SEQ ID NO: 2678641 - RNA, 17 nt, Human
guauuuaaaaauagaaa

SEQ ID NO: 2678642 - RNA, 19 nt, Human
guauuuaaaaauagaaaca

SEQ ID NO: 2678643 - RNA, 20 nt, Human
guauuuaaaaauagaaacau

SEQ ID NO: 2678644 - RNA, 14 nt, Human
aaauguauaaacuu

SEQ ID NO: 2678645 - RNA, 13 nt, Human
aaauguauaaaua

SEQ ID NO: 2678646 - RNA, 15 nt, Human
aaauguauaaauaua

SEQ ID NO: 2678647 - RNA, 16 nt, Human
aaauguauaaauauac

SEQ ID NO: 2678648 - RNA, 17 nt, Human
aaauguauaaauauaca

SEQ ID NO: 2678649 - RNA, 19 nt, Human
aaauguauaaauauacagu

SEQ ID NO: 2678650 - RNA, 21 nt, Human
aaauguauaaauauacaguau

SEQ ID NO: 2678651 - RNA, 18 nt, Human
aaaugucuguaauaauag

SEQ ID NO: 2678652 - RNA, 20 nt, Human
aaaugucuguaaauauguuu

SEQ ID NO: 2678653 - RNA, 14 nt, Human
aaaugucuguaaau

SEQ ID NO: 2678654 - RNA, 19 nt, Human
aaaucauucuuacuaaaaa

SEQ ID NO: 2678655 - RNA, 21 nt, Human
aaaucauucuuacuaaaaagu

SEQ ID NO: 2678656 - RNA, 23 nt, Human
aaaucauguugaucauguacuuu

SEQ ID NO: 2678657 - RNA, 18 nt, Human
guauucuaguuuugucaa

SEQ ID NO: 2678658 - RNA, 19 nt, Human
guauucuaauaagcuaguu

SEQ ID NO: 2678659 - RNA, 22 nt, Human
guauucuaauaagcuaguugaa

SEQ ID NO: 2678660 - RNA, 21 nt, Human
guauuguccuauuaguguuau

SEQ ID NO: 2678661 - RNA, 13 nt, Human
guauuguccuauu

SEQ ID NO: 2678662 - RNA, 13 nt, Human
aaauuaauugugu

SEQ ID NO: 2678663 - RNA, 15 nt, Human
aaauuagccgggcgu

SEQ ID NO: 2678664 - RNA, 13 nt, Human
aaauuacaauuuu

SEQ ID NO: 2678665 - RNA, 14 nt, Human
aaauuacaauuuua

SEQ ID NO: 2678666 - RNA, 15 nt, Human
aaauuacaauuuuau

SEQ ID NO: 2678667 - RNA, 16 nt, Human
aaauuacaauuuuauc

SEQ ID NO: 2678668 - RNA, 18 nt, Human
aaauuaauugugugaacu

SEQ ID NO: 2678669 - RNA, 16 nt, Human
aaauuaaucauaguca

SEQ ID NO: 2678670 - RNA, 16 nt, Human
aaauuaauugugugaa

SEQ ID NO: 2678671 - RNA, 15 nt, Human
aaauuaauuguguga

SEQ ID NO: 2678672 - RNA, 18 nt, Human
aaauuaggaauaaauaaa

SEQ ID NO: 2678673 - RNA, 16 nt, Human
aaauuaggaauaaaua

SEQ ID NO: 2678674 - RNA, 15 nt, Human
aaauuaggaauaaau

SEQ ID NO: 2678675 - RNA, 14 nt, Human
aaauuaggaauaaa

SEQ ID NO: 2678676 - RNA, 17 nt, Human
aaauuaucuugauacau

SEQ ID NO: 2678677 - RNA, 20 nt, Human
aaauuaucuugauacauuca

SEQ ID NO: 2678678 - RNA, 21 nt, Human
aaauuaucuugauacauucaa

SEQ ID NO: 2678679 - RNA, 22 nt, Human
aaauuaucuugauacauucaaa

SEQ ID NO: 2678680 - RNA, 15 nt, Human
aaauucaacuuugua

SEQ ID NO: 2678681 - RNA, 16 nt, Human
aaauucaacuuuguaa

SEQ ID NO: 2678682 - RNA, 20 nt, Human
aaauucaacuuuguaaaaau

SEQ ID NO: 2678683 - RNA, 12 nt, Human
aaauucuccacu

SEQ ID NO: 2678684 - RNA, 13 nt, Human
aaauucuccugga

SEQ ID NO: 2678685 - RNA, 23 nt, Human
aaauucuauaggaacauaugaaa

SEQ ID NO: 2678686 - RNA, 22 nt, Human
aaauucuauaggaacauaugaa

SEQ ID NO: 2678687 - RNA, 19 nt, Human
aaauucuauaggaacauau

SEQ ID NO: 2678688 - RNA, 19 nt, Human
aaauuguauauuguaauuu

SEQ ID NO: 2678689 - RNA, 13 nt, Human
aaauuguauauug

SEQ ID NO: 2678690 - RNA, 15 nt, Human
aaauuguauauugua

SEQ ID NO: 2678691 - RNA, 14 nt, Human
aaauucuccuggag

SEQ ID NO: 2678692 - RNA, 13 nt, Human
aaauuuaaaaaau

SEQ ID NO: 2678693 - RNA, 16 nt, Human
aaauuuaaaaaauaaa

SEQ ID NO: 2678694 - RNA, 19 nt, Human
aaauuuaaaaaauaaauaa

SEQ ID NO: 2678695 - RNA, 11 nt, Human
aaauuccugua

SEQ ID NO: 2678696 - RNA, 14 nt, Human
gucaggugacccug

SEQ ID NO: 2678697 - RNA, 14 nt, Human
gucacuuuuuaugc

SEQ ID NO: 2678698 - RNA, 21 nt, Human
gucaggagaucgagaccaucc

SEQ ID NO: 2678699 - RNA, 12 nt, Human
gucacuggaaag

SEQ ID NO: 2678700 - RNA, 18 nt, Human
gucacuggagguugaagc

SEQ ID NO: 2678701 - RNA, 20 nt, Human
gucacuggagguugaagcca

SEQ ID NO: 2678702 - RNA, 15 nt, Human
gucacuggaaagggg

SEQ ID NO: 2678703 - RNA, 18 nt, Human
gucacuggaaaggggaga

SEQ ID NO: 2678704 - RNA, 20 nt, Human
gucacuggaaaggggagagc

SEQ ID NO: 2678705 - RNA, 23 nt, Human
gucacuggaaaggggagagccug

SEQ ID NO: 2678706 - RNA, 19 nt, Human
gucacuguuuauuuuuuua

SEQ ID NO: 2678707 - RNA, 14 nt, Human
gucacuguuuccug

SEQ ID NO: 2678708 - RNA, 17 nt, Human
gucacuguuuccugggc

SEQ ID NO: 2678709 - RNA, 23 nt, Human
gucacuggagguugaagccaagu

SEQ ID NO: 2678710 - RNA, 21 nt, Human
aaauuuaauaccagauaccuu

SEQ ID NO: 2678711 - RNA, 17 nt, Human
gucaauuucuguguugc

SEQ ID NO: 2678712 - RNA, 22 nt, Human
gucaauuucuguguugccaagc

SEQ ID NO: 2678713 - RNA, 13 nt, Human
gucaccaccaccc

SEQ ID NO: 2678714 - RNA, 14 nt, Human
gucaccaccacccc

SEQ ID NO: 2678715 - RNA, 12 nt, Human
aacauuauuuau

SEQ ID NO: 2678716 - RNA, 13 nt, Human
guccuccucaccu

SEQ ID NO: 2678717 - RNA, 21 nt, Human
guccuccucaccucaugccca

SEQ ID NO: 2678718 - RNA, 15 nt, Human
guccuccucaccuca

SEQ ID NO: 2678719 - RNA, 17 nt, Human
guccuccucaccucaug

SEQ ID NO: 2678720 - RNA, 19 nt, Human
guccgugggacggugccca

SEQ ID NO: 2678721 - RNA, 17 nt, Human
gucccuuccccaugcuu

SEQ ID NO: 2678722 - RNA, 20 nt, Human
gucccuuccccaugcuuccu

SEQ ID NO: 2678723 - RNA, 12 nt, Human
aacaguuuugug

SEQ ID NO: 2678724 - RNA, 17 nt, Human
aacaguuuuguguaacu

SEQ ID NO: 2678725 - RNA, 17 nt, Human
aacauagccaaaaugug

SEQ ID NO: 2678726 - RNA, 17 nt, Human
guccucuuuaguuuuug

SEQ ID NO: 2678727 - RNA, 12 nt, Human
gucgaggcagga

SEQ ID NO: 2678728 - RNA, 16 nt, Human
gucgcucaugugugca

SEQ ID NO: 2678729 - RNA, 21 nt, Human
gucgcucaugugugcaacagg

SEQ ID NO: 2678730 - RNA, 11 nt, Human
gucgcuccugc

SEQ ID NO: 2678731 - RNA, 15 nt, Human
gucgcuccugcccac

SEQ ID NO: 2678732 - RNA, 17 nt, Human
gucuauaaaagaaacac

SEQ ID NO: 2678733 - RNA, 23 nt, Human
gucuauuuaaaaaaaaagucaga

SEQ ID NO: 2678734 - RNA, 11 nt, Human
aaauuucuuau

SEQ ID NO: 2678735 - RNA, 14 nt, Human
aaauuucuuaugug

SEQ ID NO: 2678736 - RNA, 15 nt, Human
aaauuucuuauguga

SEQ ID NO: 2678737 - RNA, 17 nt, Human
aaauuucuuaugugaca

SEQ ID NO: 2678738 - RNA, 20 nt, Human
aaauuucuuaugugacauua

SEQ ID NO: 2678739 - RNA, 16 nt, Human
aaauuugacuaauuuu

SEQ ID NO: 2678740 - RNA, 17 nt, Human
aaauuugacuaauuuua

SEQ ID NO: 2678741 - RNA, 18 nt, Human
aaauuugacuaauuuuac

SEQ ID NO: 2678742 - RNA, 20 nt, Human
aaauuugacuaauuuuacau

SEQ ID NO: 2678743 - RNA, 19 nt, Human
aacacaaacgggcucagca

SEQ ID NO: 2678744 - RNA, 13 nt, Human
aacacagccuggg

SEQ ID NO: 2678745 - RNA, 14 nt, Human
aacacagccugggc

SEQ ID NO: 2678746 - RNA, 15 nt, Human
aacacacacauauac

SEQ ID NO: 2678747 - RNA, 17 nt, Human
aacacacacauauacac

SEQ ID NO: 2678748 - RNA, 12 nt, Human
aacacaagcaaa

SEQ ID NO: 2678749 - RNA, 13 nt, Human
aacacaagcaaaa

SEQ ID NO: 2678750 - RNA, 16 nt, Human
aacacaagcaaaaaaa

SEQ ID NO: 2678751 - RNA, 16 nt, Human
aacacagccugggccc

SEQ ID NO: 2678752 - RNA, 16 nt, Human
guccaaccagaccugg

SEQ ID NO: 2678753 - RNA, 16 nt, Human
guccaaagaggcugcc

SEQ ID NO: 2678754 - RNA, 19 nt, Human
guccaaagaggcugccccu

SEQ ID NO: 2678755 - RNA, 17 nt, Human
guccaaacguccucuuu

SEQ ID NO: 2678756 - RNA, 16 nt, Human
aacuugaaugugucag

SEQ ID NO: 2678757 - RNA, 21 nt, Human
aacugucaggcugaaaacaau

SEQ ID NO: 2678758 - RNA, 13 nt, Human
aacuguauuugaa

SEQ ID NO: 2678759 - RNA, 20 nt, Human
aacuguauuugaaauaagaa

SEQ ID NO: 2678760 - RNA, 15 nt, Human
aacugucgugucaua

SEQ ID NO: 2678761 - RNA, 11 nt, Human
aacuguccugu

SEQ ID NO: 2678762 - RNA, 13 nt, Human
aacuguccugucc

SEQ ID NO: 2678763 - RNA, 14 nt, Human
aacuguccuguccu

SEQ ID NO: 2678764 - RNA, 16 nt, Human
aacuguccuguccugc

SEQ ID NO: 2678765 - RNA, 17 nt, Human
aacuguccuguccugcu

SEQ ID NO: 2678766 - RNA, 18 nt, Human
aacuguccuguccugcuc

SEQ ID NO: 2678767 - RNA, 20 nt, Human
aacugucgugucauacucga

SEQ ID NO: 2678768 - RNA, 14 nt, Human
aacuguguacuguu

SEQ ID NO: 2678769 - RNA, 16 nt, Human
aacugugauuucagga

SEQ ID NO: 2678770 - RNA, 22 nt, Human
aacugucucucuucucagagug

SEQ ID NO: 2678771 - RNA, 14 nt, Human
aacugucuuccuca

SEQ ID NO: 2678772 - RNA, 15 nt, Human
aacugucuuccucaa

SEQ ID NO: 2678773 - RNA, 16 nt, Human
aacugucuuccucaaa

SEQ ID NO: 2678774 - RNA, 17 nt, Human
gugauuaaagcuaagga

SEQ ID NO: 2678775 - RNA, 19 nt, Human
gugauuaaagcuaaggacc

SEQ ID NO: 2678776 - RNA, 21 nt, Human
gugauccucucaccucagccu

SEQ ID NO: 2678777 - RNA, 20 nt, Human
gugaucugcugcagagcagu

SEQ ID NO: 2678778 - RNA, 19 nt, Human
gugaucugcugcagagcag

SEQ ID NO: 2678779 - RNA, 14 nt, Human
gugauguuuguccu

SEQ ID NO: 2678780 - RNA, 23 nt, Human
gugcauuugugcuagaaauuuuc

SEQ ID NO: 2678781 - RNA, 13 nt, Human
gugcauuuuugua

SEQ ID NO: 2678782 - RNA, 15 nt, Human
gugcauuuuuguaaa

SEQ ID NO: 2678783 - RNA, 11 nt, Human
gugccaaagaa

SEQ ID NO: 2678784 - RNA, 14 nt, Human
gugccaaagaaagu

SEQ ID NO: 2678785 - RNA, 21 nt, Human
gugccaaagaaaguggucuua

SEQ ID NO: 2678786 - RNA, 15 nt, Human
aagaagagcuaucag

SEQ ID NO: 2678787 - RNA, 20 nt, Human
aagaagagcuaucaggagaa

SEQ ID NO: 2678788 - RNA, 13 nt, Human
aagaagacuuuuu

SEQ ID NO: 2678789 - RNA, 17 nt, Human
aagaaguucauguccaa

SEQ ID NO: 2678790 - RNA, 12 nt, Human
aagaagaugcuc

SEQ ID NO: 2678791 - RNA, 22 nt, Human
aagaagaugcuccagcaacaca

SEQ ID NO: 2678792 - RNA, 21 nt, Human
gugcucggagaagagcgcagu

SEQ ID NO: 2678793 - RNA, 20 nt, Human
gugccagaggaauccuggca

SEQ ID NO: 2678794 - RNA, 21 nt, Human
gugccagaggaauccuggcag

SEQ ID NO: 2678795 - RNA, 22 nt, Human
gugccagaggaauccuggcagc

SEQ ID NO: 2678796 - RNA, 18 nt, Human
aagaaaaagaaaaagaaa

SEQ ID NO: 2678797 - RNA, 13 nt, Human
aagaaaaagaaaa

SEQ ID NO: 2678798 - RNA, 19 nt, Human
aagaaaaaauauuuucccu

SEQ ID NO: 2678799 - RNA, 18 nt, Human
aagaaaaaugagccuggc

SEQ ID NO: 2678800 - RNA, 17 nt, Human
aagaaaaaugagccugg

SEQ ID NO: 2678801 - RNA, 15 nt, Human
aacuuuauaaaucca

SEQ ID NO: 2678802 - RNA, 19 nt, Human
aacuuuauaaauccaguga

SEQ ID NO: 2678803 - RNA, 22 nt, Human
gugagacccugucucaaaaaaa

SEQ ID NO: 2678804 - RNA, 22 nt, Human
gugacaguugcagcccuuguga

SEQ ID NO: 2678805 - RNA, 18 nt, Human
gugaaguuuuacugucua

SEQ ID NO: 2678806 - RNA, 23 nt, Human
gugaauaauacaguaucucaggg

SEQ ID NO: 2678807 - RNA, 17 nt, Human
aacuccacaucugccuu

SEQ ID NO: 2678808 - RNA, 18 nt, Human
aacuccacaucugccuua

SEQ ID NO: 2678809 - RNA, 14 nt, Human
aacuccacaucugc

SEQ ID NO: 2678810 - RNA, 15 nt, Human
aacuccacaucugcc

SEQ ID NO: 2678811 - RNA, 16 nt, Human
aacuccacaucugccu

SEQ ID NO: 2678812 - RNA, 15 nt, Human
aacugccaagaaauu

SEQ ID NO: 2678813 - RNA, 16 nt, Human
aacugcauuggcuuug

SEQ ID NO: 2678814 - RNA, 17 nt, Human
aacucuucucauuacuu

SEQ ID NO: 2678815 - RNA, 16 nt, Human
aacucuucucauuacu

SEQ ID NO: 2678816 - RNA, 13 nt, Human
aacucuucucauu

SEQ ID NO: 2678817 - RNA, 17 nt, Human
gucuuaagaaauguaua

SEQ ID NO: 2678818 - RNA, 21 nt, Human
gucuuaagaaauguauaaacu

SEQ ID NO: 2678819 - RNA, 13 nt, Human
gucuuaaggacaa

SEQ ID NO: 2678820 - RNA, 19 nt, Human
gucuuaaggacaaagugcc

SEQ ID NO: 2678821 - RNA, 11 nt, Human
gucuuucagua

SEQ ID NO: 2678822 - RNA, 15 nt, Human
gucuuucaguacuuu

SEQ ID NO: 2678823 - RNA, 16 nt, Human
gucuuucaguacuuuu

SEQ ID NO: 2678824 - RNA, 22 nt, Human
gucuuucaguacuuuuuuaaau

SEQ ID NO: 2678825 - RNA, 13 nt, Human
gucuuucauggcu

SEQ ID NO: 2678826 - RNA, 16 nt, Human
gucuuucauggcugcu

SEQ ID NO: 2678827 - RNA, 19 nt, Human
gucuuucauggcugcuguu

SEQ ID NO: 2678828 - RNA, 23 nt, Human
gucuuucauggcugcuguugcuu

SEQ ID NO: 2678829 - RNA, 17 nt, Human
gucucaaaaaaagaaaa

SEQ ID NO: 2678830 - RNA, 23 nt, Human
aacuauagcuugcagaacuguag

SEQ ID NO: 2678831 - RNA, 14 nt, Human
aacuaguguacauu

SEQ ID NO: 2678832 - RNA, 23 nt, Human
aacuagugggguuuccuggcacu

SEQ ID NO: 2678833 - RNA, 15 nt, Human
aacuaaaauuugaag

SEQ ID NO: 2678834 - RNA, 17 nt, Human
aacuagggaagauaaua

SEQ ID NO: 2678835 - RNA, 22 nt, Human
aaccuuaucuccacaaccucuu

SEQ ID NO: 2678836 - RNA, 15 nt, Human
aaccuucguccuuuu

SEQ ID NO: 2678837 - RNA, 16 nt, Human
gucuuucucaaagaaa

SEQ ID NO: 2678838 - RNA, 23 nt, Human
gucuuucucaaagaaauauuaag

SEQ ID NO: 2678839 - RNA, 20 nt, Human
gucuuucccauggggaggga

SEQ ID NO: 2678840 - RNA, 19 nt, Human
gucuuucccauggggaggg

SEQ ID NO: 2678841 - RNA, 21 nt, Human
aaccugggauucaggaaugug

SEQ ID NO: 2678842 - RNA, 20 nt, Human
aaccugggauucaggaaugu

SEQ ID NO: 2678843 - RNA, 17 nt, Human
aaccugggauucaggaa

SEQ ID NO: 2678844 - RNA, 14 nt, Human
aaccugggauucag

SEQ ID NO: 2678845 - RNA, 19 nt, Human
uaggcaaggcuaugugauu

SEQ ID NO: 2678846 - RNA, 17 nt, Human
uaggcaccuuuuacugu

SEQ ID NO: 2678847 - RNA, 18 nt, Human
uaggcaccuuuuacugug

SEQ ID NO: 2678848 - RNA, 20 nt, Human
uaggcauuugcugaauacag

SEQ ID NO: 2678849 - RNA, 16 nt, Human
uaggcauuugcugaau

SEQ ID NO: 2678850 - RNA, 19 nt, Human
uagggacuacccauagaca

SEQ ID NO: 2678851 - RNA, 20 nt, Human
uagggacuacccauagacau

SEQ ID NO: 2678852 - RNA, 19 nt, Human
uaggaccuuuccaccacag

SEQ ID NO: 2678853 - RNA, 21 nt, Human
uaggaccuuuccaccacagcc

SEQ ID NO: 2678854 - RNA, 22 nt, Human
uaggaccuuuccaccacagcca

SEQ ID NO: 2678855 - RNA, 13 nt, Human
uagcuaauuauuu

SEQ ID NO: 2678856 - RNA, 23 nt, Human
uaggagacuugccagagccgggc

SEQ ID NO: 2678857 - RNA, 23 nt, Human
uaggagcugccuuggcucagaca

SEQ ID NO: 2678858 - RNA, 18 nt, Human
uaggagcugccuuggcuc

SEQ ID NO: 2678859 - RNA, 17 nt, Human
uaggagaaccaaaucug

SEQ ID NO: 2678860 - RNA, 20 nt, Human
uaggagaaccaaaucuggaa

SEQ ID NO: 2678861 - RNA, 17 nt, Human
uaggagacuugccagag

SEQ ID NO: 2678862 - RNA, 20 nt, Human
uaggagacuugccagagccg

SEQ ID NO: 2678863 - RNA, 15 nt, Human
acaauaaacccucag

SEQ ID NO: 2678864 - RNA, 20 nt, Human
acaauaaacccucagagccu

SEQ ID NO: 2678865 - RNA, 19 nt, Human
acaauccacgcuucuccgg

SEQ ID NO: 2678866 - RNA, 22 nt, Human
acaauccacgcuucuccggauc

SEQ ID NO: 2678867 - RNA, 18 nt, Human
uacuggauuuguuguucu

SEQ ID NO: 2678868 - RNA, 23 nt, Human
aauuguuccuuggagaaaugaaa

SEQ ID NO: 2678869 - RNA, 13 nt, Human
aauuguucucaga

SEQ ID NO: 2678870 - RNA, 11 nt, Human
acaaaagcaau

SEQ ID NO: 2678871 - RNA, 22 nt, Human
uagauauguauucuuuucucag

SEQ ID NO: 2678872 - RNA, 22 nt, Human
uagauauugaggccaagaauau

SEQ ID NO: 2678873 - RNA, 14 nt, Human
uagaugauguauuu

SEQ ID NO: 2678874 - RNA, 23 nt, Human
uagauaucgacuuguuuuugcac

SEQ ID NO: 2678875 - RNA, 20 nt, Human
uagauaucaugcaaauuuca

SEQ ID NO: 2678876 - RNA, 18 nt, Human
uagaggcccuuugcuguc

SEQ ID NO: 2678877 - RNA, 12 nt, Human
uagcauguaaug

SEQ ID NO: 2678878 - RNA, 16 nt, Human
uagcauuuugcuaaau

SEQ ID NO: 2678879 - RNA, 22 nt, Human
uagcauuuugcuaaaugugaau

SEQ ID NO: 2678880 - RNA, 17 nt, Human
acaacaaaaagcuuccc

SEQ ID NO: 2678881 - RNA, 15 nt, Human
uagccagauuugucu

SEQ ID NO: 2678882 - RNA, 18 nt, Human
uagccagauuugucuuuu

SEQ ID NO: 2678883 - RNA, 13 nt, Human
uagccaaaaugug

SEQ ID NO: 2678884 - RNA, 21 nt, Human
uagccaaugucuccuccccuu

SEQ ID NO: 2678885 - RNA, 13 nt, Human
uagugaaacuuuu

SEQ ID NO: 2678886 - RNA, 14 nt, Human
uagugaaacuuuuc

SEQ ID NO: 2678887 - RNA, 19 nt, Human
uagugaaacuuuucuagaa

SEQ ID NO: 2678888 - RNA, 20 nt, Human
uagugaaaauuguuuaguga

SEQ ID NO: 2678889 - RNA, 23 nt, Human
uagucccagcuacuugggaggcu

SEQ ID NO: 2678890 - RNA, 16 nt, Human
uagucccugccacgaa

SEQ ID NO: 2678891 - RNA, 16 nt, Human
acacauacaugucaca

SEQ ID NO: 2678892 - RNA, 23 nt, Human
uaguguuuuuuuauuucuacugu

SEQ ID NO: 2678893 - RNA, 23 nt, Human
acacaguuuugaccuaacauacc

SEQ ID NO: 2678894 - RNA, 14 nt, Human
acacacacauauac

SEQ ID NO: 2678895 - RNA, 22 nt, Human
acaauguccuaacugaaagaug

SEQ ID NO: 2678896 - RNA, 19 nt, Human
acaaugugaaaagaaaaau

SEQ ID NO: 2678897 - RNA, 17 nt, Human
acaaugugaaaagaaaa

SEQ ID NO: 2678898 - RNA, 18 nt, Human
acaauggacccuuuuugu

SEQ ID NO: 2678899 - RNA, 15 nt, Human
acaauggaguauucu

SEQ ID NO: 2678900 - RNA, 15 nt, Human
acacucaaaagcugg

SEQ ID NO: 2678901 - RNA, 18 nt, Human
acacgaauagacaucaaa

SEQ ID NO: 2678902 - RNA, 16 nt, Human
acacuaacgaaauauc

SEQ ID NO: 2678903 - RNA, 17 nt, Human
acacuaacgaaauauca

SEQ ID NO: 2678904 - RNA, 21 nt, Human
acacuaacgaaauaucaaagu

SEQ ID NO: 2678905 - RNA, 17 nt, Human
acacuaacucaccagcc

SEQ ID NO: 2678906 - RNA, 19 nt, Human
acacuaacucaccagcccc

SEQ ID NO: 2678907 - RNA, 20 nt, Human
acacuaacucaccagcccca

SEQ ID NO: 2678908 - RNA, 22 nt, Human
acaccuuggacauccuccuccc

SEQ ID NO: 2678909 - RNA, 20 nt, Human
acaccuuggacauccuccuc

SEQ ID NO: 2678910 - RNA, 12 nt, Human
acaccuucuaua

SEQ ID NO: 2678911 - RNA, 23 nt, Human
acaccuuggacauccuccuccca

SEQ ID NO: 2678912 - RNA, 19 nt, Human
acaccuggcugagguuccu

SEQ ID NO: 2678913 - RNA, 20 nt, Human
acaccuguagcacuuacugg

SEQ ID NO: 2678914 - RNA, 23 nt, Human
acaccuggcugagguuccucugc

SEQ ID NO: 2678915 - RNA, 21 nt, Human
acaccucugcacaagcugcac

SEQ ID NO: 2678916 - RNA, 19 nt, Human
acaccucugcacaagcugc

SEQ ID NO: 2678917 - RNA, 18 nt, Human
acacccucaaccucuucu

SEQ ID NO: 2678918 - RNA, 17 nt, Human
acacccucaaccucuuc

SEQ ID NO: 2678919 - RNA, 13 nt, Human
acacccaaagcug

SEQ ID NO: 2678920 - RNA, 20 nt, Human
uauaaaaaccccaaacuguu

SEQ ID NO: 2678921 - RNA, 17 nt, Human
acacauagcauguaaug

SEQ ID NO: 2678922 - RNA, 15 nt, Human
acacauauacacgaa

SEQ ID NO: 2678923 - RNA, 16 nt, Human
acacauauauauuaca

SEQ ID NO: 2678924 - RNA, 20 nt, Human
uaguuaaauguuaccucuga

SEQ ID NO: 2678925 - RNA, 14 nt, Human
uauccaguuacugc

SEQ ID NO: 2678926 - RNA, 14 nt, Human
uauccagaaaacug

SEQ ID NO: 2678927 - RNA, 17 nt, Human
uauccagaaaacuguga

SEQ ID NO: 2678928 - RNA, 14 nt, Human
uauccgcugccagc

SEQ ID NO: 2678929 - RNA, 16 nt, Human
uaucccuuccagaugg

SEQ ID NO: 2678930 - RNA, 19 nt, Human
uaucaaauuaauuguguga

SEQ ID NO: 2678931 - RNA, 21 nt, Human
uaucaaauuaauugugugaac

SEQ ID NO: 2678932 - RNA, 20 nt, Human
uaucaaauuaauugugugaa

SEQ ID NO: 2678933 - RNA, 19 nt, Human
uaucaacuuagucaauaag

SEQ ID NO: 2678934 - RNA, 20 nt, Human
uaucauuuucuuuuuuaacc

SEQ ID NO: 2678935 - RNA, 19 nt, Human
uaucuauuaauauauguau

SEQ ID NO: 2678936 - RNA, 16 nt, Human
uaucuauucugagaaa

SEQ ID NO: 2678937 - RNA, 18 nt, Human
uaucuauuaauauaugua

SEQ ID NO: 2678938 - RNA, 17 nt, Human
uaucuauuaauauaugu

SEQ ID NO: 2678939 - RNA, 15 nt, Human
uaucuauuaauauau

SEQ ID NO: 2678940 - RNA, 13 nt, Human
uaucuauuaauau

SEQ ID NO: 2678941 - RNA, 12 nt, Human
uaucuauuaaua

SEQ ID NO: 2678942 - RNA, 16 nt, Human
uaucuaucuauuugag

SEQ ID NO: 2678943 - RNA, 17 nt, Human
uaucuaucuauuugagg

SEQ ID NO: 2678944 - RNA, 23 nt, Human
uaucuauucugagaaaacaagca

SEQ ID NO: 2678945 - RNA, 12 nt, Human
uaucuauuugag

SEQ ID NO: 2678946 - RNA, 18 nt, Human
uaucuauucugagaaaac

SEQ ID NO: 2678947 - RNA, 19 nt, Human
uaucuauucugagaaaaca

SEQ ID NO: 2678948 - RNA, 23 nt, Human
uauauugguuuuaugaugacgua

SEQ ID NO: 2678949 - RNA, 12 nt, Human
uauauuguaauu

SEQ ID NO: 2678950 - RNA, 14 nt, Human
uauauuguaauuua

SEQ ID NO: 2678951 - RNA, 18 nt, Human
acagaccccucgcaacug

SEQ ID NO: 2678952 - RNA, 16 nt, Human
uauauuaguauguaug

SEQ ID NO: 2678953 - RNA, 16 nt, Human
uauauuacugacauuu

SEQ ID NO: 2678954 - RNA, 23 nt, Human
uauauuacugacauuucuucuag

SEQ ID NO: 2678955 - RNA, 13 nt, Human
uauauuacaauga

SEQ ID NO: 2678956 - RNA, 12 nt, Human
uauauuacaaug

SEQ ID NO: 2678957 - RNA, 17 nt, Human
uauauuacaaugaucac

SEQ ID NO: 2678958 - RNA, 11 nt, Human
uauauuacaag

SEQ ID NO: 2678959 - RNA, 14 nt, Human
uauacaaaauaaga

SEQ ID NO: 2678960 - RNA, 22 nt, Human
uauacaaaccuaccaaaaugga

SEQ ID NO: 2678961 - RNA, 21 nt, Human
uauacaaaauaagaacgagga

SEQ ID NO: 2678962 - RNA, 12 nt, Human
uauaauaaaaau

SEQ ID NO: 2678963 - RNA, 13 nt, Human
uauaauaaaaaua

SEQ ID NO: 2678964 - RNA, 14 nt, Human
uauaauaaaaauau

SEQ ID NO: 2678965 - RNA, 18 nt, Human
uauaauaaaaauauauuu

SEQ ID NO: 2678966 - RNA, 13 nt, Human
acagccucuuuuu

SEQ ID NO: 2678967 - RNA, 22 nt, Human
uauggguuagauguugccaugu

SEQ ID NO: 2678968 - RNA, 17 nt, Human
uaugaacauacaaaugc

SEQ ID NO: 2678969 - RNA, 17 nt, Human
acagaugaauguauuua

SEQ ID NO: 2678970 - RNA, 14 nt, Human
acagaugaauguau

SEQ ID NO: 2678971 - RNA, 19 nt, Human
acagauugccuguuucuga

SEQ ID NO: 2678972 - RNA, 19 nt, Human
acaguacccugguugugug

SEQ ID NO: 2678973 - RNA, 14 nt, Human
acaguagagccagc

SEQ ID NO: 2678974 - RNA, 15 nt, Human
acaguagagccagcu

SEQ ID NO: 2678975 - RNA, 20 nt, Human
acaguacccugguugugugu

SEQ ID NO: 2678976 - RNA, 13 nt, Human
acaguagaacugu

SEQ ID NO: 2678977 - RNA, 18 nt, Human
acaguagaacugucugug

SEQ ID NO: 2678978 - RNA, 19 nt, Human
acaguagaacugucuguga

SEQ ID NO: 2678979 - RNA, 13 nt, Human
acaguagagccag

SEQ ID NO: 2678980 - RNA, 15 nt, Human
acaguaagauaucuc

SEQ ID NO: 2678981 - RNA, 18 nt, Human
acagggauaaggccugug

SEQ ID NO: 2678982 - RNA, 22 nt, Human
acagggauaaggccuguggggg

SEQ ID NO: 2678983 - RNA, 23 nt, Human
acaguaguuagaauuauaucacu

SEQ ID NO: 2678984 - RNA, 16 nt, Human
acaguagagccagcuu

SEQ ID NO: 2678985 - RNA, 16 nt, Human
uauuaaaauauuucag

SEQ ID NO: 2678986 - RNA, 17 nt, Human
uauuaaaauauuucagg

SEQ ID NO: 2678987 - RNA, 15 nt, Human
uauuacuguuuauua

SEQ ID NO: 2678988 - RNA, 13 nt, Human
uauuacuuccaug

SEQ ID NO: 2678989 - RNA, 14 nt, Human
uauuacuuccauga

SEQ ID NO: 2678990 - RNA, 15 nt, Human
uauuacuuccaugaa

SEQ ID NO: 2678991 - RNA, 18 nt, Human
uauuacuuccaugaauuu

SEQ ID NO: 2678992 - RNA, 19 nt, Human
uauuacuuccaugaauuuu

SEQ ID NO: 2678993 - RNA, 16 nt, Human
uauuacugacauuucu

SEQ ID NO: 2678994 - RNA, 17 nt, Human
uauuacugacauuucuu

SEQ ID NO: 2678995 - RNA, 18 nt, Human
uauuacugacauuucuuc

SEQ ID NO: 2678996 - RNA, 19 nt, Human
uauuaggaaguguuuaugu

SEQ ID NO: 2678997 - RNA, 15 nt, Human
uauuagguugucacg

SEQ ID NO: 2678998 - RNA, 15 nt, Human
uauuagaaaggcucu

SEQ ID NO: 2678999 - RNA, 16 nt, Human
uauucaauucuuuuaa

SEQ ID NO: 2679000 - RNA, 20 nt, Human
acagcuuucaugauuagcaa

SEQ ID NO: 2679001 - RNA, 14 nt, Human
acagcgucccuggc

SEQ ID NO: 2679002 - RNA, 15 nt, Human
acagcgucccuggcg

SEQ ID NO: 2679003 - RNA, 17 nt, Human
acagcgucccuggcgca

SEQ ID NO: 2679004 - RNA, 13 nt, Human
acaggaggcaggc

SEQ ID NO: 2679005 - RNA, 21 nt, Human
acaggaggcaggcauggcccu

SEQ ID NO: 2679006 - RNA, 14 nt, Human
acaggaaccuuaag

SEQ ID NO: 2679007 - RNA, 19 nt, Human
acaggcaugugucaccaug

SEQ ID NO: 2679008 - RNA, 16 nt, Human
acaggcaugugucacc

SEQ ID NO: 2679009 - RNA, 18 nt, Human
uaugugggauauugaaug

SEQ ID NO: 2679010 - RNA, 19 nt, Human
uaugugggauauugaaugu

SEQ ID NO: 2679011 - RNA, 21 nt, Human
uaugugggauauugaauguua

SEQ ID NO: 2679012 - RNA, 20 nt, Human
uauguguaugcacaguaaaa

SEQ ID NO: 2679013 - RNA, 17 nt, Human
uauuaaaaaagagacau

SEQ ID NO: 2679014 - RNA, 23 nt, Human
uauuaaaaaagagacauccaaau

SEQ ID NO: 2679015 - RNA, 13 nt, Human
uauguuuuucugu

SEQ ID NO: 2679016 - RNA, 15 nt, Human
uauguuuuucugugu

SEQ ID NO: 2679017 - RNA, 22 nt, Human
uauguuuuucugugugucaguu

SEQ ID NO: 2679018 - RNA, 17 nt, Human
uauguuuuuuaaaauau

SEQ ID NO: 2679019 - RNA, 19 nt, Human
uaugugacaauuuuguaca

SEQ ID NO: 2679020 - RNA, 12 nt, Human
uaugugaauuuu

SEQ ID NO: 2679021 - RNA, 18 nt, Human
uaugugaauuuuuaagcu

SEQ ID NO: 2679022 - RNA, 14 nt, Human
uaugugacauuaac

SEQ ID NO: 2679023 - RNA, 22 nt, Human
acaggcaugaggaaucugggag

SEQ ID NO: 2679024 - RNA, 21 nt, Human
aauuccuauauccugugacug

SEQ ID NO: 2679025 - RNA, 22 nt, Human
uacgccaggggaaaaucagccu

SEQ ID NO: 2679026 - RNA, 20 nt, Human
uacgauuuaagguauuuaaa

SEQ ID NO: 2679027 - RNA, 17 nt, Human
uacuauccaguuacugc

SEQ ID NO: 2679028 - RNA, 15 nt, Human
uacuaaaaaguauaa

SEQ ID NO: 2679029 - RNA, 16 nt, Human
uacuaaaaaguauaaa

SEQ ID NO: 2679030 - RNA, 18 nt, Human
uacuaaaaaguauaaaau

SEQ ID NO: 2679031 - RNA, 11 nt, Human
uacguuucuuu

SEQ ID NO: 2679032 - RNA, 13 nt, Human
uacguuucuuuaa

SEQ ID NO: 2679033 - RNA, 23 nt, Human
uacguuucuuuaaccuuguauaa

SEQ ID NO: 2679034 - RNA, 12 nt, Human
uacuacuuuguu

SEQ ID NO: 2679035 - RNA, 19 nt, Human
uacuacuuuguuaggauuu

SEQ ID NO: 2679036 - RNA, 22 nt, Human
uacuacuuuguuaggauuuuca

SEQ ID NO: 2679037 - RNA, 23 nt, Human
uacuacuuuguuaggauuuucac

SEQ ID NO: 2679038 - RNA, 20 nt, Human
uacuacuuuugcaugaaaau

SEQ ID NO: 2679039 - RNA, 18 nt, Human
uacuggcuuaccuccuca

SEQ ID NO: 2679040 - RNA, 18 nt, Human
aauugaguugcacuuauu

SEQ ID NO: 2679041 - RNA, 12 nt, Human
aauugccagcug

SEQ ID NO: 2679042 - RNA, 21 nt, Human
uacucuccuugaguguaugag

SEQ ID NO: 2679043 - RNA, 23 nt, Human
aauuaggcaaggcuaugugauua

SEQ ID NO: 2679044 - RNA, 20 nt, Human
aauuaggcaaggcuauguga

SEQ ID NO: 2679045 - RNA, 20 nt, Human
aauuaggaauaaauaaaaau

SEQ ID NO: 2679046 - RNA, 15 nt, Human
aauuacugccuugaa

SEQ ID NO: 2679047 - RNA, 16 nt, Human
aauuacugccuugaaa

SEQ ID NO: 2679048 - RNA, 15 nt, Human
aauuagccaagugug

SEQ ID NO: 2679049 - RNA, 14 nt, Human
aauuagccgggcgu

SEQ ID NO: 2679050 - RNA, 14 nt, Human
aauuacgugcucug

SEQ ID NO: 2679051 - RNA, 22 nt, Human
aauuaauugugugaacuuggaa

SEQ ID NO: 2679052 - RNA, 14 nt, Human
aauuacaauuuuau

SEQ ID NO: 2679053 - RNA, 15 nt, Human
aauuacaauuuuauc

SEQ ID NO: 2679054 - RNA, 19 nt, Human
aauuacaauuuuaucuguu

SEQ ID NO: 2679055 - RNA, 12 nt, Human
uaccuguauaca

SEQ ID NO: 2679056 - RNA, 20 nt, Human
uaccuguauacagugcagag

SEQ ID NO: 2679057 - RNA, 18 nt, Human
uaccuguauuuaaaaaua

SEQ ID NO: 2679058 - RNA, 21 nt, Human
uaccuguauuuaaaaauagaa

SEQ ID NO: 2679059 - RNA, 22 nt, Human
uaccuguauuuaaaaauagaaa

SEQ ID NO: 2679060 - RNA, 20 nt, Human
uaccacucgugcaucccuga

SEQ ID NO: 2679061 - RNA, 14 nt, Human
aauuccccacccug

SEQ ID NO: 2679062 - RNA, 23 nt, Human
aauucacucccacacccaagaag

SEQ ID NO: 2679063 - RNA, 12 nt, Human
aauucauuucua

SEQ ID NO: 2679064 - RNA, 13 nt, Human
aauucauuucuaa

SEQ ID NO: 2679065 - RNA, 13 nt, Human
aauucacucccac

SEQ ID NO: 2679066 - RNA, 13 nt, Human
aauuaguaacauu

SEQ ID NO: 2679067 - RNA, 20 nt, Human
aauucaaacuggggccucca

SEQ ID NO: 2679068 - RNA, 13 nt, Human
aauuauugacacu

SEQ ID NO: 2679069 - RNA, 14 nt, Human
aauuauugacacug

SEQ ID NO: 2679070 - RNA, 15 nt, Human
aauuauugacacuga

SEQ ID NO: 2679071 - RNA, 16 nt, Human
aauuauugacacugaa

SEQ ID NO: 2679072 - RNA, 17 nt, Human
aauuauugacacugaac

SEQ ID NO: 2679073 - RNA, 19 nt, Human
aauuauugacacugaacuu

SEQ ID NO: 2679074 - RNA, 19 nt, Human
aauggaaaguaacucauuu

SEQ ID NO: 2679075 - RNA, 20 nt, Human
aaugccauuuauuuauugau

SEQ ID NO: 2679076 - RNA, 18 nt, Human
aaugccauuuuaaggaaa

SEQ ID NO: 2679077 - RNA, 20 nt, Human
aaugccauuuuaaggaaaac

SEQ ID NO: 2679078 - RNA, 22 nt, Human
aaugccauuuuaaggaaaacua

SEQ ID NO: 2679079 - RNA, 19 nt, Human
aaugccauuuauuuauuga

SEQ ID NO: 2679080 - RNA, 17 nt, Human
aaugccaucuaucuagu

SEQ ID NO: 2679081 - RNA, 22 nt, Human
aaugccacugccuucgcuucuu

SEQ ID NO: 2679082 - RNA, 12 nt, Human
aaugacaauauu

SEQ ID NO: 2679083 - RNA, 15 nt, Human
aauggaaauuuugcu

SEQ ID NO: 2679084 - RNA, 16 nt, Human
aauggaaauuuugcua

SEQ ID NO: 2679085 - RNA, 17 nt, Human
aauggaaauuuugcuau

SEQ ID NO: 2679086 - RNA, 15 nt, Human
aauggauuucagaag

SEQ ID NO: 2679087 - RNA, 19 nt, Human
aauggcgugaacccgggag

SEQ ID NO: 2679088 - RNA, 20 nt, Human
aauggccucauguggcugga

SEQ ID NO: 2679089 - RNA, 22 nt, Human
aauggccucauguggcuggaag

SEQ ID NO: 2679090 - RNA, 15 nt, Human
aauggccucaugugg

SEQ ID NO: 2679091 - RNA, 19 nt, Human
uacacguuagauuugccgu

SEQ ID NO: 2679092 - RNA, 16 nt, Human
uacagagguauuaaaa

SEQ ID NO: 2679093 - RNA, 19 nt, Human
aaugugaaaagaaaaauga

SEQ ID NO: 2679094 - RNA, 21 nt, Human
aauguauaaacuuuagaguag

SEQ ID NO: 2679095 - RNA, 13 nt, Human
aauguauaaauau

SEQ ID NO: 2679096 - RNA, 14 nt, Human
aauguauaaauaua

SEQ ID NO: 2679097 - RNA, 15 nt, Human
aauguauaaauauac

SEQ ID NO: 2679098 - RNA, 16 nt, Human
aauguauaaauauaca

SEQ ID NO: 2679099 - RNA, 11 nt, Human
uacauauauau

SEQ ID NO: 2679100 - RNA, 18 nt, Human
uacauauauauauauaac

SEQ ID NO: 2679101 - RNA, 16 nt, Human
uacauaucccuuccag

SEQ ID NO: 2679102 - RNA, 19 nt, Human
uacauaucccuuccagaug

SEQ ID NO: 2679103 - RNA, 16 nt, Human
uacauauggauguuac

SEQ ID NO: 2679104 - RNA, 17 nt, Human
uacauauggauguuacu

SEQ ID NO: 2679105 - RNA, 18 nt, Human
uacauauggauguuacuc

SEQ ID NO: 2679106 - RNA, 19 nt, Human
uacauauggauguuacucu

SEQ ID NO: 2679107 - RNA, 20 nt, Human
uacauauggauguuacucuc

SEQ ID NO: 2679108 - RNA, 22 nt, Human
uacagaugaauguauuuauuug

SEQ ID NO: 2679109 - RNA, 18 nt, Human
uacagaugaauguauuua

SEQ ID NO: 2679110 - RNA, 13 nt, Human
uacauguuuauaa

SEQ ID NO: 2679111 - RNA, 15 nt, Human
aauuaauugugugaa

SEQ ID NO: 2679112 - RNA, 15 nt, Human
uacaugugauacauu

SEQ ID NO: 2679113 - RNA, 16 nt, Human
uacaugugauacauuu

SEQ ID NO: 2679114 - RNA, 17 nt, Human
uacaugugauacauuuu

SEQ ID NO: 2679115 - RNA, 18 nt, Human
uacaugugauacauuuuu

SEQ ID NO: 2679116 - RNA, 19 nt, Human
uacaugugauacauuuuuu

SEQ ID NO: 2679117 - RNA, 13 nt, Human
aauuaauugugug

SEQ ID NO: 2679118 - RNA, 13 nt, Human
aauguuaaaggga

SEQ ID NO: 2679119 - RNA, 18 nt, Human
aauguuaaagggauauuu

SEQ ID NO: 2679120 - RNA, 12 nt, Human
aauguguucucg

SEQ ID NO: 2679121 - RNA, 19 nt, Human
aauguguucucggagugug

SEQ ID NO: 2679122 - RNA, 22 nt, Human
aauguguucucggaguguguau

SEQ ID NO: 2679123 - RNA, 14 nt, Human
aauuaacugaaaca

SEQ ID NO: 2679124 - RNA, 21 nt, Human
aauguuaauggauuucagaag

SEQ ID NO: 2679125 - RNA, 21 nt, Human
aauguucucucuucuccaccu

SEQ ID NO: 2679126 - RNA, 22 nt, Human
aauccuuuguuuucugacuaau

SEQ ID NO: 2679127 - RNA, 23 nt, Human
aauccuuuguuuucugacuaauu

SEQ ID NO: 2679128 - RNA, 14 nt, Human
aauccuuuggaaaa

SEQ ID NO: 2679129 - RNA, 21 nt, Human
aaucgagugccgcaucucaca

SEQ ID NO: 2679130 - RNA, 20 nt, Human
aaucuaagcagcuuauuguu

SEQ ID NO: 2679131 - RNA, 21 nt, Human
aaucuaagcagcuuauuguuu

SEQ ID NO: 2679132 - RNA, 16 nt, Human
aauccuggcagcccag

SEQ ID NO: 2679133 - RNA, 15 nt, Human
uaaguaaucaucuaa

SEQ ID NO: 2679134 - RNA, 18 nt, Human
aaucccuuaacaguugua

SEQ ID NO: 2679135 - RNA, 22 nt, Human
aaucccuuaacaguuguauuua

SEQ ID NO: 2679136 - RNA, 13 nt, Human
aaucauucagaaa

SEQ ID NO: 2679137 - RNA, 14 nt, Human
aaucauucagaaau

SEQ ID NO: 2679138 - RNA, 15 nt, Human
aaucauucagaaaug

SEQ ID NO: 2679139 - RNA, 16 nt, Human
aaucauucagaaaugu

SEQ ID NO: 2679140 - RNA, 19 nt, Human
aaucccuuuauuacccccu

SEQ ID NO: 2679141 - RNA, 23 nt, Human
aaucccuuuauuacccccuccuu

SEQ ID NO: 2679142 - RNA, 20 nt, Human
aaucuuacuuuguaaauucu

SEQ ID NO: 2679143 - RNA, 19 nt, Human
aaucuuacuuuguaaauuc

SEQ ID NO: 2679144 - RNA, 18 nt, Human
aaucuuacuuuguaaauu

SEQ ID NO: 2679145 - RNA, 17 nt, Human
aaucuuacuuuguaaau

SEQ ID NO: 2679146 - RNA, 16 nt, Human
aaucuuacuuuguaaa

SEQ ID NO: 2679147 - RNA, 15 nt, Human
aaucuuacuuuguaa

SEQ ID NO: 2679148 - RNA, 14 nt, Human
aaucuuacuuugua

SEQ ID NO: 2679149 - RNA, 13 nt, Human
aaucuuacuuugu

SEQ ID NO: 2679150 - RNA, 13 nt, Human
aaucuuaauguuc

SEQ ID NO: 2679151 - RNA, 14 nt, Human
aaucuuaauguucc

SEQ ID NO: 2679152 - RNA, 15 nt, Human
aaucuuaauguuccu

SEQ ID NO: 2679153 - RNA, 19 nt, Human
aaucuguugauaaauccau

SEQ ID NO: 2679154 - RNA, 21 nt, Human
aaucuguugauaaauccauca

SEQ ID NO: 2679155 - RNA, 20 nt, Human
aaucuacaaucucuuuuugu

SEQ ID NO: 2679156 - RNA, 15 nt, Human
aaucuggagaccagg

SEQ ID NO: 2679157 - RNA, 22 nt, Human
uaagcuguuccuguucaguaau

SEQ ID NO: 2679158 - RNA, 18 nt, Human
uaaggaaaacuaccugua

SEQ ID NO: 2679159 - RNA, 22 nt, Human
uaaggaaaacuaccuguauuua

SEQ ID NO: 2679160 - RNA, 17 nt, Human
uaagcuucaguugcuug

SEQ ID NO: 2679161 - RNA, 16 nt, Human
uaagcuuccauuuuaa

SEQ ID NO: 2679162 - RNA, 23 nt, Human
uaagcuuccauuuuaauuuuaaa

SEQ ID NO: 2679163 - RNA, 12 nt, Human
uaaguucuuaug

SEQ ID NO: 2679164 - RNA, 21 nt, Human
uaaguucuuaugaggagggga

SEQ ID NO: 2679165 - RNA, 19 nt, Human
aaucaugaaucuuuguuuc

SEQ ID NO: 2679166 - RNA, 22 nt, Human
aaucauaguacucuuuguagca

SEQ ID NO: 2679167 - RNA, 15 nt, Human
aaucauaguuacugu

SEQ ID NO: 2679168 - RNA, 16 nt, Human
aaucauaguuacugug

SEQ ID NO: 2679169 - RNA, 17 nt, Human
aaucauaguuacugugu

SEQ ID NO: 2679170 - RNA, 19 nt, Human
aaucauaguuacuguguaa

SEQ ID NO: 2679171 - RNA, 22 nt, Human
aaucauaguuacuguguaaacu

SEQ ID NO: 2679172 - RNA, 19 nt, Human
aaucauaguacucuuugua

SEQ ID NO: 2679173 - RNA, 22 nt, Human
aaucauaggcaccuuuuacugu

SEQ ID NO: 2679174 - RNA, 23 nt, Human
aaucauaggcaccuuuuacugug

SEQ ID NO: 2679175 - RNA, 21 nt, Human
uaauagcaacuuuuguguaau

SEQ ID NO: 2679176 - RNA, 20 nt, Human
uaauagcaacuuuuguguaa

SEQ ID NO: 2679177 - RNA, 21 nt, Human
uaauauuuaacauuauuuaua

SEQ ID NO: 2679178 - RNA, 13 nt, Human
uaauauuuaacau

SEQ ID NO: 2679179 - RNA, 13 nt, Human
uaauauuuauuaa

SEQ ID NO: 2679180 - RNA, 17 nt, Human
uaauauuuauuaaauuu

SEQ ID NO: 2679181 - RNA, 16 nt, Human
uaauauuuauuaaauu

SEQ ID NO: 2679182 - RNA, 14 nt, Human
uaauauuuaaugga

SEQ ID NO: 2679183 - RNA, 22 nt, Human
uaauagacuguaacuuccaaau

SEQ ID NO: 2679184 - RNA, 18 nt, Human
uaaugaaaaugaauaucu

SEQ ID NO: 2679185 - RNA, 21 nt, Human
uaaucacuguguauauuugau

SEQ ID NO: 2679186 - RNA, 20 nt, Human
uaaucacuguguauauuuga

SEQ ID NO: 2679187 - RNA, 22 nt, Human
uaaucacuguguauauuugauu

SEQ ID NO: 2679188 - RNA, 16 nt, Human
uaaucacuguguauau

SEQ ID NO: 2679189 - RNA, 15 nt, Human
uaaucacuguguaua

SEQ ID NO: 2679190 - RNA, 14 nt, Human
uaaucacuguguau

SEQ ID NO: 2679191 - RNA, 13 nt, Human
uaaucacugugua

SEQ ID NO: 2679192 - RNA, 12 nt, Human
uaaucacugugu

SEQ ID NO: 2679193 - RNA, 10 nt, Human
uaaucacugu

SEQ ID NO: 2679194 - RNA, 19 nt, Human
uaauccaguuauaagaaga

SEQ ID NO: 2679195 - RNA, 23 nt, Human
uaauccaguuauaagaagaaguu

SEQ ID NO: 2679196 - RNA, 21 nt, Human
uaaucccagcacuuugggagg

SEQ ID NO: 2679197 - RNA, 23 nt, Human
uaaucccagcacuuugggaggcc

SEQ ID NO: 2679198 - RNA, 15 nt, Human
aaucuuuaccuguau

SEQ ID NO: 2679199 - RNA, 18 nt, Human
aaucuuuaccuguauaca

SEQ ID NO: 2679200 - RNA, 20 nt, Human
aaucuuuaccuguauacagu

SEQ ID NO: 2679201 - RNA, 22 nt, Human
aaucuuuaccuguauacagugc

SEQ ID NO: 2679202 - RNA, 23 nt, Human
aaucuuuaccuguauacagugca

SEQ ID NO: 2679203 - RNA, 15 nt, Human
uaauguguggauugc

SEQ ID NO: 2679204 - RNA, 23 nt, Human
uaauguguggauugccucugaaa

SEQ ID NO: 2679205 - RNA, 13 nt, Human
aaugaaagaaaau

SEQ ID NO: 2679206 - RNA, 16 nt, Human
aaugaaagaaaauuga

SEQ ID NO: 2679207 - RNA, 19 nt, Human
aaugaaagaaaauugaguu

SEQ ID NO: 2679208 - RNA, 17 nt, Human
aaugaauuuuuaugaua

SEQ ID NO: 2679209 - RNA, 17 nt, Human
aaugaaaauuguauuau

SEQ ID NO: 2679210 - RNA, 13 nt, Human
aaugaaaauugua

SEQ ID NO: 2679211 - RNA, 14 nt, Human
aaugaaaauuguau

SEQ ID NO: 2679212 - RNA, 21 nt, Human
aauauuuaacauuauuuauau

SEQ ID NO: 2679213 - RNA, 19 nt, Human
aauauugagaaagaaacua

SEQ ID NO: 2679214 - RNA, 16 nt, Human
aauauugagaaagaaa

SEQ ID NO: 2679215 - RNA, 20 nt, Human
aauauugagaaagaaacuaa

SEQ ID NO: 2679216 - RNA, 23 nt, Human
aauaugccugcaaucugagccag

SEQ ID NO: 2679217 - RNA, 20 nt, Human
aauauucaggguaaauagga

SEQ ID NO: 2679218 - RNA, 20 nt, Human
aauaugccuaguaacacaua

SEQ ID NO: 2679219 - RNA, 20 nt, Human
aauauuccuuugcauauuau

SEQ ID NO: 2679220 - RNA, 21 nt, Human
aauauuccuuugcauauuaua

SEQ ID NO: 2679221 - RNA, 16 nt, Human
aauauuccagaucuuu

SEQ ID NO: 2679222 - RNA, 18 nt, Human
aauauuccagaucuuuca

SEQ ID NO: 2679223 - RNA, 22 nt, Human
aauauuccagaucuuucagaaa

SEQ ID NO: 2679224 - RNA, 23 nt, Human
aauauuccagaucuuucagaaau

SEQ ID NO: 2679225 - RNA, 15 nt, Human
uaagagaaguuguaa

SEQ ID NO: 2679226 - RNA, 12 nt, Human
uaagaugugaaa

SEQ ID NO: 2679227 - RNA, 13 nt, Human
uaagaugugaaaa

SEQ ID NO: 2679228 - RNA, 14 nt, Human
uaagaugugaaaau

SEQ ID NO: 2679229 - RNA, 16 nt, Human
uaagaugugaaaauua

SEQ ID NO: 2679230 - RNA, 15 nt, Human
aauauuuuuauauca

SEQ ID NO: 2679231 - RNA, 23 nt, Human
aauauuuuuauaucaugcaaaau

SEQ ID NO: 2679232 - RNA, 18 nt, Human
aauauuuuuauauuuccu

SEQ ID NO: 2679233 - RNA, 19 nt, Human
aauauuuuuauauuuccuu

SEQ ID NO: 2679234 - RNA, 20 nt, Human
aauauuuuuauauuuccuuu

SEQ ID NO: 2679235 - RNA, 21 nt, Human
aauauuuuuauauuuccuuua

SEQ ID NO: 2679236 - RNA, 22 nt, Human
aauauuuuuauauuuccuuuau

SEQ ID NO: 2679237 - RNA, 12 nt, Human
aauauuuggaau

SEQ ID NO: 2679238 - RNA, 21 nt, Human
uaagauugauaucuauaaaau

SEQ ID NO: 2679239 - RNA, 22 nt, Human
uaagauugauaucuauaaaaua

SEQ ID NO: 2679240 - RNA, 23 nt, Human
uaagauugauaucuauaaaauag

SEQ ID NO: 2679241 - RNA, 14 nt, Human
uaagcaaauguuaa

SEQ ID NO: 2679242 - RNA, 18 nt, Human
uaagcaaauguuaaaagu

SEQ ID NO: 2679243 - RNA, 19 nt, Human
uaagcaaauguuaaaaguu

SEQ ID NO: 2679244 - RNA, 10 nt, Human
uaagcugcaa

SEQ ID NO: 2679245 - RNA, 23 nt, Human
uaagcugcaaaucugauggccuu

SEQ ID NO: 2679246 - RNA, 22 nt, Human
uaagcuguuacugucuucagua

SEQ ID NO: 2679247 - RNA, 18 nt, Human
uaacaguuguauuuaaca

SEQ ID NO: 2679248 - RNA, 19 nt, Human
uaacaguuguauuuaacag

SEQ ID NO: 2679249 - RNA, 23 nt, Human
uaacaguuguauuuaacagaaau

SEQ ID NO: 2679250 - RNA, 19 nt, Human
uaacaguuuuguguaacuc

SEQ ID NO: 2679251 - RNA, 19 nt, Human
aauaguuuauuuuaaaaca

SEQ ID NO: 2679252 - RNA, 19 nt, Human
uaacauagccaaaauguga

SEQ ID NO: 2679253 - RNA, 17 nt, Human
aauaguuuauuuuaaaa

SEQ ID NO: 2679254 - RNA, 17 nt, Human
aauauauuucuaaaugu

SEQ ID NO: 2679255 - RNA, 19 nt, Human
aauauauuucuaaauguuu

SEQ ID NO: 2679256 - RNA, 21 nt, Human
aauauauuucuaaauguuugg

SEQ ID NO: 2679257 - RNA, 18 nt, Human
uaagaauaccacaucaaa

SEQ ID NO: 2679258 - RNA, 22 nt, Human
uaagaauaccacaucaaauaag

SEQ ID NO: 2679259 - RNA, 23 nt, Human
uaagaauaccacaucaaauaaga

SEQ ID NO: 2679260 - RNA, 18 nt, Human
uaagaauaguagaugugg

SEQ ID NO: 2679261 - RNA, 20 nt, Human
uaagacauacuccuuccauc

SEQ ID NO: 2679262 - RNA, 17 nt, Human
uaagacagaguauccug

SEQ ID NO: 2679263 - RNA, 19 nt, Human
uaagacaaauauuccuuug

SEQ ID NO: 2679264 - RNA, 22 nt, Human
uaagacaauggacccuuuuugu

SEQ ID NO: 2679265 - RNA, 22 nt, Human
uaacuugagaguagaugguuug

SEQ ID NO: 2679266 - RNA, 15 nt, Human
uaacuuccaaauaaa

SEQ ID NO: 2679267 - RNA, 19 nt, Human
uaacuuccaaauaaauaau

SEQ ID NO: 2679268 - RNA, 14 nt, Human
uaacuuuacagaaa

SEQ ID NO: 2679269 - RNA, 16 nt, Human
uaacuuuauaaaucca

SEQ ID NO: 2679270 - RNA, 17 nt, Human
uaacuuuauaaauccag

SEQ ID NO: 2679271 - RNA, 19 nt, Human
uaacuugcuuaaauuucuu

SEQ ID NO: 2679272 - RNA, 20 nt, Human
uaacuugcuuaaauuucuua

SEQ ID NO: 2679273 - RNA, 19 nt, Human
uaaccuuacuaauuauacu

SEQ ID NO: 2679274 - RNA, 13 nt, Human
uaaccuuguauaa

SEQ ID NO: 2679275 - RNA, 17 nt, Human
uaacuuaauaaucaaga

SEQ ID NO: 2679276 - RNA, 16 nt, Human
uaacuuaauaaucaag

SEQ ID NO: 2679277 - RNA, 14 nt, Human
uaacuuaauaauca

SEQ ID NO: 2679278 - RNA, 13 nt, Human
uaacuuaauaauc

SEQ ID NO: 2679279 - RNA, 14 nt, Human
uaacuuaacugaaa

SEQ ID NO: 2679280 - RNA, 16 nt, Human
uaacuuaacugaaaug

SEQ ID NO: 2679281 - RNA, 21 nt, Human
uaacuuaauaaucaagagccu

SEQ ID NO: 2679282 - RNA, 20 nt, Human
ucacuugaugauacaaugaa

SEQ ID NO: 2679283 - RNA, 14 nt, Human
ucacuugaugauac

SEQ ID NO: 2679284 - RNA, 10 nt, Human
ucacuugagu

SEQ ID NO: 2679285 - RNA, 14 nt, Human
ucacuguuuccugg

SEQ ID NO: 2679286 - RNA, 21 nt, Human
ucacuguuuagauuugccaua

SEQ ID NO: 2679287 - RNA, 12 nt, Human
ucacuguuuaga

SEQ ID NO: 2679288 - RNA, 13 nt, Human
ucacuguuuagau

SEQ ID NO: 2679289 - RNA, 17 nt, Human
ucacuguuuagauuugc

SEQ ID NO: 2679290 - RNA, 16 nt, Human
ucacuguuuagauuug

SEQ ID NO: 2679291 - RNA, 15 nt, Human
ucacuguuuagauuu

SEQ ID NO: 2679292 - RNA, 12 nt, Human
ucacugugauca

SEQ ID NO: 2679293 - RNA, 21 nt, Human
ucacugugaucaauauuuuua

SEQ ID NO: 2679294 - RNA, 21 nt, Human
ucacuguguauauuugauuua

SEQ ID NO: 2679295 - RNA, 19 nt, Human
ucacuguguauauuugauu

SEQ ID NO: 2679296 - RNA, 18 nt, Human
ucacuguguauauuugau

SEQ ID NO: 2679297 - RNA, 17 nt, Human
ucacuguguauauuuga

SEQ ID NO: 2679298 - RNA, 15 nt, Human
ucacuguguauauuu

SEQ ID NO: 2679299 - RNA, 14 nt, Human
ucacuguguauauu

SEQ ID NO: 2679300 - RNA, 12 nt, Human
ucacuguguaua

SEQ ID NO: 2679301 - RNA, 23 nt, Human
ucaccucaugcccacccccugcc

SEQ ID NO: 2679302 - RNA, 20 nt, Human
ucaccucaugcccacccccu

SEQ ID NO: 2679303 - RNA, 23 nt, Human
ucacuaggcccccacuugccucu

SEQ ID NO: 2679304 - RNA, 14 nt, Human
ucacuacaguauua

SEQ ID NO: 2679305 - RNA, 18 nt, Human
ucacuacaagucagcucc

SEQ ID NO: 2679306 - RNA, 19 nt, Human
ucacuacaagucagcucca

SEQ ID NO: 2679307 - RNA, 23 nt, Human
ucacuaauugguacuuuuaaaaa

SEQ ID NO: 2679308 - RNA, 15 nt, Human
ucacuaauuuuugua

SEQ ID NO: 2679309 - RNA, 16 nt, Human
ucacuaauuuuuguau

SEQ ID NO: 2679310 - RNA, 15 nt, Human
ucacuaaagcaugaa

SEQ ID NO: 2679311 - RNA, 16 nt, Human
ucacuaaagcaugaaa

SEQ ID NO: 2679312 - RNA, 18 nt, Human
ucacuaaagcaugaaaug

SEQ ID NO: 2679313 - RNA, 21 nt, Human
ucacuaaagcaugaaauguga

SEQ ID NO: 2679314 - RNA, 22 nt, Human
ucacuaaagcaugaaaugugaa

SEQ ID NO: 2679315 - RNA, 23 nt, Human
ucacuaaagcaugaaaugugaau

SEQ ID NO: 2679316 - RNA, 21 nt, Human
ucacguuuggugcuucucaga

SEQ ID NO: 2679317 - RNA, 15 nt, Human
ucacuaauacacagu

SEQ ID NO: 2679318 - RNA, 20 nt, Human
ucacguuggggugauuuaau

SEQ ID NO: 2679319 - RNA, 17 nt, Human
ucacguuuggugcuucu

SEQ ID NO: 2679320 - RNA, 21 nt, Human
ucacguggcucgacuauagaa

SEQ ID NO: 2679321 - RNA, 23 nt, Human
accagcugaaguugcagauguua

SEQ ID NO: 2679322 - RNA, 16 nt, Human
accagcugcgcuugcu

SEQ ID NO: 2679323 - RNA, 22 nt, Human
accagcucugccgucucuggag

SEQ ID NO: 2679324 - RNA, 18 nt, Human
accagcugcgcuugcuuu

SEQ ID NO: 2679325 - RNA, 19 nt, Human
accagcugcgcuugcuuuu

SEQ ID NO: 2679326 - RNA, 22 nt, Human
accagcugcuccgaggacccag

SEQ ID NO: 2679327 - RNA, 20 nt, Human
accagcugcgcuugcuuuuc

SEQ ID NO: 2679328 - RNA, 12 nt, Human
accaggaagccg

SEQ ID NO: 2679329 - RNA, 20 nt, Human
accaggaacucuggaguuca

SEQ ID NO: 2679330 - RNA, 13 nt, Human
accaggaacagca

SEQ ID NO: 2679331 - RNA, 15 nt, Human
accacuaugaagcua

SEQ ID NO: 2679332 - RNA, 22 nt, Human
accagcgugugacuacuccccc

SEQ ID NO: 2679333 - RNA, 23 nt, Human
ucaauuucuguguugccaagcuc

SEQ ID NO: 2679334 - RNA, 15 nt, Human
ucaauuucuguguug

SEQ ID NO: 2679335 - RNA, 14 nt, Human
ucaauugucacuuu

SEQ ID NO: 2679336 - RNA, 17 nt, Human
ucaauugucacuuuuua

SEQ ID NO: 2679337 - RNA, 12 nt, Human
accaaagcugcc

SEQ ID NO: 2679338 - RNA, 13 nt, Human
accaaagcugccc

SEQ ID NO: 2679339 - RNA, 14 nt, Human
accaaagcugccca

SEQ ID NO: 2679340 - RNA, 18 nt, Human
accaaagcugcccacugu

SEQ ID NO: 2679341 - RNA, 19 nt, Human
accaaaggaaaaugucugu

SEQ ID NO: 2679342 - RNA, 19 nt, Human
accaaagcugcccacuguu

SEQ ID NO: 2679343 - RNA, 19 nt, Human
ucacaacuugauggcugcg

SEQ ID NO: 2679344 - RNA, 12 nt, Human
ucacaagaacac

SEQ ID NO: 2679345 - RNA, 20 nt, Human
ucacaagaacacacacauau

SEQ ID NO: 2679346 - RNA, 15 nt, Human
ucacacugguucuca

SEQ ID NO: 2679347 - RNA, 16 nt, Human
ucacacugguucucaa

SEQ ID NO: 2679348 - RNA, 17 nt, Human
ucacacugguucucaau

SEQ ID NO: 2679349 - RNA, 21 nt, Human
ucacacugguucucaaugaaa

SEQ ID NO: 2679350 - RNA, 19 nt, Human
ucacacugguucucaauga

SEQ ID NO: 2679351 - RNA, 20 nt, Human
ucacacugguucucaaugaa

SEQ ID NO: 2679352 - RNA, 13 nt, Human
ucacagccucuga

SEQ ID NO: 2679353 - RNA, 21 nt, Human
ucaccauucguacauaauacu

SEQ ID NO: 2679354 - RNA, 15 nt, Human
ucacccccucccacc

SEQ ID NO: 2679355 - RNA, 17 nt, Human
ucacccccucccacccc

SEQ ID NO: 2679356 - RNA, 19 nt, Human
ucacccccucccaccccca

SEQ ID NO: 2679357 - RNA, 20 nt, Human
ucacccccucccacccccag

SEQ ID NO: 2679358 - RNA, 22 nt, Human
ucacccccucccacccccagcc

SEQ ID NO: 2679359 - RNA, 23 nt, Human
ucacccccucccacccccagccc

SEQ ID NO: 2679360 - RNA, 15 nt, Human
ucaccauguaagcac

SEQ ID NO: 2679361 - RNA, 16 nt, Human
ucaccauguaagcacu

SEQ ID NO: 2679362 - RNA, 17 nt, Human
ucaccauguaagcacuc

SEQ ID NO: 2679363 - RNA, 21 nt, Human
ucaccauguaagcacucugga

SEQ ID NO: 2679364 - RNA, 15 nt, Human
ucacaguuuuuccug

SEQ ID NO: 2679365 - RNA, 17 nt, Human
ucacaguuuuuccugga

SEQ ID NO: 2679366 - RNA, 19 nt, Human
ucacaguuuuuccuggaau

SEQ ID NO: 2679367 - RNA, 13 nt, Human
ucacagcggaggu

SEQ ID NO: 2679368 - RNA, 12 nt, Human
accaccaccccu

SEQ ID NO: 2679369 - RNA, 16 nt, Human
accaccaccccuacca

SEQ ID NO: 2679370 - RNA, 16 nt, Human
accaccaagccaaggg

SEQ ID NO: 2679371 - RNA, 15 nt, Human
accacauugaagaau

SEQ ID NO: 2679372 - RNA, 14 nt, Human
accaccaaaaacaa

SEQ ID NO: 2679373 - RNA, 15 nt, Human
accaccaaaaacaaa

SEQ ID NO: 2679374 - RNA, 18 nt, Human
ucaccaugugagcucuuc

SEQ ID NO: 2679375 - RNA, 17 nt, Human
accacagccagcaccug

SEQ ID NO: 2679376 - RNA, 20 nt, Human
accacagccagcaccuggca

SEQ ID NO: 2679377 - RNA, 19 nt, Human
accacagccagcaccuggc

SEQ ID NO: 2679378 - RNA, 21 nt, Human
ucaauaucuaauauauaugaa

SEQ ID NO: 2679379 - RNA, 19 nt, Human
ucaauaucuaauauauaug

SEQ ID NO: 2679380 - RNA, 15 nt, Human
ucaauaucuaauaua

SEQ ID NO: 2679381 - RNA, 13 nt, Human
ucaauaucuaaua

SEQ ID NO: 2679382 - RNA, 16 nt, Human
ucaauauauugaacuu

SEQ ID NO: 2679383 - RNA, 17 nt, Human
ucaauauauugaacuuu

SEQ ID NO: 2679384 - RNA, 20 nt, Human
ucaauauauugaacuuuugu

SEQ ID NO: 2679385 - RNA, 22 nt, Human
ucaauauauugaacuuuuguac

SEQ ID NO: 2679386 - RNA, 13 nt, Human
ucaacuuuguaaa

SEQ ID NO: 2679387 - RNA, 14 nt, Human
ucaacuuuguaaaa

SEQ ID NO: 2679388 - RNA, 16 nt, Human
ucaacuuuguaaaaau

SEQ ID NO: 2679389 - RNA, 19 nt, Human
ucaacuuuguaaaaaucuu

SEQ ID NO: 2679390 - RNA, 16 nt, Human
ucaacugucuuccuca

SEQ ID NO: 2679391 - RNA, 23 nt, Human
ucaacugucuuccucaaaauaaa

SEQ ID NO: 2679392 - RNA, 20 nt, Human
ucaacuuagucaauaagaaa

SEQ ID NO: 2679393 - RNA, 16 nt, Human
ucaaugaaccauaaau

SEQ ID NO: 2679394 - RNA, 17 nt, Human
ucaaugaaccauaaauu

SEQ ID NO: 2679395 - RNA, 22 nt, Human
ucaaugaaaaauagugucuuug

SEQ ID NO: 2679396 - RNA, 13 nt, Human
ucaaugagagcau

SEQ ID NO: 2679397 - RNA, 14 nt, Human
ucaaugagagcaua

SEQ ID NO: 2679398 - RNA, 19 nt, Human
ucaaugagagcauaauuua

SEQ ID NO: 2679399 - RNA, 20 nt, Human
acauugaaguaaugaauuuu

SEQ ID NO: 2679400 - RNA, 19 nt, Human
acauugaaguaaugaauuu

SEQ ID NO: 2679401 - RNA, 18 nt, Human
acauugaaguaaugaauu

SEQ ID NO: 2679402 - RNA, 15 nt, Human
acauugaaguaauga

SEQ ID NO: 2679403 - RNA, 20 nt, Human
acauucuuggcuuaaucauu

SEQ ID NO: 2679404 - RNA, 22 nt, Human
acauucuuggcuuaaucauuuu

SEQ ID NO: 2679405 - RNA, 23 nt, Human
acauucuuggcuuaaucauuuuc

SEQ ID NO: 2679406 - RNA, 20 nt, Human
ucaauccugauuccucucua

SEQ ID NO: 2679407 - RNA, 21 nt, Human
ucaauccugauuccucucuaa

SEQ ID NO: 2679408 - RNA, 16 nt, Human
ucaaucuguuuuucau

SEQ ID NO: 2679409 - RNA, 13 nt, Human
accaaaauucauc

SEQ ID NO: 2679410 - RNA, 15 nt, Human
accaaagagggcuuc

SEQ ID NO: 2679411 - RNA, 18 nt, Human
accaaagagggcuuccuc

SEQ ID NO: 2679412 - RNA, 17 nt, Human
acauuguucuuauucug

SEQ ID NO: 2679413 - RNA, 17 nt, Human
acauuguuaagaaaaau

SEQ ID NO: 2679414 - RNA, 12 nt, Human
acauugugucua

SEQ ID NO: 2679415 - RNA, 15 nt, Human
acauugugucuagga

SEQ ID NO: 2679416 - RNA, 19 nt, Human
acauugucuccuauauauu

SEQ ID NO: 2679417 - RNA, 22 nt, Human
acauugucuccuauauauuucu

SEQ ID NO: 2679418 - RNA, 12 nt, Human
acauugaagaau

SEQ ID NO: 2679419 - RNA, 14 nt, Human
ucaaauuuuuugac

SEQ ID NO: 2679420 - RNA, 16 nt, Human
ucaaauuuuuugacuu

SEQ ID NO: 2679421 - RNA, 22 nt, Human
ucaaauuugucugguuaaaaaa

SEQ ID NO: 2679422 - RNA, 18 nt, Human
ucaacaaauauucacugg

SEQ ID NO: 2679423 - RNA, 22 nt, Human
ucaacaaauauucacuggcccc

SEQ ID NO: 2679424 - RNA, 15 nt, Human
ucaacaagaaauaau

SEQ ID NO: 2679425 - RNA, 18 nt, Human
ucaacaagaaauaauaga

SEQ ID NO: 2679426 - RNA, 14 nt, Human
ucaaccacaaaacu

SEQ ID NO: 2679427 - RNA, 12 nt, Human
ucaaccacaaaa

SEQ ID NO: 2679428 - RNA, 16 nt, Human
ucaacuggguccagaa

SEQ ID NO: 2679429 - RNA, 17 nt, Human
ucaacuggguccagaag

SEQ ID NO: 2679430 - RNA, 18 nt, Human
ucaacuggguccagaaga

SEQ ID NO: 2679431 - RNA, 13 nt, Human
acauguaauuuga

SEQ ID NO: 2679432 - RNA, 13 nt, Human
acauggugccuga

SEQ ID NO: 2679433 - RNA, 16 nt, Human
acauggugccugagag

SEQ ID NO: 2679434 - RNA, 18 nt, Human
acauggugccugagaggc

SEQ ID NO: 2679435 - RNA, 18 nt, Human
acaugaaucaaaagugcc

SEQ ID NO: 2679436 - RNA, 21 nt, Human
acaugaaucaaaagugccuca

SEQ ID NO: 2679437 - RNA, 22 nt, Human
acaugaguagauaauuucaggg

SEQ ID NO: 2679438 - RNA, 12 nt, Human
acauggaacagu

SEQ ID NO: 2679439 - RNA, 17 nt, Human
acauggucugucaauga

SEQ ID NO: 2679440 - RNA, 21 nt, Human
ucauaguucugagcugccagu

SEQ ID NO: 2679441 - RNA, 16 nt, Human
ucauaguuuuauuuau

SEQ ID NO: 2679442 - RNA, 15 nt, Human
ucauaguuuuauuua

SEQ ID NO: 2679443 - RNA, 17 nt, Human
ucauaguuuuauuuaua

SEQ ID NO: 2679444 - RNA, 17 nt, Human
ucauaguauccauauuu

SEQ ID NO: 2679445 - RNA, 20 nt, Human
ucauaguauccauauuuuau

SEQ ID NO: 2679446 - RNA, 24 nt, Human
ucauaguauccauauuuuauuacu

SEQ ID NO: 2679447 - RNA, 15 nt, Human
ucauaguuaaauguu

SEQ ID NO: 2679448 - RNA, 14 nt, Human
ucauaguuacugug

SEQ ID NO: 2679449 - RNA, 15 nt, Human
ucauaguuacugugu

SEQ ID NO: 2679450 - RNA, 20 nt, Human
ucauaguuacuguguaaacu

SEQ ID NO: 2679451 - RNA, 21 nt, Human
ucauaguuacuguguaaacuc

SEQ ID NO: 2679452 - RNA, 22 nt, Human
ucauaguuacuguguaaacuca

SEQ ID NO: 2679453 - RNA, 15 nt, Human
ucauauauuaaacau

SEQ ID NO: 2679454 - RNA, 17 nt, Human
ucauauauuaaacaucc

SEQ ID NO: 2679455 - RNA, 20 nt, Human
ucauauauuaaacauccaca

SEQ ID NO: 2679456 - RNA, 21 nt, Human
ucauauauuaaacauccacaa

SEQ ID NO: 2679457 - RNA, 17 nt, Human
ucauauaccagcaauau

SEQ ID NO: 2679458 - RNA, 16 nt, Human
ucauauaccagcaaua

SEQ ID NO: 2679459 - RNA, 12 nt, Human
ucauauaagaca

SEQ ID NO: 2679460 - RNA, 19 nt, Human
ucauaacauccagagcuuu

SEQ ID NO: 2679461 - RNA, 11 nt, Human
ucauaaauuau

SEQ ID NO: 2679462 - RNA, 13 nt, Human
ucauaaauuauuu

SEQ ID NO: 2679463 - RNA, 22 nt, Human
ucauaaauuauuugauuauuua

SEQ ID NO: 2679464 - RNA, 13 nt, Human
ucauaaaagagac

SEQ ID NO: 2679465 - RNA, 22 nt, Human
ucauaguacucuuuguagcaaa

SEQ ID NO: 2679466 - RNA, 16 nt, Human
ucauauguaaucucua

SEQ ID NO: 2679467 - RNA, 22 nt, Human
ucauauguaaucucuaggaagu

SEQ ID NO: 2679468 - RNA, 11 nt, Human
ucauaugaaaa

SEQ ID NO: 2679469 - RNA, 12 nt, Human
ucauaugaaaaa

SEQ ID NO: 2679470 - RNA, 21 nt, Human
ucauaugaaaaaaaugcauuu

SEQ ID NO: 2679471 - RNA, 21 nt, Human
ucauaucaacuuagucaauaa

SEQ ID NO: 2679472 - RNA, 14 nt, Human
ucauauuguuuccu

SEQ ID NO: 2679473 - RNA, 19 nt, Human
ucauaucuuaauauauuuc

SEQ ID NO: 2679474 - RNA, 14 nt, Human
accgaggggccuuu

SEQ ID NO: 2679475 - RNA, 15 nt, Human
accgaggggccuuug

SEQ ID NO: 2679476 - RNA, 21 nt, Human
accgaggggccuuuguucugg

SEQ ID NO: 2679477 - RNA, 18 nt, Human
accgaguagaaaauguga

SEQ ID NO: 2679478 - RNA, 20 nt, Human
accgaguagaaaaugugacc

SEQ ID NO: 2679479 - RNA, 18 nt, Human
accgcacagcucaggagg

SEQ ID NO: 2679480 - RNA, 17 nt, Human
ucaguggcgagaaauaa

SEQ ID NO: 2679481 - RNA, 14 nt, Human
ucagugcccuccag

SEQ ID NO: 2679482 - RNA, 15 nt, Human
ucagugcccuccagc

SEQ ID NO: 2679483 - RNA, 14 nt, Human
accuccaggcuuuc

SEQ ID NO: 2679484 - RNA, 20 nt, Human
accucccacaaaggagagcu

SEQ ID NO: 2679485 - RNA, 15 nt, Human
accuccccagcauuc

SEQ ID NO: 2679486 - RNA, 21 nt, Human
accuccccagcauuccagccc

SEQ ID NO: 2679487 - RNA, 23 nt, Human
accuccccagcauuccagccccu

SEQ ID NO: 2679488 - RNA, 17 nt, Human
accuauuuccagaaaua

SEQ ID NO: 2679489 - RNA, 16 nt, Human
accuauuuccagaaau

SEQ ID NO: 2679490 - RNA, 19 nt, Human
accuauuuccagaaauaca

SEQ ID NO: 2679491 - RNA, 15 nt, Human
accucaccuagaaau

SEQ ID NO: 2679492 - RNA, 14 nt, Human
accucaccuagaaa

SEQ ID NO: 2679493 - RNA, 22 nt, Human
accuagaaauugacacaagugg

SEQ ID NO: 2679494 - RNA, 16 nt, Human
ucaugauuagcaaguu

SEQ ID NO: 2679495 - RNA, 13 nt, Human
ucaugauuuauaa

SEQ ID NO: 2679496 - RNA, 16 nt, Human
ucaugauuuauaaaug

SEQ ID NO: 2679497 - RNA, 11 nt, Human
ucaugcaaaau

SEQ ID NO: 2679498 - RNA, 13 nt, Human
ucaugcaaaauau

SEQ ID NO: 2679499 - RNA, 19 nt, Human
ucaucuaagucaguaccca

SEQ ID NO: 2679500 - RNA, 19 nt, Human
ucauccagacucagagcuc

SEQ ID NO: 2679501 - RNA, 20 nt, Human
ucauccagacucagagcucu

SEQ ID NO: 2679502 - RNA, 20 nt, Human
ucauccagauguggcuacug

SEQ ID NO: 2679503 - RNA, 13 nt, Human
ucauguggcugga

SEQ ID NO: 2679504 - RNA, 19 nt, Human
ucaugugguuucuaugcaa

SEQ ID NO: 2679505 - RNA, 16 nt, Human
ucauguggcuggaaga

SEQ ID NO: 2679506 - RNA, 21 nt, Human
ucauguggcuggaagauccug

SEQ ID NO: 2679507 - RNA, 16 nt, Human
ucaugcacuuaaagaa

SEQ ID NO: 2679508 - RNA, 17 nt, Human
ucaugcacuuaaagaag

SEQ ID NO: 2679509 - RNA, 21 nt, Human
ucaugcacuuaaagaaguauu

SEQ ID NO: 2679510 - RNA, 22 nt, Human
ucaugcacuuaaagaaguauuu

SEQ ID NO: 2679511 - RNA, 14 nt, Human
acccggcugcagag

SEQ ID NO: 2679512 - RNA, 23 nt, Human
acccgggaaccuccccagccugc

SEQ ID NO: 2679513 - RNA, 22 nt, Human
acccgggaaccuccccagccug

SEQ ID NO: 2679514 - RNA, 22 nt, Human
ucagggugcagcccaaucugcc

SEQ ID NO: 2679515 - RNA, 23 nt, Human
ucaggguggucucuucuuggggc

SEQ ID NO: 2679516 - RNA, 14 nt, Human
ucaggggagaaaaa

SEQ ID NO: 2679517 - RNA, 18 nt, Human
ucagggcuggcuccugau

SEQ ID NO: 2679518 - RNA, 19 nt, Human
ucagggcuggcuccugauc

SEQ ID NO: 2679519 - RNA, 22 nt, Human
ucagcuuugagaagccuucagc

SEQ ID NO: 2679520 - RNA, 15 nt, Human
ucagcuuugagaagc

SEQ ID NO: 2679521 - RNA, 20 nt, Human
acccuuucccccuucucuua

SEQ ID NO: 2679522 - RNA, 14 nt, Human
acccuuuauuugaa

SEQ ID NO: 2679523 - RNA, 17 nt, Human
acccugccgucaccacc

SEQ ID NO: 2679524 - RNA, 18 nt, Human
acccugccgucaccacca

SEQ ID NO: 2679525 - RNA, 19 nt, Human
acccugccgucaccaccac

SEQ ID NO: 2679526 - RNA, 22 nt, Human
acccugccgucaccaccacccc

SEQ ID NO: 2679527 - RNA, 18 nt, Human
acccugaaagcccugagc

SEQ ID NO: 2679528 - RNA, 16 nt, Human
acccugaaagcccuga

SEQ ID NO: 2679529 - RNA, 22 nt, Human
acccucuaaccucgcccucucc

SEQ ID NO: 2679530 - RNA, 15 nt, Human
acccucuaaccucgc

SEQ ID NO: 2679531 - RNA, 23 nt, Human
acccucuaaccucgcccucuccu

SEQ ID NO: 2679532 - RNA, 18 nt, Human
acccucgccggacccucu

SEQ ID NO: 2679533 - RNA, 13 nt, Human
acccucgccggac

SEQ ID NO: 2679534 - RNA, 21 nt, Human
acccgggaggcggagcuugca

SEQ ID NO: 2679535 - RNA, 15 nt, Human
acccggggcccaggg

SEQ ID NO: 2679536 - RNA, 14 nt, Human
acccggggcccagg

SEQ ID NO: 2679537 - RNA, 22 nt, Human
acccggggcccagggcaagcuc

SEQ ID NO: 2679538 - RNA, 13 nt, Human
ucagccaggacca

SEQ ID NO: 2679539 - RNA, 23 nt, Human
ucagccaggaccauaccgggucu

SEQ ID NO: 2679540 - RNA, 13 nt, Human
acccaggaggcag

SEQ ID NO: 2679541 - RNA, 14 nt, Human
acccaggaggcagg

SEQ ID NO: 2679542 - RNA, 22 nt, Human
acccaggaggcagggaggcagc

SEQ ID NO: 2679543 - RNA, 23 nt, Human
acccaggaggcagggaggcagcc

SEQ ID NO: 2679544 - RNA, 15 nt, Human
ucagcaaaagaugcu

SEQ ID NO: 2679545 - RNA, 23 nt, Human
ucagccaagguuuuauaaggcug

SEQ ID NO: 2679546 - RNA, 14 nt, Human
ucagccaaguuuua

SEQ ID NO: 2679547 - RNA, 15 nt, Human
ucagccaaguuuuau

SEQ ID NO: 2679548 - RNA, 16 nt, Human
ucagccaaguuuuaua

SEQ ID NO: 2679549 - RNA, 14 nt, Human
accauaaauucaac

SEQ ID NO: 2679550 - RNA, 22 nt, Human
accauaaauucaacuuuguaaa

SEQ ID NO: 2679551 - RNA, 24 nt, Human
accaguuuuuggauaaagaauacu

SEQ ID NO: 2679552 - RNA, 16 nt, Human
ucagauuucugaggaa

SEQ ID NO: 2679553 - RNA, 18 nt, Human
accccaucucuacaaaaa

SEQ ID NO: 2679554 - RNA, 19 nt, Human
acccccuccuucagacacc

SEQ ID NO: 2679555 - RNA, 17 nt, Human
acccccuccuucagaca

SEQ ID NO: 2679556 - RNA, 16 nt, Human
acccccuccuucagac

SEQ ID NO: 2679557 - RNA, 15 nt, Human
acccccuccuucaga

SEQ ID NO: 2679558 - RNA, 12 nt, Human
acccccuccuuc

SEQ ID NO: 2679559 - RNA, 11 nt, Human
acccccuccuu

SEQ ID NO: 2679560 - RNA, 10 nt, Human
accccugccc

SEQ ID NO: 2679561 - RNA, 20 nt, Human
accccugcccccagccccgg

SEQ ID NO: 2679562 - RNA, 12 nt, Human
accccugccccc

SEQ ID NO: 2679563 - RNA, 13 nt, Human
accccugccccca

SEQ ID NO: 2679564 - RNA, 17 nt, Human
accccugcccccagccc

SEQ ID NO: 2679565 - RNA, 12 nt, Human
ucagcuccagcu

SEQ ID NO: 2679566 - RNA, 22 nt, Human
uccuagcuugggaggcuucccc

SEQ ID NO: 2679567 - RNA, 21 nt, Human
uccuagcuugggaggcuuccc

SEQ ID NO: 2679568 - RNA, 13 nt, Human
uccuaggcauuug

SEQ ID NO: 2679569 - RNA, 13 nt, Human
acuccugcuuaau

SEQ ID NO: 2679570 - RNA, 20 nt, Human
acuccagcaacuucuucucc

SEQ ID NO: 2679571 - RNA, 15 nt, Human
acuccagcaacuucu

SEQ ID NO: 2679572 - RNA, 11 nt, Human
acuccagccag

SEQ ID NO: 2679573 - RNA, 12 nt, Human
acuccagccagc

SEQ ID NO: 2679574 - RNA, 13 nt, Human
acuccagccagcg

SEQ ID NO: 2679575 - RNA, 14 nt, Human
acuccagccagcgc

SEQ ID NO: 2679576 - RNA, 15 nt, Human
acuccagccagcgcc

SEQ ID NO: 2679577 - RNA, 16 nt, Human
acuccagccagcgccu

SEQ ID NO: 2679578 - RNA, 17 nt, Human
acuccagccagcgccuc

SEQ ID NO: 2679579 - RNA, 18 nt, Human
acuccagccagcgccucc

SEQ ID NO: 2679580 - RNA, 19 nt, Human
acuccagccagcgccuccc

SEQ ID NO: 2679581 - RNA, 16 nt, Human
acucacagugcuuuua

SEQ ID NO: 2679582 - RNA, 17 nt, Human
acucacagagucaaggc

SEQ ID NO: 2679583 - RNA, 18 nt, Human
acucacagagucaaggcc

SEQ ID NO: 2679584 - RNA, 19 nt, Human
acucacagagucaaggccu

SEQ ID NO: 2679585 - RNA, 21 nt, Human
acucacagagucaaggccugc

SEQ ID NO: 2679586 - RNA, 22 nt, Human
acucacagagucaaggccugcu

SEQ ID NO: 2679587 - RNA, 18 nt, Human
acuccucagggcagccuc

SEQ ID NO: 2679588 - RNA, 15 nt, Human
uccucaccucaugcc

SEQ ID NO: 2679589 - RNA, 16 nt, Human
uccucaccucaugccc

SEQ ID NO: 2679590 - RNA, 21 nt, Human
uccucaccucaugcccacccc

SEQ ID NO: 2679591 - RNA, 22 nt, Human
acucuugaguuguuuuuguaua

SEQ ID NO: 2679592 - RNA, 21 nt, Human
acucuugaguuguuuuuguau

SEQ ID NO: 2679593 - RNA, 20 nt, Human
acucuugaguuguuuuugua

SEQ ID NO: 2679594 - RNA, 16 nt, Human
acucuugaguuguuuu

SEQ ID NO: 2679595 - RNA, 15 nt, Human
acucuugaguuguuu

SEQ ID NO: 2679596 - RNA, 19 nt, Human
uccucccaggaagcccagg

SEQ ID NO: 2679597 - RNA, 23 nt, Human
uccucccaggaagcccaggagcc

SEQ ID NO: 2679598 - RNA, 12 nt, Human
uccucagggcag

SEQ ID NO: 2679599 - RNA, 17 nt, Human
uccucagggcagccucc

SEQ ID NO: 2679600 - RNA, 23 nt, Human
acucugaugguucuucaccuccu

SEQ ID NO: 2679601 - RNA, 22 nt, Human
uccuggaaauugacgaggggug

SEQ ID NO: 2679602 - RNA, 14 nt, Human
uccuggaacaauau

SEQ ID NO: 2679603 - RNA, 16 nt, Human
uccuggaacaauauuu

SEQ ID NO: 2679604 - RNA, 19 nt, Human
uccuggaacaauauuuuau

SEQ ID NO: 2679605 - RNA, 20 nt, Human
uccuggaacaauauuuuaug

SEQ ID NO: 2679606 - RNA, 21 nt, Human
uccuggaacaauauuuuaugg

SEQ ID NO: 2679607 - RNA, 17 nt, Human
uccuggaauugccagcu

SEQ ID NO: 2679608 - RNA, 20 nt, Human
uccuggaauugccagcugac

SEQ ID NO: 2679609 - RNA, 20 nt, Human
uccuggcgccuggcaguccg

SEQ ID NO: 2679610 - RNA, 14 nt, Human
uccugccuguggcg

SEQ ID NO: 2679611 - RNA, 13 nt, Human
acugcacuccagc

SEQ ID NO: 2679612 - RNA, 12 nt, Human
uccugccugugg

SEQ ID NO: 2679613 - RNA, 13 nt, Human
uccugccuguggc

SEQ ID NO: 2679614 - RNA, 20 nt, Human
acugcacuccagccugggug

SEQ ID NO: 2679615 - RNA, 19 nt, Human
acugcacuccagccugggu

SEQ ID NO: 2679616 - RNA, 21 nt, Human
acugcacuccagccugggcga

SEQ ID NO: 2679617 - RNA, 18 nt, Human
acugcacuccagccuggg

SEQ ID NO: 2679618 - RNA, 17 nt, Human
acugcacuccagccugg

SEQ ID NO: 2679619 - RNA, 14 nt, Human
acugcacuccagcc

SEQ ID NO: 2679620 - RNA, 20 nt, Human
uccugauccacuuuggggga

SEQ ID NO: 2679621 - RNA, 21 nt, Human
uccugauccacuuugggggag

SEQ ID NO: 2679622 - RNA, 16 nt, Human
acugcacuccagccug

SEQ ID NO: 2679623 - RNA, 19 nt, Human
acugcacuccagccugggg

SEQ ID NO: 2679624 - RNA, 20 nt, Human
acugcacuccagccuggggg

SEQ ID NO: 2679625 - RNA, 22 nt, Human
acugacugucgggcuuuaaaaa

SEQ ID NO: 2679626 - RNA, 21 nt, Human
acugacugaggcaguuugagg

SEQ ID NO: 2679627 - RNA, 15 nt, Human
acugacugaggcagu

SEQ ID NO: 2679628 - RNA, 12 nt, Human
acugacugaggc

SEQ ID NO: 2679629 - RNA, 15 nt, Human
acugaccuuguaaaa

SEQ ID NO: 2679630 - RNA, 20 nt, Human
acugaccuuguaaaagacag

SEQ ID NO: 2679631 - RNA, 21 nt, Human
acugaaccacuuguagauuug

SEQ ID NO: 2679632 - RNA, 20 nt, Human
acugaaccacuuguagauuu

SEQ ID NO: 2679633 - RNA, 19 nt, Human
acugaaccacuuguagauu

SEQ ID NO: 2679634 - RNA, 18 nt, Human
acugaaccacuuguagau

SEQ ID NO: 2679635 - RNA, 16 nt, Human
acugaaccacuuguag

SEQ ID NO: 2679636 - RNA, 14 nt, Human
uccugacagaaggu

SEQ ID NO: 2679637 - RNA, 15 nt, Human
uccugacagaaggug

SEQ ID NO: 2679638 - RNA, 16 nt, Human
uccugacagaaggugc

SEQ ID NO: 2679639 - RNA, 14 nt, Human
uccugacauugucu

SEQ ID NO: 2679640 - RNA, 15 nt, Human
uccugacauugucuc

SEQ ID NO: 2679641 - RNA, 17 nt, Human
uccugacagaaggugcc

SEQ ID NO: 2679642 - RNA, 23 nt, Human
uccugaaacuauauuuugucaua

SEQ ID NO: 2679643 - RNA, 21 nt, Human
uccugaaacuauauuuuguca

SEQ ID NO: 2679644 - RNA, 16 nt, Human
uccugaaacuauauuu

SEQ ID NO: 2679645 - RNA, 14 nt, Human
uccugaaacuauau

SEQ ID NO: 2679646 - RNA, 23 nt, Human
uccugaaccgcacagcucaggag

SEQ ID NO: 2679647 - RNA, 21 nt, Human
uccugaaccgcacagcucagg

SEQ ID NO: 2679648 - RNA, 22 nt, Human
uccugaaccgcacagcucagga

SEQ ID NO: 2679649 - RNA, 17 nt, Human
uccugaaccgcacagcu

SEQ ID NO: 2679650 - RNA, 18 nt, Human
uccugaaccgcacagcuc

SEQ ID NO: 2679651 - RNA, 19 nt, Human
uccugaaccgcacagcuca

SEQ ID NO: 2679652 - RNA, 20 nt, Human
uccugaaccgcacagcucag

SEQ ID NO: 2679653 - RNA, 14 nt, Human
uccugaaccaugug

SEQ ID NO: 2679654 - RNA, 22 nt, Human
uccugaaccauguggauaacuu

SEQ ID NO: 2679655 - RNA, 16 nt, Human
uccugaaccgcacagc

SEQ ID NO: 2679656 - RNA, 13 nt, Human
accuuucucucuc

SEQ ID NO: 2679657 - RNA, 20 nt, Human
accuuugaguagauccauuu

SEQ ID NO: 2679658 - RNA, 17 nt, Human
accuuuggaaagcucug

SEQ ID NO: 2679659 - RNA, 18 nt, Human
uccacucguguguuucua

SEQ ID NO: 2679660 - RNA, 16 nt, Human
uccacucguguguuuc

SEQ ID NO: 2679661 - RNA, 11 nt, Human
accuuuuacug

SEQ ID NO: 2679662 - RNA, 20 nt, Human
accuuuuacugguugcaugg

SEQ ID NO: 2679663 - RNA, 21 nt, Human
accuuuuacugguugcaugga

SEQ ID NO: 2679664 - RNA, 24 nt, Human
accuuuuacugguugcauggaaau

SEQ ID NO: 2679665 - RNA, 13 nt, Human
accuuuuacugug

SEQ ID NO: 2679666 - RNA, 14 nt, Human
accuuuuacuguga

SEQ ID NO: 2679667 - RNA, 16 nt, Human
accuuuuacugugaug

SEQ ID NO: 2679668 - RNA, 15 nt, Human
uccacucguguguuu

SEQ ID NO: 2679669 - RNA, 14 nt, Human
uccacucguguguu

SEQ ID NO: 2679670 - RNA, 15 nt, Human
accuuuucagggcug

SEQ ID NO: 2679671 - RNA, 14 nt, Human
accuuuuguuuucu

SEQ ID NO: 2679672 - RNA, 14 nt, Human
uccaggccugccuc

SEQ ID NO: 2679673 - RNA, 15 nt, Human
uccaggccugccucc

SEQ ID NO: 2679674 - RNA, 16 nt, Human
uccaggccugccuccc

SEQ ID NO: 2679675 - RNA, 17 nt, Human
uccaggccugccuccca

SEQ ID NO: 2679676 - RNA, 18 nt, Human
uccaggccugccucccac

SEQ ID NO: 2679677 - RNA, 19 nt, Human
uccaggccugccucccacu

SEQ ID NO: 2679678 - RNA, 19 nt, Human
uccaggcuauguauaaaau

SEQ ID NO: 2679679 - RNA, 20 nt, Human
uccaggcuauguauaaaaua

SEQ ID NO: 2679680 - RNA, 16 nt, Human
uccagccugccccgga

SEQ ID NO: 2679681 - RNA, 17 nt, Human
acgaaauaucaaaguca

SEQ ID NO: 2679682 - RNA, 14 nt, Human
uccacugugcacac

SEQ ID NO: 2679683 - RNA, 13 nt, Human
uccagccucagcc

SEQ ID NO: 2679684 - RNA, 15 nt, Human
uccagccucagcccc

SEQ ID NO: 2679685 - RNA, 15 nt, Human
acgccucuugaccag

SEQ ID NO: 2679686 - RNA, 22 nt, Human
acgaauuucugugcccuccuga

SEQ ID NO: 2679687 - RNA, 21 nt, Human
acgaauuucugugcccuccug

SEQ ID NO: 2679688 - RNA, 19 nt, Human
acgaauuucugugcccucc

SEQ ID NO: 2679689 - RNA, 16 nt, Human
acgccucuugaccagg

SEQ ID NO: 2679690 - RNA, 24 nt, Human
acgccucuugaccaggcugccucc

SEQ ID NO: 2679691 - RNA, 21 nt, Human
acgccuguaaucccagcacuu

SEQ ID NO: 2679692 - RNA, 20 nt, Human
acgcguaucuaggcuuuggu

SEQ ID NO: 2679693 - RNA, 24 nt, Human
accuuuuuuuaucguuuuuguauu

SEQ ID NO: 2679694 - RNA, 16 nt, Human
acgcgcgucgccgcca

SEQ ID NO: 2679695 - RNA, 23 nt, Human
acgcgccucgccggaucugaggg

SEQ ID NO: 2679696 - RNA, 20 nt, Human
acgcuccgcugccgugccgc

SEQ ID NO: 2679697 - RNA, 13 nt, Human
acgcuccgcugcc

SEQ ID NO: 2679698 - RNA, 21 nt, Human
acggagucucacucugucacc

SEQ ID NO: 2679699 - RNA, 14 nt, Human
uccaguauaaccag

SEQ ID NO: 2679700 - RNA, 22 nt, Human
uccaguaagaucacuguuuaga

SEQ ID NO: 2679701 - RNA, 18 nt, Human
acggcuuuuacuuaaacc

SEQ ID NO: 2679702 - RNA, 23 nt, Human
uccaguaagaucacuguuuagau

SEQ ID NO: 2679703 - RNA, 19 nt, Human
acgggacaucacagggugg

SEQ ID NO: 2679704 - RNA, 23 nt, Human
acgggacaucacagggugggccu

SEQ ID NO: 2679705 - RNA, 18 nt, Human
acgggaacaugcccccug

SEQ ID NO: 2679706 - RNA, 22 nt, Human
acggcaggcucacugccaggcc

SEQ ID NO: 2679707 - RNA, 15 nt, Human
acggccaagaaugua

SEQ ID NO: 2679708 - RNA, 16 nt, Human
acggccaagaauguac

SEQ ID NO: 2679709 - RNA, 23 nt, Human
acggccaagaauguacguccagc

SEQ ID NO: 2679710 - RNA, 15 nt, Human
acggcaggcucacug

SEQ ID NO: 2679711 - RNA, 17 nt, Human
acggcaggcucacugcc

SEQ ID NO: 2679712 - RNA, 18 nt, Human
acggcaggcucacugcca

SEQ ID NO: 2679713 - RNA, 20 nt, Human
acggcaggcucacugccagg

SEQ ID NO: 2679714 - RNA, 12 nt, Human
acgucauguauu

SEQ ID NO: 2679715 - RNA, 18 nt, Human
acgucauguauuugagca

SEQ ID NO: 2679716 - RNA, 20 nt, Human
acgucagauguuuaaaacac

SEQ ID NO: 2679717 - RNA, 17 nt, Human
acgucagacuuggcuca

SEQ ID NO: 2679718 - RNA, 18 nt, Human
acgucagauguuuaaaac

SEQ ID NO: 2679719 - RNA, 17 nt, Human
acgucagauguuuaaaa

SEQ ID NO: 2679720 - RNA, 15 nt, Human
acgucagauguuuaa

SEQ ID NO: 2679721 - RNA, 18 nt, Human
acgucagacuuggcucag

SEQ ID NO: 2679722 - RNA, 19 nt, Human
acguuggagaagcccgugu

SEQ ID NO: 2679723 - RNA, 18 nt, Human
uccagugugggcuugacc

SEQ ID NO: 2679724 - RNA, 19 nt, Human
uccagugugggcuugacca

SEQ ID NO: 2679725 - RNA, 23 nt, Human
uccagugucuauaaaagaaacac

SEQ ID NO: 2679726 - RNA, 17 nt, Human
uccaguggaucauaaga

SEQ ID NO: 2679727 - RNA, 18 nt, Human
acggugcugugagggagg

SEQ ID NO: 2679728 - RNA, 19 nt, Human
acggugcugugagggaggg

SEQ ID NO: 2679729 - RNA, 20 nt, Human
acggugcugugagggagggg

SEQ ID NO: 2679730 - RNA, 14 nt, Human
acggugcccaagcc

SEQ ID NO: 2679731 - RNA, 15 nt, Human
acggugcccaagcca

SEQ ID NO: 2679732 - RNA, 17 nt, Human
acguacaaguaguucug

SEQ ID NO: 2679733 - RNA, 16 nt, Human
acguacaaguaguucu

SEQ ID NO: 2679734 - RNA, 15 nt, Human
acguacaaguaguuc

SEQ ID NO: 2679735 - RNA, 21 nt, Human
acguacaaguaguucuguauu

SEQ ID NO: 2679736 - RNA, 20 nt, Human
acguacaaguaguucuguau

SEQ ID NO: 2679737 - RNA, 19 nt, Human
acguacaaguaguucugua

SEQ ID NO: 2679738 - RNA, 18 nt, Human
acguacaaguaguucugu

SEQ ID NO: 2679739 - RNA, 24 nt, Human
acguacaaguaguucuguauuuga

SEQ ID NO: 2679740 - RNA, 22 nt, Human
acguacaaguaguucuguauuu

SEQ ID NO: 2679741 - RNA, 15 nt, Human
acuaauuuuacaugu

SEQ ID NO: 2679742 - RNA, 21 nt, Human
acuaauuuuacauguuuauaa

SEQ ID NO: 2679743 - RNA, 18 nt, Human
acuaauuuuuguauuauu

SEQ ID NO: 2679744 - RNA, 19 nt, Human
acuaauuuuuguauuauuu

SEQ ID NO: 2679745 - RNA, 18 nt, Human
acguuuuaaggacugacu

SEQ ID NO: 2679746 - RNA, 14 nt, Human
acguuuuaaggacu

SEQ ID NO: 2679747 - RNA, 12 nt, Human
acguuuuaagga

SEQ ID NO: 2679748 - RNA, 18 nt, Human
acguuggagaagcccgug

SEQ ID NO: 2679749 - RNA, 10 nt, Human
acguuucuuu

SEQ ID NO: 2679750 - RNA, 12 nt, Human
acguuucuuuaa

SEQ ID NO: 2679751 - RNA, 20 nt, Human
acguuucuuuaaccuuguau

SEQ ID NO: 2679752 - RNA, 21 nt, Human
acguuucuuuaaccuuguaua

SEQ ID NO: 2679753 - RNA, 11 nt, Human
acuaaagcaau

SEQ ID NO: 2679754 - RNA, 13 nt, Human
acuaaagcaauag

SEQ ID NO: 2679755 - RNA, 14 nt, Human
acuaaagcaauaga

SEQ ID NO: 2679756 - RNA, 15 nt, Human
acuaaagcaauagaa

SEQ ID NO: 2679757 - RNA, 16 nt, Human
acuaaagcaauagaaa

SEQ ID NO: 2679758 - RNA, 19 nt, Human
acuaaagcaauagaaacaa

SEQ ID NO: 2679759 - RNA, 14 nt, Human
acuacaccuggcug

SEQ ID NO: 2679760 - RNA, 21 nt, Human
acuacaccuugccuugcuguu

SEQ ID NO: 2679761 - RNA, 13 nt, Human
acuacaccuggcu

SEQ ID NO: 2679762 - RNA, 23 nt, Human
ucccacuuugcuguuccuuacuu

SEQ ID NO: 2679763 - RNA, 16 nt, Human
ucccagauacuugggg

SEQ ID NO: 2679764 - RNA, 18 nt, Human
ucccagauacuugggggg

SEQ ID NO: 2679765 - RNA, 15 nt, Human
uccccagguccagcu

SEQ ID NO: 2679766 - RNA, 16 nt, Human
uccccagguccagcuc

SEQ ID NO: 2679767 - RNA, 15 nt, Human
uccccaggggaguug

SEQ ID NO: 2679768 - RNA, 17 nt, Human
uccccagguccagcucu

SEQ ID NO: 2679769 - RNA, 23 nt, Human
uccccagguccagcucuggaggg

SEQ ID NO: 2679770 - RNA, 15 nt, Human
ucccagccucagcgc

SEQ ID NO: 2679771 - RNA, 19 nt, Human
ucccagcuacuugggaggc

SEQ ID NO: 2679772 - RNA, 18 nt, Human
ucccagcuacuugggagg

SEQ ID NO: 2679773 - RNA, 16 nt, Human
ucccagcuacucggga

SEQ ID NO: 2679774 - RNA, 16 nt, Human
ucccagcuacuuggga

SEQ ID NO: 2679775 - RNA, 16 nt, Human
ucccauuugugccaga

SEQ ID NO: 2679776 - RNA, 17 nt, Human
ucccauuugugccagag

SEQ ID NO: 2679777 - RNA, 19 nt, Human
ucccauuugugccagagga

SEQ ID NO: 2679778 - RNA, 12 nt, Human
uccccacccuga

SEQ ID NO: 2679779 - RNA, 23 nt, Human
ucccauuucuaccuaagucagcu

SEQ ID NO: 2679780 - RNA, 23 nt, Human
uccccacccugaaagcccugagc

SEQ ID NO: 2679781 - RNA, 14 nt, Human
acuaucugucuggu

SEQ ID NO: 2679782 - RNA, 17 nt, Human
acuaucugucugguggc

SEQ ID NO: 2679783 - RNA, 16 nt, Human
acuauauuuugucaua

SEQ ID NO: 2679784 - RNA, 15 nt, Human
acuauauuuugucau

SEQ ID NO: 2679785 - RNA, 20 nt, Human
acuauagcuugcagaacugu

SEQ ID NO: 2679786 - RNA, 21 nt, Human
acuagaggaaaccaguuuggu

SEQ ID NO: 2679787 - RNA, 12 nt, Human
acucaaugcuuu

SEQ ID NO: 2679788 - RNA, 15 nt, Human
acucaaugcuuuauu

SEQ ID NO: 2679789 - RNA, 17 nt, Human
acucaaugcuuuauuug

SEQ ID NO: 2679790 - RNA, 18 nt, Human
acucaaugcuuuauuugu

SEQ ID NO: 2679791 - RNA, 19 nt, Human
acucaaugcuuuauuugua

SEQ ID NO: 2679792 - RNA, 20 nt, Human
acucaaugcuuuauuuguaa

SEQ ID NO: 2679793 - RNA, 21 nt, Human
acucaaugcuuuauuuguaaa

SEQ ID NO: 2679794 - RNA, 22 nt, Human
acucaaugcuuuauuuguaaau

SEQ ID NO: 2679795 - RNA, 23 nt, Human
acucaaugcuuuauuuguaaauu

SEQ ID NO: 2679796 - RNA, 17 nt, Human
acucaagcggguggcuc

SEQ ID NO: 2679797 - RNA, 18 nt, Human
acucaagcggguggcucu

SEQ ID NO: 2679798 - RNA, 21 nt, Human
acucaagcggguggcucuggg

SEQ ID NO: 2679799 - RNA, 15 nt, Human
acuaugggaugagaa

SEQ ID NO: 2679800 - RNA, 16 nt, Human
acuaugggaugagaaa

SEQ ID NO: 2679801 - RNA, 22 nt, Human
acuaugguagccagaugauaaa

SEQ ID NO: 2679802 - RNA, 19 nt, Human
acuaugcguggcuggaacc

SEQ ID NO: 2679803 - RNA, 23 nt, Human
acuaugcguggcuggaaccacau

SEQ ID NO: 2679804 - RNA, 16 nt, Human
ucucaggagauuucau

SEQ ID NO: 2679805 - RNA, 20 nt, Human
ucucaggccggcagccccag

SEQ ID NO: 2679806 - RNA, 23 nt, Human
ucucaggccggcagccccagccu

SEQ ID NO: 2679807 - RNA, 15 nt, Human
ucucauuuaagggaa

SEQ ID NO: 2679808 - RNA, 16 nt, Human
ucucauuuaagggaaa

SEQ ID NO: 2679809 - RNA, 17 nt, Human
ucucauuuaagggaaaa

SEQ ID NO: 2679810 - RNA, 18 nt, Human
ucucauuuaagggaaaaa

SEQ ID NO: 2679811 - RNA, 19 nt, Human
ucucauuuaagggaaaaau

SEQ ID NO: 2679812 - RNA, 23 nt, Human
ucucauuuaagggaaaaauauau

SEQ ID NO: 2679813 - RNA, 21 nt, Human
acuugcuuuaccuuuucaggg

SEQ ID NO: 2679814 - RNA, 22 nt, Human
acuugcuuuaccuuuucagggc

SEQ ID NO: 2679815 - RNA, 16 nt, Human
acuugcuuauuugaca

SEQ ID NO: 2679816 - RNA, 16 nt, Human
acuugcuuaaauuucu

SEQ ID NO: 2679817 - RNA, 18 nt, Human
acuugcuuaaauuucuua

SEQ ID NO: 2679818 - RNA, 19 nt, Human
acuugcuuaaauuucuuau

SEQ ID NO: 2679819 - RNA, 23 nt, Human
acuugcuuaaauuucuuauguga

SEQ ID NO: 2679820 - RNA, 16 nt, Human
acuugauggcugcgaa

SEQ ID NO: 2679821 - RNA, 12 nt, Human
ucucaccucagc

SEQ ID NO: 2679822 - RNA, 17 nt, Human
acuuuguacauuuggga

SEQ ID NO: 2679823 - RNA, 23 nt, Human
acuuuguaaauucugauuucuuu

SEQ ID NO: 2679824 - RNA, 21 nt, Human
acuuuguaaauucugauuucu

SEQ ID NO: 2679825 - RNA, 19 nt, Human
acuuuguaaauucugauuu

SEQ ID NO: 2679826 - RNA, 18 nt, Human
acuuuguaaauucugauu

SEQ ID NO: 2679827 - RNA, 17 nt, Human
acuuuguaaauucugau

SEQ ID NO: 2679828 - RNA, 16 nt, Human
acuuuguaaauucuga

SEQ ID NO: 2679829 - RNA, 14 nt, Human
acuuuguaaauucu

SEQ ID NO: 2679830 - RNA, 17 nt, Human
acuuuguaaaaaucuuu

SEQ ID NO: 2679831 - RNA, 21 nt, Human
acuuuguaaaaaucuuuugaa

SEQ ID NO: 2679832 - RNA, 12 nt, Human
acuuuguaaaua

SEQ ID NO: 2679833 - RNA, 13 nt, Human
acuuuguaaauag

SEQ ID NO: 2679834 - RNA, 23 nt, Human
acuuuguaaauaggauuuuuaga

SEQ ID NO: 2679835 - RNA, 20 nt, Human
acuuuguuaggauuuucaca

SEQ ID NO: 2679836 - RNA, 15 nt, Human
acuuuuuaguaauuu

SEQ ID NO: 2679837 - RNA, 17 nt, Human
acuuuuuaguaauuucu

SEQ ID NO: 2679838 - RNA, 12 nt, Human
acuuuuuauaaa

SEQ ID NO: 2679839 - RNA, 17 nt, Human
agaaaaaauauuuuccc

SEQ ID NO: 2679840 - RNA, 14 nt, Human
acuuucuguuaugg

SEQ ID NO: 2679841 - RNA, 18 nt, Human
acuuucuguuaugggcuu

SEQ ID NO: 2679842 - RNA, 13 nt, Human
acuuucugccugg

SEQ ID NO: 2679843 - RNA, 18 nt, Human
acuuuacccaccuagaac

SEQ ID NO: 2679844 - RNA, 14 nt, Human
acuuucugccugga

SEQ ID NO: 2679845 - RNA, 13 nt, Human
acuuuacccaccu

SEQ ID NO: 2679846 - RNA, 17 nt, Human
acuuuacccaccuagaa

SEQ ID NO: 2679847 - RNA, 14 nt, Human
acuuuacagaaaug

SEQ ID NO: 2679848 - RNA, 15 nt, Human
acuuuacagaaaugg

SEQ ID NO: 2679849 - RNA, 18 nt, Human
acuuuacagaaauggacu

SEQ ID NO: 2679850 - RNA, 19 nt, Human
acuuuacagaaauggacug

SEQ ID NO: 2679851 - RNA, 16 nt, Human
ucuauuuauuaauauu

SEQ ID NO: 2679852 - RNA, 12 nt, Human
ucuauuuuaaga

SEQ ID NO: 2679853 - RNA, 12 nt, Human
ucuauuuuaauc

SEQ ID NO: 2679854 - RNA, 15 nt, Human
ucuauuuauguuugc

SEQ ID NO: 2679855 - RNA, 13 nt, Human
ucuauuuauguuu

SEQ ID NO: 2679856 - RNA, 16 nt, Human
ucuauugcuucaccau

SEQ ID NO: 2679857 - RNA, 22 nt, Human
ucucacccaugcaagcagagga

SEQ ID NO: 2679858 - RNA, 23 nt, Human
ucucacccaugcaagcagaggac

SEQ ID NO: 2679859 - RNA, 21 nt, Human
ucuauuaauauauguauuauu

SEQ ID NO: 2679860 - RNA, 16 nt, Human
ucuauuaauauaugua

SEQ ID NO: 2679861 - RNA, 13 nt, Human
ucuauuaauauau

SEQ ID NO: 2679862 - RNA, 12 nt, Human
ucuauuaauaua

SEQ ID NO: 2679863 - RNA, 10 nt, Human
ucuauuaaua

SEQ ID NO: 2679864 - RNA, 22 nt, Human
ucuauuaauauauguauuauuu

SEQ ID NO: 2679865 - RNA, 16 nt, Human
ucuauuaauauucagg

SEQ ID NO: 2679866 - RNA, 18 nt, Human
ucuauucugagaaaacaa

SEQ ID NO: 2679867 - RNA, 19 nt, Human
ucuauucugagaaaacaag

SEQ ID NO: 2679868 - RNA, 14 nt, Human
ucuauuccaauaaa

SEQ ID NO: 2679869 - RNA, 15 nt, Human
ucuauuccaauaaac

SEQ ID NO: 2679870 - RNA, 15 nt, Human
ucuauuauggaaaac

SEQ ID NO: 2679871 - RNA, 17 nt, Human
ucuauuauggaaaacug

SEQ ID NO: 2679872 - RNA, 20 nt, Human
ucuauuauggaaaacugugu

SEQ ID NO: 2679873 - RNA, 16 nt, Human
ucuauuauuuuuauaa

SEQ ID NO: 2679874 - RNA, 17 nt, Human
ucuauagcaucacuuaa

SEQ ID NO: 2679875 - RNA, 15 nt, Human
ucuauagcaucacuu

SEQ ID NO: 2679876 - RNA, 13 nt, Human
ucuaguucuuugu

SEQ ID NO: 2679877 - RNA, 21 nt, Human
ucuagagcuuaaugcuacaug

SEQ ID NO: 2679878 - RNA, 13 nt, Human
acuuacuugcuua

SEQ ID NO: 2679879 - RNA, 23 nt, Human
acuuagggcaccagggguuucuc

SEQ ID NO: 2679880 - RNA, 17 nt, Human
acuuaugaaugauuugc

SEQ ID NO: 2679881 - RNA, 20 nt, Human
acuuaugaaugauuugcaua

SEQ ID NO: 2679882 - RNA, 16 nt, Human
acuuagggcaccaggg

SEQ ID NO: 2679883 - RNA, 15 nt, Human
acuuagguguggggg

SEQ ID NO: 2679884 - RNA, 13 nt, Human
acuuauugaauau

SEQ ID NO: 2679885 - RNA, 15 nt, Human
acuuauugaauauau

SEQ ID NO: 2679886 - RNA, 17 nt, Human
acuuauugaauauauga

SEQ ID NO: 2679887 - RNA, 18 nt, Human
acuuauugaauauaugau

SEQ ID NO: 2679888 - RNA, 15 nt, Human
acuuauugaccauuu

SEQ ID NO: 2679889 - RNA, 19 nt, Human
acuuaaaugguaauaagca

SEQ ID NO: 2679890 - RNA, 15 nt, Human
acuguugauaaaaac

SEQ ID NO: 2679891 - RNA, 13 nt, Human
acuuaacugaaau

SEQ ID NO: 2679892 - RNA, 22 nt, Human
acuuaacugaaaugccugcuuu

SEQ ID NO: 2679893 - RNA, 18 nt, Human
acuuaaauguuauuaucu

SEQ ID NO: 2679894 - RNA, 15 nt, Human
acuuaaauguuauua

SEQ ID NO: 2679895 - RNA, 20 nt, Human
acuuaacauagccaaaaugu

SEQ ID NO: 2679896 - RNA, 18 nt, Human
ucuaauaagcuaguugaa

SEQ ID NO: 2679897 - RNA, 16 nt, Human
acuguucacucacucu

SEQ ID NO: 2679898 - RNA, 15 nt, Human
acuguucuuuccagg

SEQ ID NO: 2679899 - RNA, 12 nt, Human
agaauagaaaca

SEQ ID NO: 2679900 - RNA, 13 nt, Human
agaauagaaacaa

SEQ ID NO: 2679901 - RNA, 21 nt, Human
agaauauccuuuaaaauuuaa

SEQ ID NO: 2679902 - RNA, 22 nt, Human
agaauauccuuuaaaauuuaaa

SEQ ID NO: 2679903 - RNA, 16 nt, Human
agaauaugacuuuuua

SEQ ID NO: 2679904 - RNA, 21 nt, Human
agaauaaguuauugcaguuua

SEQ ID NO: 2679905 - RNA, 19 nt, Human
agaauaaguuauugcaguu

SEQ ID NO: 2679906 - RNA, 20 nt, Human
agaauaaguuauugcaguuu

SEQ ID NO: 2679907 - RNA, 15 nt, Human
agaauacugauggaa

SEQ ID NO: 2679908 - RNA, 17 nt, Human
agaauacugauggaauu

SEQ ID NO: 2679909 - RNA, 21 nt, Human
agaauacugauggaauuuuuu

SEQ ID NO: 2679910 - RNA, 12 nt, Human
agaauaaguuau

SEQ ID NO: 2679911 - RNA, 13 nt, Human
agaauaaguuauu

SEQ ID NO: 2679912 - RNA, 14 nt, Human
agaauaaguuauug

SEQ ID NO: 2679913 - RNA, 16 nt, Human
agaauaaguuauugca

SEQ ID NO: 2679914 - RNA, 17 nt, Human
agaauaaguuauugcag

SEQ ID NO: 2679915 - RNA, 13 nt, Human
agaauaagaauuu

SEQ ID NO: 2679916 - RNA, 16 nt, Human
agaauaagaauuugca

SEQ ID NO: 2679917 - RNA, 17 nt, Human
agaauaagaauuugcau

SEQ ID NO: 2679918 - RNA, 18 nt, Human
agaauaagaauuugcaua

SEQ ID NO: 2679919 - RNA, 15 nt, Human
agaaguuaguuugua

SEQ ID NO: 2679920 - RNA, 16 nt, Human
agaaguuaguuuguau

SEQ ID NO: 2679921 - RNA, 18 nt, Human
agaaguuaguuuguauau

SEQ ID NO: 2679922 - RNA, 19 nt, Human
agaaguuaguuuguauaua

SEQ ID NO: 2679923 - RNA, 23 nt, Human
agaaguuauuuucuacagugguu

SEQ ID NO: 2679924 - RNA, 13 nt, Human
agaaggcaauauu

SEQ ID NO: 2679925 - RNA, 14 nt, Human
agaaggcaauauua

SEQ ID NO: 2679926 - RNA, 17 nt, Human
ucugcuuucuccuuuaa

SEQ ID NO: 2679927 - RNA, 19 nt, Human
ucugcuuuagacuugaaaa

SEQ ID NO: 2679928 - RNA, 18 nt, Human
ucugcuuuagacuugaaa

SEQ ID NO: 2679929 - RNA, 16 nt, Human
ucugcuugcuuggccc

SEQ ID NO: 2679930 - RNA, 12 nt, Human
ucugcuuuagac

SEQ ID NO: 2679931 - RNA, 17 nt, Human
ucugcuuuagacuugaa

SEQ ID NO: 2679932 - RNA, 16 nt, Human
ucugcuuuagacuuga

SEQ ID NO: 2679933 - RNA, 20 nt, Human
agaauucaaacuggggccuc

SEQ ID NO: 2679934 - RNA, 21 nt, Human
agaauguacguccagccugcc

SEQ ID NO: 2679935 - RNA, 14 nt, Human
agaauuauuuuuca

SEQ ID NO: 2679936 - RNA, 13 nt, Human
agaauucagacau

SEQ ID NO: 2679937 - RNA, 13 nt, Human
agaauauugcaaa

SEQ ID NO: 2679938 - RNA, 15 nt, Human
agaauauugcaaaau

SEQ ID NO: 2679939 - RNA, 16 nt, Human
agaauauugcaaaaua

SEQ ID NO: 2679940 - RNA, 18 nt, Human
agaauauugcaaaauaca

SEQ ID NO: 2679941 - RNA, 19 nt, Human
agaauauugcaaaauacau

SEQ ID NO: 2679942 - RNA, 21 nt, Human
agaauauugcaaaauacauga

SEQ ID NO: 2679943 - RNA, 22 nt, Human
agaauauugcaaaauacaugaa

SEQ ID NO: 2679944 - RNA, 15 nt, Human
agaaucccuguguua

SEQ ID NO: 2679945 - RNA, 21 nt, Human
agaaucccuguguuaauuuaa

SEQ ID NO: 2679946 - RNA, 19 nt, Human
agaaucccuguguuaauuu

SEQ ID NO: 2679947 - RNA, 18 nt, Human
agaaucccuguguuaauu

SEQ ID NO: 2679948 - RNA, 17 nt, Human
agaaucccuguguuaau

SEQ ID NO: 2679949 - RNA, 19 nt, Human
agaauggugugaacccggg

SEQ ID NO: 2679950 - RNA, 20 nt, Human
agaauggugugaacccggga

SEQ ID NO: 2679951 - RNA, 19 nt, Human
ucugugaacaagcuucagu

SEQ ID NO: 2679952 - RNA, 17 nt, Human
ucugugaacagagagac

SEQ ID NO: 2679953 - RNA, 19 nt, Human
ucugugagaagguuuauug

SEQ ID NO: 2679954 - RNA, 20 nt, Human
ucugugagaagguuuauugu

SEQ ID NO: 2679955 - RNA, 23 nt, Human
ucugugagaagguuuauuguuaa

SEQ ID NO: 2679956 - RNA, 23 nt, Human
ucuguauuuuauuuagacaagag

SEQ ID NO: 2679957 - RNA, 22 nt, Human
ucuguauuugaaagugccuuug

SEQ ID NO: 2679958 - RNA, 18 nt, Human
ucuguauuugaaagugcc

SEQ ID NO: 2679959 - RNA, 15 nt, Human
ucuguauuugaaagu

SEQ ID NO: 2679960 - RNA, 14 nt, Human
ucuguauuugaaag

SEQ ID NO: 2679961 - RNA, 13 nt, Human
ucuguauuugaaa

SEQ ID NO: 2679962 - RNA, 18 nt, Human
ucuguuggcaggcuggcc

SEQ ID NO: 2679963 - RNA, 20 nt, Human
ucuguuggcaggcuggccag

SEQ ID NO: 2679964 - RNA, 18 nt, Human
ucuguugugugucaugcc

SEQ ID NO: 2679965 - RNA, 14 nt, Human
ucuguuguguguca

SEQ ID NO: 2679966 - RNA, 16 nt, Human
agaauugaaaaguuuu

SEQ ID NO: 2679967 - RNA, 17 nt, Human
agaauugaaaaguuuuu

SEQ ID NO: 2679968 - RNA, 19 nt, Human
agaauugaaaaguuuuugu

SEQ ID NO: 2679969 - RNA, 18 nt, Human
ucuguuuaauuuucacuu

SEQ ID NO: 2679970 - RNA, 15 nt, Human
ucuguuggcaggcug

SEQ ID NO: 2679971 - RNA, 12 nt, Human
ucuguugaaguu

SEQ ID NO: 2679972 - RNA, 17 nt, Human
ucuguugauaaauccau

SEQ ID NO: 2679973 - RNA, 15 nt, Human
agacagagaggacug

SEQ ID NO: 2679974 - RNA, 20 nt, Human
agacagagaggacuguaggg

SEQ ID NO: 2679975 - RNA, 14 nt, Human
agacacuguugaua

SEQ ID NO: 2679976 - RNA, 17 nt, Human
agacacuguugauaaaa

SEQ ID NO: 2679977 - RNA, 18 nt, Human
agacacuguugauaaaaa

SEQ ID NO: 2679978 - RNA, 19 nt, Human
agacacuguugauaaaaac

SEQ ID NO: 2679979 - RNA, 11 nt, Human
agacacugccu

SEQ ID NO: 2679980 - RNA, 12 nt, Human
agacacugccug

SEQ ID NO: 2679981 - RNA, 13 nt, Human
agacacugccugg

SEQ ID NO: 2679982 - RNA, 14 nt, Human
agacacugccuggg

SEQ ID NO: 2679983 - RNA, 15 nt, Human
agacacugccugggc

SEQ ID NO: 2679984 - RNA, 16 nt, Human
agacacugccugggcu

SEQ ID NO: 2679985 - RNA, 21 nt, Human
agacacauacaugucacauuu

SEQ ID NO: 2679986 - RNA, 14 nt, Human
agacaccugguugc

SEQ ID NO: 2679987 - RNA, 12 nt, Human
agaauuugcaua

SEQ ID NO: 2679988 - RNA, 13 nt, Human
agaauuugcauac

SEQ ID NO: 2679989 - RNA, 17 nt, Human
agaauuugcauacuuac

SEQ ID NO: 2679990 - RNA, 20 nt, Human
agaauugauauacacggaug

SEQ ID NO: 2679991 - RNA, 12 nt, Human
agaauugaaggu

SEQ ID NO: 2679992 - RNA, 16 nt, Human
agaauugaagguuuuu

SEQ ID NO: 2679993 - RNA, 15 nt, Human
agaauugaagguuuu

SEQ ID NO: 2679994 - RNA, 14 nt, Human
agaauugaagguuu

SEQ ID NO: 2679995 - RNA, 13 nt, Human
agaauugaagguu

SEQ ID NO: 2679996 - RNA, 21 nt, Human
agaauugaagguuuuugauag

SEQ ID NO: 2679997 - RNA, 20 nt, Human
agaauugaagguuuuugaua

SEQ ID NO: 2679998 - RNA, 18 nt, Human
agaauugaagguuuuuga

SEQ ID NO: 2679999 - RNA, 15 nt, Human
ucugagguuuuauuu

SEQ ID NO: 2680000 - RNA, 16 nt, Human
ucugacucgguuucuc

SEQ ID NO: 2680001 - RNA, 18 nt, Human
ucugacucgguuucucca

SEQ ID NO: 2680002 - RNA, 19 nt, Human
ucugacucgguuucuccaa

SEQ ID NO: 2680003 - RNA, 20 nt, Human
ucugacucgguuucuccaaa

SEQ ID NO: 2680004 - RNA, 15 nt, Human
ucuccuuuaauugua

SEQ ID NO: 2680005 - RNA, 17 nt, Human
ucuccuuuaauuguaaa

SEQ ID NO: 2680006 - RNA, 22 nt, Human
ucuccuuuaauuguaaaguaaa

SEQ ID NO: 2680007 - RNA, 22 nt, Human
agaaaugaggaggaugcuaaaa

SEQ ID NO: 2680008 - RNA, 18 nt, Human
agaaaugauguuggagaa

SEQ ID NO: 2680009 - RNA, 17 nt, Human
agaaauauuaagcaugu

SEQ ID NO: 2680010 - RNA, 15 nt, Human
agaagacaaacugcu

SEQ ID NO: 2680011 - RNA, 12 nt, Human
agaagacaaaau

SEQ ID NO: 2680012 - RNA, 14 nt, Human
agaacugucuguga

SEQ ID NO: 2680013 - RNA, 16 nt, Human
agaagaaguucauguc

SEQ ID NO: 2680014 - RNA, 22 nt, Human
agaagccaagggaaaggggugc

SEQ ID NO: 2680015 - RNA, 22 nt, Human
agaagccaaucuacaaucucuu

SEQ ID NO: 2680016 - RNA, 15 nt, Human
agaagccaagggaaa

SEQ ID NO: 2680017 - RNA, 16 nt, Human
agaagccaagggaaag

SEQ ID NO: 2680018 - RNA, 18 nt, Human
agaagccaagggaaaggg

SEQ ID NO: 2680019 - RNA, 19 nt, Human
agaagccaagggaaagggg

SEQ ID NO: 2680020 - RNA, 18 nt, Human
ucugcuugcucuuguccu

SEQ ID NO: 2680021 - RNA, 15 nt, Human
ucugcucaccgccca

SEQ ID NO: 2680022 - RNA, 20 nt, Human
ucugcucaccgcccaucagg

SEQ ID NO: 2680023 - RNA, 21 nt, Human
ucugcucaccgcccaucaggg

SEQ ID NO: 2680024 - RNA, 19 nt, Human
ucugcgucuauccugugua

SEQ ID NO: 2680025 - RNA, 19 nt, Human
ucugcggaucucagcuuug

SEQ ID NO: 2680026 - RNA, 21 nt, Human
ucugccuggaguguaugacug

SEQ ID NO: 2680027 - RNA, 17 nt, Human
ucugcggaucucagcuu

SEQ ID NO: 2680028 - RNA, 23 nt, Human
ucugccuggagacuuagggcacc

SEQ ID NO: 2680029 - RNA, 12 nt, Human
ucugccugcccc

SEQ ID NO: 2680030 - RNA, 14 nt, Human
ucugccugccccgc

SEQ ID NO: 2680031 - RNA, 12 nt, Human
ucugccuggagu

SEQ ID NO: 2680032 - RNA, 13 nt, Human
ucugccuggagug

SEQ ID NO: 2680033 - RNA, 21 nt, Human
agaagccaagggaaaggggug

SEQ ID NO: 2680034 - RNA, 23 nt, Human
agaucccauggguuguguguuua

SEQ ID NO: 2680035 - RNA, 17 nt, Human
agauccugcgggugggg

SEQ ID NO: 2680036 - RNA, 12 nt, Human
agauccuccugc

SEQ ID NO: 2680037 - RNA, 18 nt, Human
agauccugcggguggggc

SEQ ID NO: 2680038 - RNA, 19 nt, Human
agaucgugcuacugcacuc

SEQ ID NO: 2680039 - RNA, 16 nt, Human
agaucucgguuugcca

SEQ ID NO: 2680040 - RNA, 22 nt, Human
agaucucgguuugccaaaauuc

SEQ ID NO: 2680041 - RNA, 12 nt, Human
agaucuccagcg

SEQ ID NO: 2680042 - RNA, 17 nt, Human
agaugccacuucuaaga

SEQ ID NO: 2680043 - RNA, 20 nt, Human
agaugccacuucuaagaaaa

SEQ ID NO: 2680044 - RNA, 20 nt, Human
agaugcaccaccaagccaag

SEQ ID NO: 2680045 - RNA, 17 nt, Human
agaugccacccuagcca

SEQ ID NO: 2680046 - RNA, 15 nt, Human
agaugccacccuagc

SEQ ID NO: 2680047 - RNA, 18 nt, Human
agaugcaccaccaagcca

SEQ ID NO: 2680048 - RNA, 19 nt, Human
ugaaugcugggacucagcc

SEQ ID NO: 2680049 - RNA, 14 nt, Human
ugaaugcugggacu

SEQ ID NO: 2680050 - RNA, 15 nt, Human
ugaaugcugggacuc

SEQ ID NO: 2680051 - RNA, 11 nt, Human
ugaaugcuggg

SEQ ID NO: 2680052 - RNA, 12 nt, Human
ugaaugcuggga

SEQ ID NO: 2680053 - RNA, 13 nt, Human
ugaaugcugggac

SEQ ID NO: 2680054 - RNA, 13 nt, Human
ugaaucaauaaua

SEQ ID NO: 2680055 - RNA, 15 nt, Human
ugaaucaauaauaua

SEQ ID NO: 2680056 - RNA, 16 nt, Human
ugaaucaauaauauau

SEQ ID NO: 2680057 - RNA, 17 nt, Human
ugaaucaauaauauauu

SEQ ID NO: 2680058 - RNA, 19 nt, Human
ugaaucaauaauauauuuu

SEQ ID NO: 2680059 - RNA, 20 nt, Human
ugaaucaauaauauauuuuc

SEQ ID NO: 2680060 - RNA, 22 nt, Human
ugacacugaacuuaauaacugu

SEQ ID NO: 2680061 - RNA, 14 nt, Human
ugacauuaacaaau

SEQ ID NO: 2680062 - RNA, 19 nt, Human
ugacauuaacaaauaaaaa

SEQ ID NO: 2680063 - RNA, 13 nt, Human
ugacauuucuucu

SEQ ID NO: 2680064 - RNA, 22 nt, Human
ugacauuucuucuagugaugau

SEQ ID NO: 2680065 - RNA, 13 nt, Human
ugacaggaaccuu

SEQ ID NO: 2680066 - RNA, 13 nt, Human
agaugugaaaauu

SEQ ID NO: 2680067 - RNA, 15 nt, Human
agaugugaaaauuac

SEQ ID NO: 2680068 - RNA, 11 nt, Human
agaugugaauu

SEQ ID NO: 2680069 - RNA, 14 nt, Human
agaugugaauuauu

SEQ ID NO: 2680070 - RNA, 16 nt, Human
agaugugaauuauuga

SEQ ID NO: 2680071 - RNA, 18 nt, Human
agaugugaauuauugaca

SEQ ID NO: 2680072 - RNA, 20 nt, Human
agaugugaauuauugacacu

SEQ ID NO: 2680073 - RNA, 21 nt, Human
agaugugaauuauugacacug

SEQ ID NO: 2680074 - RNA, 22 nt, Human
agaugugaauuauugacacuga

SEQ ID NO: 2680075 - RNA, 23 nt, Human
agaugugaauuauugacacugaa

SEQ ID NO: 2680076 - RNA, 22 nt, Human
ugaccuggcaucuaauucugau

SEQ ID NO: 2680077 - RNA, 20 nt, Human
ugacuaugcguggcuggaac

SEQ ID NO: 2680078 - RNA, 18 nt, Human
ugacuauauaauuuauuu

SEQ ID NO: 2680079 - RNA, 23 nt, Human
ugacuauauaauuuauuuccacu

SEQ ID NO: 2680080 - RNA, 14 nt, Human
ugacucgguuucuc

SEQ ID NO: 2680081 - RNA, 15 nt, Human
ugacucgguuucucc

SEQ ID NO: 2680082 - RNA, 16 nt, Human
ugacucgguuucucca

SEQ ID NO: 2680083 - RNA, 18 nt, Human
ugacucgguuucuccaaa

SEQ ID NO: 2680084 - RNA, 18 nt, Human
ugacucggggguggggaa

SEQ ID NO: 2680085 - RNA, 21 nt, Human
ugacuguuuucucuugagagg

SEQ ID NO: 2680086 - RNA, 19 nt, Human
ugacuuaacauagccaaaa

SEQ ID NO: 2680087 - RNA, 16 nt, Human
ugacuuaacugcauuu

SEQ ID NO: 2680088 - RNA, 22 nt, Human
ugacuuaacauagccaaaaugu

SEQ ID NO: 2680089 - RNA, 20 nt, Human
ugacuuaacauagccaaaau

SEQ ID NO: 2680090 - RNA, 15 nt, Human
agauuaagagcaaau

SEQ ID NO: 2680091 - RNA, 23 nt, Human
ugacuuagaaucccuguguuaau

SEQ ID NO: 2680092 - RNA, 22 nt, Human
ugacuuagaaucccuguguuaa

SEQ ID NO: 2680093 - RNA, 21 nt, Human
ugacuuagaaucccuguguua

SEQ ID NO: 2680094 - RNA, 20 nt, Human
ugacuuagaaucccuguguu

SEQ ID NO: 2680095 - RNA, 19 nt, Human
ugacuuagaaucccugugu

SEQ ID NO: 2680096 - RNA, 13 nt, Human
ugacuuagaaucc

SEQ ID NO: 2680097 - RNA, 13 nt, Human
agauuauaauaaa

SEQ ID NO: 2680098 - RNA, 18 nt, Human
agauuauaauaaauauau

SEQ ID NO: 2680099 - RNA, 14 nt, Human
agcaccucagccug

SEQ ID NO: 2680100 - RNA, 16 nt, Human
agcaccucagccugca

SEQ ID NO: 2680101 - RNA, 14 nt, Human
agcaccgaggggcc

SEQ ID NO: 2680102 - RNA, 17 nt, Human
agcaccgaggggccuuu

SEQ ID NO: 2680103 - RNA, 18 nt, Human
agcaccgaggggccuuug

SEQ ID NO: 2680104 - RNA, 14 nt, Human
agcacagcuugacc

SEQ ID NO: 2680105 - RNA, 22 nt, Human
agcaaucaagguuauaauuuuu

SEQ ID NO: 2680106 - RNA, 15 nt, Human
agcaauaaaugaaug

SEQ ID NO: 2680107 - RNA, 14 nt, Human
agcaauaaaugaau

SEQ ID NO: 2680108 - RNA, 13 nt, Human
agcaauaaaugaa

SEQ ID NO: 2680109 - RNA, 12 nt, Human
agcaauagaaac

SEQ ID NO: 2680110 - RNA, 14 nt, Human
agcaauagaaacaa

SEQ ID NO: 2680111 - RNA, 18 nt, Human
agcacagcuugaccugag

SEQ ID NO: 2680112 - RNA, 20 nt, Human
agcacagcuugaccugaggc

SEQ ID NO: 2680113 - RNA, 13 nt, Human
agcaaguaaaaag

SEQ ID NO: 2680114 - RNA, 18 nt, Human
agcaaguaaaaaggcuaa

SEQ ID NO: 2680115 - RNA, 16 nt, Human
agcaagugagacccug

SEQ ID NO: 2680116 - RNA, 18 nt, Human
agcaagcaguagcauuug

SEQ ID NO: 2680117 - RNA, 21 nt, Human
ugagauggaaaaguguccuuc

SEQ ID NO: 2680118 - RNA, 22 nt, Human
ugagauuuuuaaaaaauauuuu

SEQ ID NO: 2680119 - RNA, 18 nt, Human
ugagcaaacuaacuugac

SEQ ID NO: 2680120 - RNA, 18 nt, Human
ugagcauguuugccuaga

SEQ ID NO: 2680121 - RNA, 13 nt, Human
ugagaagccuuca

SEQ ID NO: 2680122 - RNA, 14 nt, Human
ugagaagccuucag

SEQ ID NO: 2680123 - RNA, 15 nt, Human
ugagaagccuucagc

SEQ ID NO: 2680124 - RNA, 19 nt, Human
ugagaagccuucagcucca

SEQ ID NO: 2680125 - RNA, 20 nt, Human
ugagaagccuucagcuccag

SEQ ID NO: 2680126 - RNA, 22 nt, Human
ugagacacggagcccagcccuc

SEQ ID NO: 2680127 - RNA, 17 nt, Human
ugagacacggagcccag

SEQ ID NO: 2680128 - RNA, 21 nt, Human
ugagacacggagcccagcccu

SEQ ID NO: 2680129 - RNA, 13 nt, Human
ugagacugugcug

SEQ ID NO: 2680130 - RNA, 21 nt, Human
ugagacugugcuguuguucuc

SEQ ID NO: 2680131 - RNA, 13 nt, Human
ugagagcauaauu

SEQ ID NO: 2680132 - RNA, 15 nt, Human
ugagagcauaauuua

SEQ ID NO: 2680133 - RNA, 13 nt, Human
ugagauguaaaaa

SEQ ID NO: 2680134 - RNA, 20 nt, Human
ugagauguguggacuguggc

SEQ ID NO: 2680135 - RNA, 13 nt, Human
ugagauugguuuu

SEQ ID NO: 2680136 - RNA, 15 nt, Human
ugagauugguuuucc

SEQ ID NO: 2680137 - RNA, 19 nt, Human
ugagauugguuuuccugug

SEQ ID NO: 2680138 - RNA, 22 nt, Human
ugagauugguuuuccuguggca

SEQ ID NO: 2680139 - RNA, 15 nt, Human
ugagauucucaaagg

SEQ ID NO: 2680140 - RNA, 22 nt, Human
ugagauucucaaaggagcgagc

SEQ ID NO: 2680141 - RNA, 19 nt, Human
ugaaaaugaauaucuauua

SEQ ID NO: 2680142 - RNA, 13 nt, Human
ugaaaauaccauu

SEQ ID NO: 2680143 - RNA, 23 nt, Human
ugaaaaugaauaucuauuaauau

SEQ ID NO: 2680144 - RNA, 21 nt, Human
ugaaaaugaauaucuauuaau

SEQ ID NO: 2680145 - RNA, 11 nt, Human
ugaaaauggaa

SEQ ID NO: 2680146 - RNA, 23 nt, Human
ugaaaauacaacuuaaauaauaa

SEQ ID NO: 2680147 - RNA, 18 nt, Human
ugaaaauaguuuauuuua

SEQ ID NO: 2680148 - RNA, 19 nt, Human
ugaaaauacaacuuaaaua

SEQ ID NO: 2680149 - RNA, 12 nt, Human
ugaaaauacaac

SEQ ID NO: 2680150 - RNA, 15 nt, Human
ugaaaaguuuuuguu

SEQ ID NO: 2680151 - RNA, 15 nt, Human
ucuuuuuuuuuaagu

SEQ ID NO: 2680152 - RNA, 16 nt, Human
ucuuuuuuuuuaaguu

SEQ ID NO: 2680153 - RNA, 18 nt, Human
ucuuuuuuuuuaaguucu

SEQ ID NO: 2680154 - RNA, 20 nt, Human
ucuuuuuuuuuaaguucuua

SEQ ID NO: 2680155 - RNA, 14 nt, Human
agagacugaaauua

SEQ ID NO: 2680156 - RNA, 13 nt, Human
agagauccaaaga

SEQ ID NO: 2680157 - RNA, 14 nt, Human
agagauccaaagac

SEQ ID NO: 2680158 - RNA, 15 nt, Human
agagauccaaagacu

SEQ ID NO: 2680159 - RNA, 16 nt, Human
agagauccaaagacuc

SEQ ID NO: 2680160 - RNA, 13 nt, Human
ugaaagaaaauug

SEQ ID NO: 2680161 - RNA, 14 nt, Human
ugaaagaaaauuga

SEQ ID NO: 2680162 - RNA, 15 nt, Human
ugaaagaaaauugag

SEQ ID NO: 2680163 - RNA, 17 nt, Human
ugaaagaaaauugaguu

SEQ ID NO: 2680164 - RNA, 22 nt, Human
ugaaagaaaauugaguugcacu

SEQ ID NO: 2680165 - RNA, 20 nt, Human
agagacacuguugauaaaaa

SEQ ID NO: 2680166 - RNA, 22 nt, Human
agagacacuguugauaaaaacu

SEQ ID NO: 2680167 - RNA, 16 nt, Human
ucuuuuuucaaaagaa

SEQ ID NO: 2680168 - RNA, 17 nt, Human
ucuuuuuucaaaagaaa

SEQ ID NO: 2680169 - RNA, 22 nt, Human
agacugguuuauccacccacaa

SEQ ID NO: 2680170 - RNA, 14 nt, Human
agacugguuuucug

SEQ ID NO: 2680171 - RNA, 15 nt, Human
agacugguuuucugc

SEQ ID NO: 2680172 - RNA, 16 nt, Human
agacugguuuucugcc

SEQ ID NO: 2680173 - RNA, 18 nt, Human
agacugguuuucugccaa

SEQ ID NO: 2680174 - RNA, 21 nt, Human
agacuguaacuuccaaauaaa

SEQ ID NO: 2680175 - RNA, 22 nt, Human
agacuguaacuuccaaauaaau

SEQ ID NO: 2680176 - RNA, 15 nt, Human
ucuuucucaaagaaa

SEQ ID NO: 2680177 - RNA, 16 nt, Human
ucuuuccugaaccaug

SEQ ID NO: 2680178 - RNA, 15 nt, Human
agacaggagacaaaa

SEQ ID NO: 2680179 - RNA, 22 nt, Human
agacuggcuuuuauuaaugcac

SEQ ID NO: 2680180 - RNA, 23 nt, Human
agacuggcuuuuauuaaugcacu

SEQ ID NO: 2680181 - RNA, 11 nt, Human
agacuggcuuu

SEQ ID NO: 2680182 - RNA, 18 nt, Human
agacuggcuuuuauuaau

SEQ ID NO: 2680183 - RNA, 13 nt, Human
agaggccagaggc

SEQ ID NO: 2680184 - RNA, 17 nt, Human
agaggcccuuugcuguc

SEQ ID NO: 2680185 - RNA, 14 nt, Human
agaggcugccccuc

SEQ ID NO: 2680186 - RNA, 16 nt, Human
agaggcugccccucuc

SEQ ID NO: 2680187 - RNA, 18 nt, Human
agaggcugccccucucac

SEQ ID NO: 2680188 - RNA, 19 nt, Human
agaggcugccccucucacc

SEQ ID NO: 2680189 - RNA, 12 nt, Human
agaggcugcccc

SEQ ID NO: 2680190 - RNA, 20 nt, Human
agaggcugccccucucacca

SEQ ID NO: 2680191 - RNA, 20 nt, Human
agagggaggucacuggaaag

SEQ ID NO: 2680192 - RNA, 22 nt, Human
agagggaggucacuggaaaggg

SEQ ID NO: 2680193 - RNA, 17 nt, Human
ugaagggacccuuuggg

SEQ ID NO: 2680194 - RNA, 13 nt, Human
ugaagguuuuuga

SEQ ID NO: 2680195 - RNA, 18 nt, Human
ugaagguuuuugauagca

SEQ ID NO: 2680196 - RNA, 14 nt, Human
ugaagguuuuugau

SEQ ID NO: 2680197 - RNA, 19 nt, Human
ugaagguuuuugauagcau

SEQ ID NO: 2680198 - RNA, 15 nt, Human
ugaaguaaaagcaag

SEQ ID NO: 2680199 - RNA, 20 nt, Human
ugaaguaaugaauuuuuaug

SEQ ID NO: 2680200 - RNA, 14 nt, Human
ugaaguaaugaauu

SEQ ID NO: 2680201 - RNA, 12 nt, Human
ugaauaauacag

SEQ ID NO: 2680202 - RNA, 21 nt, Human
ugaauaaauucuauaggaaca

SEQ ID NO: 2680203 - RNA, 19 nt, Human
ugaauaaauucuauaggaa

SEQ ID NO: 2680204 - RNA, 12 nt, Human
ugaauaaaugug

SEQ ID NO: 2680205 - RNA, 13 nt, Human
ugaauaaaugugu

SEQ ID NO: 2680206 - RNA, 15 nt, Human
ugaaucaaaagugcc

SEQ ID NO: 2680207 - RNA, 16 nt, Human
ugaaucaaaagugccu

SEQ ID NO: 2680208 - RNA, 12 nt, Human
ugaauauuuuca

SEQ ID NO: 2680209 - RNA, 13 nt, Human
ugaauauuuucaa

SEQ ID NO: 2680210 - RNA, 15 nt, Human
ugaauacauuuccaa

SEQ ID NO: 2680211 - RNA, 13 nt, Human
ugaauaauacagu

SEQ ID NO: 2680212 - RNA, 14 nt, Human
ugaagaacugcagg

SEQ ID NO: 2680213 - RNA, 15 nt, Human
ugaagaacugcaggc

SEQ ID NO: 2680214 - RNA, 16 nt, Human
ugaagaacugcaggcc

SEQ ID NO: 2680215 - RNA, 17 nt, Human
ugaagaacugcaggccc

SEQ ID NO: 2680216 - RNA, 11 nt, Human
ugaagaauuua

SEQ ID NO: 2680217 - RNA, 15 nt, Human
ugaagaauuuaaaga

SEQ ID NO: 2680218 - RNA, 13 nt, Human
ugaagaauuuaaa

SEQ ID NO: 2680219 - RNA, 15 nt, Human
ugaagaauggcgcca

SEQ ID NO: 2680220 - RNA, 13 nt, Human
ugaagaauugaaa

SEQ ID NO: 2680221 - RNA, 23 nt, Human
ugaagaauguuagaguaaugaaa

SEQ ID NO: 2680222 - RNA, 16 nt, Human
ugaagaauagaaacaa

SEQ ID NO: 2680223 - RNA, 18 nt, Human
ugaagaauagaaacaagc

SEQ ID NO: 2680224 - RNA, 18 nt, Human
ugaagaacugcaggcccu

SEQ ID NO: 2680225 - RNA, 12 nt, Human
ugaagaagccug

SEQ ID NO: 2680226 - RNA, 14 nt, Human
ugaagaagccugua

SEQ ID NO: 2680227 - RNA, 16 nt, Human
ugaagaauuuaaagaa

SEQ ID NO: 2680228 - RNA, 20 nt, Human
ugaaccauggugaagugcuu

SEQ ID NO: 2680229 - RNA, 22 nt, Human
ugaaccauggugaagugcuugg

SEQ ID NO: 2680230 - RNA, 23 nt, Human
ugaaccauggugaagugcuugga

SEQ ID NO: 2680231 - RNA, 18 nt, Human
ugaaccauaaaaugucca

SEQ ID NO: 2680232 - RNA, 16 nt, Human
ugaaccauaaauucaa

SEQ ID NO: 2680233 - RNA, 21 nt, Human
ugaaccauaaauucaacuuug

SEQ ID NO: 2680234 - RNA, 22 nt, Human
ugaaccauaaauucaacuuugu

SEQ ID NO: 2680235 - RNA, 13 nt, Human
ugaaccacuugua

SEQ ID NO: 2680236 - RNA, 15 nt, Human
ugaaccacuuguaga

SEQ ID NO: 2680237 - RNA, 14 nt, Human
ugaaccacuuguag

SEQ ID NO: 2680238 - RNA, 16 nt, Human
ugaaccauaaaauguc

SEQ ID NO: 2680239 - RNA, 15 nt, Human
ugaaccauaaaaugu

SEQ ID NO: 2680240 - RNA, 13 nt, Human
ugaaccauaaaau

SEQ ID NO: 2680241 - RNA, 23 nt, Human
ugaaccacuuguagauuugauuu

SEQ ID NO: 2680242 - RNA, 21 nt, Human
ugaaccacuuguagauuugau

SEQ ID NO: 2680243 - RNA, 20 nt, Human
ugaaccacuuguagauuuga

SEQ ID NO: 2680244 - RNA, 16 nt, Human
ugaaccacuuguagau

SEQ ID NO: 2680245 - RNA, 17 nt, Human
ugaaaguuuuguaaaag

SEQ ID NO: 2680246 - RNA, 20 nt, Human
ugaaaguuuuguaaaagaaa

SEQ ID NO: 2680247 - RNA, 22 nt, Human
ugaaaguuuuguaaaagaaauc

SEQ ID NO: 2680248 - RNA, 16 nt, Human
agagauugugguuuca

SEQ ID NO: 2680249 - RNA, 14 nt, Human
ugaaauaacuggaa

SEQ ID NO: 2680250 - RNA, 20 nt, Human
ugaaauaacuggaacaaauu

SEQ ID NO: 2680251 - RNA, 12 nt, Human
ugaaauaaaaua

SEQ ID NO: 2680252 - RNA, 14 nt, Human
ugaaauaaaauaua

SEQ ID NO: 2680253 - RNA, 20 nt, Human
ugaaauaagaauucagacau

SEQ ID NO: 2680254 - RNA, 15 nt, Human
ugaaauaagaauuca

SEQ ID NO: 2680255 - RNA, 15 nt, Human
ugaaauaggaaacaa

SEQ ID NO: 2680256 - RNA, 17 nt, Human
ugaaauaggaaacaagu

SEQ ID NO: 2680257 - RNA, 18 nt, Human
ugaaauaggaaacaagug

SEQ ID NO: 2680258 - RNA, 16 nt, Human
ugaaauugcauacuuu

SEQ ID NO: 2680259 - RNA, 17 nt, Human
ugaaauugcauacuuug

SEQ ID NO: 2680260 - RNA, 23 nt, Human
aggugaucccguuuuccccauga

SEQ ID NO: 2680261 - RNA, 22 nt, Human
aggugaucugcugcagagcagu

SEQ ID NO: 2680262 - RNA, 21 nt, Human
uguaaaucauguugaucaugu

SEQ ID NO: 2680263 - RNA, 17 nt, Human
aggugauuccagugaag

SEQ ID NO: 2680264 - RNA, 15 nt, Human
aggugaucccguuuu

SEQ ID NO: 2680265 - RNA, 17 nt, Human
aggugguagauauugag

SEQ ID NO: 2680266 - RNA, 14 nt, Human
uguaauuuguuuga

SEQ ID NO: 2680267 - RNA, 13 nt, Human
uguacaaaauuaa

SEQ ID NO: 2680268 - RNA, 16 nt, Human
uguacaaaauuaagca

SEQ ID NO: 2680269 - RNA, 19 nt, Human
uguacaaaauuaagcaaau

SEQ ID NO: 2680270 - RNA, 24 nt, Human
uguacaaaauuaagcaaauguuaa

SEQ ID NO: 2680271 - RNA, 16 nt, Human
uguacauuugggaguu

SEQ ID NO: 2680272 - RNA, 16 nt, Human
uguacauuucuauaaa

SEQ ID NO: 2680273 - RNA, 17 nt, Human
uguacauuucuauaaau

SEQ ID NO: 2680274 - RNA, 18 nt, Human
uguacauuucuauaaaua

SEQ ID NO: 2680275 - RNA, 21 nt, Human
uguacauuucuauaaauagau

SEQ ID NO: 2680276 - RNA, 12 nt, Human
uguaaagacugg

SEQ ID NO: 2680277 - RNA, 21 nt, Human
uguaaauacacauagcaugua

SEQ ID NO: 2680278 - RNA, 18 nt, Human
uguaaauauuuauuuaug

SEQ ID NO: 2680279 - RNA, 13 nt, Human
ugguuuuccugug

SEQ ID NO: 2680280 - RNA, 13 nt, Human
ugguuuucugcca

SEQ ID NO: 2680281 - RNA, 18 nt, Human
ugguuuucugccaaugac

SEQ ID NO: 2680282 - RNA, 21 nt, Human
ugguuuucugccaaugaccaa

SEQ ID NO: 2680283 - RNA, 16 nt, Human
ugguuuuauacugaag

SEQ ID NO: 2680284 - RNA, 23 nt, Human
ugguuuuauacugaaggaaaaac

SEQ ID NO: 2680285 - RNA, 15 nt, Human
ugguuuuaugaugac

SEQ ID NO: 2680286 - RNA, 12 nt, Human
ugguuuuaugau

SEQ ID NO: 2680287 - RNA, 12 nt, Human
ugguuuuaagaa

SEQ ID NO: 2680288 - RNA, 13 nt, Human
ugguuauguuuuu

SEQ ID NO: 2680289 - RNA, 19 nt, Human
ugguuauguuuuucugugu

SEQ ID NO: 2680290 - RNA, 14 nt, Human
ugguguggccugug

SEQ ID NO: 2680291 - RNA, 15 nt, Human
ugguguggccugugg

SEQ ID NO: 2680292 - RNA, 14 nt, Human
agggugcagcccaa

SEQ ID NO: 2680293 - RNA, 21 nt, Human
agggucuuucucaaagaaaua

SEQ ID NO: 2680294 - RNA, 15 nt, Human
ugguaaaacucacug

SEQ ID NO: 2680295 - RNA, 20 nt, Human
ugguaaaacucacugugauc

SEQ ID NO: 2680296 - RNA, 18 nt, Human
ugguaaaaugaagaauuu

SEQ ID NO: 2680297 - RNA, 15 nt, Human
ugguaaaaugaagaa

SEQ ID NO: 2680298 - RNA, 14 nt, Human
uggguuuuucccug

SEQ ID NO: 2680299 - RNA, 19 nt, Human
uggucacguuuggugcuuc

SEQ ID NO: 2680300 - RNA, 19 nt, Human
ugguaaaaugaagaauuua

SEQ ID NO: 2680301 - RNA, 16 nt, Human
ugguaaagacuggcuu

SEQ ID NO: 2680302 - RNA, 15 nt, Human
ugguacaacggaggc

SEQ ID NO: 2680303 - RNA, 16 nt, Human
ugguacaacggaggcc

SEQ ID NO: 2680304 - RNA, 20 nt, Human
ugguacaacggaggccugcg

SEQ ID NO: 2680305 - RNA, 14 nt, Human
uggucaccaugaaa

SEQ ID NO: 2680306 - RNA, 16 nt, Human
uggucaccaugaaacu

SEQ ID NO: 2680307 - RNA, 18 nt, Human
aggggagggggauccgac

SEQ ID NO: 2680308 - RNA, 16 nt, Human
aggggaguugugucug

SEQ ID NO: 2680309 - RNA, 15 nt, Human
aggggucggcugacc

SEQ ID NO: 2680310 - RNA, 21 nt, Human
aggggucggcugaccaugcuc

SEQ ID NO: 2680311 - RNA, 14 nt, Human
aggggucccuagca

SEQ ID NO: 2680312 - RNA, 23 nt, Human
aggggucccuagcagcccacccu

SEQ ID NO: 2680313 - RNA, 14 nt, Human
aggggucucccugg

SEQ ID NO: 2680314 - RNA, 15 nt, Human
aggggucucccuggc

SEQ ID NO: 2680315 - RNA, 16 nt, Human
aggggucucccuggcu

SEQ ID NO: 2680316 - RNA, 17 nt, Human
aggggucucccuggcuc

SEQ ID NO: 2680317 - RNA, 18 nt, Human
aggggucucccuggcucc

SEQ ID NO: 2680318 - RNA, 19 nt, Human
aggggucucccuggcuccc

SEQ ID NO: 2680319 - RNA, 22 nt, Human
aggggacaagggauuugaggug

SEQ ID NO: 2680320 - RNA, 16 nt, Human
agggggcuugaagcca

SEQ ID NO: 2680321 - RNA, 18 nt, Human
agggggcuugaagccaaa

SEQ ID NO: 2680322 - RNA, 19 nt, Human
agggggcuugaagccaaag

SEQ ID NO: 2680323 - RNA, 18 nt, Human
agggggcuuucuggggcc

SEQ ID NO: 2680324 - RNA, 20 nt, Human
aggguaggagggugggaagg

SEQ ID NO: 2680325 - RNA, 14 nt, Human
uggucuguuggcag

SEQ ID NO: 2680326 - RNA, 18 nt, Human
uggucuguuggcaggcug

SEQ ID NO: 2680327 - RNA, 16 nt, Human
uggucuuaagaaaugu

SEQ ID NO: 2680328 - RNA, 19 nt, Human
uggucucuucuuggggccc

SEQ ID NO: 2680329 - RNA, 17 nt, Human
aggguucccgcggggcu

SEQ ID NO: 2680330 - RNA, 19 nt, Human
aggguucccgcggggcugu

SEQ ID NO: 2680331 - RNA, 14 nt, Human
uggugaacuauauu

SEQ ID NO: 2680332 - RNA, 23 nt, Human
uggucugugugugugugugugcg

SEQ ID NO: 2680333 - RNA, 15 nt, Human
agguagagucugagg

SEQ ID NO: 2680334 - RNA, 15 nt, Human
uggugaagugcuugg

SEQ ID NO: 2680335 - RNA, 14 nt, Human
aggguuucucuauu

SEQ ID NO: 2680336 - RNA, 15 nt, Human
agguaucuagagcuu

SEQ ID NO: 2680337 - RNA, 21 nt, Human
aggucaaggcugcagugagcc

SEQ ID NO: 2680338 - RNA, 14 nt, Human
ugugaagagaacca

SEQ ID NO: 2680339 - RNA, 16 nt, Human
agucuuacuacagaaa

SEQ ID NO: 2680340 - RNA, 18 nt, Human
agucuuacuacagaaaug

SEQ ID NO: 2680341 - RNA, 19 nt, Human
agucuuacuacagaaauga

SEQ ID NO: 2680342 - RNA, 18 nt, Human
agucuuagaucauaguuu

SEQ ID NO: 2680343 - RNA, 13 nt, Human
agucuuagaucau

SEQ ID NO: 2680344 - RNA, 20 nt, Human
agucuuagaucauaguuuua

SEQ ID NO: 2680345 - RNA, 19 nt, Human
agucuuagaucauaguuuu

SEQ ID NO: 2680346 - RNA, 21 nt, Human
agucuuaaggacaaagugcca

SEQ ID NO: 2680347 - RNA, 14 nt, Human
agucuuuugcuuuu

SEQ ID NO: 2680348 - RNA, 18 nt, Human
agucuuuugcuuuuggca

SEQ ID NO: 2680349 - RNA, 19 nt, Human
agucuuuugcuuuuggcaa

SEQ ID NO: 2680350 - RNA, 20 nt, Human
agucuuuugcuuuuggcaaa

SEQ ID NO: 2680351 - RNA, 23 nt, Human
agugaaaaaggaggaagagaaaa

SEQ ID NO: 2680352 - RNA, 20 nt, Human
agugaaaaaggaggaagaga

SEQ ID NO: 2680353 - RNA, 17 nt, Human
agugaaaaaggaggaag

SEQ ID NO: 2680354 - RNA, 11 nt, Human
agugaaaaagg

SEQ ID NO: 2680355 - RNA, 16 nt, Human
agucuuuuuuuuccug

SEQ ID NO: 2680356 - RNA, 14 nt, Human
agugaaaaagaugu

SEQ ID NO: 2680357 - RNA, 17 nt, Human
agugagacccugucuca

SEQ ID NO: 2680358 - RNA, 21 nt, Human
agugagacccugucucaaaaa

SEQ ID NO: 2680359 - RNA, 18 nt, Human
ugugauggacacuccagg

SEQ ID NO: 2680360 - RNA, 11 nt, Human
ugucuuccuca

SEQ ID NO: 2680361 - RNA, 16 nt, Human
ugucuuccucaaaaua

SEQ ID NO: 2680362 - RNA, 22 nt, Human
ugucuuccucaaaauaaagaag

SEQ ID NO: 2680363 - RNA, 18 nt, Human
ugucucucuucucagagu

SEQ ID NO: 2680364 - RNA, 20 nt, Human
ugucucucuucucagagugg

SEQ ID NO: 2680365 - RNA, 22 nt, Human
agucccugccacgaauuucugu

SEQ ID NO: 2680366 - RNA, 21 nt, Human
agucccugccacgaauuucug

SEQ ID NO: 2680367 - RNA, 18 nt, Human
ugucuccuauauauuucu

SEQ ID NO: 2680368 - RNA, 22 nt, Human
ugucuccuauauauuucuauua

SEQ ID NO: 2680369 - RNA, 17 nt, Human
ugucuccuuaagcugca

SEQ ID NO: 2680370 - RNA, 21 nt, Human
ugucuccuuaagcugcagaga

SEQ ID NO: 2680371 - RNA, 14 nt, Human
ugucucuugaguuu

SEQ ID NO: 2680372 - RNA, 17 nt, Human
ugucucuugaguuuguc

SEQ ID NO: 2680373 - RNA, 21 nt, Human
agucacuaugggaugagaaaa

SEQ ID NO: 2680374 - RNA, 22 nt, Human
agucacuaugggaugagaaaau

SEQ ID NO: 2680375 - RNA, 15 nt, Human
ugucagcauagaagu

SEQ ID NO: 2680376 - RNA, 12 nt, Human
aguauuguuuaa

SEQ ID NO: 2680377 - RNA, 13 nt, Human
aguauuguuuaaa

SEQ ID NO: 2680378 - RNA, 14 nt, Human
aguauuguuuaaaa

SEQ ID NO: 2680379 - RNA, 16 nt, Human
aguauuguuuaaaaug

SEQ ID NO: 2680380 - RNA, 19 nt, Human
aguauuguuuaaaauguaa

SEQ ID NO: 2680381 - RNA, 22 nt, Human
aguauuguuuaaaauguaauuu

SEQ ID NO: 2680382 - RNA, 14 nt, Human
uguagacuguggcu

SEQ ID NO: 2680383 - RNA, 17 nt, Human
ugucaaaugaugugcaa

SEQ ID NO: 2680384 - RNA, 18 nt, Human
ugucaaaugaugugcaaa

SEQ ID NO: 2680385 - RNA, 19 nt, Human
ugucaaaugaugugcaaaa

SEQ ID NO: 2680386 - RNA, 18 nt, Human
ugucaaacuguagaaaug

SEQ ID NO: 2680387 - RNA, 16 nt, Human
ugucaaacuguagaaa

SEQ ID NO: 2680388 - RNA, 23 nt, Human
uguccacgcgugccguggcacca

SEQ ID NO: 2680389 - RNA, 17 nt, Human
ugucccuaugcauauca

SEQ ID NO: 2680390 - RNA, 11 nt, Human
uguccuguccu

SEQ ID NO: 2680391 - RNA, 13 nt, Human
uguccuguccugc

SEQ ID NO: 2680392 - RNA, 14 nt, Human
uguccuguccugcu

SEQ ID NO: 2680393 - RNA, 15 nt, Human
uguccuguccugcuc

SEQ ID NO: 2680394 - RNA, 18 nt, Human
aguccccaccccugcccc

SEQ ID NO: 2680395 - RNA, 20 nt, Human
aguccccaccccugccccca

SEQ ID NO: 2680396 - RNA, 13 nt, Human
aguccccaccccu

SEQ ID NO: 2680397 - RNA, 15 nt, Human
aguccccaccccugc

SEQ ID NO: 2680398 - RNA, 16 nt, Human
aguccccaccccugcc

SEQ ID NO: 2680399 - RNA, 17 nt, Human
aguccccaccccugccc

SEQ ID NO: 2680400 - RNA, 11 nt, Human
aguccccaccc

SEQ ID NO: 2680401 - RNA, 12 nt, Human
aguccccacccc

SEQ ID NO: 2680402 - RNA, 18 nt, Human
agucaguacccaccaccu

SEQ ID NO: 2680403 - RNA, 19 nt, Human
agucaguaggacuccuuau

SEQ ID NO: 2680404 - RNA, 22 nt, Human
ugucuaaacaaugcugauuugg

SEQ ID NO: 2680405 - RNA, 12 nt, Human
ugucuaaagugu

SEQ ID NO: 2680406 - RNA, 19 nt, Human
ugucuaaaguguauuuuca

SEQ ID NO: 2680407 - RNA, 23 nt, Human
ugucuaaaguguauuuucagagc

SEQ ID NO: 2680408 - RNA, 23 nt, Human
ugucccuugcuugccugcagggc

SEQ ID NO: 2680409 - RNA, 22 nt, Human
auaauuccuauauccugugacu

SEQ ID NO: 2680410 - RNA, 13 nt, Human
auaauuguacaaa

SEQ ID NO: 2680411 - RNA, 15 nt, Human
auaauuguacaaaau

SEQ ID NO: 2680412 - RNA, 19 nt, Human
auaauuguacaaaauuaag

SEQ ID NO: 2680413 - RNA, 21 nt, Human
auaauuguacaaaauuaagca

SEQ ID NO: 2680414 - RNA, 24 nt, Human
auaauuguacaaaauuaagcaaau

SEQ ID NO: 2680415 - RNA, 23 nt, Human
uuagauuugccauagaguacacu

SEQ ID NO: 2680416 - RNA, 21 nt, Human
uuagauuugccauagaguaca

SEQ ID NO: 2680417 - RNA, 16 nt, Human
uuagauuugccauaga

SEQ ID NO: 2680418 - RNA, 20 nt, Human
uuagauucuuaauucaugag

SEQ ID NO: 2680419 - RNA, 13 nt, Human
auaaugaauaaau

SEQ ID NO: 2680420 - RNA, 14 nt, Human
auaaugaauaaauc

SEQ ID NO: 2680421 - RNA, 15 nt, Human
auaauuauauaacug

SEQ ID NO: 2680422 - RNA, 17 nt, Human
auaauuauauaacugua

SEQ ID NO: 2680423 - RNA, 19 nt, Human
auaauuauauaacuguauu

SEQ ID NO: 2680424 - RNA, 19 nt, Human
auaauacaguaucucaggg

SEQ ID NO: 2680425 - RNA, 11 nt, Human
auaauaaaaau

SEQ ID NO: 2680426 - RNA, 13 nt, Human
auaagcacuguaa

SEQ ID NO: 2680427 - RNA, 17 nt, Human
auaagcacuguaaacuu

SEQ ID NO: 2680428 - RNA, 17 nt, Human
auaagcaaucaagguua

SEQ ID NO: 2680429 - RNA, 23 nt, Human
auaagaagaaguucauguccaaa

SEQ ID NO: 2680430 - RNA, 21 nt, Human
auaagaaauaaugcuacaauu

SEQ ID NO: 2680431 - RNA, 22 nt, Human
auaagaaauaaugcuacaauuu

SEQ ID NO: 2680432 - RNA, 13 nt, Human
auaaguuauugca

SEQ ID NO: 2680433 - RNA, 14 nt, Human
auaaguuauugcag

SEQ ID NO: 2680434 - RNA, 16 nt, Human
auaaguuauugcaguu

SEQ ID NO: 2680435 - RNA, 20 nt, Human
auaaguuauugcaguuuauc

SEQ ID NO: 2680436 - RNA, 21 nt, Human
auaaguuauugcaguuuauca

SEQ ID NO: 2680437 - RNA, 24 nt, Human
auaaguuauugcaguuuaucauuc

SEQ ID NO: 2680438 - RNA, 17 nt, Human
auaauaaaaaaagaaag

SEQ ID NO: 2680439 - RNA, 14 nt, Human
auaaauguguuggg

SEQ ID NO: 2680440 - RNA, 14 nt, Human
auaaauuaggacca

SEQ ID NO: 2680441 - RNA, 20 nt, Human
auaaauaacccauaauugaa

SEQ ID NO: 2680442 - RNA, 19 nt, Human
auaaauaacucaauggaaa

SEQ ID NO: 2680443 - RNA, 15 nt, Human
uuacccaccuagaac

SEQ ID NO: 2680444 - RNA, 16 nt, Human
uuacccaccuagaaca

SEQ ID NO: 2680445 - RNA, 22 nt, Human
uuacccaccuagaacacuaacu

SEQ ID NO: 2680446 - RNA, 15 nt, Human
auaacuguauuugaa

SEQ ID NO: 2680447 - RNA, 18 nt, Human
auaacuguauuugaaaua

SEQ ID NO: 2680448 - RNA, 10 nt, Human
aguuuuccua

SEQ ID NO: 2680449 - RNA, 15 nt, Human
auaaaccacugugcg

SEQ ID NO: 2680450 - RNA, 12 nt, Human
auaaacaugaaa

SEQ ID NO: 2680451 - RNA, 22 nt, Human
auaaacaguggaauauaaggaa

SEQ ID NO: 2680452 - RNA, 13 nt, Human
auaaacagaaaug

SEQ ID NO: 2680453 - RNA, 16 nt, Human
auaaacuuuaauauaa

SEQ ID NO: 2680454 - RNA, 20 nt, Human
auaaacuuuaauauaaagua

SEQ ID NO: 2680455 - RNA, 22 nt, Human
auaaacuuuaauauaaaguagu

SEQ ID NO: 2680456 - RNA, 16 nt, Human
auaaacuauaaaacaa

SEQ ID NO: 2680457 - RNA, 17 nt, Human
auaaauaaaaauggaua

SEQ ID NO: 2680458 - RNA, 15 nt, Human
auaaauaaaaaugga

SEQ ID NO: 2680459 - RNA, 16 nt, Human
auaaaguaguccugug

SEQ ID NO: 2680460 - RNA, 17 nt, Human
auaaaguaguccuguga

SEQ ID NO: 2680461 - RNA, 20 nt, Human
uuauacaugugauacauuuu

SEQ ID NO: 2680462 - RNA, 18 nt, Human
uuauaaaucuuaugcucu

SEQ ID NO: 2680463 - RNA, 13 nt, Human
uuagccgggcgug

SEQ ID NO: 2680464 - RNA, 17 nt, Human
uuagccgcccaugcacu

SEQ ID NO: 2680465 - RNA, 21 nt, Human
uuauagaggcuagcuucugcu

SEQ ID NO: 2680466 - RNA, 23 nt, Human
uuauacuacuuuguuaggauuuu

SEQ ID NO: 2680467 - RNA, 18 nt, Human
uuauagcaacaacaauug

SEQ ID NO: 2680468 - RNA, 20 nt, Human
uuauagcaacaacaauuggu

SEQ ID NO: 2680469 - RNA, 20 nt, Human
uuauagccuggacugcuacc

SEQ ID NO: 2680470 - RNA, 20 nt, Human
uuauagucuaagacuauaua

SEQ ID NO: 2680471 - RNA, 16 nt, Human
uuauagucaauggcuu

SEQ ID NO: 2680472 - RNA, 16 nt, Human
uuauauaacuguauuu

SEQ ID NO: 2680473 - RNA, 18 nt, Human
uuauauaacuguauuuga

SEQ ID NO: 2680474 - RNA, 22 nt, Human
uuauauaacuguauuugaaaua

SEQ ID NO: 2680475 - RNA, 12 nt, Human
uuauauaacugu

SEQ ID NO: 2680476 - RNA, 17 nt, Human
uuauauagcaucuggaa

SEQ ID NO: 2680477 - RNA, 18 nt, Human
auaauuuuuuuuaaaaua

SEQ ID NO: 2680478 - RNA, 22 nt, Human
auaauuuuuuuuaaaauagaaa

SEQ ID NO: 2680479 - RNA, 13 nt, Human
auacuauuuaaga

SEQ ID NO: 2680480 - RNA, 16 nt, Human
auacuauuuaagaugu

SEQ ID NO: 2680481 - RNA, 18 nt, Human
auacuauuuaagauguga

SEQ ID NO: 2680482 - RNA, 19 nt, Human
auacuauuuaagaugugaa

SEQ ID NO: 2680483 - RNA, 20 nt, Human
auacuauuuaagaugugaaa

SEQ ID NO: 2680484 - RNA, 21 nt, Human
auacuauuuaagaugugaaaa

SEQ ID NO: 2680485 - RNA, 22 nt, Human
auacuauuuaagaugugaaaau

SEQ ID NO: 2680486 - RNA, 20 nt, Human
uuaucaaaauagucuaaggc

SEQ ID NO: 2680487 - RNA, 23 nt, Human
uuaucaaaauagucuaaggccau

SEQ ID NO: 2680488 - RNA, 16 nt, Human
auacaguuuucagaaa

SEQ ID NO: 2680489 - RNA, 17 nt, Human
auacaguuuucagaaaa

SEQ ID NO: 2680490 - RNA, 22 nt, Human
auacaguuuucagaaaaagaaa

SEQ ID NO: 2680491 - RNA, 22 nt, Human
auacaugaagaauagaaacaag

SEQ ID NO: 2680492 - RNA, 13 nt, Human
auacaugaagcuu

SEQ ID NO: 2680493 - RNA, 18 nt, Human
auacaugaagcuucaugc

SEQ ID NO: 2680494 - RNA, 16 nt, Human
auacauucaaauuugu

SEQ ID NO: 2680495 - RNA, 20 nt, Human
auacauucaaauuugucugg

SEQ ID NO: 2680496 - RNA, 21 nt, Human
auacauucaaauuugucuggu

SEQ ID NO: 2680497 - RNA, 14 nt, Human
auacauaaaagaaa

SEQ ID NO: 2680498 - RNA, 16 nt, Human
auacauaaaagaaaua

SEQ ID NO: 2680499 - RNA, 18 nt, Human
auacauaaaagaaauaaa

SEQ ID NO: 2680500 - RNA, 20 nt, Human
auacauaaaagaaauaaacc

SEQ ID NO: 2680501 - RNA, 14 nt, Human
auacauauggaugu

SEQ ID NO: 2680502 - RNA, 15 nt, Human
auacauauggauguu

SEQ ID NO: 2680503 - RNA, 18 nt, Human
auacauauggauguuacu

SEQ ID NO: 2680504 - RNA, 13 nt, Human
auaccaaacaugc

SEQ ID NO: 2680505 - RNA, 16 nt, Human
auacauuuuuuaagcu

SEQ ID NO: 2680506 - RNA, 20 nt, Human
auacauuuuuuaagcuucag

SEQ ID NO: 2680507 - RNA, 20 nt, Human
auacauuguauauaugugua

SEQ ID NO: 2680508 - RNA, 13 nt, Human
auacagcaaagga

SEQ ID NO: 2680509 - RNA, 15 nt, Human
auacagcaaaggaaa

SEQ ID NO: 2680510 - RNA, 18 nt, Human
auacaaaccuaccaaaau

SEQ ID NO: 2680511 - RNA, 15 nt, Human
auacaaaugcaucuu

SEQ ID NO: 2680512 - RNA, 13 nt, Human
auacaaaaagaaa

SEQ ID NO: 2680513 - RNA, 14 nt, Human
auacaaaaagaaaa

SEQ ID NO: 2680514 - RNA, 20 nt, Human
auacaaaugcaucuuugaug

SEQ ID NO: 2680515 - RNA, 19 nt, Human
auacaaaugcaucuuugau

SEQ ID NO: 2680516 - RNA, 18 nt, Human
auacaaaugcaucuuuga

SEQ ID NO: 2680517 - RNA, 17 nt, Human
auacaaaugcaucuuug

SEQ ID NO: 2680518 - RNA, 22 nt, Human
auacaaaugcaucuuugaugug

SEQ ID NO: 2680519 - RNA, 21 nt, Human
auacaaaugcaucuuugaugu

SEQ ID NO: 2680520 - RNA, 11 nt, Human
uguuguagugu

SEQ ID NO: 2680521 - RNA, 13 nt, Human
uguugucagcuga

SEQ ID NO: 2680522 - RNA, 15 nt, Human
uguuguaagaauucu

SEQ ID NO: 2680523 - RNA, 16 nt, Human
uguuguaagaauucug

SEQ ID NO: 2680524 - RNA, 18 nt, Human
uguuguaagaauucugau

SEQ ID NO: 2680525 - RNA, 21 nt, Human
uguuguacauacgauuuaagg

SEQ ID NO: 2680526 - RNA, 15 nt, Human
uguuguacuuaaaug

SEQ ID NO: 2680527 - RNA, 16 nt, Human
uguuguacuuaaaugg

SEQ ID NO: 2680528 - RNA, 13 nt, Human
uguuguaaaacaa

SEQ ID NO: 2680529 - RNA, 17 nt, Human
uguuguaaaacaaaauu

SEQ ID NO: 2680530 - RNA, 22 nt, Human
uguuguaaaacaaaauuugacu

SEQ ID NO: 2680531 - RNA, 23 nt, Human
uguuguaaaacaaaauuugacua

SEQ ID NO: 2680532 - RNA, 19 nt, Human
aguucuaacagugaaguuu

SEQ ID NO: 2680533 - RNA, 23 nt, Human
aguucuaacagugaaguuuuacu

SEQ ID NO: 2680534 - RNA, 17 nt, Human
aguucccuugaaacuuu

SEQ ID NO: 2680535 - RNA, 22 nt, Human
aguucccuugaaacuuugggaa

SEQ ID NO: 2680536 - RNA, 12 nt, Human
aguucaaaaaca

SEQ ID NO: 2680537 - RNA, 14 nt, Human
aguuauuuucuaca

SEQ ID NO: 2680538 - RNA, 23 nt, Human
aguuauuuucuacagugguuuua

SEQ ID NO: 2680539 - RNA, 14 nt, Human
aguuaguuuguaua

SEQ ID NO: 2680540 - RNA, 22 nt, Human
aguuaguuuguauauauuauua

SEQ ID NO: 2680541 - RNA, 21 nt, Human
aguguuucgcggguaacuggg

SEQ ID NO: 2680542 - RNA, 18 nt, Human
aguguuuauguuguuuau

SEQ ID NO: 2680543 - RNA, 15 nt, Human
aguuaguuuguauau

SEQ ID NO: 2680544 - RNA, 12 nt, Human
aguuauaagaag

SEQ ID NO: 2680545 - RNA, 14 nt, Human
aguuauaagaagaa

SEQ ID NO: 2680546 - RNA, 17 nt, Human
aguuauguaaauaauuc

SEQ ID NO: 2680547 - RNA, 14 nt, Human
aguuauguaaauaa

SEQ ID NO: 2680548 - RNA, 13 nt, Human
aguuauguaaaua

SEQ ID NO: 2680549 - RNA, 15 nt, Human
aguuauggugccgaa

SEQ ID NO: 2680550 - RNA, 23 nt, Human
aguuauggugccgaauugucuuu

SEQ ID NO: 2680551 - RNA, 20 nt, Human
aguuauguaaauaauucuuu

SEQ ID NO: 2680552 - RNA, 18 nt, Human
aguuauguaaauaauucu

SEQ ID NO: 2680553 - RNA, 20 nt, Human
aguuauuacauguaauuuga

SEQ ID NO: 2680554 - RNA, 18 nt, Human
aguuaucuuugaauaugu

SEQ ID NO: 2680555 - RNA, 13 nt, Human
aguuauugcaguu

SEQ ID NO: 2680556 - RNA, 16 nt, Human
aguuauugcaguuuau

SEQ ID NO: 2680557 - RNA, 18 nt, Human
aguuauugcaguuuauca

SEQ ID NO: 2680558 - RNA, 19 nt, Human
aguuauugcaguuuaucau

SEQ ID NO: 2680559 - RNA, 22 nt, Human
aguuauugcaguuuaucauuca

SEQ ID NO: 2680560 - RNA, 19 nt, Human
ugugcaaaaccuuuuacug

SEQ ID NO: 2680561 - RNA, 20 nt, Human
ugugcaaaaccuuuuacugg

SEQ ID NO: 2680562 - RNA, 18 nt, Human
ugugcaacaggguaugga

SEQ ID NO: 2680563 - RNA, 20 nt, Human
ugugcaacaggguauggacu

SEQ ID NO: 2680564 - RNA, 19 nt, Human
ugugcaacgccgugggcug

SEQ ID NO: 2680565 - RNA, 21 nt, Human
ugugcaacggucuccugacug

SEQ ID NO: 2680566 - RNA, 11 nt, Human
aguggcagggg

SEQ ID NO: 2680567 - RNA, 18 nt, Human
aguggcaggggacaggag

SEQ ID NO: 2680568 - RNA, 18 nt, Human
agugggugaauaauacag

SEQ ID NO: 2680569 - RNA, 13 nt, Human
agugggugaauaa

SEQ ID NO: 2680570 - RNA, 18 nt, Human
agugggggaucacagccu

SEQ ID NO: 2680571 - RNA, 15 nt, Human
agugggguuuccugg

SEQ ID NO: 2680572 - RNA, 16 nt, Human
aguguacagccagacc

SEQ ID NO: 2680573 - RNA, 18 nt, Human
aguguacagccagaccag

SEQ ID NO: 2680574 - RNA, 20 nt, Human
agugguuuuauacugaagga

SEQ ID NO: 2680575 - RNA, 21 nt, Human
agugguuuuauacugaaggaa

SEQ ID NO: 2680576 - RNA, 23 nt, Human
agugguuuuauacugaaggaaaa

SEQ ID NO: 2680577 - RNA, 16 nt, Human
aguguaacuugcuuaa

SEQ ID NO: 2680578 - RNA, 18 nt, Human
aguguaacuugcuuaaau

SEQ ID NO: 2680579 - RNA, 20 nt, Human
aguguaacuugcuuaaauuu

SEQ ID NO: 2680580 - RNA, 17 nt, Human
agugguuuuauacugaa

SEQ ID NO: 2680581 - RNA, 18 nt, Human
agugguuuuauacugaag

SEQ ID NO: 2680582 - RNA, 15 nt, Human
aguggugauuugaaa

SEQ ID NO: 2680583 - RNA, 22 nt, Human
aguggugauuugaaaaauauaa

SEQ ID NO: 2680584 - RNA, 18 nt, Human
agugguugaauaugauua

SEQ ID NO: 2680585 - RNA, 15 nt, Human
agugguugaauauga

SEQ ID NO: 2680586 - RNA, 14 nt, Human
agugguugaauaug

SEQ ID NO: 2680587 - RNA, 13 nt, Human
agugguugaauau

SEQ ID NO: 2680588 - RNA, 19 nt, Human
agugggugaauaauacagu

SEQ ID NO: 2680589 - RNA, 23 nt, Human
aguggucuuaagaaauguauaaa

SEQ ID NO: 2680590 - RNA, 18 nt, Human
uguuauuuucuguugaag

SEQ ID NO: 2680591 - RNA, 20 nt, Human
uguucccauguagcccccug

SEQ ID NO: 2680592 - RNA, 14 nt, Human
uguuauuaaacaaa

SEQ ID NO: 2680593 - RNA, 20 nt, Human
aguguacauuucuauaaaua

SEQ ID NO: 2680594 - RNA, 16 nt, Human
aguguaguuuacagaa

SEQ ID NO: 2680595 - RNA, 17 nt, Human
aguguaguuuacagaaa

SEQ ID NO: 2680596 - RNA, 19 nt, Human
aguguaguuuacagaaaaa

SEQ ID NO: 2680597 - RNA, 15 nt, Human
aguguauaauaagaa

SEQ ID NO: 2680598 - RNA, 15 nt, Human
aguguauaauauaaa

SEQ ID NO: 2680599 - RNA, 16 nt, Human
aguguauaauauaaaa

SEQ ID NO: 2680600 - RNA, 17 nt, Human
aguguauaauauaaaaa

SEQ ID NO: 2680601 - RNA, 17 nt, Human
uguuauguuuaauaagc

SEQ ID NO: 2680602 - RNA, 23 nt, Human
uguucuuggcaauaaauuuugaa

SEQ ID NO: 2680603 - RNA, 14 nt, Human
uguucuuucagaaa

SEQ ID NO: 2680604 - RNA, 15 nt, Human
uguucuuucagaaag

SEQ ID NO: 2680605 - RNA, 22 nt, Human
uguucuuggcaauaaauuuuga

SEQ ID NO: 2680606 - RNA, 20 nt, Human
uguucuuggcaauaaauuuu

SEQ ID NO: 2680607 - RNA, 17 nt, Human
uguucuuggcaauaaau

SEQ ID NO: 2680608 - RNA, 16 nt, Human
uguucuuggcaauaaa

SEQ ID NO: 2680609 - RNA, 19 nt, Human
uuaaacgaagaguucccuu

SEQ ID NO: 2680610 - RNA, 17 nt, Human
uuaaaccgccaaggcug

SEQ ID NO: 2680611 - RNA, 15 nt, Human
uuaaaaauagaaaca

SEQ ID NO: 2680612 - RNA, 14 nt, Human
uuaaaaauuguuau

SEQ ID NO: 2680613 - RNA, 20 nt, Human
uuaaauaaaauugaaaguaa

SEQ ID NO: 2680614 - RNA, 14 nt, Human
aguugcaucagaaa

SEQ ID NO: 2680615 - RNA, 14 nt, Human
aguugcauuuuaac

SEQ ID NO: 2680616 - RNA, 23 nt, Human
aguugcauuuuaacccuauuuua

SEQ ID NO: 2680617 - RNA, 19 nt, Human
aguugcaauugaauuaaau

SEQ ID NO: 2680618 - RNA, 18 nt, Human
aguugcaauugaauuaaa

SEQ ID NO: 2680619 - RNA, 20 nt, Human
aguugcaauugaauuaaauu

SEQ ID NO: 2680620 - RNA, 19 nt, Human
uuaaaaauaucaaauuaau

SEQ ID NO: 2680621 - RNA, 18 nt, Human
uuaaaaauaucaaauuaa

SEQ ID NO: 2680622 - RNA, 13 nt, Human
uuaaaaauaucaa

SEQ ID NO: 2680623 - RNA, 18 nt, Human
uuaaaaaguggaaaaaua

SEQ ID NO: 2680624 - RNA, 23 nt, Human
aguuuggcugcugucauaacauc

SEQ ID NO: 2680625 - RNA, 22 nt, Human
aguuuguaugccaagugagaag

SEQ ID NO: 2680626 - RNA, 17 nt, Human
aguuugucgcucaugug

SEQ ID NO: 2680627 - RNA, 19 nt, Human
aguuugucgcucaugugug

SEQ ID NO: 2680628 - RNA, 21 nt, Human
aguuugucgcucaugugugca

SEQ ID NO: 2680629 - RNA, 13 nt, Human
aguuugugagaaa

SEQ ID NO: 2680630 - RNA, 14 nt, Human
aguuugugagaaac

SEQ ID NO: 2680631 - RNA, 14 nt, Human
aguuuuauuuauau

SEQ ID NO: 2680632 - RNA, 23 nt, Human
aguuuuauuuauauuuauugacu

SEQ ID NO: 2680633 - RNA, 22 nt, Human
aguuuuauuuauauuuauugac

SEQ ID NO: 2680634 - RNA, 20 nt, Human
aguuuuauuuauauuuauug

SEQ ID NO: 2680635 - RNA, 19 nt, Human
aguuuuauuuauauuuauu

SEQ ID NO: 2680636 - RNA, 18 nt, Human
aguuuuauuuauauuuau

SEQ ID NO: 2680637 - RNA, 17 nt, Human
aguuuuauuuauauuua

SEQ ID NO: 2680638 - RNA, 15 nt, Human
aguuuuauuuauauu

SEQ ID NO: 2680639 - RNA, 15 nt, Human
aguuuucauuaaauc

SEQ ID NO: 2680640 - RNA, 12 nt, Human
aguuuucagaaa

SEQ ID NO: 2680641 - RNA, 18 nt, Human
aguuuucagaaaaagaaa

SEQ ID NO: 2680642 - RNA, 19 nt, Human
aguuuucagaaaaagaaau

SEQ ID NO: 2680643 - RNA, 18 nt, Human
aguuuucauaguauccau

SEQ ID NO: 2680644 - RNA, 16 nt, Human
aguuuauuuuaaaaca

SEQ ID NO: 2680645 - RNA, 23 nt, Human
aguuuauuuuaaaacaauaggau

SEQ ID NO: 2680646 - RNA, 14 nt, Human
aguucuguauuuga

SEQ ID NO: 2680647 - RNA, 13 nt, Human
aguucuguauuug

SEQ ID NO: 2680648 - RNA, 23 nt, Human
aguucuguauuugaaagugccuu

SEQ ID NO: 2680649 - RNA, 22 nt, Human
aguucuguauuugaaagugccu

SEQ ID NO: 2680650 - RNA, 21 nt, Human
aguucuguauuugaaagugcc

SEQ ID NO: 2680651 - RNA, 20 nt, Human
aguucuguauuugaaagugc

SEQ ID NO: 2680652 - RNA, 18 nt, Human
aguucuguauuugaaagu

SEQ ID NO: 2680653 - RNA, 17 nt, Human
aguucuguauuugaaag

SEQ ID NO: 2680654 - RNA, 16 nt, Human
aguucuguauuugaaa

SEQ ID NO: 2680655 - RNA, 15 nt, Human
aguucuguauuugaa

SEQ ID NO: 2680656 - RNA, 15 nt, Human
aguucuuuggauucu

SEQ ID NO: 2680657 - RNA, 22 nt, Human
aguucuuuggauucuaaauaca

SEQ ID NO: 2680658 - RNA, 15 nt, Human
aguucuuuaaacugu

SEQ ID NO: 2680659 - RNA, 23 nt, Human
aguucuuggucccuccagaacca

SEQ ID NO: 2680660 - RNA, 13 nt, Human
aguugauucagcu

SEQ ID NO: 2680661 - RNA, 18 nt, Human
aguugauucagcucugca

SEQ ID NO: 2680662 - RNA, 17 nt, Human
aguugauucagcucugc

SEQ ID NO: 2680663 - RNA, 15 nt, Human
aguugauucagcucu

SEQ ID NO: 2680664 - RNA, 14 nt, Human
aguugauucagcuc

SEQ ID NO: 2680665 - RNA, 23 nt, Human
aguugauucagcucugcaagaau

SEQ ID NO: 2680666 - RNA, 13 nt, Human
uguuuuauaaaau

SEQ ID NO: 2680667 - RNA, 15 nt, Human
uguuuucucuugaga

SEQ ID NO: 2680668 - RNA, 19 nt, Human
uguuuuccgugaaaacgga

SEQ ID NO: 2680669 - RNA, 16 nt, Human
uguuuuccgugaaaac

SEQ ID NO: 2680670 - RNA, 14 nt, Human
uguugucagcugaa

SEQ ID NO: 2680671 - RNA, 17 nt, Human
uguuguccaacuauuua

SEQ ID NO: 2680672 - RNA, 13 nt, Human
uguuugccaggac

SEQ ID NO: 2680673 - RNA, 16 nt, Human
uguuugccaggacaug

SEQ ID NO: 2680674 - RNA, 18 nt, Human
uguuugccaggacaugca

SEQ ID NO: 2680675 - RNA, 19 nt, Human
uguuugccaggacaugcaa

SEQ ID NO: 2680676 - RNA, 19 nt, Human
uguuuggagacguuuauaa

SEQ ID NO: 2680677 - RNA, 15 nt, Human
uguuuggcauguaaa

SEQ ID NO: 2680678 - RNA, 16 nt, Human
uguuuggcauguaaau

SEQ ID NO: 2680679 - RNA, 17 nt, Human
uguuugggaugaccagg

SEQ ID NO: 2680680 - RNA, 17 nt, Human
uguuuuacaauaguucu

SEQ ID NO: 2680681 - RNA, 13 nt, Human
uguuuuacaauag

SEQ ID NO: 2680682 - RNA, 21 nt, Human
uguuuuacaauaguucugugg

SEQ ID NO: 2680683 - RNA, 22 nt, Human
uguuuuacaauaguucuguggg

SEQ ID NO: 2680684 - RNA, 15 nt, Human
ugccucacuaauuuu

SEQ ID NO: 2680685 - RNA, 18 nt, Human
ugccucacuaauuuuugu

SEQ ID NO: 2680686 - RNA, 22 nt, Human
ugccucacuaauuuuuguauua

SEQ ID NO: 2680687 - RNA, 22 nt, Human
ugccuccccauuucccaucugc

SEQ ID NO: 2680688 - RNA, 23 nt, Human
ugccuccccauuucccaucugca

SEQ ID NO: 2680689 - RNA, 17 nt, Human
ugccuccccauuuccca

SEQ ID NO: 2680690 - RNA, 20 nt, Human
ugccuccccauuucccaucu

SEQ ID NO: 2680691 - RNA, 21 nt, Human
ugccuccccauuucccaucug

SEQ ID NO: 2680692 - RNA, 22 nt, Human
ugccgccgcuagguagagucug

SEQ ID NO: 2680693 - RNA, 18 nt, Human
ugccgccgcuagguagag

SEQ ID NO: 2680694 - RNA, 16 nt, Human
ugccgcaucucacagc

SEQ ID NO: 2680695 - RNA, 17 nt, Human
ugccgcccccuccugaa

SEQ ID NO: 2680696 - RNA, 18 nt, Human
ugccgcccccuccugaac

SEQ ID NO: 2680697 - RNA, 19 nt, Human
ugccgcccccuccugaacc

SEQ ID NO: 2680698 - RNA, 19 nt, Human
agcucuuccuaucccucuc

SEQ ID NO: 2680699 - RNA, 22 nt, Human
agcucuuccuaucccucuccua

SEQ ID NO: 2680700 - RNA, 13 nt, Human
ugccugcuuugaa

SEQ ID NO: 2680701 - RNA, 14 nt, Human
ugccugcuuugaau

SEQ ID NO: 2680702 - RNA, 19 nt, Human
ugccugccuuaagugagga

SEQ ID NO: 2680703 - RNA, 11 nt, Human
ugccugccuua

SEQ ID NO: 2680704 - RNA, 12 nt, Human
agcucuggaggg

SEQ ID NO: 2680705 - RNA, 16 nt, Human
agcucuggaggggagg

SEQ ID NO: 2680706 - RNA, 17 nt, Human
agcucuggaggggaggg

SEQ ID NO: 2680707 - RNA, 18 nt, Human
agcucuggaggggagggg

SEQ ID NO: 2680708 - RNA, 19 nt, Human
agcucuggaggggaggggg

SEQ ID NO: 2680709 - RNA, 20 nt, Human
agcucuggaggggaggggga

SEQ ID NO: 2680710 - RNA, 14 nt, Human
agcuccagcuuucu

SEQ ID NO: 2680711 - RNA, 21 nt, Human
agcuccagggaauccaagccu

SEQ ID NO: 2680712 - RNA, 19 nt, Human
agcucccacuucugccaga

SEQ ID NO: 2680713 - RNA, 18 nt, Human
agcucccacuucugccag

SEQ ID NO: 2680714 - RNA, 17 nt, Human
agcucccacuucugcca

SEQ ID NO: 2680715 - RNA, 20 nt, Human
agcuccccgcuucugccugc

SEQ ID NO: 2680716 - RNA, 14 nt, Human
ugcccucucaggcc

SEQ ID NO: 2680717 - RNA, 13 nt, Human
ugcccuaauaaaa

SEQ ID NO: 2680718 - RNA, 15 nt, Human
ugcccuaauaaaaag

SEQ ID NO: 2680719 - RNA, 23 nt, Human
ugcccuccugacccauugcuguu

SEQ ID NO: 2680720 - RNA, 20 nt, Human
ugcccucuucucgugccucc

SEQ ID NO: 2680721 - RNA, 22 nt, Human
ugcccugcacgucaugggaggg

SEQ ID NO: 2680722 - RNA, 11 nt, Human
agcuccacucu

SEQ ID NO: 2680723 - RNA, 12 nt, Human
agcuccacucug

SEQ ID NO: 2680724 - RNA, 13 nt, Human
agcuccacucugc

SEQ ID NO: 2680725 - RNA, 14 nt, Human
agcuccacucugcu

SEQ ID NO: 2680726 - RNA, 16 nt, Human
agcuccacucugcuuc

SEQ ID NO: 2680727 - RNA, 17 nt, Human
agcuccacucugcuucu

SEQ ID NO: 2680728 - RNA, 18 nt, Human
agcuccacucugcuucuc

SEQ ID NO: 2680729 - RNA, 19 nt, Human
agcuccacucugcuucucu

SEQ ID NO: 2680730 - RNA, 22 nt, Human
agcuccacucugcuucucugac

SEQ ID NO: 2680731 - RNA, 23 nt, Human
agcuccacucugcuucucugacu

SEQ ID NO: 2680732 - RNA, 24 nt, Human
agcuccacucugcuucucugacuu

SEQ ID NO: 2680733 - RNA, 12 nt, Human
ugccauuuauuu

SEQ ID NO: 2680734 - RNA, 14 nt, Human
ugccauuuauuuau

SEQ ID NO: 2680735 - RNA, 15 nt, Human
agcuccaagccccau

SEQ ID NO: 2680736 - RNA, 15 nt, Human
agcucaggaggcgcc

SEQ ID NO: 2680737 - RNA, 17 nt, Human
agcucaggaggcgcccu

SEQ ID NO: 2680738 - RNA, 14 nt, Human
agcuagucaacagu

SEQ ID NO: 2680739 - RNA, 13 nt, Human
agcgucccuggcg

SEQ ID NO: 2680740 - RNA, 14 nt, Human
agcgucccuggcgc

SEQ ID NO: 2680741 - RNA, 15 nt, Human
agcgucccuggcgca

SEQ ID NO: 2680742 - RNA, 18 nt, Human
agcuaguugaauacuuga

SEQ ID NO: 2680743 - RNA, 17 nt, Human
agcuaguugaauacuug

SEQ ID NO: 2680744 - RNA, 16 nt, Human
agcuaguugaauacuu

SEQ ID NO: 2680745 - RNA, 15 nt, Human
agcuaguugaauacu

SEQ ID NO: 2680746 - RNA, 19 nt, Human
ugccccaucuccccucagc

SEQ ID NO: 2680747 - RNA, 16 nt, Human
ugccccaucuccccuc

SEQ ID NO: 2680748 - RNA, 21 nt, Human
ugccccaucuccccucagcuc

SEQ ID NO: 2680749 - RNA, 13 nt, Human
ugccccggagcug

SEQ ID NO: 2680750 - RNA, 22 nt, Human
ugccccgcccccaguccccacc

SEQ ID NO: 2680751 - RNA, 14 nt, Human
ugcccccugcagac

SEQ ID NO: 2680752 - RNA, 16 nt, Human
ugccauuuuaaggaaa

SEQ ID NO: 2680753 - RNA, 20 nt, Human
ugccauuuuaaggaaaacua

SEQ ID NO: 2680754 - RNA, 20 nt, Human
ugcagcucagaaccacagca

SEQ ID NO: 2680755 - RNA, 19 nt, Human
ugcagcucagaaccacagc

SEQ ID NO: 2680756 - RNA, 18 nt, Human
ugcagcucagaaccacag

SEQ ID NO: 2680757 - RNA, 18 nt, Human
agccuucucagaagcaca

SEQ ID NO: 2680758 - RNA, 12 nt, Human
agccuucucccu

SEQ ID NO: 2680759 - RNA, 16 nt, Human
agccuucucccuagcu

SEQ ID NO: 2680760 - RNA, 20 nt, Human
agccuucucccuagcuccuc

SEQ ID NO: 2680761 - RNA, 21 nt, Human
agccuugauucccuuguuauu

SEQ ID NO: 2680762 - RNA, 16 nt, Human
agccuugagcccuggc

SEQ ID NO: 2680763 - RNA, 17 nt, Human
agccuugagcccuggcu

SEQ ID NO: 2680764 - RNA, 19 nt, Human
agccuugagcccuggcugu

SEQ ID NO: 2680765 - RNA, 18 nt, Human
ugcauucguuguguuuuu

SEQ ID NO: 2680766 - RNA, 21 nt, Human
ugcauucguuguguuuuuuaa

SEQ ID NO: 2680767 - RNA, 11 nt, Human
ugcauucauuu

SEQ ID NO: 2680768 - RNA, 14 nt, Human
ugcauucauuuuua

SEQ ID NO: 2680769 - RNA, 15 nt, Human
ugcauucauuuuuau

SEQ ID NO: 2680770 - RNA, 18 nt, Human
ugcauucauuuuuauagc

SEQ ID NO: 2680771 - RNA, 20 nt, Human
ugcauucauuuuuauagcaa

SEQ ID NO: 2680772 - RNA, 19 nt, Human
ugcauuuagggaguauucu

SEQ ID NO: 2680773 - RNA, 16 nt, Human
agcgcuuuuccuuggc

SEQ ID NO: 2680774 - RNA, 23 nt, Human
agcggcuggcagcccaccccuca

SEQ ID NO: 2680775 - RNA, 16 nt, Human
agcguauggcuuuauu

SEQ ID NO: 2680776 - RNA, 15 nt, Human
agcgucagcugcucc

SEQ ID NO: 2680777 - RNA, 19 nt, Human
agcgucagcugcucccugg

SEQ ID NO: 2680778 - RNA, 21 nt, Human
agcgucagcugcucccuggca

SEQ ID NO: 2680779 - RNA, 18 nt, Human
ugccagcuuaucucaggg

SEQ ID NO: 2680780 - RNA, 12 nt, Human
ugccagcuggcc

SEQ ID NO: 2680781 - RNA, 15 nt, Human
ugccagcuggccuuu

SEQ ID NO: 2680782 - RNA, 16 nt, Human
ugccagcuggccuuug

SEQ ID NO: 2680783 - RNA, 18 nt, Human
ugccagcuggccuuugua

SEQ ID NO: 2680784 - RNA, 19 nt, Human
ugccagcuggccuuuguaa

SEQ ID NO: 2680785 - RNA, 13 nt, Human
agcggcuggcagc

SEQ ID NO: 2680786 - RNA, 15 nt, Human
ugccagcugacaucu

SEQ ID NO: 2680787 - RNA, 18 nt, Human
ugccagcugacaucuuga

SEQ ID NO: 2680788 - RNA, 23 nt, Human
ugccagcugacaucuugaauccu

SEQ ID NO: 2680789 - RNA, 14 nt, Human
ugccagcagcagca

SEQ ID NO: 2680790 - RNA, 10 nt, Human
ugccagcagc

SEQ ID NO: 2680791 - RNA, 15 nt, Human
ugccagcagcagcag

SEQ ID NO: 2680792 - RNA, 16 nt, Human
ugccagcagcagcagg

SEQ ID NO: 2680793 - RNA, 17 nt, Human
ugccagcagcagcaggu

SEQ ID NO: 2680794 - RNA, 18 nt, Human
ugccagcagcagcaggug

SEQ ID NO: 2680795 - RNA, 23 nt, Human
ugccagaggaauccuggcagccc

SEQ ID NO: 2680796 - RNA, 21 nt, Human
ugccagauguccuaaugguga

SEQ ID NO: 2680797 - RNA, 20 nt, Human
ugcauuuccucgcagccucu

SEQ ID NO: 2680798 - RNA, 21 nt, Human
ugcauuuagggaguauucuaa

SEQ ID NO: 2680799 - RNA, 12 nt, Human
ugccagagccgg

SEQ ID NO: 2680800 - RNA, 20 nt, Human
ugccagaggaauccuggcag

SEQ ID NO: 2680801 - RNA, 21 nt, Human
ugccagaggaauccuggcagc

SEQ ID NO: 2680802 - RNA, 22 nt, Human
ugccagaggaauccuggcagcc

SEQ ID NO: 2680803 - RNA, 12 nt, Human
agcccaggagcc

SEQ ID NO: 2680804 - RNA, 15 nt, Human
agcccaggagccuca

SEQ ID NO: 2680805 - RNA, 16 nt, Human
agcccaggagccucac

SEQ ID NO: 2680806 - RNA, 17 nt, Human
agcccaggagccucacu

SEQ ID NO: 2680807 - RNA, 12 nt, Human
ugcaagugcugg

SEQ ID NO: 2680808 - RNA, 13 nt, Human
ugcaagugcugga

SEQ ID NO: 2680809 - RNA, 15 nt, Human
ugcaagugcuggagu

SEQ ID NO: 2680810 - RNA, 23 nt, Human
ugcaagugcuggagucuccugag

SEQ ID NO: 2680811 - RNA, 12 nt, Human
ugcaauaacagc

SEQ ID NO: 2680812 - RNA, 14 nt, Human
ugcaauaacagcug

SEQ ID NO: 2680813 - RNA, 15 nt, Human
ugcaauaacagcugc

SEQ ID NO: 2680814 - RNA, 16 nt, Human
ugcaauaacagcugca

SEQ ID NO: 2680815 - RNA, 17 nt, Human
ugcaauaacagcugcaa

SEQ ID NO: 2680816 - RNA, 18 nt, Human
ugcaauaacagcugcaau

SEQ ID NO: 2680817 - RNA, 17 nt, Human
agcccagggcuccugca

SEQ ID NO: 2680818 - RNA, 23 nt, Human
agcccagggcuccugcacuuacu

SEQ ID NO: 2680819 - RNA, 14 nt, Human
agcccagggcuccu

SEQ ID NO: 2680820 - RNA, 15 nt, Human
agcccagggcuccug

SEQ ID NO: 2680821 - RNA, 16 nt, Human
agcccagggcuccugc

SEQ ID NO: 2680822 - RNA, 14 nt, Human
agcccccugcuuca

SEQ ID NO: 2680823 - RNA, 12 nt, Human
agccccucuucc

SEQ ID NO: 2680824 - RNA, 13 nt, Human
agccccucuuccc

SEQ ID NO: 2680825 - RNA, 17 nt, Human
agccccucuuccccaau

SEQ ID NO: 2680826 - RNA, 22 nt, Human
agccccucuggucgcuccugcc

SEQ ID NO: 2680827 - RNA, 20 nt, Human
agccccucuggucgcuccug

SEQ ID NO: 2680828 - RNA, 21 nt, Human
agccccucuggucgcuccugc

SEQ ID NO: 2680829 - RNA, 14 nt, Human
agcccccuggccuc

SEQ ID NO: 2680830 - RNA, 14 nt, Human
agcccggccgcucc

SEQ ID NO: 2680831 - RNA, 12 nt, Human
agcccuggcugu

SEQ ID NO: 2680832 - RNA, 19 nt, Human
agcccugcuggggaucccc

SEQ ID NO: 2680833 - RNA, 22 nt, Human
agccuccacagcgagggcagcu

SEQ ID NO: 2680834 - RNA, 23 nt, Human
agccuccacagcgagggcagcug

SEQ ID NO: 2680835 - RNA, 12 nt, Human
agccuccacagc

SEQ ID NO: 2680836 - RNA, 13 nt, Human
agccuccacagcg

SEQ ID NO: 2680837 - RNA, 14 nt, Human
agccuccacagcga

SEQ ID NO: 2680838 - RNA, 15 nt, Human
agccuccacagcgag

SEQ ID NO: 2680839 - RNA, 21 nt, Human
agccuccacagcgagggcagc

SEQ ID NO: 2680840 - RNA, 13 nt, Human
agccucugcuccc

SEQ ID NO: 2680841 - RNA, 23 nt, Human
agccucugaaaaccaauguucuc

SEQ ID NO: 2680842 - RNA, 16 nt, Human
agccucugcuccccag

SEQ ID NO: 2680843 - RNA, 15 nt, Human
agccucugcucccca

SEQ ID NO: 2680844 - RNA, 15 nt, Human
ugcagcucagaacca

SEQ ID NO: 2680845 - RNA, 23 nt, Human
agccucacuggggcagacaauaa

SEQ ID NO: 2680846 - RNA, 13 nt, Human
agccucagacugg

SEQ ID NO: 2680847 - RNA, 14 nt, Human
agccucagacugga

SEQ ID NO: 2680848 - RNA, 17 nt, Human
agccucagcccccugcu

SEQ ID NO: 2680849 - RNA, 19 nt, Human
agccucagcccccugcuuc

SEQ ID NO: 2680850 - RNA, 22 nt, Human
agccucagcccccugcuucagu

SEQ ID NO: 2680851 - RNA, 19 nt, Human
agccucagcgcggcccucc

SEQ ID NO: 2680852 - RNA, 22 nt, Human
agccucagcgcggcccucccga

SEQ ID NO: 2680853 - RNA, 12 nt, Human
agcccuugccuc

SEQ ID NO: 2680854 - RNA, 13 nt, Human
agcccuugccucc

SEQ ID NO: 2680855 - RNA, 14 nt, Human
agcccuugccuccc

SEQ ID NO: 2680856 - RNA, 16 nt, Human
agcccuugccucccca

SEQ ID NO: 2680857 - RNA, 23 nt, Human
agcccuugccuccccauuuccca

SEQ ID NO: 2680858 - RNA, 23 nt, Human
ugcagaccacgcccguccugccu

SEQ ID NO: 2680859 - RNA, 15 nt, Human
ugcagaacuguagcu

SEQ ID NO: 2680860 - RNA, 12 nt, Human
ugcacuccucag

SEQ ID NO: 2680861 - RNA, 16 nt, Human
ugcacuccucagggca

SEQ ID NO: 2680862 - RNA, 15 nt, Human
ugauuuccucccucu

SEQ ID NO: 2680863 - RNA, 22 nt, Human
ugauuucuuaggggaaggagaa

SEQ ID NO: 2680864 - RNA, 18 nt, Human
ugauuucuuuaaaagaau

SEQ ID NO: 2680865 - RNA, 20 nt, Human
ugauuucuuuaaaagaauga

SEQ ID NO: 2680866 - RNA, 21 nt, Human
ugauuucuuuaaaagaaugac

SEQ ID NO: 2680867 - RNA, 23 nt, Human
ugauuucuuuucaccauucguac

SEQ ID NO: 2680868 - RNA, 16 nt, Human
ugauuugaaaaauaua

SEQ ID NO: 2680869 - RNA, 20 nt, Human
ugauuuggugaccaacuguc

SEQ ID NO: 2680870 - RNA, 19 nt, Human
ugauuuggugaccaacugu

SEQ ID NO: 2680871 - RNA, 13 nt, Human
ugauuuggugacc

SEQ ID NO: 2680872 - RNA, 13 nt, Human
ugauuucuagaac

SEQ ID NO: 2680873 - RNA, 18 nt, Human
ugauucccuuguuauuca

SEQ ID NO: 2680874 - RNA, 20 nt, Human
ugauucccuuguuauucaac

SEQ ID NO: 2680875 - RNA, 19 nt, Human
ugauucccuuguuauucaa

SEQ ID NO: 2680876 - RNA, 12 nt, Human
agccagcgccuc

SEQ ID NO: 2680877 - RNA, 14 nt, Human
agccagcgccuccc

SEQ ID NO: 2680878 - RNA, 15 nt, Human
agccagcgccucccu

SEQ ID NO: 2680879 - RNA, 16 nt, Human
agccagcgccucccuc

SEQ ID NO: 2680880 - RNA, 17 nt, Human
agccagcgccucccucc

SEQ ID NO: 2680881 - RNA, 18 nt, Human
agccagcgccucccucca

SEQ ID NO: 2680882 - RNA, 19 nt, Human
agccagcgccucccuccac

SEQ ID NO: 2680883 - RNA, 21 nt, Human
agccagcgccucccuccaccc

SEQ ID NO: 2680884 - RNA, 22 nt, Human
agccagcgccucccuccacccc

SEQ ID NO: 2680885 - RNA, 23 nt, Human
agccagcgccucccuccacccca

SEQ ID NO: 2680886 - RNA, 19 nt, Human
agccagcucccucuauuua

SEQ ID NO: 2680887 - RNA, 17 nt, Human
agccagcucccucuauu

SEQ ID NO: 2680888 - RNA, 15 nt, Human
agccagcucccucua

SEQ ID NO: 2680889 - RNA, 14 nt, Human
agccagcucccucu

SEQ ID NO: 2680890 - RNA, 22 nt, Human
agccagcucccucuauuuaugu

SEQ ID NO: 2680891 - RNA, 23 nt, Human
agccaucuaaaguaaaaagggaa

SEQ ID NO: 2680892 - RNA, 14 nt, Human
agccaugccagcug

SEQ ID NO: 2680893 - RNA, 16 nt, Human
agccaugccagcuggc

SEQ ID NO: 2680894 - RNA, 17 nt, Human
agccaugccagcuggcc

SEQ ID NO: 2680895 - RNA, 21 nt, Human
agccaugccagcuggccuuug

SEQ ID NO: 2680896 - RNA, 16 nt, Human
agccaugcgcccccuc

SEQ ID NO: 2680897 - RNA, 23 nt, Human
agccaugcgcccccuccgcccug

SEQ ID NO: 2680898 - RNA, 17 nt, Human
agccacuccccggcaug

SEQ ID NO: 2680899 - RNA, 21 nt, Human
agccaugccgucugccggacc

SEQ ID NO: 2680900 - RNA, 16 nt, Human
ugauggacacuccagg

SEQ ID NO: 2680901 - RNA, 19 nt, Human
ugauggacacuccagggac

SEQ ID NO: 2680902 - RNA, 15 nt, Human
ugauggagugugagc

SEQ ID NO: 2680903 - RNA, 14 nt, Human
ugaugagauuuuua

SEQ ID NO: 2680904 - RNA, 20 nt, Human
ugauggaauuuuuuuguacg

SEQ ID NO: 2680905 - RNA, 14 nt, Human
ugauggaaccuuaa

SEQ ID NO: 2680906 - RNA, 18 nt, Human
ugaugacaauaaagcuug

SEQ ID NO: 2680907 - RNA, 22 nt, Human
ugaugacguacaaguaguucug

SEQ ID NO: 2680908 - RNA, 21 nt, Human
ugaugacguacaaguaguucu

SEQ ID NO: 2680909 - RNA, 19 nt, Human
ugaugacguacaaguaguu

SEQ ID NO: 2680910 - RNA, 13 nt, Human
ugauccuccaaca

SEQ ID NO: 2680911 - RNA, 14 nt, Human
ugauccucucaccu

SEQ ID NO: 2680912 - RNA, 19 nt, Human
ugauuaaccacuucagcug

SEQ ID NO: 2680913 - RNA, 16 nt, Human
agccagccccucuucc

SEQ ID NO: 2680914 - RNA, 17 nt, Human
agccagccccucuuccc

SEQ ID NO: 2680915 - RNA, 19 nt, Human
uggaccgcccuuuuccccu

SEQ ID NO: 2680916 - RNA, 17 nt, Human
uggaccuaaauggccuc

SEQ ID NO: 2680917 - RNA, 18 nt, Human
uggaccuaaauggccuca

SEQ ID NO: 2680918 - RNA, 21 nt, Human
uggaccuaaauggccucaugu

SEQ ID NO: 2680919 - RNA, 16 nt, Human
uggacccuuauaaaau

SEQ ID NO: 2680920 - RNA, 15 nt, Human
uggaauugccagcug

SEQ ID NO: 2680921 - RNA, 13 nt, Human
uggaauuguggcu

SEQ ID NO: 2680922 - RNA, 14 nt, Human
uggaauuguggcua

SEQ ID NO: 2680923 - RNA, 20 nt, Human
uggaauuguggcuauccuga

SEQ ID NO: 2680924 - RNA, 22 nt, Human
uggaauuguggcuauccugauu

SEQ ID NO: 2680925 - RNA, 17 nt, Human
aggcaacucaucuuagg

SEQ ID NO: 2680926 - RNA, 21 nt, Human
aggauuuuggauguugagagg

SEQ ID NO: 2680927 - RNA, 12 nt, Human
aggauuuuuaga

SEQ ID NO: 2680928 - RNA, 20 nt, Human
aggaggcaggcauggcccug

SEQ ID NO: 2680929 - RNA, 22 nt, Human
aggaggcaggcauggcccuggg

SEQ ID NO: 2680930 - RNA, 12 nt, Human
aggagggagagg

SEQ ID NO: 2680931 - RNA, 13 nt, Human
aggagggagaggg

SEQ ID NO: 2680932 - RNA, 16 nt, Human
uggaaauugacgaggg

SEQ ID NO: 2680933 - RNA, 13 nt, Human
uggaaauuccugu

SEQ ID NO: 2680934 - RNA, 14 nt, Human
uggaaauuccugua

SEQ ID NO: 2680935 - RNA, 19 nt, Human
uggaaauuccuguacugug

SEQ ID NO: 2680936 - RNA, 22 nt, Human
uggaaauuccuguacugugucu

SEQ ID NO: 2680937 - RNA, 22 nt, Human
aggagcugccuuggcucagaca

SEQ ID NO: 2680938 - RNA, 21 nt, Human
aggagcugccuuggcucagac

SEQ ID NO: 2680939 - RNA, 23 nt, Human
aggagcugccuuggcucagacau

SEQ ID NO: 2680940 - RNA, 19 nt, Human
aggagcugccuuggcucag

SEQ ID NO: 2680941 - RNA, 18 nt, Human
aggagcugccuuggcuca

SEQ ID NO: 2680942 - RNA, 14 nt, Human
aggagggagaggga

SEQ ID NO: 2680943 - RNA, 15 nt, Human
aggagggagagggag

SEQ ID NO: 2680944 - RNA, 22 nt, Human
aggaucucuugagccugggagg

SEQ ID NO: 2680945 - RNA, 21 nt, Human
aggaucucuugagccugggag

SEQ ID NO: 2680946 - RNA, 16 nt, Human
aggagccuuuuuaaaa

SEQ ID NO: 2680947 - RNA, 14 nt, Human
aggagcgagcaugu

SEQ ID NO: 2680948 - RNA, 19 nt, Human
aggagccuuuuuaaaacac

SEQ ID NO: 2680949 - RNA, 15 nt, Human
aggagcgagcauguc

SEQ ID NO: 2680950 - RNA, 14 nt, Human
aggagccugcccag

SEQ ID NO: 2680951 - RNA, 15 nt, Human
ugcuugccugcaggg

SEQ ID NO: 2680952 - RNA, 18 nt, Human
ugcuugccugcagggcca

SEQ ID NO: 2680953 - RNA, 20 nt, Human
ugcuugccugcagggccaug

SEQ ID NO: 2680954 - RNA, 16 nt, Human
ugcuuuguagaguuuu

SEQ ID NO: 2680955 - RNA, 22 nt, Human
ugcuuuguagaguuuugucauu

SEQ ID NO: 2680956 - RNA, 12 nt, Human
ugcuuuguauug

SEQ ID NO: 2680957 - RNA, 13 nt, Human
aggacuuuguaca

SEQ ID NO: 2680958 - RNA, 16 nt, Human
aggagcaggcacgggu

SEQ ID NO: 2680959 - RNA, 21 nt, Human
ugcuucaccauggccuuauga

SEQ ID NO: 2680960 - RNA, 15 nt, Human
aggacugacugaggc

SEQ ID NO: 2680961 - RNA, 17 nt, Human
aggacugacugaggcag

SEQ ID NO: 2680962 - RNA, 16 nt, Human
aggacugacugaggca

SEQ ID NO: 2680963 - RNA, 22 nt, Human
aggacugacugaggcaguuuga

SEQ ID NO: 2680964 - RNA, 18 nt, Human
aggacugacugaggcagu

SEQ ID NO: 2680965 - RNA, 20 nt, Human
aggacuuccccggagggcug

SEQ ID NO: 2680966 - RNA, 21 nt, Human
aggacuuccccggagggcugc

SEQ ID NO: 2680967 - RNA, 13 nt, Human
ugcuucacaguag

SEQ ID NO: 2680968 - RNA, 16 nt, Human
ugcuucacaguagagc

SEQ ID NO: 2680969 - RNA, 20 nt, Human
ugcuucacaguagagccagc

SEQ ID NO: 2680970 - RNA, 21 nt, Human
ugcuucacaguagagccagcu

SEQ ID NO: 2680971 - RNA, 17 nt, Human
ugcuuauuauguaggua

SEQ ID NO: 2680972 - RNA, 17 nt, Human
ugcugugaagcuggaac

SEQ ID NO: 2680973 - RNA, 18 nt, Human
ugcugugaagcuggaacu

SEQ ID NO: 2680974 - RNA, 17 nt, Human
ugcugugagggagggga

SEQ ID NO: 2680975 - RNA, 18 nt, Human
ugcugugagggaggggaa

SEQ ID NO: 2680976 - RNA, 23 nt, Human
ugcugugagggaggggaaaagca

SEQ ID NO: 2680977 - RNA, 22 nt, Human
ugcuucacaguagagccagcuu

SEQ ID NO: 2680978 - RNA, 13 nt, Human
aggacaugcaaua

SEQ ID NO: 2680979 - RNA, 16 nt, Human
aggacaugcaauaaaa

SEQ ID NO: 2680980 - RNA, 20 nt, Human
aggacaugcaauaaaauuua

SEQ ID NO: 2680981 - RNA, 21 nt, Human
aggacaugcaauaaaauuuaa

SEQ ID NO: 2680982 - RNA, 22 nt, Human
aggacaugcaauaaaauuuaaa

SEQ ID NO: 2680983 - RNA, 13 nt, Human
ugcuggccccagc

SEQ ID NO: 2680984 - RNA, 14 nt, Human
ugcuggccccagcc

SEQ ID NO: 2680985 - RNA, 16 nt, Human
ugcuggccccagcccu

SEQ ID NO: 2680986 - RNA, 18 nt, Human
ugcuggccccagcccugc

SEQ ID NO: 2680987 - RNA, 19 nt, Human
ugcuggccccagcccugcu

SEQ ID NO: 2680988 - RNA, 20 nt, Human
ugcuggccccagcccugcug

SEQ ID NO: 2680989 - RNA, 21 nt, Human
ugcuggccccagcccugcugg

SEQ ID NO: 2680990 - RNA, 22 nt, Human
ugcuggccccagcccugcuggg

SEQ ID NO: 2680991 - RNA, 21 nt, Human
ugcugucccauagucccugcc

SEQ ID NO: 2680992 - RNA, 15 nt, Human
ugcugggagcuccac

SEQ ID NO: 2680993 - RNA, 16 nt, Human
ugcugggagcuccacu

SEQ ID NO: 2680994 - RNA, 17 nt, Human
ugcugggagcuccacuc

SEQ ID NO: 2680995 - RNA, 18 nt, Human
ugcugggagcuccacucu

SEQ ID NO: 2680996 - RNA, 20 nt, Human
ugcugggagcuccacucugc

SEQ ID NO: 2680997 - RNA, 21 nt, Human
ugcugggagcuccacucugcu

SEQ ID NO: 2680998 - RNA, 22 nt, Human
ugcugggagcuccacucugcuu

SEQ ID NO: 2680999 - RNA, 23 nt, Human
ugcugggagcuccacucugcuuc

SEQ ID NO: 2681000 - RNA, 17 nt, Human
ugcugggaggagggaga

SEQ ID NO: 2681001 - RNA, 18 nt, Human
ugcugggaggagggagag

SEQ ID NO: 2681002 - RNA, 14 nt, Human
ugcuguacaaaagc

SEQ ID NO: 2681003 - RNA, 20 nt, Human
ugcuguacacauauuugaag

SEQ ID NO: 2681004 - RNA, 23 nt, Human
ugcuguacacauauuugaagggu

SEQ ID NO: 2681005 - RNA, 20 nt, Human
ugcugggaggagggagaggg

SEQ ID NO: 2681006 - RNA, 15 nt, Human
aggaaggagaggaga

SEQ ID NO: 2681007 - RNA, 20 nt, Human
ugcuccgaggacccaggaaa

SEQ ID NO: 2681008 - RNA, 18 nt, Human
ugcuccgaggacccagga

SEQ ID NO: 2681009 - RNA, 22 nt, Human
ugcucccuguaggguccaacca

SEQ ID NO: 2681010 - RNA, 11 nt, Human
ugcuccccaca

SEQ ID NO: 2681011 - RNA, 13 nt, Human
ugcuccccacagc

SEQ ID NO: 2681012 - RNA, 14 nt, Human
ugcuccccacagcg

SEQ ID NO: 2681013 - RNA, 19 nt, Human
ugcuccccacagcgucccu

SEQ ID NO: 2681014 - RNA, 20 nt, Human
ugcuccccacagcgucccug

SEQ ID NO: 2681015 - RNA, 21 nt, Human
ugcuccccacagcgucccugg

SEQ ID NO: 2681016 - RNA, 22 nt, Human
ugcuccccacagcgucccuggc

SEQ ID NO: 2681017 - RNA, 23 nt, Human
ugcuccccacagcgucccuggcg

SEQ ID NO: 2681018 - RNA, 15 nt, Human
ugcuccagcaacaca

SEQ ID NO: 2681019 - RNA, 19 nt, Human
ugcuccagcaacacagccu

SEQ ID NO: 2681020 - RNA, 23 nt, Human
ugcuccagcaacacagccugggc

SEQ ID NO: 2681021 - RNA, 19 nt, Human
ugcuccagcuguucagcug

SEQ ID NO: 2681022 - RNA, 16 nt, Human
ugcuccagcuguucag

SEQ ID NO: 2681023 - RNA, 18 nt, Human
ugcuauuuauuuuccuaa

SEQ ID NO: 2681024 - RNA, 19 nt, Human
ugcuauuuauuuuccuaaa

SEQ ID NO: 2681025 - RNA, 16 nt, Human
ugcuauuuauuuuccu

SEQ ID NO: 2681026 - RNA, 20 nt, Human
uggccaggcuggucuugaac

SEQ ID NO: 2681027 - RNA, 17 nt, Human
aggccugguguuucuug

SEQ ID NO: 2681028 - RNA, 18 nt, Human
aggcucguggacugagug

SEQ ID NO: 2681029 - RNA, 23 nt, Human
aggcucuauuccaauaaacuaug

SEQ ID NO: 2681030 - RNA, 12 nt, Human
aggcuggcaggu

SEQ ID NO: 2681031 - RNA, 15 nt, Human
aggcuggccagucca

SEQ ID NO: 2681032 - RNA, 23 nt, Human
aggcuggaucuuggagaauguga

SEQ ID NO: 2681033 - RNA, 18 nt, Human
aggcuggcgagagucugg

SEQ ID NO: 2681034 - RNA, 17 nt, Human
aggcuggcgagagucug

SEQ ID NO: 2681035 - RNA, 22 nt, Human
aggcuggcgagagucuggcccu

SEQ ID NO: 2681036 - RNA, 20 nt, Human
aggcuggcgagagucuggcc

SEQ ID NO: 2681037 - RNA, 19 nt, Human
aggcuggcgagagucuggc

SEQ ID NO: 2681038 - RNA, 17 nt, Human
aggcuggccaguccagg

SEQ ID NO: 2681039 - RNA, 18 nt, Human
aggcuggccaguccaggc

SEQ ID NO: 2681040 - RNA, 19 nt, Human
aggcuggccaguccaggcu

SEQ ID NO: 2681041 - RNA, 21 nt, Human
aggcuggccaguccaggcugc

SEQ ID NO: 2681042 - RNA, 23 nt, Human
uggcugagguuccucugccugcc

SEQ ID NO: 2681043 - RNA, 24 nt, Human
uggcugagguuccucugccugccc

SEQ ID NO: 2681044 - RNA, 17 nt, Human
uggcugagguuccucug

SEQ ID NO: 2681045 - RNA, 18 nt, Human
uggcugagguuccucugc

SEQ ID NO: 2681046 - RNA, 20 nt, Human
uggcugagguuccucugccu

SEQ ID NO: 2681047 - RNA, 21 nt, Human
uggcugagguuccucugccug

SEQ ID NO: 2681048 - RNA, 22 nt, Human
uggcugagguuccucugccugc

SEQ ID NO: 2681049 - RNA, 20 nt, Human
uggcuguugacgcaccugug

SEQ ID NO: 2681050 - RNA, 13 nt, Human
uggcuuacacugg

SEQ ID NO: 2681051 - RNA, 22 nt, Human
uggcuucacggaagagccuugc

SEQ ID NO: 2681052 - RNA, 23 nt, Human
uggcuucacggaagagccuugcg

SEQ ID NO: 2681053 - RNA, 23 nt, Human
ugggaaagcgcggacgugcuggg

SEQ ID NO: 2681054 - RNA, 15 nt, Human
uggcuuaaucauuuu

SEQ ID NO: 2681055 - RNA, 22 nt, Human
ugggaagcccauccugaccagc

SEQ ID NO: 2681056 - RNA, 19 nt, Human
ugggaagcccauccugacc

SEQ ID NO: 2681057 - RNA, 19 nt, Human
aggccucuccauuugcucu

SEQ ID NO: 2681058 - RNA, 21 nt, Human
aggccucuccauuugcucuuc

SEQ ID NO: 2681059 - RNA, 13 nt, Human
aggccuauuucau

SEQ ID NO: 2681060 - RNA, 14 nt, Human
aggccuauuucauc

SEQ ID NO: 2681061 - RNA, 21 nt, Human
aggccuauuucaucacaagaa

SEQ ID NO: 2681062 - RNA, 12 nt, Human
aggccugcuccc

SEQ ID NO: 2681063 - RNA, 14 nt, Human
aggccugcucccug

SEQ ID NO: 2681064 - RNA, 23 nt, Human
aggccugcucccuguagggucca

SEQ ID NO: 2681065 - RNA, 18 nt, Human
aggccugccucccacuuc

SEQ ID NO: 2681066 - RNA, 22 nt, Human
aggccugccucccacuucacug

SEQ ID NO: 2681067 - RNA, 17 nt, Human
aggccugcgacccuggg

SEQ ID NO: 2681068 - RNA, 18 nt, Human
aggccugcgacccugggg

SEQ ID NO: 2681069 - RNA, 19 nt, Human
aggccugcgacccuggggg

SEQ ID NO: 2681070 - RNA, 20 nt, Human
aggccugcgacccugggggc

SEQ ID NO: 2681071 - RNA, 21 nt, Human
aggccugcgacccugggggca

SEQ ID NO: 2681072 - RNA, 16 nt, Human
aggccugaucugccca

SEQ ID NO: 2681073 - RNA, 13 nt, Human
uggccaagaagca

SEQ ID NO: 2681074 - RNA, 16 nt, Human
uggccaagaagcagug

SEQ ID NO: 2681075 - RNA, 21 nt, Human
uggccaagaagcaguggccuu

SEQ ID NO: 2681076 - RNA, 23 nt, Human
uggccaguccaggcugccguggg

SEQ ID NO: 2681077 - RNA, 20 nt, Human
uggccagucuggucucgaac

SEQ ID NO: 2681078 - RNA, 17 nt, Human
uggccaguccaggcugc

SEQ ID NO: 2681079 - RNA, 21 nt, Human
uggccaguccaggcugccgug

SEQ ID NO: 2681080 - RNA, 16 nt, Human
uggccaguccaggcug

SEQ ID NO: 2681081 - RNA, 22 nt, Human
uggccaagaagcaguggccuua

SEQ ID NO: 2681082 - RNA, 13 nt, Human
uggcccuagacuc

SEQ ID NO: 2681083 - RNA, 17 nt, Human
uggccgcugaguggcag

SEQ ID NO: 2681084 - RNA, 19 nt, Human
uggccgcugaguggcaggg

SEQ ID NO: 2681085 - RNA, 16 nt, Human
uggccgcgcuccgggc

SEQ ID NO: 2681086 - RNA, 18 nt, Human
uggccgcgcuccgggcuu

SEQ ID NO: 2681087 - RNA, 17 nt, Human
uggccgcggagccugca

SEQ ID NO: 2681088 - RNA, 18 nt, Human
aggccaaggugggaggau

SEQ ID NO: 2681089 - RNA, 13 nt, Human
uggacggcaggcu

SEQ ID NO: 2681090 - RNA, 15 nt, Human
uggacggcaggcuca

SEQ ID NO: 2681091 - RNA, 18 nt, Human
uggacggcaggcucacug

SEQ ID NO: 2681092 - RNA, 20 nt, Human
uggacggcaggcucacugcc

SEQ ID NO: 2681093 - RNA, 13 nt, Human
uggagucuccuga

SEQ ID NO: 2681094 - RNA, 14 nt, Human
uggagucuccugag

SEQ ID NO: 2681095 - RNA, 16 nt, Human
aggccaagaauauugc

SEQ ID NO: 2681096 - RNA, 18 nt, Human
aggccaagaauauugcaa

SEQ ID NO: 2681097 - RNA, 19 nt, Human
aggccaagaauauugcaaa

SEQ ID NO: 2681098 - RNA, 20 nt, Human
aggccaagaauauugcaaaa

SEQ ID NO: 2681099 - RNA, 15 nt, Human
uggauguuacucucu

SEQ ID NO: 2681100 - RNA, 18 nt, Human
uggcaccagcagccugga

SEQ ID NO: 2681101 - RNA, 20 nt, Human
uggcacccaccguggaggag

SEQ ID NO: 2681102 - RNA, 21 nt, Human
uggcacccaccguggaggagg

SEQ ID NO: 2681103 - RNA, 22 nt, Human
uggcacccaccguggaggagga

SEQ ID NO: 2681104 - RNA, 11 nt, Human
uggcagcccag

SEQ ID NO: 2681105 - RNA, 12 nt, Human
uggcagcccaga

SEQ ID NO: 2681106 - RNA, 21 nt, Human
auccugugacugucucacuua

SEQ ID NO: 2681107 - RNA, 11 nt, Human
auccugugacu

SEQ ID NO: 2681108 - RNA, 15 nt, Human
auccugugcaauaga

SEQ ID NO: 2681109 - RNA, 14 nt, Human
auccuguguagcau

SEQ ID NO: 2681110 - RNA, 15 nt, Human
auccuuaaaucuuaa

SEQ ID NO: 2681111 - RNA, 20 nt, Human
auccuuaaaucuuaauguuc

SEQ ID NO: 2681112 - RNA, 22 nt, Human
auccuuaaaucuuaauguuccu

SEQ ID NO: 2681113 - RNA, 16 nt, Human
auccuguauucuucaa

SEQ ID NO: 2681114 - RNA, 21 nt, Human
auccuguauucuucaaccagu

SEQ ID NO: 2681115 - RNA, 22 nt, Human
aucggccuagggcccccacagu

SEQ ID NO: 2681116 - RNA, 20 nt, Human
auccuggaacaauauuuuau

SEQ ID NO: 2681117 - RNA, 21 nt, Human
auccuggaacaauauuuuaug

SEQ ID NO: 2681118 - RNA, 11 nt, Human
auccuggcagc

SEQ ID NO: 2681119 - RNA, 12 nt, Human
auccuggcagcc

SEQ ID NO: 2681120 - RNA, 13 nt, Human
auccuggcagccc

SEQ ID NO: 2681121 - RNA, 20 nt, Human
auccuggcagcccagagacu

SEQ ID NO: 2681122 - RNA, 24 nt, Human
auccuggcagcccagagacuuugu

SEQ ID NO: 2681123 - RNA, 15 nt, Human
auccuggcagcccag

SEQ ID NO: 2681124 - RNA, 16 nt, Human
auccuggcagcccaga

SEQ ID NO: 2681125 - RNA, 18 nt, Human
auccuggcagcccagaga

SEQ ID NO: 2681126 - RNA, 19 nt, Human
auccuggcagcccagagac

SEQ ID NO: 2681127 - RNA, 18 nt, Human
auccuggcuaacauggug

SEQ ID NO: 2681128 - RNA, 18 nt, Human
auccugggggccuggguu

SEQ ID NO: 2681129 - RNA, 21 nt, Human
auccugggggccuggguuggg

SEQ ID NO: 2681130 - RNA, 21 nt, Human
auccugggggacccaauguag

SEQ ID NO: 2681131 - RNA, 16 nt, Human
auccugcggguggggc

SEQ ID NO: 2681132 - RNA, 15 nt, Human
auccugauuccucuc

SEQ ID NO: 2681133 - RNA, 17 nt, Human
auccugauuccucucua

SEQ ID NO: 2681134 - RNA, 18 nt, Human
auccugauuccucucuaa

SEQ ID NO: 2681135 - RNA, 20 nt, Human
auccugauuccucucuaagu

SEQ ID NO: 2681136 - RNA, 23 nt, Human
uucuuuugguaaagacuggcuuu

SEQ ID NO: 2681137 - RNA, 13 nt, Human
uucuuuugguaaa

SEQ ID NO: 2681138 - RNA, 22 nt, Human
uucuuuugguaaagacuggcuu

SEQ ID NO: 2681139 - RNA, 14 nt, Human
uucuuuucucagug

SEQ ID NO: 2681140 - RNA, 13 nt, Human
auccugaagagca

SEQ ID NO: 2681141 - RNA, 24 nt, Human
auccugaccagcugcuccgaggac

SEQ ID NO: 2681142 - RNA, 18 nt, Human
aucuaaaucuauuuauua

SEQ ID NO: 2681143 - RNA, 16 nt, Human
aucuaaaucuauuuau

SEQ ID NO: 2681144 - RNA, 15 nt, Human
aucuaaaucuauuua

SEQ ID NO: 2681145 - RNA, 13 nt, Human
aucuaaaucuauu

SEQ ID NO: 2681146 - RNA, 19 nt, Human
aucggcugcauugaagauc

SEQ ID NO: 2681147 - RNA, 15 nt, Human
aucgugaagaagccu

SEQ ID NO: 2681148 - RNA, 23 nt, Human
aucgugaagaagccuguaacacu

SEQ ID NO: 2681149 - RNA, 14 nt, Human
uugaagguuuuuga

SEQ ID NO: 2681150 - RNA, 16 nt, Human
uugaagguuuuugaua

SEQ ID NO: 2681151 - RNA, 19 nt, Human
uugaagggucuuucucaaa

SEQ ID NO: 2681152 - RNA, 17 nt, Human
uugaaguaaugaauuuu

SEQ ID NO: 2681153 - RNA, 16 nt, Human
uugaaguaaugaauuu

SEQ ID NO: 2681154 - RNA, 12 nt, Human
uugaaguaauga

SEQ ID NO: 2681155 - RNA, 19 nt, Human
uugaagucuauaaaaaaua

SEQ ID NO: 2681156 - RNA, 13 nt, Human
uugaauauaugau

SEQ ID NO: 2681157 - RNA, 23 nt, Human
uugaauaugauuaaaaauaucaa

SEQ ID NO: 2681158 - RNA, 15 nt, Human
uugaauaugauuaaa

SEQ ID NO: 2681159 - RNA, 14 nt, Human
uugaauaugauuaa

SEQ ID NO: 2681160 - RNA, 18 nt, Human
uugaaguggccagaugag

SEQ ID NO: 2681161 - RNA, 18 nt, Human
uugaagucuuuaauaaau

SEQ ID NO: 2681162 - RNA, 20 nt, Human
uugaagucuuuaauaaauaa

SEQ ID NO: 2681163 - RNA, 16 nt, Human
uugaaguguauaauau

SEQ ID NO: 2681164 - RNA, 21 nt, Human
uugaaguguauaauauaaaaa

SEQ ID NO: 2681165 - RNA, 15 nt, Human
uugauaaauccauca

SEQ ID NO: 2681166 - RNA, 22 nt, Human
uugagaagaccucaccuagaaa

SEQ ID NO: 2681167 - RNA, 19 nt, Human
uugagaagccuucagcucc

SEQ ID NO: 2681168 - RNA, 21 nt, Human
uugagaagccuucagcuccag

SEQ ID NO: 2681169 - RNA, 22 nt, Human
uugacacugaacuuaauaacug

SEQ ID NO: 2681170 - RNA, 23 nt, Human
uugagaagccuucagcuccaggg

SEQ ID NO: 2681171 - RNA, 17 nt, Human
auccacaauaaccaaga

SEQ ID NO: 2681172 - RNA, 15 nt, Human
auccacaugaaaaua

SEQ ID NO: 2681173 - RNA, 16 nt, Human
auccacaugaaaauaa

SEQ ID NO: 2681174 - RNA, 14 nt, Human
auccaacuccagca

SEQ ID NO: 2681175 - RNA, 22 nt, Human
auccaaauuuuuuuuuaaagca

SEQ ID NO: 2681176 - RNA, 15 nt, Human
auccaacuccagcaa

SEQ ID NO: 2681177 - RNA, 16 nt, Human
auccaacuccagcaac

SEQ ID NO: 2681178 - RNA, 20 nt, Human
auccaauggguuuuucccug

SEQ ID NO: 2681179 - RNA, 19 nt, Human
aucccacuaaugcaaacug

SEQ ID NO: 2681180 - RNA, 20 nt, Human
aucccacuaaugcaaacugg

SEQ ID NO: 2681181 - RNA, 14 nt, Human
uucuguuuaauuuu

SEQ ID NO: 2681182 - RNA, 19 nt, Human
uucuguuuaauuuucacuu

SEQ ID NO: 2681183 - RNA, 20 nt, Human
aucccugaucccauuuuccu

SEQ ID NO: 2681184 - RNA, 16 nt, Human
uucuuacgcaaugcuu

SEQ ID NO: 2681185 - RNA, 15 nt, Human
uucuuacuaaaaagu

SEQ ID NO: 2681186 - RNA, 18 nt, Human
uucuuacuaaaaaguaua

SEQ ID NO: 2681187 - RNA, 20 nt, Human
uucuuacuaaaaaguauaaa

SEQ ID NO: 2681188 - RNA, 15 nt, Human
uucuugcaagcaugc

SEQ ID NO: 2681189 - RNA, 15 nt, Human
uucuugccucugugc

SEQ ID NO: 2681190 - RNA, 16 nt, Human
uucuugccucugugcu

SEQ ID NO: 2681191 - RNA, 17 nt, Human
uucuugccucugugcug

SEQ ID NO: 2681192 - RNA, 22 nt, Human
uucuugccucugugcugugugu

SEQ ID NO: 2681193 - RNA, 18 nt, Human
aucacuguuuagauuugc

SEQ ID NO: 2681194 - RNA, 17 nt, Human
aucacuguuuagauuug

SEQ ID NO: 2681195 - RNA, 19 nt, Human
aucacuuagcgaacccuuu

SEQ ID NO: 2681196 - RNA, 13 nt, Human
aucacuuaaaaca

SEQ ID NO: 2681197 - RNA, 12 nt, Human
aucacuuaaaac

SEQ ID NO: 2681198 - RNA, 22 nt, Human
aucacuguuuagauuugccaua

SEQ ID NO: 2681199 - RNA, 15 nt, Human
aucacuuaaaacacg

SEQ ID NO: 2681200 - RNA, 14 nt, Human
aucacuuaaaacac

SEQ ID NO: 2681201 - RNA, 18 nt, Human
aucacuuaaaacacguuu

SEQ ID NO: 2681202 - RNA, 17 nt, Human
aucauaguuuuauuuau

SEQ ID NO: 2681203 - RNA, 16 nt, Human
aucauaguuuuauuua

SEQ ID NO: 2681204 - RNA, 14 nt, Human
aucauaguuuuauu

SEQ ID NO: 2681205 - RNA, 15 nt, Human
aucauaguuacugug

SEQ ID NO: 2681206 - RNA, 16 nt, Human
aucauaguuacugugu

SEQ ID NO: 2681207 - RNA, 19 nt, Human
aucauaguuacuguguaaa

SEQ ID NO: 2681208 - RNA, 23 nt, Human
aucauaguuuuauuuauauuuau

SEQ ID NO: 2681209 - RNA, 19 nt, Human
aucauaguuuuauuuauau

SEQ ID NO: 2681210 - RNA, 18 nt, Human
uucuccguuagcuccugu

SEQ ID NO: 2681211 - RNA, 19 nt, Human
uucuccguuagcuccugug

SEQ ID NO: 2681212 - RNA, 20 nt, Human
uucuccguuagcuccugugg

SEQ ID NO: 2681213 - RNA, 22 nt, Human
uucuccguuagcuccuguggcc

SEQ ID NO: 2681214 - RNA, 13 nt, Human
uucuccgccagcc

SEQ ID NO: 2681215 - RNA, 14 nt, Human
uucuccgccagccu

SEQ ID NO: 2681216 - RNA, 15 nt, Human
uucuccgccagccuc

SEQ ID NO: 2681217 - RNA, 16 nt, Human
uucuccgccagccucc

SEQ ID NO: 2681218 - RNA, 17 nt, Human
uucuccgccagccuccu

SEQ ID NO: 2681219 - RNA, 18 nt, Human
uucuccgccagccuccuc

SEQ ID NO: 2681220 - RNA, 16 nt, Human
uucuccguuagcuccu

SEQ ID NO: 2681221 - RNA, 17 nt, Human
uucuccguuagcuccug

SEQ ID NO: 2681222 - RNA, 19 nt, Human
uucuccgccagccuccucu

SEQ ID NO: 2681223 - RNA, 20 nt, Human
uucuccgccagccuccucug

SEQ ID NO: 2681224 - RNA, 21 nt, Human
uucuccgccagccuccucugg

SEQ ID NO: 2681225 - RNA, 14 nt, Human
aucauucuuacuaa

SEQ ID NO: 2681226 - RNA, 18 nt, Human
aucauucuuacuaaaaag

SEQ ID NO: 2681227 - RNA, 23 nt, Human
aucauucuuacuaaaaaguauaa

SEQ ID NO: 2681228 - RNA, 22 nt, Human
aucauuguacauagcauguuua

SEQ ID NO: 2681229 - RNA, 17 nt, Human
uucucgugccuccccac

SEQ ID NO: 2681230 - RNA, 23 nt, Human
uucucguuuuuauagucaauggc

SEQ ID NO: 2681231 - RNA, 15 nt, Human
uucucuauuaaaaug

SEQ ID NO: 2681232 - RNA, 20 nt, Human
auauuugaauuuuaaaucua

SEQ ID NO: 2681233 - RNA, 13 nt, Human
auauuugaauuuu

SEQ ID NO: 2681234 - RNA, 12 nt, Human
auauuugauuua

SEQ ID NO: 2681235 - RNA, 18 nt, Human
auauuugauuuauuaacu

SEQ ID NO: 2681236 - RNA, 16 nt, Human
auauuugauuuauuaa

SEQ ID NO: 2681237 - RNA, 15 nt, Human
auauuugauuuauua

SEQ ID NO: 2681238 - RNA, 14 nt, Human
auauuugauuuauu

SEQ ID NO: 2681239 - RNA, 17 nt, Human
auauuaaaaaagagaca

SEQ ID NO: 2681240 - RNA, 23 nt, Human
auauuugauuuauuaacuuaaua

SEQ ID NO: 2681241 - RNA, 17 nt, Human
auauuugcaaaguguau

SEQ ID NO: 2681242 - RNA, 20 nt, Human
auauuugcaaaguguauuag

SEQ ID NO: 2681243 - RNA, 16 nt, Human
uucccuaaucuauggu

SEQ ID NO: 2681244 - RNA, 22 nt, Human
uuccgaagaagaugcuccagca

SEQ ID NO: 2681245 - RNA, 20 nt, Human
uuccugaaacuauauuuugu

SEQ ID NO: 2681246 - RNA, 17 nt, Human
uuccugaaacuauauuu

SEQ ID NO: 2681247 - RNA, 22 nt, Human
uuccucuuuuuauuuaguuccu

SEQ ID NO: 2681248 - RNA, 21 nt, Human
uuccuggcacuggaccccagc

SEQ ID NO: 2681249 - RNA, 14 nt, Human
uuccucucuccaga

SEQ ID NO: 2681250 - RNA, 15 nt, Human
uuccucucuauauuu

SEQ ID NO: 2681251 - RNA, 14 nt, Human
uuccucucuaagug

SEQ ID NO: 2681252 - RNA, 15 nt, Human
uuccucucuccagau

SEQ ID NO: 2681253 - RNA, 16 nt, Human
uuccucucuauauuuc

SEQ ID NO: 2681254 - RNA, 19 nt, Human
aucaagguuauaauuuuuu

SEQ ID NO: 2681255 - RNA, 23 nt, Human
aucaagguuauaauuuuuuuuaa

SEQ ID NO: 2681256 - RNA, 22 nt, Human
aucaacuuagucaauaagaaaa

SEQ ID NO: 2681257 - RNA, 17 nt, Human
auauuuuucauaaacaa

SEQ ID NO: 2681258 - RNA, 18 nt, Human
auauuuuucauaaacaag

SEQ ID NO: 2681259 - RNA, 18 nt, Human
uuccuuacagaacuacuu

SEQ ID NO: 2681260 - RNA, 19 nt, Human
auauuuaacauuauuuaua

SEQ ID NO: 2681261 - RNA, 14 nt, Human
auauuguuucugca

SEQ ID NO: 2681262 - RNA, 19 nt, Human
auauuguuucugcauucau

SEQ ID NO: 2681263 - RNA, 19 nt, Human
auauuguuuuacaauaguu

SEQ ID NO: 2681264 - RNA, 9 nt, Human
auauuuaau

SEQ ID NO: 2681265 - RNA, 22 nt, Human
auauuuaacauuauuuauaugg

SEQ ID NO: 2681266 - RNA, 14 nt, Human
auauuguuugguaa

SEQ ID NO: 2681267 - RNA, 16 nt, Human
auauuguuugguaaau

SEQ ID NO: 2681268 - RNA, 18 nt, Human
auauuguuugguaaaugu

SEQ ID NO: 2681269 - RNA, 19 nt, Human
auauuguuugguaaauguu

SEQ ID NO: 2681270 - RNA, 21 nt, Human
auauuguuugguaaauguuuc

SEQ ID NO: 2681271 - RNA, 18 nt, Human
auauugguuuuaugauga

SEQ ID NO: 2681272 - RNA, 17 nt, Human
auauugguuuuaugaug

SEQ ID NO: 2681273 - RNA, 12 nt, Human
auauugguuuua

SEQ ID NO: 2681274 - RNA, 15 nt, Human
auauugguuuuauga

SEQ ID NO: 2681275 - RNA, 13 nt, Human
auauugguuuuau

SEQ ID NO: 2681276 - RNA, 19 nt, Human
auauugguuuuaugaugac

SEQ ID NO: 2681277 - RNA, 12 nt, Human
auauuacauuua

SEQ ID NO: 2681278 - RNA, 22 nt, Human
auauuacauuuauuuauccaga

SEQ ID NO: 2681279 - RNA, 12 nt, Human
auauuccuuugc

SEQ ID NO: 2681280 - RNA, 23 nt, Human
auauuccuuugcauauuauaaag

SEQ ID NO: 2681281 - RNA, 18 nt, Human
auauugaggccaagaaua

SEQ ID NO: 2681282 - RNA, 19 nt, Human
auauugaggccaagaauau

SEQ ID NO: 2681283 - RNA, 22 nt, Human
auauugaggccaagaauauugc

SEQ ID NO: 2681284 - RNA, 12 nt, Human
auauugaauguu

SEQ ID NO: 2681285 - RNA, 13 nt, Human
auauugaauguua

SEQ ID NO: 2681286 - RNA, 14 nt, Human
auauuacaaaaaca

SEQ ID NO: 2681287 - RNA, 16 nt, Human
auauuacaaaaacaaa

SEQ ID NO: 2681288 - RNA, 22 nt, Human
auauuacaaaaacaaaauaaaa

SEQ ID NO: 2681289 - RNA, 12 nt, Human
auauuacaauga

SEQ ID NO: 2681290 - RNA, 16 nt, Human
auauuacaaugaucac

SEQ ID NO: 2681291 - RNA, 15 nt, Human
auauuacaaugauca

SEQ ID NO: 2681292 - RNA, 13 nt, Human
auauuacaaugau

SEQ ID NO: 2681293 - RNA, 23 nt, Human
uuccaauuauuuauaauaaauca

SEQ ID NO: 2681294 - RNA, 21 nt, Human
auauguuuaaaauaaaaugaa

SEQ ID NO: 2681295 - RNA, 17 nt, Human
auauuaaacauccacaa

SEQ ID NO: 2681296 - RNA, 21 nt, Human
uucacuugaugauacaaugaa

SEQ ID NO: 2681297 - RNA, 19 nt, Human
uucacuuguguuuuaaaau

SEQ ID NO: 2681298 - RNA, 18 nt, Human
uuaucauucaaguguaaa

SEQ ID NO: 2681299 - RNA, 14 nt, Human
uucagaaaaagaaa

SEQ ID NO: 2681300 - RNA, 15 nt, Human
uucagaaaaagaaau

SEQ ID NO: 2681301 - RNA, 16 nt, Human
uucagaaaaagaaaug

SEQ ID NO: 2681302 - RNA, 10 nt, Human
uucagccaag

SEQ ID NO: 2681303 - RNA, 17 nt, Human
uucagcauuaagcuguu

SEQ ID NO: 2681304 - RNA, 22 nt, Human
uucagcauuaagcuguuccugu

SEQ ID NO: 2681305 - RNA, 17 nt, Human
uucagcagcaaauuuuc

SEQ ID NO: 2681306 - RNA, 19 nt, Human
uucagcagcaaauuuucag

SEQ ID NO: 2681307 - RNA, 20 nt, Human
uucagcagcaaauuuucagc

SEQ ID NO: 2681308 - RNA, 15 nt, Human
auauauggaagagga

SEQ ID NO: 2681309 - RNA, 19 nt, Human
auauauuucuaaauguuug

SEQ ID NO: 2681310 - RNA, 12 nt, Human
auauauuucuau

SEQ ID NO: 2681311 - RNA, 13 nt, Human
auauauuucuauu

SEQ ID NO: 2681312 - RNA, 17 nt, Human
auauauuucuauuauua

SEQ ID NO: 2681313 - RNA, 23 nt, Human
auauauuucuauuauuaauugca

SEQ ID NO: 2681314 - RNA, 15 nt, Human
uucaucauccagaug

SEQ ID NO: 2681315 - RNA, 15 nt, Human
uucaguaacugucag

SEQ ID NO: 2681316 - RNA, 20 nt, Human
uucaguaaguuaucuuugaa

SEQ ID NO: 2681317 - RNA, 17 nt, Human
uucagucacauggcaug

SEQ ID NO: 2681318 - RNA, 17 nt, Human
uucagucccuuccccau

SEQ ID NO: 2681319 - RNA, 14 nt, Human
uucaguaagccgug

SEQ ID NO: 2681320 - RNA, 12 nt, Human
uucagaaauguu

SEQ ID NO: 2681321 - RNA, 23 nt, Human
uucagggugcagcccaaucugcc

SEQ ID NO: 2681322 - RNA, 17 nt, Human
uucauaguaagauugau

SEQ ID NO: 2681323 - RNA, 19 nt, Human
uucauaguauccauauuuu

SEQ ID NO: 2681324 - RNA, 23 nt, Human
uucauaguauccauauuuuauua

SEQ ID NO: 2681325 - RNA, 16 nt, Human
auauggggaauauauu

SEQ ID NO: 2681326 - RNA, 23 nt, Human
auauggguuagauguugccaugu

SEQ ID NO: 2681327 - RNA, 13 nt, Human
auauguacuguuu

SEQ ID NO: 2681328 - RNA, 15 nt, Human
auauguaguaucuau

SEQ ID NO: 2681329 - RNA, 22 nt, Human
auauguguaugcacaguaaaaa

SEQ ID NO: 2681330 - RNA, 16 nt, Human
auauauuuugugugaa

SEQ ID NO: 2681331 - RNA, 19 nt, Human
auauauuuugugugaaauu

SEQ ID NO: 2681332 - RNA, 20 nt, Human
auauauuuugugugaaauug

SEQ ID NO: 2681333 - RNA, 22 nt, Human
auauauuuugugugaaauugca

SEQ ID NO: 2681334 - RNA, 16 nt, Human
auaugaacauacaaau

SEQ ID NO: 2681335 - RNA, 15 nt, Human
auauauuuucuguuu

SEQ ID NO: 2681336 - RNA, 19 nt, Human
auaugaacauacaaaugca

SEQ ID NO: 2681337 - RNA, 18 nt, Human
auaugaacauacaaaugc

SEQ ID NO: 2681338 - RNA, 17 nt, Human
auaugaacauacaaaug

SEQ ID NO: 2681339 - RNA, 15 nt, Human
auaugacuuuuuaua

SEQ ID NO: 2681340 - RNA, 13 nt, Human
uucauuauucucu

SEQ ID NO: 2681341 - RNA, 15 nt, Human
uucauuauucucugc

SEQ ID NO: 2681342 - RNA, 16 nt, Human
uucauucuucagauau

SEQ ID NO: 2681343 - RNA, 18 nt, Human
uucauuauuuuaaaaaua

SEQ ID NO: 2681344 - RNA, 17 nt, Human
uuccaguauaaccagcu

SEQ ID NO: 2681345 - RNA, 15 nt, Human
uuccagggaggggcc

SEQ ID NO: 2681346 - RNA, 17 nt, Human
uuccagguuuaagcugu

SEQ ID NO: 2681347 - RNA, 18 nt, Human
uuccagguuuaagcuguu

SEQ ID NO: 2681348 - RNA, 14 nt, Human
uuccacuaaaaaua

SEQ ID NO: 2681349 - RNA, 18 nt, Human
uuccacuaaaaauauugu

SEQ ID NO: 2681350 - RNA, 22 nt, Human
uuccaccacagccagcaccugg

SEQ ID NO: 2681351 - RNA, 15 nt, Human
uuccaccacagccag

SEQ ID NO: 2681352 - RNA, 16 nt, Human
uuccaccacagccagc

SEQ ID NO: 2681353 - RNA, 21 nt, Human
uuccaccacagccagcaccug

SEQ ID NO: 2681354 - RNA, 16 nt, Human
uuucgaagucauuaaa

SEQ ID NO: 2681355 - RNA, 20 nt, Human
uuucgaagucauuaaacugg

SEQ ID NO: 2681356 - RNA, 16 nt, Human
uuuccuuuuugacacu

SEQ ID NO: 2681357 - RNA, 17 nt, Human
uuuccuuuuugacacug

SEQ ID NO: 2681358 - RNA, 18 nt, Human
uuuccuuuuugacacuga

SEQ ID NO: 2681359 - RNA, 19 nt, Human
uuuccuuuuugacacugaa

SEQ ID NO: 2681360 - RNA, 14 nt, Human
uuuccuuuguccuu

SEQ ID NO: 2681361 - RNA, 21 nt, Human
uuuccuuuuuaaggucuuuca

SEQ ID NO: 2681362 - RNA, 13 nt, Human
uuuccuuuaugug

SEQ ID NO: 2681363 - RNA, 14 nt, Human
uuuccuuuauguga

SEQ ID NO: 2681364 - RNA, 15 nt, Human
uuuccuuuaugugaa

SEQ ID NO: 2681365 - RNA, 17 nt, Human
uuuccuuuaugugaauu

SEQ ID NO: 2681366 - RNA, 19 nt, Human
uuuccuuuaugugaauuuu

SEQ ID NO: 2681367 - RNA, 21 nt, Human
uuuccuuuaugugaauuuuua

SEQ ID NO: 2681368 - RNA, 23 nt, Human
uuuccuuuaugugaauuuuuaag

SEQ ID NO: 2681369 - RNA, 13 nt, Human
uuucguggggagg

SEQ ID NO: 2681370 - RNA, 16 nt, Human
uuucgccuuuccucuc

SEQ ID NO: 2681371 - RNA, 13 nt, Human
uuucgccuuuccu

SEQ ID NO: 2681372 - RNA, 12 nt, Human
uuuccuguugaa

SEQ ID NO: 2681373 - RNA, 22 nt, Human
uuuccuguggcauaaauugcau

SEQ ID NO: 2681374 - RNA, 17 nt, Human
auggccucauguggcug

SEQ ID NO: 2681375 - RNA, 18 nt, Human
auggccucauguggcugg

SEQ ID NO: 2681376 - RNA, 19 nt, Human
auggccucauguggcugga

SEQ ID NO: 2681377 - RNA, 20 nt, Human
auggccucauguggcuggaa

SEQ ID NO: 2681378 - RNA, 22 nt, Human
uuucccaucugcaccccuucuc

SEQ ID NO: 2681379 - RNA, 13 nt, Human
auggccucaugug

SEQ ID NO: 2681380 - RNA, 21 nt, Human
auggacccaauauuuaccaga

SEQ ID NO: 2681381 - RNA, 12 nt, Human
augggccccugg

SEQ ID NO: 2681382 - RNA, 14 nt, Human
augggccccuggca

SEQ ID NO: 2681383 - RNA, 16 nt, Human
augggccccuggcacu

SEQ ID NO: 2681384 - RNA, 19 nt, Human
augggaccuguggcugucg

SEQ ID NO: 2681385 - RNA, 18 nt, Human
uuucuuuaggagauuuau

SEQ ID NO: 2681386 - RNA, 23 nt, Human
uuucuuuugguaaagacuggcuu

SEQ ID NO: 2681387 - RNA, 13 nt, Human
uuugaaaacuuca

SEQ ID NO: 2681388 - RNA, 19 nt, Human
uuugaaaacuucagaagca

SEQ ID NO: 2681389 - RNA, 13 nt, Human
uuugaaaagcaga

SEQ ID NO: 2681390 - RNA, 18 nt, Human
uuugaaaagcagacauuu

SEQ ID NO: 2681391 - RNA, 16 nt, Human
uuugaaaagcagacau

SEQ ID NO: 2681392 - RNA, 12 nt, Human
uuucuggcaccg

SEQ ID NO: 2681393 - RNA, 23 nt, Human
uuucuuuaaccuuguauaaauua

SEQ ID NO: 2681394 - RNA, 20 nt, Human
uuucugcuuuagacuugaaa

SEQ ID NO: 2681395 - RNA, 19 nt, Human
uuucugcuuuagacuugaa

SEQ ID NO: 2681396 - RNA, 17 nt, Human
uuucugcuuuagacuug

SEQ ID NO: 2681397 - RNA, 12 nt, Human
uuucugcccugg

SEQ ID NO: 2681398 - RNA, 13 nt, Human
uuucugcccuggc

SEQ ID NO: 2681399 - RNA, 14 nt, Human
uuucugcccuggcu

SEQ ID NO: 2681400 - RNA, 15 nt, Human
uuucugcccuggcug

SEQ ID NO: 2681401 - RNA, 20 nt, Human
uuucugcccuggcugcugcc

SEQ ID NO: 2681402 - RNA, 14 nt, Human
uuucugccuggagu

SEQ ID NO: 2681403 - RNA, 22 nt, Human
uuucugccuggaguguaugacu

SEQ ID NO: 2681404 - RNA, 23 nt, Human
uuugaaagugccuuugcagcuca

SEQ ID NO: 2681405 - RNA, 21 nt, Human
uuugaaagugccuuugcagcu

SEQ ID NO: 2681406 - RNA, 18 nt, Human
uuugaaagugccuuugca

SEQ ID NO: 2681407 - RNA, 14 nt, Human
uuugaaagugccuu

SEQ ID NO: 2681408 - RNA, 18 nt, Human
uuugaaaauaguuuauuu

SEQ ID NO: 2681409 - RNA, 15 nt, Human
uuugaaaauaguuua

SEQ ID NO: 2681410 - RNA, 14 nt, Human
uuugaaaauaguuu

SEQ ID NO: 2681411 - RNA, 11 nt, Human
uuugaaaauag

SEQ ID NO: 2681412 - RNA, 22 nt, Human
uuugaaaaguaauauuuauuaa

SEQ ID NO: 2681413 - RNA, 17 nt, Human
uuugaaaaguaauauuu

SEQ ID NO: 2681414 - RNA, 14 nt, Human
uuugaaaaguaaua

SEQ ID NO: 2681415 - RNA, 12 nt, Human
uuugaaaaguaa

SEQ ID NO: 2681416 - RNA, 11 nt, Human
uuugaaaagua

SEQ ID NO: 2681417 - RNA, 22 nt, Human
auggggaaucuaagagagcugc

SEQ ID NO: 2681418 - RNA, 22 nt, Human
augggcuuuuggggagccagaa

SEQ ID NO: 2681419 - RNA, 15 nt, Human
uuucuauuuuaagac

SEQ ID NO: 2681420 - RNA, 17 nt, Human
uuucucaguguugguau

SEQ ID NO: 2681421 - RNA, 20 nt, Human
uuucucaguguugguauauu

SEQ ID NO: 2681422 - RNA, 21 nt, Human
uuucucaacuggguccagaag

SEQ ID NO: 2681423 - RNA, 15 nt, Human
uuucuauccucugua

SEQ ID NO: 2681424 - RNA, 20 nt, Human
uuucuauuauggaaaacugu

SEQ ID NO: 2681425 - RNA, 12 nt, Human
uuucuaaagacu

SEQ ID NO: 2681426 - RNA, 15 nt, Human
augccucacuaauuu

SEQ ID NO: 2681427 - RNA, 16 nt, Human
augccucacuaauuuu

SEQ ID NO: 2681428 - RNA, 20 nt, Human
augccucacuaauuuuugua

SEQ ID NO: 2681429 - RNA, 21 nt, Human
augccucacuaauuuuuguau

SEQ ID NO: 2681430 - RNA, 23 nt, Human
augccucacuaauuuuuguauua

SEQ ID NO: 2681431 - RNA, 15 nt, Human
augcgcucagggcca

SEQ ID NO: 2681432 - RNA, 23 nt, Human
augcgcucagggccaugcugagg

SEQ ID NO: 2681433 - RNA, 13 nt, Human
augcgcccccucc

SEQ ID NO: 2681434 - RNA, 18 nt, Human
augcgcccccuccgcccu

SEQ ID NO: 2681435 - RNA, 22 nt, Human
augcgcccccuccgcccugcca

SEQ ID NO: 2681436 - RNA, 20 nt, Human
uuuaaagaaaaaaaugucaa

SEQ ID NO: 2681437 - RNA, 17 nt, Human
uuuaaagaaaagaugaa

SEQ ID NO: 2681438 - RNA, 18 nt, Human
uuuaaagaaaagaugaaa

SEQ ID NO: 2681439 - RNA, 21 nt, Human
uuuaaagaaaagaugaaaggc

SEQ ID NO: 2681440 - RNA, 18 nt, Human
uuuaccuuuuaugcaaaa

SEQ ID NO: 2681441 - RNA, 22 nt, Human
augcuaauagugaucaagaaga

SEQ ID NO: 2681442 - RNA, 17 nt, Human
augcuacaauuuuaaga

SEQ ID NO: 2681443 - RNA, 23 nt, Human
uuuauuaaauuuuuuuguaugaa

SEQ ID NO: 2681444 - RNA, 17 nt, Human
uuuauuaacuuaauaau

SEQ ID NO: 2681445 - RNA, 13 nt, Human
uuuauuaaauuuu

SEQ ID NO: 2681446 - RNA, 12 nt, Human
uuuauuaaauuu

SEQ ID NO: 2681447 - RNA, 15 nt, Human
uuuauaucaugcaaa

SEQ ID NO: 2681448 - RNA, 16 nt, Human
uuuauaucaugcaaaa

SEQ ID NO: 2681449 - RNA, 17 nt, Human
uuuauaucaugcaaaau

SEQ ID NO: 2681450 - RNA, 19 nt, Human
uuuacucauccuccaggaa

SEQ ID NO: 2681451 - RNA, 21 nt, Human
uuuacucauccuccaggaacu

SEQ ID NO: 2681452 - RNA, 13 nt, Human
uuuaguaauuucu

SEQ ID NO: 2681453 - RNA, 15 nt, Human
uuuaguaauuucuuu

SEQ ID NO: 2681454 - RNA, 12 nt, Human
uuucccaucugc

SEQ ID NO: 2681455 - RNA, 13 nt, Human
uuucccaucugca

SEQ ID NO: 2681456 - RNA, 19 nt, Human
uuucccacuucccacccug

SEQ ID NO: 2681457 - RNA, 23 nt, Human
uuucccacuucccacccugcccc

SEQ ID NO: 2681458 - RNA, 14 nt, Human
uuucaguuuguugg

SEQ ID NO: 2681459 - RNA, 11 nt, Human
uuuccagggag

SEQ ID NO: 2681460 - RNA, 13 nt, Human
uuuccagggaggg

SEQ ID NO: 2681461 - RNA, 19 nt, Human
uuuccagguuuaagcuguu

SEQ ID NO: 2681462 - RNA, 18 nt, Human
uuucauaaauuauuugau

SEQ ID NO: 2681463 - RNA, 19 nt, Human
uuucauaaauuauuugauu

SEQ ID NO: 2681464 - RNA, 14 nt, Human
uuucauaaacaagu

SEQ ID NO: 2681465 - RNA, 17 nt, Human
uuucauaaacaaguucg

SEQ ID NO: 2681466 - RNA, 16 nt, Human
uuucagaaaaugaaaa

SEQ ID NO: 2681467 - RNA, 22 nt, Human
uuucaguucuuuggauucuaaa

SEQ ID NO: 2681468 - RNA, 18 nt, Human
uuucacuuguguuuuaaa

SEQ ID NO: 2681469 - RNA, 16 nt, Human
uuucagaaaaagaaau

SEQ ID NO: 2681470 - RNA, 14 nt, Human
uuucacucuaaguc

SEQ ID NO: 2681471 - RNA, 15 nt, Human
uuucacucuaaguca

SEQ ID NO: 2681472 - RNA, 18 nt, Human
uuucacucuaagucaugu

SEQ ID NO: 2681473 - RNA, 19 nt, Human
uuucacucuaagucaugua

SEQ ID NO: 2681474 - RNA, 20 nt, Human
uuucacucuaagucauguau

SEQ ID NO: 2681475 - RNA, 22 nt, Human
uuucacucuaagucauguaugu

SEQ ID NO: 2681476 - RNA, 23 nt, Human
uuucacucuaagucauguauguu

SEQ ID NO: 2681477 - RNA, 17 nt, Human
uuuauuuuuuggacuuc

SEQ ID NO: 2681478 - RNA, 13 nt, Human
uuuauuuugugua

SEQ ID NO: 2681479 - RNA, 15 nt, Human
uuuauuuuguguaaa

SEQ ID NO: 2681480 - RNA, 21 nt, Human
uuuauuuuuuuuaauuguauu

SEQ ID NO: 2681481 - RNA, 18 nt, Human
uuuauuuuuuuuaaagaa

SEQ ID NO: 2681482 - RNA, 20 nt, Human
uuuauuaacuuaauaaucaa

SEQ ID NO: 2681483 - RNA, 16 nt, Human
uuuauuacuuccauga

SEQ ID NO: 2681484 - RNA, 20 nt, Human
uuuauuacuuccaugaauuu

SEQ ID NO: 2681485 - RNA, 16 nt, Human
augcugggacucagcc

SEQ ID NO: 2681486 - RNA, 9 nt, Human
augcuggga

SEQ ID NO: 2681487 - RNA, 15 nt, Human
uuuauuacuguuuau

SEQ ID NO: 2681488 - RNA, 21 nt, Human
uuuauuacuguuuauuacuuc

SEQ ID NO: 2681489 - RNA, 10 nt, Human
augcugggac

SEQ ID NO: 2681490 - RNA, 15 nt, Human
augcugggacucagc

SEQ ID NO: 2681491 - RNA, 15 nt, Human
auggaaguuuuccua

SEQ ID NO: 2681492 - RNA, 13 nt, Human
auggaauaaaagg

SEQ ID NO: 2681493 - RNA, 13 nt, Human
uuuauuuuacaca

SEQ ID NO: 2681494 - RNA, 18 nt, Human
uuuauuuuacacagaaac

SEQ ID NO: 2681495 - RNA, 18 nt, Human
uuuauuuugagauguaaa

SEQ ID NO: 2681496 - RNA, 21 nt, Human
uuuauuuuacacagaaacacu

SEQ ID NO: 2681497 - RNA, 19 nt, Human
uuuauuuuacagcucauua

SEQ ID NO: 2681498 - RNA, 12 nt, Human
uuuauuuuccua

SEQ ID NO: 2681499 - RNA, 15 nt, Human
uuuauuuuccuaaag

SEQ ID NO: 2681500 - RNA, 23 nt, Human
augcuuacgugauccucucaccu

SEQ ID NO: 2681501 - RNA, 20 nt, Human
uuguccugccugcaauauuu

SEQ ID NO: 2681502 - RNA, 18 nt, Human
uuguccuuuuucaggaga

SEQ ID NO: 2681503 - RNA, 14 nt, Human
uugucgcucaugug

SEQ ID NO: 2681504 - RNA, 20 nt, Human
uuguccuauuaguguuauau

SEQ ID NO: 2681505 - RNA, 19 nt, Human
uuguccuauuaguguuaua

SEQ ID NO: 2681506 - RNA, 17 nt, Human
uuguccuauuaguguua

SEQ ID NO: 2681507 - RNA, 16 nt, Human
uuguccuauuaguguu

SEQ ID NO: 2681508 - RNA, 14 nt, Human
uugucacuuuuuau

SEQ ID NO: 2681509 - RNA, 21 nt, Human
uugucacuuuuuaugcuauuu

SEQ ID NO: 2681510 - RNA, 15 nt, Human
augauaaaacacaaa

SEQ ID NO: 2681511 - RNA, 19 nt, Human
augagucuguuguguguca

SEQ ID NO: 2681512 - RNA, 18 nt, Human
augagucuguuguguguc

SEQ ID NO: 2681513 - RNA, 13 nt, Human
augaggugggagg

SEQ ID NO: 2681514 - RNA, 14 nt, Human
augaggugggaggu

SEQ ID NO: 2681515 - RNA, 19 nt, Human
augaguccuugauuucaaa

SEQ ID NO: 2681516 - RNA, 21 nt, Human
augaguccuugauuucaaagu

SEQ ID NO: 2681517 - RNA, 22 nt, Human
augaggugggagguggaagaag

SEQ ID NO: 2681518 - RNA, 13 nt, Human
augagagcauaau

SEQ ID NO: 2681519 - RNA, 16 nt, Human
augagagcauaauuua

SEQ ID NO: 2681520 - RNA, 20 nt, Human
augagagcauaauuuaaaaa

SEQ ID NO: 2681521 - RNA, 12 nt, Human
augagaugugug

SEQ ID NO: 2681522 - RNA, 20 nt, Human
augagauugguuuuccugug

SEQ ID NO: 2681523 - RNA, 16 nt, Human
augagauuuuuaaaaa

SEQ ID NO: 2681524 - RNA, 20 nt, Human
augagauuuuuaaaaaauau

SEQ ID NO: 2681525 - RNA, 22 nt, Human
augagauguguggacuguggca

SEQ ID NO: 2681526 - RNA, 14 nt, Human
augagaugugugga

SEQ ID NO: 2681527 - RNA, 23 nt, Human
uugugaaccauggugaagugcuu

SEQ ID NO: 2681528 - RNA, 16 nt, Human
uuguguguccccuugc

SEQ ID NO: 2681529 - RNA, 15 nt, Human
uugugugucaugcca

SEQ ID NO: 2681530 - RNA, 16 nt, Human
uuguucucagaauccc

SEQ ID NO: 2681531 - RNA, 23 nt, Human
uuguucucagaaucccuuaacag

SEQ ID NO: 2681532 - RNA, 23 nt, Human
uuguuccuuggagaaaugaaaac

SEQ ID NO: 2681533 - RNA, 16 nt, Human
augauccuaggcauuu

SEQ ID NO: 2681534 - RNA, 18 nt, Human
augaucaccgacugaaaa

SEQ ID NO: 2681535 - RNA, 16 nt, Human
uuguugcaagauguga

SEQ ID NO: 2681536 - RNA, 17 nt, Human
uuguugcaagaugugaa

SEQ ID NO: 2681537 - RNA, 18 nt, Human
uuguugcaagaugugaau

SEQ ID NO: 2681538 - RNA, 19 nt, Human
uuguugcaagaugugaauu

SEQ ID NO: 2681539 - RNA, 20 nt, Human
uuguugcaagaugugaauua

SEQ ID NO: 2681540 - RNA, 20 nt, Human
uuguugccaugugcaccuug

SEQ ID NO: 2681541 - RNA, 14 nt, Human
uuuaaaaaaaaagu

SEQ ID NO: 2681542 - RNA, 18 nt, Human
uuuaaaaaaaaagucaga

SEQ ID NO: 2681543 - RNA, 16 nt, Human
uuuaaaaaauauuuuc

SEQ ID NO: 2681544 - RNA, 17 nt, Human
uuuaaaaaauauuuucu

SEQ ID NO: 2681545 - RNA, 12 nt, Human
uuuaaaaaauaa

SEQ ID NO: 2681546 - RNA, 22 nt, Human
uuuaaaaaauaaauaaaaacua

SEQ ID NO: 2681547 - RNA, 18 nt, Human
uuuaaagaaaaaaauguc

SEQ ID NO: 2681548 - RNA, 17 nt, Human
uuuaaagaaaaaaaugu

SEQ ID NO: 2681549 - RNA, 11 nt, Human
uuuaaacuuuc

SEQ ID NO: 2681550 - RNA, 16 nt, Human
uuuaaaaaauggucac

SEQ ID NO: 2681551 - RNA, 22 nt, Human
uuguuuuggcugaaauucuccu

SEQ ID NO: 2681552 - RNA, 15 nt, Human
uuguuuuuguauauu

SEQ ID NO: 2681553 - RNA, 13 nt, Human
uuguuuuuguaua

SEQ ID NO: 2681554 - RNA, 18 nt, Human
uuguuuuucugcuuuaga

SEQ ID NO: 2681555 - RNA, 12 nt, Human
uuguuuuucugc

SEQ ID NO: 2681556 - RNA, 16 nt, Human
augaacauacaaaugc

SEQ ID NO: 2681557 - RNA, 12 nt, Human
uugggcagagcu

SEQ ID NO: 2681558 - RNA, 22 nt, Human
uugggcagagcuggcucugagc

SEQ ID NO: 2681559 - RNA, 17 nt, Human
uugggcagagcuggcuc

SEQ ID NO: 2681560 - RNA, 21 nt, Human
uugggcagagcuggcucugag

SEQ ID NO: 2681561 - RNA, 17 nt, Human
uuguaguucuuuaaacu

SEQ ID NO: 2681562 - RNA, 22 nt, Human
uuguauaguuauguaaauaauu

SEQ ID NO: 2681563 - RNA, 15 nt, Human
uuguaguucuuuaaa

SEQ ID NO: 2681564 - RNA, 22 nt, Human
uuguaagcguauggcuuuauuu

SEQ ID NO: 2681565 - RNA, 18 nt, Human
uuguaagcguauggcuuu

SEQ ID NO: 2681566 - RNA, 17 nt, Human
uuguaagcguauggcuu

SEQ ID NO: 2681567 - RNA, 16 nt, Human
uuguaagcguauggcu

SEQ ID NO: 2681568 - RNA, 22 nt, Human
uuguaaaaaucuuuugaagcau

SEQ ID NO: 2681569 - RNA, 16 nt, Human
uuguauauuacaauga

SEQ ID NO: 2681570 - RNA, 15 nt, Human
uuguauauuacaaug

SEQ ID NO: 2681571 - RNA, 14 nt, Human
uuguauauuacaau

SEQ ID NO: 2681572 - RNA, 13 nt, Human
uuguauauuacaa

SEQ ID NO: 2681573 - RNA, 19 nt, Human
uuguauauauuauuauaau

SEQ ID NO: 2681574 - RNA, 21 nt, Human
uuguauauauuauuauaaucu

SEQ ID NO: 2681575 - RNA, 14 nt, Human
augacaaaaaaugu

SEQ ID NO: 2681576 - RNA, 17 nt, Human
augacaaaaaauguuuu

SEQ ID NO: 2681577 - RNA, 15 nt, Human
augacaauaaagcuu

SEQ ID NO: 2681578 - RNA, 19 nt, Human
uugcugaauacagaggcaa

SEQ ID NO: 2681579 - RNA, 20 nt, Human
uugcuaauuaacugaaacau

SEQ ID NO: 2681580 - RNA, 19 nt, Human
uugcuacuguuguaagaau

SEQ ID NO: 2681581 - RNA, 18 nt, Human
uugcuaucaacaauaaaa

SEQ ID NO: 2681582 - RNA, 22 nt, Human
uugcuaucaacaauaaaauuuu

SEQ ID NO: 2681583 - RNA, 14 nt, Human
uugcuugucuucug

SEQ ID NO: 2681584 - RNA, 15 nt, Human
uugcugagccucugc

SEQ ID NO: 2681585 - RNA, 14 nt, Human
uugcugagccucug

SEQ ID NO: 2681586 - RNA, 22 nt, Human
uugcugagccucugcuccccag

SEQ ID NO: 2681587 - RNA, 16 nt, Human
uugcuugccugcaggg

SEQ ID NO: 2681588 - RNA, 19 nt, Human
uugcuugccugcagggcca

SEQ ID NO: 2681589 - RNA, 15 nt, Human
uugcugacuuagaau

SEQ ID NO: 2681590 - RNA, 14 nt, Human
uugcugacuuagaa

SEQ ID NO: 2681591 - RNA, 12 nt, Human
uugcugacuuag

SEQ ID NO: 2681592 - RNA, 20 nt, Human
uugcuuuuggcaaaacucua

SEQ ID NO: 2681593 - RNA, 16 nt, Human
uugcuuuaccuuuuca

SEQ ID NO: 2681594 - RNA, 12 nt, Human
aucuuucagaaa

SEQ ID NO: 2681595 - RNA, 14 nt, Human
aucuuucagaaaua

SEQ ID NO: 2681596 - RNA, 16 nt, Human
aucuuucagaaauaua

SEQ ID NO: 2681597 - RNA, 17 nt, Human
aucuuucagaaauauaa

SEQ ID NO: 2681598 - RNA, 22 nt, Human
aucuuucagaaauauaacacau

SEQ ID NO: 2681599 - RNA, 12 nt, Human
uuggccugggcc

SEQ ID NO: 2681600 - RNA, 12 nt, Human
uuggccugcugu

SEQ ID NO: 2681601 - RNA, 13 nt, Human
uuggccugcugug

SEQ ID NO: 2681602 - RNA, 14 nt, Human
uuggccugcuguga

SEQ ID NO: 2681603 - RNA, 21 nt, Human
uuggaccuaaauggccucaug

SEQ ID NO: 2681604 - RNA, 23 nt, Human
uuggaccuaaauggccucaugug

SEQ ID NO: 2681605 - RNA, 19 nt, Human
uuggaccuaaauggccuca

SEQ ID NO: 2681606 - RNA, 23 nt, Human
auuuauuaauauuuaacauuauu

SEQ ID NO: 2681607 - RNA, 15 nt, Human
auuuauuaauauuua

SEQ ID NO: 2681608 - RNA, 14 nt, Human
auuuauuaauauuu

SEQ ID NO: 2681609 - RNA, 12 nt, Human
auuuauuaauau

SEQ ID NO: 2681610 - RNA, 23 nt, Human
auuuauuaacuuaauaaucaaga

SEQ ID NO: 2681611 - RNA, 21 nt, Human
auuuauuaacuuaauaaucaa

SEQ ID NO: 2681612 - RNA, 20 nt, Human
auuuauuaacuuaauaauca

SEQ ID NO: 2681613 - RNA, 17 nt, Human
auuuauuaacuuaauaa

SEQ ID NO: 2681614 - RNA, 14 nt, Human
auuuauuaaauuuu

SEQ ID NO: 2681615 - RNA, 24 nt, Human
auuuauuaaauuuuuuuguaugaa

SEQ ID NO: 2681616 - RNA, 21 nt, Human
auuuauuaaauuuuuuuguau

SEQ ID NO: 2681617 - RNA, 16 nt, Human
auuuauuaacuuaaua

SEQ ID NO: 2681618 - RNA, 14 nt, Human
auuuauuaacuuaa

SEQ ID NO: 2681619 - RNA, 13 nt, Human
auuuauuaacuua

SEQ ID NO: 2681620 - RNA, 16 nt, Human
auuuagacaagagaug

SEQ ID NO: 2681621 - RNA, 16 nt, Human
auuuaguauuaucaaa

SEQ ID NO: 2681622 - RNA, 17 nt, Human
auuuaaaaaauaaauaa

SEQ ID NO: 2681623 - RNA, 22 nt, Human
auuuaaaaaauaaauaaaaacu

SEQ ID NO: 2681624 - RNA, 14 nt, Human
auuuaaaaauagaa

SEQ ID NO: 2681625 - RNA, 15 nt, Human
auuuaaaaauagaaa

SEQ ID NO: 2681626 - RNA, 16 nt, Human
auuuaaaaauagaaac

SEQ ID NO: 2681627 - RNA, 17 nt, Human
auuuaaaaauagaaaca

SEQ ID NO: 2681628 - RNA, 15 nt, Human
auuuaaaaauauauu

SEQ ID NO: 2681629 - RNA, 13 nt, Human
auuuaacagaaau

SEQ ID NO: 2681630 - RNA, 21 nt, Human
auuuaaauuacaauuuuaucu

SEQ ID NO: 2681631 - RNA, 14 nt, Human
auuuagacaagaga

SEQ ID NO: 2681632 - RNA, 20 nt, Human
auuuagacaagagaugggaa

SEQ ID NO: 2681633 - RNA, 19 nt, Human
auuuagaccccauacaagu

SEQ ID NO: 2681634 - RNA, 14 nt, Human
auuuauuuauuauu

SEQ ID NO: 2681635 - RNA, 13 nt, Human
auuuauuuauuau

SEQ ID NO: 2681636 - RNA, 15 nt, Human
auuuauuuauccaga

SEQ ID NO: 2681637 - RNA, 15 nt, Human
auuuauuuauguacu

SEQ ID NO: 2681638 - RNA, 16 nt, Human
auuuauuuauguacuu

SEQ ID NO: 2681639 - RNA, 18 nt, Human
auuuauuuauguacuuuu

SEQ ID NO: 2681640 - RNA, 23 nt, Human
auuuauuuacagaugaauguauu

SEQ ID NO: 2681641 - RNA, 13 nt, Human
auuuauuuacaga

SEQ ID NO: 2681642 - RNA, 15 nt, Human
auuuauuuaauauuu

SEQ ID NO: 2681643 - RNA, 18 nt, Human
auuuauuuaauauuuaau

SEQ ID NO: 2681644 - RNA, 19 nt, Human
auuuauuauuuauuuauua

SEQ ID NO: 2681645 - RNA, 13 nt, Human
auuuauuauuuau

SEQ ID NO: 2681646 - RNA, 11 nt, Human
auuuauuauuu

SEQ ID NO: 2681647 - RNA, 18 nt, Human
auuucaaaguuuuguugu

SEQ ID NO: 2681648 - RNA, 19 nt, Human
auuucaaaguuuuguugua

SEQ ID NO: 2681649 - RNA, 13 nt, Human
auuucaaaauaua

SEQ ID NO: 2681650 - RNA, 13 nt, Human
auuucccaucugc

SEQ ID NO: 2681651 - RNA, 14 nt, Human
auuucccaucugca

SEQ ID NO: 2681652 - RNA, 15 nt, Human
auuucccaucugcac

SEQ ID NO: 2681653 - RNA, 22 nt, Human
auuucccauuugugccagagga

SEQ ID NO: 2681654 - RNA, 21 nt, Human
auuucccauuugugccagagg

SEQ ID NO: 2681655 - RNA, 17 nt, Human
auuuccagccaaagccu

SEQ ID NO: 2681656 - RNA, 22 nt, Human
auuuccagaaccacacuugaaa

SEQ ID NO: 2681657 - RNA, 17 nt, Human
auuugaaagugccuuug

SEQ ID NO: 2681658 - RNA, 16 nt, Human
auuugaaagugccuuu

SEQ ID NO: 2681659 - RNA, 17 nt, Human
auuugaacaaugaaguu

SEQ ID NO: 2681660 - RNA, 18 nt, Human
auuugaacaaugaaguug

SEQ ID NO: 2681661 - RNA, 19 nt, Human
auuugaacaaugaaguuga

SEQ ID NO: 2681662 - RNA, 20 nt, Human
auuugaacaaugaaguugaa

SEQ ID NO: 2681663 - RNA, 22 nt, Human
auuugaaagugccuuugcagcu

SEQ ID NO: 2681664 - RNA, 20 nt, Human
auuugaaagugccuuugcag

SEQ ID NO: 2681665 - RNA, 15 nt, Human
auuugaaauaagaau

SEQ ID NO: 2681666 - RNA, 16 nt, Human
auuugaaauaagaauu

SEQ ID NO: 2681667 - RNA, 14 nt, Human
auuugaaaaauaua

SEQ ID NO: 2681668 - RNA, 15 nt, Human
auuugaaaaauauaa

SEQ ID NO: 2681669 - RNA, 20 nt, Human
auuugaaaaauauaaaauua

SEQ ID NO: 2681670 - RNA, 16 nt, Human
auuucuuuuuuuccuu

SEQ ID NO: 2681671 - RNA, 22 nt, Human
auuuccccucugcacccagaac

SEQ ID NO: 2681672 - RNA, 23 nt, Human
auuuccccucugcacccagaaca

SEQ ID NO: 2681673 - RNA, 14 nt, Human
auuucuagaaacaa

SEQ ID NO: 2681674 - RNA, 15 nt, Human
auuucuacugucaaa

SEQ ID NO: 2681675 - RNA, 16 nt, Human
auuucuacugucaaau

SEQ ID NO: 2681676 - RNA, 21 nt, Human
auuucuacugucaaaugaugu

SEQ ID NO: 2681677 - RNA, 13 nt, Human
auugaccauuuuu

SEQ ID NO: 2681678 - RNA, 22 nt, Human
auugaccauuuuuuaauuuacu

SEQ ID NO: 2681679 - RNA, 22 nt, Human
auucuuuuaauuguuucagaau

SEQ ID NO: 2681680 - RNA, 22 nt, Human
auugaaaauguccaggaaagug

SEQ ID NO: 2681681 - RNA, 16 nt, Human
auugaaaaguuuuugu

SEQ ID NO: 2681682 - RNA, 19 nt, Human
auugaaaaguuuuuguuug

SEQ ID NO: 2681683 - RNA, 20 nt, Human
auugaaaaguuuuuguuugg

SEQ ID NO: 2681684 - RNA, 23 nt, Human
auugaaaaguuuuuguuuggaga

SEQ ID NO: 2681685 - RNA, 14 nt, Human
auucuggcuuuaag

SEQ ID NO: 2681686 - RNA, 16 nt, Human
auucuggcuuuaagcc

SEQ ID NO: 2681687 - RNA, 19 nt, Human
auucuggcuuuaagccuuc

SEQ ID NO: 2681688 - RNA, 16 nt, Human
auucugguuccagggu

SEQ ID NO: 2681689 - RNA, 20 nt, Human
auucugauuucuuuucacca

SEQ ID NO: 2681690 - RNA, 14 nt, Human
auucugauuucuuu

SEQ ID NO: 2681691 - RNA, 22 nt, Human
auucugauucuggcuuuaagcc

SEQ ID NO: 2681692 - RNA, 19 nt, Human
auucugguuccaggguccc

SEQ ID NO: 2681693 - RNA, 23 nt, Human
auucuuaaaaggcccauagcagc

SEQ ID NO: 2681694 - RNA, 19 nt, Human
auucuguuuuuaaugcuau

SEQ ID NO: 2681695 - RNA, 13 nt, Human
auucuuuucucag

SEQ ID NO: 2681696 - RNA, 19 nt, Human
auucuuuucucaguguugg

SEQ ID NO: 2681697 - RNA, 15 nt, Human
auucuucucuuccuu

SEQ ID NO: 2681698 - RNA, 13 nt, Human
auucuuacuaaaa

SEQ ID NO: 2681699 - RNA, 17 nt, Human
auucuuacuaaaaagua

SEQ ID NO: 2681700 - RNA, 22 nt, Human
auucuuacuaaaaaguauaaaa

SEQ ID NO: 2681701 - RNA, 17 nt, Human
auucuucagauauacug

SEQ ID NO: 2681702 - RNA, 14 nt, Human
auucuucaaccagu

SEQ ID NO: 2681703 - RNA, 15 nt, Human
auuguauuuaugugu

SEQ ID NO: 2681704 - RNA, 14 nt, Human
auuguccaguuugu

SEQ ID NO: 2681705 - RNA, 23 nt, Human
auuguccaguuugucuuggauau

SEQ ID NO: 2681706 - RNA, 20 nt, Human
auuguggucacaacuugaug

SEQ ID NO: 2681707 - RNA, 14 nt, Human
auuuauuuaugugu

SEQ ID NO: 2681708 - RNA, 14 nt, Human
auuugaagggucuu

SEQ ID NO: 2681709 - RNA, 18 nt, Human
auuuuaaaaaagccuucc

SEQ ID NO: 2681710 - RNA, 17 nt, Human
auuuuaaaaaaugguca

SEQ ID NO: 2681711 - RNA, 16 nt, Human
auuuuaaaaaaugguc

SEQ ID NO: 2681712 - RNA, 17 nt, Human
auuuuaccuagcuaauu

SEQ ID NO: 2681713 - RNA, 19 nt, Human
auuuuaccuagcuaauuau

SEQ ID NO: 2681714 - RNA, 22 nt, Human
auuuuaccuagcuaauuauuua

SEQ ID NO: 2681715 - RNA, 20 nt, Human
auuuucaacugucuuccuca

SEQ ID NO: 2681716 - RNA, 13 nt, Human
auuuucagagccg

SEQ ID NO: 2681717 - RNA, 23 nt, Human
auuuucagagccggcccgccucu

SEQ ID NO: 2681718 - RNA, 12 nt, Human
auuuucagcauu

SEQ ID NO: 2681719 - RNA, 19 nt, Human
auuuucagcauuaagcugu

SEQ ID NO: 2681720 - RNA, 20 nt, Human
auuuucagcauuaagcuguu

SEQ ID NO: 2681721 - RNA, 14 nt, Human
auuuuccaaagagu

SEQ ID NO: 2681722 - RNA, 14 nt, Human
auuuuccaaaugua

SEQ ID NO: 2681723 - RNA, 14 nt, Human
auuuucaugaaaau

SEQ ID NO: 2681724 - RNA, 17 nt, Human
auuuucaugaaaauacc

SEQ ID NO: 2681725 - RNA, 20 nt, Human
auuuucaugaaaauaccauu

SEQ ID NO: 2681726 - RNA, 21 nt, Human
auuuucaugaaaauaccauuu

SEQ ID NO: 2681727 - RNA, 14 nt, Human
auuuuccucuugug

SEQ ID NO: 2681728 - RNA, 15 nt, Human
auuuuccucuuguga

SEQ ID NO: 2681729 - RNA, 12 nt, Human
auuuuccucuga

SEQ ID NO: 2681730 - RNA, 17 nt, Human
auuuuccaaauguaaua

SEQ ID NO: 2681731 - RNA, 16 nt, Human
auuuucaaguaauugu

SEQ ID NO: 2681732 - RNA, 12 nt, Human
auuuucaaguaa

SEQ ID NO: 2681733 - RNA, 19 nt, Human
auuuucaaguaauugugaa

SEQ ID NO: 2681734 - RNA, 15 nt, Human
auuuucacauucuug

SEQ ID NO: 2681735 - RNA, 19 nt, Human
auuuucacauucuuggcuu

SEQ ID NO: 2681736 - RNA, 20 nt, Human
auuuucacauucuuggcuua

SEQ ID NO: 2681737 - RNA, 22 nt, Human
auuuucacuuuuggcaaugacu

SEQ ID NO: 2681738 - RNA, 13 nt, Human
uuuucugacuaau

SEQ ID NO: 2681739 - RNA, 11 nt, Human
uuuucuggcac

SEQ ID NO: 2681740 - RNA, 23 nt, Human
uuuucuggggaaagacacugccu

SEQ ID NO: 2681741 - RNA, 13 nt, Human
uuuucaugaaaau

SEQ ID NO: 2681742 - RNA, 14 nt, Human
uuuuauuaaugcac

SEQ ID NO: 2681743 - RNA, 13 nt, Human
uuuuauuaaugca

SEQ ID NO: 2681744 - RNA, 19 nt, Human
uuuuauuaaugcacuuucu

SEQ ID NO: 2681745 - RNA, 16 nt, Human
uuuuauuuauauguau

SEQ ID NO: 2681746 - RNA, 14 nt, Human
uuuuauuuauaugu

SEQ ID NO: 2681747 - RNA, 17 nt, Human
uuuuauuuagggaacau

SEQ ID NO: 2681748 - RNA, 14 nt, Human
uuuucauaaacaag

SEQ ID NO: 2681749 - RNA, 23 nt, Human
uuuucauaaauuauuugauuauu

SEQ ID NO: 2681750 - RNA, 19 nt, Human
uuuucauaguauccauauu

SEQ ID NO: 2681751 - RNA, 20 nt, Human
uuuucauaguauccauauuu

SEQ ID NO: 2681752 - RNA, 21 nt, Human
uuuuauuucuacugucaaaug

SEQ ID NO: 2681753 - RNA, 22 nt, Human
auguuuaaaacaccuucuauag

SEQ ID NO: 2681754 - RNA, 20 nt, Human
auguuuauaaaucuuaugcu

SEQ ID NO: 2681755 - RNA, 20 nt, Human
auguuuauaucugcaaaaaa

SEQ ID NO: 2681756 - RNA, 23 nt, Human
auguuuauaucugcaaaaaaccu

SEQ ID NO: 2681757 - RNA, 12 nt, Human
uuuucuguauuu

SEQ ID NO: 2681758 - RNA, 23 nt, Human
uuuucugugugucaguuuucaua

SEQ ID NO: 2681759 - RNA, 21 nt, Human
auguuuaaaacaccuucuaua

SEQ ID NO: 2681760 - RNA, 16 nt, Human
auguuuaaaacaccuu

SEQ ID NO: 2681761 - RNA, 14 nt, Human
auguuuaaaacacc

SEQ ID NO: 2681762 - RNA, 12 nt, Human
auguuuaaaaca

SEQ ID NO: 2681763 - RNA, 16 nt, Human
auguuguuuauaauaa

SEQ ID NO: 2681764 - RNA, 17 nt, Human
auguuguuuauaauaaa

SEQ ID NO: 2681765 - RNA, 18 nt, Human
auguuguuuauaauaaaa

SEQ ID NO: 2681766 - RNA, 20 nt, Human
auguuguuuauaauaaaaau

SEQ ID NO: 2681767 - RNA, 22 nt, Human
auguuguuuauaauaaaaauau

SEQ ID NO: 2681768 - RNA, 16 nt, Human
auuaaaacuaaauuuc

SEQ ID NO: 2681769 - RNA, 17 nt, Human
auuaaaacuaaauuuca

SEQ ID NO: 2681770 - RNA, 12 nt, Human
auuaaacuuuuu

SEQ ID NO: 2681771 - RNA, 13 nt, Human
auuaaacuucaua

SEQ ID NO: 2681772 - RNA, 18 nt, Human
auuaaacuucauauguaa

SEQ ID NO: 2681773 - RNA, 15 nt, Human
auguuuuguaaacau

SEQ ID NO: 2681774 - RNA, 16 nt, Human
auguuuuguaaacauu

SEQ ID NO: 2681775 - RNA, 17 nt, Human
auguuuuguaaacauuu

SEQ ID NO: 2681776 - RNA, 19 nt, Human
auguuuuguaaacauuuau

SEQ ID NO: 2681777 - RNA, 20 nt, Human
auguguucucggagugugua

SEQ ID NO: 2681778 - RNA, 14 nt, Human
auguguguuuuuuc

SEQ ID NO: 2681779 - RNA, 11 nt, Human
auguguuuaga

SEQ ID NO: 2681780 - RNA, 12 nt, Human
auguguuuagaa

SEQ ID NO: 2681781 - RNA, 20 nt, Human
auguuaauggauuucagaag

SEQ ID NO: 2681782 - RNA, 14 nt, Human
auguuaccucugaa

SEQ ID NO: 2681783 - RNA, 15 nt, Human
auguuaccucugaau

SEQ ID NO: 2681784 - RNA, 17 nt, Human
auguuacucucuugcac

SEQ ID NO: 2681785 - RNA, 16 nt, Human
auguucagauuauugg

SEQ ID NO: 2681786 - RNA, 14 nt, Human
auguuagaguaaug

SEQ ID NO: 2681787 - RNA, 16 nt, Human
auguugccauguguuu

SEQ ID NO: 2681788 - RNA, 18 nt, Human
auguugccauguguuuua

SEQ ID NO: 2681789 - RNA, 13 nt, Human
uuuuagaauaaga

SEQ ID NO: 2681790 - RNA, 16 nt, Human
uuuuagaauaagaauu

SEQ ID NO: 2681791 - RNA, 17 nt, Human
uuuuagaauaagaauuu

SEQ ID NO: 2681792 - RNA, 20 nt, Human
uuuuagaauaagaauuugca

SEQ ID NO: 2681793 - RNA, 21 nt, Human
uuuuagaauaagaauuugcau

SEQ ID NO: 2681794 - RNA, 22 nt, Human
uuuuagaauaagaauuugcaua

SEQ ID NO: 2681795 - RNA, 18 nt, Human
auguggaccuuagaauac

SEQ ID NO: 2681796 - RNA, 16 nt, Human
auguggccuuugaauu

SEQ ID NO: 2681797 - RNA, 20 nt, Human
auguggccuuugaauucugu

SEQ ID NO: 2681798 - RNA, 22 nt, Human
auguggcccuggcugccggcac

SEQ ID NO: 2681799 - RNA, 13 nt, Human
auguggcuggaag

SEQ ID NO: 2681800 - RNA, 14 nt, Human
auguggcuggaaga

SEQ ID NO: 2681801 - RNA, 20 nt, Human
auguggcuggaagauccugc

SEQ ID NO: 2681802 - RNA, 20 nt, Human
uuuugcacauguuuccucua

SEQ ID NO: 2681803 - RNA, 19 nt, Human
uuuugcaaagauuuaaucu

SEQ ID NO: 2681804 - RNA, 17 nt, Human
uuuugcaaagauuuaau

SEQ ID NO: 2681805 - RNA, 21 nt, Human
uuuugcaaccaggaacagcaa

SEQ ID NO: 2681806 - RNA, 12 nt, Human
uuuugauuaugu

SEQ ID NO: 2681807 - RNA, 15 nt, Human
uuuugagacagucuu

SEQ ID NO: 2681808 - RNA, 22 nt, Human
uuuugauuauuuuuuuuuucuu

SEQ ID NO: 2681809 - RNA, 12 nt, Human
uuuugcaugaaa

SEQ ID NO: 2681810 - RNA, 19 nt, Human
uuuugcaugcaugcaaaug

SEQ ID NO: 2681811 - RNA, 21 nt, Human
uuuugcaugcaugcaaaugag

SEQ ID NO: 2681812 - RNA, 21 nt, Human
uuuugcacugaggauauucag

SEQ ID NO: 2681813 - RNA, 13 nt, Human
uuuugagcacuuu

SEQ ID NO: 2681814 - RNA, 14 nt, Human
uuuugagauguaaa

SEQ ID NO: 2681815 - RNA, 19 nt, Human
uuuugauagcauuguaagc

SEQ ID NO: 2681816 - RNA, 13 nt, Human
auuaaagacagag

SEQ ID NO: 2681817 - RNA, 22 nt, Human
auuaaagacaggagacaaaaga

SEQ ID NO: 2681818 - RNA, 14 nt, Human
auuaagcaaauguu

SEQ ID NO: 2681819 - RNA, 17 nt, Human
auuaagcaaauguuaaa

SEQ ID NO: 2681820 - RNA, 15 nt, Human
auuaaacuuccuucu

SEQ ID NO: 2681821 - RNA, 23 nt, Human
uuuuuaguauuuauuuauguacu

SEQ ID NO: 2681822 - RNA, 18 nt, Human
uuuuuauaaaauggcugu

SEQ ID NO: 2681823 - RNA, 13 nt, Human
uuuuuauaauugu

SEQ ID NO: 2681824 - RNA, 18 nt, Human
uuuuuauaauuguacaaa

SEQ ID NO: 2681825 - RNA, 23 nt, Human
uuuuuauaauuguacaaaauuaa

SEQ ID NO: 2681826 - RNA, 13 nt, Human
uuuuuauacaaaa

SEQ ID NO: 2681827 - RNA, 20 nt, Human
uuuuuauacaaaccuaccaa

SEQ ID NO: 2681828 - RNA, 13 nt, Human
uuuuuacuguguu

SEQ ID NO: 2681829 - RNA, 11 nt, Human
uuuuuacugug

SEQ ID NO: 2681830 - RNA, 18 nt, Human
uuuuuagaauaagaauuu

SEQ ID NO: 2681831 - RNA, 22 nt, Human
uuuuuagaauaagaauuugcau

SEQ ID NO: 2681832 - RNA, 23 nt, Human
uuuuuagaauaagaauuugcaua

SEQ ID NO: 2681833 - RNA, 18 nt, Human
uuuuuacuguguuuuaua

SEQ ID NO: 2681834 - RNA, 15 nt, Human
uuuuguuugguaaau

SEQ ID NO: 2681835 - RNA, 16 nt, Human
uuuuguuugguaaaug

SEQ ID NO: 2681836 - RNA, 15 nt, Human
uuuuguuugccagga

SEQ ID NO: 2681837 - RNA, 16 nt, Human
uuuuguuuuaaaacug

SEQ ID NO: 2681838 - RNA, 18 nt, Human
uuuuguuuggagacguuu

SEQ ID NO: 2681839 - RNA, 15 nt, Human
uuuugccuuuugcaa

SEQ ID NO: 2681840 - RNA, 15 nt, Human
uuuuguuauuaaaca

SEQ ID NO: 2681841 - RNA, 13 nt, Human
auuacccccuccu

SEQ ID NO: 2681842 - RNA, 19 nt, Human
auuacccccuccuucagac

SEQ ID NO: 2681843 - RNA, 18 nt, Human
auuacccccuccuucaga

SEQ ID NO: 2681844 - RNA, 16 nt, Human
auuacauguaauuuga

SEQ ID NO: 2681845 - RNA, 19 nt, Human
auuacauugcuuuuucuug

SEQ ID NO: 2681846 - RNA, 18 nt, Human
auuacauuuauuuaucca

SEQ ID NO: 2681847 - RNA, 16 nt, Human
uuuuuguuauuaaaca

SEQ ID NO: 2681848 - RNA, 21 nt, Human
uuuuuauuaaucacuguguau

SEQ ID NO: 2681849 - RNA, 19 nt, Human
uuuuuauuaaucacugugu

SEQ ID NO: 2681850 - RNA, 15 nt, Human
uuuuuauuaaucacu

SEQ ID NO: 2681851 - RNA, 14 nt, Human
uuuuuauuaaaaua

SEQ ID NO: 2681852 - RNA, 23 nt, Human
uuuuuauuaaaauauuucagguu

SEQ ID NO: 2681853 - RNA, 16 nt, Human
uuuuuguaaaugugua

SEQ ID NO: 2681854 - RNA, 20 nt, Human
uuuuuguaaauguguacaua

SEQ ID NO: 2681855 - RNA, 12 nt, Human
uuuuuguaauaa

SEQ ID NO: 2681856 - RNA, 22 nt, Human
uuuuuguaauaagcaaucaagg

SEQ ID NO: 2681857 - RNA, 12 nt, Human
uuuuuauuguug

SEQ ID NO: 2681858 - RNA, 16 nt, Human
uuuuuaugcuauuucu

SEQ ID NO: 2681859 - RNA, 21 nt, Human
auuacccccuccuucagacac

SEQ ID NO: 2681860 - RNA, 20 nt, Human
auuacccccuccuucagaca

SEQ ID NO: 2681861 - RNA, 17 nt, Human
auuacgaaguucaagau

SEQ ID NO: 2681862 - RNA, 22 nt, Human
auuacgaaguucaagaucaaaa

SEQ ID NO: 2681863 - RNA, 13 nt, Human
auuacgugcucug

SEQ ID NO: 2681864 - RNA, 21 nt, Human
auuaguauguauguguaccua

SEQ ID NO: 2681865 - RNA, 15 nt, Human
auuacuuccaugaau

SEQ ID NO: 2681866 - RNA, 16 nt, Human
auuacuuccaugaauu

SEQ ID NO: 2681867 - RNA, 17 nt, Human
auuacuuccaugaauuu

SEQ ID NO: 2681868 - RNA, 14 nt, Human
auuauaguguagaa

SEQ ID NO: 2681869 - RNA, 15 nt, Human
auuauaguguagaaa

SEQ ID NO: 2681870 - RNA, 16 nt, Human
auuauaguguagaaaa

SEQ ID NO: 2681871 - RNA, 19 nt, Human
auuauauaacuguauuuga

SEQ ID NO: 2681872 - RNA, 15 nt, Human
auuauauaacuguau

SEQ ID NO: 2681873 - RNA, 17 nt, Human
auuauauaacuguauuu

SEQ ID NO: 2681874 - RNA, 17 nt, Human
auuccagccccucuggu

SEQ ID NO: 2681875 - RNA, 12 nt, Human
auucagucacau

SEQ ID NO: 2681876 - RNA, 18 nt, Human
auucaguaacugucaggc

SEQ ID NO: 2681877 - RNA, 11 nt, Human
auucagacauc

SEQ ID NO: 2681878 - RNA, 15 nt, Human
auucagacaucugag

SEQ ID NO: 2681879 - RNA, 20 nt, Human
auucucccagguaccagcug

SEQ ID NO: 2681880 - RNA, 21 nt, Human
auucucccagguaccagcugc

SEQ ID NO: 2681881 - RNA, 22 nt, Human
auucucccagguaccagcugcg

SEQ ID NO: 2681882 - RNA, 13 nt, Human
auucuccacugug

SEQ ID NO: 2681883 - RNA, 24 nt, Human
auucucccagguaccagcugcgcu

SEQ ID NO: 2681884 - RNA, 11 nt, Human
auucuccugga

SEQ ID NO: 2681885 - RNA, 17 nt, Human
auucucaaaggagcgag

SEQ ID NO: 2681886 - RNA, 14 nt, Human
auucuaaauacaug

SEQ ID NO: 2681887 - RNA, 17 nt, Human
auucuaguuuugucaaa

SEQ ID NO: 2681888 - RNA, 13 nt, Human
auucuauaaaacu

SEQ ID NO: 2681889 - RNA, 14 nt, Human
auucuauaaaacuc

SEQ ID NO: 2681890 - RNA, 15 nt, Human
auucuauaaaacucu

SEQ ID NO: 2681891 - RNA, 24 nt, Human
auucuauaaaacucugcauguaga

SEQ ID NO: 2681892 - RNA, 18 nt, Human
cgguuucgaagucauuaa

SEQ ID NO: 2681893 - RNA, 13 nt, Human
cgguuuccaggga

SEQ ID NO: 2681894 - RNA, 16 nt, Human
cgguuuccagggaggg

SEQ ID NO: 2681895 - RNA, 20 nt, Human
cgguuuccagggaggggccg

SEQ ID NO: 2681896 - RNA, 22 nt, Human
cgguuucgaagucauuaaacug

SEQ ID NO: 2681897 - RNA, 16 nt, Human
cgguuuuacugcagcu

SEQ ID NO: 2681898 - RNA, 11 nt, Human
cgguuucucca

SEQ ID NO: 2681899 - RNA, 20 nt, Human
cguguaaccauggacccaau

SEQ ID NO: 2681900 - RNA, 11 nt, Human
cgggcucagca

SEQ ID NO: 2681901 - RNA, 14 nt, Human
cgggcgcgguggcu

SEQ ID NO: 2681902 - RNA, 16 nt, Human
cgggcgcgguggcuca

SEQ ID NO: 2681903 - RNA, 15 nt, Human
cgggcucagcaaaag

SEQ ID NO: 2681904 - RNA, 12 nt, Human
cggggaagagau

SEQ ID NO: 2681905 - RNA, 19 nt, Human
cggggaagagauccaaaga

SEQ ID NO: 2681906 - RNA, 20 nt, Human
cggggaagagauccaaagac

SEQ ID NO: 2681907 - RNA, 18 nt, Human
cgguguggagaagcggcu

SEQ ID NO: 2681908 - RNA, 13 nt, Human
cgguguggagaag

SEQ ID NO: 2681909 - RNA, 13 nt, Human
cggcucccagccu

SEQ ID NO: 2681910 - RNA, 19 nt, Human
cggcucccagccucagcgc

SEQ ID NO: 2681911 - RNA, 17 nt, Human
cggcucccagccucagc

SEQ ID NO: 2681912 - RNA, 15 nt, Human
cggcucccagccuca

SEQ ID NO: 2681913 - RNA, 14 nt, Human
cggcucccagccuc

SEQ ID NO: 2681914 - RNA, 16 nt, Human
cggaggcaaagcuggc

SEQ ID NO: 2681915 - RNA, 19 nt, Human
cggaggcaaagcuggcuca

SEQ ID NO: 2681916 - RNA, 22 nt, Human
cggaggcauccuacccuuuucu

SEQ ID NO: 2681917 - RNA, 20 nt, Human
cgccuguaaucccagcacuu

SEQ ID NO: 2681918 - RNA, 20 nt, Human
cgccuguaaucccagcuacu

SEQ ID NO: 2681919 - RNA, 14 nt, Human
cgcugccccaucuc

SEQ ID NO: 2681920 - RNA, 23 nt, Human
cgcugccccaucuccccucagcu

SEQ ID NO: 2681921 - RNA, 21 nt, Human
cgcugccccaucuccccucag

SEQ ID NO: 2681922 - RNA, 24 nt, Human
cgcugccccaucuccccucagcuc

SEQ ID NO: 2681923 - RNA, 14 nt, Human
cgcugccagccuug

SEQ ID NO: 2681924 - RNA, 21 nt, Human
cgcugccagccuugagcccug

SEQ ID NO: 2681925 - RNA, 23 nt, Human
cgcugccagccuugagcccuggc

SEQ ID NO: 2681926 - RNA, 18 nt, Human
cgcugcccaccugccggc

SEQ ID NO: 2681927 - RNA, 19 nt, Human
cgcugcccaccugccggcc

SEQ ID NO: 2681928 - RNA, 15 nt, Human
cgccugcugcaugcc

SEQ ID NO: 2681929 - RNA, 21 nt, Human
cgccuggcaguccgugggacg

SEQ ID NO: 2681930 - RNA, 13 nt, Human
cgccuggccagga

SEQ ID NO: 2681931 - RNA, 14 nt, Human
cgccuggccaggag

SEQ ID NO: 2681932 - RNA, 15 nt, Human
cgccuggccaggagc

SEQ ID NO: 2681933 - RNA, 16 nt, Human
cgccuggccaggagca

SEQ ID NO: 2681934 - RNA, 18 nt, Human
cgccuggccaggagcagg

SEQ ID NO: 2681935 - RNA, 16 nt, Human
cgccuccauccaaggc

SEQ ID NO: 2681936 - RNA, 18 nt, Human
cgccuccauccaaggcca

SEQ ID NO: 2681937 - RNA, 15 nt, Human
cgccucuuucaagca

SEQ ID NO: 2681938 - RNA, 15 nt, Human
cgccucuugaccagg

SEQ ID NO: 2681939 - RNA, 17 nt, Human
cgccucuugaccaggcu

SEQ ID NO: 2681940 - RNA, 12 nt, Human
cgccacucauuu

SEQ ID NO: 2681941 - RNA, 14 nt, Human
cgccacucauuuca

SEQ ID NO: 2681942 - RNA, 16 nt, Human
cgccacucauuucauc

SEQ ID NO: 2681943 - RNA, 17 nt, Human
cgccacucauuucaucu

SEQ ID NO: 2681944 - RNA, 19 nt, Human
cgccacucauuucaucuca

SEQ ID NO: 2681945 - RNA, 21 nt, Human
cgccacucauuucaucucauu

SEQ ID NO: 2681946 - RNA, 14 nt, Human
cgagucaaaguuga

SEQ ID NO: 2681947 - RNA, 21 nt, Human
cgaucacaaaugacuuuauua

SEQ ID NO: 2681948 - RNA, 19 nt, Human
cgaucacaaaugacuuuau

SEQ ID NO: 2681949 - RNA, 18 nt, Human
cgaucacaaaugacuuua

SEQ ID NO: 2681950 - RNA, 17 nt, Human
cgaucacaaaugacuuu

SEQ ID NO: 2681951 - RNA, 15 nt, Human
cgaucacaaaugacu

SEQ ID NO: 2681952 - RNA, 14 nt, Human
cgaucacaaaugac

SEQ ID NO: 2681953 - RNA, 23 nt, Human
cgacucugugccucccuccccag

SEQ ID NO: 2681954 - RNA, 17 nt, Human
cgacugaaaauauuguu

SEQ ID NO: 2681955 - RNA, 16 nt, Human
cgacuccguuggccac

SEQ ID NO: 2681956 - RNA, 19 nt, Human
cgacuccguuggccacucc

SEQ ID NO: 2681957 - RNA, 12 nt, Human
cgacuauagaaa

SEQ ID NO: 2681958 - RNA, 10 nt, Human
cgacuccagc

SEQ ID NO: 2681959 - RNA, 11 nt, Human
cgacuccagcc

SEQ ID NO: 2681960 - RNA, 12 nt, Human
cgacuccagcca

SEQ ID NO: 2681961 - RNA, 13 nt, Human
cgacuccagccag

SEQ ID NO: 2681962 - RNA, 14 nt, Human
cgacuccagccagc

SEQ ID NO: 2681963 - RNA, 15 nt, Human
cgacuccagccagcg

SEQ ID NO: 2681964 - RNA, 16 nt, Human
cgacuccagccagcgc

SEQ ID NO: 2681965 - RNA, 17 nt, Human
cgacuccagccagcgcc

SEQ ID NO: 2681966 - RNA, 18 nt, Human
cgacuccagccagcgccu

SEQ ID NO: 2681967 - RNA, 20 nt, Human
cgacuccagccagcgccucc

SEQ ID NO: 2681968 - RNA, 21 nt, Human
cgacuccagccagcgccuccc

SEQ ID NO: 2681969 - RNA, 15 nt, Human
cgacuaaacuagauu

SEQ ID NO: 2681970 - RNA, 14 nt, Human
cgacgcccacccaa

SEQ ID NO: 2681971 - RNA, 21 nt, Human
cgacuaaacuagauuuucacu

SEQ ID NO: 2681972 - RNA, 19 nt, Human
cgaccccccgugggcuccc

SEQ ID NO: 2681973 - RNA, 12 nt, Human
cgacccuggggg

SEQ ID NO: 2681974 - RNA, 17 nt, Human
cgacccugggggcacag

SEQ ID NO: 2681975 - RNA, 19 nt, Human
cgacccugggggcacagga

SEQ ID NO: 2681976 - RNA, 23 nt, Human
cgacccugggggcacaggaggca

SEQ ID NO: 2681977 - RNA, 12 nt, Human
cgacgcccaccc

SEQ ID NO: 2681978 - RNA, 18 nt, Human
cgacugaaaauauuguuu

SEQ ID NO: 2681979 - RNA, 17 nt, Human
cgacugcccggcagggu

SEQ ID NO: 2681980 - RNA, 16 nt, Human
cgaccccccgugggcu

SEQ ID NO: 2681981 - RNA, 18 nt, Human
cgaccccccgugggcucc

SEQ ID NO: 2681982 - RNA, 17 nt, Human
cgaauuuuucagaugau

SEQ ID NO: 2681983 - RNA, 18 nt, Human
cgacacggucucggauca

SEQ ID NO: 2681984 - RNA, 20 nt, Human
cgaauuucugugcccuccug

SEQ ID NO: 2681985 - RNA, 16 nt, Human
cgaauuucugugcccu

SEQ ID NO: 2681986 - RNA, 12 nt, Human
ccuuuuuauuua

SEQ ID NO: 2681987 - RNA, 13 nt, Human
ccuuuuuauuuau

SEQ ID NO: 2681988 - RNA, 22 nt, Human
ccuuuuuauuuauauguaugug

SEQ ID NO: 2681989 - RNA, 20 nt, Human
ccuuuuuauuuauauguaug

SEQ ID NO: 2681990 - RNA, 18 nt, Human
ccuuuuuauuuauaugua

SEQ ID NO: 2681991 - RNA, 16 nt, Human
ccuuuuuauuuauaug

SEQ ID NO: 2681992 - RNA, 13 nt, Human
ccuuuuugacacu

SEQ ID NO: 2681993 - RNA, 14 nt, Human
ccuuuuugacacug

SEQ ID NO: 2681994 - RNA, 15 nt, Human
ccuuuuugacacuga

SEQ ID NO: 2681995 - RNA, 16 nt, Human
ccuuuuugacacugaa

SEQ ID NO: 2681996 - RNA, 19 nt, Human
ccuuuuucauaaauuauuu

SEQ ID NO: 2681997 - RNA, 18 nt, Human
ccuuuaauuguaaaguaa

SEQ ID NO: 2681998 - RNA, 20 nt, Human
ccuuuagaaacucaaaaacu

SEQ ID NO: 2681999 - RNA, 11 nt, Human
ccuuuuuaagg

SEQ ID NO: 2682000 - RNA, 12 nt, Human
ccuugcuggccc

SEQ ID NO: 2682001 - RNA, 13 nt, Human
ccuugcuggcccc

SEQ ID NO: 2682002 - RNA, 14 nt, Human
ccuugcuggcccca

SEQ ID NO: 2682003 - RNA, 15 nt, Human
ccuugcuggccccag

SEQ ID NO: 2682004 - RNA, 16 nt, Human
ccuugcuggccccagc

SEQ ID NO: 2682005 - RNA, 17 nt, Human
ccuugcuggccccagcc

SEQ ID NO: 2682006 - RNA, 19 nt, Human
ccuugcuggccccagcccu

SEQ ID NO: 2682007 - RNA, 20 nt, Human
ccuugcuggccccagcccug

SEQ ID NO: 2682008 - RNA, 21 nt, Human
ccuugcuggccccagcccugc

SEQ ID NO: 2682009 - RNA, 22 nt, Human
ccuugcuggccccagcccugcu

SEQ ID NO: 2682010 - RNA, 16 nt, Human
ccuugcuugccugcag

SEQ ID NO: 2682011 - RNA, 18 nt, Human
ccuugcuugccugcaggg

SEQ ID NO: 2682012 - RNA, 21 nt, Human
ccuugcuugccugcagggcca

SEQ ID NO: 2682013 - RNA, 19 nt, Human
ccuugcuguuuguccugag

SEQ ID NO: 2682014 - RNA, 21 nt, Human
ccuugcuguuuguccugagau

SEQ ID NO: 2682015 - RNA, 11 nt, Human
cuauuaauaua

SEQ ID NO: 2682016 - RNA, 15 nt, Human
cuauuaauauaugua

SEQ ID NO: 2682017 - RNA, 14 nt, Human
cuauuaauauaugu

SEQ ID NO: 2682018 - RNA, 12 nt, Human
cuauuaauauau

SEQ ID NO: 2682019 - RNA, 17 nt, Human
cuauuaauauauguauu

SEQ ID NO: 2682020 - RNA, 14 nt, Human
cuauuuuuguaaag

SEQ ID NO: 2682021 - RNA, 19 nt, Human
cuauuuuuguaaaguuucc

SEQ ID NO: 2682022 - RNA, 21 nt, Human
cuauuaauauauguauuauuu

SEQ ID NO: 2682023 - RNA, 18 nt, Human
cucaaaagcugggcaggu

SEQ ID NO: 2682024 - RNA, 18 nt, Human
cucaaaauaaagaaguau

SEQ ID NO: 2682025 - RNA, 16 nt, Human
cucaauagaucuccag

SEQ ID NO: 2682026 - RNA, 20 nt, Human
cucaauaaagugcuuuaaaa

SEQ ID NO: 2682027 - RNA, 22 nt, Human
cucaaugcaguuagcugaagaa

SEQ ID NO: 2682028 - RNA, 15 nt, Human
cucaaugcuuuauuu

SEQ ID NO: 2682029 - RNA, 17 nt, Human
cucaaugcuuuauuugu

SEQ ID NO: 2682030 - RNA, 19 nt, Human
cucaaugcuuuauuuguaa

SEQ ID NO: 2682031 - RNA, 20 nt, Human
cucaaugcuuuauuuguaaa

SEQ ID NO: 2682032 - RNA, 18 nt, Human
cuaguuugggaggagcag

SEQ ID NO: 2682033 - RNA, 18 nt, Human
cuaguuugugagaaacau

SEQ ID NO: 2682034 - RNA, 20 nt, Human
cuaguuugugagaaacaucu

SEQ ID NO: 2682035 - RNA, 18 nt, Human
cuaucuaguucuaacagu

SEQ ID NO: 2682036 - RNA, 13 nt, Human
cuaucuauuugag

SEQ ID NO: 2682037 - RNA, 14 nt, Human
cuaucuauuugagg

SEQ ID NO: 2682038 - RNA, 21 nt, Human
cuacagugguuuuauacugaa

SEQ ID NO: 2682039 - RNA, 22 nt, Human
cuacaguugaaaaacagcugag

SEQ ID NO: 2682040 - RNA, 21 nt, Human
cuacaguugaaaaacagcuga

SEQ ID NO: 2682041 - RNA, 19 nt, Human
cuacaguugaaaaacagcu

SEQ ID NO: 2682042 - RNA, 14 nt, Human
cuaauuucuccucc

SEQ ID NO: 2682043 - RNA, 15 nt, Human
cuaauuucuccuccc

SEQ ID NO: 2682044 - RNA, 14 nt, Human
cuacagugguuuua

SEQ ID NO: 2682045 - RNA, 16 nt, Human
cuacagugguuuuaua

SEQ ID NO: 2682046 - RNA, 16 nt, Human
cuacauaucccuucca

SEQ ID NO: 2682047 - RNA, 17 nt, Human
cuacauaucccuuccag

SEQ ID NO: 2682048 - RNA, 18 nt, Human
cuacauaucccuuccaga

SEQ ID NO: 2682049 - RNA, 19 nt, Human
cuacauaucccuuccagau

SEQ ID NO: 2682050 - RNA, 21 nt, Human
cuacauaucccuuccagaugg

SEQ ID NO: 2682051 - RNA, 14 nt, Human
cuacaugcuggggu

SEQ ID NO: 2682052 - RNA, 15 nt, Human
cuacaugcugggguc

SEQ ID NO: 2682053 - RNA, 12 nt, Human
cuaccugcccuc

SEQ ID NO: 2682054 - RNA, 14 nt, Human
cuaccugcccucaa

SEQ ID NO: 2682055 - RNA, 16 nt, Human
cuaccugcccucaagg

SEQ ID NO: 2682056 - RNA, 20 nt, Human
cuaccuguauuuaaaaauag

SEQ ID NO: 2682057 - RNA, 21 nt, Human
cuaccuguauuuaaaaauaga

SEQ ID NO: 2682058 - RNA, 23 nt, Human
cuaccuguauuuaaaaauagaaa

SEQ ID NO: 2682059 - RNA, 22 nt, Human
cgugugugugugugugugugca

SEQ ID NO: 2682060 - RNA, 20 nt, Human
cuaagugggcauugccaugu

SEQ ID NO: 2682061 - RNA, 23 nt, Human
cuaagugggcauugccaugugga

SEQ ID NO: 2682062 - RNA, 22 nt, Human
cuaauugcugugugucccaggc

SEQ ID NO: 2682063 - RNA, 14 nt, Human
cuaauucuaaugug

SEQ ID NO: 2682064 - RNA, 22 nt, Human
cuagaacacuaacucaccagcc

SEQ ID NO: 2682065 - RNA, 19 nt, Human
cuagaacacuaacucacca

SEQ ID NO: 2682066 - RNA, 20 nt, Human
cuagaacacuaacucaccag

SEQ ID NO: 2682067 - RNA, 12 nt, Human
cuagaagccaag

SEQ ID NO: 2682068 - RNA, 13 nt, Human
cuagaagccaagg

SEQ ID NO: 2682069 - RNA, 16 nt, Human
cuagaagccaagggaa

SEQ ID NO: 2682070 - RNA, 20 nt, Human
cuagaagccaagggaaaggg

SEQ ID NO: 2682071 - RNA, 21 nt, Human
cuagaagccaagggaaagggg

SEQ ID NO: 2682072 - RNA, 22 nt, Human
cucuaaaagguaauguguggau

SEQ ID NO: 2682073 - RNA, 14 nt, Human
cucuaaagagcauc

SEQ ID NO: 2682074 - RNA, 13 nt, Human
cucucaccucagc

SEQ ID NO: 2682075 - RNA, 19 nt, Human
cucucacacugguucucaa

SEQ ID NO: 2682076 - RNA, 20 nt, Human
cucucacacugguucucaau

SEQ ID NO: 2682077 - RNA, 22 nt, Human
cucucacacugguucucaauga

SEQ ID NO: 2682078 - RNA, 14 nt, Human
cucguguguuucua

SEQ ID NO: 2682079 - RNA, 18 nt, Human
cuccuggcccacugcauc

SEQ ID NO: 2682080 - RNA, 16 nt, Human
cuccuggcccacugca

SEQ ID NO: 2682081 - RNA, 20 nt, Human
cuccuaacugccagcccccu

SEQ ID NO: 2682082 - RNA, 21 nt, Human
cuccucuccuacucggcucug

SEQ ID NO: 2682083 - RNA, 19 nt, Human
cuccuacauaucccuucca

SEQ ID NO: 2682084 - RNA, 20 nt, Human
cuccuacauaucccuuccag

SEQ ID NO: 2682085 - RNA, 21 nt, Human
cuccuacauaucccuuccaga

SEQ ID NO: 2682086 - RNA, 22 nt, Human
cuccguuagcuccuguggcccc

SEQ ID NO: 2682087 - RNA, 12 nt, Human
cuccguuggcca

SEQ ID NO: 2682088 - RNA, 20 nt, Human
cuccguuggccacuccgaga

SEQ ID NO: 2682089 - RNA, 17 nt, Human
cuccguuagcuccugug

SEQ ID NO: 2682090 - RNA, 18 nt, Human
cuccguuagcuccugugg

SEQ ID NO: 2682091 - RNA, 21 nt, Human
cuccguuagcuccuguggccc

SEQ ID NO: 2682092 - RNA, 22 nt, Human
cucccccaguuccucccaggaa

SEQ ID NO: 2682093 - RNA, 22 nt, Human
cucccccagccaugccagcugg

SEQ ID NO: 2682094 - RNA, 13 nt, Human
cuccacugugcac

SEQ ID NO: 2682095 - RNA, 16 nt, Human
cuccacugugcacacc

SEQ ID NO: 2682096 - RNA, 17 nt, Human
cuccccauggagccagc

SEQ ID NO: 2682097 - RNA, 12 nt, Human
cuccccauggag

SEQ ID NO: 2682098 - RNA, 17 nt, Human
cuccccauuucccaucu

SEQ ID NO: 2682099 - RNA, 18 nt, Human
cuccccauuucccaucug

SEQ ID NO: 2682100 - RNA, 19 nt, Human
cuccccauuucccaucugc

SEQ ID NO: 2682101 - RNA, 22 nt, Human
cuccccauuucccaucugcacc

SEQ ID NO: 2682102 - RNA, 20 nt, Human
cuccccauuucccaucugca

SEQ ID NO: 2682103 - RNA, 21 nt, Human
cuccccauuucccaucugcac

SEQ ID NO: 2682104 - RNA, 11 nt, Human
cucccaccccc

SEQ ID NO: 2682105 - RNA, 13 nt, Human
cucccacccccag

SEQ ID NO: 2682106 - RNA, 14 nt, Human
cucccacccccagc

SEQ ID NO: 2682107 - RNA, 15 nt, Human
cucccacccccagcc

SEQ ID NO: 2682108 - RNA, 16 nt, Human
cucccacccccagccc

SEQ ID NO: 2682109 - RNA, 21 nt, Human
cuccaggggcugcuuccuccu

SEQ ID NO: 2682110 - RNA, 14 nt, Human
cuccaggggcugcu

SEQ ID NO: 2682111 - RNA, 15 nt, Human
cuccaggggcugcuu

SEQ ID NO: 2682112 - RNA, 18 nt, Human
cuccaggggcugcuuccu

SEQ ID NO: 2682113 - RNA, 12 nt, Human
cucaguaaacgg

SEQ ID NO: 2682114 - RNA, 20 nt, Human
cucaguaaacgggaacaugc

SEQ ID NO: 2682115 - RNA, 21 nt, Human
cucaguaaacgggaacaugcc

SEQ ID NO: 2682116 - RNA, 13 nt, Human
cucaugcccaccc

SEQ ID NO: 2682117 - RNA, 16 nt, Human
cucaugcccacccccu

SEQ ID NO: 2682118 - RNA, 17 nt, Human
cucaugcccacccccug

SEQ ID NO: 2682119 - RNA, 19 nt, Human
cucaugcccacccccugcc

SEQ ID NO: 2682120 - RNA, 20 nt, Human
cucaugcccacccccugccc

SEQ ID NO: 2682121 - RNA, 21 nt, Human
cucaugcccacccccugcccu

SEQ ID NO: 2682122 - RNA, 22 nt, Human
cucaugcccacccccugcccug

SEQ ID NO: 2682123 - RNA, 23 nt, Human
cucaugcccacccccugcccugc

SEQ ID NO: 2682124 - RNA, 13 nt, Human
cucaucugcuggu

SEQ ID NO: 2682125 - RNA, 17 nt, Human
cucaucuggaguucuca

SEQ ID NO: 2682126 - RNA, 21 nt, Human
cucaucuggaguucucaaaga

SEQ ID NO: 2682127 - RNA, 14 nt, Human
cucaucugcugguc

SEQ ID NO: 2682128 - RNA, 15 nt, Human
cucaucugcuggucc

SEQ ID NO: 2682129 - RNA, 16 nt, Human
cucaucugcugguccg

SEQ ID NO: 2682130 - RNA, 20 nt, Human
cucaucugcugguccguggg

SEQ ID NO: 2682131 - RNA, 15 nt, Human
cuccaagccccaucu

SEQ ID NO: 2682132 - RNA, 17 nt, Human
cuccaagccccaucuuc

SEQ ID NO: 2682133 - RNA, 18 nt, Human
cuccaagccccaucuucu

SEQ ID NO: 2682134 - RNA, 16 nt, Human
cucaugugugcaacag

SEQ ID NO: 2682135 - RNA, 12 nt, Human
cucauguggcug

SEQ ID NO: 2682136 - RNA, 13 nt, Human
cucauguggcugg

SEQ ID NO: 2682137 - RNA, 14 nt, Human
cucauguggcugga

SEQ ID NO: 2682138 - RNA, 15 nt, Human
cucauguggcuggaa

SEQ ID NO: 2682139 - RNA, 12 nt, Human
cugaggugggag

SEQ ID NO: 2682140 - RNA, 15 nt, Human
cugagcuuucugcua

SEQ ID NO: 2682141 - RNA, 14 nt, Human
cugagcuuucugcu

SEQ ID NO: 2682142 - RNA, 19 nt, Human
cugagaucgugcuacugca

SEQ ID NO: 2682143 - RNA, 21 nt, Human
cugagaucaaaacgguuuuac

SEQ ID NO: 2682144 - RNA, 21 nt, Human
cugaguauuaauaucugagga

SEQ ID NO: 2682145 - RNA, 15 nt, Human
cugagauggaaaagu

SEQ ID NO: 2682146 - RNA, 23 nt, Human
cugaccuggcaucuaauucugau

SEQ ID NO: 2682147 - RNA, 16 nt, Human
cugacccauugcuguu

SEQ ID NO: 2682148 - RNA, 14 nt, Human
cugacccauugcug

SEQ ID NO: 2682149 - RNA, 12 nt, Human
cugagacugugc

SEQ ID NO: 2682150 - RNA, 15 nt, Human
cugagacugugcugu

SEQ ID NO: 2682151 - RNA, 21 nt, Human
cugagacuuucagugcacugu

SEQ ID NO: 2682152 - RNA, 12 nt, Human
cugagagccagg

SEQ ID NO: 2682153 - RNA, 17 nt, Human
cugagaggcaggcauag

SEQ ID NO: 2682154 - RNA, 14 nt, Human
cugagaggcaggca

SEQ ID NO: 2682155 - RNA, 15 nt, Human
cugagaggcaggcau

SEQ ID NO: 2682156 - RNA, 12 nt, Human
cugagaggcagg

SEQ ID NO: 2682157 - RNA, 13 nt, Human
cugagaggcaggc

SEQ ID NO: 2682158 - RNA, 22 nt, Human
cugacaaggcacuucauguaaa

SEQ ID NO: 2682159 - RNA, 23 nt, Human
cugacaaggcacuucauguaaag

SEQ ID NO: 2682160 - RNA, 18 nt, Human
cucuuagauucuuaauuc

SEQ ID NO: 2682161 - RNA, 14 nt, Human
cucuucagaugcca

SEQ ID NO: 2682162 - RNA, 20 nt, Human
cucuucagaugccacuucua

SEQ ID NO: 2682163 - RNA, 21 nt, Human
cucuucagaugccacuucuaa

SEQ ID NO: 2682164 - RNA, 21 nt, Human
cucuggguccuuccugaaacu

SEQ ID NO: 2682165 - RNA, 18 nt, Human
cucuggguccuuccugaa

SEQ ID NO: 2682166 - RNA, 17 nt, Human
cucuggguccuuccuga

SEQ ID NO: 2682167 - RNA, 16 nt, Human
cucuggguccuuccug

SEQ ID NO: 2682168 - RNA, 15 nt, Human
cucuggguccuuccu

SEQ ID NO: 2682169 - RNA, 13 nt, Human
cucugcuccccag

SEQ ID NO: 2682170 - RNA, 13 nt, Human
cucugucaggccu

SEQ ID NO: 2682171 - RNA, 14 nt, Human
cucugucaggccuu

SEQ ID NO: 2682172 - RNA, 20 nt, Human
cucuggucgcuccugcccac

SEQ ID NO: 2682173 - RNA, 17 nt, Human
cucuggucgcuccugcc

SEQ ID NO: 2682174 - RNA, 18 nt, Human
cucuggucgcuccugccc

SEQ ID NO: 2682175 - RNA, 16 nt, Human
cucuggucgcuccugc

SEQ ID NO: 2682176 - RNA, 21 nt, Human
cugaaaauuggacagauugcc

SEQ ID NO: 2682177 - RNA, 23 nt, Human
cugaaaauuggacagauugccug

SEQ ID NO: 2682178 - RNA, 20 nt, Human
cugaaacuauauuuugucau

SEQ ID NO: 2682179 - RNA, 12 nt, Human
cugaaacuauau

SEQ ID NO: 2682180 - RNA, 14 nt, Human
cugaauuuuuuugu

SEQ ID NO: 2682181 - RNA, 15 nt, Human
cugaauuuuuuugua

SEQ ID NO: 2682182 - RNA, 16 nt, Human
cugaauuuuuuuguaa

SEQ ID NO: 2682183 - RNA, 17 nt, Human
cugaauuuuuuuguaau

SEQ ID NO: 2682184 - RNA, 18 nt, Human
cugaauuuuuuuguaaua

SEQ ID NO: 2682185 - RNA, 19 nt, Human
cugaauuuuuuuguaauaa

SEQ ID NO: 2682186 - RNA, 20 nt, Human
cugaauuuuuuuguaauaag

SEQ ID NO: 2682187 - RNA, 23 nt, Human
cugaauuuuuuuguaauaagcaa

SEQ ID NO: 2682188 - RNA, 16 nt, Human
ccugugacugucucac

SEQ ID NO: 2682189 - RNA, 22 nt, Human
ccugugacauggugccugagag

SEQ ID NO: 2682190 - RNA, 23 nt, Human
ccugugacauggugccugagagg

SEQ ID NO: 2682191 - RNA, 16 nt, Human
ccugugaaugccacug

SEQ ID NO: 2682192 - RNA, 17 nt, Human
ccugugaaugccacugc

SEQ ID NO: 2682193 - RNA, 19 nt, Human
ccugugaaugccacugccu

SEQ ID NO: 2682194 - RNA, 21 nt, Human
ccugugaaugccacugccuuc

SEQ ID NO: 2682195 - RNA, 22 nt, Human
ccugugaaugccacugccuucg

SEQ ID NO: 2682196 - RNA, 17 nt, Human
ccugugacauggugccu

SEQ ID NO: 2682197 - RNA, 18 nt, Human
ccugugacauggugccug

SEQ ID NO: 2682198 - RNA, 19 nt, Human
ccugugacauggugccuga

SEQ ID NO: 2682199 - RNA, 21 nt, Human
ccugugacauggugccugaga

SEQ ID NO: 2682200 - RNA, 15 nt, Human
ccuguaaucccagca

SEQ ID NO: 2682201 - RNA, 16 nt, Human
ccuguaaucccagcac

SEQ ID NO: 2682202 - RNA, 18 nt, Human
ccuguaacuugagaguag

SEQ ID NO: 2682203 - RNA, 16 nt, Human
ccugguuguguguccc

SEQ ID NO: 2682204 - RNA, 16 nt, Human
ccugggccgcugccac

SEQ ID NO: 2682205 - RNA, 17 nt, Human
ccugggccgcugccacg

SEQ ID NO: 2682206 - RNA, 22 nt, Human
ccugggccguaucuccggcucc

SEQ ID NO: 2682207 - RNA, 20 nt, Human
ccugggccguaucuccggcu

SEQ ID NO: 2682208 - RNA, 13 nt, Human
ccugggccgcugc

SEQ ID NO: 2682209 - RNA, 14 nt, Human
ccugggcccugggc

SEQ ID NO: 2682210 - RNA, 15 nt, Human
ccugggcccugggcu

SEQ ID NO: 2682211 - RNA, 16 nt, Human
ccugggcccugggcug

SEQ ID NO: 2682212 - RNA, 18 nt, Human
ccugggcccugggcugga

SEQ ID NO: 2682213 - RNA, 19 nt, Human
ccugggcccugggcuggaa

SEQ ID NO: 2682214 - RNA, 15 nt, Human
ccugggggcacagga

SEQ ID NO: 2682215 - RNA, 18 nt, Human
ccugggggcacaggaggc

SEQ ID NO: 2682216 - RNA, 23 nt, Human
ccugggggcacaggaggcaggca

SEQ ID NO: 2682217 - RNA, 17 nt, Human
ccugggggccuggguug

SEQ ID NO: 2682218 - RNA, 14 nt, Human
ccugggccccagcu

SEQ ID NO: 2682219 - RNA, 21 nt, Human
ccuggccuauccgcugccagc

SEQ ID NO: 2682220 - RNA, 23 nt, Human
ccuggccuauccgcugccagccu

SEQ ID NO: 2682221 - RNA, 13 nt, Human
ccuggccucugug

SEQ ID NO: 2682222 - RNA, 17 nt, Human
ccuggccgcgcuccggg

SEQ ID NO: 2682223 - RNA, 19 nt, Human
ccuggccgcggagccugca

SEQ ID NO: 2682224 - RNA, 21 nt, Human
ccugcagaugccacccuagcc

SEQ ID NO: 2682225 - RNA, 15 nt, Human
ccucuuucccuagga

SEQ ID NO: 2682226 - RNA, 20 nt, Human
ccugaccagcugcuccgagg

SEQ ID NO: 2682227 - RNA, 21 nt, Human
ccugaccagcugcuccgagga

SEQ ID NO: 2682228 - RNA, 22 nt, Human
ccugaccagcugcuccgaggac

SEQ ID NO: 2682229 - RNA, 14 nt, Human
ccugaccagcugcu

SEQ ID NO: 2682230 - RNA, 15 nt, Human
ccugaccagcugcuc

SEQ ID NO: 2682231 - RNA, 13 nt, Human
ccugcagaugcca

SEQ ID NO: 2682232 - RNA, 14 nt, Human
ccugcagaugccac

SEQ ID NO: 2682233 - RNA, 15 nt, Human
ccugcagaugccacc

SEQ ID NO: 2682234 - RNA, 20 nt, Human
ccugcagaugccacccuagc

SEQ ID NO: 2682235 - RNA, 20 nt, Human
ccugccucccacuucacugc

SEQ ID NO: 2682236 - RNA, 14 nt, Human
ccugcugcgcaguu

SEQ ID NO: 2682237 - RNA, 20 nt, Human
ccugccccaaucccuuuauu

SEQ ID NO: 2682238 - RNA, 13 nt, Human
ccugcccagacaa

SEQ ID NO: 2682239 - RNA, 15 nt, Human
ccugcccagacaaga

SEQ ID NO: 2682240 - RNA, 18 nt, Human
ccugcccagcccccuggu

SEQ ID NO: 2682241 - RNA, 23 nt, Human
ccucuuuaguuuuugguugggaa

SEQ ID NO: 2682242 - RNA, 23 nt, Human
ccucuuucaagcagucgugccug

SEQ ID NO: 2682243 - RNA, 22 nt, Human
ccucauggcagccuacucuccu

SEQ ID NO: 2682244 - RNA, 20 nt, Human
ccucaaagcuuggauuaaau

SEQ ID NO: 2682245 - RNA, 24 nt, Human
ccucaaagcuuggauuaaauacau

SEQ ID NO: 2682246 - RNA, 20 nt, Human
ccuccccaaaucaauacacu

SEQ ID NO: 2682247 - RNA, 19 nt, Human
ccuccaaauggagaagcug

SEQ ID NO: 2682248 - RNA, 20 nt, Human
ccuccaaauggagaagcugc

SEQ ID NO: 2682249 - RNA, 21 nt, Human
ccuccaaauggagaagcugca

SEQ ID NO: 2682250 - RNA, 22 nt, Human
ccuccaaauggagaagcugcag

SEQ ID NO: 2682251 - RNA, 23 nt, Human
ccuccaaauggagaagcugcagg

SEQ ID NO: 2682252 - RNA, 13 nt, Human
ccucccaccccca

SEQ ID NO: 2682253 - RNA, 14 nt, Human
ccucccacccccag

SEQ ID NO: 2682254 - RNA, 15 nt, Human
ccucccacccccagc

SEQ ID NO: 2682255 - RNA, 16 nt, Human
ccucccacccccagcc

SEQ ID NO: 2682256 - RNA, 12 nt, Human
ccuccaacccug

SEQ ID NO: 2682257 - RNA, 13 nt, Human
ccuccaacccugc

SEQ ID NO: 2682258 - RNA, 14 nt, Human
ccuccaacccugcc

SEQ ID NO: 2682259 - RNA, 15 nt, Human
ccuccaacccugccg

SEQ ID NO: 2682260 - RNA, 18 nt, Human
ccuccaacccugccguca

SEQ ID NO: 2682261 - RNA, 17 nt, Human
cccugugacauggugcc

SEQ ID NO: 2682262 - RNA, 18 nt, Human
cccugugacauggugccu

SEQ ID NO: 2682263 - RNA, 23 nt, Human
cccugucucaaaaaaagaaaaag

SEQ ID NO: 2682264 - RNA, 20 nt, Human
cccugucucaaaaaaagaaa

SEQ ID NO: 2682265 - RNA, 18 nt, Human
ccgcaguguggccaggcu

SEQ ID NO: 2682266 - RNA, 14 nt, Human
ccgcaucucacagc

SEQ ID NO: 2682267 - RNA, 14 nt, Human
ccgcagcccuggca

SEQ ID NO: 2682268 - RNA, 21 nt, Human
cccuuccuuuucccugcuucc

SEQ ID NO: 2682269 - RNA, 22 nt, Human
cccuuccuuuucccugcuucca

SEQ ID NO: 2682270 - RNA, 19 nt, Human
cccugugacauggugccug

SEQ ID NO: 2682271 - RNA, 20 nt, Human
cccugugacauggugccuga

SEQ ID NO: 2682272 - RNA, 19 nt, Human
cccuuccuuuucccugcuu

SEQ ID NO: 2682273 - RNA, 14 nt, Human
ccggcccccugccc

SEQ ID NO: 2682274 - RNA, 14 nt, Human
ccagcagccuggac

SEQ ID NO: 2682275 - RNA, 15 nt, Human
ccagcagccuggacc

SEQ ID NO: 2682276 - RNA, 20 nt, Human
ccagcagccuggacccugug

SEQ ID NO: 2682277 - RNA, 19 nt, Human
ccagcagccuggacccugu

SEQ ID NO: 2682278 - RNA, 16 nt, Human
ccagcuuaucucaggg

SEQ ID NO: 2682279 - RNA, 13 nt, Human
ccacucugcuucu

SEQ ID NO: 2682280 - RNA, 14 nt, Human
ccacucugcuucuc

SEQ ID NO: 2682281 - RNA, 17 nt, Human
ccacucugcuucucuga

SEQ ID NO: 2682282 - RNA, 19 nt, Human
ccacucugcuucucugacu

SEQ ID NO: 2682283 - RNA, 20 nt, Human
ccacucugcuucucugacuu

SEQ ID NO: 2682284 - RNA, 21 nt, Human
ccaggaguguggccacguggg

SEQ ID NO: 2682285 - RNA, 20 nt, Human
ccaggggcugcuuccuccug

SEQ ID NO: 2682286 - RNA, 21 nt, Human
ccaggggcugcuuccuccugg

SEQ ID NO: 2682287 - RNA, 22 nt, Human
ccaggggcugcuuccuccugga

SEQ ID NO: 2682288 - RNA, 23 nt, Human
ccaggggcugcuuccuccuggaa

SEQ ID NO: 2682289 - RNA, 15 nt, Human
ccaguccccaccccu

SEQ ID NO: 2682290 - RNA, 16 nt, Human
ccaguccccaccccug

SEQ ID NO: 2682291 - RNA, 17 nt, Human
ccaguccccaccccugc

SEQ ID NO: 2682292 - RNA, 18 nt, Human
ccaguccccaccccugcc

SEQ ID NO: 2682293 - RNA, 19 nt, Human
ccaguccccaccccugccc

SEQ ID NO: 2682294 - RNA, 21 nt, Human
ccaguccccaccccugccccc

SEQ ID NO: 2682295 - RNA, 22 nt, Human
ccaguccccaccccugccccca

SEQ ID NO: 2682296 - RNA, 15 nt, Human
ccagggggcaagagg

SEQ ID NO: 2682297 - RNA, 22 nt, Human
ccauugagaccgugaagauacu

SEQ ID NO: 2682298 - RNA, 18 nt, Human
ccauuucccaucugcacc

SEQ ID NO: 2682299 - RNA, 19 nt, Human
ccauacauaaaagaaauaa

SEQ ID NO: 2682300 - RNA, 17 nt, Human
ccauacacuuuguugca

SEQ ID NO: 2682301 - RNA, 20 nt, Human
ccauacacuuuguugcaaga

SEQ ID NO: 2682302 - RNA, 16 nt, Human
ccauccccuguagagu

SEQ ID NO: 2682303 - RNA, 20 nt, Human
cccuaucuccugacagaagg

SEQ ID NO: 2682304 - RNA, 22 nt, Human
cccuaucuccugacagaaggug

SEQ ID NO: 2682305 - RNA, 13 nt, Human
cccuaucuccuga

SEQ ID NO: 2682306 - RNA, 14 nt, Human
cccuaucuccugac

SEQ ID NO: 2682307 - RNA, 15 nt, Human
cccuaucuccugaca

SEQ ID NO: 2682308 - RNA, 16 nt, Human
cccuaucuccugacag

SEQ ID NO: 2682309 - RNA, 17 nt, Human
cccuaucuccugacaga

SEQ ID NO: 2682310 - RNA, 20 nt, Human
cccggcuuccuuucccaagc

SEQ ID NO: 2682311 - RNA, 21 nt, Human
cccggcugcagaggccagagg

SEQ ID NO: 2682312 - RNA, 20 nt, Human
cccgggaaccuccccagccu

SEQ ID NO: 2682313 - RNA, 23 nt, Human
cccgggaaccuccccagccugcg

SEQ ID NO: 2682314 - RNA, 22 nt, Human
cccgggaaccuccccagccugc

SEQ ID NO: 2682315 - RNA, 14 nt, Human
ccccuucucuccuc

SEQ ID NO: 2682316 - RNA, 12 nt, Human
ccccaucuugcu

SEQ ID NO: 2682317 - RNA, 14 nt, Human
ccccaucuugcuuc

SEQ ID NO: 2682318 - RNA, 16 nt, Human
cccaggggacaaggga

SEQ ID NO: 2682319 - RNA, 14 nt, Human
cccagggcuccugc

SEQ ID NO: 2682320 - RNA, 15 nt, Human
cccagggcuccugca

SEQ ID NO: 2682321 - RNA, 19 nt, Human
cccauuucccaucugcacc

SEQ ID NO: 2682322 - RNA, 14 nt, Human
cccauuucccaucu

SEQ ID NO: 2682323 - RNA, 15 nt, Human
cccauuucccaucug

SEQ ID NO: 2682324 - RNA, 16 nt, Human
cccauuucccaucugc

SEQ ID NO: 2682325 - RNA, 17 nt, Human
cccauuucccaucugca

SEQ ID NO: 2682326 - RNA, 14 nt, Human
cccaggaagcccag

SEQ ID NO: 2682327 - RNA, 15 nt, Human
cccaggaagcccagg

SEQ ID NO: 2682328 - RNA, 15 nt, Human
cccagcacuuuggga

SEQ ID NO: 2682329 - RNA, 17 nt, Human
cccagcacuuugggagg

SEQ ID NO: 2682330 - RNA, 18 nt, Human
cccagcacuuugggaggc

SEQ ID NO: 2682331 - RNA, 23 nt, Human
cccagcacuuugggaggccgagg

SEQ ID NO: 2682332 - RNA, 17 nt, Human
ccaauauuuaccagacc

SEQ ID NO: 2682333 - RNA, 18 nt, Human
ccaaauggagaagcugca

SEQ ID NO: 2682334 - RNA, 19 nt, Human
ccaaauggagaagcugcag

SEQ ID NO: 2682335 - RNA, 20 nt, Human
ccaaauggagaagcugcagg

SEQ ID NO: 2682336 - RNA, 21 nt, Human
ccaaauggagaagcugcaggc

SEQ ID NO: 2682337 - RNA, 15 nt, Human
ccaauguaggagcug

SEQ ID NO: 2682338 - RNA, 20 nt, Human
ccaauggguuuuucccugua

SEQ ID NO: 2682339 - RNA, 20 nt, Human
ccaauguaggagcugccuug

SEQ ID NO: 2682340 - RNA, 17 nt, Human
ccaauguaggagcugcc

SEQ ID NO: 2682341 - RNA, 15 nt, Human
cauuugugccagagg

SEQ ID NO: 2682342 - RNA, 16 nt, Human
cauuugugccagagga

SEQ ID NO: 2682343 - RNA, 16 nt, Human
cauuugugcuagaaau

SEQ ID NO: 2682344 - RNA, 20 nt, Human
cauuugugcuagaaauuuuc

SEQ ID NO: 2682345 - RNA, 21 nt, Human
cauuugugcuagaaauuuuca

SEQ ID NO: 2682346 - RNA, 16 nt, Human
cauuuuuuaauuuacu

SEQ ID NO: 2682347 - RNA, 21 nt, Human
cauuuuuuaauuuacuuguuu

SEQ ID NO: 2682348 - RNA, 23 nt, Human
cauuuuuuaauuuacuuguuuug

SEQ ID NO: 2682349 - RNA, 14 nt, Human
cauuuuuuugcaug

SEQ ID NO: 2682350 - RNA, 17 nt, Human
ccaccgccccuggccgc

SEQ ID NO: 2682351 - RNA, 22 nt, Human
ccaccuuuggaaagcucugacc

SEQ ID NO: 2682352 - RNA, 24 nt, Human
ccaccuuuggaaagcucugaccac

SEQ ID NO: 2682353 - RNA, 20 nt, Human
ccacccuuucccccuucucu

SEQ ID NO: 2682354 - RNA, 23 nt, Human
ccacgaauuucugugcccuccug

SEQ ID NO: 2682355 - RNA, 21 nt, Human
ccacgaauuucugugcccucc

SEQ ID NO: 2682356 - RNA, 18 nt, Human
ccacgaauuucugugccc

SEQ ID NO: 2682357 - RNA, 15 nt, Human
ccacgcccguccugc

SEQ ID NO: 2682358 - RNA, 17 nt, Human
ccacgcccguccugccu

SEQ ID NO: 2682359 - RNA, 18 nt, Human
ccacgcccguccugccug

SEQ ID NO: 2682360 - RNA, 23 nt, Human
ccacgcccguccugccuguggcg

SEQ ID NO: 2682361 - RNA, 19 nt, Human
ccacgcccguccugccugu

SEQ ID NO: 2682362 - RNA, 20 nt, Human
ccacgcccguccugccugug

SEQ ID NO: 2682363 - RNA, 21 nt, Human
ccacgcccguccugccugugg

SEQ ID NO: 2682364 - RNA, 22 nt, Human
ccacgcccguccugccuguggc

SEQ ID NO: 2682365 - RNA, 22 nt, Human
ccacagcaacgaucacaaauga

SEQ ID NO: 2682366 - RNA, 15 nt, Human
ccacagccagcaccu

SEQ ID NO: 2682367 - RNA, 15 nt, Human
ccacagcgagggcag

SEQ ID NO: 2682368 - RNA, 17 nt, Human
ccacagcgagggcagcu

SEQ ID NO: 2682369 - RNA, 17 nt, Human
ccacagccagcaccugg

SEQ ID NO: 2682370 - RNA, 18 nt, Human
ccacagccagcaccuggc

SEQ ID NO: 2682371 - RNA, 19 nt, Human
ccacagccagcaccuggca

SEQ ID NO: 2682372 - RNA, 22 nt, Human
ccacagccagcaccuggcaucg

SEQ ID NO: 2682373 - RNA, 13 nt, Human
ccacagcgccagc

SEQ ID NO: 2682374 - RNA, 18 nt, Human
ccacagcgccagccucag

SEQ ID NO: 2682375 - RNA, 23 nt, Human
ccacagcgccagccucagacugg

SEQ ID NO: 2682376 - RNA, 24 nt, Human
ccacagcgccagccucagacugga

SEQ ID NO: 2682377 - RNA, 12 nt, Human
ccacagcguccc

SEQ ID NO: 2682378 - RNA, 15 nt, Human
ccacagcgucccugg

SEQ ID NO: 2682379 - RNA, 16 nt, Human
ccacagcgucccuggc

SEQ ID NO: 2682380 - RNA, 17 nt, Human
ccacagcgucccuggcg

SEQ ID NO: 2682381 - RNA, 21 nt, Human
ccacagcgucccuggcgcagg

SEQ ID NO: 2682382 - RNA, 18 nt, Human
ccacagcgagggcagcug

SEQ ID NO: 2682383 - RNA, 19 nt, Human
ccacagcgagggcagcugc

SEQ ID NO: 2682384 - RNA, 20 nt, Human
ccacagcgagggcagcugcu

SEQ ID NO: 2682385 - RNA, 21 nt, Human
ccacagcgagggcagcugcua

SEQ ID NO: 2682386 - RNA, 21 nt, Human
ccaccacagccagcaccuggc

SEQ ID NO: 2682387 - RNA, 14 nt, Human
ccaccacagccagc

SEQ ID NO: 2682388 - RNA, 15 nt, Human
ccaccacagccagca

SEQ ID NO: 2682389 - RNA, 18 nt, Human
ccaccacagccagcaccu

SEQ ID NO: 2682390 - RNA, 20 nt, Human
ccaccacagccagcaccugg

SEQ ID NO: 2682391 - RNA, 15 nt, Human
ccacccugggcccug

SEQ ID NO: 2682392 - RNA, 16 nt, Human
ccacccugggcccugg

SEQ ID NO: 2682393 - RNA, 17 nt, Human
ccacccugggcccuggg

SEQ ID NO: 2682394 - RNA, 20 nt, Human
ccacccugggcccugggcug

SEQ ID NO: 2682395 - RNA, 22 nt, Human
ccacccugggcccugggcugga

SEQ ID NO: 2682396 - RNA, 20 nt, Human
ccacuccgagaggugggcca

SEQ ID NO: 2682397 - RNA, 18 nt, Human
ccacucccuugcuggccc

SEQ ID NO: 2682398 - RNA, 20 nt, Human
ccacucccuugcuggcccca

SEQ ID NO: 2682399 - RNA, 16 nt, Human
ccacuccgagaggugg

SEQ ID NO: 2682400 - RNA, 17 nt, Human
ccacuccgagagguggg

SEQ ID NO: 2682401 - RNA, 19 nt, Human
ccacuccgagaggugggcc

SEQ ID NO: 2682402 - RNA, 23 nt, Human
ccacuccgagaggugggccaguc

SEQ ID NO: 2682403 - RNA, 20 nt, Human
caugcuccuggcccacugca

SEQ ID NO: 2682404 - RNA, 16 nt, Human
caugcaaaauauguuu

SEQ ID NO: 2682405 - RNA, 17 nt, Human
caugcaaaauauguuua

SEQ ID NO: 2682406 - RNA, 16 nt, Human
cauggcuccggccucu

SEQ ID NO: 2682407 - RNA, 17 nt, Human
cauggcuccggccucug

SEQ ID NO: 2682408 - RNA, 16 nt, Human
cauggcucaggguggu

SEQ ID NO: 2682409 - RNA, 17 nt, Human
cauucuaggcucacugc

SEQ ID NO: 2682410 - RNA, 21 nt, Human
cauucguuguguuuuuuaaga

SEQ ID NO: 2682411 - RNA, 23 nt, Human
cauucguuguguuuuuuaagaua

SEQ ID NO: 2682412 - RNA, 19 nt, Human
cauucguacauaauacuga

SEQ ID NO: 2682413 - RNA, 17 nt, Human
cauucguacauaauacu

SEQ ID NO: 2682414 - RNA, 13 nt, Human
cauuauaaaaaga

SEQ ID NO: 2682415 - RNA, 15 nt, Human
cauguagcagugagu

SEQ ID NO: 2682416 - RNA, 19 nt, Human
cauguagcagugagucaua

SEQ ID NO: 2682417 - RNA, 17 nt, Human
cauguagcccccuggcc

SEQ ID NO: 2682418 - RNA, 13 nt, Human
cauguagcccccu

SEQ ID NO: 2682419 - RNA, 22 nt, Human
cauguagcccccuggccucugu

SEQ ID NO: 2682420 - RNA, 21 nt, Human
cauguagcccccuggccucug

SEQ ID NO: 2682421 - RNA, 20 nt, Human
cauguagcccccuggccucu

SEQ ID NO: 2682422 - RNA, 18 nt, Human
cauguagcccccuggccu

SEQ ID NO: 2682423 - RNA, 14 nt, Human
cauguauuugagca

SEQ ID NO: 2682424 - RNA, 15 nt, Human
cauguauuugagcau

SEQ ID NO: 2682425 - RNA, 22 nt, Human
cauguacuuuuuaguaauuucu

SEQ ID NO: 2682426 - RNA, 21 nt, Human
cauguuggccaggcuggucuu

SEQ ID NO: 2682427 - RNA, 15 nt, Human
cauguugggaaacuu

SEQ ID NO: 2682428 - RNA, 19 nt, Human
cauguugggaaacuuggcu

SEQ ID NO: 2682429 - RNA, 20 nt, Human
cauguugggaaacuuggcuc

SEQ ID NO: 2682430 - RNA, 21 nt, Human
cauguugggaaacuuggcucg

SEQ ID NO: 2682431 - RNA, 12 nt, Human
cauguuauguuu

SEQ ID NO: 2682432 - RNA, 13 nt, Human
cauguuauguuua

SEQ ID NO: 2682433 - RNA, 20 nt, Human
caugucaaacaugagaugug

SEQ ID NO: 2682434 - RNA, 21 nt, Human
caugucaaacaugagaugugu

SEQ ID NO: 2682435 - RNA, 13 nt, Human
caugucaaacaug

SEQ ID NO: 2682436 - RNA, 18 nt, Human
cauauggguuagauguug

SEQ ID NO: 2682437 - RNA, 17 nt, Human
cauauggguuagauguu

SEQ ID NO: 2682438 - RNA, 22 nt, Human
cagugguggcaacauucauugc

SEQ ID NO: 2682439 - RNA, 11 nt, Human
cauauggaugu

SEQ ID NO: 2682440 - RNA, 12 nt, Human
cauauggauguu

SEQ ID NO: 2682441 - RNA, 15 nt, Human
cauauggauguuacu

SEQ ID NO: 2682442 - RNA, 16 nt, Human
cauauggauguuacuc

SEQ ID NO: 2682443 - RNA, 14 nt, Human
caucacuuaaaaca

SEQ ID NO: 2682444 - RNA, 13 nt, Human
caucacuuaaaac

SEQ ID NO: 2682445 - RNA, 12 nt, Human
caucacuguauc

SEQ ID NO: 2682446 - RNA, 21 nt, Human
cauccccuguagagugggagc

SEQ ID NO: 2682447 - RNA, 15 nt, Human
caucacuuaaaacac

SEQ ID NO: 2682448 - RNA, 16 nt, Human
caucgcaccauucuga

SEQ ID NO: 2682449 - RNA, 18 nt, Human
caucgcaccauucugacu

SEQ ID NO: 2682450 - RNA, 19 nt, Human
caucgcaccauucugacuc

SEQ ID NO: 2682451 - RNA, 17 nt, Human
caucggccuagggcccc

SEQ ID NO: 2682452 - RNA, 15 nt, Human
caucggcguggccca

SEQ ID NO: 2682453 - RNA, 16 nt, Human
caucggccuagggccc

SEQ ID NO: 2682454 - RNA, 14 nt, Human
caucggccuagggc

SEQ ID NO: 2682455 - RNA, 14 nt, Human
caucugcugguccg

SEQ ID NO: 2682456 - RNA, 19 nt, Human
caucugcugguccguggga

SEQ ID NO: 2682457 - RNA, 16 nt, Human
caucgugaagaagccu

SEQ ID NO: 2682458 - RNA, 17 nt, Human
caucgugaagaagccug

SEQ ID NO: 2682459 - RNA, 18 nt, Human
caucgugaagaagccugu

SEQ ID NO: 2682460 - RNA, 17 nt, Human
caucuguggacugaccu

SEQ ID NO: 2682461 - RNA, 15 nt, Human
caucgccacaaacuc

SEQ ID NO: 2682462 - RNA, 14 nt, Human
caucuggaagauca

SEQ ID NO: 2682463 - RNA, 21 nt, Human
caucuggaagaucauuuugaa

SEQ ID NO: 2682464 - RNA, 21 nt, Human
caucuggaaucuggagaccag

SEQ ID NO: 2682465 - RNA, 16 nt, Human
caucuggaaucuggag

SEQ ID NO: 2682466 - RNA, 19 nt, Human
cagcugagggugagugggu

SEQ ID NO: 2682467 - RNA, 19 nt, Human
cagcuguucagcugguuga

SEQ ID NO: 2682468 - RNA, 17 nt, Human
cagccucugaaaaccaa

SEQ ID NO: 2682469 - RNA, 18 nt, Human
cagccugcgccugcugca

SEQ ID NO: 2682470 - RNA, 12 nt, Human
cagccugcucca

SEQ ID NO: 2682471 - RNA, 23 nt, Human
cagccugcuagcuagcucaacua

SEQ ID NO: 2682472 - RNA, 22 nt, Human
cagccugcuagcuagcucaacu

SEQ ID NO: 2682473 - RNA, 18 nt, Human
cagccugcuagcuagcuc

SEQ ID NO: 2682474 - RNA, 16 nt, Human
cagccugcuagcuagc

SEQ ID NO: 2682475 - RNA, 13 nt, Human
cagccugcuagcu

SEQ ID NO: 2682476 - RNA, 23 nt, Human
cagccugcgccugcugcaugccc

SEQ ID NO: 2682477 - RNA, 22 nt, Human
cagccugcgccugcugcaugcc

SEQ ID NO: 2682478 - RNA, 21 nt, Human
cagccugcgccugcugcaugc

SEQ ID NO: 2682479 - RNA, 12 nt, Human
cagcgccucccu

SEQ ID NO: 2682480 - RNA, 14 nt, Human
cagcgccucccucc

SEQ ID NO: 2682481 - RNA, 15 nt, Human
cagcgccucccucca

SEQ ID NO: 2682482 - RNA, 16 nt, Human
cagcgccucccuccac

SEQ ID NO: 2682483 - RNA, 18 nt, Human
cagcgccucccuccaccc

SEQ ID NO: 2682484 - RNA, 20 nt, Human
cagcgccucccuccacccca

SEQ ID NO: 2682485 - RNA, 21 nt, Human
cagcgccucccuccaccccag

SEQ ID NO: 2682486 - RNA, 22 nt, Human
cagcgccucccuccaccccagg

SEQ ID NO: 2682487 - RNA, 23 nt, Human
cagcgccucccuccaccccagga

SEQ ID NO: 2682488 - RNA, 15 nt, Human
cagaucacugccaca

SEQ ID NO: 2682489 - RNA, 16 nt, Human
cagaucacugccacac

SEQ ID NO: 2682490 - RNA, 22 nt, Human
cagagguauuaaaacuaaauuu

SEQ ID NO: 2682491 - RNA, 23 nt, Human
cagagguauuaaaacuaaauuuc

SEQ ID NO: 2682492 - RNA, 13 nt, Human
cagagguacccug

SEQ ID NO: 2682493 - RNA, 14 nt, Human
cagagguacccugg

SEQ ID NO: 2682494 - RNA, 15 nt, Human
cagagguacccuggg

SEQ ID NO: 2682495 - RNA, 16 nt, Human
cagagguacccugggu

SEQ ID NO: 2682496 - RNA, 17 nt, Human
cagagguacccugggug

SEQ ID NO: 2682497 - RNA, 18 nt, Human
cagagguacccugggugu

SEQ ID NO: 2682498 - RNA, 18 nt, Human
cagagguugugcacuguu

SEQ ID NO: 2682499 - RNA, 13 nt, Human
cagaucacugcca

SEQ ID NO: 2682500 - RNA, 14 nt, Human
cagaucacugccac

SEQ ID NO: 2682501 - RNA, 13 nt, Human
cagaaucccuuaa

SEQ ID NO: 2682502 - RNA, 18 nt, Human
cagaaucccuuaacaguu

SEQ ID NO: 2682503 - RNA, 13 nt, Human
cagaauauuuuua

SEQ ID NO: 2682504 - RNA, 21 nt, Human
cagaauauuuuuauauuuccu

SEQ ID NO: 2682505 - RNA, 22 nt, Human
cagaauauuuuuauauuuccuu

SEQ ID NO: 2682506 - RNA, 23 nt, Human
cagaauauuuuuauauuuccuuu

SEQ ID NO: 2682507 - RNA, 17 nt, Human
cagcaguugcugguaaa

SEQ ID NO: 2682508 - RNA, 19 nt, Human
cagcaucaccugccuguua

SEQ ID NO: 2682509 - RNA, 23 nt, Human
cagcaguugcugguaaaaugaag

SEQ ID NO: 2682510 - RNA, 22 nt, Human
cagcaguugcugguaaaaugaa

SEQ ID NO: 2682511 - RNA, 21 nt, Human
cagcaguugcugguaaaauga

SEQ ID NO: 2682512 - RNA, 20 nt, Human
cagcaguugcugguaaaaug

SEQ ID NO: 2682513 - RNA, 13 nt, Human
cagcaucaggguu

SEQ ID NO: 2682514 - RNA, 16 nt, Human
cagcaucaccugccug

SEQ ID NO: 2682515 - RNA, 17 nt, Human
cagcaucaccugccugu

SEQ ID NO: 2682516 - RNA, 23 nt, Human
cagcaucaggguuaagaagacuu

SEQ ID NO: 2682517 - RNA, 22 nt, Human
cagccaggaccauaccgggucu

SEQ ID NO: 2682518 - RNA, 16 nt, Human
cagccagcgccucccu

SEQ ID NO: 2682519 - RNA, 17 nt, Human
cagccagcgccucccuc

SEQ ID NO: 2682520 - RNA, 18 nt, Human
cagccagcgccucccucc

SEQ ID NO: 2682521 - RNA, 19 nt, Human
cagccagcgccucccucca

SEQ ID NO: 2682522 - RNA, 20 nt, Human
cagccagcgccucccuccac

SEQ ID NO: 2682523 - RNA, 21 nt, Human
cagccagcgccucccuccacc

SEQ ID NO: 2682524 - RNA, 22 nt, Human
cagccagcgccucccuccaccc

SEQ ID NO: 2682525 - RNA, 23 nt, Human
cagccagcgccucccuccacccc

SEQ ID NO: 2682526 - RNA, 21 nt, Human
caguaaacgggaacaugcccc

SEQ ID NO: 2682527 - RNA, 23 nt, Human
caguaaacgggaacaugcccccu

SEQ ID NO: 2682528 - RNA, 21 nt, Human
cagguuggugggggccucggu

SEQ ID NO: 2682529 - RNA, 14 nt, Human
cagguuuaagcugu

SEQ ID NO: 2682530 - RNA, 21 nt, Human
caggugauuggaccaggccau

SEQ ID NO: 2682531 - RNA, 23 nt, Human
caggugaucugcugcagagcagu

SEQ ID NO: 2682532 - RNA, 20 nt, Human
caggugauuggaccaggcca

SEQ ID NO: 2682533 - RNA, 19 nt, Human
cagggauaaggccuguggg

SEQ ID NO: 2682534 - RNA, 19 nt, Human
caggggaaaaucagccugc

SEQ ID NO: 2682535 - RNA, 20 nt, Human
caggggaaaaucagccugcu

SEQ ID NO: 2682536 - RNA, 23 nt, Human
cagggcugcugggggcaacuggc

SEQ ID NO: 2682537 - RNA, 21 nt, Human
cagggcugcugggggcaacug

SEQ ID NO: 2682538 - RNA, 12 nt, Human
cagggcucccag

SEQ ID NO: 2682539 - RNA, 14 nt, Human
cagggcucccaggg

SEQ ID NO: 2682540 - RNA, 21 nt, Human
cagggcucccaggggucuccc

SEQ ID NO: 2682541 - RNA, 22 nt, Human
cagggagccuuugguucuggcc

SEQ ID NO: 2682542 - RNA, 14 nt, Human
auuuauaauuccua

SEQ ID NO: 2682543 - RNA, 22 nt, Human
auuuaauggaaguguauuuauu

SEQ ID NO: 2682544 - RNA, 23 nt, Human
auuuaauggaaguguauuuauuu

SEQ ID NO: 2682545 - RNA, 20 nt, Human
auuuaauccaguuauaagaa

SEQ ID NO: 2682546 - RNA, 23 nt, Human
auuuaauccaguuauaagaagaa

SEQ ID NO: 2682547 - RNA, 15 nt, Human
auuucaucacaagaa

SEQ ID NO: 2682548 - RNA, 19 nt, Human
auuucaucacaagaacaca

SEQ ID NO: 2682549 - RNA, 15 nt, Human
auuuauauuuauuga

SEQ ID NO: 2682550 - RNA, 22 nt, Human
auuuauauuuauugacucuuga

SEQ ID NO: 2682551 - RNA, 20 nt, Human
auuuauauuuauugacucuu

SEQ ID NO: 2682552 - RNA, 16 nt, Human
auuuauauuuauugac

SEQ ID NO: 2682553 - RNA, 15 nt, Human
auuucuccauacgca

SEQ ID NO: 2682554 - RNA, 15 nt, Human
auuucucauugacuu

SEQ ID NO: 2682555 - RNA, 17 nt, Human
auuucucauugacuuuu

SEQ ID NO: 2682556 - RNA, 22 nt, Human
auuucucauugacuuuuauaaa

SEQ ID NO: 2682557 - RNA, 14 nt, Human
auuucaucucauuu

SEQ ID NO: 2682558 - RNA, 15 nt, Human
auuucaucucauuua

SEQ ID NO: 2682559 - RNA, 21 nt, Human
auuucaucucauuuaagggaa

SEQ ID NO: 2682560 - RNA, 22 nt, Human
auuucaucucauuuaagggaaa

SEQ ID NO: 2682561 - RNA, 23 nt, Human
auuucaucucauuuaagggaaaa

SEQ ID NO: 2682562 - RNA, 23 nt, Human
auuucuguguugccaagcuccaa

SEQ ID NO: 2682563 - RNA, 15 nt, Human
auuucuguguugcca

SEQ ID NO: 2682564 - RNA, 11 nt, Human
auuucuguguu

SEQ ID NO: 2682565 - RNA, 19 nt, Human
auuucuccucccuuccuuu

SEQ ID NO: 2682566 - RNA, 12 nt, Human
auuucuccuccc

SEQ ID NO: 2682567 - RNA, 14 nt, Human
auuucuccucccuu

SEQ ID NO: 2682568 - RNA, 17 nt, Human
auuucuccucccuuccu

SEQ ID NO: 2682569 - RNA, 20 nt, Human
auuguugacaacugugacug

SEQ ID NO: 2682570 - RNA, 18 nt, Human
auuguugacaacugugac

SEQ ID NO: 2682571 - RNA, 20 nt, Human
auuguuccuuggagaaauga

SEQ ID NO: 2682572 - RNA, 21 nt, Human
auuguuccuuggagaaaugaa

SEQ ID NO: 2682573 - RNA, 14 nt, Human
auuguucucagaau

SEQ ID NO: 2682574 - RNA, 17 nt, Human
auuguucucagaauccc

SEQ ID NO: 2682575 - RNA, 19 nt, Human
auuguaagcguauggcuuu

SEQ ID NO: 2682576 - RNA, 18 nt, Human
auuguaagcguauggcuu

SEQ ID NO: 2682577 - RNA, 19 nt, Human
auuguugacaacugugacu

SEQ ID NO: 2682578 - RNA, 14 nt, Human
auuguuuaaaaugu

SEQ ID NO: 2682579 - RNA, 15 nt, Human
auuguuuaaaaugua

SEQ ID NO: 2682580 - RNA, 16 nt, Human
auuguuuaaaauguaa

SEQ ID NO: 2682581 - RNA, 17 nt, Human
auuguuuaaaauguaau

SEQ ID NO: 2682582 - RNA, 18 nt, Human
auuguucuuauucuggca

SEQ ID NO: 2682583 - RNA, 14 nt, Human
auugaugcaaauaa

SEQ ID NO: 2682584 - RNA, 17 nt, Human
auuguaagcguauggcu

SEQ ID NO: 2682585 - RNA, 14 nt, Human
auuaaauucugagc

SEQ ID NO: 2682586 - RNA, 13 nt, Human
auucaacuuugua

SEQ ID NO: 2682587 - RNA, 14 nt, Human
auucaacuuuguaa

SEQ ID NO: 2682588 - RNA, 15 nt, Human
auucaacuuuguaaa

SEQ ID NO: 2682589 - RNA, 18 nt, Human
auucaacuuuguaaaaau

SEQ ID NO: 2682590 - RNA, 13 nt, Human
auucaucugucua

SEQ ID NO: 2682591 - RNA, 17 nt, Human
auucaucugucuauauu

SEQ ID NO: 2682592 - RNA, 18 nt, Human
auucaucugucuauauuu

SEQ ID NO: 2682593 - RNA, 16 nt, Human
auucaugaggagggug

SEQ ID NO: 2682594 - RNA, 11 nt, Human
auucauuucua

SEQ ID NO: 2682595 - RNA, 12 nt, Human
auucauuucuaa

SEQ ID NO: 2682596 - RNA, 16 nt, Human
auugagaaagaaacua

SEQ ID NO: 2682597 - RNA, 23 nt, Human
auugagaccgugaagauacuuug

SEQ ID NO: 2682598 - RNA, 22 nt, Human
auugagaccgugaagauacuuu

SEQ ID NO: 2682599 - RNA, 21 nt, Human
auugagaccgugaagauacuu

SEQ ID NO: 2682600 - RNA, 20 nt, Human
auugagaccgugaagauacu

SEQ ID NO: 2682601 - RNA, 17 nt, Human
auugagaccgugaagau

SEQ ID NO: 2682602 - RNA, 17 nt, Human
auucugagccugauauu

SEQ ID NO: 2682603 - RNA, 18 nt, Human
auucugacucgguuucuc

SEQ ID NO: 2682604 - RNA, 20 nt, Human
auucugacucgguuucucca

SEQ ID NO: 2682605 - RNA, 14 nt, Human
auucugagaaaaca

SEQ ID NO: 2682606 - RNA, 15 nt, Human
auucugagaaaacaa

SEQ ID NO: 2682607 - RNA, 19 nt, Human
auucuuguugcuguacaaa

SEQ ID NO: 2682608 - RNA, 20 nt, Human
auucuuguugcuguacaaaa

SEQ ID NO: 2682609 - RNA, 21 nt, Human
auucuuguugcuguacaaaag

SEQ ID NO: 2682610 - RNA, 22 nt, Human
auucuuguugcuguacaaaagc

SEQ ID NO: 2682611 - RNA, 18 nt, Human
auucuuggcuuaaucauu

SEQ ID NO: 2682612 - RNA, 21 nt, Human
auucugauucuggcuuuaagc

SEQ ID NO: 2682613 - RNA, 16 nt, Human
caacaaaaagcuuccc

SEQ ID NO: 2682614 - RNA, 17 nt, Human
caacaaaaagcuucccc

SEQ ID NO: 2682615 - RNA, 15 nt, Human
caaauuuuuugacuu

SEQ ID NO: 2682616 - RNA, 23 nt, Human
caaauuuuuugacuuuuuuugua

SEQ ID NO: 2682617 - RNA, 14 nt, Human
caacaauugguaaa

SEQ ID NO: 2682618 - RNA, 15 nt, Human
caacaauugguaaaa

SEQ ID NO: 2682619 - RNA, 18 nt, Human
caacaauugguaaaacuc

SEQ ID NO: 2682620 - RNA, 19 nt, Human
caacaauugguaaaacuca

SEQ ID NO: 2682621 - RNA, 18 nt, Human
caaaucguagcguuuguu

SEQ ID NO: 2682622 - RNA, 16 nt, Human
caaaugagcucugaaa

SEQ ID NO: 2682623 - RNA, 20 nt, Human
caaaugagcucugaaaucuu

SEQ ID NO: 2682624 - RNA, 21 nt, Human
caaaugagcucugaaaucuuc

SEQ ID NO: 2682625 - RNA, 21 nt, Human
caaaugcaaaaacucuuugag

SEQ ID NO: 2682626 - RNA, 19 nt, Human
caaaugcaaaaacucuuug

SEQ ID NO: 2682627 - RNA, 16 nt, Human
caaaucugauggccuu

SEQ ID NO: 2682628 - RNA, 21 nt, Human
caaaugaugugcaaaaccuuu

SEQ ID NO: 2682629 - RNA, 22 nt, Human
caacaccucugcacaagcugca

SEQ ID NO: 2682630 - RNA, 18 nt, Human
caaccccaaacccaagug

SEQ ID NO: 2682631 - RNA, 17 nt, Human
caaccccaagccagccc

SEQ ID NO: 2682632 - RNA, 14 nt, Human
caaccaugucauuu

SEQ ID NO: 2682633 - RNA, 16 nt, Human
caaccaugucauuuca

SEQ ID NO: 2682634 - RNA, 22 nt, Human
caaccaugucauuucagaaguu

SEQ ID NO: 2682635 - RNA, 21 nt, Human
caaccacuaagaauucaaacu

SEQ ID NO: 2682636 - RNA, 19 nt, Human
caagaugugaauuauugac

SEQ ID NO: 2682637 - RNA, 22 nt, Human
caagaugugaauuauugacacu

SEQ ID NO: 2682638 - RNA, 23 nt, Human
caagaugugaauuauugacacug

SEQ ID NO: 2682639 - RNA, 19 nt, Human
caagauguugauuuuuacu

SEQ ID NO: 2682640 - RNA, 22 nt, Human
caaaaaaaaaaaaaagcaucua

SEQ ID NO: 2682641 - RNA, 19 nt, Human
caaaaaaaauuuagccggg

SEQ ID NO: 2682642 - RNA, 21 nt, Human
caaaaaaaauuuagccgggcg

SEQ ID NO: 2682643 - RNA, 22 nt, Human
caaaagcgcuuuuccuuggcau

SEQ ID NO: 2682644 - RNA, 17 nt, Human
caaaagcgcuuuuccuu

SEQ ID NO: 2682645 - RNA, 12 nt, Human
auuuuuaagcug

SEQ ID NO: 2682646 - RNA, 17 nt, Human
caaaccacgccucuuga

SEQ ID NO: 2682647 - RNA, 19 nt, Human
caaaccacgccucuugacc

SEQ ID NO: 2682648 - RNA, 22 nt, Human
caaaccacgccucuugaccagg

SEQ ID NO: 2682649 - RNA, 15 nt, Human
caaaagcugggcagg

SEQ ID NO: 2682650 - RNA, 22 nt, Human
caaaaguagaacuuuguauagu

SEQ ID NO: 2682651 - RNA, 21 nt, Human
caaaaguagaacuuuguauag

SEQ ID NO: 2682652 - RNA, 20 nt, Human
caaaaguagaacuuuguaua

SEQ ID NO: 2682653 - RNA, 19 nt, Human
caaaaguagaacuuuguau

SEQ ID NO: 2682654 - RNA, 18 nt, Human
caaaaguagaacuuugua

SEQ ID NO: 2682655 - RNA, 14 nt, Human
caaaaguagaacuu

SEQ ID NO: 2682656 - RNA, 11 nt, Human
caaaagguuua

SEQ ID NO: 2682657 - RNA, 15 nt, Human
caaaagguuuauucc

SEQ ID NO: 2682658 - RNA, 16 nt, Human
caaaagucugucuuuc

SEQ ID NO: 2682659 - RNA, 19 nt, Human
caaaagucugucuuuccug

SEQ ID NO: 2682660 - RNA, 21 nt, Human
caaaagugccucaagaggaau

SEQ ID NO: 2682661 - RNA, 22 nt, Human
auuuuauauuacugacauuucu

SEQ ID NO: 2682662 - RNA, 22 nt, Human
auuuuaucuguuuccugacauu

SEQ ID NO: 2682663 - RNA, 18 nt, Human
auuuucuucucugugaga

SEQ ID NO: 2682664 - RNA, 18 nt, Human
auuuugaaucaauaauau

SEQ ID NO: 2682665 - RNA, 18 nt, Human
auuuugaccuacucucau

SEQ ID NO: 2682666 - RNA, 17 nt, Human
auuuugaccuacucuca

SEQ ID NO: 2682667 - RNA, 22 nt, Human
auuuugagaaugcugacacuuu

SEQ ID NO: 2682668 - RNA, 13 nt, Human
auuuugagaugua

SEQ ID NO: 2682669 - RNA, 19 nt, Human
auuuugagauguaaaaaga

SEQ ID NO: 2682670 - RNA, 18 nt, Human
auuuugaguaaagcuccu

SEQ ID NO: 2682671 - RNA, 12 nt, Human
cagaaauuguau

SEQ ID NO: 2682672 - RNA, 13 nt, Human
cagaaauuguaua

SEQ ID NO: 2682673 - RNA, 14 nt, Human
cagaaauuguauau

SEQ ID NO: 2682674 - RNA, 15 nt, Human
cagaaauuguauauu

SEQ ID NO: 2682675 - RNA, 16 nt, Human
cagaaauuguauauug

SEQ ID NO: 2682676 - RNA, 18 nt, Human
cagaaauuguauauugua

SEQ ID NO: 2682677 - RNA, 19 nt, Human
cagaaauuguauauuguaa

SEQ ID NO: 2682678 - RNA, 22 nt, Human
cagaaauguugagucuguacua

SEQ ID NO: 2682679 - RNA, 21 nt, Human
cagaaauuguauauuguaauu

SEQ ID NO: 2682680 - RNA, 22 nt, Human
cagaaauuguauauuguaauuu

SEQ ID NO: 2682681 - RNA, 18 nt, Human
cagaagugcccuuccugc

SEQ ID NO: 2682682 - RNA, 20 nt, Human
cagaagugcccuuccugcug

SEQ ID NO: 2682683 - RNA, 21 nt, Human
cagaagugcccuuccugcugc

SEQ ID NO: 2682684 - RNA, 16 nt, Human
cagaaguuaguuugua

SEQ ID NO: 2682685 - RNA, 18 nt, Human
cagaaguuaguuuguaua

SEQ ID NO: 2682686 - RNA, 19 nt, Human
cagaaguuaguuuguauau

SEQ ID NO: 2682687 - RNA, 15 nt, Human
cagaauacugaugga

SEQ ID NO: 2682688 - RNA, 21 nt, Human
cagaauaaguuauugcaguuu

SEQ ID NO: 2682689 - RNA, 23 nt, Human
cagaauaaguuauugcaguuuau

SEQ ID NO: 2682690 - RNA, 15 nt, Human
cagaauaaguuauug

SEQ ID NO: 2682691 - RNA, 17 nt, Human
cagaauaaguuauugca

SEQ ID NO: 2682692 - RNA, 18 nt, Human
cagaauaaguuauugcag

SEQ ID NO: 2682693 - RNA, 19 nt, Human
cagaauaaguuauugcagu

SEQ ID NO: 2682694 - RNA, 20 nt, Human
cagaauaaguuauugcaguu

SEQ ID NO: 2682695 - RNA, 21 nt, Human
cacuggggcagacaauaaacc

SEQ ID NO: 2682696 - RNA, 22 nt, Human
cacugguccccaacaaugugag

SEQ ID NO: 2682697 - RNA, 17 nt, Human
cacuugugauuauuuau

SEQ ID NO: 2682698 - RNA, 16 nt, Human
cacuguuuaaucauag

SEQ ID NO: 2682699 - RNA, 12 nt, Human
cacuguuuagau

SEQ ID NO: 2682700 - RNA, 20 nt, Human
cacuguuuagauuugccaua

SEQ ID NO: 2682701 - RNA, 15 nt, Human
cacuguuuagauuug

SEQ ID NO: 2682702 - RNA, 23 nt, Human
cacuguuuagauuugccauagag

SEQ ID NO: 2682703 - RNA, 13 nt, Human
cacuguuuccugg

SEQ ID NO: 2682704 - RNA, 14 nt, Human
cacuguuuccuggg

SEQ ID NO: 2682705 - RNA, 15 nt, Human
cacuguuuccugggc

SEQ ID NO: 2682706 - RNA, 17 nt, Human
cacuguuucucuugagc

SEQ ID NO: 2682707 - RNA, 18 nt, Human
cacuguuucucuugagcu

SEQ ID NO: 2682708 - RNA, 21 nt, Human
cacuuacugguaggaccaagc

SEQ ID NO: 2682709 - RNA, 15 nt, Human
cacuuacugguagga

SEQ ID NO: 2682710 - RNA, 19 nt, Human
cacuguuucucuugagcug

SEQ ID NO: 2682711 - RNA, 20 nt, Human
cacuguuucucuugagcugg

SEQ ID NO: 2682712 - RNA, 16 nt, Human
cacuuacuugcuuauu

SEQ ID NO: 2682713 - RNA, 23 nt, Human
cacuuuauugccuuuuaauuuuu

SEQ ID NO: 2682714 - RNA, 17 nt, Human
cacuaggcccccacuug

SEQ ID NO: 2682715 - RNA, 20 nt, Human
cacuaggcccccacuugccu

SEQ ID NO: 2682716 - RNA, 21 nt, Human
cacuaggcccccacuugccuc

SEQ ID NO: 2682717 - RNA, 22 nt, Human
cacuaggcccccacuugccucu

SEQ ID NO: 2682718 - RNA, 14 nt, Human
cacuccccuagggg

SEQ ID NO: 2682719 - RNA, 15 nt, Human
cacuaauuuuuguau

SEQ ID NO: 2682720 - RNA, 18 nt, Human
cacuaauuuuuguauuau

SEQ ID NO: 2682721 - RNA, 19 nt, Human
cacuaauuuuuguauuauu

SEQ ID NO: 2682722 - RNA, 20 nt, Human
cacuaauuuuuguauuauuu

SEQ ID NO: 2682723 - RNA, 23 nt, Human
cacuaauuuuuguauuauuuuug

SEQ ID NO: 2682724 - RNA, 17 nt, Human
cacuaauugguacuuuu

SEQ ID NO: 2682725 - RNA, 23 nt, Human
cacuaauugguacuuuuaaaaac

SEQ ID NO: 2682726 - RNA, 21 nt, Human
cacuacaagucagcuccagcu

SEQ ID NO: 2682727 - RNA, 23 nt, Human
cacggagucguggggugugcugg

SEQ ID NO: 2682728 - RNA, 19 nt, Human
cacggagcccagcccuccc

SEQ ID NO: 2682729 - RNA, 19 nt, Human
cacggaggaugaugccagu

SEQ ID NO: 2682730 - RNA, 23 nt, Human
cacggaggcauccuacccuuuuc

SEQ ID NO: 2682731 - RNA, 22 nt, Human
cacugaaaauuggacagauugc

SEQ ID NO: 2682732 - RNA, 13 nt, Human
cacugaaaguuuu

SEQ ID NO: 2682733 - RNA, 16 nt, Human
cacugaaaguuuugua

SEQ ID NO: 2682734 - RNA, 17 nt, Human
cacugaaaguuuuguaa

SEQ ID NO: 2682735 - RNA, 18 nt, Human
cacugaaaguuuuguaaa

SEQ ID NO: 2682736 - RNA, 19 nt, Human
cacugaaaguuuuguaaaa

SEQ ID NO: 2682737 - RNA, 20 nt, Human
cacugaaaguuuuguaaaag

SEQ ID NO: 2682738 - RNA, 21 nt, Human
cacugaaaguuuuguaaaaga

SEQ ID NO: 2682739 - RNA, 23 nt, Human
cacugaaaguuuuguaaaagaaa

SEQ ID NO: 2682740 - RNA, 13 nt, Human
caccuugccuugc

SEQ ID NO: 2682741 - RNA, 16 nt, Human
caccuuggacauccuc

SEQ ID NO: 2682742 - RNA, 17 nt, Human
caccuuggacauccucc

SEQ ID NO: 2682743 - RNA, 18 nt, Human
caccuuggacauccuccu

SEQ ID NO: 2682744 - RNA, 21 nt, Human
caccuuggacauccuccuccc

SEQ ID NO: 2682745 - RNA, 22 nt, Human
caccuuggacauccuccuccca

SEQ ID NO: 2682746 - RNA, 19 nt, Human
caccuuuggaaagcucuga

SEQ ID NO: 2682747 - RNA, 13 nt, Human
caccuugugccug

SEQ ID NO: 2682748 - RNA, 15 nt, Human
caccuugugccuggg

SEQ ID NO: 2682749 - RNA, 16 nt, Human
caccuugugccugggg

SEQ ID NO: 2682750 - RNA, 17 nt, Human
caccuugugccuggggu

SEQ ID NO: 2682751 - RNA, 18 nt, Human
caccuugugccuggggug

SEQ ID NO: 2682752 - RNA, 11 nt, Human
caauaaaauuu

SEQ ID NO: 2682753 - RNA, 13 nt, Human
caauaaaauuuaa

SEQ ID NO: 2682754 - RNA, 14 nt, Human
caauaaaauuuaaa

SEQ ID NO: 2682755 - RNA, 20 nt, Human
caauaaaauuuaaaaaauaa

SEQ ID NO: 2682756 - RNA, 14 nt, Human
caauaaaaaucaua

SEQ ID NO: 2682757 - RNA, 15 nt, Human
caauaaacccucaga

SEQ ID NO: 2682758 - RNA, 19 nt, Human
caauaaacccucagagccu

SEQ ID NO: 2682759 - RNA, 20 nt, Human
caauaaacccucagagccuc

SEQ ID NO: 2682760 - RNA, 18 nt, Human
caauaaaauuuuuuuaaa

SEQ ID NO: 2682761 - RNA, 20 nt, Human
caauaaaauuuuuuuaaagu

SEQ ID NO: 2682762 - RNA, 20 nt, Human
caaguacauggcuagcuuuu

SEQ ID NO: 2682763 - RNA, 23 nt, Human
caaguaauugugaaaaaguuaaa

SEQ ID NO: 2682764 - RNA, 11 nt, Human
caaguaauugu

SEQ ID NO: 2682765 - RNA, 13 nt, Human
caaguaguucugu

SEQ ID NO: 2682766 - RNA, 19 nt, Human
caaguugagcuaugacuua

SEQ ID NO: 2682767 - RNA, 18 nt, Human
caaguuggaugcggccau

SEQ ID NO: 2682768 - RNA, 12 nt, Human
caaguuguaaau

SEQ ID NO: 2682769 - RNA, 15 nt, Human
caaguuguaaauaau

SEQ ID NO: 2682770 - RNA, 16 nt, Human
caaguugucagguuau

SEQ ID NO: 2682771 - RNA, 14 nt, Human
caauucuguuuuua

SEQ ID NO: 2682772 - RNA, 23 nt, Human
caauucuguuuuuaaugcuauuu

SEQ ID NO: 2682773 - RNA, 18 nt, Human
caaugcuucuagaguuuu

SEQ ID NO: 2682774 - RNA, 17 nt, Human
caaugcuuuauuuguaa

SEQ ID NO: 2682775 - RNA, 18 nt, Human
caaugcuuuauuuguaaa

SEQ ID NO: 2682776 - RNA, 20 nt, Human
caaugcuuuauuuguaaauu

SEQ ID NO: 2682777 - RNA, 23 nt, Human
caaugcuuuauuuguaaauuuag

SEQ ID NO: 2682778 - RNA, 22 nt, Human
cacaagcaaaaaaaaaaaaaag

SEQ ID NO: 2682779 - RNA, 22 nt, Human
cacagacacuaacgaaauauca

SEQ ID NO: 2682780 - RNA, 14 nt, Human
cacagggugggccu

SEQ ID NO: 2682781 - RNA, 16 nt, Human
cacagggugggccucg

SEQ ID NO: 2682782 - RNA, 13 nt, Human
cacagcucaggag

SEQ ID NO: 2682783 - RNA, 15 nt, Human
cacagcucaggaggc

SEQ ID NO: 2682784 - RNA, 14 nt, Human
cacagcgucccugg

SEQ ID NO: 2682785 - RNA, 15 nt, Human
cacagcgucccuggc

SEQ ID NO: 2682786 - RNA, 16 nt, Human
cacagcgucccuggcg

SEQ ID NO: 2682787 - RNA, 18 nt, Human
cacagcgucccuggcgca

SEQ ID NO: 2682788 - RNA, 19 nt, Human
cacagcgucccuggcgcag

SEQ ID NO: 2682789 - RNA, 22 nt, Human
cacagcgucccuggcgcaggug

SEQ ID NO: 2682790 - RNA, 21 nt, Human
cacagcggagguguggagccg

SEQ ID NO: 2682791 - RNA, 12 nt, Human
cacagaaugcaa

SEQ ID NO: 2682792 - RNA, 19 nt, Human
cacagaaugcaaccaaguc

SEQ ID NO: 2682793 - RNA, 16 nt, Human
cacagaauauuuuuau

SEQ ID NO: 2682794 - RNA, 18 nt, Human
cacagaauauuuuuauau

SEQ ID NO: 2682795 - RNA, 18 nt, Human
cacauccgcgugugccug

SEQ ID NO: 2682796 - RNA, 19 nt, Human
cacauccgcgugugccugu

SEQ ID NO: 2682797 - RNA, 22 nt, Human
cacauccgcgugugccugugug

SEQ ID NO: 2682798 - RNA, 23 nt, Human
cacauccgcgugugccugugugc

SEQ ID NO: 2682799 - RNA, 21 nt, Human
cacauuugcuacuguuguaag

SEQ ID NO: 2682800 - RNA, 15 nt, Human
caccaggcgcugccc

SEQ ID NO: 2682801 - RNA, 22 nt, Human
caccagcucugccgucucugga

SEQ ID NO: 2682802 - RNA, 22 nt, Human
caccaggccaccuccccagcau

SEQ ID NO: 2682803 - RNA, 15 nt, Human
caccaggccaccucc

SEQ ID NO: 2682804 - RNA, 19 nt, Human
caccaggccaccuccccag

SEQ ID NO: 2682805 - RNA, 13 nt, Human
caccaggccaccu

SEQ ID NO: 2682806 - RNA, 14 nt, Human
caccaggccaccuc

SEQ ID NO: 2682807 - RNA, 12 nt, Human
caccagcagccu

SEQ ID NO: 2682808 - RNA, 14 nt, Human
caccagcagccugg

SEQ ID NO: 2682809 - RNA, 12 nt, Human
caccaaaaacaa

SEQ ID NO: 2682810 - RNA, 13 nt, Human
caccaaaaacaaa

SEQ ID NO: 2682811 - RNA, 15 nt, Human
caccagcaucaccug

SEQ ID NO: 2682812 - RNA, 18 nt, Human
caccagcaucaccugccu

SEQ ID NO: 2682813 - RNA, 19 nt, Human
caccagcaucaccugccug

SEQ ID NO: 2682814 - RNA, 20 nt, Human
caccagcaucaccugccugu

SEQ ID NO: 2682815 - RNA, 15 nt, Human
caccagcagccugga

SEQ ID NO: 2682816 - RNA, 16 nt, Human
cuuuuguguaaugaaa

SEQ ID NO: 2682817 - RNA, 17 nt, Human
cuuuuguguaaugaaaa

SEQ ID NO: 2682818 - RNA, 12 nt, Human
cuuuuuuuguau

SEQ ID NO: 2682819 - RNA, 16 nt, Human
cuuuuuuuguaugugu

SEQ ID NO: 2682820 - RNA, 17 nt, Human
cuuuuuuuguaugugug

SEQ ID NO: 2682821 - RNA, 13 nt, Human
cuuuuuuuuuaag

SEQ ID NO: 2682822 - RNA, 14 nt, Human
cuuuuuuuuuaagu

SEQ ID NO: 2682823 - RNA, 18 nt, Human
cuuuuuuuuuaaguucuu

SEQ ID NO: 2682824 - RNA, 21 nt, Human
cuuuuuuuuuaaguucuuaug

SEQ ID NO: 2682825 - RNA, 22 nt, Human
cuuuuuuuuuuuuuuuuugguc

SEQ ID NO: 2682826 - RNA, 19 nt, Human
gaaaaaauauuuuccugcc

SEQ ID NO: 2682827 - RNA, 11 nt, Human
cuuuugcuuuu

SEQ ID NO: 2682828 - RNA, 20 nt, Human
cuuuugccuuuugcaaccag

SEQ ID NO: 2682829 - RNA, 20 nt, Human
cuuuugguaaagacuggcuu

SEQ ID NO: 2682830 - RNA, 21 nt, Human
cuuuugguaaagacuggcuuu

SEQ ID NO: 2682831 - RNA, 17 nt, Human
cuuuugcuuuuggcaaa

SEQ ID NO: 2682832 - RNA, 15 nt, Human
cuuuugcuuuuggca

SEQ ID NO: 2682833 - RNA, 16 nt, Human
gaaaacuucagaagca

SEQ ID NO: 2682834 - RNA, 17 nt, Human
gaaaagagacaggcagg

SEQ ID NO: 2682835 - RNA, 13 nt, Human
gaaaagagacagg

SEQ ID NO: 2682836 - RNA, 15 nt, Human
gaaaacugugauuuc

SEQ ID NO: 2682837 - RNA, 12 nt, Human
gaaaacuguguu

SEQ ID NO: 2682838 - RNA, 13 nt, Human
gaaaacuguguug

SEQ ID NO: 2682839 - RNA, 19 nt, Human
gaaaacuguguugccacag

SEQ ID NO: 2682840 - RNA, 22 nt, Human
gaaaauuacaguccaaaauacu

SEQ ID NO: 2682841 - RNA, 16 nt, Human
gaaaagcauuuuucaa

SEQ ID NO: 2682842 - RNA, 21 nt, Human
gaaaagccuaaucacaguuuu

SEQ ID NO: 2682843 - RNA, 16 nt, Human
gaaaagcagacauuuu

SEQ ID NO: 2682844 - RNA, 15 nt, Human
gaaaagcagacauuu

SEQ ID NO: 2682845 - RNA, 18 nt, Human
gaaaagagacaggcaggu

SEQ ID NO: 2682846 - RNA, 19 nt, Human
cuuuuauuaaugcacuuuc

SEQ ID NO: 2682847 - RNA, 14 nt, Human
cuuuuauuaaugca

SEQ ID NO: 2682848 - RNA, 16 nt, Human
cuuuuauuaaugcacu

SEQ ID NO: 2682849 - RNA, 13 nt, Human
gaaagacacugcc

SEQ ID NO: 2682850 - RNA, 14 nt, Human
gaaagacacugccu

SEQ ID NO: 2682851 - RNA, 15 nt, Human
gaaagacacugccug

SEQ ID NO: 2682852 - RNA, 18 nt, Human
gaaagacacugccugggc

SEQ ID NO: 2682853 - RNA, 19 nt, Human
gaaagacacugccugggcu

SEQ ID NO: 2682854 - RNA, 12 nt, Human
gaaacuuggcuc

SEQ ID NO: 2682855 - RNA, 17 nt, Human
gaaacuuguuucacuga

SEQ ID NO: 2682856 - RNA, 18 nt, Human
gaaacuuguuucacugaa

SEQ ID NO: 2682857 - RNA, 19 nt, Human
gaaacuuaaauguuauuau

SEQ ID NO: 2682858 - RNA, 21 nt, Human
gaaacuuaaauguuauuaucu

SEQ ID NO: 2682859 - RNA, 16 nt, Human
gaaaucaaagugcuau

SEQ ID NO: 2682860 - RNA, 14 nt, Human
gaaaucaaagugcu

SEQ ID NO: 2682861 - RNA, 12 nt, Human
gaaaucaaagug

SEQ ID NO: 2682862 - RNA, 20 nt, Human
gaaagacacugccugggcug

SEQ ID NO: 2682863 - RNA, 17 nt, Human
gaaaucaaagugcuauu

SEQ ID NO: 2682864 - RNA, 21 nt, Human
gaaaugaaauauuguuuccaa

SEQ ID NO: 2682865 - RNA, 13 nt, Human
gaaauuuugcuau

SEQ ID NO: 2682866 - RNA, 12 nt, Human
gaaauuuuguaa

SEQ ID NO: 2682867 - RNA, 13 nt, Human
gaaauuuuguaag

SEQ ID NO: 2682868 - RNA, 14 nt, Human
gaaauuuuguaaga

SEQ ID NO: 2682869 - RNA, 15 nt, Human
gaaauuuuguaagaa

SEQ ID NO: 2682870 - RNA, 17 nt, Human
gaaauuuuguaagaagg

SEQ ID NO: 2682871 - RNA, 19 nt, Human
gaaauuuuguaagaaggca

SEQ ID NO: 2682872 - RNA, 20 nt, Human
gaaauuuuguaagaaggcaa

SEQ ID NO: 2682873 - RNA, 13 nt, Human
gaacaagcuucag

SEQ ID NO: 2682874 - RNA, 18 nt, Human
gaacaagcuucaguaagu

SEQ ID NO: 2682875 - RNA, 15 nt, Human
cuucuucucaaagca

SEQ ID NO: 2682876 - RNA, 12 nt, Human
cuucuucuccau

SEQ ID NO: 2682877 - RNA, 16 nt, Human
cuucuuacgcaaugcu

SEQ ID NO: 2682878 - RNA, 15 nt, Human
cuucuaauugcugug

SEQ ID NO: 2682879 - RNA, 14 nt, Human
cuuccucuugucug

SEQ ID NO: 2682880 - RNA, 16 nt, Human
cuuccucuugucugau

SEQ ID NO: 2682881 - RNA, 18 nt, Human
cuuccucuugucugauuu

SEQ ID NO: 2682882 - RNA, 18 nt, Human
cuucuauagcaucacuua

SEQ ID NO: 2682883 - RNA, 22 nt, Human
cuucucugacuucugccuggag

SEQ ID NO: 2682884 - RNA, 16 nt, Human
cuucuauagcaucacu

SEQ ID NO: 2682885 - RNA, 12 nt, Human
cuucuaccugcc

SEQ ID NO: 2682886 - RNA, 13 nt, Human
cuucuaccugccc

SEQ ID NO: 2682887 - RNA, 14 nt, Human
cuucuaccugcccu

SEQ ID NO: 2682888 - RNA, 15 nt, Human
cuucuaccugcccuc

SEQ ID NO: 2682889 - RNA, 16 nt, Human
cuucuaccugcccuca

SEQ ID NO: 2682890 - RNA, 18 nt, Human
cuucuaccugcccucaag

SEQ ID NO: 2682891 - RNA, 19 nt, Human
cuucuaccugcccucaagg

SEQ ID NO: 2682892 - RNA, 16 nt, Human
cuuccauuuuaauuuu

SEQ ID NO: 2682893 - RNA, 12 nt, Human
cuuccauuccac

SEQ ID NO: 2682894 - RNA, 15 nt, Human
cuuccauuccacaca

SEQ ID NO: 2682895 - RNA, 17 nt, Human
cuuccauuccacacaga

SEQ ID NO: 2682896 - RNA, 22 nt, Human
cuuccauuccacacagaaugca

SEQ ID NO: 2682897 - RNA, 13 nt, Human
cuuccaugaauuu

SEQ ID NO: 2682898 - RNA, 18 nt, Human
cuuccaugaauuuuaaaa

SEQ ID NO: 2682899 - RNA, 19 nt, Human
cuuccaugaauuuuaaaau

SEQ ID NO: 2682900 - RNA, 20 nt, Human
cuuccaugaauuuuaaaauc

SEQ ID NO: 2682901 - RNA, 20 nt, Human
cuuaaagaaguauuuuuaga

SEQ ID NO: 2682902 - RNA, 18 nt, Human
cuugucuucugguacuuu

SEQ ID NO: 2682903 - RNA, 21 nt, Human
cuugucuucugguacuuucug

SEQ ID NO: 2682904 - RNA, 23 nt, Human
cuugucuucugguacuuucuguu

SEQ ID NO: 2682905 - RNA, 14 nt, Human
cuuuaagacauacu

SEQ ID NO: 2682906 - RNA, 17 nt, Human
cuuuaagccuucaaaac

SEQ ID NO: 2682907 - RNA, 18 nt, Human
cuuuaagccuucaaaacu

SEQ ID NO: 2682908 - RNA, 20 nt, Human
cuuuaagccuucaaaacuau

SEQ ID NO: 2682909 - RNA, 23 nt, Human
cuuuaagacauacuccuuccauc

SEQ ID NO: 2682910 - RNA, 16 nt, Human
cuugguucugugaaca

SEQ ID NO: 2682911 - RNA, 14 nt, Human
cuugucugauuucu

SEQ ID NO: 2682912 - RNA, 13 nt, Human
cuugucuguagau

SEQ ID NO: 2682913 - RNA, 13 nt, Human
cuugccuccaggu

SEQ ID NO: 2682914 - RNA, 14 nt, Human
cuugccuccaggug

SEQ ID NO: 2682915 - RNA, 15 nt, Human
cuugccuccaggugc

SEQ ID NO: 2682916 - RNA, 16 nt, Human
cuugccuccaggugca

SEQ ID NO: 2682917 - RNA, 18 nt, Human
cuugccuccaggugcaga

SEQ ID NO: 2682918 - RNA, 19 nt, Human
cuugccuccaggugcagag

SEQ ID NO: 2682919 - RNA, 21 nt, Human
cuugccuccaggugcagaggu

SEQ ID NO: 2682920 - RNA, 23 nt, Human
cuugccuccaggugcagagguac

SEQ ID NO: 2682921 - RNA, 19 nt, Human
cuugauuucaaaguuuugu

SEQ ID NO: 2682922 - RNA, 23 nt, Human
cuugauuucaaaguuuuguugua

SEQ ID NO: 2682923 - RNA, 17 nt, Human
cuugauucccuuguuau

SEQ ID NO: 2682924 - RNA, 20 nt, Human
cuugccuccccauuucccau

SEQ ID NO: 2682925 - RNA, 12 nt, Human
cuugccucccca

SEQ ID NO: 2682926 - RNA, 14 nt, Human
cuugccuccccauu

SEQ ID NO: 2682927 - RNA, 19 nt, Human
cuuggccuaaaccucaguu

SEQ ID NO: 2682928 - RNA, 18 nt, Human
cugcuaccuuucaaagcu

SEQ ID NO: 2682929 - RNA, 19 nt, Human
cugcuaccuuucaaagcuu

SEQ ID NO: 2682930 - RNA, 20 nt, Human
cugcuaccuuucaaagcuug

SEQ ID NO: 2682931 - RNA, 16 nt, Human
cugcuauccccaucuc

SEQ ID NO: 2682932 - RNA, 20 nt, Human
cugcuauccccaucucccug

SEQ ID NO: 2682933 - RNA, 21 nt, Human
cugcuauccccaucucccugc

SEQ ID NO: 2682934 - RNA, 23 nt, Human
cugcuauccccaucucccugccu

SEQ ID NO: 2682935 - RNA, 17 nt, Human
cugcuauuuauuuuccu

SEQ ID NO: 2682936 - RNA, 17 nt, Human
cugcuaucaaagagguu

SEQ ID NO: 2682937 - RNA, 19 nt, Human
cugcuauuuauuuuccuaa

SEQ ID NO: 2682938 - RNA, 20 nt, Human
cugcuauuuauuuuccuaaa

SEQ ID NO: 2682939 - RNA, 21 nt, Human
cugcuauuuauuuuccuaaag

SEQ ID NO: 2682940 - RNA, 17 nt, Human
cuggcucccuccuccag

SEQ ID NO: 2682941 - RNA, 18 nt, Human
cuggcucccuccuccagg

SEQ ID NO: 2682942 - RNA, 21 nt, Human
cuggcucccuccuccaggccu

SEQ ID NO: 2682943 - RNA, 22 nt, Human
cuggcucccuccuccaggccug

SEQ ID NO: 2682944 - RNA, 23 nt, Human
cuggcucccuccuccaggccugc

SEQ ID NO: 2682945 - RNA, 19 nt, Human
cuggcccuagacucggggu

SEQ ID NO: 2682946 - RNA, 13 nt, Human
cuggcccuagacu

SEQ ID NO: 2682947 - RNA, 20 nt, Human
cuggccgcgcuccgggcuuu

SEQ ID NO: 2682948 - RNA, 18 nt, Human
cuggccgcggagccugca

SEQ ID NO: 2682949 - RNA, 21 nt, Human
cugcuucagucccuuccccau

SEQ ID NO: 2682950 - RNA, 13 nt, Human
cuggaaaggggag

SEQ ID NO: 2682951 - RNA, 15 nt, Human
cuggaaaggggagag

SEQ ID NO: 2682952 - RNA, 16 nt, Human
cuggaaaggggagagc

SEQ ID NO: 2682953 - RNA, 17 nt, Human
cuggaaaggggagagcc

SEQ ID NO: 2682954 - RNA, 18 nt, Human
cuggaaaggggagagccu

SEQ ID NO: 2682955 - RNA, 19 nt, Human
cuggaaaggggagagccug

SEQ ID NO: 2682956 - RNA, 20 nt, Human
cuggaaaggggagagccugc

SEQ ID NO: 2682957 - RNA, 21 nt, Human
cuggaaaggggagagccugcu

SEQ ID NO: 2682958 - RNA, 22 nt, Human
cuggaaaggggagagccugcug

SEQ ID NO: 2682959 - RNA, 23 nt, Human
cuggaaaggggagagccugcugg

SEQ ID NO: 2682960 - RNA, 15 nt, Human
cugugaaugccacug

SEQ ID NO: 2682961 - RNA, 16 nt, Human
cugugaaugccacugc

SEQ ID NO: 2682962 - RNA, 20 nt, Human
cugugaaugccacugccuuc

SEQ ID NO: 2682963 - RNA, 21 nt, Human
cugugaaugccacugccuucg

SEQ ID NO: 2682964 - RNA, 15 nt, Human
cuguucacucacucu

SEQ ID NO: 2682965 - RNA, 12 nt, Human
cuguucagcugg

SEQ ID NO: 2682966 - RNA, 13 nt, Human
cuguuacugucuu

SEQ ID NO: 2682967 - RNA, 17 nt, Human
cuguuacugucuucagu

SEQ ID NO: 2682968 - RNA, 22 nt, Human
cuguguccaugcgcucagggcc

SEQ ID NO: 2682969 - RNA, 23 nt, Human
cuguguccaugcgcucagggcca

SEQ ID NO: 2682970 - RNA, 13 nt, Human
cuguguccaugcg

SEQ ID NO: 2682971 - RNA, 18 nt, Human
cuguguccaugcgcucag

SEQ ID NO: 2682972 - RNA, 19 nt, Human
cuguguccaugcgcucagg

SEQ ID NO: 2682973 - RNA, 21 nt, Human
cuguguccaugcgcucagggc

SEQ ID NO: 2682974 - RNA, 16 nt, Human
cuguguauuugcuuuu

SEQ ID NO: 2682975 - RNA, 14 nt, Human
cuguguauuugcuu

SEQ ID NO: 2682976 - RNA, 15 nt, Human
cuguguauuugcuuu

SEQ ID NO: 2682977 - RNA, 22 nt, Human
cuguguauauuugauuuauuaa

SEQ ID NO: 2682978 - RNA, 20 nt, Human
cuguguauauuugauuuauu

SEQ ID NO: 2682979 - RNA, 18 nt, Human
cuguguauauuugauuua

SEQ ID NO: 2682980 - RNA, 16 nt, Human
cuguguauauuugauu

SEQ ID NO: 2682981 - RNA, 15 nt, Human
cuguguauauuugau

SEQ ID NO: 2682982 - RNA, 12 nt, Human
cuguguauauuu

SEQ ID NO: 2682983 - RNA, 21 nt, Human
cuguguauaugguauauauac

SEQ ID NO: 2682984 - RNA, 15 nt, Human
cuguuggcaggcugg

SEQ ID NO: 2682985 - RNA, 16 nt, Human
cuguuggcaggcuggc

SEQ ID NO: 2682986 - RNA, 18 nt, Human
cuguuggcaggcuggcca

SEQ ID NO: 2682987 - RNA, 19 nt, Human
cuguuggcaggcuggccag

SEQ ID NO: 2682988 - RNA, 19 nt, Human
cuuaaacgaagaguucccu

SEQ ID NO: 2682989 - RNA, 19 nt, Human
cuuaaacacucaccuucua

SEQ ID NO: 2682990 - RNA, 15 nt, Human
cuuaaaaccaaagag

SEQ ID NO: 2682991 - RNA, 21 nt, Human
cuuaaaaccaaagagggcuuc

SEQ ID NO: 2682992 - RNA, 14 nt, Human
cuuaaaaccaaaga

SEQ ID NO: 2682993 - RNA, 13 nt, Human
cuuaaaaccaaag

SEQ ID NO: 2682994 - RNA, 22 nt, Human
cuuaaaauaaugaauacauuuc

SEQ ID NO: 2682995 - RNA, 14 nt, Human
cuguaaauauguuu

SEQ ID NO: 2682996 - RNA, 11 nt, Human
cuguaaaucau

SEQ ID NO: 2682997 - RNA, 15 nt, Human
cuguagagugggagc

SEQ ID NO: 2682998 - RNA, 16 nt, Human
cuguaacacuccucug

SEQ ID NO: 2682999 - RNA, 16 nt, Human
cuguagcacuuacugg

SEQ ID NO: 2683000 - RNA, 16 nt, Human
cuguagaugauguauu

SEQ ID NO: 2683001 - RNA, 14 nt, Human
cuguagauauguau

SEQ ID NO: 2683002 - RNA, 18 nt, Human
cuguagauauguauucuu

SEQ ID NO: 2683003 - RNA, 20 nt, Human
cuguagauauguauucuuuu

SEQ ID NO: 2683004 - RNA, 13 nt, Human
cuguagaugaugu

SEQ ID NO: 2683005 - RNA, 22 nt, Human
cugucggcgcugccccaucucc

SEQ ID NO: 2683006 - RNA, 15 nt, Human
cugucggugggaccu

SEQ ID NO: 2683007 - RNA, 23 nt, Human
cugucggcgcugccccaucuccc

SEQ ID NO: 2683008 - RNA, 20 nt, Human
cugucggcgcugccccaucu

SEQ ID NO: 2683009 - RNA, 15 nt, Human
cugucuaaaguguau

SEQ ID NO: 2683010 - RNA, 12 nt, Human
cuguccuguccu

SEQ ID NO: 2683011 - RNA, 14 nt, Human
cuguccuguccugc

SEQ ID NO: 2683012 - RNA, 16 nt, Human
cuguccuguccugcuc

SEQ ID NO: 2683013 - RNA, 15 nt, Human
cugucauugcacaua

SEQ ID NO: 2683014 - RNA, 21 nt, Human
cuguagcuauaaugagcaugu

SEQ ID NO: 2683015 - RNA, 14 nt, Human
cuguagcugccaug

SEQ ID NO: 2683016 - RNA, 16 nt, Human
cuguagcuuuuaggaa

SEQ ID NO: 2683017 - RNA, 16 nt, Human
cugucaguaugacauu

SEQ ID NO: 2683018 - RNA, 16 nt, Human
cugucaggccuucagg

SEQ ID NO: 2683019 - RNA, 16 nt, Human
cugucaggcugaaaac

SEQ ID NO: 2683020 - RNA, 18 nt, Human
cugucaggcugaaaacaa

SEQ ID NO: 2683021 - RNA, 19 nt, Human
cugucaggcugaaaacaau

SEQ ID NO: 2683022 - RNA, 17 nt, Human
gaauaucuauuaauaua

SEQ ID NO: 2683023 - RNA, 19 nt, Human
gaauauccuuuaaaauuua

SEQ ID NO: 2683024 - RNA, 16 nt, Human
gaauaugcaacauugu

SEQ ID NO: 2683025 - RNA, 13 nt, Human
gaauauggacaua

SEQ ID NO: 2683026 - RNA, 21 nt, Human
gaauaugauuaaaaauaucaa

SEQ ID NO: 2683027 - RNA, 19 nt, Human
gaauaugauuaaaaauauc

SEQ ID NO: 2683028 - RNA, 13 nt, Human
gaauauugcaaaa

SEQ ID NO: 2683029 - RNA, 14 nt, Human
gaauauugcaaaau

SEQ ID NO: 2683030 - RNA, 18 nt, Human
gaauauugcaaaauacau

SEQ ID NO: 2683031 - RNA, 20 nt, Human
gaauauugcaaaauacauga

SEQ ID NO: 2683032 - RNA, 21 nt, Human
gaauauugcaaaauacaugaa

SEQ ID NO: 2683033 - RNA, 22 nt, Human
gaauauacaugaagaauagaaa

SEQ ID NO: 2683034 - RNA, 20 nt, Human
gaauauaucucuauuugaga

SEQ ID NO: 2683035 - RNA, 15 nt, Human
gaaugaggugggagg

SEQ ID NO: 2683036 - RNA, 22 nt, Human
gaaugaggugggagguggaaga

SEQ ID NO: 2683037 - RNA, 21 nt, Human
gaaugagucuguuguguguca

SEQ ID NO: 2683038 - RNA, 20 nt, Human
gaaugaugauccuaggcauu

SEQ ID NO: 2683039 - RNA, 14 nt, Human
gaaugauuugcaua

SEQ ID NO: 2683040 - RNA, 21 nt, Human
gaauuaaauuaggaauaaaua

SEQ ID NO: 2683041 - RNA, 20 nt, Human
gaauuaaauuaggaauaaau

SEQ ID NO: 2683042 - RNA, 14 nt, Human
gaauuaaaaaagca

SEQ ID NO: 2683043 - RNA, 19 nt, Human
gaaugcaaccaagucacac

SEQ ID NO: 2683044 - RNA, 19 nt, Human
gaauuaccaagaauauccu

SEQ ID NO: 2683045 - RNA, 19 nt, Human
gaauuacgugcucuguggg

SEQ ID NO: 2683046 - RNA, 15 nt, Human
gaauuacgugcucug

SEQ ID NO: 2683047 - RNA, 12 nt, Human
gacaaagugcca

SEQ ID NO: 2683048 - RNA, 16 nt, Human
gacaaagugccaaaga

SEQ ID NO: 2683049 - RNA, 17 nt, Human
gacaaagugccaaagaa

SEQ ID NO: 2683050 - RNA, 18 nt, Human
gacaaagugccaaagaaa

SEQ ID NO: 2683051 - RNA, 19 nt, Human
gacaaagugccaaagaaag

SEQ ID NO: 2683052 - RNA, 11 nt, Human
gacaaauauuc

SEQ ID NO: 2683053 - RNA, 22 nt, Human
gacaaauauuccuuugcauauu

SEQ ID NO: 2683054 - RNA, 18 nt, Human
gacaaaaaauguuuuaaa

SEQ ID NO: 2683055 - RNA, 13 nt, Human
gaauuuuuuugua

SEQ ID NO: 2683056 - RNA, 14 nt, Human
gaauuuuuuuguaa

SEQ ID NO: 2683057 - RNA, 21 nt, Human
gaauuaugcuuuguagaguuu

SEQ ID NO: 2683058 - RNA, 17 nt, Human
gaauuagauuucuauag

SEQ ID NO: 2683059 - RNA, 12 nt, Human
gaauuauugaca

SEQ ID NO: 2683060 - RNA, 14 nt, Human
gaauuauugacacu

SEQ ID NO: 2683061 - RNA, 15 nt, Human
gaauuauugacacug

SEQ ID NO: 2683062 - RNA, 16 nt, Human
gaauuauugacacuga

SEQ ID NO: 2683063 - RNA, 17 nt, Human
gaauuauugacacugaa

SEQ ID NO: 2683064 - RNA, 22 nt, Human
gaauucaaacuggggccuccag

SEQ ID NO: 2683065 - RNA, 21 nt, Human
gaauucaaacuggggccucca

SEQ ID NO: 2683066 - RNA, 18 nt, Human
gaauucaaacuggggccu

SEQ ID NO: 2683067 - RNA, 16 nt, Human
gaauucaaacuggggc

SEQ ID NO: 2683068 - RNA, 15 nt, Human
gaauuauuuuucacu

SEQ ID NO: 2683069 - RNA, 20 nt, Human
gacauuuuaaaaaaugguca

SEQ ID NO: 2683070 - RNA, 17 nt, Human
gacauguuuuccgugaa

SEQ ID NO: 2683071 - RNA, 18 nt, Human
gacccggaggccgaggcc

SEQ ID NO: 2683072 - RNA, 19 nt, Human
gaccucaggugagaagcag

SEQ ID NO: 2683073 - RNA, 18 nt, Human
gaccucaggugagaagca

SEQ ID NO: 2683074 - RNA, 21 nt, Human
gaccucaggugagaagcagag

SEQ ID NO: 2683075 - RNA, 11 nt, Human
gacccuccaaa

SEQ ID NO: 2683076 - RNA, 13 nt, Human
gacccucuugccc

SEQ ID NO: 2683077 - RNA, 14 nt, Human
gacccucuugccca

SEQ ID NO: 2683078 - RNA, 17 nt, Human
gacccucuugcccaucc

SEQ ID NO: 2683079 - RNA, 19 nt, Human
gacccucuugcccauccug

SEQ ID NO: 2683080 - RNA, 20 nt, Human
gacccucuugcccauccuga

SEQ ID NO: 2683081 - RNA, 22 nt, Human
gacccucuugcccauccugacu

SEQ ID NO: 2683082 - RNA, 20 nt, Human
gaccuccacacccgugagaa

SEQ ID NO: 2683083 - RNA, 16 nt, Human
gacgccaugugaugga

SEQ ID NO: 2683084 - RNA, 22 nt, Human
gacgccaugugauggacacucc

SEQ ID NO: 2683085 - RNA, 11 nt, Human
gacgcccaccc

SEQ ID NO: 2683086 - RNA, 14 nt, Human
gacgccacucauuu

SEQ ID NO: 2683087 - RNA, 16 nt, Human
gacgccacucauuuca

SEQ ID NO: 2683088 - RNA, 17 nt, Human
gacgccacucauuucau

SEQ ID NO: 2683089 - RNA, 18 nt, Human
gacgccacucauuucauc

SEQ ID NO: 2683090 - RNA, 19 nt, Human
gacgccacucauuucaucu

SEQ ID NO: 2683091 - RNA, 21 nt, Human
gacgccacucauuucaucuca

SEQ ID NO: 2683092 - RNA, 23 nt, Human
gacgccacucauuucaucucauu

SEQ ID NO: 2683093 - RNA, 17 nt, Human
gagauugguuuuccugu

SEQ ID NO: 2683094 - RNA, 21 nt, Human
gagauugugccacuucacucc

SEQ ID NO: 2683095 - RNA, 14 nt, Human
gagagggagagaga

SEQ ID NO: 2683096 - RNA, 13 nt, Human
gagauuauaauaa

SEQ ID NO: 2683097 - RNA, 16 nt, Human
gagauguguggacugu

SEQ ID NO: 2683098 - RNA, 20 nt, Human
gagauguguggacuguggca

SEQ ID NO: 2683099 - RNA, 21 nt, Human
gagagcuagcagcagggaggg

SEQ ID NO: 2683100 - RNA, 15 nt, Human
gagagcuagcagcag

SEQ ID NO: 2683101 - RNA, 13 nt, Human
gagacucagugca

SEQ ID NO: 2683102 - RNA, 15 nt, Human
gagacucagugcaga

SEQ ID NO: 2683103 - RNA, 16 nt, Human
gagacucagugcagau

SEQ ID NO: 2683104 - RNA, 23 nt, Human
gagacucagugcagauggagaga

SEQ ID NO: 2683105 - RNA, 20 nt, Human
gagacguuuauaaacagaaa

SEQ ID NO: 2683106 - RNA, 23 nt, Human
gagacguuuauaaacagaaaugg

SEQ ID NO: 2683107 - RNA, 18 nt, Human
gagacgguguuuugccau

SEQ ID NO: 2683108 - RNA, 17 nt, Human
gagacgguuuccaggga

SEQ ID NO: 2683109 - RNA, 19 nt, Human
gagacgguuuccagggagg

SEQ ID NO: 2683110 - RNA, 23 nt, Human
gagacgguuuccagggaggggcc

SEQ ID NO: 2683111 - RNA, 10 nt, Human
gagagggaga

SEQ ID NO: 2683112 - RNA, 14 nt, Human
gagaggcaaugauu

SEQ ID NO: 2683113 - RNA, 10 nt, Human
gagaggacag

SEQ ID NO: 2683114 - RNA, 19 nt, Human
gagaggacaauacuggggu

SEQ ID NO: 2683115 - RNA, 15 nt, Human
gagaggacagcuuga

SEQ ID NO: 2683116 - RNA, 18 nt, Human
gagaggacagcuugagcc

SEQ ID NO: 2683117 - RNA, 20 nt, Human
gagaggacuguagggagggc

SEQ ID NO: 2683118 - RNA, 18 nt, Human
gagaggaaauucuccacu

SEQ ID NO: 2683119 - RNA, 18 nt, Human
gagaaaaaugcuccccac

SEQ ID NO: 2683120 - RNA, 16 nt, Human
gacuuuuuauaaaaug

SEQ ID NO: 2683121 - RNA, 13 nt, Human
gacuuuuuuugua

SEQ ID NO: 2683122 - RNA, 17 nt, Human
gacuuuuuuuguaugug

SEQ ID NO: 2683123 - RNA, 13 nt, Human
gagaagguuuauu

SEQ ID NO: 2683124 - RNA, 15 nt, Human
gagaagguuuauugu

SEQ ID NO: 2683125 - RNA, 16 nt, Human
gagaagguuuauuguu

SEQ ID NO: 2683126 - RNA, 17 nt, Human
gagaagguuuauuguua

SEQ ID NO: 2683127 - RNA, 22 nt, Human
gagaccgugaagauacuuugua

SEQ ID NO: 2683128 - RNA, 20 nt, Human
gagaccgugaagauacuuug

SEQ ID NO: 2683129 - RNA, 20 nt, Human
gagaccgggguauccugggg

SEQ ID NO: 2683130 - RNA, 18 nt, Human
gagaccgggcccuggguu

SEQ ID NO: 2683131 - RNA, 20 nt, Human
gagaccgggcccuggguucc

SEQ ID NO: 2683132 - RNA, 19 nt, Human
gagaccuggcacuggaugc

SEQ ID NO: 2683133 - RNA, 16 nt, Human
gagaaguuguaaagua

SEQ ID NO: 2683134 - RNA, 21 nt, Human
gagacccugucucaaaaaaag

SEQ ID NO: 2683135 - RNA, 12 nt, Human
gagcuggcucug

SEQ ID NO: 2683136 - RNA, 11 nt, Human
gagcuggccuc

SEQ ID NO: 2683137 - RNA, 16 nt, Human
gagcuggccucucuag

SEQ ID NO: 2683138 - RNA, 20 nt, Human
gagcaucggccuagggcccc

SEQ ID NO: 2683139 - RNA, 13 nt, Human
gaggaccagggcc

SEQ ID NO: 2683140 - RNA, 14 nt, Human
gaggaccagggccu

SEQ ID NO: 2683141 - RNA, 11 nt, Human
gaggacccagg

SEQ ID NO: 2683142 - RNA, 12 nt, Human
gaggacccagga

SEQ ID NO: 2683143 - RNA, 20 nt, Human
gaggacuguagggagggcgg

SEQ ID NO: 2683144 - RNA, 21 nt, Human
gaggacuguagggagggcggc

SEQ ID NO: 2683145 - RNA, 20 nt, Human
gaggacccaggaaaggcagg

SEQ ID NO: 2683146 - RNA, 20 nt, Human
gaggggagacuuugauguca

SEQ ID NO: 2683147 - RNA, 11 nt, Human
gaggggagggg

SEQ ID NO: 2683148 - RNA, 12 nt, Human
gaggggagggua

SEQ ID NO: 2683149 - RNA, 18 nt, Human
gaggccaagaauauugca

SEQ ID NO: 2683150 - RNA, 22 nt, Human
gaggccaagaauauugcaaaau

SEQ ID NO: 2683151 - RNA, 14 nt, Human
gcagccaaccuaag

SEQ ID NO: 2683152 - RNA, 15 nt, Human
gcagaggccagaggc

SEQ ID NO: 2683153 - RNA, 21 nt, Human
gcagaacgaaccuuggccugg

SEQ ID NO: 2683154 - RNA, 22 nt, Human
gcagaacgaaccuuggccuggg

SEQ ID NO: 2683155 - RNA, 12 nt, Human
gcagagcuggcu

SEQ ID NO: 2683156 - RNA, 13 nt, Human
gcagagcuggcuc

SEQ ID NO: 2683157 - RNA, 14 nt, Human
gcagagcuggcucu

SEQ ID NO: 2683158 - RNA, 15 nt, Human
gcagagcuggcucug

SEQ ID NO: 2683159 - RNA, 17 nt, Human
gcagagcuggcucugag

SEQ ID NO: 2683160 - RNA, 23 nt, Human
gcagagcuggcucugagcgccuc

SEQ ID NO: 2683161 - RNA, 12 nt, Human
gcagaggccaga

SEQ ID NO: 2683162 - RNA, 14 nt, Human
gcagaggaccaggg

SEQ ID NO: 2683163 - RNA, 16 nt, Human
gcagaggaccagggcc

SEQ ID NO: 2683164 - RNA, 17 nt, Human
gcagaggaccagggccu

SEQ ID NO: 2683165 - RNA, 22 nt, Human
gcagaaaaucuuuuacuagugu

SEQ ID NO: 2683166 - RNA, 19 nt, Human
gcagaaaaaggcugugcug

SEQ ID NO: 2683167 - RNA, 17 nt, Human
gcagaaaaaggcugugc

SEQ ID NO: 2683168 - RNA, 14 nt, Human
gcacuccagccugg

SEQ ID NO: 2683169 - RNA, 18 nt, Human
gcagcccaccccucaaca

SEQ ID NO: 2683170 - RNA, 13 nt, Human
gcagccaguucaa

SEQ ID NO: 2683171 - RNA, 14 nt, Human
gcaguuuaucauuc

SEQ ID NO: 2683172 - RNA, 22 nt, Human
gcaguuggccagagagccuggu

SEQ ID NO: 2683173 - RNA, 14 nt, Human
gcaguuggccagag

SEQ ID NO: 2683174 - RNA, 19 nt, Human
gcaguugcugguaaaauga

SEQ ID NO: 2683175 - RNA, 18 nt, Human
gcaguugcugguaaaaug

SEQ ID NO: 2683176 - RNA, 23 nt, Human
gcaguugcugguaaaaugaagaa

SEQ ID NO: 2683177 - RNA, 16 nt, Human
gcagucgugccugugu

SEQ ID NO: 2683178 - RNA, 17 nt, Human
gcagucgugccuguguc

SEQ ID NO: 2683179 - RNA, 18 nt, Human
gcagucgugccugugucc

SEQ ID NO: 2683180 - RNA, 19 nt, Human
gcagucgugccugugucca

SEQ ID NO: 2683181 - RNA, 11 nt, Human
gcauccagccu

SEQ ID NO: 2683182 - RNA, 21 nt, Human
gcaucccuaccgacccagggu

SEQ ID NO: 2683183 - RNA, 18 nt, Human
gcaucccuaccgacccag

SEQ ID NO: 2683184 - RNA, 12 nt, Human
gcaucccugaga

SEQ ID NO: 2683185 - RNA, 13 nt, Human
gcaucccugagac

SEQ ID NO: 2683186 - RNA, 22 nt, Human
gcaucccuuuuucauaaauuau

SEQ ID NO: 2683187 - RNA, 13 nt, Human
gcauggcccuggg

SEQ ID NO: 2683188 - RNA, 20 nt, Human
gcaucggccuagggccccca

SEQ ID NO: 2683189 - RNA, 16 nt, Human
gcaucggccuagggcc

SEQ ID NO: 2683190 - RNA, 14 nt, Human
gcauggcccugggc

SEQ ID NO: 2683191 - RNA, 13 nt, Human
gcaugguggccag

SEQ ID NO: 2683192 - RNA, 14 nt, Human
gcaugguggccaga

SEQ ID NO: 2683193 - RNA, 15 nt, Human
gcaugguggccagag

SEQ ID NO: 2683194 - RNA, 16 nt, Human
gcaugguggccagagg

SEQ ID NO: 2683195 - RNA, 19 nt, Human
gcaugguuuugugccaucu

SEQ ID NO: 2683196 - RNA, 21 nt, Human
gcaugguuuugugccaucugu

SEQ ID NO: 2683197 - RNA, 15 nt, Human
gcauguaaauguaaa

SEQ ID NO: 2683198 - RNA, 17 nt, Human
gcauguaaauguaaacu

SEQ ID NO: 2683199 - RNA, 19 nt, Human
gcauguaaauguaaacuca

SEQ ID NO: 2683200 - RNA, 20 nt, Human
gcaaccaggaacagcaaaug

SEQ ID NO: 2683201 - RNA, 15 nt, Human
gcaaccaggaacagc

SEQ ID NO: 2683202 - RNA, 17 nt, Human
gcaaccaggaacagcaa

SEQ ID NO: 2683203 - RNA, 11 nt, Human
gcaaccaggaa

SEQ ID NO: 2683204 - RNA, 14 nt, Human
gcaaccacuaagaa

SEQ ID NO: 2683205 - RNA, 15 nt, Human
gcaaccaagucacac

SEQ ID NO: 2683206 - RNA, 14 nt, Human
gcaacauucauugc

SEQ ID NO: 2683207 - RNA, 22 nt, Human
gcaacaggguauggacuaucug

SEQ ID NO: 2683208 - RNA, 13 nt, Human
gcaaaaggccucu

SEQ ID NO: 2683209 - RNA, 16 nt, Human
gcaaaaggccucuugu

SEQ ID NO: 2683210 - RNA, 17 nt, Human
gcaaaaggccucuugua

SEQ ID NO: 2683211 - RNA, 23 nt, Human
gcaaaaggccucuuguaaagacu

SEQ ID NO: 2683212 - RNA, 10 nt, Human
gcaaaauaug

SEQ ID NO: 2683213 - RNA, 13 nt, Human
gcaaaauauguuu

SEQ ID NO: 2683214 - RNA, 13 nt, Human
gcaaaauaaaaca

SEQ ID NO: 2683215 - RNA, 15 nt, Human
gcaaaauaaaacaua

SEQ ID NO: 2683216 - RNA, 21 nt, Human
gcaaaauaaaacauagcaaau

SEQ ID NO: 2683217 - RNA, 13 nt, Human
gcaaaauacauga

SEQ ID NO: 2683218 - RNA, 14 nt, Human
gcaaaauacaugaa

SEQ ID NO: 2683219 - RNA, 17 nt, Human
gcaaaauacaugaagcu

SEQ ID NO: 2683220 - RNA, 13 nt, Human
gauggaauuuuuu

SEQ ID NO: 2683221 - RNA, 19 nt, Human
gauuuaaucugccaagggc

SEQ ID NO: 2683222 - RNA, 14 nt, Human
gcaaaaaggcagga

SEQ ID NO: 2683223 - RNA, 22 nt, Human
gcaaaagaugcuucucacugcc

SEQ ID NO: 2683224 - RNA, 17 nt, Human
gcaaaagaugcuucuca

SEQ ID NO: 2683225 - RNA, 20 nt, Human
gauuuauuaacuuaauaauc

SEQ ID NO: 2683226 - RNA, 18 nt, Human
gaucugcugcagagcagu

SEQ ID NO: 2683227 - RNA, 17 nt, Human
gaucugcugcagagcag

SEQ ID NO: 2683228 - RNA, 16 nt, Human
gaucugcugcagagca

SEQ ID NO: 2683229 - RNA, 11 nt, Human
gaucugcccau

SEQ ID NO: 2683230 - RNA, 13 nt, Human
gaucugcccaucg

SEQ ID NO: 2683231 - RNA, 18 nt, Human
gaucugcccaucgugaag

SEQ ID NO: 2683232 - RNA, 19 nt, Human
gaucugcccaucgugaaga

SEQ ID NO: 2683233 - RNA, 21 nt, Human
gaucugcccaucgugaagaag

SEQ ID NO: 2683234 - RNA, 23 nt, Human
gaucugcccaucgugaagaagcc

SEQ ID NO: 2683235 - RNA, 19 nt, Human
gaucucuugagccugggag

SEQ ID NO: 2683236 - RNA, 13 nt, Human
gaucugagggaga

SEQ ID NO: 2683237 - RNA, 18 nt, Human
gaucucuugagccuggga

SEQ ID NO: 2683238 - RNA, 14 nt, Human
gaucucuccuggcc

SEQ ID NO: 2683239 - RNA, 16 nt, Human
gaucucuccuggccua

SEQ ID NO: 2683240 - RNA, 14 nt, Human
gauccacuuugggg

SEQ ID NO: 2683241 - RNA, 18 nt, Human
gauccacucgccucagcc

SEQ ID NO: 2683242 - RNA, 18 nt, Human
gauggaaaaacugaggcu

SEQ ID NO: 2683243 - RNA, 18 nt, Human
gauggaaaaguguccuuc

SEQ ID NO: 2683244 - RNA, 14 nt, Human
gaugauccuaggca

SEQ ID NO: 2683245 - RNA, 13 nt, Human
gaugauccuaggc

SEQ ID NO: 2683246 - RNA, 14 nt, Human
gaugauuuaagugu

SEQ ID NO: 2683247 - RNA, 21 nt, Human
gauacugcgacuuucugccug

SEQ ID NO: 2683248 - RNA, 23 nt, Human
gauacugcgacuuucugccugga

SEQ ID NO: 2683249 - RNA, 17 nt, Human
gauacugcgacuuucug

SEQ ID NO: 2683250 - RNA, 18 nt, Human
gauacugcgacuuucugc

SEQ ID NO: 2683251 - RNA, 19 nt, Human
gauacugcgacuuucugcc

SEQ ID NO: 2683252 - RNA, 20 nt, Human
gauacugcgacuuucugccu

SEQ ID NO: 2683253 - RNA, 13 nt, Human
gauaccagcugga

SEQ ID NO: 2683254 - RNA, 19 nt, Human
gauacaguuuucagaaaaa

SEQ ID NO: 2683255 - RNA, 14 nt, Human
gaucaaaaaggcuu

SEQ ID NO: 2683256 - RNA, 23 nt, Human
gaucaaaaaggcuuauaaaacag

SEQ ID NO: 2683257 - RNA, 20 nt, Human
gaucaaaaaggcuuauaaaa

SEQ ID NO: 2683258 - RNA, 23 nt, Human
gauacuuuguauuguccuauuag

SEQ ID NO: 2683259 - RNA, 19 nt, Human
gauacuuuguauuguccua

SEQ ID NO: 2683260 - RNA, 16 nt, Human
gauacuuuguauuguc

SEQ ID NO: 2683261 - RNA, 16 nt, Human
gauccacccaacccua

SEQ ID NO: 2683262 - RNA, 17 nt, Human
gauccacccaacccuau

SEQ ID NO: 2683263 - RNA, 11 nt, Human
gauccaaagac

SEQ ID NO: 2683264 - RNA, 12 nt, Human
gauccaaagacu

SEQ ID NO: 2683265 - RNA, 21 nt, Human
gcugccucccuuguggcagca

SEQ ID NO: 2683266 - RNA, 13 nt, Human
gcugccucuuucc

SEQ ID NO: 2683267 - RNA, 18 nt, Human
gcugccuauugauuuaag

SEQ ID NO: 2683268 - RNA, 20 nt, Human
gcugcccccaccccggggac

SEQ ID NO: 2683269 - RNA, 13 nt, Human
gcugccccucuca

SEQ ID NO: 2683270 - RNA, 14 nt, Human
gcugccccucucac

SEQ ID NO: 2683271 - RNA, 15 nt, Human
gcugccccucucacc

SEQ ID NO: 2683272 - RNA, 16 nt, Human
gcugccccucucacca

SEQ ID NO: 2683273 - RNA, 18 nt, Human
gcugccccucucaccaaa

SEQ ID NO: 2683274 - RNA, 15 nt, Human
gcugcccccaccccg

SEQ ID NO: 2683275 - RNA, 16 nt, Human
gcugcagcaccgaggg

SEQ ID NO: 2683276 - RNA, 20 nt, Human
gcugcagcaccgaggggccu

SEQ ID NO: 2683277 - RNA, 23 nt, Human
gcugcagcaccgaggggccuuug

SEQ ID NO: 2683278 - RNA, 15 nt, Human
gcugcaauucccugg

SEQ ID NO: 2683279 - RNA, 16 nt, Human
gcugcaauucccugga

SEQ ID NO: 2683280 - RNA, 19 nt, Human
gcugcacccucaggcaggu

SEQ ID NO: 2683281 - RNA, 18 nt, Human
gcugcacccucaggcagg

SEQ ID NO: 2683282 - RNA, 14 nt, Human
gcugaggugggagg

SEQ ID NO: 2683283 - RNA, 23 nt, Human
gcugagggugagugggugaauaa

SEQ ID NO: 2683284 - RNA, 18 nt, Human
gcugagggugagugggug

SEQ ID NO: 2683285 - RNA, 14 nt, Human
gcugaggguuugaa

SEQ ID NO: 2683286 - RNA, 10 nt, Human
gcugcucuuc

SEQ ID NO: 2683287 - RNA, 22 nt, Human
gcugcucuucaucccauuccag

SEQ ID NO: 2683288 - RNA, 23 nt, Human
gcuggacuucuaccugcccucaa

SEQ ID NO: 2683289 - RNA, 16 nt, Human
gcuggcucugagcgcc

SEQ ID NO: 2683290 - RNA, 13 nt, Human
gcuggcucugagc

SEQ ID NO: 2683291 - RNA, 17 nt, Human
gcugguacaacggaggc

SEQ ID NO: 2683292 - RNA, 23 nt, Human
gcugguaaaaugaagaauuuaaa

SEQ ID NO: 2683293 - RNA, 14 nt, Human
gcugguaaaaugaa

SEQ ID NO: 2683294 - RNA, 18 nt, Human
gcugguaaaaugaagaau

SEQ ID NO: 2683295 - RNA, 16 nt, Human
gcugguaaaaugaaga

SEQ ID NO: 2683296 - RNA, 17 nt, Human
gcugggccauguccaaa

SEQ ID NO: 2683297 - RNA, 19 nt, Human
gcugggccauguccaaaga

SEQ ID NO: 2683298 - RNA, 20 nt, Human
gcugggccauguccaaagag

SEQ ID NO: 2683299 - RNA, 14 nt, Human
gcugggcagguugg

SEQ ID NO: 2683300 - RNA, 19 nt, Human
gcugugcugcccugaagaa

SEQ ID NO: 2683301 - RNA, 16 nt, Human
gcugugcugcccugaa

SEQ ID NO: 2683302 - RNA, 17 nt, Human
gcugugcugcccugaag

SEQ ID NO: 2683303 - RNA, 16 nt, Human
gcugugcuaugaauuu

SEQ ID NO: 2683304 - RNA, 15 nt, Human
gcugugcuaugaauu

SEQ ID NO: 2683305 - RNA, 14 nt, Human
gcugugcuaugaau

SEQ ID NO: 2683306 - RNA, 13 nt, Human
gcugugagggagg

SEQ ID NO: 2683307 - RNA, 14 nt, Human
gcugugagggaggg

SEQ ID NO: 2683308 - RNA, 15 nt, Human
gcugugagggagggg

SEQ ID NO: 2683309 - RNA, 23 nt, Human
gcugugagggaggggaaaagcau

SEQ ID NO: 2683310 - RNA, 13 nt, Human
gcugugcaacgcc

SEQ ID NO: 2683311 - RNA, 19 nt, Human
gcugugcaacgccgugggc

SEQ ID NO: 2683312 - RNA, 20 nt, Human
gcugugcaacgccgugggcu

SEQ ID NO: 2683313 - RNA, 23 nt, Human
gcugugcaacgccgugggcugcg

SEQ ID NO: 2683314 - RNA, 19 nt, Human
gcugugcaacggucuccug

SEQ ID NO: 2683315 - RNA, 18 nt, Human
gcuuuucuguauuuuauu

SEQ ID NO: 2683316 - RNA, 17 nt, Human
gcuuuucugcccuggcu

SEQ ID NO: 2683317 - RNA, 16 nt, Human
gcuuuucugcccuggc

SEQ ID NO: 2683318 - RNA, 15 nt, Human
gcuuuuccuuggcau

SEQ ID NO: 2683319 - RNA, 18 nt, Human
gcuuuucugcccuggcug

SEQ ID NO: 2683320 - RNA, 19 nt, Human
gcuuuucugcccuggcugc

SEQ ID NO: 2683321 - RNA, 22 nt, Human
gcuuuucugcccuggcugcugc

SEQ ID NO: 2683322 - RNA, 14 nt, Human
gcuuuucuguauuu

SEQ ID NO: 2683323 - RNA, 18 nt, Human
ggaaacucacacuccccu

SEQ ID NO: 2683324 - RNA, 18 nt, Human
ggaaacuccacaucugcc

SEQ ID NO: 2683325 - RNA, 20 nt, Human
ggaaacuccacaucugccuu

SEQ ID NO: 2683326 - RNA, 21 nt, Human
ggaaacuccacaucugccuua

SEQ ID NO: 2683327 - RNA, 14 nt, Human
ggaaagacacugcc

SEQ ID NO: 2683328 - RNA, 20 nt, Human
ggaaagacacugccugggcu

SEQ ID NO: 2683329 - RNA, 15 nt, Human
ggaaagacacugccu

SEQ ID NO: 2683330 - RNA, 16 nt, Human
ggaaagacacugccug

SEQ ID NO: 2683331 - RNA, 15 nt, Human
ggaaagcaauaaaug

SEQ ID NO: 2683332 - RNA, 16 nt, Human
gcuuugccauugugaa

SEQ ID NO: 2683333 - RNA, 16 nt, Human
gcuuugccaugugcuu

SEQ ID NO: 2683334 - RNA, 12 nt, Human
gcuuaauaccaa

SEQ ID NO: 2683335 - RNA, 15 nt, Human
gcuuaaucauuuuca

SEQ ID NO: 2683336 - RNA, 16 nt, Human
gcuuaaucauuuucau

SEQ ID NO: 2683337 - RNA, 21 nt, Human
gcuuaaucauuuucauuccua

SEQ ID NO: 2683338 - RNA, 22 nt, Human
gcuuaaucuucaaagccuucuc

SEQ ID NO: 2683339 - RNA, 19 nt, Human
gcuguuugagauucucaaa

SEQ ID NO: 2683340 - RNA, 18 nt, Human
ggaaaucagccaaguuuu

SEQ ID NO: 2683341 - RNA, 23 nt, Human
ggaaaucagccaaguuuuauaau

SEQ ID NO: 2683342 - RNA, 14 nt, Human
ggaagcccaggagc

SEQ ID NO: 2683343 - RNA, 19 nt, Human
ggaagcccaggagccucac

SEQ ID NO: 2683344 - RNA, 14 nt, Human
ggaagcccauccug

SEQ ID NO: 2683345 - RNA, 18 nt, Human
ggacaguaucccacaucc

SEQ ID NO: 2683346 - RNA, 13 nt, Human
ggacauccuccuc

SEQ ID NO: 2683347 - RNA, 21 nt, Human
ggacaucacagggugggccuc

SEQ ID NO: 2683348 - RNA, 16 nt, Human
ggacauccuccuccca

SEQ ID NO: 2683349 - RNA, 16 nt, Human
ggacaugcaauaaaau

SEQ ID NO: 2683350 - RNA, 18 nt, Human
ggacaugcaauaaaauuu

SEQ ID NO: 2683351 - RNA, 19 nt, Human
ggacaugcaauaaaauuua

SEQ ID NO: 2683352 - RNA, 22 nt, Human
ggacaugcaauaaaauuuaaaa

SEQ ID NO: 2683353 - RNA, 16 nt, Human
ggaaugaggaaaauuc

SEQ ID NO: 2683354 - RNA, 17 nt, Human
ggaaugaggaaaauucu

SEQ ID NO: 2683355 - RNA, 21 nt, Human
ggaaugaggugggagguggaa

SEQ ID NO: 2683356 - RNA, 13 nt, Human
ggacacacagccu

SEQ ID NO: 2683357 - RNA, 14 nt, Human
ggacacacagccua

SEQ ID NO: 2683358 - RNA, 15 nt, Human
ggaagccguccuggc

SEQ ID NO: 2683359 - RNA, 23 nt, Human
ggaauauaaggaaagcaauaaau

SEQ ID NO: 2683360 - RNA, 17 nt, Human
gcccccacuugccucuu

SEQ ID NO: 2683361 - RNA, 21 nt, Human
gcccccacuugccucuuccuu

SEQ ID NO: 2683362 - RNA, 14 nt, Human
gcccccacuugccu

SEQ ID NO: 2683363 - RNA, 16 nt, Human
gcccccacuugccucu

SEQ ID NO: 2683364 - RNA, 23 nt, Human
gccccacagucuccggccucucc

SEQ ID NO: 2683365 - RNA, 15 nt, Human
gccccacauguccag

SEQ ID NO: 2683366 - RNA, 23 nt, Human
gccccacauguccagcaccuugu

SEQ ID NO: 2683367 - RNA, 20 nt, Human
gcccccagccccggggugag

SEQ ID NO: 2683368 - RNA, 21 nt, Human
gcccccagccccggggugagu

SEQ ID NO: 2683369 - RNA, 17 nt, Human
gcccccagcccagggcu

SEQ ID NO: 2683370 - RNA, 18 nt, Human
gcccccagcccagggcuc

SEQ ID NO: 2683371 - RNA, 21 nt, Human
gcccccagcccagggcuccug

SEQ ID NO: 2683372 - RNA, 22 nt, Human
gcccccagcccagggcuccugc

SEQ ID NO: 2683373 - RNA, 16 nt, Human
gcauuuagcuggccac

SEQ ID NO: 2683374 - RNA, 19 nt, Human
gcauuuagggaguauucua

SEQ ID NO: 2683375 - RNA, 18 nt, Human
gcauuuagggaguauucu

SEQ ID NO: 2683376 - RNA, 20 nt, Human
gccauuagccagauuugucu

SEQ ID NO: 2683377 - RNA, 12 nt, Human
gccuagcacagc

SEQ ID NO: 2683378 - RNA, 14 nt, Human
gccuagcacagcag

SEQ ID NO: 2683379 - RNA, 15 nt, Human
gccuagcacagcagc

SEQ ID NO: 2683380 - RNA, 16 nt, Human
gccuagcacagcagcu

SEQ ID NO: 2683381 - RNA, 22 nt, Human
gccuacagcuuugaucccugac

SEQ ID NO: 2683382 - RNA, 23 nt, Human
gccuacagcuuugaucccugaca

SEQ ID NO: 2683383 - RNA, 13 nt, Human
gccucauguggcu

SEQ ID NO: 2683384 - RNA, 14 nt, Human
gccucauguggcug

SEQ ID NO: 2683385 - RNA, 12 nt, Human
gccuccagaacu

SEQ ID NO: 2683386 - RNA, 15 nt, Human
gccuccacagcgagg

SEQ ID NO: 2683387 - RNA, 17 nt, Human
gccucauguggcuggaa

SEQ ID NO: 2683388 - RNA, 15 nt, Human
gccucauguggcugg

SEQ ID NO: 2683389 - RNA, 16 nt, Human
gccucauguggcugga

SEQ ID NO: 2683390 - RNA, 20 nt, Human
gccuccacagcgagggcagc

SEQ ID NO: 2683391 - RNA, 21 nt, Human
gccuccacagcgagggcagcu

SEQ ID NO: 2683392 - RNA, 22 nt, Human
gccuccacagcgagggcagcug

SEQ ID NO: 2683393 - RNA, 23 nt, Human
gccuccacagcgagggcagcugc

SEQ ID NO: 2683394 - RNA, 17 nt, Human
gccuccucuggacggca

SEQ ID NO: 2683395 - RNA, 21 nt, Human
gccuccucucauaaaagagac

SEQ ID NO: 2683396 - RNA, 20 nt, Human
gccuccucuggacggcaggc

SEQ ID NO: 2683397 - RNA, 11 nt, Human
gcccugccacu

SEQ ID NO: 2683398 - RNA, 12 nt, Human
gcccugccacuc

SEQ ID NO: 2683399 - RNA, 13 nt, Human
gcccugccacuca

SEQ ID NO: 2683400 - RNA, 19 nt, Human
gcccugccacucacuaggc

SEQ ID NO: 2683401 - RNA, 20 nt, Human
gcccugccacucacuaggcc

SEQ ID NO: 2683402 - RNA, 21 nt, Human
gcccugccacucacuaggccc

SEQ ID NO: 2683403 - RNA, 14 nt, Human
gcccguccugccug

SEQ ID NO: 2683404 - RNA, 15 nt, Human
gcccguccugccugu

SEQ ID NO: 2683405 - RNA, 16 nt, Human
gcccguccugccugug

SEQ ID NO: 2683406 - RNA, 17 nt, Human
gcccguccugccugugg

SEQ ID NO: 2683407 - RNA, 18 nt, Human
gcccguccugccuguggc

SEQ ID NO: 2683408 - RNA, 16 nt, Human
gccgcguggugccauc

SEQ ID NO: 2683409 - RNA, 20 nt, Human
gccgcguggugccaucccca

SEQ ID NO: 2683410 - RNA, 15 nt, Human
gccgcuccaccagca

SEQ ID NO: 2683411 - RNA, 23 nt, Human
gccgcuagguagagucugagggc

SEQ ID NO: 2683412 - RNA, 13 nt, Human
gccgcuagguaga

SEQ ID NO: 2683413 - RNA, 21 nt, Human
gccgcguggugccauccccag

SEQ ID NO: 2683414 - RNA, 23 nt, Human
gcccuuccgcaguguggccaggc

SEQ ID NO: 2683415 - RNA, 17 nt, Human
gccggcagccccagccu

SEQ ID NO: 2683416 - RNA, 16 nt, Human
gccggcagccccagcc

SEQ ID NO: 2683417 - RNA, 15 nt, Human
gccggcagccccagc

SEQ ID NO: 2683418 - RNA, 14 nt, Human
gccggcagccccag

SEQ ID NO: 2683419 - RNA, 16 nt, Human
gccggcacggcccgug

SEQ ID NO: 2683420 - RNA, 17 nt, Human
gccggaucugagggaga

SEQ ID NO: 2683421 - RNA, 15 nt, Human
gccggaucugaggga

SEQ ID NO: 2683422 - RNA, 22 nt, Human
gccggacccggaggccgaggcc

SEQ ID NO: 2683423 - RNA, 13 nt, Human
gcucaggaguuug

SEQ ID NO: 2683424 - RNA, 15 nt, Human
gcucaggaggcgccc

SEQ ID NO: 2683425 - RNA, 22 nt, Human
gcucacugccaggccagccucc

SEQ ID NO: 2683426 - RNA, 21 nt, Human
gcucacugccaggccagccuc

SEQ ID NO: 2683427 - RNA, 23 nt, Human
gcucacugccaggccagccuccg

SEQ ID NO: 2683428 - RNA, 15 nt, Human
gcucagaaccacagc

SEQ ID NO: 2683429 - RNA, 17 nt, Human
gcucagaaccacagcaa

SEQ ID NO: 2683430 - RNA, 18 nt, Human
gcuaguugaauacuugaa

SEQ ID NO: 2683431 - RNA, 16 nt, Human
gcuaguugaauacuug

SEQ ID NO: 2683432 - RNA, 15 nt, Human
gcuaguugaauacuu

SEQ ID NO: 2683433 - RNA, 13 nt, Human
gcuaguugaauac

SEQ ID NO: 2683434 - RNA, 18 nt, Human
gcuagguuaaaugguugg

SEQ ID NO: 2683435 - RNA, 22 nt, Human
gcuaguugaauacuugaaccau

SEQ ID NO: 2683436 - RNA, 19 nt, Human
gcuaguugaauacuugaac

SEQ ID NO: 2683437 - RNA, 23 nt, Human
gcuauuacgaaguucaagaucaa

SEQ ID NO: 2683438 - RNA, 14 nt, Human
gcucaaagaaaucu

SEQ ID NO: 2683439 - RNA, 20 nt, Human
gccuugauucccuuguuauu

SEQ ID NO: 2683440 - RNA, 15 nt, Human
gccuugagcccuggc

SEQ ID NO: 2683441 - RNA, 16 nt, Human
gccuugagcccuggcu

SEQ ID NO: 2683442 - RNA, 15 nt, Human
gccuugaguuccagu

SEQ ID NO: 2683443 - RNA, 15 nt, Human
gccuucuuuugauua

SEQ ID NO: 2683444 - RNA, 22 nt, Human
gccuucuuuugauuauguuuuu

SEQ ID NO: 2683445 - RNA, 19 nt, Human
gccuucgucuuucccaugg

SEQ ID NO: 2683446 - RNA, 15 nt, Human
gccuucucagaagca

SEQ ID NO: 2683447 - RNA, 16 nt, Human
gccuucucagaagcac

SEQ ID NO: 2683448 - RNA, 16 nt, Human
gccucugucaggccuu

SEQ ID NO: 2683449 - RNA, 18 nt, Human
gccucugucaggccuuca

SEQ ID NO: 2683450 - RNA, 20 nt, Human
gcggauuaauuugcaucuga

SEQ ID NO: 2683451 - RNA, 18 nt, Human
gcggauuaauuugcaucu

SEQ ID NO: 2683452 - RNA, 19 nt, Human
gcggauuaauuugcaucug

SEQ ID NO: 2683453 - RNA, 16 nt, Human
gcggccuuuggcuuca

SEQ ID NO: 2683454 - RNA, 19 nt, Human
gcggcaggggccuggagau

SEQ ID NO: 2683455 - RNA, 15 nt, Human
gcggcaggggccugg

SEQ ID NO: 2683456 - RNA, 16 nt, Human
gcggcaggggccugga

SEQ ID NO: 2683457 - RNA, 17 nt, Human
gcggcguacaggcuggc

SEQ ID NO: 2683458 - RNA, 16 nt, Human
gcggcguacaggcugg

SEQ ID NO: 2683459 - RNA, 21 nt, Human
gcgugcgcaucuugccuccag

SEQ ID NO: 2683460 - RNA, 22 nt, Human
gcgugcgcaucuugccuccagg

SEQ ID NO: 2683461 - RNA, 23 nt, Human
gcgugcgcaucuugccuccaggu

SEQ ID NO: 2683462 - RNA, 16 nt, Human
gcgggacagaguagcc

SEQ ID NO: 2683463 - RNA, 21 nt, Human
gcgggagccaugcgcccccuc

SEQ ID NO: 2683464 - RNA, 15 nt, Human
gcgugccguggcacc

SEQ ID NO: 2683465 - RNA, 17 nt, Human
gcgugccguggcaccag

SEQ ID NO: 2683466 - RNA, 12 nt, Human
gcggcugugcuu

SEQ ID NO: 2683467 - RNA, 15 nt, Human
gcggcuggcagccca

SEQ ID NO: 2683468 - RNA, 14 nt, Human
gcguggagggaggc

SEQ ID NO: 2683469 - RNA, 16 nt, Human
gcguggagggaggccc

SEQ ID NO: 2683470 - RNA, 17 nt, Human
gcguggagggaggcccc

SEQ ID NO: 2683471 - RNA, 20 nt, Human
gcguggagggaggccccagg

SEQ ID NO: 2683472 - RNA, 21 nt, Human
gcguggagggaggccccaggg

SEQ ID NO: 2683473 - RNA, 22 nt, Human
gcguggagggaggccccagggg

SEQ ID NO: 2683474 - RNA, 17 nt, Human
gguuucgaagucauuaa

SEQ ID NO: 2683475 - RNA, 20 nt, Human
gguuuccuggcacuggaccc

SEQ ID NO: 2683476 - RNA, 12 nt, Human
gguuuccaggga

SEQ ID NO: 2683477 - RNA, 13 nt, Human
gguucucaaugaa

SEQ ID NO: 2683478 - RNA, 14 nt, Human
gguucucaaugaaa

SEQ ID NO: 2683479 - RNA, 22 nt, Human
aaaguaacucauuuguuaaaau

SEQ ID NO: 2683480 - RNA, 23 nt, Human
gguuuuaugguuacuucuucucu

SEQ ID NO: 2683481 - RNA, 16 nt, Human
aaaguaacugugagaa

SEQ ID NO: 2683482 - RNA, 16 nt, Human
gguuuuauacugaagg

SEQ ID NO: 2683483 - RNA, 11 nt, Human
gguuuuaugau

SEQ ID NO: 2683484 - RNA, 17 nt, Human
gguuuuauaaggcugau

SEQ ID NO: 2683485 - RNA, 13 nt, Human
gguuuuaaacuuu

SEQ ID NO: 2683486 - RNA, 14 nt, Human
gguuuuaaacuuuc

SEQ ID NO: 2683487 - RNA, 21 nt, Human
aaaguggcgugggagccagcc

SEQ ID NO: 2683488 - RNA, 22 nt, Human
aaaguggcgugggagccagccu

SEQ ID NO: 2683489 - RNA, 16 nt, Human
aaaguauguauuauuu

SEQ ID NO: 2683490 - RNA, 17 nt, Human
aaaguauguauuauuua

SEQ ID NO: 2683491 - RNA, 19 nt, Human
aaaguauguauuauuuaca

SEQ ID NO: 2683492 - RNA, 15 nt, Human
aaaguaauauuuauu

SEQ ID NO: 2683493 - RNA, 18 nt, Human
aaaguaauauuuauuaaa

SEQ ID NO: 2683494 - RNA, 15 nt, Human
aaaguagaacuuugu

SEQ ID NO: 2683495 - RNA, 23 nt, Human
aaaguagaacuuuguauaguuau

SEQ ID NO: 2683496 - RNA, 21 nt, Human
aaaguagaacuuuguauaguu

SEQ ID NO: 2683497 - RNA, 18 nt, Human
aaaguagaacuuuguaua

SEQ ID NO: 2683498 - RNA, 17 nt, Human
aaaguagaacuuuguau

SEQ ID NO: 2683499 - RNA, 16 nt, Human
aaaguagaacuuugua

SEQ ID NO: 2683500 - RNA, 13 nt, Human
ggugugggggaag

SEQ ID NO: 2683501 - RNA, 11 nt, Human
gguguggggga

SEQ ID NO: 2683502 - RNA, 16 nt, Human
gguguggagccgaggc

SEQ ID NO: 2683503 - RNA, 18 nt, Human
gguguggcccauggcugu

SEQ ID NO: 2683504 - RNA, 12 nt, Human
gguguggagaag

SEQ ID NO: 2683505 - RNA, 14 nt, Human
ggugggggagggag

SEQ ID NO: 2683506 - RNA, 23 nt, Human
gguguggagaagcggcuggcagc

SEQ ID NO: 2683507 - RNA, 14 nt, Human
gguguggagaagcg

SEQ ID NO: 2683508 - RNA, 13 nt, Human
ggugggggccucg

SEQ ID NO: 2683509 - RNA, 12 nt, Human
gguggggaaagg

SEQ ID NO: 2683510 - RNA, 14 nt, Human
ggugggcuggacuu

SEQ ID NO: 2683511 - RNA, 19 nt, Human
gguucguucuguacuguua

SEQ ID NO: 2683512 - RNA, 12 nt, Human
gguucucaauga

SEQ ID NO: 2683513 - RNA, 20 nt, Human
gguguuugaaaauaguuuau

SEQ ID NO: 2683514 - RNA, 14 nt, Human
gguguuugaaaaua

SEQ ID NO: 2683515 - RNA, 13 nt, Human
gguguuugaaaau

SEQ ID NO: 2683516 - RNA, 15 nt, Human
aaaguaacucauuug

SEQ ID NO: 2683517 - RNA, 14 nt, Human
aaaguaacucauuu

SEQ ID NO: 2683518 - RNA, 18 nt, Human
aaaguaaauacaugcaua

SEQ ID NO: 2683519 - RNA, 20 nt, Human
aaaguaacucauuuguuaaa

SEQ ID NO: 2683520 - RNA, 18 nt, Human
aaaguaacucauuuguua

SEQ ID NO: 2683521 - RNA, 15 nt, Human
ggugggaaggggagc

SEQ ID NO: 2683522 - RNA, 23 nt, Human
ggugggaaggggagcacaauuuc

SEQ ID NO: 2683523 - RNA, 20 nt, Human
aaaguaaaaagggaauuaug

SEQ ID NO: 2683524 - RNA, 20 nt, Human
ggugggaggaucucuugagc

SEQ ID NO: 2683525 - RNA, 13 nt, Human
ggugggcucugug

SEQ ID NO: 2683526 - RNA, 16 nt, Human
ggugggcucugugcag

SEQ ID NO: 2683527 - RNA, 11 nt, Human
ggugggacccc

SEQ ID NO: 2683528 - RNA, 20 nt, Human
ggugggacccccguggggca

SEQ ID NO: 2683529 - RNA, 23 nt, Human
aaagggcccacagugacuuuugc

SEQ ID NO: 2683530 - RNA, 16 nt, Human
aaaggggagagccugc

SEQ ID NO: 2683531 - RNA, 19 nt, Human
aaaggggagagccugcugg

SEQ ID NO: 2683532 - RNA, 14 nt, Human
aaaggggagagccu

SEQ ID NO: 2683533 - RNA, 19 nt, Human
aaagguggauuuuguuuaa

SEQ ID NO: 2683534 - RNA, 18 nt, Human
aaagguggugaggcaaua

SEQ ID NO: 2683535 - RNA, 23 nt, Human
aaaggggucggcugaccaugcuc

SEQ ID NO: 2683536 - RNA, 24 nt, Human
aaaggggucggcugaccaugcuca

SEQ ID NO: 2683537 - RNA, 23 nt, Human
aaaggugaguuugagcugccuuc

SEQ ID NO: 2683538 - RNA, 21 nt, Human
aaaggugaguuugagcugccu

SEQ ID NO: 2683539 - RNA, 22 nt, Human
aaaggugaguuugagcugccuu

SEQ ID NO: 2683540 - RNA, 20 nt, Human
aaaggugaguuugagcugcc

SEQ ID NO: 2683541 - RNA, 13 nt, Human
aaagcugagccug

SEQ ID NO: 2683542 - RNA, 15 nt, Human
aaagcugagccugca

SEQ ID NO: 2683543 - RNA, 14 nt, Human
aaagcuguuccuug

SEQ ID NO: 2683544 - RNA, 15 nt, Human
aaagcaguauuuuuc

SEQ ID NO: 2683545 - RNA, 16 nt, Human
aaagcaguauuuuucu

SEQ ID NO: 2683546 - RNA, 12 nt, Human
gguaucauauau

SEQ ID NO: 2683547 - RNA, 20 nt, Human
gguggcaccagcagccugga

SEQ ID NO: 2683548 - RNA, 14 nt, Human
gguggcaccagcag

SEQ ID NO: 2683549 - RNA, 18 nt, Human
ggugcuggagcacugggc

SEQ ID NO: 2683550 - RNA, 22 nt, Human
ggugcuggagcacugggcuccc

SEQ ID NO: 2683551 - RNA, 20 nt, Human
ggugcuggagcacugggcuc

SEQ ID NO: 2683552 - RNA, 13 nt, Human
guaauaagcacug

SEQ ID NO: 2683553 - RNA, 20 nt, Human
guaauaagcacuguaaacuu

SEQ ID NO: 2683554 - RNA, 21 nt, Human
guaauaagcacuguaaacuuc

SEQ ID NO: 2683555 - RNA, 17 nt, Human
guaauacuuccagaagu

SEQ ID NO: 2683556 - RNA, 13 nt, Human
guaauaauagacu

SEQ ID NO: 2683557 - RNA, 16 nt, Human
guaauaauagacugua

SEQ ID NO: 2683558 - RNA, 13 nt, Human
guaauauuuauua

SEQ ID NO: 2683559 - RNA, 15 nt, Human
guaauauuuauuaaa

SEQ ID NO: 2683560 - RNA, 14 nt, Human
guaauauuuauuaa

SEQ ID NO: 2683561 - RNA, 21 nt, Human
guaauauuuauuaaauuuuuu

SEQ ID NO: 2683562 - RNA, 18 nt, Human
guaauauuuauuaaauuu

SEQ ID NO: 2683563 - RNA, 17 nt, Human
guaauauuuauuaaauu

SEQ ID NO: 2683564 - RNA, 16 nt, Human
guaauauuuauuaaau

SEQ ID NO: 2683565 - RNA, 16 nt, Human
guaaguuaucuuugaa

SEQ ID NO: 2683566 - RNA, 12 nt, Human
guacaaaauuaa

SEQ ID NO: 2683567 - RNA, 14 nt, Human
guacaaaauuaagc

SEQ ID NO: 2683568 - RNA, 14 nt, Human
guacaacggaggcc

SEQ ID NO: 2683569 - RNA, 15 nt, Human
guacaacggaggccu

SEQ ID NO: 2683570 - RNA, 23 nt, Human
guacaacggaggccugcgacccu

SEQ ID NO: 2683571 - RNA, 22 nt, Human
guacaaguaguucuguauuuga

SEQ ID NO: 2683572 - RNA, 21 nt, Human
guacaaguaguucuguauuug

SEQ ID NO: 2683573 - RNA, 17 nt, Human
guacaaguaguucugua

SEQ ID NO: 2683574 - RNA, 16 nt, Human
guacaaguaguucugu

SEQ ID NO: 2683575 - RNA, 15 nt, Human
guacaaguaguucug

SEQ ID NO: 2683576 - RNA, 14 nt, Human
guacaaguaguucu

SEQ ID NO: 2683577 - RNA, 13 nt, Human
guacaaguaguuc

SEQ ID NO: 2683578 - RNA, 23 nt, Human
guaauccuagcacuuugggaggc

SEQ ID NO: 2683579 - RNA, 18 nt, Human
guaaucccugcuuuuugu

SEQ ID NO: 2683580 - RNA, 17 nt, Human
guaauccccuaaaauaa

SEQ ID NO: 2683581 - RNA, 20 nt, Human
guaauccccuaaaauaacag

SEQ ID NO: 2683582 - RNA, 13 nt, Human
guaaucccugcuu

SEQ ID NO: 2683583 - RNA, 15 nt, Human
guaaucaucuaaguc

SEQ ID NO: 2683584 - RNA, 16 nt, Human
guaaucaucuaaguca

SEQ ID NO: 2683585 - RNA, 13 nt, Human
aaauaauucuuuu

SEQ ID NO: 2683586 - RNA, 21 nt, Human
aaauaauucuuuuuuauuaau

SEQ ID NO: 2683587 - RNA, 19 nt, Human
aaauaauucuuuuuuauua

SEQ ID NO: 2683588 - RNA, 18 nt, Human
aaauaauucuuuuuuauu

SEQ ID NO: 2683589 - RNA, 14 nt, Human
aaauaauucuuuuu

SEQ ID NO: 2683590 - RNA, 21 nt, Human
aaauaauuauauaacuguauu

SEQ ID NO: 2683591 - RNA, 22 nt, Human
aaauaauuauauaacuguauuu

SEQ ID NO: 2683592 - RNA, 23 nt, Human
aaauaauuauauaacuguauuug

SEQ ID NO: 2683593 - RNA, 17 nt, Human
aaagugggcuuaaugga

SEQ ID NO: 2683594 - RNA, 23 nt, Human
aaagugucagaaggagcuacaaa

SEQ ID NO: 2683595 - RNA, 17 nt, Human
aaaguuaaaauuguuau

SEQ ID NO: 2683596 - RNA, 16 nt, Human
aaaguuaaacauugaa

SEQ ID NO: 2683597 - RNA, 22 nt, Human
aaaguuaaacauugaaguaaug

SEQ ID NO: 2683598 - RNA, 22 nt, Human
guaaaguauguauuauuuacau

SEQ ID NO: 2683599 - RNA, 23 nt, Human
guaaaguauguauuauuuacauu

SEQ ID NO: 2683600 - RNA, 15 nt, Human
guaaaguauguauua

SEQ ID NO: 2683601 - RNA, 17 nt, Human
guaaaguauguauuauu

SEQ ID NO: 2683602 - RNA, 18 nt, Human
guaaauuuuguaugaaaa

SEQ ID NO: 2683603 - RNA, 20 nt, Human
guaaagcuauuuaugggccc

SEQ ID NO: 2683604 - RNA, 23 nt, Human
guaaagcuauuuaugggccccug

SEQ ID NO: 2683605 - RNA, 12 nt, Human
guaaagcuccua

SEQ ID NO: 2683606 - RNA, 21 nt, Human
guaaagcccauuuuuaaaaua

SEQ ID NO: 2683607 - RNA, 15 nt, Human
guaaacaaaaugaag

SEQ ID NO: 2683608 - RNA, 22 nt, Human
guaaacgggaacaugcccccug

SEQ ID NO: 2683609 - RNA, 19 nt, Human
guaaacucaucugaaaugu

SEQ ID NO: 2683610 - RNA, 13 nt, Human
guaacauucaugu

SEQ ID NO: 2683611 - RNA, 17 nt, Human
guaacauucauguucua

SEQ ID NO: 2683612 - RNA, 23 nt, Human
aaauaucaaauuaauugugugaa

SEQ ID NO: 2683613 - RNA, 13 nt, Human
aaauaucauugua

SEQ ID NO: 2683614 - RNA, 20 nt, Human
aaauaucaaauuaauugugu

SEQ ID NO: 2683615 - RNA, 16 nt, Human
aaauaucaaauuaauu

SEQ ID NO: 2683616 - RNA, 13 nt, Human
aaauaucaaauua

SEQ ID NO: 2683617 - RNA, 12 nt, Human
aaauaucaaauu

SEQ ID NO: 2683618 - RNA, 12 nt, Human
aaauaucaaagu

SEQ ID NO: 2683619 - RNA, 14 nt, Human
aaauaucaaaguca

SEQ ID NO: 2683620 - RNA, 21 nt, Human
aaauaucaaagucauuaaaga

SEQ ID NO: 2683621 - RNA, 22 nt, Human
aaauaucaaagucauuaaagac

SEQ ID NO: 2683622 - RNA, 22 nt, Human
aaauauauaucuaucuauuuga

SEQ ID NO: 2683623 - RNA, 20 nt, Human
aaauauauucuuucaaagga

SEQ ID NO: 2683624 - RNA, 17 nt, Human
aaauauaucuuauaaag

SEQ ID NO: 2683625 - RNA, 12 nt, Human
aaauaccauuua

SEQ ID NO: 2683626 - RNA, 22 nt, Human
aaauaccauuuaguaagaauac

SEQ ID NO: 2683627 - RNA, 13 nt, Human
aaauauauacauu

SEQ ID NO: 2683628 - RNA, 14 nt, Human
aaauaucuuggccu

SEQ ID NO: 2683629 - RNA, 16 nt, Human
aaauauuccuuugcau

SEQ ID NO: 2683630 - RNA, 19 nt, Human
aaauauuccuuugcauauu

SEQ ID NO: 2683631 - RNA, 23 nt, Human
aaaucagccugcuccagcuguuc

SEQ ID NO: 2683632 - RNA, 19 nt, Human
aaaucauaguuaaauguua

SEQ ID NO: 2683633 - RNA, 21 nt, Human
aaaucagccugcuccagcugu

SEQ ID NO: 2683634 - RNA, 19 nt, Human
aaaucagccugcuccagcu

SEQ ID NO: 2683635 - RNA, 13 nt, Human
aaauauguuuuua

SEQ ID NO: 2683636 - RNA, 16 nt, Human
ggggucccuagcagcc

SEQ ID NO: 2683637 - RNA, 22 nt, Human
ggggucccuagcagcccacccu

SEQ ID NO: 2683638 - RNA, 21 nt, Human
ggguccugaggccugcagcac

SEQ ID NO: 2683639 - RNA, 22 nt, Human
aaaccuuaucuccacaaccucu

SEQ ID NO: 2683640 - RNA, 18 nt, Human
aaaccugggauucaggaa

SEQ ID NO: 2683641 - RNA, 21 nt, Human
aaaccugggauucaggaaugu

SEQ ID NO: 2683642 - RNA, 22 nt, Human
aaaccacuuaaacgaagaguuc

SEQ ID NO: 2683643 - RNA, 12 nt, Human
aaacauuugcug

SEQ ID NO: 2683644 - RNA, 15 nt, Human
aaaccacuagaaagu

SEQ ID NO: 2683645 - RNA, 12 nt, Human
ggggcccagugc

SEQ ID NO: 2683646 - RNA, 14 nt, Human
ggggcccagugcau

SEQ ID NO: 2683647 - RNA, 19 nt, Human
ggggcccagggcaagcucc

SEQ ID NO: 2683648 - RNA, 21 nt, Human
ggggccauuugcaauaacagc

SEQ ID NO: 2683649 - RNA, 17 nt, Human
aaaaugucuguaauaau

SEQ ID NO: 2683650 - RNA, 18 nt, Human
aaaaugucuguaauaaua

SEQ ID NO: 2683651 - RNA, 12 nt, Human
aaaaugucugua

SEQ ID NO: 2683652 - RNA, 23 nt, Human
aaaauguccaguaagaucacugu

SEQ ID NO: 2683653 - RNA, 11 nt, Human
aaaaugucugu

SEQ ID NO: 2683654 - RNA, 23 nt, Human
aaaaugucaaaaguagaacuuug

SEQ ID NO: 2683655 - RNA, 22 nt, Human
aaaaugucaaaaguagaacuuu

SEQ ID NO: 2683656 - RNA, 21 nt, Human
aaaaugucaaaaguagaacuu

SEQ ID NO: 2683657 - RNA, 15 nt, Human
aaaaugucaaaagua

SEQ ID NO: 2683658 - RNA, 14 nt, Human
aaaaugucaaaagu

SEQ ID NO: 2683659 - RNA, 23 nt, Human
ggggguggccgcugaguggcagg

SEQ ID NO: 2683660 - RNA, 13 nt, Human
ggggguggccgcu

SEQ ID NO: 2683661 - RNA, 14 nt, Human
gggggcaggugcug

SEQ ID NO: 2683662 - RNA, 15 nt, Human
gggggcacaggaggc

SEQ ID NO: 2683663 - RNA, 17 nt, Human
gggggaucacagccucu

SEQ ID NO: 2683664 - RNA, 14 nt, Human
aaacuguuugaaaa

SEQ ID NO: 2683665 - RNA, 23 nt, Human
aaacuguuugaaaacuucagaag

SEQ ID NO: 2683666 - RNA, 21 nt, Human
aaacuuaaauguuauuaucug

SEQ ID NO: 2683667 - RNA, 16 nt, Human
aaacuuaaauguuauu

SEQ ID NO: 2683668 - RNA, 17 nt, Human
aaacuuaaauguuauua

SEQ ID NO: 2683669 - RNA, 16 nt, Human
aaacuaaagcaauaga

SEQ ID NO: 2683670 - RNA, 17 nt, Human
aaacuaaagcaauagaa

SEQ ID NO: 2683671 - RNA, 20 nt, Human
aaacuaaagcaauagaaaca

SEQ ID NO: 2683672 - RNA, 22 nt, Human
aaacgcuaaagagcccuugccu

SEQ ID NO: 2683673 - RNA, 16 nt, Human
aaacgugguuacauua

SEQ ID NO: 2683674 - RNA, 12 nt, Human
aaacuucagaag

SEQ ID NO: 2683675 - RNA, 20 nt, Human
aaacuucagaagcaaacaau

SEQ ID NO: 2683676 - RNA, 13 nt, Human
ggguuuuguaaug

SEQ ID NO: 2683677 - RNA, 19 nt, Human
ggguguccccgcugcugug

SEQ ID NO: 2683678 - RNA, 12 nt, Human
gguaaauguuuc

SEQ ID NO: 2683679 - RNA, 13 nt, Human
gguaaauguuucu

SEQ ID NO: 2683680 - RNA, 16 nt, Human
gguaaauguuucuuuu

SEQ ID NO: 2683681 - RNA, 21 nt, Human
gguaaauguuucuuuuaaaga

SEQ ID NO: 2683682 - RNA, 13 nt, Human
gguaaaaugaaga

SEQ ID NO: 2683683 - RNA, 20 nt, Human
gguaaaaugaagaauuuaaa

SEQ ID NO: 2683684 - RNA, 14 nt, Human
gguaaaaugaagaa

SEQ ID NO: 2683685 - RNA, 12 nt, Human
gguaaaaugaag

SEQ ID NO: 2683686 - RNA, 19 nt, Human
gguaaaacucacugugauc

SEQ ID NO: 2683687 - RNA, 18 nt, Human
gguaaaaaguauuuuuuc

SEQ ID NO: 2683688 - RNA, 15 nt, Human
gguaaagacuggcuu

SEQ ID NO: 2683689 - RNA, 16 nt, Human
gguaaagacuggcuuu

SEQ ID NO: 2683690 - RNA, 15 nt, Human
gguaaauaaaccacu

SEQ ID NO: 2683691 - RNA, 20 nt, Human
gguaaauaaaccacugugcg

SEQ ID NO: 2683692 - RNA, 18 nt, Human
gguagguucagccaaggu

SEQ ID NO: 2683693 - RNA, 19 nt, Human
gguagguucagccaagguu

SEQ ID NO: 2683694 - RNA, 13 nt, Human
gguauauauacau

SEQ ID NO: 2683695 - RNA, 15 nt, Human
gguagguucagccaa

SEQ ID NO: 2683696 - RNA, 16 nt, Human
gguagguucagccaag

SEQ ID NO: 2683697 - RNA, 17 nt, Human
gguagguucagccaagg

SEQ ID NO: 2683698 - RNA, 17 nt, Human
gguaggagggugggaag

SEQ ID NO: 2683699 - RNA, 19 nt, Human
gguaagaauaguagaugug

SEQ ID NO: 2683700 - RNA, 12 nt, Human
gguaacuguccu

SEQ ID NO: 2683701 - RNA, 13 nt, Human
gguaacuguccug

SEQ ID NO: 2683702 - RNA, 14 nt, Human
gguaacuguccugu

SEQ ID NO: 2683703 - RNA, 16 nt, Human
gguaacuguccugucc

SEQ ID NO: 2683704 - RNA, 17 nt, Human
gguaacuguccuguccu

SEQ ID NO: 2683705 - RNA, 21 nt, Human
ggucaguaguuuaaaaguucu

SEQ ID NO: 2683706 - RNA, 18 nt, Human
gguauccccccaucuugc

SEQ ID NO: 2683707 - RNA, 18 nt, Human
gguccagcuggccuggac

SEQ ID NO: 2683708 - RNA, 20 nt, Human
gguccagcuggccuggacag

SEQ ID NO: 2683709 - RNA, 22 nt, Human
gguccagcucuggaggggaggg

SEQ ID NO: 2683710 - RNA, 13 nt, Human
gguccagcuggcc

SEQ ID NO: 2683711 - RNA, 15 nt, Human
gguccagcuggccug

SEQ ID NO: 2683712 - RNA, 11 nt, Human
gguccagcucu

SEQ ID NO: 2683713 - RNA, 12 nt, Human
gguccagcucug

SEQ ID NO: 2683714 - RNA, 13 nt, Human
gguccagcucugg

SEQ ID NO: 2683715 - RNA, 14 nt, Human
gguccagcucugga

SEQ ID NO: 2683716 - RNA, 15 nt, Human
gguccagcucuggag

SEQ ID NO: 2683717 - RNA, 16 nt, Human
gguccagcucuggagg

SEQ ID NO: 2683718 - RNA, 12 nt, Human
aaaauacaugaa

SEQ ID NO: 2683719 - RNA, 13 nt, Human
aaaauacaugaag

SEQ ID NO: 2683720 - RNA, 15 nt, Human
aaaauacaugaagcu

SEQ ID NO: 2683721 - RNA, 13 nt, Human
aaaauaacaguau

SEQ ID NO: 2683722 - RNA, 16 nt, Human
aaaauacauagugaaa

SEQ ID NO: 2683723 - RNA, 12 nt, Human
aaaauacauugu

SEQ ID NO: 2683724 - RNA, 20 nt, Human
aaaauaauuauauaacugua

SEQ ID NO: 2683725 - RNA, 16 nt, Human
aaaauaauaaaaaaag

SEQ ID NO: 2683726 - RNA, 13 nt, Human
aaaauaauaauaa

SEQ ID NO: 2683727 - RNA, 14 nt, Human
aaaagguauuauac

SEQ ID NO: 2683728 - RNA, 20 nt, Human
aaaauaacccuuugguuuuu

SEQ ID NO: 2683729 - RNA, 15 nt, Human
aaaaggucuuuaaaa

SEQ ID NO: 2683730 - RNA, 14 nt, Human
aaaaggaguauaca

SEQ ID NO: 2683731 - RNA, 15 nt, Human
aaaaggaguauacaa

SEQ ID NO: 2683732 - RNA, 11 nt, Human
aaaaggcagga

SEQ ID NO: 2683733 - RNA, 15 nt, Human
aaaaggccucuugua

SEQ ID NO: 2683734 - RNA, 21 nt, Human
aaaaggccucuuguaaagacu

SEQ ID NO: 2683735 - RNA, 22 nt, Human
aaaaggccucuuguaaagacug

SEQ ID NO: 2683736 - RNA, 23 nt, Human
aaaaggccucuuguaaagacugg

SEQ ID NO: 2683737 - RNA, 12 nt, Human
aaaauauuuuga

SEQ ID NO: 2683738 - RNA, 13 nt, Human
aaaauauuuucuc

SEQ ID NO: 2683739 - RNA, 23 nt, Human
aaaauauuuucucuguacuuuuc

SEQ ID NO: 2683740 - RNA, 16 nt, Human
aaaauauuuuccugcc

SEQ ID NO: 2683741 - RNA, 19 nt, Human
aaaauauuguuuuacaaua

SEQ ID NO: 2683742 - RNA, 11 nt, Human
aaaauauuguu

SEQ ID NO: 2683743 - RNA, 14 nt, Human
aaaauauuguuucu

SEQ ID NO: 2683744 - RNA, 15 nt, Human
aaaauauuguuucug

SEQ ID NO: 2683745 - RNA, 16 nt, Human
aaaauauuguuucugc

SEQ ID NO: 2683746 - RNA, 22 nt, Human
aaaauauuguuucugcauucau

SEQ ID NO: 2683747 - RNA, 23 nt, Human
aaaauauuguuucugcauucauu

SEQ ID NO: 2683748 - RNA, 20 nt, Human
aaaauauuguuuuacaauag

SEQ ID NO: 2683749 - RNA, 17 nt, Human
aaaauagaaauuuugua

SEQ ID NO: 2683750 - RNA, 20 nt, Human
aaaauagaaauuuuguaaga

SEQ ID NO: 2683751 - RNA, 21 nt, Human
aaaauagaaauuuuguaagaa

SEQ ID NO: 2683752 - RNA, 11 nt, Human
aaaauagaaac

SEQ ID NO: 2683753 - RNA, 12 nt, Human
aaaauagaaaca

SEQ ID NO: 2683754 - RNA, 13 nt, Human
aaaauagaaacau

SEQ ID NO: 2683755 - RNA, 15 nt, Human
aaaauagaaacauau

SEQ ID NO: 2683756 - RNA, 13 nt, Human
aaaauaucaaauu

SEQ ID NO: 2683757 - RNA, 20 nt, Human
aaaauagaguguaguuuaca

SEQ ID NO: 2683758 - RNA, 18 nt, Human
aaaauauauuuauaagga

SEQ ID NO: 2683759 - RNA, 12 nt, Human
aaaauaucuugg

SEQ ID NO: 2683760 - RNA, 13 nt, Human
aaaauauuuugaa

SEQ ID NO: 2683761 - RNA, 14 nt, Human
aaaauauuuggaau

SEQ ID NO: 2683762 - RNA, 16 nt, Human
aaaaucugagggaaau

SEQ ID NO: 2683763 - RNA, 21 nt, Human
aaaaucugagggaaauguuuu

SEQ ID NO: 2683764 - RNA, 11 nt, Human
gggcucccagg

SEQ ID NO: 2683765 - RNA, 15 nt, Human
aaaauggucucuaac

SEQ ID NO: 2683766 - RNA, 12 nt, Human
gggcugcuuccu

SEQ ID NO: 2683767 - RNA, 22 nt, Human
gggcugcggcguacaggcuggc

SEQ ID NO: 2683768 - RNA, 20 nt, Human
gggcugcggcguacaggcug

SEQ ID NO: 2683769 - RNA, 13 nt, Human
gggcucccagggg

SEQ ID NO: 2683770 - RNA, 14 nt, Human
gggcucccaggggu

SEQ ID NO: 2683771 - RNA, 22 nt, Human
gggcucccaggggucucccugg

SEQ ID NO: 2683772 - RNA, 23 nt, Human
gggcucccaggggucucccuggc

SEQ ID NO: 2683773 - RNA, 15 nt, Human
gggcucccgggcccc

SEQ ID NO: 2683774 - RNA, 22 nt, Human
gggcucagcaaaagaugcuucu

SEQ ID NO: 2683775 - RNA, 14 nt, Human
gggcuagggagacg

SEQ ID NO: 2683776 - RNA, 20 nt, Human
gggccgggcgcgguggcuca

SEQ ID NO: 2683777 - RNA, 12 nt, Human
gggccggcccug

SEQ ID NO: 2683778 - RNA, 19 nt, Human
gggccggcccugugugcag

SEQ ID NO: 2683779 - RNA, 17 nt, Human
gggccgccgccucuuuc

SEQ ID NO: 2683780 - RNA, 20 nt, Human
gggccgcguggugccauccc

SEQ ID NO: 2683781 - RNA, 23 nt, Human
gggccgcguggugccauccccag

SEQ ID NO: 2683782 - RNA, 12 nt, Human
gggccgcugcca

SEQ ID NO: 2683783 - RNA, 22 nt, Human
gggccauguccaaagaggcugc

SEQ ID NO: 2683784 - RNA, 23 nt, Human
gggccauguccaaagaggcugcc

SEQ ID NO: 2683785 - RNA, 23 nt, Human
gggccaugcugaggccugggccg

SEQ ID NO: 2683786 - RNA, 13 nt, Human
gggccauggcuca

SEQ ID NO: 2683787 - RNA, 15 nt, Human
gggccauggcucagg

SEQ ID NO: 2683788 - RNA, 19 nt, Human
gggccauggcucagggugg

SEQ ID NO: 2683789 - RNA, 21 nt, Human
gggccaugcugaggccugggc

SEQ ID NO: 2683790 - RNA, 14 nt, Human
gggccauguccaaa

SEQ ID NO: 2683791 - RNA, 15 nt, Human
gggccauguccaaag

SEQ ID NO: 2683792 - RNA, 16 nt, Human
gggccauguccaaaga

SEQ ID NO: 2683793 - RNA, 17 nt, Human
gggccauguccaaagag

SEQ ID NO: 2683794 - RNA, 21 nt, Human
gggccauguccaaagaggcug

SEQ ID NO: 2683795 - RNA, 13 nt, Human
aaaauggaaauuu

SEQ ID NO: 2683796 - RNA, 22 nt, Human
gggccacugguccccaacaaug

SEQ ID NO: 2683797 - RNA, 19 nt, Human
gggccaugcugaggccugg

SEQ ID NO: 2683798 - RNA, 20 nt, Human
gggccaugcugaggccuggg

SEQ ID NO: 2683799 - RNA, 14 nt, Human
gggccauuugcaau

SEQ ID NO: 2683800 - RNA, 16 nt, Human
gggccugcccagacaa

SEQ ID NO: 2683801 - RNA, 13 nt, Human
gggcguggaggga

SEQ ID NO: 2683802 - RNA, 15 nt, Human
gggcguggagggagg

SEQ ID NO: 2683803 - RNA, 21 nt, Human
gggcguggagggaggccccag

SEQ ID NO: 2683804 - RNA, 22 nt, Human
gggccucgguguggagaagcgg

SEQ ID NO: 2683805 - RNA, 15 nt, Human
ggcaucuaucugugc

SEQ ID NO: 2683806 - RNA, 16 nt, Human
ggcaucuaucugugcu

SEQ ID NO: 2683807 - RNA, 18 nt, Human
ggcaucuaucugugcuag

SEQ ID NO: 2683808 - RNA, 14 nt, Human
ggcauuugcugaau

SEQ ID NO: 2683809 - RNA, 13 nt, Human
ggcaucaugcaug

SEQ ID NO: 2683810 - RNA, 18 nt, Human
ggcaucgcaccauucuga

SEQ ID NO: 2683811 - RNA, 21 nt, Human
ggcaucgcaccauucugacuc

SEQ ID NO: 2683812 - RNA, 21 nt, Human
ggccagagagccuggugcugc

SEQ ID NO: 2683813 - RNA, 18 nt, Human
ggccagagagccuggugc

SEQ ID NO: 2683814 - RNA, 19 nt, Human
ggccagaggcccccagccc

SEQ ID NO: 2683815 - RNA, 21 nt, Human
ggccagaggcccccagcccag

SEQ ID NO: 2683816 - RNA, 15 nt, Human
ggccaagaagcagug

SEQ ID NO: 2683817 - RNA, 17 nt, Human
ggccaagaauauugcaa

SEQ ID NO: 2683818 - RNA, 22 nt, Human
ggccaagaauauugcaaaauac

SEQ ID NO: 2683819 - RNA, 21 nt, Human
ggccaagaauguacguccagc

SEQ ID NO: 2683820 - RNA, 13 nt, Human
ggcaggggugggg

SEQ ID NO: 2683821 - RNA, 14 nt, Human
ggcagggguggggg

SEQ ID NO: 2683822 - RNA, 16 nt, Human
ggcaggggcuggaggg

SEQ ID NO: 2683823 - RNA, 16 nt, Human
ggauuuuuagaauuaa

SEQ ID NO: 2683824 - RNA, 12 nt, Human
ggcaaaacucua

SEQ ID NO: 2683825 - RNA, 15 nt, Human
ggcaaaaaggcagga

SEQ ID NO: 2683826 - RNA, 18 nt, Human
ggcacauugagcugugca

SEQ ID NO: 2683827 - RNA, 14 nt, Human
ggcaggggccugga

SEQ ID NO: 2683828 - RNA, 16 nt, Human
ggcaggggccuggaga

SEQ ID NO: 2683829 - RNA, 17 nt, Human
ggcaggggccuggagau

SEQ ID NO: 2683830 - RNA, 17 nt, Human
ggcagggagcugggccc

SEQ ID NO: 2683831 - RNA, 14 nt, Human
ggcagggaggcagc

SEQ ID NO: 2683832 - RNA, 15 nt, Human
ggcagggaggcagcc

SEQ ID NO: 2683833 - RNA, 16 nt, Human
ggcagggaggcagccg

SEQ ID NO: 2683834 - RNA, 14 nt, Human
ggcaggcugggcca

SEQ ID NO: 2683835 - RNA, 15 nt, Human
ggcaggcugggccau

SEQ ID NO: 2683836 - RNA, 16 nt, Human
ggcaggcugggccaug

SEQ ID NO: 2683837 - RNA, 22 nt, Human
ggcaggcugggccauguccaaa

SEQ ID NO: 2683838 - RNA, 18 nt, Human
ggcaggaggaucacuuga

SEQ ID NO: 2683839 - RNA, 15 nt, Human
ggcagcccagagacu

SEQ ID NO: 2683840 - RNA, 21 nt, Human
ggcagcccagagacuuuguag

SEQ ID NO: 2683841 - RNA, 22 nt, Human
ggcagcccagagacuuuguaga

SEQ ID NO: 2683842 - RNA, 18 nt, Human
ggcagccccagccugcua

SEQ ID NO: 2683843 - RNA, 17 nt, Human
ggcagccccagccugcu

SEQ ID NO: 2683844 - RNA, 19 nt, Human
ggcagccccagccugcuag

SEQ ID NO: 2683845 - RNA, 12 nt, Human
ggcagccucugu

SEQ ID NO: 2683846 - RNA, 20 nt, Human
ggcagccucugucaggccuu

SEQ ID NO: 2683847 - RNA, 16 nt, Human
ggcagccccagccugc

SEQ ID NO: 2683848 - RNA, 15 nt, Human
ggcagccccagccug

SEQ ID NO: 2683849 - RNA, 14 nt, Human
ggcagccccagccu

SEQ ID NO: 2683850 - RNA, 13 nt, Human
ggcagccccagcc

SEQ ID NO: 2683851 - RNA, 22 nt, Human
ggaucucagcuuugagaagccu

SEQ ID NO: 2683852 - RNA, 16 nt, Human
ggaucucagcuuugag

SEQ ID NO: 2683853 - RNA, 17 nt, Human
ggaucucagcuuugaga

SEQ ID NO: 2683854 - RNA, 15 nt, Human
ggaucucagcuuuga

SEQ ID NO: 2683855 - RNA, 18 nt, Human
ggaucuaccagcauaaau

SEQ ID NO: 2683856 - RNA, 13 nt, Human
ggaucuaccagca

SEQ ID NO: 2683857 - RNA, 12 nt, Human
ggaucuaccagc

SEQ ID NO: 2683858 - RNA, 18 nt, Human
ggaucucuugagccuggg

SEQ ID NO: 2683859 - RNA, 20 nt, Human
ggaguguaugacugcacaug

SEQ ID NO: 2683860 - RNA, 18 nt, Human
ggaguggugauuugaaaa

SEQ ID NO: 2683861 - RNA, 18 nt, Human
ggagugucuggaauugug

SEQ ID NO: 2683862 - RNA, 19 nt, Human
ggagugugagccaccuaag

SEQ ID NO: 2683863 - RNA, 13 nt, Human
ggagggugggaag

SEQ ID NO: 2683864 - RNA, 14 nt, Human
ggagggugggaagg

SEQ ID NO: 2683865 - RNA, 15 nt, Human
ggaggcuuccugcgu

SEQ ID NO: 2683866 - RNA, 18 nt, Human
ggagggggcuugaagcca

SEQ ID NO: 2683867 - RNA, 21 nt, Human
ggagggggcuugaagccaaag

SEQ ID NO: 2683868 - RNA, 16 nt, Human
ggagggggcuugaagc

SEQ ID NO: 2683869 - RNA, 14 nt, Human
ggagggggauccga

SEQ ID NO: 2683870 - RNA, 20 nt, Human
ggaggcgggggcugcccuug

SEQ ID NO: 2683871 - RNA, 20 nt, Human
ggaggcggagcuugcaguga

SEQ ID NO: 2683872 - RNA, 22 nt, Human
ggaggcuccugccugagcuucc

SEQ ID NO: 2683873 - RNA, 16 nt, Human
ggcuggccaguccagg

SEQ ID NO: 2683874 - RNA, 20 nt, Human
ggcuggccaguccaggcugc

SEQ ID NO: 2683875 - RNA, 21 nt, Human
ggcuggccaguccaggcugcc

SEQ ID NO: 2683876 - RNA, 16 nt, Human
ggcugcccuugggcca

SEQ ID NO: 2683877 - RNA, 18 nt, Human
ggcugcccuugggccacc

SEQ ID NO: 2683878 - RNA, 16 nt, Human
ggcugccguggggccg

SEQ ID NO: 2683879 - RNA, 23 nt, Human
ggcugccguggggccgccgccuc

SEQ ID NO: 2683880 - RNA, 15 nt, Human
ggcugccccucucac

SEQ ID NO: 2683881 - RNA, 15 nt, Human
ggcugaccaugcuca

SEQ ID NO: 2683882 - RNA, 13 nt, Human
ggcugaaaacaau

SEQ ID NO: 2683883 - RNA, 13 nt, Human
ggcucguggacug

SEQ ID NO: 2683884 - RNA, 19 nt, Human
ggcucguggacugaguggg

SEQ ID NO: 2683885 - RNA, 23 nt, Human
ggcucguggacugagugggaagc

SEQ ID NO: 2683886 - RNA, 15 nt, Human
ggcucccuccuccag

SEQ ID NO: 2683887 - RNA, 16 nt, Human
ggcucccuccuccagg

SEQ ID NO: 2683888 - RNA, 20 nt, Human
ggcucccuccuccaggccug

SEQ ID NO: 2683889 - RNA, 11 nt, Human
aaaaaaaccac

SEQ ID NO: 2683890 - RNA, 12 nt, Human
aaaaaaauaaua

SEQ ID NO: 2683891 - RNA, 22 nt, Human
aaaaaacugcugacuguuuucu

SEQ ID NO: 2683892 - RNA, 10 nt, Human
aaaaaacuac

SEQ ID NO: 2683893 - RNA, 20 nt, Human
aaaaauaaaauaauuauaaa

SEQ ID NO: 2683894 - RNA, 16 nt, Human
aaaaauaauaauaaug

SEQ ID NO: 2683895 - RNA, 18 nt, Human
aaaaauacuauuuaagau

SEQ ID NO: 2683896 - RNA, 20 nt, Human
ggcugguacaacggaggccu

SEQ ID NO: 2683897 - RNA, 11 nt, Human
aaaaauagaaa

SEQ ID NO: 2683898 - RNA, 12 nt, Human
aaaaauagaaac

SEQ ID NO: 2683899 - RNA, 13 nt, Human
aaaaauagaaaca

SEQ ID NO: 2683900 - RNA, 15 nt, Human
aaaaauagaaacaua

SEQ ID NO: 2683901 - RNA, 16 nt, Human
aaaaauagaaacauau

SEQ ID NO: 2683902 - RNA, 14 nt, Human
aaaaaggaggaaga

SEQ ID NO: 2683903 - RNA, 12 nt, Human
aaaaaggcagga

SEQ ID NO: 2683904 - RNA, 22 nt, Human
ggcuggccaguccaggcugccg

SEQ ID NO: 2683905 - RNA, 14 nt, Human
ggccgcuccaccag

SEQ ID NO: 2683906 - RNA, 14 nt, Human
ggccgccgccucuu

SEQ ID NO: 2683907 - RNA, 18 nt, Human
ggccgcgcguccagcugc

SEQ ID NO: 2683908 - RNA, 19 nt, Human
ggccgcgcguccagcugcc

SEQ ID NO: 2683909 - RNA, 16 nt, Human
ggccgcggagccugca

SEQ ID NO: 2683910 - RNA, 16 nt, Human
ggccgcgcccuuuccc

SEQ ID NO: 2683911 - RNA, 22 nt, Human
ggcccuagacucggggugcuuc

SEQ ID NO: 2683912 - RNA, 20 nt, Human
ggccccagcaccucagccug

SEQ ID NO: 2683913 - RNA, 15 nt, Human
ggccccagcacagcu

SEQ ID NO: 2683914 - RNA, 18 nt, Human
ggccccagcacagcuuga

SEQ ID NO: 2683915 - RNA, 17 nt, Human
ggccccagcaccucagc

SEQ ID NO: 2683916 - RNA, 13 nt, Human
ggccccagcccug

SEQ ID NO: 2683917 - RNA, 14 nt, Human
ggccccagcccugc

SEQ ID NO: 2683918 - RNA, 15 nt, Human
ggccccagcccugcu

SEQ ID NO: 2683919 - RNA, 16 nt, Human
ggccccagcccugcug

SEQ ID NO: 2683920 - RNA, 18 nt, Human
ggccccagcccugcuggg

SEQ ID NO: 2683921 - RNA, 21 nt, Human
ggccccagcccugcuggggau

SEQ ID NO: 2683922 - RNA, 22 nt, Human
ggccccagcccugcuggggauc

SEQ ID NO: 2683923 - RNA, 22 nt, Human
ggccagaggcccccagcccagg

SEQ ID NO: 2683924 - RNA, 22 nt, Human
ggcgagagucuggcccuagacu

SEQ ID NO: 2683925 - RNA, 17 nt, Human
ggccuuauugcauccca

SEQ ID NO: 2683926 - RNA, 13 nt, Human
ggccuuaauuucc

SEQ ID NO: 2683927 - RNA, 15 nt, Human
ggccuuaauuuccuu

SEQ ID NO: 2683928 - RNA, 16 nt, Human
ggccuuaauuuccuuu

SEQ ID NO: 2683929 - RNA, 17 nt, Human
ggccuuaauuuccuuuu

SEQ ID NO: 2683930 - RNA, 20 nt, Human
ggccuuaauuuccuuuuuga

SEQ ID NO: 2683931 - RNA, 19 nt, Human
ggccuggagauccuccugc

SEQ ID NO: 2683932 - RNA, 20 nt, Human
ggccuggagauccuccugca

SEQ ID NO: 2683933 - RNA, 16 nt, Human
ggccugcgacccuggg

SEQ ID NO: 2683934 - RNA, 18 nt, Human
ggccugcgacccuggggg

SEQ ID NO: 2683935 - RNA, 23 nt, Human
ggccugcgacccugggggcacag

SEQ ID NO: 2683936 - RNA, 15 nt, Human
ggccugccucccacu

SEQ ID NO: 2683937 - RNA, 14 nt, Human
ggccugcacaguga

SEQ ID NO: 2683938 - RNA, 23 nt, Human
cacuugaugauacaaugaacacu

SEQ ID NO: 2683939 - RNA, 13 nt, Human
cacuugaguccag

SEQ ID NO: 2683940 - RNA, 18 nt, Human
cacuugaggucaggaguu

SEQ ID NO: 2683941 - RNA, 14 nt, Human
cacuugaggccuga

SEQ ID NO: 2683942 - RNA, 15 nt, Human
cacuugaggccugau

SEQ ID NO: 2683943 - RNA, 16 nt, Human
cacuugaggccugauc

SEQ ID NO: 2683944 - RNA, 17 nt, Human
cacuugaggccugaucu

SEQ ID NO: 2683945 - RNA, 20 nt, Human
cacuugaggccugaucugcc

SEQ ID NO: 2683946 - RNA, 14 nt, Human
cacuugaaaccuuu

SEQ ID NO: 2683947 - RNA, 21 nt, Human
cacuugaaaccuuuuuuuauc

SEQ ID NO: 2683948 - RNA, 19 nt, Human
cacuucuaagaaaagccua

SEQ ID NO: 2683949 - RNA, 19 nt, Human
cacuugaagccaucuaaag

SEQ ID NO: 2683950 - RNA, 13 nt, Human
cacuugagagaaa

SEQ ID NO: 2683951 - RNA, 13 nt, Human
cacuugccugggu

SEQ ID NO: 2683952 - RNA, 12 nt, Human
cacuugccucuu

SEQ ID NO: 2683953 - RNA, 13 nt, Human
cacuugccucuuc

SEQ ID NO: 2683954 - RNA, 21 nt, Human
cacuugccucuuccuugaaga

SEQ ID NO: 2683955 - RNA, 12 nt, Human
cacuugccuggg

SEQ ID NO: 2683956 - RNA, 14 nt, Human
cacuugccucuucc

SEQ ID NO: 2683957 - RNA, 17 nt, Human
cacuugccucuuccuug

SEQ ID NO: 2683958 - RNA, 18 nt, Human
cacuucacuccagccugg

SEQ ID NO: 2683959 - RNA, 14 nt, Human
cacuucacccugga

SEQ ID NO: 2683960 - RNA, 13 nt, Human
cacuguugauaaa

SEQ ID NO: 2683961 - RNA, 14 nt, Human
cacuguugauaaaa

SEQ ID NO: 2683962 - RNA, 16 nt, Human
cacuguugauaaaaac

SEQ ID NO: 2683963 - RNA, 17 nt, Human
cacuguugauaaaaacu

SEQ ID NO: 2683964 - RNA, 15 nt, Human
cacuucauguaaagu

SEQ ID NO: 2683965 - RNA, 19 nt, Human
cacuucauguaaaguguca

SEQ ID NO: 2683966 - RNA, 21 nt, Human
cacuucagcugacuuuucugu

SEQ ID NO: 2683967 - RNA, 12 nt, Human
cacuucagcuga

SEQ ID NO: 2683968 - RNA, 17 nt, Human
cacuucugccagauguc

SEQ ID NO: 2683969 - RNA, 13 nt, Human
cacuucugccaga

SEQ ID NO: 2683970 - RNA, 23 nt, Human
cacuucgggaggucgaggcagga

SEQ ID NO: 2683971 - RNA, 21 nt, Human
cacuucgggaggucgaggcag

SEQ ID NO: 2683972 - RNA, 21 nt, Human
cacuucacugcgaagacccuc

SEQ ID NO: 2683973 - RNA, 15 nt, Human
cacuuccuuuuaacu

SEQ ID NO: 2683974 - RNA, 23 nt, Human
cacuucgcaccggagugucugga

SEQ ID NO: 2683975 - RNA, 14 nt, Human
cacuucccacccug

SEQ ID NO: 2683976 - RNA, 16 nt, Human
cacuucccacccugcc

SEQ ID NO: 2683977 - RNA, 14 nt, Human
cacugugcuuucag

SEQ ID NO: 2683978 - RNA, 19 nt, Human
cacugugaucaauauuuuu

SEQ ID NO: 2683979 - RNA, 21 nt, Human
cacugugaucaauauuuuuau

SEQ ID NO: 2683980 - RNA, 15 nt, Human
cacugugcacaccca

SEQ ID NO: 2683981 - RNA, 19 nt, Human
cacugugcgucuuggugua

SEQ ID NO: 2683982 - RNA, 22 nt, Human
cacugugcgucuugguguaauu

SEQ ID NO: 2683983 - RNA, 13 nt, Human
cacuguguauauu

SEQ ID NO: 2683984 - RNA, 17 nt, Human
cacuguguauauuugau

SEQ ID NO: 2683985 - RNA, 16 nt, Human
cacuguguauauuuga

SEQ ID NO: 2683986 - RNA, 15 nt, Human
cacuguguauauuug

SEQ ID NO: 2683987 - RNA, 14 nt, Human
cacuguguauauuu

SEQ ID NO: 2683988 - RNA, 21 nt, Human
cacuguguauauuugauuuau

SEQ ID NO: 2683989 - RNA, 20 nt, Human
cacuguguauauuugauuua

SEQ ID NO: 2683990 - RNA, 18 nt, Human
cacuguguauauuugauu

SEQ ID NO: 2683991 - RNA, 21 nt, Human
cacuguuccagugucuauaaa

SEQ ID NO: 2683992 - RNA, 13 nt, Human
cacugugaagaga

SEQ ID NO: 2683993 - RNA, 13 nt, Human
cacuggcgaggag

SEQ ID NO: 2683994 - RNA, 23 nt, Human
cacuggcgcaucauaugcaguga

SEQ ID NO: 2683995 - RNA, 13 nt, Human
cacugcaaccucc

SEQ ID NO: 2683996 - RNA, 14 nt, Human
cacugcaaccuccg

SEQ ID NO: 2683997 - RNA, 18 nt, Human
cacugccuucgcuucuug

SEQ ID NO: 2683998 - RNA, 19 nt, Human
cacugccuucgcuucuugc

SEQ ID NO: 2683999 - RNA, 21 nt, Human
cacugccuucgcuucuugccu

SEQ ID NO: 2684000 - RNA, 23 nt, Human
cacugccuucgcuucuugccucu

SEQ ID NO: 2684001 - RNA, 12 nt, Human
cacugccuuuuu

SEQ ID NO: 2684002 - RNA, 15 nt, Human
cacugccugggcuga

SEQ ID NO: 2684003 - RNA, 19 nt, Human
cacugccuuuuuauuuaua

SEQ ID NO: 2684004 - RNA, 20 nt, Human
cacugcgaagacccucuugc

SEQ ID NO: 2684005 - RNA, 21 nt, Human
cacugcgaagacccucuugcc

SEQ ID NO: 2684006 - RNA, 22 nt, Human
cacugcgaagacccucuugccc

SEQ ID NO: 2684007 - RNA, 11 nt, Human
cacugccuggg

SEQ ID NO: 2684008 - RNA, 12 nt, Human
cacugccugggc

SEQ ID NO: 2684009 - RNA, 13 nt, Human
cacugccugggcu

SEQ ID NO: 2684010 - RNA, 19 nt, Human
cacugccugggcugacccc

SEQ ID NO: 2684011 - RNA, 15 nt, Human
cacugccugccuuaa

SEQ ID NO: 2684012 - RNA, 14 nt, Human
cacugccugccuua

SEQ ID NO: 2684013 - RNA, 20 nt, Human
cacugccugccuuaagugag

SEQ ID NO: 2684014 - RNA, 16 nt, Human
cacugccugccuuaag

SEQ ID NO: 2684015 - RNA, 17 nt, Human
cacuggaccccagcaag

SEQ ID NO: 2684016 - RNA, 15 nt, Human
cacuggaccccagca

SEQ ID NO: 2684017 - RNA, 12 nt, Human
cacuggaaaggg

SEQ ID NO: 2684018 - RNA, 15 nt, Human
cacuggaaaggggag

SEQ ID NO: 2684019 - RNA, 16 nt, Human
cacuggaaaggggaga

SEQ ID NO: 2684020 - RNA, 18 nt, Human
cacuggaaaggggagagc

SEQ ID NO: 2684021 - RNA, 19 nt, Human
cacuggaaaggggagagcc

SEQ ID NO: 2684022 - RNA, 22 nt, Human
cacuggaaaggggagagccugc

SEQ ID NO: 2684023 - RNA, 23 nt, Human
cacuggaaaggggagagccugcu

SEQ ID NO: 2684024 - RNA, 24 nt, Human
cacuggaaaggggagagccugcug

SEQ ID NO: 2684025 - RNA, 18 nt, Human
cacuggagguugaagcca

SEQ ID NO: 2684026 - RNA, 20 nt, Human
cacuggagguugaagccaag

SEQ ID NO: 2684027 - RNA, 21 nt, Human
cacuggagguugaagccaagu

SEQ ID NO: 2684028 - RNA, 15 nt, Human
cacuggaugcagaaa

SEQ ID NO: 2684029 - RNA, 18 nt, Human
cacuggcaaugguaguuu

SEQ ID NO: 2684030 - RNA, 23 nt, Human
cacgguuucgaagucauuaaacu

SEQ ID NO: 2684031 - RNA, 21 nt, Human
cacgguuucgaagucauuaaa

SEQ ID NO: 2684032 - RNA, 22 nt, Human
cacggguggggaaaggaggugg

SEQ ID NO: 2684033 - RNA, 13 nt, Human
cacgggugguccc

SEQ ID NO: 2684034 - RNA, 14 nt, Human
cacggguggucccc

SEQ ID NO: 2684035 - RNA, 15 nt, Human
cacgggugguccccg

SEQ ID NO: 2684036 - RNA, 15 nt, Human
cacgggagauuucuu

SEQ ID NO: 2684037 - RNA, 18 nt, Human
cacgggacaucacagggu

SEQ ID NO: 2684038 - RNA, 20 nt, Human
cacgccuguaauccuagcac

SEQ ID NO: 2684039 - RNA, 19 nt, Human
cacgccuguaauccuagca

SEQ ID NO: 2684040 - RNA, 16 nt, Human
cacgccuguaauccca

SEQ ID NO: 2684041 - RNA, 17 nt, Human
cacgcgugccguggcac

SEQ ID NO: 2684042 - RNA, 14 nt, Human
cacgucaugggagg

SEQ ID NO: 2684043 - RNA, 22 nt, Human
cacuaaaaauauuguuucugca

SEQ ID NO: 2684044 - RNA, 22 nt, Human
cacguuuuaaggacugacugag

SEQ ID NO: 2684045 - RNA, 17 nt, Human
cacguuggggugauuua

SEQ ID NO: 2684046 - RNA, 20 nt, Human
cacguuggggugauuuaauc

SEQ ID NO: 2684047 - RNA, 21 nt, Human
cacguuggggugauuuaaucc

SEQ ID NO: 2684048 - RNA, 16 nt, Human
cacguuuuaaggacug

SEQ ID NO: 2684049 - RNA, 15 nt, Human
cacguuuuaaggacu

SEQ ID NO: 2684050 - RNA, 14 nt, Human
cacguuuuaaggac

SEQ ID NO: 2684051 - RNA, 13 nt, Human
cacguuuuaagga

SEQ ID NO: 2684052 - RNA, 21 nt, Human
caccuucuagucuuggccagc

SEQ ID NO: 2684053 - RNA, 21 nt, Human
cacgaagguaaaaaguauuuu

SEQ ID NO: 2684054 - RNA, 16 nt, Human
cacgacugcccggcag

SEQ ID NO: 2684055 - RNA, 23 nt, Human
cacgaauuucugugcccuccuga

SEQ ID NO: 2684056 - RNA, 16 nt, Human
cacgaauagacaucaa

SEQ ID NO: 2684057 - RNA, 17 nt, Human
cacgaauuucugugccc

SEQ ID NO: 2684058 - RNA, 17 nt, Human
cacgacugcccggcagg

SEQ ID NO: 2684059 - RNA, 22 nt, Human
caccuugaagaaccucucacuu

SEQ ID NO: 2684060 - RNA, 21 nt, Human
caccuucuauagcaucacuua

SEQ ID NO: 2684061 - RNA, 16 nt, Human
cacgagaccccggcuu

SEQ ID NO: 2684062 - RNA, 12 nt, Human
cacgagccaccu

SEQ ID NO: 2684063 - RNA, 15 nt, Human
cacgaggucaggaga

SEQ ID NO: 2684064 - RNA, 17 nt, Human
cacgaguaagauuaaga

SEQ ID NO: 2684065 - RNA, 17 nt, Human
cacgcacuucgggaggu

SEQ ID NO: 2684066 - RNA, 23 nt, Human
cacgcacuggguugcgggacaga

SEQ ID NO: 2684067 - RNA, 21 nt, Human
cacgcccgggguggccacagc

SEQ ID NO: 2684068 - RNA, 20 nt, Human
cacgcccguccugccugugg

SEQ ID NO: 2684069 - RNA, 21 nt, Human
cacgcccguccugccuguggc

SEQ ID NO: 2684070 - RNA, 14 nt, Human
cacgcccguccugc

SEQ ID NO: 2684071 - RNA, 15 nt, Human
cacgcccguccugcc

SEQ ID NO: 2684072 - RNA, 16 nt, Human
cacgcccguccugccu

SEQ ID NO: 2684073 - RNA, 19 nt, Human
cacgcccguccugccugug

SEQ ID NO: 2684074 - RNA, 19 nt, Human
cacuccugcuuaaucuuca

SEQ ID NO: 2684075 - RNA, 21 nt, Human
cacuccugcuuaaucuucaaa

SEQ ID NO: 2684076 - RNA, 13 nt, Human
cacuccucagggc

SEQ ID NO: 2684077 - RNA, 16 nt, Human
cacuccucagggcagc

SEQ ID NO: 2684078 - RNA, 14 nt, Human
cacucccuugcugg

SEQ ID NO: 2684079 - RNA, 17 nt, Human
cacucccuugcuggccc

SEQ ID NO: 2684080 - RNA, 18 nt, Human
cacucccuugcuggcccc

SEQ ID NO: 2684081 - RNA, 19 nt, Human
cacucccuugcuggcccca

SEQ ID NO: 2684082 - RNA, 20 nt, Human
cacucccuugcuggccccag

SEQ ID NO: 2684083 - RNA, 22 nt, Human
cacucccuugcuggccccagcc

SEQ ID NO: 2684084 - RNA, 19 nt, Human
cacuccgagaggugggcca

SEQ ID NO: 2684085 - RNA, 14 nt, Human
cacucggguuucuc

SEQ ID NO: 2684086 - RNA, 20 nt, Human
cacucggguuucucuguggc

SEQ ID NO: 2684087 - RNA, 21 nt, Human
cacucggguuucucuguggcu

SEQ ID NO: 2684088 - RNA, 17 nt, Human
cacucgugcaucccuga

SEQ ID NO: 2684089 - RNA, 15 nt, Human
cacucuaagucaugu

SEQ ID NO: 2684090 - RNA, 16 nt, Human
cacucuaagucaugua

SEQ ID NO: 2684091 - RNA, 17 nt, Human
cacucuaagucauguau

SEQ ID NO: 2684092 - RNA, 18 nt, Human
cacucuaagucauguaug

SEQ ID NO: 2684093 - RNA, 22 nt, Human
cacucuaagucauguauguuuc

SEQ ID NO: 2684094 - RNA, 21 nt, Human
cacucuaaaggcgcugagacu

SEQ ID NO: 2684095 - RNA, 16 nt, Human
cacucguguguuucua

SEQ ID NO: 2684096 - RNA, 15 nt, Human
cacucguguguuucu

SEQ ID NO: 2684097 - RNA, 13 nt, Human
cacucuccaucac

SEQ ID NO: 2684098 - RNA, 18 nt, Human
cacucuggaugauggauu

SEQ ID NO: 2684099 - RNA, 21 nt, Human
cacucugcuucucugacuucu

SEQ ID NO: 2684100 - RNA, 16 nt, Human
cacucugcuucucuga

SEQ ID NO: 2684101 - RNA, 17 nt, Human
cacucugcuucucugac

SEQ ID NO: 2684102 - RNA, 18 nt, Human
cacucugcuucucugacu

SEQ ID NO: 2684103 - RNA, 19 nt, Human
cacucugcuucucugacuu

SEQ ID NO: 2684104 - RNA, 12 nt, Human
cacucugcuucu

SEQ ID NO: 2684105 - RNA, 13 nt, Human
cacucugcuucuc

SEQ ID NO: 2684106 - RNA, 14 nt, Human
cacucugcuucucu

SEQ ID NO: 2684107 - RNA, 15 nt, Human
cacucugcuucucug

SEQ ID NO: 2684108 - RNA, 15 nt, Human
cacucacagagucaa

SEQ ID NO: 2684109 - RNA, 18 nt, Human
cacucacagagucaaggc

SEQ ID NO: 2684110 - RNA, 20 nt, Human
cacucacagagucaaggccu

SEQ ID NO: 2684111 - RNA, 22 nt, Human
cacucacagagucaaggccugc

SEQ ID NO: 2684112 - RNA, 23 nt, Human
cacucacagagucaaggccugcu

SEQ ID NO: 2684113 - RNA, 16 nt, Human
cacucacuaggccccc

SEQ ID NO: 2684114 - RNA, 17 nt, Human
cacucacuaggccccca

SEQ ID NO: 2684115 - RNA, 22 nt, Human
cacucacuaggcccccacuugc

SEQ ID NO: 2684116 - RNA, 20 nt, Human
cacucaaaagcugggcaggu

SEQ ID NO: 2684117 - RNA, 19 nt, Human
cacucaaaagcugggcagg

SEQ ID NO: 2684118 - RNA, 18 nt, Human
cacucaaaagcugggcag

SEQ ID NO: 2684119 - RNA, 17 nt, Human
cacucaaaagcugggca

SEQ ID NO: 2684120 - RNA, 15 nt, Human
cacucaaaagcuggg

SEQ ID NO: 2684121 - RNA, 16 nt, Human
cacuaaagcaugaaau

SEQ ID NO: 2684122 - RNA, 21 nt, Human
cacuaaagcaugaaaugugaa

SEQ ID NO: 2684123 - RNA, 22 nt, Human
cacuaaagcaugaaaugugaau

SEQ ID NO: 2684124 - RNA, 13 nt, Human
cacuaaaucagag

SEQ ID NO: 2684125 - RNA, 15 nt, Human
cacuaaaucagagac

SEQ ID NO: 2684126 - RNA, 16 nt, Human
cacuaaaucagagaca

SEQ ID NO: 2684127 - RNA, 14 nt, Human
cacuaacucaccag

SEQ ID NO: 2684128 - RNA, 15 nt, Human
cacuaacucaccagc

SEQ ID NO: 2684129 - RNA, 18 nt, Human
cacuaacucaccagcccc

SEQ ID NO: 2684130 - RNA, 19 nt, Human
cacuaacucaccagcccca

SEQ ID NO: 2684131 - RNA, 16 nt, Human
cacuaacgaaauauca

SEQ ID NO: 2684132 - RNA, 17 nt, Human
cacuaugaagcuaccuc

SEQ ID NO: 2684133 - RNA, 22 nt, Human
caccuguagucccagcuacuug

SEQ ID NO: 2684134 - RNA, 16 nt, Human
caccuguagucccagc

SEQ ID NO: 2684135 - RNA, 17 nt, Human
caccuguagucccagcu

SEQ ID NO: 2684136 - RNA, 22 nt, Human
caccuguagcacuuacugguag

SEQ ID NO: 2684137 - RNA, 11 nt, Human
caccugguugc

SEQ ID NO: 2684138 - RNA, 18 nt, Human
caccuguagcacuuacug

SEQ ID NO: 2684139 - RNA, 23 nt, Human
caccuggcaucgcaccauucuga

SEQ ID NO: 2684140 - RNA, 22 nt, Human
caccuggcugagguuccucugc

SEQ ID NO: 2684141 - RNA, 23 nt, Human
caccuggcugagguuccucugcc

SEQ ID NO: 2684142 - RNA, 19 nt, Human
caccuggcugagguuccuc

SEQ ID NO: 2684143 - RNA, 20 nt, Human
caccuggcugagguuccucu

SEQ ID NO: 2684144 - RNA, 21 nt, Human
caccuggcugagguuccucug

SEQ ID NO: 2684145 - RNA, 19 nt, Human
caccucugcacaagcugca

SEQ ID NO: 2684146 - RNA, 18 nt, Human
caccucugcacaagcugc

SEQ ID NO: 2684147 - RNA, 12 nt, Human
caccuccaggcu

SEQ ID NO: 2684148 - RNA, 14 nt, Human
caccuccccagcau

SEQ ID NO: 2684149 - RNA, 16 nt, Human
caccuccccagcauuc

SEQ ID NO: 2684150 - RNA, 19 nt, Human
caccucaugcccacccccu

SEQ ID NO: 2684151 - RNA, 20 nt, Human
caccucaugcccacccccug

SEQ ID NO: 2684152 - RNA, 21 nt, Human
caccucaugcccacccccugc

SEQ ID NO: 2684153 - RNA, 22 nt, Human
caccucaugcccacccccugcc

SEQ ID NO: 2684154 - RNA, 17 nt, Human
caccguggaggaggaag

SEQ ID NO: 2684155 - RNA, 12 nt, Human
caccucaugccc

SEQ ID NO: 2684156 - RNA, 14 nt, Human
caccucaugcccac

SEQ ID NO: 2684157 - RNA, 15 nt, Human
caccucaugcccacc

SEQ ID NO: 2684158 - RNA, 16 nt, Human
caccucaugcccaccc

SEQ ID NO: 2684159 - RNA, 17 nt, Human
caccucaugcccacccc

SEQ ID NO: 2684160 - RNA, 18 nt, Human
caccucaugcccaccccc

SEQ ID NO: 2684161 - RNA, 19 nt, Human
caccgcgggugugggaaag

SEQ ID NO: 2684162 - RNA, 15 nt, Human
caccgguccagcugg

SEQ ID NO: 2684163 - RNA, 16 nt, Human
caccgguccagcuggc

SEQ ID NO: 2684164 - RNA, 17 nt, Human
caccgguccagcuggcc

SEQ ID NO: 2684165 - RNA, 18 nt, Human
caccgguccagcuggccu

SEQ ID NO: 2684166 - RNA, 19 nt, Human
caccgccuccccaccucca

SEQ ID NO: 2684167 - RNA, 22 nt, Human
caccgccuccccaccuccaggc

SEQ ID NO: 2684168 - RNA, 14 nt, Human
caccgcccaucagg

SEQ ID NO: 2684169 - RNA, 14 nt, Human
caccgccccuggcc

SEQ ID NO: 2684170 - RNA, 15 nt, Human
caccgccccuggccg

SEQ ID NO: 2684171 - RNA, 18 nt, Human
cacccucaaccucuucug

SEQ ID NO: 2684172 - RNA, 21 nt, Human
cacccggugggacccccgugg

SEQ ID NO: 2684173 - RNA, 15 nt, Human
cacccggcugcagag

SEQ ID NO: 2684174 - RNA, 21 nt, Human
cacccggcugcagaggccaga

SEQ ID NO: 2684175 - RNA, 12 nt, Human
caccccuucucu

SEQ ID NO: 2684176 - RNA, 18 nt, Human
caccccuucucuccuccc

SEQ ID NO: 2684177 - RNA, 21 nt, Human
caccccuucucuccuccccaa

SEQ ID NO: 2684178 - RNA, 21 nt, Human
cacccgacgucauguauuuga

SEQ ID NO: 2684179 - RNA, 19 nt, Human
caccccugcccccagcccc

SEQ ID NO: 2684180 - RNA, 18 nt, Human
caccccugcccccagccc

SEQ ID NO: 2684181 - RNA, 11 nt, Human
caccccugccc

SEQ ID NO: 2684182 - RNA, 13 nt, Human
caccccugccccc

SEQ ID NO: 2684183 - RNA, 14 nt, Human
caccccugccccca

SEQ ID NO: 2684184 - RNA, 12 nt, Human
caccccuaccac

SEQ ID NO: 2684185 - RNA, 20 nt, Human
caccccucaacaccucugca

SEQ ID NO: 2684186 - RNA, 13 nt, Human
caccgaggggccu

SEQ ID NO: 2684187 - RNA, 14 nt, Human
caccgaggggccuu

SEQ ID NO: 2684188 - RNA, 16 nt, Human
caccgaggggccuuug

SEQ ID NO: 2684189 - RNA, 15 nt, Human
caccgacugaaaaua

SEQ ID NO: 2684190 - RNA, 15 nt, Human
cagaccagauuaaac

SEQ ID NO: 2684191 - RNA, 23 nt, Human
cagaccacgcccguccugccugu

SEQ ID NO: 2684192 - RNA, 24 nt, Human
cagaccacgcccguccugccugug

SEQ ID NO: 2684193 - RNA, 22 nt, Human
cagaccacgcccguccugccug

SEQ ID NO: 2684194 - RNA, 20 nt, Human
cagaccacaaaacuuuucua

SEQ ID NO: 2684195 - RNA, 14 nt, Human
cagaccacaaaacu

SEQ ID NO: 2684196 - RNA, 13 nt, Human
cagacauuuuaaa

SEQ ID NO: 2684197 - RNA, 20 nt, Human
cagaccgcgggcacugccgc

SEQ ID NO: 2684198 - RNA, 18 nt, Human
cagagaaaaaugcucccc

SEQ ID NO: 2684199 - RNA, 20 nt, Human
cagagaaaaaugcuccccac

SEQ ID NO: 2684200 - RNA, 23 nt, Human
cagagaaaaaugcuccccacagc

SEQ ID NO: 2684201 - RNA, 13 nt, Human
cagacucagagcu

SEQ ID NO: 2684202 - RNA, 15 nt, Human
cagacucagagcucu

SEQ ID NO: 2684203 - RNA, 16 nt, Human
cagacucagagcucuc

SEQ ID NO: 2684204 - RNA, 17 nt, Human
cagacucagagcucucu

SEQ ID NO: 2684205 - RNA, 18 nt, Human
cagacucagagcucucuc

SEQ ID NO: 2684206 - RNA, 20 nt, Human
cagacucagagcucucucua

SEQ ID NO: 2684207 - RNA, 23 nt, Human
cagacucagagcucucucuacag

SEQ ID NO: 2684208 - RNA, 15 nt, Human
cagacuuccuugaga

SEQ ID NO: 2684209 - RNA, 24 nt, Human
cagacuuccuugagacacggagcc

SEQ ID NO: 2684210 - RNA, 14 nt, Human
cagacuuggcucag

SEQ ID NO: 2684211 - RNA, 16 nt, Human
cagaccuggaagaaca

SEQ ID NO: 2684212 - RNA, 21 nt, Human
cagaccuggaagaacaggccu

SEQ ID NO: 2684213 - RNA, 20 nt, Human
cagacuauuuuuagauuuuc

SEQ ID NO: 2684214 - RNA, 22 nt, Human
cagacuauuuuuagauuuucuu

SEQ ID NO: 2684215 - RNA, 15 nt, Human
cagacuauuuuuaga

SEQ ID NO: 2684216 - RNA, 22 nt, Human
cagacauguuuuccgugaaaac

SEQ ID NO: 2684217 - RNA, 18 nt, Human
cagacauguuuuccguga

SEQ ID NO: 2684218 - RNA, 12 nt, Human
cagacauguuuu

SEQ ID NO: 2684219 - RNA, 20 nt, Human
cagacaucugagguuuuauu

SEQ ID NO: 2684220 - RNA, 18 nt, Human
cagacaccuuggacaucc

SEQ ID NO: 2684221 - RNA, 19 nt, Human
cagacacgagccaccucac

SEQ ID NO: 2684222 - RNA, 14 nt, Human
cagacaccuuggac

SEQ ID NO: 2684223 - RNA, 19 nt, Human
cagacacuaacgaaauauc

SEQ ID NO: 2684224 - RNA, 21 nt, Human
cagacacccucaaccucuucu

SEQ ID NO: 2684225 - RNA, 15 nt, Human
cagacacccucaacc

SEQ ID NO: 2684226 - RNA, 14 nt, Human
cagacacccucaac

SEQ ID NO: 2684227 - RNA, 13 nt, Human
cagaauguaagug

SEQ ID NO: 2684228 - RNA, 18 nt, Human
cagaauguaagugggccc

SEQ ID NO: 2684229 - RNA, 19 nt, Human
cagaauguaagugggccca

SEQ ID NO: 2684230 - RNA, 20 nt, Human
cagaauguaagugggcccac

SEQ ID NO: 2684231 - RNA, 21 nt, Human
cagaauguaagugggcccacc

SEQ ID NO: 2684232 - RNA, 22 nt, Human
cagaauguaagugggcccaccc

SEQ ID NO: 2684233 - RNA, 23 nt, Human
cagaauguaagugggcccacccg

SEQ ID NO: 2684234 - RNA, 18 nt, Human
cagaaugcugcaggacuu

SEQ ID NO: 2684235 - RNA, 20 nt, Human
cagaaugcaaccaagucaca

SEQ ID NO: 2684236 - RNA, 21 nt, Human
cagaaugcaaccaagucacac

SEQ ID NO: 2684237 - RNA, 20 nt, Human
cagacaaaagcgcuuuuccu

SEQ ID NO: 2684238 - RNA, 22 nt, Human
cagacaagauuuuuuaauuguu

SEQ ID NO: 2684239 - RNA, 18 nt, Human
cagacaauaaacccucag

SEQ ID NO: 2684240 - RNA, 20 nt, Human
cagacaauaaacccucagag

SEQ ID NO: 2684241 - RNA, 22 nt, Human
cagacaauaaacccucagagcc

SEQ ID NO: 2684242 - RNA, 23 nt, Human
cagacaauaaacccucagagccu

SEQ ID NO: 2684243 - RNA, 15 nt, Human
cagaacuugaaugug

SEQ ID NO: 2684244 - RNA, 18 nt, Human
cagaacucacuggggccu

SEQ ID NO: 2684245 - RNA, 15 nt, Human
cagaacucacugggg

SEQ ID NO: 2684246 - RNA, 21 nt, Human
cagaacgaaccuuggccuggg

SEQ ID NO: 2684247 - RNA, 13 nt, Human
cagaacuacuucu

SEQ ID NO: 2684248 - RNA, 16 nt, Human
cagaacuugaaugugu

SEQ ID NO: 2684249 - RNA, 20 nt, Human
cagaagcacagaauauuuuu

SEQ ID NO: 2684250 - RNA, 20 nt, Human
cagaagucacacauuacaaa

SEQ ID NO: 2684251 - RNA, 22 nt, Human
cagaagucacacauuacaaagu

SEQ ID NO: 2684252 - RNA, 23 nt, Human
cagaagccaaucuacaaucucuu

SEQ ID NO: 2684253 - RNA, 22 nt, Human
cagaaggugccacuuuacccac

SEQ ID NO: 2684254 - RNA, 17 nt, Human
cagaacagugguggcaa

SEQ ID NO: 2684255 - RNA, 20 nt, Human
cagaaccaccccggcccccu

SEQ ID NO: 2684256 - RNA, 16 nt, Human
cagaaccacacuugaa

SEQ ID NO: 2684257 - RNA, 21 nt, Human
cagaaccacacuugaaaccuu

SEQ ID NO: 2684258 - RNA, 22 nt, Human
cagaaccacacuugaaaccuuu

SEQ ID NO: 2684259 - RNA, 20 nt, Human
cagaaacuugugaaguggaa

SEQ ID NO: 2684260 - RNA, 21 nt, Human
cagaaacacugccuuuuuauu

SEQ ID NO: 2684261 - RNA, 15 nt, Human
cagaaacacugccuu

SEQ ID NO: 2684262 - RNA, 17 nt, Human
cagaaacacugccuuuu

SEQ ID NO: 2684263 - RNA, 18 nt, Human
cagaaacacugccuuuuu

SEQ ID NO: 2684264 - RNA, 19 nt, Human
cagaaacacugccuuuuua

SEQ ID NO: 2684265 - RNA, 12 nt, Human
cagaaacacugc

SEQ ID NO: 2684266 - RNA, 13 nt, Human
cagaaacacugcc

SEQ ID NO: 2684267 - RNA, 14 nt, Human
cagaaacacugccu

SEQ ID NO: 2684268 - RNA, 12 nt, Human
cacuuuggggga

SEQ ID NO: 2684269 - RNA, 14 nt, Human
cagaaaaugaaaaa

SEQ ID NO: 2684270 - RNA, 18 nt, Human
cacuuugaagucuauaaa

SEQ ID NO: 2684271 - RNA, 17 nt, Human
cacuuugagccugggaa

SEQ ID NO: 2684272 - RNA, 18 nt, Human
cacuuugagccugggaaa

SEQ ID NO: 2684273 - RNA, 19 nt, Human
cacuuugagccugggaaau

SEQ ID NO: 2684274 - RNA, 20 nt, Human
cacuuucuauccucuguaaa

SEQ ID NO: 2684275 - RNA, 16 nt, Human
cacuuugggaggccaa

SEQ ID NO: 2684276 - RNA, 13 nt, Human
cacuuugggaggc

SEQ ID NO: 2684277 - RNA, 12 nt, Human
cacuuugggagg

SEQ ID NO: 2684278 - RNA, 19 nt, Human
cagaaaaaaugucuguaaa

SEQ ID NO: 2684279 - RNA, 20 nt, Human
cagaaaaaaugucuguaaau

SEQ ID NO: 2684280 - RNA, 20 nt, Human
cagaaaaaaagagugaaaaa

SEQ ID NO: 2684281 - RNA, 21 nt, Human
cagaaaaaaagagugaaaaag

SEQ ID NO: 2684282 - RNA, 21 nt, Human
cagaaaaagaaaugaacauaa

SEQ ID NO: 2684283 - RNA, 17 nt, Human
cagaaaaaggcugugcu

SEQ ID NO: 2684284 - RNA, 14 nt, Human
cacuuuguugcaag

SEQ ID NO: 2684285 - RNA, 15 nt, Human
cacuuuguugcaaga

SEQ ID NO: 2684286 - RNA, 21 nt, Human
cacuuuguugcaagaugugaa

SEQ ID NO: 2684287 - RNA, 22 nt, Human
cacuuuguugcaagaugugaau

SEQ ID NO: 2684288 - RNA, 23 nt, Human
cacuuuguugcaagaugugaauu

SEQ ID NO: 2684289 - RNA, 20 nt, Human
cacuuuguuucguggggagg

SEQ ID NO: 2684290 - RNA, 21 nt, Human
cacuuuguuucguggggaggu

SEQ ID NO: 2684291 - RNA, 14 nt, Human
cacuuuuuaugcua

SEQ ID NO: 2684292 - RNA, 15 nt, Human
cagaggaccagggcc

SEQ ID NO: 2684293 - RNA, 16 nt, Human
cagaggaccagggccu

SEQ ID NO: 2684294 - RNA, 16 nt, Human
cagaggaauccuggca

SEQ ID NO: 2684295 - RNA, 17 nt, Human
cagaggaauccuggcag

SEQ ID NO: 2684296 - RNA, 18 nt, Human
cagaggaauccuggcagc

SEQ ID NO: 2684297 - RNA, 19 nt, Human
cagaggaauccuggcagcc

SEQ ID NO: 2684298 - RNA, 20 nt, Human
cagaggaauccuggcagccc

SEQ ID NO: 2684299 - RNA, 21 nt, Human
cagaggaauccuggcagccca

SEQ ID NO: 2684300 - RNA, 22 nt, Human
cagaggaauccuggcagcccag

SEQ ID NO: 2684301 - RNA, 23 nt, Human
cagaggaauccuggcagcccaga

SEQ ID NO: 2684302 - RNA, 15 nt, Human
cagaggagccuuuuu

SEQ ID NO: 2684303 - RNA, 22 nt, Human
cagaggagccuuuuuaaaacac

SEQ ID NO: 2684304 - RNA, 14 nt, Human
cagaggagccuuuu

SEQ ID NO: 2684305 - RNA, 18 nt, Human
cagagccggcccgccucu

SEQ ID NO: 2684306 - RNA, 20 nt, Human
cagagccggcccgccucucc

SEQ ID NO: 2684307 - RNA, 13 nt, Human
cagaggaaggaga

SEQ ID NO: 2684308 - RNA, 20 nt, Human
cagagaugcaccaccaagcc

SEQ ID NO: 2684309 - RNA, 21 nt, Human
cagagaugcaccaccaagcca

SEQ ID NO: 2684310 - RNA, 16 nt, Human
cagagauuucucauug

SEQ ID NO: 2684311 - RNA, 19 nt, Human
cagagauuucucauugacu

SEQ ID NO: 2684312 - RNA, 20 nt, Human
cagagauuucucauugacuu

SEQ ID NO: 2684313 - RNA, 21 nt, Human
cagagauuucucauugacuuu

SEQ ID NO: 2684314 - RNA, 20 nt, Human
cagagcaagugagacccugu

SEQ ID NO: 2684315 - RNA, 14 nt, Human
cagagcaagugaga

SEQ ID NO: 2684316 - RNA, 21 nt, Human
cagagacacuguugauaaaaa

SEQ ID NO: 2684317 - RNA, 22 nt, Human
cagagacacuguugauaaaaac

SEQ ID NO: 2684318 - RNA, 23 nt, Human
cagagacacuguugauaaaaacu

SEQ ID NO: 2684319 - RNA, 12 nt, Human
cagagacaaaau

SEQ ID NO: 2684320 - RNA, 20 nt, Human
cagagacaaaauauuuccca

SEQ ID NO: 2684321 - RNA, 12 nt, Human
cagagacagaua

SEQ ID NO: 2684322 - RNA, 16 nt, Human
cagagacagauaccuc

SEQ ID NO: 2684323 - RNA, 19 nt, Human
cagagacagauaccuccaa

SEQ ID NO: 2684324 - RNA, 20 nt, Human
cagagacagauaccuccaac

SEQ ID NO: 2684325 - RNA, 14 nt, Human
cagaguuuucauua

SEQ ID NO: 2684326 - RNA, 17 nt, Human
cagaguuuucauuaaau

SEQ ID NO: 2684327 - RNA, 22 nt, Human
cagaguuuucauuaaauccuuu

SEQ ID NO: 2684328 - RNA, 23 nt, Human
cagaguuuucauuaaauccuuuu

SEQ ID NO: 2684329 - RNA, 12 nt, Human
cagagugguggg

SEQ ID NO: 2684330 - RNA, 15 nt, Human
cagagugguggggga

SEQ ID NO: 2684331 - RNA, 12 nt, Human
cagaugagcugu

SEQ ID NO: 2684332 - RNA, 15 nt, Human
cagaucuuucagaaa

SEQ ID NO: 2684333 - RNA, 17 nt, Human
cagaucuuucagaaaua

SEQ ID NO: 2684334 - RNA, 20 nt, Human
cagaucuuucagaaauauaa

SEQ ID NO: 2684335 - RNA, 23 nt, Human
cagaugaauguauuuauuuggga

SEQ ID NO: 2684336 - RNA, 19 nt, Human
cagaugaauguauuuauuu

SEQ ID NO: 2684337 - RNA, 15 nt, Human
cagaugaauguauuu

SEQ ID NO: 2684338 - RNA, 15 nt, Human
cagagucagccagga

SEQ ID NO: 2684339 - RNA, 16 nt, Human
cagagucagccaggac

SEQ ID NO: 2684340 - RNA, 17 nt, Human
cagagucagccaggacc

SEQ ID NO: 2684341 - RNA, 18 nt, Human
cagagucagccaggacca

SEQ ID NO: 2684342 - RNA, 21 nt, Human
cagaggccgcgcguccagcug

SEQ ID NO: 2684343 - RNA, 23 nt, Human
cagaggcccccagcccagggcuc

SEQ ID NO: 2684344 - RNA, 24 nt, Human
cagaggcccccagcccagggcucc

SEQ ID NO: 2684345 - RNA, 16 nt, Human
cagaggcccccagccc

SEQ ID NO: 2684346 - RNA, 17 nt, Human
cagaggcccccagccca

SEQ ID NO: 2684347 - RNA, 19 nt, Human
cagaggcccccagcccagg

SEQ ID NO: 2684348 - RNA, 22 nt, Human
cagaggcccccagcccagggcu

SEQ ID NO: 2684349 - RNA, 14 nt, Human
cagaggcuggguuc

SEQ ID NO: 2684350 - RNA, 12 nt, Human
cagaggcugggu

SEQ ID NO: 2684351 - RNA, 13 nt, Human
cagaggcuggguu

SEQ ID NO: 2684352 - RNA, 20 nt, Human
cagaggccagaggcccccag

SEQ ID NO: 2684353 - RNA, 20 nt, Human
caggaagggaugcaggcucc

SEQ ID NO: 2684354 - RNA, 22 nt, Human
caggaagggccuacagcccauu

SEQ ID NO: 2684355 - RNA, 17 nt, Human
caggaauauuuuccaaa

SEQ ID NO: 2684356 - RNA, 12 nt, Human
caggacgccacu

SEQ ID NO: 2684357 - RNA, 14 nt, Human
caggacgccacuca

SEQ ID NO: 2684358 - RNA, 16 nt, Human
caggacgccacucauu

SEQ ID NO: 2684359 - RNA, 17 nt, Human
caggacgccacucauuu

SEQ ID NO: 2684360 - RNA, 18 nt, Human
caggacgccacucauuuc

SEQ ID NO: 2684361 - RNA, 19 nt, Human
caggacgccacucauuuca

SEQ ID NO: 2684362 - RNA, 20 nt, Human
caggacgccacucauuucau

SEQ ID NO: 2684363 - RNA, 21 nt, Human
caggacgccacucauuucauc

SEQ ID NO: 2684364 - RNA, 17 nt, Human
caggaauguguggccug

SEQ ID NO: 2684365 - RNA, 16 nt, Human
caggaauguguggccu

SEQ ID NO: 2684366 - RNA, 23 nt, Human
caggaauguguggccugcacagu

SEQ ID NO: 2684367 - RNA, 21 nt, Human
caggaauguguggccugcaca

SEQ ID NO: 2684368 - RNA, 19 nt, Human
caggaauguguggccugca

SEQ ID NO: 2684369 - RNA, 14 nt, Human
caggaaggaaguca

SEQ ID NO: 2684370 - RNA, 15 nt, Human
caggaagccguccug

SEQ ID NO: 2684371 - RNA, 18 nt, Human
caggaagccguccuggcg

SEQ ID NO: 2684372 - RNA, 16 nt, Human
caggaagcccaggagc

SEQ ID NO: 2684373 - RNA, 18 nt, Human
caggaagcccaggagccu

SEQ ID NO: 2684374 - RNA, 19 nt, Human
caggaagcccaggagccuc

SEQ ID NO: 2684375 - RNA, 20 nt, Human
caggaagcccaggagccuca

SEQ ID NO: 2684376 - RNA, 14 nt, Human
cagcuugagccggg

SEQ ID NO: 2684377 - RNA, 21 nt, Human
cagcuugagccgggccccugg

SEQ ID NO: 2684378 - RNA, 22 nt, Human
cagcuugagccgggccccuggg

SEQ ID NO: 2684379 - RNA, 15 nt, Human
cagcuugaccugagg

SEQ ID NO: 2684380 - RNA, 16 nt, Human
cagcuugaccugaggc

SEQ ID NO: 2684381 - RNA, 17 nt, Human
cagcuugaccugaggcu

SEQ ID NO: 2684382 - RNA, 19 nt, Human
cagcuugaccugaggcugu

SEQ ID NO: 2684383 - RNA, 20 nt, Human
cagcuugaccugaggcugug

SEQ ID NO: 2684384 - RNA, 21 nt, Human
cagcuugaccugaggcugugg

SEQ ID NO: 2684385 - RNA, 22 nt, Human
cagcuugaccugaggcuguggu

SEQ ID NO: 2684386 - RNA, 23 nt, Human
cagcuugaccugaggcugugguc

SEQ ID NO: 2684387 - RNA, 16 nt, Human
cagcuuucaugauuag

SEQ ID NO: 2684388 - RNA, 21 nt, Human
cagcuuucaucuuuguggaug

SEQ ID NO: 2684389 - RNA, 20 nt, Human
cagcuuucaugauuagcaag

SEQ ID NO: 2684390 - RNA, 17 nt, Human
cagcuuucaugauuagc

SEQ ID NO: 2684391 - RNA, 22 nt, Human
cagcuuggggccaccaaagcug

SEQ ID NO: 2684392 - RNA, 20 nt, Human
cagcuuggggccaccaaagc

SEQ ID NO: 2684393 - RNA, 21 nt, Human
cagcuuggggccaccaaagcu

SEQ ID NO: 2684394 - RNA, 16 nt, Human
cagcuuuucucaacug

SEQ ID NO: 2684395 - RNA, 21 nt, Human
cagcuuuucucaacugggucc

SEQ ID NO: 2684396 - RNA, 12 nt, Human
cagcuuugcaaa

SEQ ID NO: 2684397 - RNA, 16 nt, Human
cagcuuugagaagccu

SEQ ID NO: 2684398 - RNA, 18 nt, Human
cagcuuugagaagccuuc

SEQ ID NO: 2684399 - RNA, 20 nt, Human
cagcuuugaucccugacauc

SEQ ID NO: 2684400 - RNA, 17 nt, Human
cagcuuugaucccugac

SEQ ID NO: 2684401 - RNA, 16 nt, Human
cagcuuugaucccuga

SEQ ID NO: 2684402 - RNA, 19 nt, Human
cagcuuugagaagccuuca

SEQ ID NO: 2684403 - RNA, 20 nt, Human
cagcuuugagaagccuucag

SEQ ID NO: 2684404 - RNA, 23 nt, Human
cagcuuuguuuguugucagcuga

SEQ ID NO: 2684405 - RNA, 22 nt, Human
cagcuuuguuuguugucagcug

SEQ ID NO: 2684406 - RNA, 21 nt, Human
cagcuuuguuuguugucagcu

SEQ ID NO: 2684407 - RNA, 12 nt, Human
cagcuuuguuug

SEQ ID NO: 2684408 - RNA, 18 nt, Human
cagcugguugagguuuca

SEQ ID NO: 2684409 - RNA, 13 nt, Human
cagcuggccugga

SEQ ID NO: 2684410 - RNA, 14 nt, Human
cagcuggccuggac

SEQ ID NO: 2684411 - RNA, 15 nt, Human
cagcuggccuggaca

SEQ ID NO: 2684412 - RNA, 16 nt, Human
cagcuggccuggacag

SEQ ID NO: 2684413 - RNA, 17 nt, Human
cagcuggccuggacagu

SEQ ID NO: 2684414 - RNA, 16 nt, Human
cagcuggccuuuguaa

SEQ ID NO: 2684415 - RNA, 20 nt, Human
cagcugggccgggacccagg

SEQ ID NO: 2684416 - RNA, 23 nt, Human
cagcugggccgggacccagggcc

SEQ ID NO: 2684417 - RNA, 18 nt, Human
cagcugcucccuggcauu

SEQ ID NO: 2684418 - RNA, 23 nt, Human
cagcugcuccgaggacccaggaa

SEQ ID NO: 2684419 - RNA, 19 nt, Human
cagcugcgcuugcuuuucu

SEQ ID NO: 2684420 - RNA, 22 nt, Human
cagcugcuauuuauuuuccuaa

SEQ ID NO: 2684421 - RNA, 17 nt, Human
cagcugcgcuugcuuuu

SEQ ID NO: 2684422 - RNA, 16 nt, Human
cagcugcuauccccau

SEQ ID NO: 2684423 - RNA, 18 nt, Human
cagcugcuauccccaucu

SEQ ID NO: 2684424 - RNA, 23 nt, Human
cagcugcuauccccaucucccug

SEQ ID NO: 2684425 - RNA, 20 nt, Human
cagcugcuauuuauuuuccu

SEQ ID NO: 2684426 - RNA, 23 nt, Human
cagcugaaguugcagauguuaga

SEQ ID NO: 2684427 - RNA, 14 nt, Human
cagcugacaucuug

SEQ ID NO: 2684428 - RNA, 21 nt, Human
cagcugacaucuugaauccuu

SEQ ID NO: 2684429 - RNA, 21 nt, Human
cagcucugcaagaauugaagc

SEQ ID NO: 2684430 - RNA, 19 nt, Human
cagcucugccgucucugga

SEQ ID NO: 2684431 - RNA, 20 nt, Human
cagcucugccgucucuggag

SEQ ID NO: 2684432 - RNA, 11 nt, Human
cagcucuggag

SEQ ID NO: 2684433 - RNA, 16 nt, Human
cagcucugcaagaauu

SEQ ID NO: 2684434 - RNA, 15 nt, Human
cagcucugcaagaau

SEQ ID NO: 2684435 - RNA, 15 nt, Human
cagcucggcucagcu

SEQ ID NO: 2684436 - RNA, 13 nt, Human
cagcucggggagc

SEQ ID NO: 2684437 - RNA, 14 nt, Human
cagcucggcucagc

SEQ ID NO: 2684438 - RNA, 13 nt, Human
cagcucggcucag

SEQ ID NO: 2684439 - RNA, 16 nt, Human
cagcucgguacccggg

SEQ ID NO: 2684440 - RNA, 16 nt, Human
cagcucggggagccuu

SEQ ID NO: 2684441 - RNA, 14 nt, Human
cagcucauuaaacu

SEQ ID NO: 2684442 - RNA, 16 nt, Human
cagcucauuaaacuuu

SEQ ID NO: 2684443 - RNA, 18 nt, Human
cagcucuggaggggaggg

SEQ ID NO: 2684444 - RNA, 22 nt, Human
cagcucugccgucucuggagcg

SEQ ID NO: 2684445 - RNA, 21 nt, Human
cagccccacugccagcagcag

SEQ ID NO: 2684446 - RNA, 22 nt, Human
cagccccacugccagcagcagc

SEQ ID NO: 2684447 - RNA, 19 nt, Human
cagccccagccugcuagcu

SEQ ID NO: 2684448 - RNA, 18 nt, Human
cagccccagccugcuagc

SEQ ID NO: 2684449 - RNA, 17 nt, Human
cagccccagccugcuag

SEQ ID NO: 2684450 - RNA, 16 nt, Human
cagccccagccugcua

SEQ ID NO: 2684451 - RNA, 15 nt, Human
cagccccagccugcu

SEQ ID NO: 2684452 - RNA, 14 nt, Human
cagccccagccugc

SEQ ID NO: 2684453 - RNA, 13 nt, Human
cagccccagccug

SEQ ID NO: 2684454 - RNA, 12 nt, Human
cagccccagccu

SEQ ID NO: 2684455 - RNA, 12 nt, Human
cagccccacugc

SEQ ID NO: 2684456 - RNA, 13 nt, Human
cagccccacugcc

SEQ ID NO: 2684457 - RNA, 14 nt, Human
cagccccacugcca

SEQ ID NO: 2684458 - RNA, 15 nt, Human
cagccccacugccag

SEQ ID NO: 2684459 - RNA, 16 nt, Human
cagccccacugccagc

SEQ ID NO: 2684460 - RNA, 18 nt, Human
cagccccacugccagcag

SEQ ID NO: 2684461 - RNA, 19 nt, Human
cagccccacugccagcagc

SEQ ID NO: 2684462 - RNA, 20 nt, Human
cagccccacugccagcagca

SEQ ID NO: 2684463 - RNA, 20 nt, Human
cagcccuccccauggagcca

SEQ ID NO: 2684464 - RNA, 17 nt, Human
cagcccggccgcuccac

SEQ ID NO: 2684465 - RNA, 13 nt, Human
cagccucagacug

SEQ ID NO: 2684466 - RNA, 14 nt, Human
cagccucagacugg

SEQ ID NO: 2684467 - RNA, 20 nt, Human
cagccucagcgcggcccucc

SEQ ID NO: 2684468 - RNA, 18 nt, Human
cagccucagcgcggcccu

SEQ ID NO: 2684469 - RNA, 17 nt, Human
cagccucagcgcggccc

SEQ ID NO: 2684470 - RNA, 21 nt, Human
cagcccuccccauggagccag

SEQ ID NO: 2684471 - RNA, 11 nt, Human
cagcccugcug

SEQ ID NO: 2684472 - RNA, 12 nt, Human
cagcccugcugg

SEQ ID NO: 2684473 - RNA, 15 nt, Human
cagccuacucuccuu

SEQ ID NO: 2684474 - RNA, 16 nt, Human
cagccuacucuccuug

SEQ ID NO: 2684475 - RNA, 17 nt, Human
cagccuagcacagcagc

SEQ ID NO: 2684476 - RNA, 19 nt, Human
cagccuagcacagcagcuu

SEQ ID NO: 2684477 - RNA, 21 nt, Human
cagccguguaaccauggaccc

SEQ ID NO: 2684478 - RNA, 21 nt, Human
cagcccuggcagggggcaugc

SEQ ID NO: 2684479 - RNA, 13 nt, Human
cagcccugcuggg

SEQ ID NO: 2684480 - RNA, 15 nt, Human
cagcccugcugggga

SEQ ID NO: 2684481 - RNA, 20 nt, Human
cagcccugcuggggaucccc

SEQ ID NO: 2684482 - RNA, 15 nt, Human
cagccucucagugcc

SEQ ID NO: 2684483 - RNA, 19 nt, Human
cagccucucagugcccucc

SEQ ID NO: 2684484 - RNA, 21 nt, Human
cagccucucagugcccuccag

SEQ ID NO: 2684485 - RNA, 22 nt, Human
cagccucucagugcccuccagc

SEQ ID NO: 2684486 - RNA, 19 nt, Human
cagccuggacccuguggau

SEQ ID NO: 2684487 - RNA, 15 nt, Human
cagccuggacccugu

SEQ ID NO: 2684488 - RNA, 20 nt, Human
cagccugcuccagcuguuca

SEQ ID NO: 2684489 - RNA, 14 nt, Human
cagccuccucugga

SEQ ID NO: 2684490 - RNA, 17 nt, Human
cagccuccucuggacgg

SEQ ID NO: 2684491 - RNA, 21 nt, Human
cagccuccucuggacggcagg

SEQ ID NO: 2684492 - RNA, 22 nt, Human
cagccuccucuggacggcaggc

SEQ ID NO: 2684493 - RNA, 23 nt, Human
cagccuccucuggacggcaggcu

SEQ ID NO: 2684494 - RNA, 19 nt, Human
cagccuccgagagggagag

SEQ ID NO: 2684495 - RNA, 20 nt, Human
cagccuccgagagggagaga

SEQ ID NO: 2684496 - RNA, 17 nt, Human
cagccuccgagagggag

SEQ ID NO: 2684497 - RNA, 12 nt, Human
cagccugggccc

SEQ ID NO: 2684498 - RNA, 15 nt, Human
cagccugggccccag

SEQ ID NO: 2684499 - RNA, 16 nt, Human
cagccugggccccagc

SEQ ID NO: 2684500 - RNA, 19 nt, Human
cagccugggcaaugugaua

SEQ ID NO: 2684501 - RNA, 16 nt, Human
cagccugggcaaugug

SEQ ID NO: 2684502 - RNA, 23 nt, Human
cagccuucagacagagaggacug

SEQ ID NO: 2684503 - RNA, 15 nt, Human
cagccuugagcccug

SEQ ID NO: 2684504 - RNA, 16 nt, Human
cagccuugagcccugg

SEQ ID NO: 2684505 - RNA, 18 nt, Human
cagccuugagcccuggcu

SEQ ID NO: 2684506 - RNA, 19 nt, Human
cagccuugagcccuggcug

SEQ ID NO: 2684507 - RNA, 19 nt, Human
cagcuacuugggaggcuga

SEQ ID NO: 2684508 - RNA, 14 nt, Human
cagcuaauucuacu

SEQ ID NO: 2684509 - RNA, 22 nt, Human
cagcuaauucuacucacagugc

SEQ ID NO: 2684510 - RNA, 20 nt, Human
cagcgaucucuccacugugc

SEQ ID NO: 2684511 - RNA, 14 nt, Human
cagcgccagccuca

SEQ ID NO: 2684512 - RNA, 17 nt, Human
cagcgacuccguuggcc

SEQ ID NO: 2684513 - RNA, 21 nt, Human
cagcgacuccguuggccacuc

SEQ ID NO: 2684514 - RNA, 22 nt, Human
cagcgacuccguuggccacucc

SEQ ID NO: 2684515 - RNA, 18 nt, Human
cagcgagggcagcugcua

SEQ ID NO: 2684516 - RNA, 15 nt, Human
cagcgagggcagcug

SEQ ID NO: 2684517 - RNA, 16 nt, Human
cagcgagggcagcugc

SEQ ID NO: 2684518 - RNA, 17 nt, Human
cagcgagggcagcugcu

SEQ ID NO: 2684519 - RNA, 14 nt, Human
cagcgagggcagcu

SEQ ID NO: 2684520 - RNA, 15 nt, Human
cagcuacuugggagg

SEQ ID NO: 2684521 - RNA, 16 nt, Human
cagcuacuugggaggc

SEQ ID NO: 2684522 - RNA, 18 nt, Human
cagcuacuugggaggcug

SEQ ID NO: 2684523 - RNA, 13 nt, Human
cagcuaugcaaaa

SEQ ID NO: 2684524 - RNA, 17 nt, Human
cagcucagaaccacagc

SEQ ID NO: 2684525 - RNA, 15 nt, Human
cagcucagaaccaca

SEQ ID NO: 2684526 - RNA, 13 nt, Human
cagcucagaacca

SEQ ID NO: 2684527 - RNA, 16 nt, Human
cagcuacacagagcuu

SEQ ID NO: 2684528 - RNA, 23 nt, Human
cagccaagguuuuauaaggcuga

SEQ ID NO: 2684529 - RNA, 14 nt, Human
cagccaaguuuuau

SEQ ID NO: 2684530 - RNA, 15 nt, Human
cagccaguucaaaaa

SEQ ID NO: 2684531 - RNA, 16 nt, Human
cagccacuccccggca

SEQ ID NO: 2684532 - RNA, 17 nt, Human
cagcccagagacuuugu

SEQ ID NO: 2684533 - RNA, 21 nt, Human
cagcccagagacuuuguagau

SEQ ID NO: 2684534 - RNA, 13 nt, Human
cagcccagagacu

SEQ ID NO: 2684535 - RNA, 14 nt, Human
cagcccagagacuu

SEQ ID NO: 2684536 - RNA, 12 nt, Human
cagcccagagac

SEQ ID NO: 2684537 - RNA, 16 nt, Human
cagcccagggcuccug

SEQ ID NO: 2684538 - RNA, 17 nt, Human
cagcccagggcuccugc

SEQ ID NO: 2684539 - RNA, 18 nt, Human
cagcccagggcuccugca

SEQ ID NO: 2684540 - RNA, 19 nt, Human
cagcccagggcuccugcac

SEQ ID NO: 2684541 - RNA, 21 nt, Human
cagcccagggcuccugcacuu

SEQ ID NO: 2684542 - RNA, 16 nt, Human
cagccaugccagcugg

SEQ ID NO: 2684543 - RNA, 17 nt, Human
cagccaugccagcuggc

SEQ ID NO: 2684544 - RNA, 18 nt, Human
cagccaugccagcuggcc

SEQ ID NO: 2684545 - RNA, 20 nt, Human
cagccaugccagcuggccuu

SEQ ID NO: 2684546 - RNA, 21 nt, Human
cagccaugccagcuggccuuu

SEQ ID NO: 2684547 - RNA, 23 nt, Human
cagccauccagggggcaagagga

SEQ ID NO: 2684548 - RNA, 15 nt, Human
cagcccaccccucaa

SEQ ID NO: 2684549 - RNA, 17 nt, Human
cagcccaaucugccaga

SEQ ID NO: 2684550 - RNA, 12 nt, Human
cagcccacccug

SEQ ID NO: 2684551 - RNA, 13 nt, Human
cagcccacccugc

SEQ ID NO: 2684552 - RNA, 14 nt, Human
cagcccacccugcu

SEQ ID NO: 2684553 - RNA, 16 nt, Human
cagcccacccugcugc

SEQ ID NO: 2684554 - RNA, 18 nt, Human
cagcccacccugcugcug

SEQ ID NO: 2684555 - RNA, 15 nt, Human
cagccaaaggcuggc

SEQ ID NO: 2684556 - RNA, 21 nt, Human
cagccaaagccuccuccagcc

SEQ ID NO: 2684557 - RNA, 18 nt, Human
cagccaaagccuccucca

SEQ ID NO: 2684558 - RNA, 16 nt, Human
cagccaagauuuuccu

SEQ ID NO: 2684559 - RNA, 20 nt, Human
cagccaagauuuuccucuug

SEQ ID NO: 2684560 - RNA, 22 nt, Human
cagccaagauuuuccucuugug

SEQ ID NO: 2684561 - RNA, 23 nt, Human
cagccaagauuuuccucuuguga

SEQ ID NO: 2684562 - RNA, 18 nt, Human
cagcauuuagcuggccac

SEQ ID NO: 2684563 - RNA, 21 nt, Human
cagcauuuagcuggccacaug

SEQ ID NO: 2684564 - RNA, 22 nt, Human
cagcauuuagcuggccacaugg

SEQ ID NO: 2684565 - RNA, 16 nt, Human
cagccaaagccuccuc

SEQ ID NO: 2684566 - RNA, 15 nt, Human
cagccaaagccuccu

SEQ ID NO: 2684567 - RNA, 14 nt, Human
cagcauuccagccc

SEQ ID NO: 2684568 - RNA, 16 nt, Human
cagcauuccagccccu

SEQ ID NO: 2684569 - RNA, 20 nt, Human
cagcauuccagccccucugg

SEQ ID NO: 2684570 - RNA, 21 nt, Human
cagcauuccagccccucuggu

SEQ ID NO: 2684571 - RNA, 18 nt, Human
cagcagggagggcuucug

SEQ ID NO: 2684572 - RNA, 20 nt, Human
cagcagggagggcuucugcc

SEQ ID NO: 2684573 - RNA, 18 nt, Human
cagcagccuggacccugu

SEQ ID NO: 2684574 - RNA, 15 nt, Human
cagcagccuggaccc

SEQ ID NO: 2684575 - RNA, 14 nt, Human
cagcagccuggacc

SEQ ID NO: 2684576 - RNA, 12 nt, Human
cagcagccugga

SEQ ID NO: 2684577 - RNA, 22 nt, Human
cagcagccuggacccuguggau

SEQ ID NO: 2684578 - RNA, 19 nt, Human
cagcagccuggacccugug

SEQ ID NO: 2684579 - RNA, 15 nt, Human
cagcagcuuauaaug

SEQ ID NO: 2684580 - RNA, 21 nt, Human
cagcagcuuauaaugggcucu

SEQ ID NO: 2684581 - RNA, 23 nt, Human
cagcagcuuauaaugggcucucc

SEQ ID NO: 2684582 - RNA, 18 nt, Human
cagcaaaagaugcuucuc

SEQ ID NO: 2684583 - RNA, 13 nt, Human
cagcaaauuuuca

SEQ ID NO: 2684584 - RNA, 14 nt, Human
cagcaaauuuucag

SEQ ID NO: 2684585 - RNA, 22 nt, Human
cagcaaaugcaaaaacucuuug

SEQ ID NO: 2684586 - RNA, 13 nt, Human
cagcaaaugcaaa

SEQ ID NO: 2684587 - RNA, 14 nt, Human
cagcaaaggaaacu

SEQ ID NO: 2684588 - RNA, 23 nt, Human
cagcaaaggaaacuuugcagaug

SEQ ID NO: 2684589 - RNA, 23 nt, Human
cagcaacgaucacaaaugacuuu

SEQ ID NO: 2684590 - RNA, 22 nt, Human
cagcaacgaucacaaaugacuu

SEQ ID NO: 2684591 - RNA, 21 nt, Human
cagcaacgaucacaaaugacu

SEQ ID NO: 2684592 - RNA, 20 nt, Human
cagcaacgaucacaaaugac

SEQ ID NO: 2684593 - RNA, 19 nt, Human
cagcaacgaucacaaauga

SEQ ID NO: 2684594 - RNA, 18 nt, Human
cagcaacgaucacaaaug

SEQ ID NO: 2684595 - RNA, 16 nt, Human
cagcaacgaucacaaa

SEQ ID NO: 2684596 - RNA, 20 nt, Human
cagcaacggcacagcuaauu

SEQ ID NO: 2684597 - RNA, 22 nt, Human
cagcaacuucuucuccaucccu

SEQ ID NO: 2684598 - RNA, 20 nt, Human
cagcaacuucuucuccaucc

SEQ ID NO: 2684599 - RNA, 14 nt, Human
cagcaacacagccu

SEQ ID NO: 2684600 - RNA, 19 nt, Human
cagcaacacagccugggcc

SEQ ID NO: 2684601 - RNA, 16 nt, Human
cagcaacacagccugg

SEQ ID NO: 2684602 - RNA, 18 nt, Human
cagcaacacagccugggc

SEQ ID NO: 2684603 - RNA, 15 nt, Human
cagauuuuacagagc

SEQ ID NO: 2684604 - RNA, 19 nt, Human
cagauuuuacagagcgcac

SEQ ID NO: 2684605 - RNA, 24 nt, Human
cagauuugucuuuuuguuguaaaa

SEQ ID NO: 2684606 - RNA, 17 nt, Human
cagauguuagauauuuu

SEQ ID NO: 2684607 - RNA, 14 nt, Human
cagauuaaacuuca

SEQ ID NO: 2684608 - RNA, 17 nt, Human
cagauguuuaaaacacc

SEQ ID NO: 2684609 - RNA, 23 nt, Human
cagauguuuccagacuuccuuga

SEQ ID NO: 2684610 - RNA, 18 nt, Human
cagauguuuccagacuuc

SEQ ID NO: 2684611 - RNA, 14 nt, Human
cagauguuuaaaac

SEQ ID NO: 2684612 - RNA, 18 nt, Human
cagaugccacuucuaaga

SEQ ID NO: 2684613 - RNA, 14 nt, Human
cagauguuuccaga

SEQ ID NO: 2684614 - RNA, 16 nt, Human
cagauguuuaaaacac

SEQ ID NO: 2684615 - RNA, 15 nt, Human
cagauguuuaaaaca

SEQ ID NO: 2684616 - RNA, 16 nt, Human
cagauguuuccagacu

SEQ ID NO: 2684617 - RNA, 15 nt, Human
cagauguuuccagac

SEQ ID NO: 2684618 - RNA, 12 nt, Human
cagauguggcua

SEQ ID NO: 2684619 - RNA, 19 nt, Human
cagauguggcuacugacau

SEQ ID NO: 2684620 - RNA, 20 nt, Human
cagauguggcuacugacaua

SEQ ID NO: 2684621 - RNA, 23 nt, Human
cagauguggcuacugacauaucu

SEQ ID NO: 2684622 - RNA, 22 nt, Human
cagauguccuaauggugaugca

SEQ ID NO: 2684623 - RNA, 19 nt, Human
cagauguccuaauggugau

SEQ ID NO: 2684624 - RNA, 15 nt, Human
cagauggucauccag

SEQ ID NO: 2684625 - RNA, 16 nt, Human
cagauggucauccaga

SEQ ID NO: 2684626 - RNA, 18 nt, Human
cagauggaaaaacugagg

SEQ ID NO: 2684627 - RNA, 16 nt, Human
cagaugccacccuagc

SEQ ID NO: 2684628 - RNA, 18 nt, Human
cagaugccacccuagcca

SEQ ID NO: 2684629 - RNA, 20 nt, Human
cagaugccacccuagccaau

SEQ ID NO: 2684630 - RNA, 13 nt, Human
cagaugcguccca

SEQ ID NO: 2684631 - RNA, 20 nt, Human
cagaugcgucccaagauguu

SEQ ID NO: 2684632 - RNA, 21 nt, Human
cagaugcgucccaagauguug

SEQ ID NO: 2684633 - RNA, 22 nt, Human
cagaugcgucccaagauguuga

SEQ ID NO: 2684634 - RNA, 15 nt, Human
cagcaagugugaaua

SEQ ID NO: 2684635 - RNA, 22 nt, Human
cagcaagugguccuagaggccc

SEQ ID NO: 2684636 - RNA, 14 nt, Human
cagcaagugguccu

SEQ ID NO: 2684637 - RNA, 16 nt, Human
cagcacuuugggaggc

SEQ ID NO: 2684638 - RNA, 15 nt, Human
cagcacuuugggagg

SEQ ID NO: 2684639 - RNA, 18 nt, Human
cagcacuuugggaggccg

SEQ ID NO: 2684640 - RNA, 22 nt, Human
cagcagaggcccagauauuaga

SEQ ID NO: 2684641 - RNA, 15 nt, Human
cagcagcaaauuuuc

SEQ ID NO: 2684642 - RNA, 13 nt, Human
cagcagcagcagg

SEQ ID NO: 2684643 - RNA, 14 nt, Human
cagcagcagcaggu

SEQ ID NO: 2684644 - RNA, 15 nt, Human
cagcagcagcaggug

SEQ ID NO: 2684645 - RNA, 13 nt, Human
cagcagcagguga

SEQ ID NO: 2684646 - RNA, 16 nt, Human
cagcagcagcagguga

SEQ ID NO: 2684647 - RNA, 12 nt, Human
cagcagcaggug

SEQ ID NO: 2684648 - RNA, 14 nt, Human
caggcuccccugag

SEQ ID NO: 2684649 - RNA, 16 nt, Human
caggcuccccugagga

SEQ ID NO: 2684650 - RNA, 15 nt, Human
caggcuccccugagg

SEQ ID NO: 2684651 - RNA, 22 nt, Human
caggcucccaggagccugccca

SEQ ID NO: 2684652 - RNA, 15 nt, Human
caggcucccaggagc

SEQ ID NO: 2684653 - RNA, 24 nt, Human
caggcucccaggagccugcccagc

SEQ ID NO: 2684654 - RNA, 23 nt, Human
caggcucccaggagccugcccag

SEQ ID NO: 2684655 - RNA, 13 nt, Human
caggccggcagcc

SEQ ID NO: 2684656 - RNA, 18 nt, Human
caggccgcgcccuuuccc

SEQ ID NO: 2684657 - RNA, 22 nt, Human
caggccggcagccccagccugc

SEQ ID NO: 2684658 - RNA, 21 nt, Human
caggccggcagccccagccug

SEQ ID NO: 2684659 - RNA, 20 nt, Human
caggccggcagccccagccu

SEQ ID NO: 2684660 - RNA, 17 nt, Human
caggccggcagccccag

SEQ ID NO: 2684661 - RNA, 23 nt, Human
caggccggcagccccagccugcu

SEQ ID NO: 2684662 - RNA, 17 nt, Human
caggcuauguauaaaau

SEQ ID NO: 2684663 - RNA, 21 nt, Human
caggcuauguauaaaauacau

SEQ ID NO: 2684664 - RNA, 15 nt, Human
caggcucacucacag

SEQ ID NO: 2684665 - RNA, 16 nt, Human
caggcucacucacaga

SEQ ID NO: 2684666 - RNA, 20 nt, Human
caggcucacucacagaguca

SEQ ID NO: 2684667 - RNA, 13 nt, Human
caggcucacugcc

SEQ ID NO: 2684668 - RNA, 14 nt, Human
caggcucacugcca

SEQ ID NO: 2684669 - RNA, 15 nt, Human
caggcucacugccag

SEQ ID NO: 2684670 - RNA, 16 nt, Human
caggcucacugccagg

SEQ ID NO: 2684671 - RNA, 23 nt, Human
caggcucacugccaggccagccu

SEQ ID NO: 2684672 - RNA, 18 nt, Human
caggcucacugccaggcc

SEQ ID NO: 2684673 - RNA, 20 nt, Human
caggcucacugccaggccag

SEQ ID NO: 2684674 - RNA, 21 nt, Human
caggcucacugccaggccagc

SEQ ID NO: 2684675 - RNA, 22 nt, Human
caggcucacugccaggccagcc

SEQ ID NO: 2684676 - RNA, 15 nt, Human
caggcuccugugaua

SEQ ID NO: 2684677 - RNA, 21 nt, Human
caggcucguggacugaguggg

SEQ ID NO: 2684678 - RNA, 22 nt, Human
caggcccuggccuccccugcca

SEQ ID NO: 2684679 - RNA, 14 nt, Human
caggcccuggccuc

SEQ ID NO: 2684680 - RNA, 15 nt, Human
caggcccuggccucc

SEQ ID NO: 2684681 - RNA, 17 nt, Human
caggcccuggccucccc

SEQ ID NO: 2684682 - RNA, 18 nt, Human
caggcccuggccuccccu

SEQ ID NO: 2684683 - RNA, 20 nt, Human
caggcccuggccuccccugc

SEQ ID NO: 2684684 - RNA, 14 nt, Human
caggcccuccucuc

SEQ ID NO: 2684685 - RNA, 16 nt, Human
caggcccuccucuccc

SEQ ID NO: 2684686 - RNA, 14 nt, Human
caggcugaaaacaa

SEQ ID NO: 2684687 - RNA, 15 nt, Human
caggcugaaaacaau

SEQ ID NO: 2684688 - RNA, 16 nt, Human
caggcugccguggggc

SEQ ID NO: 2684689 - RNA, 16 nt, Human
caggcugccucccuug

SEQ ID NO: 2684690 - RNA, 21 nt, Human
caggcuggccaguccaggcug

SEQ ID NO: 2684691 - RNA, 14 nt, Human
caggcuggccaguc

SEQ ID NO: 2684692 - RNA, 16 nt, Human
caggcuggccagucca

SEQ ID NO: 2684693 - RNA, 18 nt, Human
caggcuggccaguccagg

SEQ ID NO: 2684694 - RNA, 19 nt, Human
caggcuggccaguccaggc

SEQ ID NO: 2684695 - RNA, 12 nt, Human
caggcuggccag

SEQ ID NO: 2684696 - RNA, 14 nt, Human
caggcuggacgugg

SEQ ID NO: 2684697 - RNA, 11 nt, Human
cagggccuuuu

SEQ ID NO: 2684698 - RNA, 20 nt, Human
cagggccuuuucuggcaccg

SEQ ID NO: 2684699 - RNA, 16 nt, Human
caggggacaggagucc

SEQ ID NO: 2684700 - RNA, 22 nt, Human
caggggacaggaguccacuuug

SEQ ID NO: 2684701 - RNA, 22 nt, Human
caggggcugcuuccuccuggaa

SEQ ID NO: 2684702 - RNA, 16 nt, Human
caggggcugcuuccuc

SEQ ID NO: 2684703 - RNA, 18 nt, Human
caggggcugcuuccuccu

SEQ ID NO: 2684704 - RNA, 19 nt, Human
caggggcugcuuccuccug

SEQ ID NO: 2684705 - RNA, 20 nt, Human
caggggcugcuuccuccugg

SEQ ID NO: 2684706 - RNA, 13 nt, Human
caggggcugcuuc

SEQ ID NO: 2684707 - RNA, 23 nt, Human
caggggccuggagauccuccugc

SEQ ID NO: 2684708 - RNA, 12 nt, Human
caggggccugga

SEQ ID NO: 2684709 - RNA, 13 nt, Human
caggggccuggag

SEQ ID NO: 2684710 - RNA, 14 nt, Human
caggggccuggaga

SEQ ID NO: 2684711 - RNA, 15 nt, Human
caggggccuggagau

SEQ ID NO: 2684712 - RNA, 22 nt, Human
caggggccuggagauccuccug

SEQ ID NO: 2684713 - RNA, 15 nt, Human
cagggggcaagagga

SEQ ID NO: 2684714 - RNA, 17 nt, Human
cagggggcaugaccaga

SEQ ID NO: 2684715 - RNA, 14 nt, Human
cagggccaugcuga

SEQ ID NO: 2684716 - RNA, 16 nt, Human
cagggccaugcugagg

SEQ ID NO: 2684717 - RNA, 17 nt, Human
cagggccaugcugaggc

SEQ ID NO: 2684718 - RNA, 18 nt, Human
cagggccaugcugaggcc

SEQ ID NO: 2684719 - RNA, 21 nt, Human
cagggccaugcugaggccugg

SEQ ID NO: 2684720 - RNA, 14 nt, Human
cagggccgaccaga

SEQ ID NO: 2684721 - RNA, 23 nt, Human
cagggccgaccagaggagccuuu

SEQ ID NO: 2684722 - RNA, 23 nt, Human
cagggccaugcugaggccugggc

SEQ ID NO: 2684723 - RNA, 16 nt, Human
cagggccauggcucag

SEQ ID NO: 2684724 - RNA, 17 nt, Human
cagggccauggcucagg

SEQ ID NO: 2684725 - RNA, 18 nt, Human
cagggccauggcucaggg

SEQ ID NO: 2684726 - RNA, 22 nt, Human
cagggccauggcucaggguggu

SEQ ID NO: 2684727 - RNA, 22 nt, Human
cagggccaugcugaggccuggg

SEQ ID NO: 2684728 - RNA, 23 nt, Human
cagggaccggcggaccccagcca

SEQ ID NO: 2684729 - RNA, 22 nt, Human
cagggcaagcuccgcaggacuu

SEQ ID NO: 2684730 - RNA, 13 nt, Human
caggcuuucccac

SEQ ID NO: 2684731 - RNA, 21 nt, Human
cagggcaagcuccgcaggacu

SEQ ID NO: 2684732 - RNA, 18 nt, Human
cagggcaagcuccgcagg

SEQ ID NO: 2684733 - RNA, 15 nt, Human
cagggcaagcuccgc

SEQ ID NO: 2684734 - RNA, 13 nt, Human
cagggcaagcucc

SEQ ID NO: 2684735 - RNA, 21 nt, Human
cagggcagccucccccggcuc

SEQ ID NO: 2684736 - RNA, 15 nt, Human
cagggacacacagcc

SEQ ID NO: 2684737 - RNA, 18 nt, Human
cagggaauccaagccucc

SEQ ID NO: 2684738 - RNA, 23 nt, Human
cagggaauccaagccuccacagc

SEQ ID NO: 2684739 - RNA, 14 nt, Human
cagggaauccaagc

SEQ ID NO: 2684740 - RNA, 15 nt, Human
cagggaagccccaca

SEQ ID NO: 2684741 - RNA, 17 nt, Human
cagggaagccccacaug

SEQ ID NO: 2684742 - RNA, 22 nt, Human
cagggaagccccacauguccag

SEQ ID NO: 2684743 - RNA, 23 nt, Human
cagggaagccccacauguccagc

SEQ ID NO: 2684744 - RNA, 16 nt, Human
caggccauucugccgc

SEQ ID NO: 2684745 - RNA, 19 nt, Human
caggccaaagugccgguga

SEQ ID NO: 2684746 - RNA, 15 nt, Human
caggcaggugggaug

SEQ ID NO: 2684747 - RNA, 17 nt, Human
caggcaguuggccagag

SEQ ID NO: 2684748 - RNA, 14 nt, Human
caggcauagaggcu

SEQ ID NO: 2684749 - RNA, 17 nt, Human
caggcauagaggcuucu

SEQ ID NO: 2684750 - RNA, 18 nt, Human
caggcauagaggcuucuc

SEQ ID NO: 2684751 - RNA, 19 nt, Human
caggcauagaggcuucucc

SEQ ID NO: 2684752 - RNA, 21 nt, Human
caggcauagaggcuucuccgc

SEQ ID NO: 2684753 - RNA, 23 nt, Human
caggcauagaggcuucuccgcca

SEQ ID NO: 2684754 - RNA, 22 nt, Human
caggcaugaggaaucugggagg

SEQ ID NO: 2684755 - RNA, 17 nt, Human
caggcaugguggcccac

SEQ ID NO: 2684756 - RNA, 14 nt, Human
caggcauggcccug

SEQ ID NO: 2684757 - RNA, 15 nt, Human
caggcauggcccugg

SEQ ID NO: 2684758 - RNA, 16 nt, Human
caggcauggcccuggg

SEQ ID NO: 2684759 - RNA, 17 nt, Human
caggcauggcccugggc

SEQ ID NO: 2684760 - RNA, 18 nt, Human
caggcauggcccugggcg

SEQ ID NO: 2684761 - RNA, 17 nt, Human
caggcaaagaaaaugaa

SEQ ID NO: 2684762 - RNA, 12 nt, Human
caggcagggaga

SEQ ID NO: 2684763 - RNA, 12 nt, Human
caggcaggggug

SEQ ID NO: 2684764 - RNA, 13 nt, Human
caggcaggggugg

SEQ ID NO: 2684765 - RNA, 17 nt, Human
caggcaggggugggggu

SEQ ID NO: 2684766 - RNA, 21 nt, Human
caggcagggguggggguggag

SEQ ID NO: 2684767 - RNA, 22 nt, Human
caggcagggguggggguggagg

SEQ ID NO: 2684768 - RNA, 23 nt, Human
caggcagggguggggguggaggc

SEQ ID NO: 2684769 - RNA, 13 nt, Human
caggcagccucug

SEQ ID NO: 2684770 - RNA, 16 nt, Human
caggcagccucuguca

SEQ ID NO: 2684771 - RNA, 17 nt, Human
caggcagccucugucag

SEQ ID NO: 2684772 - RNA, 18 nt, Human
caggcagccucugucagg

SEQ ID NO: 2684773 - RNA, 21 nt, Human
caggcagccucugucaggccu

SEQ ID NO: 2684774 - RNA, 22 nt, Human
caggcagccucugucaggccuu

SEQ ID NO: 2684775 - RNA, 23 nt, Human
caggauggccgggcgcgguggcu

SEQ ID NO: 2684776 - RNA, 23 nt, Human
caggauaucacauuggagucacu

SEQ ID NO: 2684777 - RNA, 22 nt, Human
caggacuuccccggagggcugc

SEQ ID NO: 2684778 - RNA, 21 nt, Human
caggacuuccccggagggcug

SEQ ID NO: 2684779 - RNA, 15 nt, Human
caggacuuccccgga

SEQ ID NO: 2684780 - RNA, 13 nt, Human
caggagacaaaag

SEQ ID NO: 2684781 - RNA, 22 nt, Human
caggagaucgagaccauccugg

SEQ ID NO: 2684782 - RNA, 16 nt, Human
caggagccugcccagc

SEQ ID NO: 2684783 - RNA, 16 nt, Human
caggagccucacuggg

SEQ ID NO: 2684784 - RNA, 15 nt, Human
caggagcaggcacgg

SEQ ID NO: 2684785 - RNA, 17 nt, Human
caggagcaggcacgggu

SEQ ID NO: 2684786 - RNA, 18 nt, Human
caggagcaggcacgggug

SEQ ID NO: 2684787 - RNA, 14 nt, Human
caggaguccacuuu

SEQ ID NO: 2684788 - RNA, 18 nt, Human
caggaguccacuuuguuu

SEQ ID NO: 2684789 - RNA, 21 nt, Human
caggaguuugagaccaaccug

SEQ ID NO: 2684790 - RNA, 16 nt, Human
caggagaaccuaacau

SEQ ID NO: 2684791 - RNA, 23 nt, Human
caggaguuugagaccaaccuggg

SEQ ID NO: 2684792 - RNA, 22 nt, Human
caggaguuugagaccaaccugg

SEQ ID NO: 2684793 - RNA, 16 nt, Human
cagguucaguauuaug

SEQ ID NO: 2684794 - RNA, 14 nt, Human
caguaacugucagg

SEQ ID NO: 2684795 - RNA, 20 nt, Human
caguaagauaucucaaugaa

SEQ ID NO: 2684796 - RNA, 15 nt, Human
caguaagaucacugu

SEQ ID NO: 2684797 - RNA, 17 nt, Human
caguaagaucacuguuu

SEQ ID NO: 2684798 - RNA, 16 nt, Human
caguaagaucacuguu

SEQ ID NO: 2684799 - RNA, 18 nt, Human
caguaacccccuuaaauu

SEQ ID NO: 2684800 - RNA, 20 nt, Human
caguaacccccuuaaauuua

SEQ ID NO: 2684801 - RNA, 21 nt, Human
caguaacccccuuaaauuuaa

SEQ ID NO: 2684802 - RNA, 14 nt, Human
caguaagucuuuuu

SEQ ID NO: 2684803 - RNA, 15 nt, Human
caguaaguuaucuuu

SEQ ID NO: 2684804 - RNA, 20 nt, Human
caguaaguuaucuuugaaua

SEQ ID NO: 2684805 - RNA, 21 nt, Human
caguaagaucacuguuuagau

SEQ ID NO: 2684806 - RNA, 20 nt, Human
caguaagaucacuguuuaga

SEQ ID NO: 2684807 - RNA, 19 nt, Human
caguaagaucacuguuuag

SEQ ID NO: 2684808 - RNA, 14 nt, Human
caguacccaccacc

SEQ ID NO: 2684809 - RNA, 16 nt, Human
caguacccaccaccuu

SEQ ID NO: 2684810 - RNA, 22 nt, Human
caguacuauucagguaacacua

SEQ ID NO: 2684811 - RNA, 17 nt, Human
caguacccugguugugu

SEQ ID NO: 2684812 - RNA, 16 nt, Human
caguacccugguugug

SEQ ID NO: 2684813 - RNA, 12 nt, Human
caggugggcugg

SEQ ID NO: 2684814 - RNA, 22 nt, Human
caggugggcuggacuucuaccu

SEQ ID NO: 2684815 - RNA, 23 nt, Human
caggugggcuggacuucuaccug

SEQ ID NO: 2684816 - RNA, 18 nt, Human
caggugguuauggagagg

SEQ ID NO: 2684817 - RNA, 20 nt, Human
caggugguuauggagagggu

SEQ ID NO: 2684818 - RNA, 20 nt, Human
caggugagaagcagaggaag

SEQ ID NO: 2684819 - RNA, 13 nt, Human
caggugagaagca

SEQ ID NO: 2684820 - RNA, 13 nt, Human
caggugagaaacu

SEQ ID NO: 2684821 - RNA, 22 nt, Human
caggugagaaacuguuugaaaa

SEQ ID NO: 2684822 - RNA, 21 nt, Human
caggugagaagcagaggaagg

SEQ ID NO: 2684823 - RNA, 16 nt, Human
caggugggcccucuga

SEQ ID NO: 2684824 - RNA, 21 nt, Human
caggugcuggagcacugggcu

SEQ ID NO: 2684825 - RNA, 19 nt, Human
caggugcuggagcacuggg

SEQ ID NO: 2684826 - RNA, 18 nt, Human
caggugcuggagcacugg

SEQ ID NO: 2684827 - RNA, 15 nt, Human
caggugcuggagcac

SEQ ID NO: 2684828 - RNA, 23 nt, Human
caggugcuggagcacugggcucc

SEQ ID NO: 2684829 - RNA, 22 nt, Human
caggugcuggagcacugggcuc

SEQ ID NO: 2684830 - RNA, 23 nt, Human
cagguccagcucuggaggggagg

SEQ ID NO: 2684831 - RNA, 13 nt, Human
cagguccagcucu

SEQ ID NO: 2684832 - RNA, 14 nt, Human
cagguccagcucug

SEQ ID NO: 2684833 - RNA, 16 nt, Human
cagguccagcucugga

SEQ ID NO: 2684834 - RNA, 17 nt, Human
cagguccagcucuggag

SEQ ID NO: 2684835 - RNA, 19 nt, Human
cagguccagcucuggaggg

SEQ ID NO: 2684836 - RNA, 23 nt, Human
cagguaguugcaauugaauuaaa

SEQ ID NO: 2684837 - RNA, 18 nt, Human
cagguaguugcaauugaa

SEQ ID NO: 2684838 - RNA, 13 nt, Human
cagguaccagcug

SEQ ID NO: 2684839 - RNA, 14 nt, Human
cagguaccagcugc

SEQ ID NO: 2684840 - RNA, 15 nt, Human
cagguaccagcugcg

SEQ ID NO: 2684841 - RNA, 19 nt, Human
cagguaaugugaauaaauu

SEQ ID NO: 2684842 - RNA, 13 nt, Human
cagguaaugugaa

SEQ ID NO: 2684843 - RNA, 21 nt, Human
cagguaccagcugcgcuugcu

SEQ ID NO: 2684844 - RNA, 16 nt, Human
cagguaccagcugcgc

SEQ ID NO: 2684845 - RNA, 17 nt, Human
cagguaccagcugcgcu

SEQ ID NO: 2684846 - RNA, 18 nt, Human
cagguaccagcugcgcuu

SEQ ID NO: 2684847 - RNA, 19 nt, Human
cagguaccagcugcgcuug

SEQ ID NO: 2684848 - RNA, 13 nt, Human
cagggucccucug

SEQ ID NO: 2684849 - RNA, 21 nt, Human
caggguauuccagagugggga

SEQ ID NO: 2684850 - RNA, 20 nt, Human
caggguauuccagagugggg

SEQ ID NO: 2684851 - RNA, 18 nt, Human
caggguauggacuaucug

SEQ ID NO: 2684852 - RNA, 23 nt, Human
caggguauggacuaucugucugg

SEQ ID NO: 2684853 - RNA, 13 nt, Human
cagggguuucucg

SEQ ID NO: 2684854 - RNA, 12 nt, Human
cagggguggggg

SEQ ID NO: 2684855 - RNA, 20 nt, Human
cagggguggggguggaggcu

SEQ ID NO: 2684856 - RNA, 22 nt, Human
cagggguggggguggaggcuuc

SEQ ID NO: 2684857 - RNA, 15 nt, Human
cagggucccucugug

SEQ ID NO: 2684858 - RNA, 16 nt, Human
cagggucccucugugu

SEQ ID NO: 2684859 - RNA, 13 nt, Human
caggggucucccu

SEQ ID NO: 2684860 - RNA, 14 nt, Human
caggggucucccug

SEQ ID NO: 2684861 - RNA, 15 nt, Human
caggggucucccugg

SEQ ID NO: 2684862 - RNA, 16 nt, Human
caggggucucccuggc

SEQ ID NO: 2684863 - RNA, 17 nt, Human
caggggucucccuggcu

SEQ ID NO: 2684864 - RNA, 18 nt, Human
caggggucucccuggcuc

SEQ ID NO: 2684865 - RNA, 19 nt, Human
caggggucucccuggcucc

SEQ ID NO: 2684866 - RNA, 20 nt, Human
caggggucucccuggcuccc

SEQ ID NO: 2684867 - RNA, 21 nt, Human
caggggucucccuggcucccu

SEQ ID NO: 2684868 - RNA, 22 nt, Human
caggggucucccuggcucccuc

SEQ ID NO: 2684869 - RNA, 13 nt, Human
cagugcccuccag

SEQ ID NO: 2684870 - RNA, 14 nt, Human
cagugcccuccagc

SEQ ID NO: 2684871 - RNA, 16 nt, Human
cagugcccuccagccc

SEQ ID NO: 2684872 - RNA, 18 nt, Human
cagugcccuccagccccg

SEQ ID NO: 2684873 - RNA, 18 nt, Human
cagugccgagaaggaagc

SEQ ID NO: 2684874 - RNA, 15 nt, Human
cagugccgagaagga

SEQ ID NO: 2684875 - RNA, 15 nt, Human
cagugccuauugaua

SEQ ID NO: 2684876 - RNA, 15 nt, Human
cagucuguggaucag

SEQ ID NO: 2684877 - RNA, 22 nt, Human
cagucuuagaucauaguuuuau

SEQ ID NO: 2684878 - RNA, 18 nt, Human
cagugaccucucucucug

SEQ ID NO: 2684879 - RNA, 20 nt, Human
cagugaagauauuuuauuuc

SEQ ID NO: 2684880 - RNA, 21 nt, Human
cagugaauuugcacuguuuaa

SEQ ID NO: 2684881 - RNA, 24 nt, Human
cagugagccgagauugcaccacug

SEQ ID NO: 2684882 - RNA, 15 nt, Human
caguaucucagggcc

SEQ ID NO: 2684883 - RNA, 13 nt, Human
caguaucucaggg

SEQ ID NO: 2684884 - RNA, 16 nt, Human
caguaucccacaucca

SEQ ID NO: 2684885 - RNA, 12 nt, Human
caguaucccaca

SEQ ID NO: 2684886 - RNA, 13 nt, Human
caguaucccacau

SEQ ID NO: 2684887 - RNA, 14 nt, Human
caguaucccacauc

SEQ ID NO: 2684888 - RNA, 15 nt, Human
caguaucccacaucc

SEQ ID NO: 2684889 - RNA, 18 nt, Human
caguaguuuaaaaguucu

SEQ ID NO: 2684890 - RNA, 22 nt, Human
caguaggugcccagaauaaguu

SEQ ID NO: 2684891 - RNA, 17 nt, Human
caguaggacuccuuauu

SEQ ID NO: 2684892 - RNA, 20 nt, Human
caguauaaccagcugaaguu

SEQ ID NO: 2684893 - RNA, 16 nt, Human
caguagauuuuccaaa

SEQ ID NO: 2684894 - RNA, 18 nt, Human
caguagauuuuccaaaug

SEQ ID NO: 2684895 - RNA, 14 nt, Human
caguagaacuccag

SEQ ID NO: 2684896 - RNA, 22 nt, Human
caguagaacuccaggcccuccu

SEQ ID NO: 2684897 - RNA, 12 nt, Human
caguagaacugu

SEQ ID NO: 2684898 - RNA, 14 nt, Human
caguagaacugucu

SEQ ID NO: 2684899 - RNA, 15 nt, Human
caguagaacugucug

SEQ ID NO: 2684900 - RNA, 15 nt, Human
caguacuuuuuuaaa

SEQ ID NO: 2684901 - RNA, 21 nt, Human
caguacuuuuuuaaauauuuu

SEQ ID NO: 2684902 - RNA, 23 nt, Human
caguacuuuuuuaaauauuuucu

SEQ ID NO: 2684903 - RNA, 16 nt, Human
caguagagccagcuug

SEQ ID NO: 2684904 - RNA, 17 nt, Human
caguagagccagcuugg

SEQ ID NO: 2684905 - RNA, 20 nt, Human
caguagaccuuguuacuucu

SEQ ID NO: 2684906 - RNA, 12 nt, Human
caguagagccag

SEQ ID NO: 2684907 - RNA, 13 nt, Human
caguagagccagc

SEQ ID NO: 2684908 - RNA, 14 nt, Human
caguagagccagcu

SEQ ID NO: 2684909 - RNA, 15 nt, Human
caguagagccagcuu

SEQ ID NO: 2684910 - RNA, 21 nt, Human
cagucagguaguugcaauuga

SEQ ID NO: 2684911 - RNA, 15 nt, Human
caguaugugggauau

SEQ ID NO: 2684912 - RNA, 19 nt, Human
caguaugugggauauugaa

SEQ ID NO: 2684913 - RNA, 14 nt, Human
cagucacuggaggu

SEQ ID NO: 2684914 - RNA, 23 nt, Human
cagucacuggagguugaagccaa

SEQ ID NO: 2684915 - RNA, 15 nt, Human
caguccaggcugccg

SEQ ID NO: 2684916 - RNA, 18 nt, Human
caguccaggcugccgugg

SEQ ID NO: 2684917 - RNA, 12 nt, Human
caguccccaccc

SEQ ID NO: 2684918 - RNA, 13 nt, Human
caguccccacccc

SEQ ID NO: 2684919 - RNA, 14 nt, Human
caguccccaccccu

SEQ ID NO: 2684920 - RNA, 15 nt, Human
caguccccaccccug

SEQ ID NO: 2684921 - RNA, 16 nt, Human
caguccccaccccugc

SEQ ID NO: 2684922 - RNA, 17 nt, Human
caguccccaccccugcc

SEQ ID NO: 2684923 - RNA, 18 nt, Human
caguccccaccccugccc

SEQ ID NO: 2684924 - RNA, 14 nt, Human
caguccaaaauacu

SEQ ID NO: 2684925 - RNA, 17 nt, Human
caguccacccugccugc

SEQ ID NO: 2684926 - RNA, 18 nt, Human
caguccacccugccugcc

SEQ ID NO: 2684927 - RNA, 23 nt, Human
cagucauuaugagaggcaaugau

SEQ ID NO: 2684928 - RNA, 13 nt, Human
cagucauuaugag

SEQ ID NO: 2684929 - RNA, 22 nt, Human
cagucccuuccccaugcuuccu

SEQ ID NO: 2684930 - RNA, 15 nt, Human
caguccuacucaagc

SEQ ID NO: 2684931 - RNA, 20 nt, Human
caguccuacucaagcgggug

SEQ ID NO: 2684932 - RNA, 21 nt, Human
caguccuacucaagcgggugg

SEQ ID NO: 2684933 - RNA, 21 nt, Human
caguccccaccccugccccca

SEQ ID NO: 2684934 - RNA, 19 nt, Human
caguccccaccccugcccc

SEQ ID NO: 2684935 - RNA, 20 nt, Human
caguccccaccccugccccc

SEQ ID NO: 2684936 - RNA, 22 nt, Human
cagucauucagcagcaaauuuu

SEQ ID NO: 2684937 - RNA, 14 nt, Human
cauuauuuauaugg

SEQ ID NO: 2684938 - RNA, 17 nt, Human
cauucaaguguaaaaua

SEQ ID NO: 2684939 - RNA, 13 nt, Human
cauucaaauuugu

SEQ ID NO: 2684940 - RNA, 14 nt, Human
cauucaaauuuguc

SEQ ID NO: 2684941 - RNA, 15 nt, Human
cauucaaauuugucu

SEQ ID NO: 2684942 - RNA, 22 nt, Human
cauucaaguguaaaauauuuug

SEQ ID NO: 2684943 - RNA, 23 nt, Human
cauucaaguguaaaauauuuuga

SEQ ID NO: 2684944 - RNA, 18 nt, Human
cauucaaguguaaaauau

SEQ ID NO: 2684945 - RNA, 19 nt, Human
cauucaaguguaaaauauu

SEQ ID NO: 2684946 - RNA, 20 nt, Human
cauucaaguguaaaauauuu

SEQ ID NO: 2684947 - RNA, 21 nt, Human
cauucaaguguaaaauauuuu

SEQ ID NO: 2684948 - RNA, 22 nt, Human
cauuauucucugcuauauauaa

SEQ ID NO: 2684949 - RNA, 24 nt, Human
cauuauucucugcuauauauaaaa

SEQ ID NO: 2684950 - RNA, 18 nt, Human
cauuacuuguugccuaua

SEQ ID NO: 2684951 - RNA, 17 nt, Human
cauuacuuguugccuau

SEQ ID NO: 2684952 - RNA, 21 nt, Human
cauuacagagguauuaaaacu

SEQ ID NO: 2684953 - RNA, 18 nt, Human
cauuaaggggaagaauga

SEQ ID NO: 2684954 - RNA, 19 nt, Human
cauuaaggggaagaaugaa

SEQ ID NO: 2684955 - RNA, 21 nt, Human
cauuaaggggaagaaugaaag

SEQ ID NO: 2684956 - RNA, 23 nt, Human
cauuaaggggaagaaugaaagcu

SEQ ID NO: 2684957 - RNA, 13 nt, Human
cauucagagucag

SEQ ID NO: 2684958 - RNA, 22 nt, Human
cauucagagucagccaggacca

SEQ ID NO: 2684959 - RNA, 19 nt, Human
cauucagcagcaaauuuuc

SEQ ID NO: 2684960 - RNA, 20 nt, Human
cauucagcagcaaauuuuca

SEQ ID NO: 2684961 - RNA, 12 nt, Human
cauucagaaaug

SEQ ID NO: 2684962 - RNA, 14 nt, Human
cauucagaaauguu

SEQ ID NO: 2684963 - RNA, 15 nt, Human
cauucagaaauguug

SEQ ID NO: 2684964 - RNA, 20 nt, Human
cauucagaaauguugagucu

SEQ ID NO: 2684965 - RNA, 23 nt, Human
cauucagaaauguugagucugua

SEQ ID NO: 2684966 - RNA, 11 nt, Human
cauucauuuuu

SEQ ID NO: 2684967 - RNA, 13 nt, Human
cauucauuuuuau

SEQ ID NO: 2684968 - RNA, 16 nt, Human
cauucauuuuuauagc

SEQ ID NO: 2684969 - RNA, 22 nt, Human
cauuccuaaagaaaaauaucuu

SEQ ID NO: 2684970 - RNA, 13 nt, Human
cauuccacacaga

SEQ ID NO: 2684971 - RNA, 13 nt, Human
cauuccagccccu

SEQ ID NO: 2684972 - RNA, 15 nt, Human
cauuccagccccucu

SEQ ID NO: 2684973 - RNA, 18 nt, Human
cauuccagccccucuggu

SEQ ID NO: 2684974 - RNA, 19 nt, Human
cauuccagccccucugguc

SEQ ID NO: 2684975 - RNA, 22 nt, Human
cauuccagccccucuggucgcu

SEQ ID NO: 2684976 - RNA, 12 nt, Human
cauuccaggcag

SEQ ID NO: 2684977 - RNA, 17 nt, Human
cauuccaggcagccucu

SEQ ID NO: 2684978 - RNA, 18 nt, Human
cauuccaggcagccucug

SEQ ID NO: 2684979 - RNA, 19 nt, Human
cauuccaggcagccucugu

SEQ ID NO: 2684980 - RNA, 21 nt, Human
cauuccaggcagccucuguca

SEQ ID NO: 2684981 - RNA, 21 nt, Human
cauucuggucaagggcuguca

SEQ ID NO: 2684982 - RNA, 23 nt, Human
cauucuggucaagggcugucauu

SEQ ID NO: 2684983 - RNA, 12 nt, Human
cauucuuacuaa

SEQ ID NO: 2684984 - RNA, 18 nt, Human
cauucuuacuaaaaagua

SEQ ID NO: 2684985 - RNA, 19 nt, Human
cauucuuacuaaaaaguau

SEQ ID NO: 2684986 - RNA, 22 nt, Human
cauucuuacuaaaaaguauaaa

SEQ ID NO: 2684987 - RNA, 18 nt, Human
cauucugccgcccccucc

SEQ ID NO: 2684988 - RNA, 21 nt, Human
cauucugccgcccccuccuga

SEQ ID NO: 2684989 - RNA, 22 nt, Human
cauucugccgcccccuccugaa

SEQ ID NO: 2684990 - RNA, 23 nt, Human
cauucugccgcccccuccugaac

SEQ ID NO: 2684991 - RNA, 23 nt, Human
cauucugacucgguuucuccaaa

SEQ ID NO: 2684992 - RNA, 12 nt, Human
cauucugacucg

SEQ ID NO: 2684993 - RNA, 16 nt, Human
cauucugacucgguuu

SEQ ID NO: 2684994 - RNA, 19 nt, Human
cauucugacucgguuucuc

SEQ ID NO: 2684995 - RNA, 21 nt, Human
cauucugacucgguuucucca

SEQ ID NO: 2684996 - RNA, 12 nt, Human
cauucuuggcuu

SEQ ID NO: 2684997 - RNA, 19 nt, Human
cauucuuggcuuaaucauu

SEQ ID NO: 2684998 - RNA, 20 nt, Human
cauucuuggcuuaaucauuu

SEQ ID NO: 2684999 - RNA, 14 nt, Human
cauuuucauuccua

SEQ ID NO: 2685000 - RNA, 23 nt, Human
ccaaaauguaggcuuaguuugug

SEQ ID NO: 2685001 - RNA, 20 nt, Human
ccaaaaugugagugguugaa

SEQ ID NO: 2685002 - RNA, 16 nt, Human
ccaaaaucucaagaaa

SEQ ID NO: 2685003 - RNA, 15 nt, Human
ccaaaauuaaggugu

SEQ ID NO: 2685004 - RNA, 14 nt, Human
ccaaaauuaaggug

SEQ ID NO: 2685005 - RNA, 16 nt, Human
cauuugcaauaacagc

SEQ ID NO: 2685006 - RNA, 18 nt, Human
cauuugcaauaacagcug

SEQ ID NO: 2685007 - RNA, 19 nt, Human
cauuugcaauaacagcugc

SEQ ID NO: 2685008 - RNA, 20 nt, Human
cauuugcaauaacagcugca

SEQ ID NO: 2685009 - RNA, 21 nt, Human
cauuugcaauaacagcugcaa

SEQ ID NO: 2685010 - RNA, 13 nt, Human
cauuugcugaaua

SEQ ID NO: 2685011 - RNA, 16 nt, Human
cauuugaugcaugucu

SEQ ID NO: 2685012 - RNA, 17 nt, Human
cauuugaugcaugucuu

SEQ ID NO: 2685013 - RNA, 19 nt, Human
cauuugaugcaugucuuuu

SEQ ID NO: 2685014 - RNA, 20 nt, Human
cauuugaugcaugucuuuua

SEQ ID NO: 2685015 - RNA, 22 nt, Human
cauuugaugcaugucuuuuaaa

SEQ ID NO: 2685016 - RNA, 18 nt, Human
cauugaaguaaugaauuu

SEQ ID NO: 2685017 - RNA, 21 nt, Human
cauugaagaauguuagaguaa

SEQ ID NO: 2685018 - RNA, 22 nt, Human
cauugaagaauguuagaguaau

SEQ ID NO: 2685019 - RNA, 19 nt, Human
cauugaaguaaugaauuuu

SEQ ID NO: 2685020 - RNA, 10 nt, Human
cauugaguau

SEQ ID NO: 2685021 - RNA, 14 nt, Human
cauugaguauuguu

SEQ ID NO: 2685022 - RNA, 15 nt, Human
cauugaguauuguuu

SEQ ID NO: 2685023 - RNA, 16 nt, Human
cauugaguauuguuua

SEQ ID NO: 2685024 - RNA, 18 nt, Human
cauugaguauuguuuaaa

SEQ ID NO: 2685025 - RNA, 22 nt, Human
cauugaguauuguuuaaaaugu

SEQ ID NO: 2685026 - RNA, 14 nt, Human
cauugagcugugca

SEQ ID NO: 2685027 - RNA, 15 nt, Human
cauugagcugugcaa

SEQ ID NO: 2685028 - RNA, 21 nt, Human
cauuguaagcguauggcuuua

SEQ ID NO: 2685029 - RNA, 15 nt, Human
cauuuaaaaaaaauc

SEQ ID NO: 2685030 - RNA, 12 nt, Human
cauuuaaaaaaa

SEQ ID NO: 2685031 - RNA, 14 nt, Human
cauuuaagggaaaa

SEQ ID NO: 2685032 - RNA, 15 nt, Human
cauuuaagggaaaaa

SEQ ID NO: 2685033 - RNA, 16 nt, Human
cauuuaagggaaaaau

SEQ ID NO: 2685034 - RNA, 17 nt, Human
cauuuaagggaaaaaua

SEQ ID NO: 2685035 - RNA, 18 nt, Human
cauuuaagggaaaaauau

SEQ ID NO: 2685036 - RNA, 19 nt, Human
cauuuaagggaaaaauaua

SEQ ID NO: 2685037 - RNA, 22 nt, Human
cauuuaagggaaaaauauauau

SEQ ID NO: 2685038 - RNA, 20 nt, Human
cauuuaagggaaagaaaaug

SEQ ID NO: 2685039 - RNA, 20 nt, Human
cauuuaagcuguggucaagg

SEQ ID NO: 2685040 - RNA, 9 nt, Human
cauugagua

SEQ ID NO: 2685041 - RNA, 18 nt, Human
cauuuacucuaaaaacug

SEQ ID NO: 2685042 - RNA, 21 nt, Human
cauguuuccucuaguucuuug

SEQ ID NO: 2685043 - RNA, 13 nt, Human
cauguuuccucua

SEQ ID NO: 2685044 - RNA, 14 nt, Human
caugugagcucuuc

SEQ ID NO: 2685045 - RNA, 16 nt, Human
caugugagcucuuccu

SEQ ID NO: 2685046 - RNA, 18 nt, Human
caugugagcucuuccuau

SEQ ID NO: 2685047 - RNA, 21 nt, Human
caugugagugacgaugaugua

SEQ ID NO: 2685048 - RNA, 15 nt, Human
caugugauacauuuu

SEQ ID NO: 2685049 - RNA, 16 nt, Human
caugugauacauuuuu

SEQ ID NO: 2685050 - RNA, 22 nt, Human
caugugauacauuuuuuaagcu

SEQ ID NO: 2685051 - RNA, 17 nt, Human
caugugauggacacucc

SEQ ID NO: 2685052 - RNA, 18 nt, Human
caugugauggacacucca

SEQ ID NO: 2685053 - RNA, 19 nt, Human
caugugauggacacuccag

SEQ ID NO: 2685054 - RNA, 20 nt, Human
caugugauggacacuccagg

SEQ ID NO: 2685055 - RNA, 21 nt, Human
caugugauggacacuccaggg

SEQ ID NO: 2685056 - RNA, 22 nt, Human
caugugauggacacuccaggga

SEQ ID NO: 2685057 - RNA, 17 nt, Human
cauguaaagugucagaa

SEQ ID NO: 2685058 - RNA, 18 nt, Human
cauguaaagugucagaag

SEQ ID NO: 2685059 - RNA, 15 nt, Human
cauguaaauguaaac

SEQ ID NO: 2685060 - RNA, 16 nt, Human
cauguaaauguaaacu

SEQ ID NO: 2685061 - RNA, 19 nt, Human
caugguuuugugccaucug

SEQ ID NO: 2685062 - RNA, 20 nt, Human
caugguuuugugccaucugu

SEQ ID NO: 2685063 - RNA, 24 nt, Human
caugguuuugugccaucuguagcu

SEQ ID NO: 2685064 - RNA, 13 nt, Human
caugguggccaga

SEQ ID NO: 2685065 - RNA, 21 nt, Human
caugucguggacacacacaga

SEQ ID NO: 2685066 - RNA, 22 nt, Human
cauggugccugagaggcaggca

SEQ ID NO: 2685067 - RNA, 18 nt, Human
cauggugccugagaggca

SEQ ID NO: 2685068 - RNA, 17 nt, Human
cauggugccugagaggc

SEQ ID NO: 2685069 - RNA, 19 nt, Human
cauggugccugagaggcag

SEQ ID NO: 2685070 - RNA, 21 nt, Human
cauggugccugagaggcaggc

SEQ ID NO: 2685071 - RNA, 14 nt, Human
caugguuugacuca

SEQ ID NO: 2685072 - RNA, 15 nt, Human
cauguaaaacagaaa

SEQ ID NO: 2685073 - RNA, 17 nt, Human
cauguaaaacagaaaaa

SEQ ID NO: 2685074 - RNA, 14 nt, Human
cauguuugccuaga

SEQ ID NO: 2685075 - RNA, 18 nt, Human
cauguuugccuagacagc

SEQ ID NO: 2685076 - RNA, 23 nt, Human
cauuaaaaaaaugugccuaguuu

SEQ ID NO: 2685077 - RNA, 14 nt, Human
caugcuucuucuca

SEQ ID NO: 2685078 - RNA, 15 nt, Human
cauggaaaucagcca

SEQ ID NO: 2685079 - RNA, 21 nt, Human
cauggaaaucagccaaguuuu

SEQ ID NO: 2685080 - RNA, 19 nt, Human
caugcuugugaaaaugugu

SEQ ID NO: 2685081 - RNA, 17 nt, Human
cauggagccagcucccu

SEQ ID NO: 2685082 - RNA, 14 nt, Human
cauggagccagcuc

SEQ ID NO: 2685083 - RNA, 14 nt, Human
caugcacuuaaaga

SEQ ID NO: 2685084 - RNA, 16 nt, Human
caugcacuuaaagaag

SEQ ID NO: 2685085 - RNA, 17 nt, Human
caugcacuuaaagaagu

SEQ ID NO: 2685086 - RNA, 22 nt, Human
caugcgcucagggccaugcuga

SEQ ID NO: 2685087 - RNA, 23 nt, Human
caugcgcucagggccaugcugag

SEQ ID NO: 2685088 - RNA, 14 nt, Human
caugggagggggcu

SEQ ID NO: 2685089 - RNA, 22 nt, Human
caugggagggggcuugaagcca

SEQ ID NO: 2685090 - RNA, 20 nt, Human
cauggcagccuacucuccuu

SEQ ID NO: 2685091 - RNA, 14 nt, Human
caucaccugccugu

SEQ ID NO: 2685092 - RNA, 14 nt, Human
caucacccucuucc

SEQ ID NO: 2685093 - RNA, 21 nt, Human
caucacccucuuccugugauc

SEQ ID NO: 2685094 - RNA, 19 nt, Human
caucaguuuuguuuacuca

SEQ ID NO: 2685095 - RNA, 16 nt, Human
caucauccagaugugg

SEQ ID NO: 2685096 - RNA, 17 nt, Human
caucauccagauguggc

SEQ ID NO: 2685097 - RNA, 12 nt, Human
caucaugcaugu

SEQ ID NO: 2685098 - RNA, 17 nt, Human
cauccagacucagagcu

SEQ ID NO: 2685099 - RNA, 21 nt, Human
cauccagacucagagcucucu

SEQ ID NO: 2685100 - RNA, 23 nt, Human
cauccagucucccaacuuguauu

SEQ ID NO: 2685101 - RNA, 22 nt, Human
caucauuccuuuuuauuuauau

SEQ ID NO: 2685102 - RNA, 15 nt, Human
caucauuccuuuuua

SEQ ID NO: 2685103 - RNA, 20 nt, Human
caucauuccuuuuuauuuau

SEQ ID NO: 2685104 - RNA, 19 nt, Human
caucauuccuuuuuauuua

SEQ ID NO: 2685105 - RNA, 23 nt, Human
caucccugagacagggagggaag

SEQ ID NO: 2685106 - RNA, 13 nt, Human
cauagucccugcc

SEQ ID NO: 2685107 - RNA, 11 nt, Human
cauauaagaca

SEQ ID NO: 2685108 - RNA, 18 nt, Human
cauauaagacaaauauuc

SEQ ID NO: 2685109 - RNA, 20 nt, Human
cauauaagacaaauauuccu

SEQ ID NO: 2685110 - RNA, 13 nt, Human
cauauauauuaca

SEQ ID NO: 2685111 - RNA, 16 nt, Human
cauauauauuacaagg

SEQ ID NO: 2685112 - RNA, 19 nt, Human
cauagugaaaauuguuuag

SEQ ID NO: 2685113 - RNA, 14 nt, Human
cauauaguguacag

SEQ ID NO: 2685114 - RNA, 12 nt, Human
cauauauauuac

SEQ ID NO: 2685115 - RNA, 21 nt, Human
cauaguacucuuuguagcaaa

SEQ ID NO: 2685116 - RNA, 14 nt, Human
cauaguaagauuga

SEQ ID NO: 2685117 - RNA, 22 nt, Human
cauagucaccugacuaagaaau

SEQ ID NO: 2685118 - RNA, 12 nt, Human
cauagucccugc

SEQ ID NO: 2685119 - RNA, 19 nt, Human
cauaguauccauauuuuau

SEQ ID NO: 2685120 - RNA, 20 nt, Human
cauaguauccauauuuuauu

SEQ ID NO: 2685121 - RNA, 18 nt, Human
cauaugaaaauacaacuu

SEQ ID NO: 2685122 - RNA, 11 nt, Human
cauaugaaaaa

SEQ ID NO: 2685123 - RNA, 22 nt, Human
cauaugaaaaaaaugcauuuua

SEQ ID NO: 2685124 - RNA, 15 nt, Human
cauaugaaaggagag

SEQ ID NO: 2685125 - RNA, 20 nt, Human
cauaucuuaauauauuucua

SEQ ID NO: 2685126 - RNA, 21 nt, Human
cauauugugcuucacaguaga

SEQ ID NO: 2685127 - RNA, 23 nt, Human
cauauugugcuucacaguagagc

SEQ ID NO: 2685128 - RNA, 17 nt, Human
caugacucggggguggg

SEQ ID NO: 2685129 - RNA, 14 nt, Human
caugagaugugugg

SEQ ID NO: 2685130 - RNA, 12 nt, Human
caugagaugugu

SEQ ID NO: 2685131 - RNA, 23 nt, Human
caugagauguguggacuguggca

SEQ ID NO: 2685132 - RNA, 15 nt, Human
caugagaugugugga

SEQ ID NO: 2685133 - RNA, 17 nt, Human
caugagauguguggacu

SEQ ID NO: 2685134 - RNA, 15 nt, Human
caugagacucagugc

SEQ ID NO: 2685135 - RNA, 17 nt, Human
caugagacucagugcag

SEQ ID NO: 2685136 - RNA, 18 nt, Human
caugagacucagugcaga

SEQ ID NO: 2685137 - RNA, 19 nt, Human
caugagacucagugcagau

SEQ ID NO: 2685138 - RNA, 12 nt, Human
caugaggagggu

SEQ ID NO: 2685139 - RNA, 13 nt, Human
caugaggagggug

SEQ ID NO: 2685140 - RNA, 20 nt, Human
caugaggagggugggggagg

SEQ ID NO: 2685141 - RNA, 22 nt, Human
caugaggaacuguagaugaugu

SEQ ID NO: 2685142 - RNA, 18 nt, Human
caugaggaacuguagaug

SEQ ID NO: 2685143 - RNA, 21 nt, Human
caugaguaaaauagauuuuau

SEQ ID NO: 2685144 - RNA, 21 nt, Human
caugaguagauaauuucaggg

SEQ ID NO: 2685145 - RNA, 22 nt, Human
caugaguagauaauuucagggu

SEQ ID NO: 2685146 - RNA, 13 nt, Human
caugaaauaaaau

SEQ ID NO: 2685147 - RNA, 14 nt, Human
caugaaauaaaaua

SEQ ID NO: 2685148 - RNA, 18 nt, Human
caugaaauaaaauauauc

SEQ ID NO: 2685149 - RNA, 21 nt, Human
caugaaauaaaauauaucuua

SEQ ID NO: 2685150 - RNA, 24 nt, Human
caugaaaauaccauuuaguaagaa

SEQ ID NO: 2685151 - RNA, 15 nt, Human
caugaagaauagaaa

SEQ ID NO: 2685152 - RNA, 18 nt, Human
caugaagaauagaaacaa

SEQ ID NO: 2685153 - RNA, 13 nt, Human
caugaaaugugaa

SEQ ID NO: 2685154 - RNA, 14 nt, Human
caugaaaugugaau

SEQ ID NO: 2685155 - RNA, 16 nt, Human
caugaaaugugaauuu

SEQ ID NO: 2685156 - RNA, 19 nt, Human
caugaaaugugaauuuuua

SEQ ID NO: 2685157 - RNA, 20 nt, Human
caugaaaugugaauuuuuau

SEQ ID NO: 2685158 - RNA, 23 nt, Human
caugaaaugugaauuuuuauugu

SEQ ID NO: 2685159 - RNA, 22 nt, Human
caugaaacuuguuucacugaaa

SEQ ID NO: 2685160 - RNA, 18 nt, Human
caucuuuuuuguuaacug

SEQ ID NO: 2685161 - RNA, 14 nt, Human
caucuuugaugugu

SEQ ID NO: 2685162 - RNA, 13 nt, Human
caucuuugaugug

SEQ ID NO: 2685163 - RNA, 12 nt, Human
caucuuugaugu

SEQ ID NO: 2685164 - RNA, 18 nt, Human
caucuuugauguguuguu

SEQ ID NO: 2685165 - RNA, 16 nt, Human
caucuuugauguguug

SEQ ID NO: 2685166 - RNA, 15 nt, Human
caucuuugauguguu

SEQ ID NO: 2685167 - RNA, 14 nt, Human
caucugaaauguua

SEQ ID NO: 2685168 - RNA, 16 nt, Human
caucucuacaaaaagc

SEQ ID NO: 2685169 - RNA, 15 nt, Human
caucucccucccaca

SEQ ID NO: 2685170 - RNA, 21 nt, Human
caucuccccucagcucggcuc

SEQ ID NO: 2685171 - RNA, 17 nt, Human
caucuccccucagcucg

SEQ ID NO: 2685172 - RNA, 16 nt, Human
caucuccccucagcuc

SEQ ID NO: 2685173 - RNA, 13 nt, Human
caucucccugccu

SEQ ID NO: 2685174 - RNA, 14 nt, Human
caucucccugccug

SEQ ID NO: 2685175 - RNA, 15 nt, Human
caucucccugccugg

SEQ ID NO: 2685176 - RNA, 16 nt, Human
caucucccugccuggc

SEQ ID NO: 2685177 - RNA, 17 nt, Human
caucucccugccuggcc

SEQ ID NO: 2685178 - RNA, 18 nt, Human
caucucccugccuggccc

SEQ ID NO: 2685179 - RNA, 19 nt, Human
caucucccugccuggcccc

SEQ ID NO: 2685180 - RNA, 21 nt, Human
caucucccugccuggccccca

SEQ ID NO: 2685181 - RNA, 15 nt, Human
caucuccccucagcu

SEQ ID NO: 2685182 - RNA, 16 nt, Human
cauccgcgugugccug

SEQ ID NO: 2685183 - RNA, 17 nt, Human
cauccgcgugugccugu

SEQ ID NO: 2685184 - RNA, 20 nt, Human
cauccgcgugugccugugug

SEQ ID NO: 2685185 - RNA, 10 nt, Human
caucuuuaag

SEQ ID NO: 2685186 - RNA, 16 nt, Human
caucugccccacaguc

SEQ ID NO: 2685187 - RNA, 13 nt, Human
caucuugaauccu

SEQ ID NO: 2685188 - RNA, 17 nt, Human
caucuugaauccuucca

SEQ ID NO: 2685189 - RNA, 18 nt, Human
caucuugaauccuuccau

SEQ ID NO: 2685190 - RNA, 23 nt, Human
caucuugaauccuuccauuccac

SEQ ID NO: 2685191 - RNA, 21 nt, Human
ccacuaagaauucaaacuggg

SEQ ID NO: 2685192 - RNA, 15 nt, Human
ccacuccccggcaug

SEQ ID NO: 2685193 - RNA, 18 nt, Human
ccacucacuaggccccca

SEQ ID NO: 2685194 - RNA, 13 nt, Human
ccacucauuucau

SEQ ID NO: 2685195 - RNA, 14 nt, Human
ccacucauuucauc

SEQ ID NO: 2685196 - RNA, 15 nt, Human
ccacucauuucaucu

SEQ ID NO: 2685197 - RNA, 14 nt, Human
ccacugccuucgcu

SEQ ID NO: 2685198 - RNA, 15 nt, Human
ccacugccuucgcuu

SEQ ID NO: 2685199 - RNA, 16 nt, Human
ccacugccuucgcuuc

SEQ ID NO: 2685200 - RNA, 18 nt, Human
ccacugccuucgcuucuu

SEQ ID NO: 2685201 - RNA, 22 nt, Human
ccacugccuucgcuucuugccu

SEQ ID NO: 2685202 - RNA, 23 nt, Human
ccacugccuucgcuucuugccuc

SEQ ID NO: 2685203 - RNA, 20 nt, Human
ccacugcacuccagccuggg

SEQ ID NO: 2685204 - RNA, 19 nt, Human
ccacugcacuccagccugg

SEQ ID NO: 2685205 - RNA, 18 nt, Human
ccacugcacuccagccug

SEQ ID NO: 2685206 - RNA, 12 nt, Human
ccacuaaaaaua

SEQ ID NO: 2685207 - RNA, 13 nt, Human
ccacuaaaaauau

SEQ ID NO: 2685208 - RNA, 14 nt, Human
ccacuaaaaauauu

SEQ ID NO: 2685209 - RNA, 16 nt, Human
ccacuaaaaauauugu

SEQ ID NO: 2685210 - RNA, 23 nt, Human
ccacuaaaaauauuguuucugca

SEQ ID NO: 2685211 - RNA, 21 nt, Human
ccacguuggagaagcccgugu

SEQ ID NO: 2685212 - RNA, 20 nt, Human
ccacguuggagaagcccgug

SEQ ID NO: 2685213 - RNA, 18 nt, Human
ccacccuagccaaugucu

SEQ ID NO: 2685214 - RNA, 21 nt, Human
ccacccuagccaaugucuccu

SEQ ID NO: 2685215 - RNA, 18 nt, Human
ccaccccggggacccugu

SEQ ID NO: 2685216 - RNA, 19 nt, Human
ccaccccggggacccugug

SEQ ID NO: 2685217 - RNA, 20 nt, Human
ccaccccggggacccuguga

SEQ ID NO: 2685218 - RNA, 21 nt, Human
ccaccccggggacccugugac

SEQ ID NO: 2685219 - RNA, 15 nt, Human
ccaccccggcccccu

SEQ ID NO: 2685220 - RNA, 19 nt, Human
ccaccccggcccccugccc

SEQ ID NO: 2685221 - RNA, 19 nt, Human
ccaccccucaacaccucug

SEQ ID NO: 2685222 - RNA, 17 nt, Human
ccacccugaaagcccug

SEQ ID NO: 2685223 - RNA, 16 nt, Human
ccacccugaaagcccu

SEQ ID NO: 2685224 - RNA, 18 nt, Human
ccacccugaaagcccuga

SEQ ID NO: 2685225 - RNA, 21 nt, Human
ccaccuccaggcuuucccacu

SEQ ID NO: 2685226 - RNA, 17 nt, Human
ccaccucccacaaagga

SEQ ID NO: 2685227 - RNA, 14 nt, Human
ccacgcuucuccgg

SEQ ID NO: 2685228 - RNA, 17 nt, Human
ccacgcuucuccggauc

SEQ ID NO: 2685229 - RNA, 16 nt, Human
ccacaucaaauaagaa

SEQ ID NO: 2685230 - RNA, 18 nt, Human
ccacauccaacuccagca

SEQ ID NO: 2685231 - RNA, 19 nt, Human
ccacauccaacuccagcaa

SEQ ID NO: 2685232 - RNA, 12 nt, Human
ccacaucugccu

SEQ ID NO: 2685233 - RNA, 13 nt, Human
ccacaucugccuu

SEQ ID NO: 2685234 - RNA, 14 nt, Human
ccacaucugccuua

SEQ ID NO: 2685235 - RNA, 22 nt, Human
ccacaucugccuuaaaaccaaa

SEQ ID NO: 2685236 - RNA, 23 nt, Human
ccacaucugccuuaaaaccaaag

SEQ ID NO: 2685237 - RNA, 16 nt, Human
ccacacucuccaucac

SEQ ID NO: 2685238 - RNA, 13 nt, Human
ccacacucuccau

SEQ ID NO: 2685239 - RNA, 21 nt, Human
ccaccaaagcugcccacuguu

SEQ ID NO: 2685240 - RNA, 18 nt, Human
ccaccaaagcugcccacu

SEQ ID NO: 2685241 - RNA, 19 nt, Human
ccaccaaagcugcccacug

SEQ ID NO: 2685242 - RNA, 12 nt, Human
ccaccaaagcug

SEQ ID NO: 2685243 - RNA, 13 nt, Human
ccaccaaagcugc

SEQ ID NO: 2685244 - RNA, 14 nt, Human
ccaccaaagcugcc

SEQ ID NO: 2685245 - RNA, 16 nt, Human
ccaccaaagcugccca

SEQ ID NO: 2685246 - RNA, 14 nt, Human
ccacaucaaaccuu

SEQ ID NO: 2685247 - RNA, 15 nt, Human
ccacacagaaugcaa

SEQ ID NO: 2685248 - RNA, 15 nt, Human
ccacacccaaagcug

SEQ ID NO: 2685249 - RNA, 13 nt, Human
ccagaggagccuu

SEQ ID NO: 2685250 - RNA, 15 nt, Human
ccagaggagccuuuu

SEQ ID NO: 2685251 - RNA, 16 nt, Human
ccagaggagccuuuuu

SEQ ID NO: 2685252 - RNA, 17 nt, Human
ccagaggagccuuuuua

SEQ ID NO: 2685253 - RNA, 14 nt, Human
ccagaggcccccag

SEQ ID NO: 2685254 - RNA, 15 nt, Human
ccagaggcccccagc

SEQ ID NO: 2685255 - RNA, 18 nt, Human
ccagaggcccccagccca

SEQ ID NO: 2685256 - RNA, 17 nt, Human
ccagaggaauccuggca

SEQ ID NO: 2685257 - RNA, 18 nt, Human
ccagaggaauccuggcag

SEQ ID NO: 2685258 - RNA, 19 nt, Human
ccagaggaauccuggcagc

SEQ ID NO: 2685259 - RNA, 20 nt, Human
ccagaggaauccuggcagcc

SEQ ID NO: 2685260 - RNA, 21 nt, Human
ccagaggaauccuggcagccc

SEQ ID NO: 2685261 - RNA, 22 nt, Human
ccagaggaauccuggcagccca

SEQ ID NO: 2685262 - RNA, 23 nt, Human
ccagaggaauccuggcagcccag

SEQ ID NO: 2685263 - RNA, 12 nt, Human
ccagaggcuggg

SEQ ID NO: 2685264 - RNA, 15 nt, Human
ccagaggcuggguuc

SEQ ID NO: 2685265 - RNA, 22 nt, Human
ccagaggcccccagcccagggc

SEQ ID NO: 2685266 - RNA, 19 nt, Human
ccagaggcccccagcccag

SEQ ID NO: 2685267 - RNA, 21 nt, Human
ccagaggcccccagcccaggg

SEQ ID NO: 2685268 - RNA, 11 nt, Human
ccacugggagg

SEQ ID NO: 2685269 - RNA, 15 nt, Human
ccagauuaaacuuca

SEQ ID NO: 2685270 - RNA, 17 nt, Human
ccagaugcgucccaaga

SEQ ID NO: 2685271 - RNA, 16 nt, Human
ccagaggcuggguuca

SEQ ID NO: 2685272 - RNA, 21 nt, Human
ccagaugcgucccaagauguu

SEQ ID NO: 2685273 - RNA, 23 nt, Human
ccagauguuuccagacuuccuug

SEQ ID NO: 2685274 - RNA, 17 nt, Human
ccagauguuuccagacu

SEQ ID NO: 2685275 - RNA, 13 nt, Human
ccagauguggcua

SEQ ID NO: 2685276 - RNA, 13 nt, Human
ccagauggucauc

SEQ ID NO: 2685277 - RNA, 16 nt, Human
ccagauggucauccag

SEQ ID NO: 2685278 - RNA, 17 nt, Human
ccagauggucauccaga

SEQ ID NO: 2685279 - RNA, 18 nt, Human
ccagauggucauccagac

SEQ ID NO: 2685280 - RNA, 14 nt, Human
ccagcaucaccugc

SEQ ID NO: 2685281 - RNA, 15 nt, Human
ccagcaucaccugcc

SEQ ID NO: 2685282 - RNA, 16 nt, Human
ccagcaucaccugccu

SEQ ID NO: 2685283 - RNA, 17 nt, Human
ccagcaucaccugccug

SEQ ID NO: 2685284 - RNA, 18 nt, Human
ccagcaucaccugccugu

SEQ ID NO: 2685285 - RNA, 14 nt, Human
ccagcauuccagcc

SEQ ID NO: 2685286 - RNA, 15 nt, Human
ccagcauuccagccc

SEQ ID NO: 2685287 - RNA, 16 nt, Human
ccagcauuccagcccc

SEQ ID NO: 2685288 - RNA, 17 nt, Human
ccagcauuccagccccu

SEQ ID NO: 2685289 - RNA, 18 nt, Human
ccagcauuccagccccuc

SEQ ID NO: 2685290 - RNA, 19 nt, Human
ccagcauuccagccccucu

SEQ ID NO: 2685291 - RNA, 20 nt, Human
ccagcauuccagccccucug

SEQ ID NO: 2685292 - RNA, 21 nt, Human
ccagcauuccagccccucugg

SEQ ID NO: 2685293 - RNA, 22 nt, Human
ccagcauuccagccccucuggu

SEQ ID NO: 2685294 - RNA, 12 nt, Human
ccagccagcgcc

SEQ ID NO: 2685295 - RNA, 13 nt, Human
ccagccagcgccu

SEQ ID NO: 2685296 - RNA, 14 nt, Human
ccagccagcgccuc

SEQ ID NO: 2685297 - RNA, 15 nt, Human
ccagccagcgccucc

SEQ ID NO: 2685298 - RNA, 16 nt, Human
ccagccagcgccuccc

SEQ ID NO: 2685299 - RNA, 17 nt, Human
ccagccagcgccucccu

SEQ ID NO: 2685300 - RNA, 20 nt, Human
ccagccagcgccucccucca

SEQ ID NO: 2685301 - RNA, 22 nt, Human
ccagccagcgccucccuccacc

SEQ ID NO: 2685302 - RNA, 20 nt, Human
ccagccagaggcaucugagg

SEQ ID NO: 2685303 - RNA, 17 nt, Human
ccagccaacucugggaa

SEQ ID NO: 2685304 - RNA, 19 nt, Human
ccagccaaagccuccucca

SEQ ID NO: 2685305 - RNA, 18 nt, Human
ccagccaaagccuccucc

SEQ ID NO: 2685306 - RNA, 15 nt, Human
ccagccaaagccucc

SEQ ID NO: 2685307 - RNA, 16 nt, Human
ccagcauuuagcuggc

SEQ ID NO: 2685308 - RNA, 17 nt, Human
ccagcauuuagcuggcc

SEQ ID NO: 2685309 - RNA, 18 nt, Human
ccagcauuuagcuggcca

SEQ ID NO: 2685310 - RNA, 19 nt, Human
ccagcauuuagcuggccac

SEQ ID NO: 2685311 - RNA, 20 nt, Human
ccagcauuuagcuggccaca

SEQ ID NO: 2685312 - RNA, 21 nt, Human
ccagccucagcgcggcccucc

SEQ ID NO: 2685313 - RNA, 13 nt, Human
ccagccucagcgc

SEQ ID NO: 2685314 - RNA, 12 nt, Human
ccagccucagcg

SEQ ID NO: 2685315 - RNA, 16 nt, Human
ccagccucagacugga

SEQ ID NO: 2685316 - RNA, 19 nt, Human
ccagccgccaugcuccugg

SEQ ID NO: 2685317 - RNA, 18 nt, Human
ccagccgccaugcuccug

SEQ ID NO: 2685318 - RNA, 14 nt, Human
ccagccgccaugcu

SEQ ID NO: 2685319 - RNA, 21 nt, Human
ccagcccuccccauggagcca

SEQ ID NO: 2685320 - RNA, 20 nt, Human
ccagcccuccccauggagcc

SEQ ID NO: 2685321 - RNA, 14 nt, Human
ccagcccuccccau

SEQ ID NO: 2685322 - RNA, 13 nt, Human
ccagccccacugc

SEQ ID NO: 2685323 - RNA, 16 nt, Human
ccagccccacugccag

SEQ ID NO: 2685324 - RNA, 17 nt, Human
ccagccccacugccagc

SEQ ID NO: 2685325 - RNA, 18 nt, Human
ccagccccacugccagca

SEQ ID NO: 2685326 - RNA, 19 nt, Human
ccagccccacugccagcag

SEQ ID NO: 2685327 - RNA, 20 nt, Human
ccagccccacugccagcagc

SEQ ID NO: 2685328 - RNA, 21 nt, Human
ccagccccacugccagcagca

SEQ ID NO: 2685329 - RNA, 23 nt, Human
ccagccccacugccagcagcagc

SEQ ID NO: 2685330 - RNA, 14 nt, Human
ccagcaacuucuuc

SEQ ID NO: 2685331 - RNA, 23 nt, Human
ccagcaacuucuucuccaucccu

SEQ ID NO: 2685332 - RNA, 13 nt, Human
cccaaccucaggg

SEQ ID NO: 2685333 - RNA, 15 nt, Human
cccaaccucagggcu

SEQ ID NO: 2685334 - RNA, 19 nt, Human
cccaaccucagggcuccca

SEQ ID NO: 2685335 - RNA, 20 nt, Human
cccaaccucagggcucccag

SEQ ID NO: 2685336 - RNA, 22 nt, Human
cccaaccucagggcucccaggg

SEQ ID NO: 2685337 - RNA, 16 nt, Human
cccaaggcuggcaggu

SEQ ID NO: 2685338 - RNA, 21 nt, Human
cccaaucccuuuauuaccccc

SEQ ID NO: 2685339 - RNA, 17 nt, Human
cccaaucccuuuauuac

SEQ ID NO: 2685340 - RNA, 14 nt, Human
cccaaaucaauaca

SEQ ID NO: 2685341 - RNA, 16 nt, Human
cccaaaucaauacacu

SEQ ID NO: 2685342 - RNA, 20 nt, Human
cccaacccuaucuccugaca

SEQ ID NO: 2685343 - RNA, 11 nt, Human
ccauucuccca

SEQ ID NO: 2685344 - RNA, 12 nt, Human
ccauucucccag

SEQ ID NO: 2685345 - RNA, 13 nt, Human
ccauucucccagg

SEQ ID NO: 2685346 - RNA, 14 nt, Human
ccauucucccaggu

SEQ ID NO: 2685347 - RNA, 15 nt, Human
ccauucucccaggua

SEQ ID NO: 2685348 - RNA, 14 nt, Human
ccauuugugccaga

SEQ ID NO: 2685349 - RNA, 15 nt, Human
ccauuugugccagag

SEQ ID NO: 2685350 - RNA, 16 nt, Human
ccauuugugccagagg

SEQ ID NO: 2685351 - RNA, 18 nt, Human
ccauuugugccagaggaa

SEQ ID NO: 2685352 - RNA, 13 nt, Human
cccaaagcugagc

SEQ ID NO: 2685353 - RNA, 14 nt, Human
cccaaagcugagcc

SEQ ID NO: 2685354 - RNA, 16 nt, Human
cccaaagcugagccug

SEQ ID NO: 2685355 - RNA, 18 nt, Human
cccaaagcugagccugca

SEQ ID NO: 2685356 - RNA, 14 nt, Human
ccauagucccugcc

SEQ ID NO: 2685357 - RNA, 21 nt, Human
ccauauugugcuucacaguag

SEQ ID NO: 2685358 - RNA, 13 nt, Human
ccauagucccugc

SEQ ID NO: 2685359 - RNA, 14 nt, Human
ccauauuggccagu

SEQ ID NO: 2685360 - RNA, 17 nt, Human
ccaucgugaagaagccu

SEQ ID NO: 2685361 - RNA, 18 nt, Human
ccaucgugaagaagccug

SEQ ID NO: 2685362 - RNA, 20 nt, Human
ccaucgugaagaagccugua

SEQ ID NO: 2685363 - RNA, 14 nt, Human
ccauggccuuauga

SEQ ID NO: 2685364 - RNA, 16 nt, Human
ccauggcucagggugg

SEQ ID NO: 2685365 - RNA, 17 nt, Human
ccauggcucaggguggu

SEQ ID NO: 2685366 - RNA, 16 nt, Human
ccaucugccccacagu

SEQ ID NO: 2685367 - RNA, 17 nt, Human
ccaucugccccacaguc

SEQ ID NO: 2685368 - RNA, 19 nt, Human
ccaucugccccacagucuc

SEQ ID NO: 2685369 - RNA, 20 nt, Human
ccaucugccccacagucucc

SEQ ID NO: 2685370 - RNA, 14 nt, Human
ccaucugcaccccu

SEQ ID NO: 2685371 - RNA, 12 nt, Human
ccaucugcaccc

SEQ ID NO: 2685372 - RNA, 17 nt, Human
ccaucugcaccccuucu

SEQ ID NO: 2685373 - RNA, 20 nt, Human
ccaucugcaccccuucucuc

SEQ ID NO: 2685374 - RNA, 22 nt, Human
ccaucugcaccccuucucuccu

SEQ ID NO: 2685375 - RNA, 23 nt, Human
ccaucugcaccccuucucuccuc

SEQ ID NO: 2685376 - RNA, 21 nt, Human
ccaguguuugggaugaccagg

SEQ ID NO: 2685377 - RNA, 19 nt, Human
ccaguuaaaauguguuucu

SEQ ID NO: 2685378 - RNA, 13 nt, Human
ccagugugggcuu

SEQ ID NO: 2685379 - RNA, 18 nt, Human
ccagugugggcuugacca

SEQ ID NO: 2685380 - RNA, 20 nt, Human
ccagugugggcuugaccagg

SEQ ID NO: 2685381 - RNA, 21 nt, Human
ccagugucuauaaaagaaaca

SEQ ID NO: 2685382 - RNA, 20 nt, Human
ccagugccgagaaggaagcc

SEQ ID NO: 2685383 - RNA, 16 nt, Human
ccagucuguggaucag

SEQ ID NO: 2685384 - RNA, 24 nt, Human
ccagguucuccguuagcuccugug

SEQ ID NO: 2685385 - RNA, 22 nt, Human
ccagguucuccguuagcuccug

SEQ ID NO: 2685386 - RNA, 23 nt, Human
ccagguucuccguuagcuccugu

SEQ ID NO: 2685387 - RNA, 19 nt, Human
ccagguaccagcugcgcuu

SEQ ID NO: 2685388 - RNA, 14 nt, Human
ccagguuccgaaga

SEQ ID NO: 2685389 - RNA, 21 nt, Human
ccagguucuccguuagcuccu

SEQ ID NO: 2685390 - RNA, 12 nt, Human
ccagucugugga

SEQ ID NO: 2685391 - RNA, 13 nt, Human
ccagucuguggau

SEQ ID NO: 2685392 - RNA, 13 nt, Human
ccagggagccuuu

SEQ ID NO: 2685393 - RNA, 12 nt, Human
ccagggagccuu

SEQ ID NO: 2685394 - RNA, 14 nt, Human
ccagggagccuuug

SEQ ID NO: 2685395 - RNA, 12 nt, Human
ccagggcuccug

SEQ ID NO: 2685396 - RNA, 13 nt, Human
ccagggcuccugc

SEQ ID NO: 2685397 - RNA, 14 nt, Human
ccagggcuccugca

SEQ ID NO: 2685398 - RNA, 20 nt, Human
ccagggcuccugcacuuacu

SEQ ID NO: 2685399 - RNA, 15 nt, Human
ccagguaccagcugc

SEQ ID NO: 2685400 - RNA, 17 nt, Human
ccagguaccagcugcgc

SEQ ID NO: 2685401 - RNA, 18 nt, Human
ccagguaccagcugcgcu

SEQ ID NO: 2685402 - RNA, 23 nt, Human
ccagguaccagcugcgcuugcuu

SEQ ID NO: 2685403 - RNA, 23 nt, Human
ccaggccagccuccgagagggag

SEQ ID NO: 2685404 - RNA, 11 nt, Human
ccagccucccu

SEQ ID NO: 2685405 - RNA, 13 nt, Human
ccaggagccucac

SEQ ID NO: 2685406 - RNA, 17 nt, Human
ccaggagccugcccagc

SEQ ID NO: 2685407 - RNA, 16 nt, Human
ccaggagccugcccag

SEQ ID NO: 2685408 - RNA, 19 nt, Human
ccaggcuauguauaaaaua

SEQ ID NO: 2685409 - RNA, 20 nt, Human
ccaggcuauguauaaaauac

SEQ ID NO: 2685410 - RNA, 22 nt, Human
ccaggcuauguauaaaauacau

SEQ ID NO: 2685411 - RNA, 13 nt, Human
ccaggcucacuca

SEQ ID NO: 2685412 - RNA, 17 nt, Human
ccaggcucacucacaga

SEQ ID NO: 2685413 - RNA, 18 nt, Human
ccaggcucacucacagag

SEQ ID NO: 2685414 - RNA, 20 nt, Human
ccaggcucacucacagaguc

SEQ ID NO: 2685415 - RNA, 15 nt, Human
ccaggccauucugcc

SEQ ID NO: 2685416 - RNA, 17 nt, Human
ccaggccauucugccgc

SEQ ID NO: 2685417 - RNA, 19 nt, Human
ccaggccgcgcccuuuccc

SEQ ID NO: 2685418 - RNA, 11 nt, Human
ccagccuccuc

SEQ ID NO: 2685419 - RNA, 12 nt, Human
ccagccuccucu

SEQ ID NO: 2685420 - RNA, 13 nt, Human
ccagccuccucug

SEQ ID NO: 2685421 - RNA, 18 nt, Human
ccagccuccgagagggag

SEQ ID NO: 2685422 - RNA, 19 nt, Human
ccagccuccgagagggaga

SEQ ID NO: 2685423 - RNA, 21 nt, Human
ccagccuccgagagggagaga

SEQ ID NO: 2685424 - RNA, 14 nt, Human
ccagccuccucugg

SEQ ID NO: 2685425 - RNA, 15 nt, Human
ccagccuccucugga

SEQ ID NO: 2685426 - RNA, 17 nt, Human
ccuuggugccucuugua

SEQ ID NO: 2685427 - RNA, 13 nt, Human
ccuugauuucaaa

SEQ ID NO: 2685428 - RNA, 19 nt, Human
ccuugauucccuuguuauu

SEQ ID NO: 2685429 - RNA, 19 nt, Human
ccuuguuacuucugaggua

SEQ ID NO: 2685430 - RNA, 16 nt, Human
ccuuguuacuucugag

SEQ ID NO: 2685431 - RNA, 18 nt, Human
ccuuguuacuucugaggu

SEQ ID NO: 2685432 - RNA, 17 nt, Human
ccuuguccucagccagu

SEQ ID NO: 2685433 - RNA, 18 nt, Human
ccuugaaacuuugggaaa

SEQ ID NO: 2685434 - RNA, 19 nt, Human
ccuugaaacuuugggaaaa

SEQ ID NO: 2685435 - RNA, 18 nt, Human
ccuugaagaacugcaggc

SEQ ID NO: 2685436 - RNA, 21 nt, Human
ccuugaagaacugcaggcccu

SEQ ID NO: 2685437 - RNA, 22 nt, Human
ccuugaagaacugcaggcccug

SEQ ID NO: 2685438 - RNA, 23 nt, Human
ccuugaagaacugcaggcccugg

SEQ ID NO: 2685439 - RNA, 18 nt, Human
ccuugaagaaccucucac

SEQ ID NO: 2685440 - RNA, 17 nt, Human
ccuugaagaaccucuca

SEQ ID NO: 2685441 - RNA, 20 nt, Human
ccuugaguugauucagcucu

SEQ ID NO: 2685442 - RNA, 13 nt, Human
ccuugagggcugc

SEQ ID NO: 2685443 - RNA, 15 nt, Human
ccuugagggcugcag

SEQ ID NO: 2685444 - RNA, 16 nt, Human
ccuugagggcugcagu

SEQ ID NO: 2685445 - RNA, 18 nt, Human
ccuucgggcgucugugug

SEQ ID NO: 2685446 - RNA, 22 nt, Human
ccuucuagucuuggccagccaa

SEQ ID NO: 2685447 - RNA, 21 nt, Human
ccuucuauagcaucacuuaaa

SEQ ID NO: 2685448 - RNA, 19 nt, Human
ccuucuauagcaucacuua

SEQ ID NO: 2685449 - RNA, 20 nt, Human
ccuucagacacccucaaccu

SEQ ID NO: 2685450 - RNA, 17 nt, Human
ccuucagacacccucaa

SEQ ID NO: 2685451 - RNA, 11 nt, Human
ccuucagacac

SEQ ID NO: 2685452 - RNA, 10 nt, Human
ccuucagaca

SEQ ID NO: 2685453 - RNA, 19 nt, Human
ccuucgcuucuugccucug

SEQ ID NO: 2685454 - RNA, 20 nt, Human
ccuucgcuucuugccucugu

SEQ ID NO: 2685455 - RNA, 21 nt, Human
ccuucgcuucuugccucugug

SEQ ID NO: 2685456 - RNA, 23 nt, Human
ccuucgcuucuugccucugugcu

SEQ ID NO: 2685457 - RNA, 23 nt, Human
ccuuccuuuucccugcuuccagg

SEQ ID NO: 2685458 - RNA, 20 nt, Human
ccuuccuuuucccugcuucc

SEQ ID NO: 2685459 - RNA, 21 nt, Human
ccuuccuuuucccugcuucca

SEQ ID NO: 2685460 - RNA, 16 nt, Human
ccuuccuuuucccugc

SEQ ID NO: 2685461 - RNA, 17 nt, Human
ccuuccuuuucccugcu

SEQ ID NO: 2685462 - RNA, 18 nt, Human
ccuuccuuuucccugcuu

SEQ ID NO: 2685463 - RNA, 19 nt, Human
ccuuccuuuucccugcuuc

SEQ ID NO: 2685464 - RNA, 16 nt, Human
ccuucgcuucuugccu

SEQ ID NO: 2685465 - RNA, 17 nt, Human
ccuucgcuucuugccuc

SEQ ID NO: 2685466 - RNA, 18 nt, Human
ccuucgcuucuugccucu

SEQ ID NO: 2685467 - RNA, 15 nt, Human
ccuuccuuuucccug

SEQ ID NO: 2685468 - RNA, 13 nt, Human
ccuuccuuuuccc

SEQ ID NO: 2685469 - RNA, 17 nt, Human
ccuuccucucuccagau

SEQ ID NO: 2685470 - RNA, 15 nt, Human
ccuuccucucuccag

SEQ ID NO: 2685471 - RNA, 14 nt, Human
ccuuacuaauuaua

SEQ ID NO: 2685472 - RNA, 10 nt, Human
ccugugugca

SEQ ID NO: 2685473 - RNA, 12 nt, Human
ccugugugcagg

SEQ ID NO: 2685474 - RNA, 13 nt, Human
ccugugugcaggu

SEQ ID NO: 2685475 - RNA, 16 nt, Human
ccugugugcagguucc

SEQ ID NO: 2685476 - RNA, 19 nt, Human
ccuguguccaugcgcucag

SEQ ID NO: 2685477 - RNA, 13 nt, Human
ccuguguccaugc

SEQ ID NO: 2685478 - RNA, 13 nt, Human
ccuguguuaauuu

SEQ ID NO: 2685479 - RNA, 23 nt, Human
ccuguguuaauuuaaguuuugac

SEQ ID NO: 2685480 - RNA, 17 nt, Human
ccuguguuaauuuaagu

SEQ ID NO: 2685481 - RNA, 14 nt, Human
ccuguguuaauuua

SEQ ID NO: 2685482 - RNA, 15 nt, Human
ccuuaaaaccaaaga

SEQ ID NO: 2685483 - RNA, 16 nt, Human
ccuuaaaaccaaagag

SEQ ID NO: 2685484 - RNA, 20 nt, Human
ccuuaaaacaucauuccuuu

SEQ ID NO: 2685485 - RNA, 17 nt, Human
ccuuaaaaccaaagagg

SEQ ID NO: 2685486 - RNA, 16 nt, Human
ccuuaacaguuguauu

SEQ ID NO: 2685487 - RNA, 13 nt, Human
ccuuaaauuuaau

SEQ ID NO: 2685488 - RNA, 17 nt, Human
ccuuaacaguuguauuu

SEQ ID NO: 2685489 - RNA, 19 nt, Human
ccuuaagugaggaaaucaa

SEQ ID NO: 2685490 - RNA, 17 nt, Human
ccuuaauucacucccac

SEQ ID NO: 2685491 - RNA, 20 nt, Human
ccuuaagugaggaaaucaaa

SEQ ID NO: 2685492 - RNA, 22 nt, Human
ccuuaagugaggaaaucaaagu

SEQ ID NO: 2685493 - RNA, 13 nt, Human
ccuuaauuuccuu

SEQ ID NO: 2685494 - RNA, 15 nt, Human
ccuuaauuuccuuuu

SEQ ID NO: 2685495 - RNA, 18 nt, Human
ccuuaauuuccuuuuuga

SEQ ID NO: 2685496 - RNA, 19 nt, Human
ccuuaauuuccuuuuugac

SEQ ID NO: 2685497 - RNA, 20 nt, Human
ccuuaauuuccuuuuugaca

SEQ ID NO: 2685498 - RNA, 22 nt, Human
ccuuaauuuccuuuuugacacu

SEQ ID NO: 2685499 - RNA, 23 nt, Human
ccuuaauuuccuuuuugacacug

SEQ ID NO: 2685500 - RNA, 24 nt, Human
ccuuaauuuccuuuuugacacuga

SEQ ID NO: 2685501 - RNA, 16 nt, Human
ccuuaacugcauccag

SEQ ID NO: 2685502 - RNA, 13 nt, Human
ccuuacuggcuua

SEQ ID NO: 2685503 - RNA, 18 nt, Human
ccuuacuggcuuaccucc

SEQ ID NO: 2685504 - RNA, 20 nt, Human
cgagauugcaccacugcacu

SEQ ID NO: 2685505 - RNA, 20 nt, Human
cgagagucuggcccuagacu

SEQ ID NO: 2685506 - RNA, 14 nt, Human
cgagaccagccugg

SEQ ID NO: 2685507 - RNA, 13 nt, Human
cgagaccauccug

SEQ ID NO: 2685508 - RNA, 15 nt, Human
cgagaccauccuggc

SEQ ID NO: 2685509 - RNA, 16 nt, Human
cgagaccauccuggcu

SEQ ID NO: 2685510 - RNA, 14 nt, Human
cgagaggugggcca

SEQ ID NO: 2685511 - RNA, 15 nt, Human
cgagaggugggccag

SEQ ID NO: 2685512 - RNA, 19 nt, Human
cgagaggugggccagucug

SEQ ID NO: 2685513 - RNA, 20 nt, Human
cgagaggugggccagucugu

SEQ ID NO: 2685514 - RNA, 19 nt, Human
cgagagucuggcccuagac

SEQ ID NO: 2685515 - RNA, 17 nt, Human
cgagagucuggcccuag

SEQ ID NO: 2685516 - RNA, 15 nt, Human
cgagagucuggcccu

SEQ ID NO: 2685517 - RNA, 14 nt, Human
cgagagucuggccc

SEQ ID NO: 2685518 - RNA, 22 nt, Human
cgagaggugggccagucugugg

SEQ ID NO: 2685519 - RNA, 23 nt, Human
cgagaggugggccagucugugga

SEQ ID NO: 2685520 - RNA, 14 nt, Human
cgaauagacaucaa

SEQ ID NO: 2685521 - RNA, 15 nt, Human
cgaauagacaucaaa

SEQ ID NO: 2685522 - RNA, 17 nt, Human
cgaauagacaucaaacu

SEQ ID NO: 2685523 - RNA, 16 nt, Human
cgacuuucugccugga

SEQ ID NO: 2685524 - RNA, 17 nt, Human
cgagaaagaggcaccag

SEQ ID NO: 2685525 - RNA, 20 nt, Human
cgagaaauaaaguuugcuua

SEQ ID NO: 2685526 - RNA, 19 nt, Human
cgagaaagaggcaccagga

SEQ ID NO: 2685527 - RNA, 21 nt, Human
cgagaaagaggcaccaggaag

SEQ ID NO: 2685528 - RNA, 19 nt, Human
cgacuuguuuuugcacaug

SEQ ID NO: 2685529 - RNA, 13 nt, Human
cgacuuucugccu

SEQ ID NO: 2685530 - RNA, 14 nt, Human
cgacuuucugccug

SEQ ID NO: 2685531 - RNA, 15 nt, Human
cgacuuucugccugg

SEQ ID NO: 2685532 - RNA, 10 nt, Human
cgaauaaaug

SEQ ID NO: 2685533 - RNA, 18 nt, Human
cgaaguucaagaucaaaa

SEQ ID NO: 2685534 - RNA, 18 nt, Human
cgaagacccucuugccca

SEQ ID NO: 2685535 - RNA, 20 nt, Human
cgaagacccucuugcccauc

SEQ ID NO: 2685536 - RNA, 23 nt, Human
cgaagacccucuugcccauccug

SEQ ID NO: 2685537 - RNA, 17 nt, Human
cgaaguucaagaucaaa

SEQ ID NO: 2685538 - RNA, 16 nt, Human
cgaaguucaagaucaa

SEQ ID NO: 2685539 - RNA, 14 nt, Human
cgaagaagaugcuc

SEQ ID NO: 2685540 - RNA, 17 nt, Human
cgaaccuuggccugggc

SEQ ID NO: 2685541 - RNA, 19 nt, Human
cgaaccuuggccugggccg

SEQ ID NO: 2685542 - RNA, 18 nt, Human
cgaaccuuggccugggcc

SEQ ID NO: 2685543 - RNA, 20 nt, Human
cgaaaggaugaaagugacca

SEQ ID NO: 2685544 - RNA, 11 nt, Human
ccuuuuacugg

SEQ ID NO: 2685545 - RNA, 12 nt, Human
ccuuuuacuggu

SEQ ID NO: 2685546 - RNA, 18 nt, Human
ccuuuuacugguugcaug

SEQ ID NO: 2685547 - RNA, 19 nt, Human
ccuuuuacugguugcaugg

SEQ ID NO: 2685548 - RNA, 20 nt, Human
ccuuuuacugguugcaugga

SEQ ID NO: 2685549 - RNA, 12 nt, Human
ccuuuuacugug

SEQ ID NO: 2685550 - RNA, 12 nt, Human
ccuuuucagggc

SEQ ID NO: 2685551 - RNA, 13 nt, Human
ccuuuucagggcu

SEQ ID NO: 2685552 - RNA, 18 nt, Human
ccuuuucagggcuggcuc

SEQ ID NO: 2685553 - RNA, 18 nt, Human
cgaaaccugggauucagg

SEQ ID NO: 2685554 - RNA, 16 nt, Human
ccuuuuuuuuuucuug

SEQ ID NO: 2685555 - RNA, 22 nt, Human
cgccaggggaaaaucagccugc

SEQ ID NO: 2685556 - RNA, 19 nt, Human
cgcagagcgcgccccuagc

SEQ ID NO: 2685557 - RNA, 13 nt, Human
cgcagagcgcgcc

SEQ ID NO: 2685558 - RNA, 14 nt, Human
cgcaccauucugac

SEQ ID NO: 2685559 - RNA, 15 nt, Human
cgcaccauucugacu

SEQ ID NO: 2685560 - RNA, 17 nt, Human
cgauguuauuagauguu

SEQ ID NO: 2685561 - RNA, 15 nt, Human
cgagcaugucgugga

SEQ ID NO: 2685562 - RNA, 17 nt, Human
cgccaugcuccuggccc

SEQ ID NO: 2685563 - RNA, 13 nt, Human
ccugcaauauuug

SEQ ID NO: 2685564 - RNA, 16 nt, Human
ccugcaauauuugaau

SEQ ID NO: 2685565 - RNA, 19 nt, Human
ccugcacgucaugggaggg

SEQ ID NO: 2685566 - RNA, 23 nt, Human
ccugcacgucaugggagggggcu

SEQ ID NO: 2685567 - RNA, 12 nt, Human
ccugcacuccuc

SEQ ID NO: 2685568 - RNA, 23 nt, Human
ccugcacuccucagggcagccuc

SEQ ID NO: 2685569 - RNA, 18 nt, Human
ccugcacgucaugggagg

SEQ ID NO: 2685570 - RNA, 17 nt, Human
ccugcagggccauggcu

SEQ ID NO: 2685571 - RNA, 19 nt, Human
ccugcagggccauggcuca

SEQ ID NO: 2685572 - RNA, 20 nt, Human
ccugcagggccauggcucag

SEQ ID NO: 2685573 - RNA, 13 nt, Human
ccugauuccucuc

SEQ ID NO: 2685574 - RNA, 12 nt, Human
ccugcagggcca

SEQ ID NO: 2685575 - RNA, 16 nt, Human
ccugccaggcauggug

SEQ ID NO: 2685576 - RNA, 15 nt, Human
ccugccaggcauggu

SEQ ID NO: 2685577 - RNA, 13 nt, Human
ccugcccccagcc

SEQ ID NO: 2685578 - RNA, 14 nt, Human
ccugcccccagccc

SEQ ID NO: 2685579 - RNA, 15 nt, Human
ccugcccccagcccc

SEQ ID NO: 2685580 - RNA, 17 nt, Human
ccugcccccagccccgg

SEQ ID NO: 2685581 - RNA, 16 nt, Human
ccugagcuuucugcua

SEQ ID NO: 2685582 - RNA, 14 nt, Human
ccugagcuuucugc

SEQ ID NO: 2685583 - RNA, 13 nt, Human
ccugacauugucu

SEQ ID NO: 2685584 - RNA, 23 nt, Human
ccugacagagggauggaggaaga

SEQ ID NO: 2685585 - RNA, 14 nt, Human
ccugacagaaggug

SEQ ID NO: 2685586 - RNA, 15 nt, Human
ccugacagaaggugc

SEQ ID NO: 2685587 - RNA, 16 nt, Human
ccugacagaaggugcc

SEQ ID NO: 2685588 - RNA, 17 nt, Human
ccugacagaaggugcca

SEQ ID NO: 2685589 - RNA, 14 nt, Human
ccugcgacccuggg

SEQ ID NO: 2685590 - RNA, 15 nt, Human
ccugcgacccugggg

SEQ ID NO: 2685591 - RNA, 16 nt, Human
ccugcgacccuggggg

SEQ ID NO: 2685592 - RNA, 17 nt, Human
ccugcgacccugggggc

SEQ ID NO: 2685593 - RNA, 21 nt, Human
ccugcgacccugggggcacag

SEQ ID NO: 2685594 - RNA, 14 nt, Human
ccugcgccugcugc

SEQ ID NO: 2685595 - RNA, 13 nt, Human
ccugcgccugcug

SEQ ID NO: 2685596 - RNA, 15 nt, Human
ccugcgccugcugca

SEQ ID NO: 2685597 - RNA, 18 nt, Human
ccugcgccugcugcaugc

SEQ ID NO: 2685598 - RNA, 20 nt, Human
ccugcggguggggcuugggg

SEQ ID NO: 2685599 - RNA, 21 nt, Human
ccugcggguggggcuuggggc

SEQ ID NO: 2685600 - RNA, 24 nt, Human
ccugcggguggggcuuggggcuca

SEQ ID NO: 2685601 - RNA, 12 nt, Human
ccugccuggccc

SEQ ID NO: 2685602 - RNA, 13 nt, Human
ccugccuggcccc

SEQ ID NO: 2685603 - RNA, 15 nt, Human
ccugccuggccccca

SEQ ID NO: 2685604 - RNA, 14 nt, Human
ccugccuuaaguga

SEQ ID NO: 2685605 - RNA, 20 nt, Human
ccugccccgcccccaguccc

SEQ ID NO: 2685606 - RNA, 18 nt, Human
ccugccccggagcuggag

SEQ ID NO: 2685607 - RNA, 13 nt, Human
ccugccccgcccc

SEQ ID NO: 2685608 - RNA, 18 nt, Human
ccugccccgcccccaguc

SEQ ID NO: 2685609 - RNA, 18 nt, Human
ccugcccccagccccggg

SEQ ID NO: 2685610 - RNA, 16 nt, Human
ccugccgucaccacca

SEQ ID NO: 2685611 - RNA, 17 nt, Human
ccugccgucaccaccac

SEQ ID NO: 2685612 - RNA, 18 nt, Human
ccugccgucaccaccacc

SEQ ID NO: 2685613 - RNA, 22 nt, Human
ccugccgucaccaccaccccua

SEQ ID NO: 2685614 - RNA, 23 nt, Human
ccugccgucaccaccaccccuac

SEQ ID NO: 2685615 - RNA, 16 nt, Human
ccugccccucagagac

SEQ ID NO: 2685616 - RNA, 19 nt, Human
ccugccggccccggccgcc

SEQ ID NO: 2685617 - RNA, 17 nt, Human
ccugcucauuaugccac

SEQ ID NO: 2685618 - RNA, 23 nt, Human
ccugcucauuaugccacuuccuu

SEQ ID NO: 2685619 - RNA, 18 nt, Human
ccugcguccuccucaccu

SEQ ID NO: 2685620 - RNA, 19 nt, Human
ccugcguccuccucaccuc

SEQ ID NO: 2685621 - RNA, 13 nt, Human
ccugcguccuccu

SEQ ID NO: 2685622 - RNA, 15 nt, Human
ccugcguccuccuca

SEQ ID NO: 2685623 - RNA, 16 nt, Human
ccugcguccuccucac

SEQ ID NO: 2685624 - RNA, 17 nt, Human
ccugcguccuccucacc

SEQ ID NO: 2685625 - RNA, 21 nt, Human
ccugcuuccaggaaacuccac

SEQ ID NO: 2685626 - RNA, 16 nt, Human
ccuggaagaacaggcc

SEQ ID NO: 2685627 - RNA, 17 nt, Human
ccuggaagaacaggccu

SEQ ID NO: 2685628 - RNA, 18 nt, Human
ccuggaagaacaggccuc

SEQ ID NO: 2685629 - RNA, 20 nt, Human
ccuggaagaacaggccucuc

SEQ ID NO: 2685630 - RNA, 23 nt, Human
ccuggaagaacaggccucuccau

SEQ ID NO: 2685631 - RNA, 19 nt, Human
ccuggaacaauauuuuaug

SEQ ID NO: 2685632 - RNA, 20 nt, Human
ccuggaacaauauuuuaugg

SEQ ID NO: 2685633 - RNA, 23 nt, Human
ccugcugugauuccacuacaccu

SEQ ID NO: 2685634 - RNA, 22 nt, Human
ccugcuuaaucuucaaagccuu

SEQ ID NO: 2685635 - RNA, 23 nt, Human
ccugcuuaaucuucaaagccuuc

SEQ ID NO: 2685636 - RNA, 20 nt, Human
ccugcugugauuccacuaca

SEQ ID NO: 2685637 - RNA, 17 nt, Human
ccugcgcucucuuugca

SEQ ID NO: 2685638 - RNA, 24 nt, Human
ccugcuucagucccuuccccaugc

SEQ ID NO: 2685639 - RNA, 14 nt, Human
ccugcuuccaggaa

SEQ ID NO: 2685640 - RNA, 24 nt, Human
ccuggcugagguuccucugccugc

SEQ ID NO: 2685641 - RNA, 13 nt, Human
ccuggcugccggc

SEQ ID NO: 2685642 - RNA, 15 nt, Human
ccuggcugccggcac

SEQ ID NO: 2685643 - RNA, 13 nt, Human
ccuggcugcugcc

SEQ ID NO: 2685644 - RNA, 14 nt, Human
ccuggcugcugccc

SEQ ID NO: 2685645 - RNA, 15 nt, Human
ccuggcugcugcccc

SEQ ID NO: 2685646 - RNA, 16 nt, Human
ccuggcugcugccccc

SEQ ID NO: 2685647 - RNA, 17 nt, Human
ccuggcugcugccccca

SEQ ID NO: 2685648 - RNA, 18 nt, Human
ccuggcugcugcccccac

SEQ ID NO: 2685649 - RNA, 20 nt, Human
ccuggcugcugcccccaccc

SEQ ID NO: 2685650 - RNA, 21 nt, Human
ccuggcugcugcccccacccc

SEQ ID NO: 2685651 - RNA, 22 nt, Human
ccuggcugcugcccccaccccg

SEQ ID NO: 2685652 - RNA, 15 nt, Human
ccuggcagcccagag

SEQ ID NO: 2685653 - RNA, 17 nt, Human
ccuggcagcccagagac

SEQ ID NO: 2685654 - RNA, 18 nt, Human
ccuggcagcccagagacu

SEQ ID NO: 2685655 - RNA, 15 nt, Human
ccuggaauugccagc

SEQ ID NO: 2685656 - RNA, 17 nt, Human
ccuggaauugccagcug

SEQ ID NO: 2685657 - RNA, 13 nt, Human
ccuggagauccuc

SEQ ID NO: 2685658 - RNA, 15 nt, Human
ccuggagauccuccu

SEQ ID NO: 2685659 - RNA, 19 nt, Human
ccuggagacuuagggcacc

SEQ ID NO: 2685660 - RNA, 23 nt, Human
ccuggagacuuagggcaccaggg

SEQ ID NO: 2685661 - RNA, 11 nt, Human
ccuggcagccc

SEQ ID NO: 2685662 - RNA, 13 nt, Human
ccuggcagcccag

SEQ ID NO: 2685663 - RNA, 14 nt, Human
ccuggcagcccaga

SEQ ID NO: 2685664 - RNA, 16 nt, Human
ccuggagauccuccug

SEQ ID NO: 2685665 - RNA, 17 nt, Human
ccuggagauccuccugc

SEQ ID NO: 2685666 - RNA, 18 nt, Human
ccuggagauccuccugca

SEQ ID NO: 2685667 - RNA, 21 nt, Human
ccuggcuguucugugguuccu

SEQ ID NO: 2685668 - RNA, 15 nt, Human
ccugggugggcucug

SEQ ID NO: 2685669 - RNA, 16 nt, Human
ccugggugggcucugu

SEQ ID NO: 2685670 - RNA, 17 nt, Human
ccugggugggcucugug

SEQ ID NO: 2685671 - RNA, 15 nt, Human
cccggggacccugug

SEQ ID NO: 2685672 - RNA, 16 nt, Human
cccggggacccuguga

SEQ ID NO: 2685673 - RNA, 17 nt, Human
cccggggacccugugac

SEQ ID NO: 2685674 - RNA, 18 nt, Human
cccggggacccugugaca

SEQ ID NO: 2685675 - RNA, 21 nt, Human
cccggggacccugugacaugg

SEQ ID NO: 2685676 - RNA, 16 nt, Human
cccggggcccagggca

SEQ ID NO: 2685677 - RNA, 15 nt, Human
cccggggcccagggc

SEQ ID NO: 2685678 - RNA, 18 nt, Human
cccgguggcggccccagc

SEQ ID NO: 2685679 - RNA, 19 nt, Human
cccgguggcggccccagca

SEQ ID NO: 2685680 - RNA, 16 nt, Human
cccgggguggccacag

SEQ ID NO: 2685681 - RNA, 14 nt, Human
cccgugggcucccg

SEQ ID NO: 2685682 - RNA, 14 nt, Human
cccguggggcaggg

SEQ ID NO: 2685683 - RNA, 22 nt, Human
cccguggggcagggagcugggc

SEQ ID NO: 2685684 - RNA, 13 nt, Human
cccguccugccug

SEQ ID NO: 2685685 - RNA, 14 nt, Human
cccguccugccugu

SEQ ID NO: 2685686 - RNA, 15 nt, Human
cccguccugccugug

SEQ ID NO: 2685687 - RNA, 16 nt, Human
cccguccugccugugg

SEQ ID NO: 2685688 - RNA, 17 nt, Human
cccguccugccuguggc

SEQ ID NO: 2685689 - RNA, 15 nt, Human
cccuaaucuaugguc

SEQ ID NO: 2685690 - RNA, 20 nt, Human
cccggugggacccccguggg

SEQ ID NO: 2685691 - RNA, 22 nt, Human
cccuaaucuauggucgggagac

SEQ ID NO: 2685692 - RNA, 20 nt, Human
cccuacaguugaaaaacagc

SEQ ID NO: 2685693 - RNA, 18 nt, Human
cccguuccaccccaagag

SEQ ID NO: 2685694 - RNA, 21 nt, Human
cccuagcuuuagacccugggu

SEQ ID NO: 2685695 - RNA, 17 nt, Human
cccuagcuuuagacccu

SEQ ID NO: 2685696 - RNA, 18 nt, Human
cccuagcuuuagacccug

SEQ ID NO: 2685697 - RNA, 19 nt, Human
cccuagcuuuagacccugg

SEQ ID NO: 2685698 - RNA, 20 nt, Human
cccuagcuccuccccuuccu

SEQ ID NO: 2685699 - RNA, 23 nt, Human
cccuagccgguuccugucccugc

SEQ ID NO: 2685700 - RNA, 18 nt, Human
cccuagccgguuccuguc

SEQ ID NO: 2685701 - RNA, 17 nt, Human
cccuagccgguuccugu

SEQ ID NO: 2685702 - RNA, 19 nt, Human
cccuacucccugcagaugc

SEQ ID NO: 2685703 - RNA, 21 nt, Human
cccuacucccugcagaugcca

SEQ ID NO: 2685704 - RNA, 15 nt, Human
cccuacucccugcag

SEQ ID NO: 2685705 - RNA, 16 nt, Human
cccuacucccugcaga

SEQ ID NO: 2685706 - RNA, 18 nt, Human
cccuacucccugcagaug

SEQ ID NO: 2685707 - RNA, 23 nt, Human
cccuacuauucaguggcgagaaa

SEQ ID NO: 2685708 - RNA, 12 nt, Human
cccgcugcugug

SEQ ID NO: 2685709 - RNA, 16 nt, Human
cccgcugcugugcaac

SEQ ID NO: 2685710 - RNA, 16 nt, Human
cccgccgauagaggga

SEQ ID NO: 2685711 - RNA, 11 nt, Human
cccgggcccca

SEQ ID NO: 2685712 - RNA, 21 nt, Human
cccucuccuuuguucccggcu

SEQ ID NO: 2685713 - RNA, 16 nt, Human
cccucugcacccagaa

SEQ ID NO: 2685714 - RNA, 16 nt, Human
cccucugaacuugccu

SEQ ID NO: 2685715 - RNA, 18 nt, Human
cccuccagaaccaccccg

SEQ ID NO: 2685716 - RNA, 14 nt, Human
cccuccccauggag

SEQ ID NO: 2685717 - RNA, 23 nt, Human
cccucccccagccaugccagcug

SEQ ID NO: 2685718 - RNA, 13 nt, Human
cccuccaccccag

SEQ ID NO: 2685719 - RNA, 14 nt, Human
cccuccaccccagg

SEQ ID NO: 2685720 - RNA, 15 nt, Human
cccuccaccccagga

SEQ ID NO: 2685721 - RNA, 18 nt, Human
cccucuggucgcuccugc

SEQ ID NO: 2685722 - RNA, 19 nt, Human
cccucuggucgcuccugcc

SEQ ID NO: 2685723 - RNA, 20 nt, Human
cccucuggucgcuccugccc

SEQ ID NO: 2685724 - RNA, 22 nt, Human
cccucuggucgcuccugcccac

SEQ ID NO: 2685725 - RNA, 16 nt, Human
cccugaaagcccugag

SEQ ID NO: 2685726 - RNA, 15 nt, Human
cccugaaagcccuga

SEQ ID NO: 2685727 - RNA, 13 nt, Human
cccugccacucac

SEQ ID NO: 2685728 - RNA, 18 nt, Human
cccugccacucacuaggc

SEQ ID NO: 2685729 - RNA, 19 nt, Human
cccugccacucacuaggcc

SEQ ID NO: 2685730 - RNA, 13 nt, Human
cccugcacgucau

SEQ ID NO: 2685731 - RNA, 15 nt, Human
cccugcacgucaugg

SEQ ID NO: 2685732 - RNA, 14 nt, Human
cccugcacgucaug

SEQ ID NO: 2685733 - RNA, 15 nt, Human
cccugagucugggca

SEQ ID NO: 2685734 - RNA, 16 nt, Human
cccugagucugggcag

SEQ ID NO: 2685735 - RNA, 13 nt, Human
cccugggcccugg

SEQ ID NO: 2685736 - RNA, 16 nt, Human
cccugggcccugggcu

SEQ ID NO: 2685737 - RNA, 18 nt, Human
cccugggcccugggcugg

SEQ ID NO: 2685738 - RNA, 19 nt, Human
cccugggcccugggcugga

SEQ ID NO: 2685739 - RNA, 20 nt, Human
cccugccacucacuaggccc

SEQ ID NO: 2685740 - RNA, 21 nt, Human
cccacaaaggagagcuagcag

SEQ ID NO: 2685741 - RNA, 17 nt, Human
cccacagcgucccuggc

SEQ ID NO: 2685742 - RNA, 18 nt, Human
cccacagcgucccuggcg

SEQ ID NO: 2685743 - RNA, 18 nt, Human
cccaccgguccagcuggc

SEQ ID NO: 2685744 - RNA, 16 nt, Human
cccaccgguccagcug

SEQ ID NO: 2685745 - RNA, 17 nt, Human
cccaccgguccagcugg

SEQ ID NO: 2685746 - RNA, 17 nt, Human
cccacgagaccccggcu

SEQ ID NO: 2685747 - RNA, 21 nt, Human
cccacuuugcuguuccuuacu

SEQ ID NO: 2685748 - RNA, 22 nt, Human
cccacuuugcuguuccuuacuu

SEQ ID NO: 2685749 - RNA, 14 nt, Human
cccacuucugccag

SEQ ID NO: 2685750 - RNA, 13 nt, Human
cccacuugccucu

SEQ ID NO: 2685751 - RNA, 14 nt, Human
cccacuugccucuu

SEQ ID NO: 2685752 - RNA, 15 nt, Human
cccacuugccucuuc

SEQ ID NO: 2685753 - RNA, 21 nt, Human
cccacuugccucuuccuugaa

SEQ ID NO: 2685754 - RNA, 14 nt, Human
cccaccuccaggcu

SEQ ID NO: 2685755 - RNA, 21 nt, Human
cccacgacugcccggcagggu

SEQ ID NO: 2685756 - RNA, 20 nt, Human
cccacgacugcccggcaggg

SEQ ID NO: 2685757 - RNA, 13 nt, Human
cccaccugccggc

SEQ ID NO: 2685758 - RNA, 14 nt, Human
cccaccugccggcc

SEQ ID NO: 2685759 - RNA, 16 nt, Human
ccuauauccugugacu

SEQ ID NO: 2685760 - RNA, 13 nt, Human
ccuauauauuucu

SEQ ID NO: 2685761 - RNA, 15 nt, Human
ccuauauauuucuau

SEQ ID NO: 2685762 - RNA, 20 nt, Human
ccuaguuugggaggagcaga

SEQ ID NO: 2685763 - RNA, 16 nt, Human
ccuaguuugugagaaa

SEQ ID NO: 2685764 - RNA, 17 nt, Human
ccuaguuugugagaaac

SEQ ID NO: 2685765 - RNA, 16 nt, Human
ccuaccaauauuaggu

SEQ ID NO: 2685766 - RNA, 20 nt, Human
ccuagggcccccacaguugc

SEQ ID NO: 2685767 - RNA, 12 nt, Human
ccuagggccccc

SEQ ID NO: 2685768 - RNA, 19 nt, Human
ccuaaaauaacaguaugug

SEQ ID NO: 2685769 - RNA, 23 nt, Human
ccuaaaauaacaguaugugggau

SEQ ID NO: 2685770 - RNA, 16 nt, Human
ccgggucuugauucag

SEQ ID NO: 2685771 - RNA, 13 nt, Human
ccuaaaagcacuc

SEQ ID NO: 2685772 - RNA, 22 nt, Human
ccgugugagaagugaaugcugg

SEQ ID NO: 2685773 - RNA, 23 nt, Human
ccgugugagaagugaaugcuggg

SEQ ID NO: 2685774 - RNA, 16 nt, Human
ccgugucugucuggca

SEQ ID NO: 2685775 - RNA, 17 nt, Human
ccgugucugucuggcac

SEQ ID NO: 2685776 - RNA, 23 nt, Human
ccuaauuucuccucccuuccuuu

SEQ ID NO: 2685777 - RNA, 20 nt, Human
ccuaauuucuccucccuucc

SEQ ID NO: 2685778 - RNA, 21 nt, Human
ccgggaccacccugagccggc

SEQ ID NO: 2685779 - RNA, 20 nt, Human
ccgggcgcgguggcucacgc

SEQ ID NO: 2685780 - RNA, 20 nt, Human
ccgggaccacccugagccgg

SEQ ID NO: 2685781 - RNA, 14 nt, Human
ccgguccagcuggc

SEQ ID NO: 2685782 - RNA, 15 nt, Human
ccgguaacuguccug

SEQ ID NO: 2685783 - RNA, 16 nt, Human
ccgguaacuguccugu

SEQ ID NO: 2685784 - RNA, 18 nt, Human
ccgguaacuguccugucc

SEQ ID NO: 2685785 - RNA, 19 nt, Human
ccgguaacuguccuguccu

SEQ ID NO: 2685786 - RNA, 21 nt, Human
ccgguaacuguccuguccugc

SEQ ID NO: 2685787 - RNA, 15 nt, Human
ccggcuuccuuuccc

SEQ ID NO: 2685788 - RNA, 19 nt, Human
ccggcuuccuuucccaagc

SEQ ID NO: 2685789 - RNA, 23 nt, Human
ccggcuuccuuucccaagccuuc

SEQ ID NO: 2685790 - RNA, 20 nt, Human
ccgcugccacguuggagaag

SEQ ID NO: 2685791 - RNA, 13 nt, Human
ccgcugccagccu

SEQ ID NO: 2685792 - RNA, 15 nt, Human
ccgcugccagccuug

SEQ ID NO: 2685793 - RNA, 19 nt, Human
ccgauguuauuagauguua

SEQ ID NO: 2685794 - RNA, 22 nt, Human
ccgaggccuaccccgcagacac

SEQ ID NO: 2685795 - RNA, 16 nt, Human
ccgcgggcacugccgc

SEQ ID NO: 2685796 - RNA, 15 nt, Human
ccgcggagccugcau

SEQ ID NO: 2685797 - RNA, 21 nt, Human
ccgcggggcugucggcgcugc

SEQ ID NO: 2685798 - RNA, 14 nt, Human
ccgcgugugccugu

SEQ ID NO: 2685799 - RNA, 17 nt, Human
ccgcgugugccugugug

SEQ ID NO: 2685800 - RNA, 15 nt, Human
ccgcgaccauguggc

SEQ ID NO: 2685801 - RNA, 18 nt, Human
ccgcgaccauguggccac

SEQ ID NO: 2685802 - RNA, 16 nt, Human
ccgcgccacaggaccc

SEQ ID NO: 2685803 - RNA, 15 nt, Human
ccgcgccacaggacc

SEQ ID NO: 2685804 - RNA, 14 nt, Human
ccgcgcguccagcu

SEQ ID NO: 2685805 - RNA, 17 nt, Human
ccgcgcguccagcugcc

SEQ ID NO: 2685806 - RNA, 23 nt, Human
ccgcgcguccagcugcccuuccg

SEQ ID NO: 2685807 - RNA, 21 nt, Human
ccgcgcuccgggcuuucacgg

SEQ ID NO: 2685808 - RNA, 12 nt, Human
ccgcacagcuca

SEQ ID NO: 2685809 - RNA, 13 nt, Human
ccgcacagcucag

SEQ ID NO: 2685810 - RNA, 14 nt, Human
ccgcacagcucagg

SEQ ID NO: 2685811 - RNA, 16 nt, Human
ccgcacagcucaggag

SEQ ID NO: 2685812 - RNA, 18 nt, Human
ccgcacagcucaggaggc

SEQ ID NO: 2685813 - RNA, 20 nt, Human
ccuccagccccgcgaccaug

SEQ ID NO: 2685814 - RNA, 13 nt, Human
ccuccaggccugc

SEQ ID NO: 2685815 - RNA, 15 nt, Human
ccuccaggccugccu

SEQ ID NO: 2685816 - RNA, 16 nt, Human
ccuccaggccugccuc

SEQ ID NO: 2685817 - RNA, 18 nt, Human
ccuccaggccugccuccc

SEQ ID NO: 2685818 - RNA, 19 nt, Human
ccuccaggccugccuccca

SEQ ID NO: 2685819 - RNA, 20 nt, Human
ccuccaggccugccucccac

SEQ ID NO: 2685820 - RNA, 21 nt, Human
ccuccaggccugccucccacu

SEQ ID NO: 2685821 - RNA, 13 nt, Human
ccuccaccccagg

SEQ ID NO: 2685822 - RNA, 14 nt, Human
ccuccaccccagga

SEQ ID NO: 2685823 - RNA, 15 nt, Human
ccuccaccccaggac

SEQ ID NO: 2685824 - RNA, 16 nt, Human
ccuccaccacccuuuc

SEQ ID NO: 2685825 - RNA, 14 nt, Human
ccuccaggugcaga

SEQ ID NO: 2685826 - RNA, 15 nt, Human
ccuccaggugcagag

SEQ ID NO: 2685827 - RNA, 17 nt, Human
ccuccaggugcagaggu

SEQ ID NO: 2685828 - RNA, 18 nt, Human
ccuccaggugcagaggua

SEQ ID NO: 2685829 - RNA, 14 nt, Human
ccuccccauuuccc

SEQ ID NO: 2685830 - RNA, 15 nt, Human
ccuccccauuuccca

SEQ ID NO: 2685831 - RNA, 20 nt, Human
ccuccccauuucccaucugc

SEQ ID NO: 2685832 - RNA, 21 nt, Human
ccuccccauuucccaucugca

SEQ ID NO: 2685833 - RNA, 22 nt, Human
ccuccccauuucccaucugcac

SEQ ID NO: 2685834 - RNA, 16 nt, Human
ccuccauuugagaaaa

SEQ ID NO: 2685835 - RNA, 17 nt, Human
ccuccauuugagaaaau

SEQ ID NO: 2685836 - RNA, 19 nt, Human
ccuccccagugcaaaugca

SEQ ID NO: 2685837 - RNA, 16 nt, Human
ccuccccauggagcca

SEQ ID NO: 2685838 - RNA, 22 nt, Human
ccuccacagcgagggcagcugc

SEQ ID NO: 2685839 - RNA, 23 nt, Human
ccuccacagcgagggcagcugcu

SEQ ID NO: 2685840 - RNA, 14 nt, Human
ccuccacagcgagg

SEQ ID NO: 2685841 - RNA, 15 nt, Human
ccuccacagcgaggg

SEQ ID NO: 2685842 - RNA, 20 nt, Human
ccuccacagcgagggcagcu

SEQ ID NO: 2685843 - RNA, 21 nt, Human
ccuccacagcgagggcagcug

SEQ ID NO: 2685844 - RNA, 13 nt, Human
ccuccacagcgag

SEQ ID NO: 2685845 - RNA, 20 nt, Human
ccuccucuggacggcaggcu

SEQ ID NO: 2685846 - RNA, 21 nt, Human
ccuccucuggacggcaggcuc

SEQ ID NO: 2685847 - RNA, 22 nt, Human
ccuccucuggacggcaggcuca

SEQ ID NO: 2685848 - RNA, 20 nt, Human
ccuccugaaccgcacagcuc

SEQ ID NO: 2685849 - RNA, 22 nt, Human
ccuccugaaccgcacagcucag

SEQ ID NO: 2685850 - RNA, 21 nt, Human
ccuccugacccauugcuguug

SEQ ID NO: 2685851 - RNA, 20 nt, Human
ccuccugacccauugcuguu

SEQ ID NO: 2685852 - RNA, 12 nt, Human
ccucccuccacc

SEQ ID NO: 2685853 - RNA, 13 nt, Human
ccucccuccaccc

SEQ ID NO: 2685854 - RNA, 15 nt, Human
ccucccuccacccca

SEQ ID NO: 2685855 - RNA, 16 nt, Human
ccucccuccaccccag

SEQ ID NO: 2685856 - RNA, 17 nt, Human
ccucccuccaccccagg

SEQ ID NO: 2685857 - RNA, 19 nt, Human
ccucccuccaccccaggac

SEQ ID NO: 2685858 - RNA, 20 nt, Human
ccucccuccaccccaggacg

SEQ ID NO: 2685859 - RNA, 23 nt, Human
ccuccccauuucccaucugcacc

SEQ ID NO: 2685860 - RNA, 21 nt, Human
ccucccccagccaugccagcu

SEQ ID NO: 2685861 - RNA, 23 nt, Human
ccucccccagccaugccagcugg

SEQ ID NO: 2685862 - RNA, 18 nt, Human
ccucgguguggagaagcg

SEQ ID NO: 2685863 - RNA, 15 nt, Human
ccucgguacucccau

SEQ ID NO: 2685864 - RNA, 14 nt, Human
ccucuagaggcaag

SEQ ID NO: 2685865 - RNA, 15 nt, Human
ccucuagaagccaag

SEQ ID NO: 2685866 - RNA, 16 nt, Human
ccucuagaagccaagg

SEQ ID NO: 2685867 - RNA, 18 nt, Human
ccucuagaagccaaggga

SEQ ID NO: 2685868 - RNA, 22 nt, Human
ccuccuucagacacccucaacc

SEQ ID NO: 2685869 - RNA, 15 nt, Human
ccuccuucagacacc

SEQ ID NO: 2685870 - RNA, 14 nt, Human
ccuccuucagacac

SEQ ID NO: 2685871 - RNA, 13 nt, Human
ccuccuucagaca

SEQ ID NO: 2685872 - RNA, 14 nt, Human
ccucgguguggaga

SEQ ID NO: 2685873 - RNA, 16 nt, Human
ccucggugccuuccuc

SEQ ID NO: 2685874 - RNA, 21 nt, Human
ccucuauuuauguuugcacuu

SEQ ID NO: 2685875 - RNA, 17 nt, Human
ccucuauuuauguuugc

SEQ ID NO: 2685876 - RNA, 14 nt, Human
ccucucagugcccu

SEQ ID NO: 2685877 - RNA, 16 nt, Human
ccucucagugcccucc

SEQ ID NO: 2685878 - RNA, 18 nt, Human
ccucucagugcccuccag

SEQ ID NO: 2685879 - RNA, 14 nt, Human
ccucucaccucagc

SEQ ID NO: 2685880 - RNA, 22 nt, Human
cuucucauuacuuguugccuau

SEQ ID NO: 2685881 - RNA, 14 nt, Human
cuucucauuacuug

SEQ ID NO: 2685882 - RNA, 21 nt, Human
cuucucacugccaugccagcu

SEQ ID NO: 2685883 - RNA, 13 nt, Human
cuucucagaagca

SEQ ID NO: 2685884 - RNA, 14 nt, Human
cuucucagaagcac

SEQ ID NO: 2685885 - RNA, 16 nt, Human
cuucucagaagcacag

SEQ ID NO: 2685886 - RNA, 17 nt, Human
cuucucagaagcacaga

SEQ ID NO: 2685887 - RNA, 22 nt, Human
cuucucagaagcacagaauauu

SEQ ID NO: 2685888 - RNA, 16 nt, Human
cuucucacugccaugc

SEQ ID NO: 2685889 - RNA, 22 nt, Human
cuucgucuuucccauggggagg

SEQ ID NO: 2685890 - RNA, 14 nt, Human
cuucgucuuuccca

SEQ ID NO: 2685891 - RNA, 21 nt, Human
cuucgucuuucccauggggag

SEQ ID NO: 2685892 - RNA, 19 nt, Human
cuucgggaggucgaggcag

SEQ ID NO: 2685893 - RNA, 21 nt, Human
cuuccuuaauucacucccaca

SEQ ID NO: 2685894 - RNA, 19 nt, Human
cuuccuuaauucacuccca

SEQ ID NO: 2685895 - RNA, 19 nt, Human
cuuccuuucccaagccuuc

SEQ ID NO: 2685896 - RNA, 17 nt, Human
cuuccuuuuaucaguag

SEQ ID NO: 2685897 - RNA, 14 nt, Human
cuuccuuuucccug

SEQ ID NO: 2685898 - RNA, 13 nt, Human
cuuccuuuuaacu

SEQ ID NO: 2685899 - RNA, 14 nt, Human
cuuccuuuuaacug

SEQ ID NO: 2685900 - RNA, 15 nt, Human
cuucgcuucuugccu

SEQ ID NO: 2685901 - RNA, 16 nt, Human
cuucgcuucuugccuc

SEQ ID NO: 2685902 - RNA, 17 nt, Human
cuucgcuucuugccucu

SEQ ID NO: 2685903 - RNA, 18 nt, Human
cuucgcuucuugccucug

SEQ ID NO: 2685904 - RNA, 20 nt, Human
cuucgcuucuugccucugug

SEQ ID NO: 2685905 - RNA, 21 nt, Human
cuucgcuucuugccucugugc

SEQ ID NO: 2685906 - RNA, 20 nt, Human
cuuccccccaaaacccggga

SEQ ID NO: 2685907 - RNA, 23 nt, Human
cuucccccaccgguccagcuggc

SEQ ID NO: 2685908 - RNA, 19 nt, Human
cuuccccaugcuuccuugc

SEQ ID NO: 2685909 - RNA, 21 nt, Human
cuucccuagcuuuagacccug

SEQ ID NO: 2685910 - RNA, 22 nt, Human
cuucccuagcuuuagacccugg

SEQ ID NO: 2685911 - RNA, 13 nt, Human
cuucccaugcauu

SEQ ID NO: 2685912 - RNA, 18 nt, Human
cuucccaugcauucuggu

SEQ ID NO: 2685913 - RNA, 20 nt, Human
cuuccagaucacugccacac

SEQ ID NO: 2685914 - RNA, 13 nt, Human
cuuccagaucacu

SEQ ID NO: 2685915 - RNA, 15 nt, Human
cuuccagaucacugc

SEQ ID NO: 2685916 - RNA, 17 nt, Human
cuuccagaucacugcca

SEQ ID NO: 2685917 - RNA, 18 nt, Human
cuuccagaucacugccac

SEQ ID NO: 2685918 - RNA, 16 nt, Human
cuuccugugauccacc

SEQ ID NO: 2685919 - RNA, 18 nt, Human
cuuccugugauccaccca

SEQ ID NO: 2685920 - RNA, 15 nt, Human
cuuccugcguccucc

SEQ ID NO: 2685921 - RNA, 16 nt, Human
cuuccugcguccuccu

SEQ ID NO: 2685922 - RNA, 21 nt, Human
cuuccugcguccuccucaccu

SEQ ID NO: 2685923 - RNA, 18 nt, Human
cuuccugcguccuccuca

SEQ ID NO: 2685924 - RNA, 20 nt, Human
cuuccugcguccuccucacc

SEQ ID NO: 2685925 - RNA, 22 nt, Human
cuuccucaaaauaaagaaguau

SEQ ID NO: 2685926 - RNA, 23 nt, Human
cuucccuagcuuuagacccuggg

SEQ ID NO: 2685927 - RNA, 17 nt, Human
cuucagucccuucccca

SEQ ID NO: 2685928 - RNA, 22 nt, Human
cuucagucccuuccccaugcuu

SEQ ID NO: 2685929 - RNA, 17 nt, Human
cuucauguaaaguguca

SEQ ID NO: 2685930 - RNA, 14 nt, Human
cuucauuauucucu

SEQ ID NO: 2685931 - RNA, 15 nt, Human
cuucauuauucucug

SEQ ID NO: 2685932 - RNA, 14 nt, Human
cuucauuauuuuaa

SEQ ID NO: 2685933 - RNA, 18 nt, Human
cuucauuauuuuaaaaau

SEQ ID NO: 2685934 - RNA, 19 nt, Human
cuucagcugacuuuucugu

SEQ ID NO: 2685935 - RNA, 15 nt, Human
cuucagcugacuuuu

SEQ ID NO: 2685936 - RNA, 14 nt, Human
cuucaguaagccgu

SEQ ID NO: 2685937 - RNA, 14 nt, Human
cuucaaaugaaaau

SEQ ID NO: 2685938 - RNA, 21 nt, Human
cuucacaguagagccagcuug

SEQ ID NO: 2685939 - RNA, 22 nt, Human
cuucacaguagagccagcuugg

SEQ ID NO: 2685940 - RNA, 19 nt, Human
cuucacaguagagccagcu

SEQ ID NO: 2685941 - RNA, 20 nt, Human
cuucacaguagagccagcuu

SEQ ID NO: 2685942 - RNA, 17 nt, Human
cuucagaugccacuucu

SEQ ID NO: 2685943 - RNA, 23 nt, Human
cuguuucuggacccuuauaaaau

SEQ ID NO: 2685944 - RNA, 18 nt, Human
cuguugccauggugaugg

SEQ ID NO: 2685945 - RNA, 19 nt, Human
cuguuuagauuugccauag

SEQ ID NO: 2685946 - RNA, 22 nt, Human
cuguuuagauuugccauagagu

SEQ ID NO: 2685947 - RNA, 21 nt, Human
cuguuuagauuugccauagag

SEQ ID NO: 2685948 - RNA, 16 nt, Human
cuguuuguccugagau

SEQ ID NO: 2685949 - RNA, 22 nt, Human
cuguuuguccugagauggaaaa

SEQ ID NO: 2685950 - RNA, 19 nt, Human
cuguuugaaaacuucagaa

SEQ ID NO: 2685951 - RNA, 17 nt, Human
cuuaaaaaguggaaaaa

SEQ ID NO: 2685952 - RNA, 16 nt, Human
cuuaaaaaguggaaaa

SEQ ID NO: 2685953 - RNA, 15 nt, Human
cuuaaaaacugaaaa

SEQ ID NO: 2685954 - RNA, 19 nt, Human
cuguucugugguuccucug

SEQ ID NO: 2685955 - RNA, 20 nt, Human
cuguucugugguuccucugc

SEQ ID NO: 2685956 - RNA, 21 nt, Human
cuguucugugguuccucugcu

SEQ ID NO: 2685957 - RNA, 18 nt, Human
cuguugacgcaccugugg

SEQ ID NO: 2685958 - RNA, 14 nt, Human
cuguugauaaaaac

SEQ ID NO: 2685959 - RNA, 15 nt, Human
cuguugauaaaaacu

SEQ ID NO: 2685960 - RNA, 18 nt, Human
cuguugauaaaaacucag

SEQ ID NO: 2685961 - RNA, 15 nt, Human
cuguugauaaaucca

SEQ ID NO: 2685962 - RNA, 18 nt, Human
cuguugauaaauccauca

SEQ ID NO: 2685963 - RNA, 21 nt, Human
cuuaaugaaugagucuguugu

SEQ ID NO: 2685964 - RNA, 23 nt, Human
cuuaauauauuucuaaauguuug

SEQ ID NO: 2685965 - RNA, 21 nt, Human
cuuaaucuguuuauuuacaag

SEQ ID NO: 2685966 - RNA, 12 nt, Human
cuuaaugaaaua

SEQ ID NO: 2685967 - RNA, 12 nt, Human
cuuaauuuccuu

SEQ ID NO: 2685968 - RNA, 13 nt, Human
cuuaauuuccuuu

SEQ ID NO: 2685969 - RNA, 14 nt, Human
cuuaauuuccuuuu

SEQ ID NO: 2685970 - RNA, 17 nt, Human
cuuaauuuccuuuuuga

SEQ ID NO: 2685971 - RNA, 20 nt, Human
cuuaauuuccuuuuugacac

SEQ ID NO: 2685972 - RNA, 21 nt, Human
cuuaauuuccuuuuugacacu

SEQ ID NO: 2685973 - RNA, 22 nt, Human
cuuaauuuccuuuuugacacug

SEQ ID NO: 2685974 - RNA, 23 nt, Human
cuuaauuuccuuuuugacacuga

SEQ ID NO: 2685975 - RNA, 19 nt, Human
cuuaagacagaguauccug

SEQ ID NO: 2685976 - RNA, 19 nt, Human
cuuaacauagccaaaaugu

SEQ ID NO: 2685977 - RNA, 15 nt, Human
cuuaacauagccaaa

SEQ ID NO: 2685978 - RNA, 16 nt, Human
cuuaacaguuguauuu

SEQ ID NO: 2685979 - RNA, 17 nt, Human
cuuaacaguuguauuua

SEQ ID NO: 2685980 - RNA, 20 nt, Human
cuuaacauagccaaaaugug

SEQ ID NO: 2685981 - RNA, 21 nt, Human
cuuaauaaucaagagccuuaa

SEQ ID NO: 2685982 - RNA, 19 nt, Human
cuuaaguaaucaucuaagu

SEQ ID NO: 2685983 - RNA, 20 nt, Human
cuuaauaaucaagagccuua

SEQ ID NO: 2685984 - RNA, 15 nt, Human
cuuaauaaucaagag

SEQ ID NO: 2685985 - RNA, 14 nt, Human
cuuaauaaucaaga

SEQ ID NO: 2685986 - RNA, 13 nt, Human
cuuaauaaucaag

SEQ ID NO: 2685987 - RNA, 20 nt, Human
cuuaauaaauuguguuuccu

SEQ ID NO: 2685988 - RNA, 15 nt, Human
cuuaauaacugugua

SEQ ID NO: 2685989 - RNA, 19 nt, Human
cuuaauaacuguguacugu

SEQ ID NO: 2685990 - RNA, 20 nt, Human
cuuaauaacuguguacuguu

SEQ ID NO: 2685991 - RNA, 20 nt, Human
cuuaagggguaucauguaug

SEQ ID NO: 2685992 - RNA, 18 nt, Human
cuuaaggacaaagugcca

SEQ ID NO: 2685993 - RNA, 23 nt, Human
cuuaaggacaaagugccaaagaa

SEQ ID NO: 2685994 - RNA, 12 nt, Human
cuuaagcuuccg

SEQ ID NO: 2685995 - RNA, 20 nt, Human
cuuagaaaaaccaccaccau

SEQ ID NO: 2685996 - RNA, 18 nt, Human
cuuaauugaugcaaauaa

SEQ ID NO: 2685997 - RNA, 18 nt, Human
cuuagaaucccuguguua

SEQ ID NO: 2685998 - RNA, 15 nt, Human
cuuagaaucccugug

SEQ ID NO: 2685999 - RNA, 16 nt, Human
cuuagaauacaguuuu

SEQ ID NO: 2686000 - RNA, 20 nt, Human
cuuagaaucccuguguuaau

SEQ ID NO: 2686001 - RNA, 19 nt, Human
cuuagaaucccuguguuaa

SEQ ID NO: 2686002 - RNA, 21 nt, Human
cuuagguuggcaaaaaggcag

SEQ ID NO: 2686003 - RNA, 23 nt, Human
cuuagguuggcaaaaaggcagga

SEQ ID NO: 2686004 - RNA, 15 nt, Human
cugugugcgcucugu

SEQ ID NO: 2686005 - RNA, 14 nt, Human
cugugugucaguuu

SEQ ID NO: 2686006 - RNA, 16 nt, Human
cugugugucaguuuuc

SEQ ID NO: 2686007 - RNA, 17 nt, Human
cugugugucaguuuuca

SEQ ID NO: 2686008 - RNA, 18 nt, Human
cugugugucaguuuucau

SEQ ID NO: 2686009 - RNA, 16 nt, Human
cugugugucccaggca

SEQ ID NO: 2686010 - RNA, 18 nt, Human
cugugugucccaggcagg

SEQ ID NO: 2686011 - RNA, 19 nt, Human
cugugugucccaggcaggg

SEQ ID NO: 2686012 - RNA, 20 nt, Human
cugugugucccaggcaggga

SEQ ID NO: 2686013 - RNA, 22 nt, Human
cugugugucccaggcagggaga

SEQ ID NO: 2686014 - RNA, 23 nt, Human
cugugugucccaggcagggagac

SEQ ID NO: 2686015 - RNA, 9 nt, Human
cugugugca

SEQ ID NO: 2686016 - RNA, 13 nt, Human
cugugugcagguu

SEQ ID NO: 2686017 - RNA, 11 nt, Human
cuguguaaacu

SEQ ID NO: 2686018 - RNA, 14 nt, Human
cuguguaaacucau

SEQ ID NO: 2686019 - RNA, 21 nt, Human
cuguguaaacucaucugaaau

SEQ ID NO: 2686020 - RNA, 19 nt, Human
cugugguuggcugggaaau

SEQ ID NO: 2686021 - RNA, 18 nt, Human
cugugguuggcugggaaa

SEQ ID NO: 2686022 - RNA, 17 nt, Human
cugugguuggcugggaa

SEQ ID NO: 2686023 - RNA, 21 nt, Human
cuguguuaauuuaaguuuuga

SEQ ID NO: 2686024 - RNA, 16 nt, Human
cuguguuaauuuaagu

SEQ ID NO: 2686025 - RNA, 15 nt, Human
cuguguuaauuuaag

SEQ ID NO: 2686026 - RNA, 13 nt, Human
cuguguugccaag

SEQ ID NO: 2686027 - RNA, 18 nt, Human
cuguguugguguggccca

SEQ ID NO: 2686028 - RNA, 21 nt, Human
cuguguuguaccaaaauucau

SEQ ID NO: 2686029 - RNA, 21 nt, Human
cuguguugccaagcuccaagc

SEQ ID NO: 2686030 - RNA, 13 nt, Human
cuguguugccaca

SEQ ID NO: 2686031 - RNA, 22 nt, Human
cuguguugccacaguagaacug

SEQ ID NO: 2686032 - RNA, 23 nt, Human
cuguguugccacaguagaacugu

SEQ ID NO: 2686033 - RNA, 14 nt, Human
cuguguugccaagc

SEQ ID NO: 2686034 - RNA, 16 nt, Human
cuguguugccaagcuc

SEQ ID NO: 2686035 - RNA, 17 nt, Human
cuguguugccaagcucc

SEQ ID NO: 2686036 - RNA, 19 nt, Human
cuguguugccaagcuccaa

SEQ ID NO: 2686037 - RNA, 21 nt, Human
cugugggggguaaucccugcu

SEQ ID NO: 2686038 - RNA, 15 nt, Human
cugugguuccucugc

SEQ ID NO: 2686039 - RNA, 16 nt, Human
cugugguuccucugcu

SEQ ID NO: 2686040 - RNA, 20 nt, Human
cuguggucaaggcuacagau

SEQ ID NO: 2686041 - RNA, 16 nt, Human
cuguggucacagcgga

SEQ ID NO: 2686042 - RNA, 15 nt, Human
cuguggaucagagau

SEQ ID NO: 2686043 - RNA, 21 nt, Human
cuguggccccacccugggccc

SEQ ID NO: 2686044 - RNA, 16 nt, Human
cuguggccccacccug

SEQ ID NO: 2686045 - RNA, 17 nt, Human
cuguggccccacccugg

SEQ ID NO: 2686046 - RNA, 18 nt, Human
cuguggccccacccuggg

SEQ ID NO: 2686047 - RNA, 20 nt, Human
cuguggccccacccugggcc

SEQ ID NO: 2686048 - RNA, 17 nt, Human
cugugcccuccugaccc

SEQ ID NO: 2686049 - RNA, 16 nt, Human
cugugcccuccugacc

SEQ ID NO: 2686050 - RNA, 14 nt, Human
cugugcccuccuga

SEQ ID NO: 2686051 - RNA, 21 nt, Human
cuguggacugaccuuguaaaa

SEQ ID NO: 2686052 - RNA, 22 nt, Human
cuguggacugaccuuguaaaag

SEQ ID NO: 2686053 - RNA, 18 nt, Human
cugucuucaguaagccgu

SEQ ID NO: 2686054 - RNA, 13 nt, Human
cugucuuccucaa

SEQ ID NO: 2686055 - RNA, 14 nt, Human
cugucuuccucaaa

SEQ ID NO: 2686056 - RNA, 20 nt, Human
cugucuuccucaaaauaaag

SEQ ID NO: 2686057 - RNA, 18 nt, Human
cugucuuuccugaaccau

SEQ ID NO: 2686058 - RNA, 14 nt, Human
cugucugugaacag

SEQ ID NO: 2686059 - RNA, 23 nt, Human
cugucugguggccccguuucugg

SEQ ID NO: 2686060 - RNA, 13 nt, Human
cugucugguggcc

SEQ ID NO: 2686061 - RNA, 15 nt, Human
cugucugguggcccc

SEQ ID NO: 2686062 - RNA, 13 nt, Human
cugugaugagcug

SEQ ID NO: 2686063 - RNA, 14 nt, Human
cugugaugagcuga

SEQ ID NO: 2686064 - RNA, 15 nt, Human
cugugaugagcugau

SEQ ID NO: 2686065 - RNA, 16 nt, Human
cugugaugagcugauc

SEQ ID NO: 2686066 - RNA, 18 nt, Human
cugugaugagcugaucug

SEQ ID NO: 2686067 - RNA, 22 nt, Human
cugugaugagcugaucugcgga

SEQ ID NO: 2686068 - RNA, 13 nt, Human
cugugauguuugu

SEQ ID NO: 2686069 - RNA, 23 nt, Human
cugugauguuuguguauguggga

SEQ ID NO: 2686070 - RNA, 20 nt, Human
cugugaacaagcuucaguaa

SEQ ID NO: 2686071 - RNA, 21 nt, Human
cugugaacaagcuucaguaag

SEQ ID NO: 2686072 - RNA, 19 nt, Human
cugugaacagagagacccu

SEQ ID NO: 2686073 - RNA, 22 nt, Human
cugugauuccacuacaccuggc

SEQ ID NO: 2686074 - RNA, 16 nt, Human
cugugcagucacugga

SEQ ID NO: 2686075 - RNA, 19 nt, Human
cugugcccagaauacugau

SEQ ID NO: 2686076 - RNA, 20 nt, Human
cugggcuuauaucuggccuc

SEQ ID NO: 2686077 - RNA, 18 nt, Human
cugggcuugucuguagau

SEQ ID NO: 2686078 - RNA, 22 nt, Human
cugggcuuauaucuggccucug

SEQ ID NO: 2686079 - RNA, 16 nt, Human
cuggggaaagacacug

SEQ ID NO: 2686080 - RNA, 18 nt, Human
cuggggaaagacacugcc

SEQ ID NO: 2686081 - RNA, 19 nt, Human
cuggggaaagacacugccu

SEQ ID NO: 2686082 - RNA, 20 nt, Human
cugggguguuaguggcaccg

SEQ ID NO: 2686083 - RNA, 14 nt, Human
cugggguugagggc

SEQ ID NO: 2686084 - RNA, 13 nt, Human
cuggguccagaag

SEQ ID NO: 2686085 - RNA, 19 nt, Human
cuggguccuuccugaaacu

SEQ ID NO: 2686086 - RNA, 15 nt, Human
cuggguccuuccuga

SEQ ID NO: 2686087 - RNA, 14 nt, Human
cuggguccuuccug

SEQ ID NO: 2686088 - RNA, 22 nt, Human
cugguaaaaugaagaauuuaaa

SEQ ID NO: 2686089 - RNA, 19 nt, Human
cugguaaaaugaagaauuu

SEQ ID NO: 2686090 - RNA, 17 nt, Human
cugguaaaaugaagaau

SEQ ID NO: 2686091 - RNA, 16 nt, Human
cugguaaaaugaagaa

SEQ ID NO: 2686092 - RNA, 15 nt, Human
cugguaaaaugaaga

SEQ ID NO: 2686093 - RNA, 13 nt, Human
cugguaaaaugaa

SEQ ID NO: 2686094 - RNA, 13 nt, Human
cugggcccugagu

SEQ ID NO: 2686095 - RNA, 22 nt, Human
cugggcccugagucugggcagc

SEQ ID NO: 2686096 - RNA, 11 nt, Human
cugggcccuga

SEQ ID NO: 2686097 - RNA, 20 nt, Human
cugggcccgacauggcuccg

SEQ ID NO: 2686098 - RNA, 21 nt, Human
cugggcccgacauggcuccgg

SEQ ID NO: 2686099 - RNA, 17 nt, Human
cuguacgacacgggugg

SEQ ID NO: 2686100 - RNA, 20 nt, Human
cuguauuuuguuuuugucuu

SEQ ID NO: 2686101 - RNA, 23 nt, Human
cuguauuuuauuuagacaagaga

SEQ ID NO: 2686102 - RNA, 17 nt, Human
cuguauuuaaaaauaga

SEQ ID NO: 2686103 - RNA, 18 nt, Human
cuguauuuaaaaauagaa

SEQ ID NO: 2686104 - RNA, 19 nt, Human
cuguauuuaaaaauagaaa

SEQ ID NO: 2686105 - RNA, 18 nt, Human
cuguauuuuuuuuucuaa

SEQ ID NO: 2686106 - RNA, 21 nt, Human
cuguauuuuuuuuucuaagag

SEQ ID NO: 2686107 - RNA, 22 nt, Human
cuguauuuuuuuuucuaagaga

SEQ ID NO: 2686108 - RNA, 17 nt, Human
cuguaaucccagcacuu

SEQ ID NO: 2686109 - RNA, 14 nt, Human
cuguaaucccagca

SEQ ID NO: 2686110 - RNA, 13 nt, Human
cuguaaucccagc

SEQ ID NO: 2686111 - RNA, 14 nt, Human
cuguaaucccagcu

SEQ ID NO: 2686112 - RNA, 19 nt, Human
cuguaauccuagcacuuug

SEQ ID NO: 2686113 - RNA, 19 nt, Human
cuguaaucccagcuacucg

SEQ ID NO: 2686114 - RNA, 22 nt, Human
cuguaaucccagcuacucggga

SEQ ID NO: 2686115 - RNA, 22 nt, Human
gaacacuuauaagugaagugau

SEQ ID NO: 2686116 - RNA, 23 nt, Human
gaaauuugggagagccauacaua

SEQ ID NO: 2686117 - RNA, 20 nt, Human
gaaccuaacuccccacccca

SEQ ID NO: 2686118 - RNA, 19 nt, Human
gaaccacauugaagaaugu

SEQ ID NO: 2686119 - RNA, 19 nt, Human
gaacuauauuaguauguau

SEQ ID NO: 2686120 - RNA, 20 nt, Human
gaacuauugugcucagagac

SEQ ID NO: 2686121 - RNA, 17 nt, Human
gaaccuuggccugggcc

SEQ ID NO: 2686122 - RNA, 16 nt, Human
gaaccuuggccugggc

SEQ ID NO: 2686123 - RNA, 13 nt, Human
gaaccuuggccug

SEQ ID NO: 2686124 - RNA, 12 nt, Human
gaaccugugucc

SEQ ID NO: 2686125 - RNA, 14 nt, Human
gaacuccaggcccu

SEQ ID NO: 2686126 - RNA, 17 nt, Human
gaacuccaggcccuccu

SEQ ID NO: 2686127 - RNA, 23 nt, Human
gaacuccaggcccuccucuccca

SEQ ID NO: 2686128 - RNA, 18 nt, Human
gaacuguagaugauguau

SEQ ID NO: 2686129 - RNA, 20 nt, Human
gaacuggucaccaugaaacu

SEQ ID NO: 2686130 - RNA, 20 nt, Human
gaacuguagcugccauggcu

SEQ ID NO: 2686131 - RNA, 17 nt, Human
gaacugucugugaacag

SEQ ID NO: 2686132 - RNA, 17 nt, Human
gaacuugaaugugucag

SEQ ID NO: 2686133 - RNA, 13 nt, Human
gaagaagaugcuc

SEQ ID NO: 2686134 - RNA, 19 nt, Human
gaagaacugcaggcccugg

SEQ ID NO: 2686135 - RNA, 15 nt, Human
gaacuuggaagcaca

SEQ ID NO: 2686136 - RNA, 13 nt, Human
gaacuuggaagca

SEQ ID NO: 2686137 - RNA, 18 nt, Human
gaaauaggaaacaaguga

SEQ ID NO: 2686138 - RNA, 15 nt, Human
gaaauaggaaacaag

SEQ ID NO: 2686139 - RNA, 14 nt, Human
gaaauaggaaacaa

SEQ ID NO: 2686140 - RNA, 17 nt, Human
gaaauauaacacauuuu

SEQ ID NO: 2686141 - RNA, 18 nt, Human
gaaauauaacacauuuuu

SEQ ID NO: 2686142 - RNA, 17 nt, Human
gaaauaaaguuugcuua

SEQ ID NO: 2686143 - RNA, 16 nt, Human
gaaacaucucaauaaa

SEQ ID NO: 2686144 - RNA, 17 nt, Human
gaaacaucucaauaaag

SEQ ID NO: 2686145 - RNA, 16 nt, Human
gaaauaauagaaaugu

SEQ ID NO: 2686146 - RNA, 14 nt, Human
gaaauaaugcuaca

SEQ ID NO: 2686147 - RNA, 19 nt, Human
gaaauaaugcuacaauuuu

SEQ ID NO: 2686148 - RNA, 21 nt, Human
gaaauaaugcuacaauuuuaa

SEQ ID NO: 2686149 - RNA, 23 nt, Human
gaaauaaugcuacaauuuuaaga

SEQ ID NO: 2686150 - RNA, 14 nt, Human
gaaauucuccugga

SEQ ID NO: 2686151 - RNA, 15 nt, Human
gaaauucuccuggag

SEQ ID NO: 2686152 - RNA, 16 nt, Human
gaaauucuccuggagg

SEQ ID NO: 2686153 - RNA, 14 nt, Human
gaaauguuuuguaa

SEQ ID NO: 2686154 - RNA, 18 nt, Human
gaaauguuuuguaaacau

SEQ ID NO: 2686155 - RNA, 19 nt, Human
gaaauguuuuguaaacauu

SEQ ID NO: 2686156 - RNA, 20 nt, Human
gaaauguuuuguaaacauuu

SEQ ID NO: 2686157 - RNA, 22 nt, Human
gaaauguuuuguaaacauuuau

SEQ ID NO: 2686158 - RNA, 22 nt, Human
gaaauauuaagcauguuuuguu

SEQ ID NO: 2686159 - RNA, 15 nt, Human
gaaauggaaagcaga

SEQ ID NO: 2686160 - RNA, 16 nt, Human
gaaauggaaagcagag

SEQ ID NO: 2686161 - RNA, 14 nt, Human
gaaauggaaauuuu

SEQ ID NO: 2686162 - RNA, 21 nt, Human
gaaauggaggaucucuaaaga

SEQ ID NO: 2686163 - RNA, 24 nt, Human
gaaauggaggaucucuaaagagca

SEQ ID NO: 2686164 - RNA, 21 nt, Human
gaaauuuucaagagucuaaua

SEQ ID NO: 2686165 - RNA, 23 nt, Human
gaaauguuacaaaaauaaacuau

SEQ ID NO: 2686166 - RNA, 13 nt, Human
gaaauugcauacu

SEQ ID NO: 2686167 - RNA, 16 nt, Human
gaaauugcauacuuug

SEQ ID NO: 2686168 - RNA, 18 nt, Human
gaaauugcuuuguauugu

SEQ ID NO: 2686169 - RNA, 17 nt, Human
gaaauucuccuggaggu

SEQ ID NO: 2686170 - RNA, 21 nt, Human
gaaauugacacaaguggaccu

SEQ ID NO: 2686171 - RNA, 23 nt, Human
gaaggagauaauuacugccuuga

SEQ ID NO: 2686172 - RNA, 17 nt, Human
gaaggagaaguaagagg

SEQ ID NO: 2686173 - RNA, 22 nt, Human
gaaggcaagaggggguggaggg

SEQ ID NO: 2686174 - RNA, 23 nt, Human
gaaggcaagaggggguggagggg

SEQ ID NO: 2686175 - RNA, 14 nt, Human
gaaggcaagccagg

SEQ ID NO: 2686176 - RNA, 16 nt, Human
gaaggcaagccaggcu

SEQ ID NO: 2686177 - RNA, 14 nt, Human
gaaggcaagagggg

SEQ ID NO: 2686178 - RNA, 16 nt, Human
gaaggcaagagggggu

SEQ ID NO: 2686179 - RNA, 17 nt, Human
gaaggcaagagggggug

SEQ ID NO: 2686180 - RNA, 13 nt, Human
gaaggguuucucu

SEQ ID NO: 2686181 - RNA, 14 nt, Human
gaaggguuucucua

SEQ ID NO: 2686182 - RNA, 16 nt, Human
gaaggguuucucuauu

SEQ ID NO: 2686183 - RNA, 14 nt, Human
gaagggguuccuca

SEQ ID NO: 2686184 - RNA, 19 nt, Human
gaagccuccuuagaaaaaa

SEQ ID NO: 2686185 - RNA, 22 nt, Human
gaagccguccuggcgccuggca

SEQ ID NO: 2686186 - RNA, 12 nt, Human
gaagaagccugu

SEQ ID NO: 2686187 - RNA, 21 nt, Human
gaagccggggaagagauccaa

SEQ ID NO: 2686188 - RNA, 19 nt, Human
gaagccaucuaaaguaaaa

SEQ ID NO: 2686189 - RNA, 14 nt, Human
gaauagacaucaaa

SEQ ID NO: 2686190 - RNA, 16 nt, Human
gaauagacaucaaacu

SEQ ID NO: 2686191 - RNA, 19 nt, Human
gaauagacaucaaacucaa

SEQ ID NO: 2686192 - RNA, 11 nt, Human
gaaucaauaau

SEQ ID NO: 2686193 - RNA, 21 nt, Human
gaaucaauaauauauuuucug

SEQ ID NO: 2686194 - RNA, 14 nt, Human
gaauccaagccucc

SEQ ID NO: 2686195 - RNA, 15 nt, Human
gaauccaagccucca

SEQ ID NO: 2686196 - RNA, 17 nt, Human
gaauccaagccuccaca

SEQ ID NO: 2686197 - RNA, 20 nt, Human
gaauccaagccuccacagcg

SEQ ID NO: 2686198 - RNA, 17 nt, Human
gaaucccuguguuaauu

SEQ ID NO: 2686199 - RNA, 16 nt, Human
gaaucccuuaacaguu

SEQ ID NO: 2686200 - RNA, 18 nt, Human
gaaucuggagaccaggga

SEQ ID NO: 2686201 - RNA, 16 nt, Human
gaaucuggagaccagg

SEQ ID NO: 2686202 - RNA, 22 nt, Human
gaaucuggagaccagggagccu

SEQ ID NO: 2686203 - RNA, 13 nt, Human
gaauccuggcagc

SEQ ID NO: 2686204 - RNA, 14 nt, Human
gaauccuggcagcc

SEQ ID NO: 2686205 - RNA, 16 nt, Human
gaauccuggcagccca

SEQ ID NO: 2686206 - RNA, 17 nt, Human
gaauccuggcagcccag

SEQ ID NO: 2686207 - RNA, 12 nt, Human
gaauccuggcag

SEQ ID NO: 2686208 - RNA, 19 nt, Human
gaaucccuuaacaguugua

SEQ ID NO: 2686209 - RNA, 21 nt, Human
gaaucccuuaacaguuguauu

SEQ ID NO: 2686210 - RNA, 15 nt, Human
gaaugaaagcuguuc

SEQ ID NO: 2686211 - RNA, 14 nt, Human
gaauacuugaacca

SEQ ID NO: 2686212 - RNA, 12 nt, Human
gaauacuugaac

SEQ ID NO: 2686213 - RNA, 22 nt, Human
gaauacuugaaccauaaaaugu

SEQ ID NO: 2686214 - RNA, 15 nt, Human
gaauacuugaaccau

SEQ ID NO: 2686215 - RNA, 17 nt, Human
gaauacugcuugaauaa

SEQ ID NO: 2686216 - RNA, 14 nt, Human
gaauacugcuugaa

SEQ ID NO: 2686217 - RNA, 13 nt, Human
gaauacugcuuga

SEQ ID NO: 2686218 - RNA, 15 nt, Human
gaauacugauggaau

SEQ ID NO: 2686219 - RNA, 16 nt, Human
gaauacugauggaauu

SEQ ID NO: 2686220 - RNA, 18 nt, Human
gaauaaguuauugcaguu

SEQ ID NO: 2686221 - RNA, 19 nt, Human
gaauaaguuauugcaguuu

SEQ ID NO: 2686222 - RNA, 12 nt, Human
gaauaaguuauu

SEQ ID NO: 2686223 - RNA, 13 nt, Human
gaauaaguuauug

SEQ ID NO: 2686224 - RNA, 14 nt, Human
gaauaaguuauugc

SEQ ID NO: 2686225 - RNA, 16 nt, Human
gaauaaguuauugcag

SEQ ID NO: 2686226 - RNA, 12 nt, Human
gaauaaaugugu

SEQ ID NO: 2686227 - RNA, 16 nt, Human
gaauaaauguguuggg

SEQ ID NO: 2686228 - RNA, 13 nt, Human
gaagguuuauugu

SEQ ID NO: 2686229 - RNA, 14 nt, Human
gaagguuuauuguu

SEQ ID NO: 2686230 - RNA, 22 nt, Human
gaagguuuauuguuaauacaag

SEQ ID NO: 2686231 - RNA, 14 nt, Human
gaagguuuuugaua

SEQ ID NO: 2686232 - RNA, 14 nt, Human
gaauaaacaccacu

SEQ ID NO: 2686233 - RNA, 11 nt, Human
gaaacacugcc

SEQ ID NO: 2686234 - RNA, 12 nt, Human
gaaacacugccu

SEQ ID NO: 2686235 - RNA, 13 nt, Human
gaaacacugccuu

SEQ ID NO: 2686236 - RNA, 14 nt, Human
gaaacacugccuuu

SEQ ID NO: 2686237 - RNA, 16 nt, Human
gaaacacugccuuuuu

SEQ ID NO: 2686238 - RNA, 17 nt, Human
gaaacacugccuuuuua

SEQ ID NO: 2686239 - RNA, 18 nt, Human
gaaaaucagccugcucca

SEQ ID NO: 2686240 - RNA, 16 nt, Human
gaaaaucagccugcuc

SEQ ID NO: 2686241 - RNA, 14 nt, Human
gaaaaucagccugc

SEQ ID NO: 2686242 - RNA, 22 nt, Human
gaaaaauaaagacaccugguug

SEQ ID NO: 2686243 - RNA, 20 nt, Human
gaaaacaauggaguauucuc

SEQ ID NO: 2686244 - RNA, 17 nt, Human
cuuuucugcccuggcug

SEQ ID NO: 2686245 - RNA, 15 nt, Human
gaaaaaggcugugcu

SEQ ID NO: 2686246 - RNA, 16 nt, Human
gaaaaaggcugugcug

SEQ ID NO: 2686247 - RNA, 19 nt, Human
gaaaaaguuaaacauugaa

SEQ ID NO: 2686248 - RNA, 17 nt, Human
cuuuucucaguguuggu

SEQ ID NO: 2686249 - RNA, 20 nt, Human
cuuuucucaacuggguccag

SEQ ID NO: 2686250 - RNA, 20 nt, Human
cuuuucccugcuuccaggaa

SEQ ID NO: 2686251 - RNA, 18 nt, Human
cuuuucccugcuuccagg

SEQ ID NO: 2686252 - RNA, 13 nt, Human
cuuuucccugcuu

SEQ ID NO: 2686253 - RNA, 14 nt, Human
cuuuucccugcuuc

SEQ ID NO: 2686254 - RNA, 15 nt, Human
cuuuucccugcuucc

SEQ ID NO: 2686255 - RNA, 23 nt, Human
cuuuucuguccgagcuuugaaaa

SEQ ID NO: 2686256 - RNA, 18 nt, Human
cuuuucuguccgagcuuu

SEQ ID NO: 2686257 - RNA, 19 nt, Human
cuuuucugcccuggcugcu

SEQ ID NO: 2686258 - RNA, 12 nt, Human
cuuuucuggcac

SEQ ID NO: 2686259 - RNA, 14 nt, Human
cuuuucuggcaccg

SEQ ID NO: 2686260 - RNA, 15 nt, Human
cuuuucuggcaccgc

SEQ ID NO: 2686261 - RNA, 21 nt, Human
cuuuucuggggaaagacacug

SEQ ID NO: 2686262 - RNA, 23 nt, Human
cuuuucuggggaaagacacugcc

SEQ ID NO: 2686263 - RNA, 13 nt, Human
cuuuucuguauuu

SEQ ID NO: 2686264 - RNA, 17 nt, Human
cuuuucauucucuuuua

SEQ ID NO: 2686265 - RNA, 13 nt, Human
cuuuucagggcug

SEQ ID NO: 2686266 - RNA, 16 nt, Human
cuuuucagggcuggcu

SEQ ID NO: 2686267 - RNA, 17 nt, Human
cuuuucagggcuggcuc

SEQ ID NO: 2686268 - RNA, 20 nt, Human
cuuuucagggcuggcuccug

SEQ ID NO: 2686269 - RNA, 23 nt, Human
cuuuucagggcuggcuccugauc

SEQ ID NO: 2686270 - RNA, 17 nt, Human
cuuuguuucguggggag

SEQ ID NO: 2686271 - RNA, 18 nt, Human
cuuuguuucguggggagg

SEQ ID NO: 2686272 - RNA, 20 nt, Human
cuuuguuuguugucagcuga

SEQ ID NO: 2686273 - RNA, 18 nt, Human
cuuuguuuguugucagcu

SEQ ID NO: 2686274 - RNA, 19 nt, Human
cuuuuaauuguuucagaau

SEQ ID NO: 2686275 - RNA, 20 nt, Human
cuuuuaccuuuuuuuuuucu

SEQ ID NO: 2686276 - RNA, 21 nt, Human
cuuuuaccuuuuuuuuuucuu

SEQ ID NO: 2686277 - RNA, 14 nt, Human
cuuugggaaaacau

SEQ ID NO: 2686278 - RNA, 21 nt, Human
cuuugggaaaacauguuaaug

SEQ ID NO: 2686279 - RNA, 13 nt, Human
cuuugggaggcca

SEQ ID NO: 2686280 - RNA, 18 nt, Human
cuuuguucauagcccagu

SEQ ID NO: 2686281 - RNA, 14 nt, Human
cuuuguucccggcu

SEQ ID NO: 2686282 - RNA, 14 nt, Human
cuuugcugucccau

SEQ ID NO: 2686283 - RNA, 23 nt, Human
cuuugcugucccauagucccugc

SEQ ID NO: 2686284 - RNA, 22 nt, Human
cuuugcugucccauagucccug

SEQ ID NO: 2686285 - RNA, 15 nt, Human
cuuucccaagccuuc

SEQ ID NO: 2686286 - RNA, 16 nt, Human
cuuucccauggggagg

SEQ ID NO: 2686287 - RNA, 20 nt, Human
cuuuggaccuaaauggccuc

SEQ ID NO: 2686288 - RNA, 20 nt, Human
cuuuaaacugucgugucaua

SEQ ID NO: 2686289 - RNA, 14 nt, Human
cuuuaaacugucgu

SEQ ID NO: 2686290 - RNA, 12 nt, Human
cuuguuuuugca

SEQ ID NO: 2686291 - RNA, 16 nt, Human
cuuguuuuugcacaug

SEQ ID NO: 2686292 - RNA, 17 nt, Human
cuuguuuuggauggcuu

SEQ ID NO: 2686293 - RNA, 21 nt, Human
cuuguuuuggauggcuugucu

SEQ ID NO: 2686294 - RNA, 16 nt, Human
cuuguggcagcaacgg

SEQ ID NO: 2686295 - RNA, 22 nt, Human
cuuguugguucaccauugagac

SEQ ID NO: 2686296 - RNA, 13 nt, Human
cuuuauaaaucca

SEQ ID NO: 2686297 - RNA, 17 nt, Human
cuuuauaaauccaguga

SEQ ID NO: 2686298 - RNA, 18 nt, Human
cuuuauaaauccagugac

SEQ ID NO: 2686299 - RNA, 13 nt, Human
cuuuaguuuuugg

SEQ ID NO: 2686300 - RNA, 14 nt, Human
cuuuaguuuuuggu

SEQ ID NO: 2686301 - RNA, 21 nt, Human
cuuuaguuuuugguugggaau

SEQ ID NO: 2686302 - RNA, 23 nt, Human
cuuuaguuuuugguugggaauga

SEQ ID NO: 2686303 - RNA, 12 nt, Human
cuuuauuauuua

SEQ ID NO: 2686304 - RNA, 14 nt, Human
cuuuauuauuuauu

SEQ ID NO: 2686305 - RNA, 13 nt, Human
cuuuauuauuuau

SEQ ID NO: 2686306 - RNA, 22 nt, Human
cuuuauuacccccuccuucaga

SEQ ID NO: 2686307 - RNA, 20 nt, Human
cuuuauuacccccuccuuca

SEQ ID NO: 2686308 - RNA, 14 nt, Human
cuuuauuacccccu

SEQ ID NO: 2686309 - RNA, 14 nt, Human
cuuuauuaauguuu

SEQ ID NO: 2686310 - RNA, 15 nt, Human
cuuuauuaauguuuu

SEQ ID NO: 2686311 - RNA, 19 nt, Human
cuuuauuaauguuuucaaa

SEQ ID NO: 2686312 - RNA, 20 nt, Human
cuuuauguuuuugaggcuuu

SEQ ID NO: 2686313 - RNA, 14 nt, Human
cuuucaguacuuuu

SEQ ID NO: 2686314 - RNA, 15 nt, Human
cuuucaguacuuuuu

SEQ ID NO: 2686315 - RNA, 21 nt, Human
cuuucaguacuuuuuuaaaua

SEQ ID NO: 2686316 - RNA, 20 nt, Human
cuuuauuugaacaaugaagu

SEQ ID NO: 2686317 - RNA, 14 nt, Human
cuuuauuuguaaau

SEQ ID NO: 2686318 - RNA, 15 nt, Human
cuuuauuuguaaauu

SEQ ID NO: 2686319 - RNA, 16 nt, Human
cuuuauuuguaaauuu

SEQ ID NO: 2686320 - RNA, 17 nt, Human
cuuuauuuguaaauuua

SEQ ID NO: 2686321 - RNA, 22 nt, Human
cuuuccaaaugcccagcuuaaa

SEQ ID NO: 2686322 - RNA, 19 nt, Human
cuuuccaaaugcccagcuu

SEQ ID NO: 2686323 - RNA, 18 nt, Human
cuuuccaaaugcccagcu

SEQ ID NO: 2686324 - RNA, 11 nt, Human
cuuucccaagc

SEQ ID NO: 2686325 - RNA, 15 nt, Human
cuuuccaccacagcc

SEQ ID NO: 2686326 - RNA, 17 nt, Human
cuuuccaccacagccag

SEQ ID NO: 2686327 - RNA, 21 nt, Human
cuuuccaccacagccagcacc

SEQ ID NO: 2686328 - RNA, 22 nt, Human
cuuuccaccacagccagcaccu

SEQ ID NO: 2686329 - RNA, 23 nt, Human
cuuuccaccacagccagcaccug

SEQ ID NO: 2686330 - RNA, 22 nt, Human
cuuuccaaaccuuaucuccaca

SEQ ID NO: 2686331 - RNA, 18 nt, Human
cuuuccaaaccuuaucuc

SEQ ID NO: 2686332 - RNA, 16 nt, Human
cuuggggggcugaggu

SEQ ID NO: 2686333 - RNA, 15 nt, Human
cuuggggggcugagg

SEQ ID NO: 2686334 - RNA, 14 nt, Human
cuugggccacugug

SEQ ID NO: 2686335 - RNA, 22 nt, Human
cuugggcagagcuggcucugag

SEQ ID NO: 2686336 - RNA, 23 nt, Human
cuugggcagagcuggcucugagc

SEQ ID NO: 2686337 - RNA, 13 nt, Human
cuugggccacccc

SEQ ID NO: 2686338 - RNA, 17 nt, Human
cuugggccaccccuccu

SEQ ID NO: 2686339 - RNA, 14 nt, Human
cuugggcagagcug

SEQ ID NO: 2686340 - RNA, 15 nt, Human
cuugggcagagcugg

SEQ ID NO: 2686341 - RNA, 18 nt, Human
cuugggcagagcuggcuc

SEQ ID NO: 2686342 - RNA, 19 nt, Human
cuugggcagagcuggcucu

SEQ ID NO: 2686343 - RNA, 20 nt, Human
cuugggcagagcuggcucug

SEQ ID NO: 2686344 - RNA, 14 nt, Human
cuuggagggaagcc

SEQ ID NO: 2686345 - RNA, 13 nt, Human
cuugccagagccg

SEQ ID NO: 2686346 - RNA, 20 nt, Human
cuugccagagccgggcacau

SEQ ID NO: 2686347 - RNA, 16 nt, Human
cuuggaaauuccugua

SEQ ID NO: 2686348 - RNA, 19 nt, Human
cuuggaaauuccuguacug

SEQ ID NO: 2686349 - RNA, 20 nt, Human
cuuggaaauuccuguacugu

SEQ ID NO: 2686350 - RNA, 15 nt, Human
cuugcuuauuugaca

SEQ ID NO: 2686351 - RNA, 17 nt, Human
cuugcuuuucuguauuu

SEQ ID NO: 2686352 - RNA, 19 nt, Human
cuugcuguuuguccugaga

SEQ ID NO: 2686353 - RNA, 13 nt, Human
cuugcuuaaauuu

SEQ ID NO: 2686354 - RNA, 16 nt, Human
cuugcuuaaauuucuu

SEQ ID NO: 2686355 - RNA, 17 nt, Human
cuugcuuaaauuucuua

SEQ ID NO: 2686356 - RNA, 22 nt, Human
cuugcuuaaauuucuuauguga

SEQ ID NO: 2686357 - RNA, 23 nt, Human
cuugcuuaaauuucuuaugugac

SEQ ID NO: 2686358 - RNA, 13 nt, Human
cucgacucugugc

SEQ ID NO: 2686359 - RNA, 14 nt, Human
cucgacucugugcc

SEQ ID NO: 2686360 - RNA, 19 nt, Human
cuccuuauuuggcgugacc

SEQ ID NO: 2686361 - RNA, 18 nt, Human
cucgcauaggaccuuucc

SEQ ID NO: 2686362 - RNA, 20 nt, Human
cucgccggacccucuaaccu

SEQ ID NO: 2686363 - RNA, 17 nt, Human
cucgccggaucugaggg

SEQ ID NO: 2686364 - RNA, 18 nt, Human
cucgccggaucugaggga

SEQ ID NO: 2686365 - RNA, 12 nt, Human
cucgcugagggc

SEQ ID NO: 2686366 - RNA, 22 nt, Human
cucgcugagggcagacuggggc

SEQ ID NO: 2686367 - RNA, 18 nt, Human
cucgcagccucucagugc

SEQ ID NO: 2686368 - RNA, 19 nt, Human
cucgcagccucucagugcc

SEQ ID NO: 2686369 - RNA, 19 nt, Human
cuccugcuuaaucuucaaa

SEQ ID NO: 2686370 - RNA, 14 nt, Human
cuccuuagaaaaaa

SEQ ID NO: 2686371 - RNA, 14 nt, Human
cuccugcugccaca

SEQ ID NO: 2686372 - RNA, 15 nt, Human
cuccucccacccggc

SEQ ID NO: 2686373 - RNA, 15 nt, Human
cuccuccagccgcca

SEQ ID NO: 2686374 - RNA, 18 nt, Human
cuccucagggcagccucc

SEQ ID NO: 2686375 - RNA, 18 nt, Human
cuccucucccauccuuga

SEQ ID NO: 2686376 - RNA, 20 nt, Human
cuccucccacccggcugcag

SEQ ID NO: 2686377 - RNA, 22 nt, Human
cuccucccacccggcugcagag

SEQ ID NO: 2686378 - RNA, 22 nt, Human
cuccuauucucuuaauuuuucu

SEQ ID NO: 2686379 - RNA, 15 nt, Human
cuccuauucuauaaa

SEQ ID NO: 2686380 - RNA, 16 nt, Human
cuccuauucuauaaaa

SEQ ID NO: 2686381 - RNA, 20 nt, Human
cuccuauucuauaaaacucu

SEQ ID NO: 2686382 - RNA, 12 nt, Human
cuccgccagccu

SEQ ID NO: 2686383 - RNA, 13 nt, Human
cuccgccagccuc

SEQ ID NO: 2686384 - RNA, 12 nt, Human
cuccgcaggacu

SEQ ID NO: 2686385 - RNA, 22 nt, Human
cuccgcaggacuuccccggagg

SEQ ID NO: 2686386 - RNA, 13 nt, Human
cuccgcaggacuu

SEQ ID NO: 2686387 - RNA, 17 nt, Human
cuccgaggacccaggaa

SEQ ID NO: 2686388 - RNA, 14 nt, Human
cuccgagagggaga

SEQ ID NO: 2686389 - RNA, 13 nt, Human
cuccgagaggugg

SEQ ID NO: 2686390 - RNA, 14 nt, Human
cuccgagagguggg

SEQ ID NO: 2686391 - RNA, 15 nt, Human
cuccgagaggugggc

SEQ ID NO: 2686392 - RNA, 17 nt, Human
cuccgagaggugggcca

SEQ ID NO: 2686393 - RNA, 18 nt, Human
cuccgagaggugggccag

SEQ ID NO: 2686394 - RNA, 22 nt, Human
cuccgagaggugggccagucug

SEQ ID NO: 2686395 - RNA, 16 nt, Human
cuccgagagggagaga

SEQ ID NO: 2686396 - RNA, 15 nt, Human
cuccgaggacccagg

SEQ ID NO: 2686397 - RNA, 22 nt, Human
cucccuguaggguccaaccaga

SEQ ID NO: 2686398 - RNA, 19 nt, Human
cuccccagcauuccagccc

SEQ ID NO: 2686399 - RNA, 12 nt, Human
cucccugccugg

SEQ ID NO: 2686400 - RNA, 16 nt, Human
cuccccuuuuuuuccc

SEQ ID NO: 2686401 - RNA, 17 nt, Human
cucaucaaucaaauaag

SEQ ID NO: 2686402 - RNA, 21 nt, Human
cucauaucaacuuagucaaua

SEQ ID NO: 2686403 - RNA, 21 nt, Human
cucaucaaucaaauaaguauu

SEQ ID NO: 2686404 - RNA, 23 nt, Human
cucaggaguuugagaccaaccug

SEQ ID NO: 2686405 - RNA, 18 nt, Human
cucaggaguuugagacca

SEQ ID NO: 2686406 - RNA, 15 nt, Human
cucagggccuggucg

SEQ ID NO: 2686407 - RNA, 13 nt, Human
cucagggcuccca

SEQ ID NO: 2686408 - RNA, 15 nt, Human
cucagggcucccagg

SEQ ID NO: 2686409 - RNA, 16 nt, Human
cucagggcucccaggg

SEQ ID NO: 2686410 - RNA, 14 nt, Human
cucagggcagccuc

SEQ ID NO: 2686411 - RNA, 21 nt, Human
cucagggcagccucccccggc

SEQ ID NO: 2686412 - RNA, 20 nt, Human
cucaggugagaagcagagga

SEQ ID NO: 2686413 - RNA, 19 nt, Human
cucaggugagaagcagagg

SEQ ID NO: 2686414 - RNA, 16 nt, Human
cucaggugagaagcag

SEQ ID NO: 2686415 - RNA, 21 nt, Human
cuccauaguuuggcauuugca

SEQ ID NO: 2686416 - RNA, 15 nt, Human
cuccaucacccucuu

SEQ ID NO: 2686417 - RNA, 20 nt, Human
cuccauaguuuggcauuugc

SEQ ID NO: 2686418 - RNA, 22 nt, Human
cuccaucacccucuuccuguga

SEQ ID NO: 2686419 - RNA, 12 nt, Human
cuccaucccucu

SEQ ID NO: 2686420 - RNA, 13 nt, Human
cuccaucccucua

SEQ ID NO: 2686421 - RNA, 15 nt, Human
cuccaucccucuaau

SEQ ID NO: 2686422 - RNA, 22 nt, Human
cuccaucccucuaaugagacug

SEQ ID NO: 2686423 - RNA, 12 nt, Human
cuccauccaagg

SEQ ID NO: 2686424 - RNA, 13 nt, Human
cuccauccaaggc

SEQ ID NO: 2686425 - RNA, 14 nt, Human
cuccauccaaggcc

SEQ ID NO: 2686426 - RNA, 18 nt, Human
cuccauccaaggccaggu

SEQ ID NO: 2686427 - RNA, 22 nt, Human
cuccagcgaucucuccacugug

SEQ ID NO: 2686428 - RNA, 13 nt, Human
cuccagccugggg

SEQ ID NO: 2686429 - RNA, 16 nt, Human
cuccagccugggggac

SEQ ID NO: 2686430 - RNA, 12 nt, Human
cuccagccuggg

SEQ ID NO: 2686431 - RNA, 18 nt, Human
cuccagcgucagcugcuc

SEQ ID NO: 2686432 - RNA, 19 nt, Human
cuccagcgucagcugcucc

SEQ ID NO: 2686433 - RNA, 23 nt, Human
cuccagcgucagcugcucccugg

SEQ ID NO: 2686434 - RNA, 23 nt, Human
cuccaaacugaagcagccucucc

SEQ ID NO: 2686435 - RNA, 13 nt, Human
cucauauaagaca

SEQ ID NO: 2686436 - RNA, 19 nt, Human
cucauuacuuguugccuau

SEQ ID NO: 2686437 - RNA, 15 nt, Human
cucauuaaacuuuuu

SEQ ID NO: 2686438 - RNA, 19 nt, Human
cucaucugaaauguuacaa

SEQ ID NO: 2686439 - RNA, 21 nt, Human
cucaucugaaauguuacaaaa

SEQ ID NO: 2686440 - RNA, 13 nt, Human
cucaucugcaaaa

SEQ ID NO: 2686441 - RNA, 12 nt, Human
cucaucugcugg

SEQ ID NO: 2686442 - RNA, 17 nt, Human
cuccacaaccucuuccc

SEQ ID NO: 2686443 - RNA, 22 nt, Human
cuccacaaccucuuccccccaa

SEQ ID NO: 2686444 - RNA, 13 nt, Human
cuccacaucugcc

SEQ ID NO: 2686445 - RNA, 14 nt, Human
cuccacaucugccu

SEQ ID NO: 2686446 - RNA, 15 nt, Human
cuccacaucugccuu

SEQ ID NO: 2686447 - RNA, 17 nt, Human
cuccacaucugccuuaa

SEQ ID NO: 2686448 - RNA, 16 nt, Human
cuccacaucugccuua

SEQ ID NO: 2686449 - RNA, 13 nt, Human
cucacugccaggc

SEQ ID NO: 2686450 - RNA, 12 nt, Human
cucacugccagg

SEQ ID NO: 2686451 - RNA, 22 nt, Human
cucacucggguuucucuguggc

SEQ ID NO: 2686452 - RNA, 16 nt, Human
cucacucacagaguca

SEQ ID NO: 2686453 - RNA, 16 nt, Human
cucagagugguggggg

SEQ ID NO: 2686454 - RNA, 21 nt, Human
cucagaguggugggggaaggc

SEQ ID NO: 2686455 - RNA, 22 nt, Human
cucagagacacuguugauaaaa

SEQ ID NO: 2686456 - RNA, 22 nt, Human
cucacugccaggccagccuccg

SEQ ID NO: 2686457 - RNA, 19 nt, Human
cucacuguuuguuuuuauu

SEQ ID NO: 2686458 - RNA, 21 nt, Human
cucacuguuuguuuuuauuua

SEQ ID NO: 2686459 - RNA, 19 nt, Human
cucagagaaaaaugcuccc

SEQ ID NO: 2686460 - RNA, 20 nt, Human
cucagagaaaaaugcucccc

SEQ ID NO: 2686461 - RNA, 21 nt, Human
cucagagaaaaaugcucccca

SEQ ID NO: 2686462 - RNA, 23 nt, Human
cucagagaaaaaugcuccccaca

SEQ ID NO: 2686463 - RNA, 22 nt, Human
cucacugccaugccagcuuauc

SEQ ID NO: 2686464 - RNA, 19 nt, Human
cucacugccaugccagcuu

SEQ ID NO: 2686465 - RNA, 14 nt, Human
cucacugccaggcc

SEQ ID NO: 2686466 - RNA, 15 nt, Human
cucacugccaggcca

SEQ ID NO: 2686467 - RNA, 18 nt, Human
cucacugccaggccagcc

SEQ ID NO: 2686468 - RNA, 19 nt, Human
cucacugccaggccagccu

SEQ ID NO: 2686469 - RNA, 20 nt, Human
cucacugccaggccagccuc

SEQ ID NO: 2686470 - RNA, 21 nt, Human
cucacugccaggccagccucc

SEQ ID NO: 2686471 - RNA, 17 nt, Human
cucagauuucugaggaa

SEQ ID NO: 2686472 - RNA, 16 nt, Human
cucagauuucugagga

SEQ ID NO: 2686473 - RNA, 13 nt, Human
cucaaauuuuuug

SEQ ID NO: 2686474 - RNA, 21 nt, Human
cucaaauuuuuugacuuuuuu

SEQ ID NO: 2686475 - RNA, 21 nt, Human
cucaacaccucugcacaagcu

SEQ ID NO: 2686476 - RNA, 14 nt, Human
cuauuucaucacaa

SEQ ID NO: 2686477 - RNA, 22 nt, Human
cuauucuauaaaacucugcaug

SEQ ID NO: 2686478 - RNA, 12 nt, Human
cuauuccaauaa

SEQ ID NO: 2686479 - RNA, 15 nt, Human
cuauuccaauaaacu

SEQ ID NO: 2686480 - RNA, 12 nt, Human
cucaacaagaaa

SEQ ID NO: 2686481 - RNA, 22 nt, Human
cucacagcuaugcaaaaagcua

SEQ ID NO: 2686482 - RNA, 16 nt, Human
cucacagcuaugcaaa

SEQ ID NO: 2686483 - RNA, 15 nt, Human
cucacagcuaugcaa

SEQ ID NO: 2686484 - RNA, 15 nt, Human
cucaagaaauuccca

SEQ ID NO: 2686485 - RNA, 23 nt, Human
cucaccagccccacugccagcag

SEQ ID NO: 2686486 - RNA, 21 nt, Human
cucaccagccccacugccagc

SEQ ID NO: 2686487 - RNA, 22 nt, Human
cucaccagccccacugccagca

SEQ ID NO: 2686488 - RNA, 13 nt, Human
cucaccagcccca

SEQ ID NO: 2686489 - RNA, 16 nt, Human
cucaccagccccacug

SEQ ID NO: 2686490 - RNA, 17 nt, Human
cucaccagccccacugc

SEQ ID NO: 2686491 - RNA, 18 nt, Human
cucaccagccccacugcc

SEQ ID NO: 2686492 - RNA, 19 nt, Human
cucaccagccccacugcca

SEQ ID NO: 2686493 - RNA, 20 nt, Human
cucaccagccccacugccag

SEQ ID NO: 2686494 - RNA, 17 nt, Human
cuauaagccaaaauuaa

SEQ ID NO: 2686495 - RNA, 17 nt, Human
cuauagcaucacuuaaa

SEQ ID NO: 2686496 - RNA, 15 nt, Human
cuauagcaucacuua

SEQ ID NO: 2686497 - RNA, 20 nt, Human
cuauagcaucacuuaaaaca

SEQ ID NO: 2686498 - RNA, 21 nt, Human
cuaucugucugguggccccgu

SEQ ID NO: 2686499 - RNA, 12 nt, Human
cuaucugugcua

SEQ ID NO: 2686500 - RNA, 17 nt, Human
cuaucugucugguggcc

SEQ ID NO: 2686501 - RNA, 18 nt, Human
cuaucugucugguggccc

SEQ ID NO: 2686502 - RNA, 11 nt, Human
cuaucugucug

SEQ ID NO: 2686503 - RNA, 14 nt, Human
cuaucugucuggug

SEQ ID NO: 2686504 - RNA, 16 nt, Human
cuaucugucugguggc

SEQ ID NO: 2686505 - RNA, 18 nt, Human
cuauauuuuaaccugcau

SEQ ID NO: 2686506 - RNA, 19 nt, Human
cuauucaguggcgagaaau

SEQ ID NO: 2686507 - RNA, 15 nt, Human
cuauuagagaagaga

SEQ ID NO: 2686508 - RNA, 18 nt, Human
cuauuacgaaguucaaga

SEQ ID NO: 2686509 - RNA, 23 nt, Human
cuauuacgaaguucaagaucaaa

SEQ ID NO: 2686510 - RNA, 22 nt, Human
cuauuacgaaguucaagaucaa

SEQ ID NO: 2686511 - RNA, 16 nt, Human
cuauuaguguuauaug

SEQ ID NO: 2686512 - RNA, 15 nt, Human
cuauuaguguuauau

SEQ ID NO: 2686513 - RNA, 14 nt, Human
cuauuaguguuaua

SEQ ID NO: 2686514 - RNA, 17 nt, Human
cuauggucgggagacag

SEQ ID NO: 2686515 - RNA, 21 nt, Human
cuauggucgggagacagcauc

SEQ ID NO: 2686516 - RNA, 20 nt, Human
cuaugcauaucaguugagcu

SEQ ID NO: 2686517 - RNA, 14 nt, Human
cuauggcagaaaaa

SEQ ID NO: 2686518 - RNA, 23 nt, Human
cuauggcagaaaaaaugucugua

SEQ ID NO: 2686519 - RNA, 16 nt, Human
cuauggcagaaaaaau

SEQ ID NO: 2686520 - RNA, 22 nt, Human
cuauggcagaaaaaaugucugu

SEQ ID NO: 2686521 - RNA, 17 nt, Human
cuaugcuuuccaaaccu

SEQ ID NO: 2686522 - RNA, 16 nt, Human
cuagguagagucugag

SEQ ID NO: 2686523 - RNA, 17 nt, Human
cuagguagagucugagg

SEQ ID NO: 2686524 - RNA, 12 nt, Human
cuaggucuccag

SEQ ID NO: 2686525 - RNA, 13 nt, Human
cuaggucuccagu

SEQ ID NO: 2686526 - RNA, 15 nt, Human
cgccaugcuccuggc

SEQ ID NO: 2686527 - RNA, 18 nt, Human
cgcccaugcacuggggac

SEQ ID NO: 2686528 - RNA, 12 nt, Human
cuagugaaacuu

SEQ ID NO: 2686529 - RNA, 16 nt, Human
cuagugaaacuuuucu

SEQ ID NO: 2686530 - RNA, 14 nt, Human
cuagucauauauua

SEQ ID NO: 2686531 - RNA, 21 nt, Human
cuagucaacaguacccugguu

SEQ ID NO: 2686532 - RNA, 14 nt, Human
cuagucaccagaga

SEQ ID NO: 2686533 - RNA, 13 nt, Human
cuaguaagaagac

SEQ ID NO: 2686534 - RNA, 22 nt, Human
cuaguaagaagacaaacugcuu

SEQ ID NO: 2686535 - RNA, 21 nt, Human
cugauuucuagaacccgugac

SEQ ID NO: 2686536 - RNA, 13 nt, Human
cugauuucuucag

SEQ ID NO: 2686537 - RNA, 22 nt, Human
cugauuugcaauaaaaaugaua

SEQ ID NO: 2686538 - RNA, 13 nt, Human
cugauuucuuuuc

SEQ ID NO: 2686539 - RNA, 21 nt, Human
cugaugguguggccuguggcu

SEQ ID NO: 2686540 - RNA, 23 nt, Human
cugauuugaugauacauuucauu

SEQ ID NO: 2686541 - RNA, 16 nt, Human
cugauuugcugcucuu

SEQ ID NO: 2686542 - RNA, 17 nt, Human
cugauuugcugcucuuc

SEQ ID NO: 2686543 - RNA, 22 nt, Human
cugcacaagcugcacccucagg

SEQ ID NO: 2686544 - RNA, 22 nt, Human
cugcacaugacucggggguggg

SEQ ID NO: 2686545 - RNA, 23 nt, Human
cugcacaugacucgggggugggg

SEQ ID NO: 2686546 - RNA, 22 nt, Human
cugcacuccucagggcagccuc

SEQ ID NO: 2686547 - RNA, 19 nt, Human
cugcaccccuucucuccuc

SEQ ID NO: 2686548 - RNA, 20 nt, Human
cugcaccccuucucuccucc

SEQ ID NO: 2686549 - RNA, 21 nt, Human
cugcaccccuucucuccuccc

SEQ ID NO: 2686550 - RNA, 15 nt, Human
cugcacuccucaggg

SEQ ID NO: 2686551 - RNA, 19 nt, Human
cugcacucuuaagcuuccg

SEQ ID NO: 2686552 - RNA, 14 nt, Human
cugcacccucaggc

SEQ ID NO: 2686553 - RNA, 13 nt, Human
cugcacccucagg

SEQ ID NO: 2686554 - RNA, 16 nt, Human
cugaggccugcagcac

SEQ ID NO: 2686555 - RNA, 14 nt, Human
cugaggccugggcc

SEQ ID NO: 2686556 - RNA, 15 nt, Human
cugaggccugggccg

SEQ ID NO: 2686557 - RNA, 19 nt, Human
cugaggccugggccgcugc

SEQ ID NO: 2686558 - RNA, 22 nt, Human
cugaggccugggccgcugccac

SEQ ID NO: 2686559 - RNA, 23 nt, Human
cugaggccugggccgcugccacg

SEQ ID NO: 2686560 - RNA, 20 nt, Human
cugaggccguugcugacuua

SEQ ID NO: 2686561 - RNA, 13 nt, Human
cugaggcuguggu

SEQ ID NO: 2686562 - RNA, 14 nt, Human
cugaggcugugguc

SEQ ID NO: 2686563 - RNA, 17 nt, Human
cugaggcuguggucaca

SEQ ID NO: 2686564 - RNA, 19 nt, Human
cugaggcuguggucacagc

SEQ ID NO: 2686565 - RNA, 20 nt, Human
cugaggcuguggucacagcg

SEQ ID NO: 2686566 - RNA, 12 nt, Human
cugaggcugagg

SEQ ID NO: 2686567 - RNA, 14 nt, Human
cugaggcugaggca

SEQ ID NO: 2686568 - RNA, 20 nt, Human
cugagucuguucugguaauc

SEQ ID NO: 2686569 - RNA, 14 nt, Human
cugagucugggcag

SEQ ID NO: 2686570 - RNA, 22 nt, Human
cugagucugggcagcugucccu

SEQ ID NO: 2686571 - RNA, 18 nt, Human
cugcccaucgugaagaag

SEQ ID NO: 2686572 - RNA, 21 nt, Human
cugcccaucgugaagaagccu

SEQ ID NO: 2686573 - RNA, 22 nt, Human
cugcccaucgugaagaagccug

SEQ ID NO: 2686574 - RNA, 17 nt, Human
cugcccagcccccuggu

SEQ ID NO: 2686575 - RNA, 13 nt, Human
cugcccacuguuu

SEQ ID NO: 2686576 - RNA, 22 nt, Human
cugcccacuguuucucuugagc

SEQ ID NO: 2686577 - RNA, 23 nt, Human
cugcccacuguuucucuugagcu

SEQ ID NO: 2686578 - RNA, 17 nt, Human
cugcccagacaagauuu

SEQ ID NO: 2686579 - RNA, 17 nt, Human
cugccaggcaggggugg

SEQ ID NO: 2686580 - RNA, 20 nt, Human
cugccaggcagggguggggg

SEQ ID NO: 2686581 - RNA, 13 nt, Human
cugccaggccagc

SEQ ID NO: 2686582 - RNA, 15 nt, Human
cugccaggccagccu

SEQ ID NO: 2686583 - RNA, 16 nt, Human
cugccaggccagccuc

SEQ ID NO: 2686584 - RNA, 17 nt, Human
cugccaggccagccucc

SEQ ID NO: 2686585 - RNA, 18 nt, Human
cugccaggccagccuccg

SEQ ID NO: 2686586 - RNA, 19 nt, Human
cugccaggccagccuccga

SEQ ID NO: 2686587 - RNA, 20 nt, Human
cugccaggccagccuccgag

SEQ ID NO: 2686588 - RNA, 22 nt, Human
cugccaggccagccuccgagag

SEQ ID NO: 2686589 - RNA, 23 nt, Human
cugccaggccagccuccgagagg

SEQ ID NO: 2686590 - RNA, 14 nt, Human
cugccaugccagcu

SEQ ID NO: 2686591 - RNA, 16 nt, Human
cugccacucacuaggc

SEQ ID NO: 2686592 - RNA, 19 nt, Human
cugccacucacuaggcccc

SEQ ID NO: 2686593 - RNA, 13 nt, Human
cugccaggcaugg

SEQ ID NO: 2686594 - RNA, 11 nt, Human
cugccaggcau

SEQ ID NO: 2686595 - RNA, 16 nt, Human
cugcaucguuucaucu

SEQ ID NO: 2686596 - RNA, 13 nt, Human
cugcauccagccu

SEQ ID NO: 2686597 - RNA, 22 nt, Human
cugcaucguuucaucuuccaac

SEQ ID NO: 2686598 - RNA, 20 nt, Human
cugcauguagaggcuuguuu

SEQ ID NO: 2686599 - RNA, 16 nt, Human
cugcaugcccucucag

SEQ ID NO: 2686600 - RNA, 15 nt, Human
cugcaugcccucuca

SEQ ID NO: 2686601 - RNA, 21 nt, Human
cugcaugcccucucaggccgg

SEQ ID NO: 2686602 - RNA, 20 nt, Human
cugcaugcccucucaggccg

SEQ ID NO: 2686603 - RNA, 19 nt, Human
cugcaugcccucucaggcc

SEQ ID NO: 2686604 - RNA, 18 nt, Human
cugcaugcccucucaggc

SEQ ID NO: 2686605 - RNA, 17 nt, Human
cugcaugcccucucagg

SEQ ID NO: 2686606 - RNA, 22 nt, Human
cugccuggagacuuagggcacc

SEQ ID NO: 2686607 - RNA, 20 nt, Human
cugccuucgcuucuugccuc

SEQ ID NO: 2686608 - RNA, 21 nt, Human
cugccuucgcuucuugccucu

SEQ ID NO: 2686609 - RNA, 23 nt, Human
cugccuucgcuucuugccucugu

SEQ ID NO: 2686610 - RNA, 19 nt, Human
cugccugccccgcccccag

SEQ ID NO: 2686611 - RNA, 21 nt, Human
cugccugccccgcccccaguc

SEQ ID NO: 2686612 - RNA, 14 nt, Human
cugccugccccgcc

SEQ ID NO: 2686613 - RNA, 15 nt, Human
cugccugccccgccc

SEQ ID NO: 2686614 - RNA, 18 nt, Human
cugccugccccgccccca

SEQ ID NO: 2686615 - RNA, 22 nt, Human
cugccugccccgcccccagucc

SEQ ID NO: 2686616 - RNA, 24 nt, Human
cugcguccuccucaccucaugccc

SEQ ID NO: 2686617 - RNA, 13 nt, Human
cugcgucuauccu

SEQ ID NO: 2686618 - RNA, 16 nt, Human
cugcgucuauccugug

SEQ ID NO: 2686619 - RNA, 18 nt, Human
cugcgucuauccugugua

SEQ ID NO: 2686620 - RNA, 13 nt, Human
cugcguccuccuc

SEQ ID NO: 2686621 - RNA, 14 nt, Human
cugcguccuccuca

SEQ ID NO: 2686622 - RNA, 15 nt, Human
cugcguccuccucac

SEQ ID NO: 2686623 - RNA, 17 nt, Human
cugcguccuccucaccu

SEQ ID NO: 2686624 - RNA, 18 nt, Human
cugcguccuccucaccuc

SEQ ID NO: 2686625 - RNA, 19 nt, Human
cugcguccuccucaccuca

SEQ ID NO: 2686626 - RNA, 20 nt, Human
cugcgaagacccucuugccc

SEQ ID NO: 2686627 - RNA, 21 nt, Human
cugcgaagacccucuugccca

SEQ ID NO: 2686628 - RNA, 22 nt, Human
cugcgaagacccucuugcccau

SEQ ID NO: 2686629 - RNA, 14 nt, Human
cugccuuugcacca

SEQ ID NO: 2686630 - RNA, 20 nt, Human
cugccuuugcaccacgggac

SEQ ID NO: 2686631 - RNA, 15 nt, Human
cugcggaucucagcu

SEQ ID NO: 2686632 - RNA, 17 nt, Human
cugcggcguacaggcug

SEQ ID NO: 2686633 - RNA, 15 nt, Human
cugccuauugauuua

SEQ ID NO: 2686634 - RNA, 21 nt, Human
cugccggacccggaggccgag

SEQ ID NO: 2686635 - RNA, 20 nt, Human
cugccgccgcuagguagagu

SEQ ID NO: 2686636 - RNA, 19 nt, Human
cugccgcccccuccugaac

SEQ ID NO: 2686637 - RNA, 18 nt, Human
cugccgcccccuccugaa

SEQ ID NO: 2686638 - RNA, 13 nt, Human
cugccccucucac

SEQ ID NO: 2686639 - RNA, 17 nt, Human
cugccccucucaccaaa

SEQ ID NO: 2686640 - RNA, 15 nt, Human
cugaauguugggacu

SEQ ID NO: 2686641 - RNA, 16 nt, Human
cugaauguugggacug

SEQ ID NO: 2686642 - RNA, 19 nt, Human
cugaauguugggacugcua

SEQ ID NO: 2686643 - RNA, 17 nt, Human
cugaaguuuuuuugcug

SEQ ID NO: 2686644 - RNA, 23 nt, Human
cugaaguuuuuuugcugcugccu

SEQ ID NO: 2686645 - RNA, 17 nt, Human
cugaaguugcagauguu

SEQ ID NO: 2686646 - RNA, 18 nt, Human
cugaaguugcagauguua

SEQ ID NO: 2686647 - RNA, 22 nt, Human
cugaagucccagauacuugggg

SEQ ID NO: 2686648 - RNA, 20 nt, Human
cugaagucuuacuacagaaa

SEQ ID NO: 2686649 - RNA, 12 nt, Human
cugaaccaugug

SEQ ID NO: 2686650 - RNA, 22 nt, Human
cugaaccacuuguagauuugau

SEQ ID NO: 2686651 - RNA, 18 nt, Human
cugaaccacuuguagauu

SEQ ID NO: 2686652 - RNA, 17 nt, Human
cugaaccacuuguagau

SEQ ID NO: 2686653 - RNA, 15 nt, Human
cugaaccacuuguag

SEQ ID NO: 2686654 - RNA, 14 nt, Human
cugaaccacuugua

SEQ ID NO: 2686655 - RNA, 21 nt, Human
cugaacaauaggcuguuccca

SEQ ID NO: 2686656 - RNA, 19 nt, Human
cugaacaauaggcuguucc

SEQ ID NO: 2686657 - RNA, 18 nt, Human
cugaaauucuccuggagg

SEQ ID NO: 2686658 - RNA, 14 nt, Human
cugaaauucuccug

SEQ ID NO: 2686659 - RNA, 15 nt, Human
cugaaauucuccugg

SEQ ID NO: 2686660 - RNA, 16 nt, Human
cugaaauucuccugga

SEQ ID NO: 2686661 - RNA, 17 nt, Human
cugaaauucuccuggag

SEQ ID NO: 2686662 - RNA, 13 nt, Human
cugaaaguuuugu

SEQ ID NO: 2686663 - RNA, 15 nt, Human
cugaaaguuuuguaa

SEQ ID NO: 2686664 - RNA, 16 nt, Human
cugaaaguuuuguaaa

SEQ ID NO: 2686665 - RNA, 17 nt, Human
cugaaaguuuuguaaaa

SEQ ID NO: 2686666 - RNA, 18 nt, Human
cugaaaguuuuguaaaag

SEQ ID NO: 2686667 - RNA, 20 nt, Human
cugaaaguuuuguaaaagaa

SEQ ID NO: 2686668 - RNA, 22 nt, Human
cugaaaguuuuguaaaagaaau

SEQ ID NO: 2686669 - RNA, 23 nt, Human
cugaaaguuuuguaaaagaaauc

SEQ ID NO: 2686670 - RNA, 16 nt, Human
cugaaaguagggggcu

SEQ ID NO: 2686671 - RNA, 23 nt, Human
cucuuuuccacuccauugucgua

SEQ ID NO: 2686672 - RNA, 12 nt, Human
cugaaagugugu

SEQ ID NO: 2686673 - RNA, 21 nt, Human
cugaaaguguguguaguuuua

SEQ ID NO: 2686674 - RNA, 18 nt, Human
cucuucucauuacuuguu

SEQ ID NO: 2686675 - RNA, 16 nt, Human
cugaccagcugcuccg

SEQ ID NO: 2686676 - RNA, 19 nt, Human
cugaccagcugcuccgagg

SEQ ID NO: 2686677 - RNA, 13 nt, Human
cugaccagcugcu

SEQ ID NO: 2686678 - RNA, 13 nt, Human
cugacguccaccu

SEQ ID NO: 2686679 - RNA, 14 nt, Human
cugagaaaacaagc

SEQ ID NO: 2686680 - RNA, 12 nt, Human
cugagaaaacaa

SEQ ID NO: 2686681 - RNA, 16 nt, Human
cugacuggugcugcag

SEQ ID NO: 2686682 - RNA, 14 nt, Human
cugacuaagaaauu

SEQ ID NO: 2686683 - RNA, 17 nt, Human
cugacugaggcaguuug

SEQ ID NO: 2686684 - RNA, 14 nt, Human
cugacugaggcagu

SEQ ID NO: 2686685 - RNA, 11 nt, Human
cugacugaggc

SEQ ID NO: 2686686 - RNA, 15 nt, Human
cugacucgguuucuc

SEQ ID NO: 2686687 - RNA, 16 nt, Human
cugacucgguuucucc

SEQ ID NO: 2686688 - RNA, 17 nt, Human
cugacucgguuucucca

SEQ ID NO: 2686689 - RNA, 18 nt, Human
cugacucgguuucuccaa

SEQ ID NO: 2686690 - RNA, 21 nt, Human
cugacugaaaguagggggcuu

SEQ ID NO: 2686691 - RNA, 21 nt, Human
cugacugucgggcuuuaaaaa

SEQ ID NO: 2686692 - RNA, 16 nt, Human
cucugggauccugggg

SEQ ID NO: 2686693 - RNA, 16 nt, Human
cucugccgucucugga

SEQ ID NO: 2686694 - RNA, 17 nt, Human
cucugccgucucuggag

SEQ ID NO: 2686695 - RNA, 18 nt, Human
cucugccgucucuggagc

SEQ ID NO: 2686696 - RNA, 13 nt, Human
cucuuccugugau

SEQ ID NO: 2686697 - RNA, 17 nt, Human
cucuuccugugauccac

SEQ ID NO: 2686698 - RNA, 23 nt, Human
cucuuccuugaagaacugcaggc

SEQ ID NO: 2686699 - RNA, 16 nt, Human
cucuuccuuuuaucag

SEQ ID NO: 2686700 - RNA, 22 nt, Human
cucuuaagcuuccgccgucuca

SEQ ID NO: 2686701 - RNA, 14 nt, Human
cucuuccccccaaa

SEQ ID NO: 2686702 - RNA, 13 nt, Human
cucuuccccccaa

SEQ ID NO: 2686703 - RNA, 20 nt, Human
cucugaauuuacuuccuugc

SEQ ID NO: 2686704 - RNA, 21 nt, Human
cucugaauuuacuuccuugca

SEQ ID NO: 2686705 - RNA, 17 nt, Human
cucugaaugccccauaa

SEQ ID NO: 2686706 - RNA, 13 nt, Human
cucugaccacuug

SEQ ID NO: 2686707 - RNA, 20 nt, Human
cucugaccacuugaggccug

SEQ ID NO: 2686708 - RNA, 15 nt, Human
cucugccgucucugg

SEQ ID NO: 2686709 - RNA, 19 nt, Human
cucugccccucccccagcc

SEQ ID NO: 2686710 - RNA, 23 nt, Human
cucugccccucccccagccaugc

SEQ ID NO: 2686711 - RNA, 15 nt, Human
cucugcacaagcugc

SEQ ID NO: 2686712 - RNA, 14 nt, Human
cucugcacaagcug

SEQ ID NO: 2686713 - RNA, 13 nt, Human
cucugcacaagcu

SEQ ID NO: 2686714 - RNA, 10 nt, Human
cucugcacaa

SEQ ID NO: 2686715 - RNA, 17 nt, Human
cucugcauuuaaaaaaa

SEQ ID NO: 2686716 - RNA, 11 nt, Human
gagcugccagu

SEQ ID NO: 2686717 - RNA, 13 nt, Human
gagcugccagugg

SEQ ID NO: 2686718 - RNA, 21 nt, Human
gagcuuaaugcuacaugugag

SEQ ID NO: 2686719 - RNA, 22 nt, Human
gagcuuaaugcuacaugugagu

SEQ ID NO: 2686720 - RNA, 21 nt, Human
gagcuccacucugcuucucug

SEQ ID NO: 2686721 - RNA, 12 nt, Human
gagcuccacucu

SEQ ID NO: 2686722 - RNA, 13 nt, Human
gagcuccacucug

SEQ ID NO: 2686723 - RNA, 16 nt, Human
gagcuccacucugcuu

SEQ ID NO: 2686724 - RNA, 18 nt, Human
gagcuccacucugcuucu

SEQ ID NO: 2686725 - RNA, 14 nt, Human
gagcucucucuaca

SEQ ID NO: 2686726 - RNA, 15 nt, Human
gagcucugaaaucuu

SEQ ID NO: 2686727 - RNA, 16 nt, Human
gagcucugaaaucuuc

SEQ ID NO: 2686728 - RNA, 19 nt, Human
gagcucugaaaucuuccca

SEQ ID NO: 2686729 - RNA, 17 nt, Human
gagccuggugcugcugc

SEQ ID NO: 2686730 - RNA, 16 nt, Human
gagccuggugcugcug

SEQ ID NO: 2686731 - RNA, 21 nt, Human
gagccugggaggucaaggcug

SEQ ID NO: 2686732 - RNA, 13 nt, Human
gagccugggaggu

SEQ ID NO: 2686733 - RNA, 10 nt, Human
gagccuggca

SEQ ID NO: 2686734 - RNA, 15 nt, Human
gagccugcuggcacc

SEQ ID NO: 2686735 - RNA, 15 nt, Human
gagccuggcaagaau

SEQ ID NO: 2686736 - RNA, 10 nt, Human
gagccugcug

SEQ ID NO: 2686737 - RNA, 12 nt, Human
gagccugcuggc

SEQ ID NO: 2686738 - RNA, 11 nt, Human
gagccugcugg

SEQ ID NO: 2686739 - RNA, 13 nt, Human
gagccugcuggca

SEQ ID NO: 2686740 - RNA, 13 nt, Human
gagccugcaggga

SEQ ID NO: 2686741 - RNA, 16 nt, Human
gagccugcagggaagc

SEQ ID NO: 2686742 - RNA, 21 nt, Human
gaaugcugcaggacuugagaa

SEQ ID NO: 2686743 - RNA, 18 nt, Human
gaaugcugggacucagcc

SEQ ID NO: 2686744 - RNA, 19 nt, Human
gaaugcugggacucagccu

SEQ ID NO: 2686745 - RNA, 13 nt, Human
gaaugcugggacu

SEQ ID NO: 2686746 - RNA, 14 nt, Human
gaaugcugggacuc

SEQ ID NO: 2686747 - RNA, 16 nt, Human
gaaugcugggacucag

SEQ ID NO: 2686748 - RNA, 17 nt, Human
gaaugcugggacucagc

SEQ ID NO: 2686749 - RNA, 13 nt, Human
gagaucagccugg

SEQ ID NO: 2686750 - RNA, 16 nt, Human
gagaucagccugggca

SEQ ID NO: 2686751 - RNA, 14 nt, Human
gagaucagccuggg

SEQ ID NO: 2686752 - RNA, 17 nt, Human
gagauccuccugcagac

SEQ ID NO: 2686753 - RNA, 23 nt, Human
gagauccuccugcagaccacgcc

SEQ ID NO: 2686754 - RNA, 13 nt, Human
gagauccuccugc

SEQ ID NO: 2686755 - RNA, 14 nt, Human
gagauccuccugca

SEQ ID NO: 2686756 - RNA, 20 nt, Human
gagaucgcgccacugcacuc

SEQ ID NO: 2686757 - RNA, 17 nt, Human
gagaucgagaccauccu

SEQ ID NO: 2686758 - RNA, 18 nt, Human
gagaucgagaccauccug

SEQ ID NO: 2686759 - RNA, 19 nt, Human
gagaucgagaccauccugg

SEQ ID NO: 2686760 - RNA, 21 nt, Human
gagaucgagaccauccuggcu

SEQ ID NO: 2686761 - RNA, 22 nt, Human
gagaucgagaccauccuggcua

SEQ ID NO: 2686762 - RNA, 21 nt, Human
gagaucgugcuacugcacucc

SEQ ID NO: 2686763 - RNA, 21 nt, Human
gagcaggcacggguggucccc

SEQ ID NO: 2686764 - RNA, 22 nt, Human
gagcaggcacgggugguccccg

SEQ ID NO: 2686765 - RNA, 14 nt, Human
gagcacugggcucc

SEQ ID NO: 2686766 - RNA, 22 nt, Human
gagccauggaccacgcaggaag

SEQ ID NO: 2686767 - RNA, 17 nt, Human
gagccaugcgcccccuc

SEQ ID NO: 2686768 - RNA, 12 nt, Human
gagccaccucac

SEQ ID NO: 2686769 - RNA, 21 nt, Human
gaggcccccagcccagggcuc

SEQ ID NO: 2686770 - RNA, 15 nt, Human
gaggcccccagccca

SEQ ID NO: 2686771 - RNA, 14 nt, Human
gaggcccccagccc

SEQ ID NO: 2686772 - RNA, 16 nt, Human
gaggcccccagcccag

SEQ ID NO: 2686773 - RNA, 17 nt, Human
gaggcccccagcccagg

SEQ ID NO: 2686774 - RNA, 19 nt, Human
gaggcccccagcccagggc

SEQ ID NO: 2686775 - RNA, 20 nt, Human
gaggcccccagcccagggcu

SEQ ID NO: 2686776 - RNA, 14 nt, Human
gaggccgaggccau

SEQ ID NO: 2686777 - RNA, 14 nt, Human
gaggccgaggcggg

SEQ ID NO: 2686778 - RNA, 22 nt, Human
gaggccugaucugcccaucgug

SEQ ID NO: 2686779 - RNA, 16 nt, Human
gaggccugcgacccug

SEQ ID NO: 2686780 - RNA, 19 nt, Human
gaggccugcgacccugggg

SEQ ID NO: 2686781 - RNA, 20 nt, Human
gaggccugcgacccuggggg

SEQ ID NO: 2686782 - RNA, 17 nt, Human
gaggcccuuugcugucc

SEQ ID NO: 2686783 - RNA, 16 nt, Human
gaggcccuuugcuguc

SEQ ID NO: 2686784 - RNA, 21 nt, Human
gaggccugggccgcugccacg

SEQ ID NO: 2686785 - RNA, 22 nt, Human
gaggccugggccgcugccacgu

SEQ ID NO: 2686786 - RNA, 14 nt, Human
gaggccugggccgc

SEQ ID NO: 2686787 - RNA, 16 nt, Human
gaggccugggccgcug

SEQ ID NO: 2686788 - RNA, 20 nt, Human
gaggccugggccgcugccac

SEQ ID NO: 2686789 - RNA, 20 nt, Human
gaggcggagcuugcagugag

SEQ ID NO: 2686790 - RNA, 15 nt, Human
gaggcuucuccgcca

SEQ ID NO: 2686791 - RNA, 18 nt, Human
gaggcuucuccgccagcc

SEQ ID NO: 2686792 - RNA, 13 nt, Human
gaggcuuccugcg

SEQ ID NO: 2686793 - RNA, 15 nt, Human
gaggcuuccugcguc

SEQ ID NO: 2686794 - RNA, 21 nt, Human
gaggcuuccugcguccuccuc

SEQ ID NO: 2686795 - RNA, 15 nt, Human
gagggacggccaaga

SEQ ID NO: 2686796 - RNA, 20 nt, Human
gagggacggccaagaaugua

SEQ ID NO: 2686797 - RNA, 22 nt, Human
gagggacgucagacuuggcuca

SEQ ID NO: 2686798 - RNA, 11 nt, Human
gagggaggccc

SEQ ID NO: 2686799 - RNA, 12 nt, Human
gagggaggcccc

SEQ ID NO: 2686800 - RNA, 16 nt, Human
gagggaggccccaggg

SEQ ID NO: 2686801 - RNA, 17 nt, Human
gagggaggccccagggg

SEQ ID NO: 2686802 - RNA, 16 nt, Human
gagggagaacaagacc

SEQ ID NO: 2686803 - RNA, 19 nt, Human
gagggaaggguuucucuau

SEQ ID NO: 2686804 - RNA, 20 nt, Human
gagggaaggguuucucuauu

SEQ ID NO: 2686805 - RNA, 23 nt, Human
gaggcuucuccgccagccuccuc

SEQ ID NO: 2686806 - RNA, 19 nt, Human
gaggcuucuccgccagccu

SEQ ID NO: 2686807 - RNA, 20 nt, Human
gaggcuucuccgccagccuc

SEQ ID NO: 2686808 - RNA, 21 nt, Human
gaggcuucuccgccagccucc

SEQ ID NO: 2686809 - RNA, 22 nt, Human
gaggcuucuccgccagccuccu

SEQ ID NO: 2686810 - RNA, 19 nt, Human
gaggcuuguuuaccuuucu

SEQ ID NO: 2686811 - RNA, 23 nt, Human
gaggcuuguuuaccuuucucucu

SEQ ID NO: 2686812 - RNA, 17 nt, Human
gagggcagacuggggca

SEQ ID NO: 2686813 - RNA, 18 nt, Human
gagggcagacuggggcau

SEQ ID NO: 2686814 - RNA, 21 nt, Human
gagggcagacuggggcauccu

SEQ ID NO: 2686815 - RNA, 23 nt, Human
gagggcagacuggggcauccugu

SEQ ID NO: 2686816 - RNA, 15 nt, Human
gaggaaugaaaaaag

SEQ ID NO: 2686817 - RNA, 20 nt, Human
gaggaauccuggcagcccag

SEQ ID NO: 2686818 - RNA, 15 nt, Human
gaggaauccuggcag

SEQ ID NO: 2686819 - RNA, 16 nt, Human
gaggaauccuggcagc

SEQ ID NO: 2686820 - RNA, 17 nt, Human
gaggaauccuggcagcc

SEQ ID NO: 2686821 - RNA, 19 nt, Human
gaggaauccuggcagccca

SEQ ID NO: 2686822 - RNA, 21 nt, Human
gaggaaggcaagagggggugg

SEQ ID NO: 2686823 - RNA, 13 nt, Human
gaggaaggcaaga

SEQ ID NO: 2686824 - RNA, 13 nt, Human
gaggagccuuuuu

SEQ ID NO: 2686825 - RNA, 11 nt, Human
gaggagccuuu

SEQ ID NO: 2686826 - RNA, 16 nt, Human
gaggaggaaggcaaga

SEQ ID NO: 2686827 - RNA, 13 nt, Human
gaggaggaaggca

SEQ ID NO: 2686828 - RNA, 11 nt, Human
gaggaggggag

SEQ ID NO: 2686829 - RNA, 12 nt, Human
gaggaggggagg

SEQ ID NO: 2686830 - RNA, 13 nt, Human
gaggaggggaggg

SEQ ID NO: 2686831 - RNA, 11 nt, Human
gaggagggaga

SEQ ID NO: 2686832 - RNA, 17 nt, Human
gaggagggagagggagg

SEQ ID NO: 2686833 - RNA, 15 nt, Human
gaggacagcuugagc

SEQ ID NO: 2686834 - RNA, 18 nt, Human
gaggacagcuugagccgg

SEQ ID NO: 2686835 - RNA, 13 nt, Human
gaggcaccaggaa

SEQ ID NO: 2686836 - RNA, 17 nt, Human
gaggcaccaggaagccg

SEQ ID NO: 2686837 - RNA, 21 nt, Human
gaggcagcgugaaagcagaug

SEQ ID NO: 2686838 - RNA, 23 nt, Human
gaggcagcgugaaagcagaugag

SEQ ID NO: 2686839 - RNA, 16 nt, Human
gaggcaggcauggccc

SEQ ID NO: 2686840 - RNA, 18 nt, Human
gaggcaggcauggcccug

SEQ ID NO: 2686841 - RNA, 19 nt, Human
gaggcaggcauggcccugg

SEQ ID NO: 2686842 - RNA, 20 nt, Human
gaggcaggcauggcccuggg

SEQ ID NO: 2686843 - RNA, 12 nt, Human
gaggaggguggg

SEQ ID NO: 2686844 - RNA, 15 nt, Human
gaggaggguggggga

SEQ ID NO: 2686845 - RNA, 17 nt, Human
gaggagggugggggagg

SEQ ID NO: 2686846 - RNA, 16 nt, Human
gaggauugcuugagcu

SEQ ID NO: 2686847 - RNA, 14 nt, Human
gaggauuaguuuag

SEQ ID NO: 2686848 - RNA, 22 nt, Human
gaggaugguagaaguuuggcug

SEQ ID NO: 2686849 - RNA, 14 nt, Human
gaugaaaacauagc

SEQ ID NO: 2686850 - RNA, 12 nt, Human
gaucuuucagaa

SEQ ID NO: 2686851 - RNA, 15 nt, Human
gaucuuucagaaaua

SEQ ID NO: 2686852 - RNA, 16 nt, Human
gaucuuucagaaauau

SEQ ID NO: 2686853 - RNA, 18 nt, Human
gaucuuucagaaauauaa

SEQ ID NO: 2686854 - RNA, 16 nt, Human
gaucgagaccauccug

SEQ ID NO: 2686855 - RNA, 17 nt, Human
gaucgagaccauccugg

SEQ ID NO: 2686856 - RNA, 18 nt, Human
gaucgagaccauccuggc

SEQ ID NO: 2686857 - RNA, 19 nt, Human
gaucgagaccauccuggcu

SEQ ID NO: 2686858 - RNA, 21 nt, Human
gauccuuagagguccucugga

SEQ ID NO: 2686859 - RNA, 22 nt, Human
gauccuuagagguccucuggag

SEQ ID NO: 2686860 - RNA, 23 nt, Human
gaugggaaugaggugggaggugg

SEQ ID NO: 2686861 - RNA, 14 nt, Human
gaugcaugucuuuu

SEQ ID NO: 2686862 - RNA, 16 nt, Human
gaugcaugucuuuuaa

SEQ ID NO: 2686863 - RNA, 17 nt, Human
gaugcaugucuuuuaaa

SEQ ID NO: 2686864 - RNA, 22 nt, Human
gaugcaugucuuuuaaaaugca

SEQ ID NO: 2686865 - RNA, 21 nt, Human
gaugacguacaaguaguucug

SEQ ID NO: 2686866 - RNA, 15 nt, Human
gaugacuguguugua

SEQ ID NO: 2686867 - RNA, 21 nt, Human
gauuaaccacuucagcugacu

SEQ ID NO: 2686868 - RNA, 19 nt, Human
gauuaaccacuucagcuga

SEQ ID NO: 2686869 - RNA, 18 nt, Human
gauuaaccacuucagcug

SEQ ID NO: 2686870 - RNA, 20 nt, Human
gauuaaauacauauggaugu

SEQ ID NO: 2686871 - RNA, 17 nt, Human
gauuauuuuuuuuuucu

SEQ ID NO: 2686872 - RNA, 18 nt, Human
gauguguggacuguggca

SEQ ID NO: 2686873 - RNA, 20 nt, Human
gaugguguagcccucccacu

SEQ ID NO: 2686874 - RNA, 15 nt, Human
gauuggaccaggcca

SEQ ID NO: 2686875 - RNA, 18 nt, Human
gauugcuugagcucagga

SEQ ID NO: 2686876 - RNA, 23 nt, Human
gauugacuaacucaaauacacau

SEQ ID NO: 2686877 - RNA, 14 nt, Human
gauuggaccaggcc

SEQ ID NO: 2686878 - RNA, 18 nt, Human
gauugaaaauguccagga

SEQ ID NO: 2686879 - RNA, 19 nt, Human
gauugaaaauguccaggaa

SEQ ID NO: 2686880 - RNA, 20 nt, Human
gauugaaaauguccaggaaa

SEQ ID NO: 2686881 - RNA, 13 nt, Human
gauucccuuguua

SEQ ID NO: 2686882 - RNA, 23 nt, Human
gauucuaccacacagcagcaguu

SEQ ID NO: 2686883 - RNA, 13 nt, Human
gauucuaaauaca

SEQ ID NO: 2686884 - RNA, 14 nt, Human
gauucuaaauacau

SEQ ID NO: 2686885 - RNA, 17 nt, Human
gauuccucucuaagugg

SEQ ID NO: 2686886 - RNA, 19 nt, Human
gauucccuuguuauucaac

SEQ ID NO: 2686887 - RNA, 16 nt, Human
gauucccuuguuauuc

SEQ ID NO: 2686888 - RNA, 18 nt, Human
gagugugagccaccuaag

SEQ ID NO: 2686889 - RNA, 23 nt, Human
gagugugagccaccuaagaucuc

SEQ ID NO: 2686890 - RNA, 17 nt, Human
gagugugccugaagucc

SEQ ID NO: 2686891 - RNA, 19 nt, Human
gaguuccaguuccucuuug

SEQ ID NO: 2686892 - RNA, 22 nt, Human
gaguucccuugaaacuuuggga

SEQ ID NO: 2686893 - RNA, 23 nt, Human
gaguggcaggggacaggagucca

SEQ ID NO: 2686894 - RNA, 17 nt, Human
gagucuggcccuagacu

SEQ ID NO: 2686895 - RNA, 19 nt, Human
gagucugaggccguugcug

SEQ ID NO: 2686896 - RNA, 12 nt, Human
gagucugaggcc

SEQ ID NO: 2686897 - RNA, 20 nt, Human
gagucugagggcuuguaguu

SEQ ID NO: 2686898 - RNA, 23 nt, Human
gagucugaggccguugcugacuu

SEQ ID NO: 2686899 - RNA, 12 nt, Human
gagugggaagcc

SEQ ID NO: 2686900 - RNA, 13 nt, Human
gagugggaagccc

SEQ ID NO: 2686901 - RNA, 11 nt, Human
gagugggaagc

SEQ ID NO: 2686902 - RNA, 23 nt, Human
gagugggggaucacagccucuga

SEQ ID NO: 2686903 - RNA, 16 nt, Human
gaguuuucauuaaauc

SEQ ID NO: 2686904 - RNA, 16 nt, Human
gaguuuugucauucag

SEQ ID NO: 2686905 - RNA, 15 nt, Human
gauaauguauuuuaa

SEQ ID NO: 2686906 - RNA, 21 nt, Human
gauagacgaguugauuuccuc

SEQ ID NO: 2686907 - RNA, 15 nt, Human
gauagcauuguaagc

SEQ ID NO: 2686908 - RNA, 18 nt, Human
gauauacacggaugacuu

SEQ ID NO: 2686909 - RNA, 10 nt, Human
gaguaaagcu

SEQ ID NO: 2686910 - RNA, 19 nt, Human
gagguuuuaaaaaaauccc

SEQ ID NO: 2686911 - RNA, 16 nt, Human
gagguuuuauuucauu

SEQ ID NO: 2686912 - RNA, 21 nt, Human
gagguuuuauuucauuuuuca

SEQ ID NO: 2686913 - RNA, 17 nt, Human
gaguaaagcuccuaucu

SEQ ID NO: 2686914 - RNA, 14 nt, Human
gagguccucuggag

SEQ ID NO: 2686915 - RNA, 16 nt, Human
gagguccucuggagcc

SEQ ID NO: 2686916 - RNA, 13 nt, Human
gaggggguggagg

SEQ ID NO: 2686917 - RNA, 14 nt, Human
gaggggguggaggg

SEQ ID NO: 2686918 - RNA, 20 nt, Human
gagguccucuggagcccuaa

SEQ ID NO: 2686919 - RNA, 17 nt, Human
gaggugggccagucugu

SEQ ID NO: 2686920 - RNA, 21 nt, Human
gagggggcuugaagccaaaga

SEQ ID NO: 2686921 - RNA, 18 nt, Human
gagucguggggugugcug

SEQ ID NO: 2686922 - RNA, 19 nt, Human
gagucguggggugugcugg

SEQ ID NO: 2686923 - RNA, 20 nt, Human
gagucguggggugugcuggg

SEQ ID NO: 2686924 - RNA, 17 nt, Human
gagucguggggugugcu

SEQ ID NO: 2686925 - RNA, 14 nt, Human
gagucaaggccugc

SEQ ID NO: 2686926 - RNA, 15 nt, Human
gagucaaggccugcu

SEQ ID NO: 2686927 - RNA, 21 nt, Human
gaguauuguuuaaaauguaau

SEQ ID NO: 2686928 - RNA, 12 nt, Human
gcccagagacuu

SEQ ID NO: 2686929 - RNA, 16 nt, Human
gcccagcccuccccau

SEQ ID NO: 2686930 - RNA, 12 nt, Human
gcccagcccucc

SEQ ID NO: 2686931 - RNA, 13 nt, Human
gccaugcugaggc

SEQ ID NO: 2686932 - RNA, 14 nt, Human
gccaugcugaggcc

SEQ ID NO: 2686933 - RNA, 17 nt, Human
gccaugcugaggccugg

SEQ ID NO: 2686934 - RNA, 18 nt, Human
gccaugcugaggccuggg

SEQ ID NO: 2686935 - RNA, 19 nt, Human
gccaugcugaggccugggc

SEQ ID NO: 2686936 - RNA, 20 nt, Human
gccaugcugaggccugggcc

SEQ ID NO: 2686937 - RNA, 21 nt, Human
gccaugcugaggccugggccg

SEQ ID NO: 2686938 - RNA, 22 nt, Human
gccauuuuaaggaaaacuaccu

SEQ ID NO: 2686939 - RNA, 14 nt, Human
gccaucuaaaguaa

SEQ ID NO: 2686940 - RNA, 15 nt, Human
gccaucuagccagcc

SEQ ID NO: 2686941 - RNA, 16 nt, Human
gccaucuagccagccc

SEQ ID NO: 2686942 - RNA, 23 nt, Human
gccaucuagccagccccucuucc

SEQ ID NO: 2686943 - RNA, 18 nt, Human
gccaugccagcuuaucuc

SEQ ID NO: 2686944 - RNA, 13 nt, Human
gccaugccagcuu

SEQ ID NO: 2686945 - RNA, 19 nt, Human
gccaugccagcuuaucuca

SEQ ID NO: 2686946 - RNA, 13 nt, Human
gccaugccagcug

SEQ ID NO: 2686947 - RNA, 14 nt, Human
gccaugccagcugg

SEQ ID NO: 2686948 - RNA, 15 nt, Human
gccaugccagcuggc

SEQ ID NO: 2686949 - RNA, 16 nt, Human
gccaugccagcuggcc

SEQ ID NO: 2686950 - RNA, 14 nt, Human
gccaguauuuuuua

SEQ ID NO: 2686951 - RNA, 23 nt, Human
gccagguucuccguuagcuccug

SEQ ID NO: 2686952 - RNA, 14 nt, Human
gccaggcugccugg

SEQ ID NO: 2686953 - RNA, 18 nt, Human
gccaggcugccuggccuu

SEQ ID NO: 2686954 - RNA, 14 nt, Human
gccagauuugucuu

SEQ ID NO: 2686955 - RNA, 15 nt, Human
gccagauuugucuuu

SEQ ID NO: 2686956 - RNA, 16 nt, Human
gccagauuugucuuuu

SEQ ID NO: 2686957 - RNA, 20 nt, Human
gccagauuugucuuuuuguu

SEQ ID NO: 2686958 - RNA, 17 nt, Human
gccagaggaauccuggc

SEQ ID NO: 2686959 - RNA, 18 nt, Human
gccagaggaauccuggca

SEQ ID NO: 2686960 - RNA, 19 nt, Human
gccagaggaauccuggcag

SEQ ID NO: 2686961 - RNA, 20 nt, Human
gccagaggaauccuggcagc

SEQ ID NO: 2686962 - RNA, 21 nt, Human
gccagaggaauccuggcagcc

SEQ ID NO: 2686963 - RNA, 22 nt, Human
gccagaggaauccuggcagccc

SEQ ID NO: 2686964 - RNA, 23 nt, Human
gccagaggaauccuggcagccca

SEQ ID NO: 2686965 - RNA, 24 nt, Human
gccagaggaauccuggcagcccag

SEQ ID NO: 2686966 - RNA, 15 nt, Human
gccacaguagaacug

SEQ ID NO: 2686967 - RNA, 15 nt, Human
gccacaucaaaccuu

SEQ ID NO: 2686968 - RNA, 16 nt, Human
gccacaucaaaccuuu

SEQ ID NO: 2686969 - RNA, 22 nt, Human
gccaccgcgggugugggaaagc

SEQ ID NO: 2686970 - RNA, 17 nt, Human
gccacacucuccaucac

SEQ ID NO: 2686971 - RNA, 18 nt, Human
gccacacucuccaucacc

SEQ ID NO: 2686972 - RNA, 12 nt, Human
gccacaggaccc

SEQ ID NO: 2686973 - RNA, 11 nt, Human
gccacaggacc

SEQ ID NO: 2686974 - RNA, 15 nt, Human
gccacagcgccagcc

SEQ ID NO: 2686975 - RNA, 16 nt, Human
gccacagcgccagccu

SEQ ID NO: 2686976 - RNA, 18 nt, Human
gccacagcgccagccuca

SEQ ID NO: 2686977 - RNA, 16 nt, Human
gccaaugucuccuccc

SEQ ID NO: 2686978 - RNA, 13 nt, Human
gccaaguggggug

SEQ ID NO: 2686979 - RNA, 18 nt, Human
gccaaguggggugcuggg

SEQ ID NO: 2686980 - RNA, 23 nt, Human
gccaaguggggugcugggaggag

SEQ ID NO: 2686981 - RNA, 19 nt, Human
gccaaguggggugcuggga

SEQ ID NO: 2686982 - RNA, 20 nt, Human
gccaaguggggugcugggag

SEQ ID NO: 2686983 - RNA, 18 nt, Human
gcauuugucaaugacagu

SEQ ID NO: 2686984 - RNA, 13 nt, Human
gcauuugucaaug

SEQ ID NO: 2686985 - RNA, 21 nt, Human
gccaaggcugggggaagaagc

SEQ ID NO: 2686986 - RNA, 12 nt, Human
gccaagggaaag

SEQ ID NO: 2686987 - RNA, 18 nt, Human
gccaagggaaaggggugc

SEQ ID NO: 2686988 - RNA, 16 nt, Human
gccaaguaagaaagug

SEQ ID NO: 2686989 - RNA, 20 nt, Human
gccaagguuuuauaaggcug

SEQ ID NO: 2686990 - RNA, 21 nt, Human
gccaagggccgacuaagagaa

SEQ ID NO: 2686991 - RNA, 23 nt, Human
gccaaggugggaggauugcuuga

SEQ ID NO: 2686992 - RNA, 15 nt, Human
gccaaggugggagga

SEQ ID NO: 2686993 - RNA, 14 nt, Human
gccaaggugggagg

SEQ ID NO: 2686994 - RNA, 20 nt, Human
gccaagggcccaaagaaaga

SEQ ID NO: 2686995 - RNA, 18 nt, Human
gccaagggaaccuguguc

SEQ ID NO: 2686996 - RNA, 19 nt, Human
gccaagggaaccugugucc

SEQ ID NO: 2686997 - RNA, 22 nt, Human
gccaagggaaaggggugcuuuu

SEQ ID NO: 2686998 - RNA, 20 nt, Human
gcagcucagaaccacagcaa

SEQ ID NO: 2686999 - RNA, 20 nt, Human
gcagccucuccccaggucca

SEQ ID NO: 2687000 - RNA, 12 nt, Human
gcagccucuccc

SEQ ID NO: 2687001 - RNA, 16 nt, Human
gcagccucuccccagg

SEQ ID NO: 2687002 - RNA, 20 nt, Human
gcagccucucagugcccucc

SEQ ID NO: 2687003 - RNA, 22 nt, Human
gcagccucucagugcccuccag

SEQ ID NO: 2687004 - RNA, 15 nt, Human
gcagcagcaggugau

SEQ ID NO: 2687005 - RNA, 19 nt, Human
gcagcagggagggcuucug

SEQ ID NO: 2687006 - RNA, 18 nt, Human
gcagcagggagggcuucu

SEQ ID NO: 2687007 - RNA, 20 nt, Human
gcagccgccccaucugcccc

SEQ ID NO: 2687008 - RNA, 19 nt, Human
gcagcccuggcagggggca

SEQ ID NO: 2687009 - RNA, 14 nt, Human
gcagagguacccug

SEQ ID NO: 2687010 - RNA, 15 nt, Human
gcagagguacccugg

SEQ ID NO: 2687011 - RNA, 16 nt, Human
gcagagguacccuggg

SEQ ID NO: 2687012 - RNA, 17 nt, Human
gcagagguacccugggu

SEQ ID NO: 2687013 - RNA, 18 nt, Human
gcagagguacccugggug

SEQ ID NO: 2687014 - RNA, 19 nt, Human
gcagagguacccugggugu

SEQ ID NO: 2687015 - RNA, 18 nt, Human
gcagauguuagauauuuu

SEQ ID NO: 2687016 - RNA, 20 nt, Human
gcagauguuagauauuuuuc

SEQ ID NO: 2687017 - RNA, 20 nt, Human
gcagacuggggcauccugug

SEQ ID NO: 2687018 - RNA, 22 nt, Human
gcacuucgggaggucgaggcag

SEQ ID NO: 2687019 - RNA, 13 nt, Human
gcacuuaaagaag

SEQ ID NO: 2687020 - RNA, 14 nt, Human
gcacagcuugaccu

SEQ ID NO: 2687021 - RNA, 22 nt, Human
gcacagcuugaccugaggcugu

SEQ ID NO: 2687022 - RNA, 18 nt, Human
gcacagcuugaccugagg

SEQ ID NO: 2687023 - RNA, 19 nt, Human
gcacagcuugaccugaggc

SEQ ID NO: 2687024 - RNA, 20 nt, Human
gcacagcuugaccugaggcu

SEQ ID NO: 2687025 - RNA, 21 nt, Human
gcacagcuugaccugaggcug

SEQ ID NO: 2687026 - RNA, 13 nt, Human
gcaccaccaagcc

SEQ ID NO: 2687027 - RNA, 14 nt, Human
gcaccaccaagcca

SEQ ID NO: 2687028 - RNA, 13 nt, Human
gcaccagcagccu

SEQ ID NO: 2687029 - RNA, 14 nt, Human
gcaccagcagccug

SEQ ID NO: 2687030 - RNA, 18 nt, Human
gcacugggcucccgggcc

SEQ ID NO: 2687031 - RNA, 14 nt, Human
gcacugggcucccg

SEQ ID NO: 2687032 - RNA, 16 nt, Human
gcacuggcgaggagag

SEQ ID NO: 2687033 - RNA, 15 nt, Human
gcacuggcgaggaga

SEQ ID NO: 2687034 - RNA, 14 nt, Human
gcacuguugagaag

SEQ ID NO: 2687035 - RNA, 18 nt, Human
gcacuguugagaaggaga

SEQ ID NO: 2687036 - RNA, 23 nt, Human
gcacgcggauuaauuugcaucug

SEQ ID NO: 2687037 - RNA, 19 nt, Human
gcacccucaggcagguggg

SEQ ID NO: 2687038 - RNA, 16 nt, Human
gcacccucaggcaggu

SEQ ID NO: 2687039 - RNA, 12 nt, Human
gcaccccuucuc

SEQ ID NO: 2687040 - RNA, 13 nt, Human
gcaccccuucucu

SEQ ID NO: 2687041 - RNA, 17 nt, Human
gcaccccuucucuccuc

SEQ ID NO: 2687042 - RNA, 18 nt, Human
gcaccccuucucuccucc

SEQ ID NO: 2687043 - RNA, 19 nt, Human
gcaccccuucucuccuccc

SEQ ID NO: 2687044 - RNA, 20 nt, Human
gcaccccuucucuccucccc

SEQ ID NO: 2687045 - RNA, 21 nt, Human
gcaccccuucucuccucccca

SEQ ID NO: 2687046 - RNA, 22 nt, Human
gcaccccuucucuccuccccaa

SEQ ID NO: 2687047 - RNA, 17 nt, Human
gcacuaaaucagagaca

SEQ ID NO: 2687048 - RNA, 17 nt, Human
gcacuacaccuugccuu

SEQ ID NO: 2687049 - RNA, 19 nt, Human
gcauacuuaccuagugaaa

SEQ ID NO: 2687050 - RNA, 21 nt, Human
gcauacuuaccuagugaaacu

SEQ ID NO: 2687051 - RNA, 12 nt, Human
gcaucaggguua

SEQ ID NO: 2687052 - RNA, 14 nt, Human
gcaucuaucucauc

SEQ ID NO: 2687053 - RNA, 15 nt, Human
gcaucuaucugugcu

SEQ ID NO: 2687054 - RNA, 16 nt, Human
gcaucuaucugugcua

SEQ ID NO: 2687055 - RNA, 13 nt, Human
gcaucaugcaugu

SEQ ID NO: 2687056 - RNA, 21 nt, Human
gcaucucacagcuaugcaaaa

SEQ ID NO: 2687057 - RNA, 10 nt, Human
gcauugagua

SEQ ID NO: 2687058 - RNA, 15 nt, Human
gcauugaguauuguu

SEQ ID NO: 2687059 - RNA, 17 nt, Human
gcauugaguauuguuua

SEQ ID NO: 2687060 - RNA, 15 nt, Human
gcaugcccucucagg

SEQ ID NO: 2687061 - RNA, 13 nt, Human
gcauguuauguuu

SEQ ID NO: 2687062 - RNA, 14 nt, Human
gcauguuauguuua

SEQ ID NO: 2687063 - RNA, 16 nt, Human
gcauguuauguuuaau

SEQ ID NO: 2687064 - RNA, 18 nt, Human
gcauguuauguuuaauaa

SEQ ID NO: 2687065 - RNA, 19 nt, Human
gcauguuauguuuaauaag

SEQ ID NO: 2687066 - RNA, 20 nt, Human
gcauguucacccuuauaguc

SEQ ID NO: 2687067 - RNA, 21 nt, Human
gcauguucacccuuauagucu

SEQ ID NO: 2687068 - RNA, 15 nt, Human
gcaugaccagaugcg

SEQ ID NO: 2687069 - RNA, 16 nt, Human
gcaugcccucucaggc

SEQ ID NO: 2687070 - RNA, 12 nt, Human
gcaggcccuggc

SEQ ID NO: 2687071 - RNA, 14 nt, Human
gcaggcccuggccu

SEQ ID NO: 2687072 - RNA, 15 nt, Human
gcaggcccuggccuc

SEQ ID NO: 2687073 - RNA, 16 nt, Human
gcaggcccuggccucc

SEQ ID NO: 2687074 - RNA, 17 nt, Human
gcaggcauagaggcuuc

SEQ ID NO: 2687075 - RNA, 13 nt, Human
gcaggcauggccc

SEQ ID NO: 2687076 - RNA, 15 nt, Human
gcaggcauggcccug

SEQ ID NO: 2687077 - RNA, 16 nt, Human
gcaggcauggcccugg

SEQ ID NO: 2687078 - RNA, 19 nt, Human
gcaggcauggcccugggcg

SEQ ID NO: 2687079 - RNA, 22 nt, Human
gcaggacuuccccggagggcug

SEQ ID NO: 2687080 - RNA, 15 nt, Human
gcaggccuauuucau

SEQ ID NO: 2687081 - RNA, 19 nt, Human
gcaggguccuagaaauucc

SEQ ID NO: 2687082 - RNA, 15 nt, Human
gcuuccaaauauugu

SEQ ID NO: 2687083 - RNA, 22 nt, Human
gcuucucagauuucugaggaaa

SEQ ID NO: 2687084 - RNA, 21 nt, Human
gcuucucagauuucugaggaa

SEQ ID NO: 2687085 - RNA, 17 nt, Human
gcuucucacugccaugc

SEQ ID NO: 2687086 - RNA, 22 nt, Human
gcuucucacugccaugccagcu

SEQ ID NO: 2687087 - RNA, 13 nt, Human
gcuucugccugca

SEQ ID NO: 2687088 - RNA, 23 nt, Human
gcuucugcuuuucugcccuggcu

SEQ ID NO: 2687089 - RNA, 16 nt, Human
gcuucugcuuuucugc

SEQ ID NO: 2687090 - RNA, 19 nt, Human
gcuucugcuuuucugcccu

SEQ ID NO: 2687091 - RNA, 20 nt, Human
gcuucugcuuuucugcccug

SEQ ID NO: 2687092 - RNA, 21 nt, Human
gcuucugcuuuucugcccugg

SEQ ID NO: 2687093 - RNA, 13 nt, Human
gcuucugcuuuuc

SEQ ID NO: 2687094 - RNA, 14 nt, Human
gcuucugcuuuucu

SEQ ID NO: 2687095 - RNA, 15 nt, Human
gcuucugcuuuucug

SEQ ID NO: 2687096 - RNA, 22 nt, Human
gcuuacguaguucuaccggcuu

SEQ ID NO: 2687097 - RNA, 15 nt, Human
gcuuacguaguucua

SEQ ID NO: 2687098 - RNA, 14 nt, Human
gcuuacguaguucu

SEQ ID NO: 2687099 - RNA, 11 nt, Human
gcuuauaucug

SEQ ID NO: 2687100 - RNA, 15 nt, Human
gcuuauaucuggccu

SEQ ID NO: 2687101 - RNA, 17 nt, Human
gcuuauaucuggccucu

SEQ ID NO: 2687102 - RNA, 20 nt, Human
gcuuauaucuggccucugcu

SEQ ID NO: 2687103 - RNA, 19 nt, Human
gcuucaugcacuuaaagaa

SEQ ID NO: 2687104 - RNA, 20 nt, Human
gcuucaugcacuuaaagaag

SEQ ID NO: 2687105 - RNA, 15 nt, Human
gcuucaguugcuugu

SEQ ID NO: 2687106 - RNA, 15 nt, Human
gcuuucccacuuccc

SEQ ID NO: 2687107 - RNA, 16 nt, Human
gcuuuuauagaggcua

SEQ ID NO: 2687108 - RNA, 12 nt, Human
gcuuucaugauu

SEQ ID NO: 2687109 - RNA, 18 nt, Human
gcuuucaugauuagcaag

SEQ ID NO: 2687110 - RNA, 22 nt, Human
gcuuuccaaaccuuaucuccac

SEQ ID NO: 2687111 - RNA, 19 nt, Human
gcuuuccaaaccuuaucuc

SEQ ID NO: 2687112 - RNA, 16 nt, Human
gcuuguuuaccuuucu

SEQ ID NO: 2687113 - RNA, 18 nt, Human
gcuuguuuaccuuucucu

SEQ ID NO: 2687114 - RNA, 20 nt, Human
gcuuuaaaaagggaagaaac

SEQ ID NO: 2687115 - RNA, 21 nt, Human
gcuuuaaaaagggaagaaacu

SEQ ID NO: 2687116 - RNA, 22 nt, Human
gcuuuaaaaagggaagaaacug

SEQ ID NO: 2687117 - RNA, 12 nt, Human
gcuugcuuuucu

SEQ ID NO: 2687118 - RNA, 11 nt, Human
gcuugcuggcc

SEQ ID NO: 2687119 - RNA, 14 nt, Human
gcuugccugcaggg

SEQ ID NO: 2687120 - RNA, 15 nt, Human
gcuugccugcagggc

SEQ ID NO: 2687121 - RNA, 16 nt, Human
gcuugccugcagggcc

SEQ ID NO: 2687122 - RNA, 17 nt, Human
gcuugccugcagggcca

SEQ ID NO: 2687123 - RNA, 22 nt, Human
gcuugccugcagggccauggcu

SEQ ID NO: 2687124 - RNA, 18 nt, Human
gcuuguucaucauccaga

SEQ ID NO: 2687125 - RNA, 21 nt, Human
gcuuguucaucauccagaugu

SEQ ID NO: 2687126 - RNA, 19 nt, Human
gcuguguugguguggccca

SEQ ID NO: 2687127 - RNA, 14 nt, Human
gcugugugucccag

SEQ ID NO: 2687128 - RNA, 15 nt, Human
gcugugugucccagg

SEQ ID NO: 2687129 - RNA, 16 nt, Human
gcugugugucccaggc

SEQ ID NO: 2687130 - RNA, 18 nt, Human
gcugugugucccaggcag

SEQ ID NO: 2687131 - RNA, 20 nt, Human
gcugugugucccaggcaggg

SEQ ID NO: 2687132 - RNA, 23 nt, Human
gcugugugucccaggcagggaga

SEQ ID NO: 2687133 - RNA, 13 nt, Human
gcuuaccuccuca

SEQ ID NO: 2687134 - RNA, 22 nt, Human
gcugucccuugcuugccugcag

SEQ ID NO: 2687135 - RNA, 21 nt, Human
gcugucauugcacauaagcuu

SEQ ID NO: 2687136 - RNA, 20 nt, Human
gcugucccauagucccugcc

SEQ ID NO: 2687137 - RNA, 18 nt, Human
gcugucccauagucccug

SEQ ID NO: 2687138 - RNA, 23 nt, Human
gcugucccauagucccugccacg

SEQ ID NO: 2687139 - RNA, 21 nt, Human
gcugucccauagucccugcca

SEQ ID NO: 2687140 - RNA, 15 nt, Human
gcugguccgugggac

SEQ ID NO: 2687141 - RNA, 16 nt, Human
gcugguccgugggacg

SEQ ID NO: 2687142 - RNA, 12 nt, Human
gcuggugcacag

SEQ ID NO: 2687143 - RNA, 20 nt, Human
gcuggugcacagccacuccc

SEQ ID NO: 2687144 - RNA, 21 nt, Human
gcuggggauccccgccuggcc

SEQ ID NO: 2687145 - RNA, 22 nt, Human
gcuggggauccccgccuggcca

SEQ ID NO: 2687146 - RNA, 23 nt, Human
gcuggggauccccgccuggccag

SEQ ID NO: 2687147 - RNA, 12 nt, Human
gcuggggaagga

SEQ ID NO: 2687148 - RNA, 13 nt, Human
gcuggggaaggaa

SEQ ID NO: 2687149 - RNA, 15 nt, Human
gcuggggaaggaagc

SEQ ID NO: 2687150 - RNA, 21 nt, Human
gcugcaguucuacucaggcug

SEQ ID NO: 2687151 - RNA, 22 nt, Human
gcugcaguucuacucaggcugg

SEQ ID NO: 2687152 - RNA, 22 nt, Human
gcugaucugcggaucucagcuu

SEQ ID NO: 2687153 - RNA, 17 nt, Human
gcugauuuggugaccaa

SEQ ID NO: 2687154 - RNA, 15 nt, Human
gcugagacugugcug

SEQ ID NO: 2687155 - RNA, 12 nt, Human
gcucuucuuaaa

SEQ ID NO: 2687156 - RNA, 22 nt, Human
gcugacuguuuucucuugagag

SEQ ID NO: 2687157 - RNA, 13 nt, Human
gcugacuuagaau

SEQ ID NO: 2687158 - RNA, 16 nt, Human
gcugacaucuugaauc

SEQ ID NO: 2687159 - RNA, 22 nt, Human
gcugacaucuugaauccuucca

SEQ ID NO: 2687160 - RNA, 23 nt, Human
gcugacaucuugaauccuuccau

SEQ ID NO: 2687161 - RNA, 14 nt, Human
gcugcccugaagaa

SEQ ID NO: 2687162 - RNA, 17 nt, Human
gcugcgcuugcuuuucu

SEQ ID NO: 2687163 - RNA, 16 nt, Human
gcugcgcuugcuuuuc

SEQ ID NO: 2687164 - RNA, 16 nt, Human
gcugccuucccuagcu

SEQ ID NO: 2687165 - RNA, 12 nt, Human
gcugccuucccu

SEQ ID NO: 2687166 - RNA, 13 nt, Human
gcugccuucccua

SEQ ID NO: 2687167 - RNA, 15 nt, Human
gcugccuucccuagc

SEQ ID NO: 2687168 - RNA, 18 nt, Human
gcugcggcguacaggcug

SEQ ID NO: 2687169 - RNA, 17 nt, Human
gcugcggcguacaggcu

SEQ ID NO: 2687170 - RNA, 14 nt, Human
gcuggaagauccug

SEQ ID NO: 2687171 - RNA, 15 nt, Human
gcuggaagauccugc

SEQ ID NO: 2687172 - RNA, 17 nt, Human
gcuggaagauccugcgg

SEQ ID NO: 2687173 - RNA, 18 nt, Human
gcuggaagauccugcggg

SEQ ID NO: 2687174 - RNA, 16 nt, Human
gcuggccaguccaggc

SEQ ID NO: 2687175 - RNA, 17 nt, Human
gcuggccaguccaggcu

SEQ ID NO: 2687176 - RNA, 22 nt, Human
gcuggccaguccacccugccug

SEQ ID NO: 2687177 - RNA, 14 nt, Human
gcuggccaguccag

SEQ ID NO: 2687178 - RNA, 15 nt, Human
gcuggccaguccagg

SEQ ID NO: 2687179 - RNA, 21 nt, Human
gcuggcacccaccguggagga

SEQ ID NO: 2687180 - RNA, 23 nt, Human
gcuggcacccaccguggaggagg

SEQ ID NO: 2687181 - RNA, 16 nt, Human
gcuggcacccaccgug

SEQ ID NO: 2687182 - RNA, 20 nt, Human
gcuggcacccaccguggagg

SEQ ID NO: 2687183 - RNA, 13 nt, Human
gcuccuguggccc

SEQ ID NO: 2687184 - RNA, 15 nt, Human
gcuccuguggcccca

SEQ ID NO: 2687185 - RNA, 20 nt, Human
gcuccuguggccccacccug

SEQ ID NO: 2687186 - RNA, 21 nt, Human
gcuccuguggccccacccugg

SEQ ID NO: 2687187 - RNA, 15 nt, Human
gcuccuccccuuccu

SEQ ID NO: 2687188 - RNA, 23 nt, Human
gcuccuccccuuccucuugucug

SEQ ID NO: 2687189 - RNA, 21 nt, Human
gcuccggccucugccuuugca

SEQ ID NO: 2687190 - RNA, 15 nt, Human
gcuccgcugccgugc

SEQ ID NO: 2687191 - RNA, 17 nt, Human
gcuccagcuuucugcca

SEQ ID NO: 2687192 - RNA, 21 nt, Human
gcuccagcuuucugccaucua

SEQ ID NO: 2687193 - RNA, 17 nt, Human
gcucaugugugcaacag

SEQ ID NO: 2687194 - RNA, 22 nt, Human
gcucaugugugcaacaggguau

SEQ ID NO: 2687195 - RNA, 14 nt, Human
gcucauuaaacuuu

SEQ ID NO: 2687196 - RNA, 17 nt, Human
gcucauuaaacuuuuuu

SEQ ID NO: 2687197 - RNA, 16 nt, Human
gcucauuaugccacuu

SEQ ID NO: 2687198 - RNA, 21 nt, Human
gcuccagcuguucagcugguu

SEQ ID NO: 2687199 - RNA, 16 nt, Human
gcuccgcaggacuucc

SEQ ID NO: 2687200 - RNA, 17 nt, Human
gcuccgcaggacuuccc

SEQ ID NO: 2687201 - RNA, 14 nt, Human
gcuccgcaggacuu

SEQ ID NO: 2687202 - RNA, 13 nt, Human
gcuccgcaggacu

SEQ ID NO: 2687203 - RNA, 15 nt, Human
gcuccgaggacccag

SEQ ID NO: 2687204 - RNA, 16 nt, Human
gcuccgaggacccagg

SEQ ID NO: 2687205 - RNA, 20 nt, Human
gcuccagggaauccaagccu

SEQ ID NO: 2687206 - RNA, 21 nt, Human
gcuccagggaauccaagccuc

SEQ ID NO: 2687207 - RNA, 22 nt, Human
gcuccagggaauccaagccucc

SEQ ID NO: 2687208 - RNA, 23 nt, Human
gcuccagggaauccaagccucca

SEQ ID NO: 2687209 - RNA, 13 nt, Human
gcucacacaccug

SEQ ID NO: 2687210 - RNA, 16 nt, Human
gcuaucaggagaaagc

SEQ ID NO: 2687211 - RNA, 18 nt, Human
gcuauaaugagcauguuu

SEQ ID NO: 2687212 - RNA, 18 nt, Human
gcuauccccaucucccug

SEQ ID NO: 2687213 - RNA, 19 nt, Human
gcuauccccaucucccugc

SEQ ID NO: 2687214 - RNA, 21 nt, Human
gcuauccccaucucccugccu

SEQ ID NO: 2687215 - RNA, 22 nt, Human
gcuauccccaucucccugccug

SEQ ID NO: 2687216 - RNA, 23 nt, Human
gcuauccccaucucccugccugg

SEQ ID NO: 2687217 - RNA, 12 nt, Human
gcuauccugauu

SEQ ID NO: 2687218 - RNA, 17 nt, Human
gcuauauaagacaagaa

SEQ ID NO: 2687219 - RNA, 14 nt, Human
gcuauauauaaaac

SEQ ID NO: 2687220 - RNA, 19 nt, Human
gcuauaaagcaguauuuuu

SEQ ID NO: 2687221 - RNA, 21 nt, Human
gcuauaaagcaguauuuuucu

SEQ ID NO: 2687222 - RNA, 19 nt, Human
gcucagcucggggagccuu

SEQ ID NO: 2687223 - RNA, 23 nt, Human
gcucaucugcugguccgugggac

SEQ ID NO: 2687224 - RNA, 16 nt, Human
gcucaucugcuggucc

SEQ ID NO: 2687225 - RNA, 21 nt, Human
gcucaucugcugguccguggg

SEQ ID NO: 2687226 - RNA, 13 nt, Human
gcucaucugcugg

SEQ ID NO: 2687227 - RNA, 14 nt, Human
gcucaucugcuggu

SEQ ID NO: 2687228 - RNA, 15 nt, Human
gcucaucugcugguc

SEQ ID NO: 2687229 - RNA, 13 nt, Human
gccugcucccugu

SEQ ID NO: 2687230 - RNA, 14 nt, Human
gccugcauuuccuc

SEQ ID NO: 2687231 - RNA, 19 nt, Human
gccugcauuuccucgcagc

SEQ ID NO: 2687232 - RNA, 21 nt, Human
gccugcauuuccucgcagccu

SEQ ID NO: 2687233 - RNA, 22 nt, Human
gccugcugcaugcccucucagg

SEQ ID NO: 2687234 - RNA, 21 nt, Human
gccugcugcaugcccucucag

SEQ ID NO: 2687235 - RNA, 18 nt, Human
gccugcugcaugcccucu

SEQ ID NO: 2687236 - RNA, 14 nt, Human
gccugcugcaugcc

SEQ ID NO: 2687237 - RNA, 22 nt, Human
gccuggacaguaucccacaucc

SEQ ID NO: 2687238 - RNA, 21 nt, Human
gccuggacaguaucccacauc

SEQ ID NO: 2687239 - RNA, 12 nt, Human
gccugcagggaa

SEQ ID NO: 2687240 - RNA, 15 nt, Human
gccugcagggaagcc

SEQ ID NO: 2687241 - RNA, 20 nt, Human
gccugcagggaagccccaca

SEQ ID NO: 2687242 - RNA, 22 nt, Human
gccugcagggaagccccacaug

SEQ ID NO: 2687243 - RNA, 13 nt, Human
gccugcagggcca

SEQ ID NO: 2687244 - RNA, 14 nt, Human
gccugcagggccau

SEQ ID NO: 2687245 - RNA, 16 nt, Human
gccugcagggccaugg

SEQ ID NO: 2687246 - RNA, 18 nt, Human
gccugcagggccauggcu

SEQ ID NO: 2687247 - RNA, 21 nt, Human
gccugcagggccauggcucag

SEQ ID NO: 2687248 - RNA, 15 nt, Human
gccuggguugggggc

SEQ ID NO: 2687249 - RNA, 21 nt, Human
gccugggcugaccccgguggc

SEQ ID NO: 2687250 - RNA, 20 nt, Human
gccugggcgacagagcgaga

SEQ ID NO: 2687251 - RNA, 17 nt, Human
gccugggccgcugccac

SEQ ID NO: 2687252 - RNA, 18 nt, Human
gccugggccgcugccacg

SEQ ID NO: 2687253 - RNA, 22 nt, Human
gccugggccguaucuccggcuc

SEQ ID NO: 2687254 - RNA, 15 nt, Human
gccuguaauccuagc

SEQ ID NO: 2687255 - RNA, 10 nt, Human
gccuggcccc

SEQ ID NO: 2687256 - RNA, 20 nt, Human
gccuguaauccuagcacuuu

SEQ ID NO: 2687257 - RNA, 16 nt, Human
gccugggccgcugcca

SEQ ID NO: 2687258 - RNA, 15 nt, Human
gccugggccccagcu

SEQ ID NO: 2687259 - RNA, 20 nt, Human
gccugggccccagcucgcgg

SEQ ID NO: 2687260 - RNA, 13 nt, Human
gccuggcccccaa

SEQ ID NO: 2687261 - RNA, 20 nt, Human
gccuggcccccaaccucagg

SEQ ID NO: 2687262 - RNA, 22 nt, Human
gccuggcccccaaccucagggc

SEQ ID NO: 2687263 - RNA, 22 nt, Human
gcgccccuagccgguuccuguc

SEQ ID NO: 2687264 - RNA, 13 nt, Human
gcgccccuagccg

SEQ ID NO: 2687265 - RNA, 22 nt, Human
gcgcccccuccgcccugccacu

SEQ ID NO: 2687266 - RNA, 12 nt, Human
gcgccccuagcc

SEQ ID NO: 2687267 - RNA, 21 nt, Human
gcgcccccuccgcccugccac

SEQ ID NO: 2687268 - RNA, 13 nt, Human
gcgccacaggacc

SEQ ID NO: 2687269 - RNA, 14 nt, Human
gcgccacaggaccc

SEQ ID NO: 2687270 - RNA, 15 nt, Human
gcgccaccagcucug

SEQ ID NO: 2687271 - RNA, 17 nt, Human
gcgcaguguuuugcaag

SEQ ID NO: 2687272 - RNA, 11 nt, Human
gcgcaucuaac

SEQ ID NO: 2687273 - RNA, 18 nt, Human
gcgcaucuugccuccagg

SEQ ID NO: 2687274 - RNA, 22 nt, Human
gcgcaucuugccuccaggugca

SEQ ID NO: 2687275 - RNA, 19 nt, Human
gcgccuccauccaaggcca

SEQ ID NO: 2687276 - RNA, 12 nt, Human
gcgccucccucc

SEQ ID NO: 2687277 - RNA, 14 nt, Human
gcgccucccuccac

SEQ ID NO: 2687278 - RNA, 16 nt, Human
gcgccucccuccaccc

SEQ ID NO: 2687279 - RNA, 17 nt, Human
gcgccucccuccacccc

SEQ ID NO: 2687280 - RNA, 18 nt, Human
gcgccucccuccacccca

SEQ ID NO: 2687281 - RNA, 19 nt, Human
gcgccucccuccaccccag

SEQ ID NO: 2687282 - RNA, 21 nt, Human
gcgccucccuccaccccagga

SEQ ID NO: 2687283 - RNA, 22 nt, Human
gcgccucccuccaccccaggac

SEQ ID NO: 2687284 - RNA, 23 nt, Human
gcgccucccuccaccccaggacg

SEQ ID NO: 2687285 - RNA, 21 nt, Human
gcgccucgccggaucugaggg

SEQ ID NO: 2687286 - RNA, 16 nt, Human
gcgccugcugcaugcc

SEQ ID NO: 2687287 - RNA, 22 nt, Human
gcgcccuuaacugcauccagcc

SEQ ID NO: 2687288 - RNA, 16 nt, Human
gcgcccuuggcuucug

SEQ ID NO: 2687289 - RNA, 20 nt, Human
gcgcccuuggcuucugugau

SEQ ID NO: 2687290 - RNA, 23 nt, Human
gcgcccuuuccccgacgcccacc

SEQ ID NO: 2687291 - RNA, 12 nt, Human
gcgcccuuuccc

SEQ ID NO: 2687292 - RNA, 18 nt, Human
gcgcccuuuccccgacgc

SEQ ID NO: 2687293 - RNA, 19 nt, Human
gcggguggaucacgagguc

SEQ ID NO: 2687294 - RNA, 18 nt, Human
gccuuguccucagccagu

SEQ ID NO: 2687295 - RNA, 18 nt, Human
gccuuccucucuccagau

SEQ ID NO: 2687296 - RNA, 17 nt, Human
gccuuccucucuccaga

SEQ ID NO: 2687297 - RNA, 16 nt, Human
gccuuccucucuccag

SEQ ID NO: 2687298 - RNA, 13 nt, Human
gccuuccucucuc

SEQ ID NO: 2687299 - RNA, 24 nt, Human
gccuucccuagcuuuagacccugg

SEQ ID NO: 2687300 - RNA, 23 nt, Human
gccuucccuagcuuuagacccug

SEQ ID NO: 2687301 - RNA, 20 nt, Human
gccuuaaacacucaccuucu

SEQ ID NO: 2687302 - RNA, 22 nt, Human
gccuuaagugaggaaaucaaag

SEQ ID NO: 2687303 - RNA, 14 nt, Human
gccuuaauuuccuu

SEQ ID NO: 2687304 - RNA, 17 nt, Human
gccuuaauuuccuuuuu

SEQ ID NO: 2687305 - RNA, 19 nt, Human
gccuuaauuuccuuuuuga

SEQ ID NO: 2687306 - RNA, 21 nt, Human
gccuuaauuuccuuuuugaca

SEQ ID NO: 2687307 - RNA, 23 nt, Human
gccuuaauuuccuuuuugacacu

SEQ ID NO: 2687308 - RNA, 21 nt, Human
gccuuaagugaggaaaucaaa

SEQ ID NO: 2687309 - RNA, 20 nt, Human
gccuuaagugaggaaaucaa

SEQ ID NO: 2687310 - RNA, 23 nt, Human
gccuuuccuuuucgccuuuccuc

SEQ ID NO: 2687311 - RNA, 14 nt, Human
gccuuuccucucua

SEQ ID NO: 2687312 - RNA, 13 nt, Human
gccuuuccucucu

SEQ ID NO: 2687313 - RNA, 19 nt, Human
gcgaagacccucuugccca

SEQ ID NO: 2687314 - RNA, 22 nt, Human
gcgaagacccucuugcccaucc

SEQ ID NO: 2687315 - RNA, 18 nt, Human
gcgcaggugggcuggacu

SEQ ID NO: 2687316 - RNA, 19 nt, Human
gcgcaggugggcuggacuu

SEQ ID NO: 2687317 - RNA, 13 nt, Human
ggcuccccugagg

SEQ ID NO: 2687318 - RNA, 12 nt, Human
ggcuccccugag

SEQ ID NO: 2687319 - RNA, 20 nt, Human
ggcucccaggagccugccca

SEQ ID NO: 2687320 - RNA, 21 nt, Human
ggcucccaggagccugcccag

SEQ ID NO: 2687321 - RNA, 12 nt, Human
ggcucccagggg

SEQ ID NO: 2687322 - RNA, 22 nt, Human
ggcucccaggagccugcccagc

SEQ ID NO: 2687323 - RNA, 20 nt, Human
ggcucccaggggucucccug

SEQ ID NO: 2687324 - RNA, 21 nt, Human
ggcucccaggggucucccugg

SEQ ID NO: 2687325 - RNA, 22 nt, Human
ggcucccaggggucucccuggc

SEQ ID NO: 2687326 - RNA, 23 nt, Human
ggcucccaggggucucccuggcu

SEQ ID NO: 2687327 - RNA, 23 nt, Human
ggcucuccggggccauuugcaau

SEQ ID NO: 2687328 - RNA, 12 nt, Human
ggcucugcaguc

SEQ ID NO: 2687329 - RNA, 14 nt, Human
ggcucugcaguccu

SEQ ID NO: 2687330 - RNA, 22 nt, Human
ggcucugcaguccuacucaagc

SEQ ID NO: 2687331 - RNA, 14 nt, Human
ggcucugagcgccu

SEQ ID NO: 2687332 - RNA, 15 nt, Human
ggcucugagcgccuc

SEQ ID NO: 2687333 - RNA, 13 nt, Human
ggcuauccugauu

SEQ ID NO: 2687334 - RNA, 13 nt, Human
ggcucacgccugu

SEQ ID NO: 2687335 - RNA, 21 nt, Human
ggcgcugcccaccugccggcc

SEQ ID NO: 2687336 - RNA, 23 nt, Human
ggcucacgccuguaaucccagca

SEQ ID NO: 2687337 - RNA, 20 nt, Human
ggcggguggaucacgagguc

SEQ ID NO: 2687338 - RNA, 23 nt, Human
ggcgcugccccaucuccccucag

SEQ ID NO: 2687339 - RNA, 18 nt, Human
ggcgcccuuggcuucugu

SEQ ID NO: 2687340 - RNA, 15 nt, Human
ggcgcgguggcucac

SEQ ID NO: 2687341 - RNA, 15 nt, Human
ggccucuccauuugc

SEQ ID NO: 2687342 - RNA, 20 nt, Human
ggccucuccauuugcucuuc

SEQ ID NO: 2687343 - RNA, 15 nt, Human
ggccucuccagccuc

SEQ ID NO: 2687344 - RNA, 19 nt, Human
ggccucuccagccucagcc

SEQ ID NO: 2687345 - RNA, 13 nt, Human
ggccucucuagca

SEQ ID NO: 2687346 - RNA, 20 nt, Human
ggccucgguguggagaagcg

SEQ ID NO: 2687347 - RNA, 16 nt, Human
ggccguugcugacuua

SEQ ID NO: 2687348 - RNA, 14 nt, Human
ggccggcccugugu

SEQ ID NO: 2687349 - RNA, 15 nt, Human
ggccggcccugugug

SEQ ID NO: 2687350 - RNA, 14 nt, Human
ggcgcaggugggcu

SEQ ID NO: 2687351 - RNA, 15 nt, Human
ggcgcaggugggcug

SEQ ID NO: 2687352 - RNA, 16 nt, Human
ggcgcaggugggcugg

SEQ ID NO: 2687353 - RNA, 20 nt, Human
ggcgcaggugggcuggacuu

SEQ ID NO: 2687354 - RNA, 16 nt, Human
ggcgccaccagcucug

SEQ ID NO: 2687355 - RNA, 17 nt, Human
ggcgccaccagcucugc

SEQ ID NO: 2687356 - RNA, 18 nt, Human
ggcgccaccagcucugcc

SEQ ID NO: 2687357 - RNA, 21 nt, Human
ggccugggccguaucuccggc

SEQ ID NO: 2687358 - RNA, 23 nt, Human
ggccugggccguaucuccggcuc

SEQ ID NO: 2687359 - RNA, 15 nt, Human
ggccugggccgcugc

SEQ ID NO: 2687360 - RNA, 18 nt, Human
ggcuguucugugguuccu

SEQ ID NO: 2687361 - RNA, 21 nt, Human
ggcuguucugugguuccucug

SEQ ID NO: 2687362 - RNA, 14 nt, Human
ggcuguguuggugu

SEQ ID NO: 2687363 - RNA, 15 nt, Human
ggcugucggcgcugc

SEQ ID NO: 2687364 - RNA, 16 nt, Human
ggcugucggugggacc

SEQ ID NO: 2687365 - RNA, 13 nt, Human
ggcugucggcgcu

SEQ ID NO: 2687366 - RNA, 14 nt, Human
ggcugugcugcccu

SEQ ID NO: 2687367 - RNA, 15 nt, Human
ggcugugcugcccug

SEQ ID NO: 2687368 - RNA, 16 nt, Human
ggcugugcugcccuga

SEQ ID NO: 2687369 - RNA, 15 nt, Human
ggcuguggucacagc

SEQ ID NO: 2687370 - RNA, 12 nt, Human
ggcuuggccugc

SEQ ID NO: 2687371 - RNA, 13 nt, Human
ggcuuggccugcu

SEQ ID NO: 2687372 - RNA, 14 nt, Human
ggcuuggccugcug

SEQ ID NO: 2687373 - RNA, 16 nt, Human
ggcuuggccugcugug

SEQ ID NO: 2687374 - RNA, 15 nt, Human
ggcuuggccugcugu

SEQ ID NO: 2687375 - RNA, 21 nt, Human
ggcuucacggaagagccuugc

SEQ ID NO: 2687376 - RNA, 20 nt, Human
ggcuucacggaagagccuug

SEQ ID NO: 2687377 - RNA, 20 nt, Human
ggcuggagugcaguggcgca

SEQ ID NO: 2687378 - RNA, 20 nt, Human
ggcuggacuucuaccugccc

SEQ ID NO: 2687379 - RNA, 21 nt, Human
ggcuggacuucuaccugcccu

SEQ ID NO: 2687380 - RNA, 15 nt, Human
ggcuggacguggugg

SEQ ID NO: 2687381 - RNA, 15 nt, Human
ggcugaggcaggaga

SEQ ID NO: 2687382 - RNA, 16 nt, Human
ggcugaggcaggagaa

SEQ ID NO: 2687383 - RNA, 23 nt, Human
ggcugaggcaggagaauggugug

SEQ ID NO: 2687384 - RNA, 16 nt, Human
ggcugggggaagaagc

SEQ ID NO: 2687385 - RNA, 21 nt, Human
gggacccaauguaggagcugc

SEQ ID NO: 2687386 - RNA, 22 nt, Human
gggaaucuaagagagcugccau

SEQ ID NO: 2687387 - RNA, 19 nt, Human
ggcuuuuauuaaugcacuu

SEQ ID NO: 2687388 - RNA, 20 nt, Human
ggcuuuuauuaaugcacuuu

SEQ ID NO: 2687389 - RNA, 14 nt, Human
ggcuuucuggggcc

SEQ ID NO: 2687390 - RNA, 15 nt, Human
ggcuuucuguugcca

SEQ ID NO: 2687391 - RNA, 17 nt, Human
ggcuuugccauugugaa

SEQ ID NO: 2687392 - RNA, 18 nt, Human
gggaauccaagccuccac

SEQ ID NO: 2687393 - RNA, 21 nt, Human
gggaauccaagccuccacagc

SEQ ID NO: 2687394 - RNA, 22 nt, Human
gggaauccaagccuccacagcg

SEQ ID NO: 2687395 - RNA, 15 nt, Human
gggaauccaagccuc

SEQ ID NO: 2687396 - RNA, 17 nt, Human
gggaccugccaggcagg

SEQ ID NO: 2687397 - RNA, 13 nt, Human
gggacacacagcc

SEQ ID NO: 2687398 - RNA, 23 nt, Human
gggacccccguggggcagggagc

SEQ ID NO: 2687399 - RNA, 18 nt, Human
gggaccugccaggcaggg

SEQ ID NO: 2687400 - RNA, 19 nt, Human
gggaccugccaggcagggg

SEQ ID NO: 2687401 - RNA, 12 nt, Human
gggacccagugc

SEQ ID NO: 2687402 - RNA, 15 nt, Human
gggacccagugcaga

SEQ ID NO: 2687403 - RNA, 16 nt, Human
gggacccagugcagaa

SEQ ID NO: 2687404 - RNA, 20 nt, Human
gggacgcuccgcugccgugc

SEQ ID NO: 2687405 - RNA, 17 nt, Human
gggacggugcccaagcc

SEQ ID NO: 2687406 - RNA, 13 nt, Human
gggaggagggaga

SEQ ID NO: 2687407 - RNA, 14 nt, Human
gggaggagggagag

SEQ ID NO: 2687408 - RNA, 17 nt, Human
gggaggagggagaggga

SEQ ID NO: 2687409 - RNA, 23 nt, Human
gggaggaucucuugagccuggga

SEQ ID NO: 2687410 - RNA, 21 nt, Human
gggaggauugcuugagcucag

SEQ ID NO: 2687411 - RNA, 18 nt, Human
gggaggagggagagggag

SEQ ID NO: 2687412 - RNA, 23 nt, Human
gggaggauugcuugagcucagga

SEQ ID NO: 2687413 - RNA, 13 nt, Human
gggagcggagguu

SEQ ID NO: 2687414 - RNA, 21 nt, Human
gggagccuuugguucuggcca

SEQ ID NO: 2687415 - RNA, 20 nt, Human
gggagccgguaacuguccug

SEQ ID NO: 2687416 - RNA, 19 nt, Human
gggagcuccacucugcuuc

SEQ ID NO: 2687417 - RNA, 23 nt, Human
gggagcuccacucugcuucucug

SEQ ID NO: 2687418 - RNA, 18 nt, Human
gggagccuuagccgccca

SEQ ID NO: 2687419 - RNA, 22 nt, Human
gggagccuuugguucuggccag

SEQ ID NO: 2687420 - RNA, 13 nt, Human
gggagcugggccc

SEQ ID NO: 2687421 - RNA, 19 nt, Human
gggagcugggcccgacaug

SEQ ID NO: 2687422 - RNA, 16 nt, Human
ggcaagagggggugga

SEQ ID NO: 2687423 - RNA, 19 nt, Human
ggauugaaaauguccagga

SEQ ID NO: 2687424 - RNA, 14 nt, Human
ggauucugguucca

SEQ ID NO: 2687425 - RNA, 18 nt, Human
ggauucugguuccagggu

SEQ ID NO: 2687426 - RNA, 19 nt, Human
ggauucugguuccaggguc

SEQ ID NO: 2687427 - RNA, 17 nt, Human
ggcaccagggguuucuc

SEQ ID NO: 2687428 - RNA, 14 nt, Human
ggcaccaggaagcc

SEQ ID NO: 2687429 - RNA, 15 nt, Human
ggcaccaggaagccg

SEQ ID NO: 2687430 - RNA, 17 nt, Human
ggcaccagcagccugga

SEQ ID NO: 2687431 - RNA, 18 nt, Human
ggcaaggacuuuguacau

SEQ ID NO: 2687432 - RNA, 18 nt, Human
ggcaagcuccgcaggacu

SEQ ID NO: 2687433 - RNA, 14 nt, Human
ggcaagcuccgcag

SEQ ID NO: 2687434 - RNA, 13 nt, Human
ggcaagccaggcu

SEQ ID NO: 2687435 - RNA, 16 nt, Human
ggcagagcuggcucug

SEQ ID NO: 2687436 - RNA, 17 nt, Human
ggcagagcuggcucuga

SEQ ID NO: 2687437 - RNA, 22 nt, Human
ggauuccacucguguguuucua

SEQ ID NO: 2687438 - RNA, 14 nt, Human
ggauucuaaauaca

SEQ ID NO: 2687439 - RNA, 15 nt, Human
ggauucuaaauacau

SEQ ID NO: 2687440 - RNA, 19 nt, Human
ggauucuaaauacaugcca

SEQ ID NO: 2687441 - RNA, 21 nt, Human
ggauucaggaauguguggccu

SEQ ID NO: 2687442 - RNA, 18 nt, Human
ggauuaguuuagaacagg

SEQ ID NO: 2687443 - RNA, 17 nt, Human
ggauuaguuuagaacag

SEQ ID NO: 2687444 - RNA, 14 nt, Human
ggauuaguuuagaa

SEQ ID NO: 2687445 - RNA, 23 nt, Human
ggaugaugucuuuuuauuaaaau

SEQ ID NO: 2687446 - RNA, 17 nt, Human
ggaugccagggccgacc

SEQ ID NO: 2687447 - RNA, 16 nt, Human
ggcaggggugggggug

SEQ ID NO: 2687448 - RNA, 11 nt, Human
ggcagcugcua

SEQ ID NO: 2687449 - RNA, 22 nt, Human
ggcagcugcuauuuauuuuccu

SEQ ID NO: 2687450 - RNA, 12 nt, Human
ggcaggguccua

SEQ ID NO: 2687451 - RNA, 17 nt, Human
ggcagguuggugggggc

SEQ ID NO: 2687452 - RNA, 21 nt, Human
ggcaugagacucagugcagau

SEQ ID NO: 2687453 - RNA, 18 nt, Human
ggcaugguuuugugccau

SEQ ID NO: 2687454 - RNA, 22 nt, Human
ggcaugguuuugugccaucugu

SEQ ID NO: 2687455 - RNA, 11 nt, Human
ggcauguaaau

SEQ ID NO: 2687456 - RNA, 18 nt, Human
ggcauguaaauguaaacu

SEQ ID NO: 2687457 - RNA, 21 nt, Human
ggcauguaaauguaaacucag

SEQ ID NO: 2687458 - RNA, 21 nt, Human
ggcaguagaacuccaggcccu

SEQ ID NO: 2687459 - RNA, 15 nt, Human
ggcaguccgugggac

SEQ ID NO: 2687460 - RNA, 16 nt, Human
ggcaguccgugggacg

SEQ ID NO: 2687461 - RNA, 13 nt, Human
ggcaugaccagau

SEQ ID NO: 2687462 - RNA, 20 nt, Human
ggccacugugaagagaacca

SEQ ID NO: 2687463 - RNA, 17 nt, Human
ggccacagcgccagccu

SEQ ID NO: 2687464 - RNA, 17 nt, Human
ggccaccuccccagcau

SEQ ID NO: 2687465 - RNA, 13 nt, Human
ggccaccucccca

SEQ ID NO: 2687466 - RNA, 16 nt, Human
ggccaccuccccagca

SEQ ID NO: 2687467 - RNA, 13 nt, Human
ggccaugcugagg

SEQ ID NO: 2687468 - RNA, 14 nt, Human
ggccaugcugaggc

SEQ ID NO: 2687469 - RNA, 15 nt, Human
ggccaugcugaggcc

SEQ ID NO: 2687470 - RNA, 18 nt, Human
ggccaugcugaggccugg

SEQ ID NO: 2687471 - RNA, 19 nt, Human
ggccaugcugaggccuggg

SEQ ID NO: 2687472 - RNA, 22 nt, Human
ggccaugcugaggccugggccg

SEQ ID NO: 2687473 - RNA, 18 nt, Human
ggcccacccggugggacc

SEQ ID NO: 2687474 - RNA, 20 nt, Human
ggcccacccggugggacccc

SEQ ID NO: 2687475 - RNA, 13 nt, Human
ggccaggagcagg

SEQ ID NO: 2687476 - RNA, 21 nt, Human
ggccaggagcaggcacgggug

SEQ ID NO: 2687477 - RNA, 20 nt, Human
gcuuuguagaguuuugucau

SEQ ID NO: 2687478 - RNA, 14 nt, Human
ggacagaaagagac

SEQ ID NO: 2687479 - RNA, 14 nt, Human
ggacacuccaggga

SEQ ID NO: 2687480 - RNA, 18 nt, Human
ggacacuccagggacaca

SEQ ID NO: 2687481 - RNA, 22 nt, Human
ggacacuccagggacacacagc

SEQ ID NO: 2687482 - RNA, 23 nt, Human
ggacacuccagggacacacagcc

SEQ ID NO: 2687483 - RNA, 19 nt, Human
gcuuuuauuaaugcacuuu

SEQ ID NO: 2687484 - RNA, 22 nt, Human
gcuuuuauuaaugcacuuucua

SEQ ID NO: 2687485 - RNA, 15 nt, Human
gcuuuuauuaaugca

SEQ ID NO: 2687486 - RNA, 18 nt, Human
gcuuuuauuaaugcacuu

SEQ ID NO: 2687487 - RNA, 22 nt, Human
gcuuuuauagaggcuagcuucu

SEQ ID NO: 2687488 - RNA, 19 nt, Human
gcuuuuauagaggcuagcu

SEQ ID NO: 2687489 - RNA, 17 nt, Human
ggacugacugaggcagu

SEQ ID NO: 2687490 - RNA, 16 nt, Human
ggacugacugaggcag

SEQ ID NO: 2687491 - RNA, 15 nt, Human
ggacugacugaggca

SEQ ID NO: 2687492 - RNA, 11 nt, Human
ggacugacuga

SEQ ID NO: 2687493 - RNA, 14 nt, Human
ggagaagagcgcag

SEQ ID NO: 2687494 - RNA, 12 nt, Human
ggagaagcugca

SEQ ID NO: 2687495 - RNA, 13 nt, Human
ggagaagcugcag

SEQ ID NO: 2687496 - RNA, 14 nt, Human
ggagaagcugcagg

SEQ ID NO: 2687497 - RNA, 17 nt, Human
ggagaagggaaguugaa

SEQ ID NO: 2687498 - RNA, 21 nt, Human
ggacugaccuuguaaaagaca

SEQ ID NO: 2687499 - RNA, 12 nt, Human
ggaccagggccu

SEQ ID NO: 2687500 - RNA, 20 nt, Human
ggaccuuuccaccacagcca

SEQ ID NO: 2687501 - RNA, 16 nt, Human
ggaccuuuuguuuucu

SEQ ID NO: 2687502 - RNA, 18 nt, Human
ggaccuuuccaccacagc

SEQ ID NO: 2687503 - RNA, 19 nt, Human
ggaccuuuccaccacagcc

SEQ ID NO: 2687504 - RNA, 22 nt, Human
ggaccuuuccaccacagccagc

SEQ ID NO: 2687505 - RNA, 19 nt, Human
ggacccaauguaggagcug

SEQ ID NO: 2687506 - RNA, 20 nt, Human
ggagggcggcaggggccugg

SEQ ID NO: 2687507 - RNA, 21 nt, Human
ggagggcggcaggggccugga

SEQ ID NO: 2687508 - RNA, 13 nt, Human
ggaggggaggggg

SEQ ID NO: 2687509 - RNA, 14 nt, Human
ggaggggaggguaa

SEQ ID NO: 2687510 - RNA, 13 nt, Human
ggaguauugaaug

SEQ ID NO: 2687511 - RNA, 16 nt, Human
ggaguauugaauggug

SEQ ID NO: 2687512 - RNA, 21 nt, Human
ggaguauugaaugguggugga

SEQ ID NO: 2687513 - RNA, 17 nt, Human
ggagcucaucugcaaaa

SEQ ID NO: 2687514 - RNA, 21 nt, Human
ggaggcaaagcuggcucaccu

SEQ ID NO: 2687515 - RNA, 17 nt, Human
ggaggcaaagcuggcuc

SEQ ID NO: 2687516 - RNA, 20 nt, Human
ggaggcaaagcuggcucacc

SEQ ID NO: 2687517 - RNA, 13 nt, Human
ggaggcagccgcc

SEQ ID NO: 2687518 - RNA, 14 nt, Human
ggaggcaggcaugg

SEQ ID NO: 2687519 - RNA, 17 nt, Human
ggaggcagggaggcagc

SEQ ID NO: 2687520 - RNA, 18 nt, Human
ggaggcagggaggcagcc

SEQ ID NO: 2687521 - RNA, 17 nt, Human
ggagggauucugguucc

SEQ ID NO: 2687522 - RNA, 13 nt, Human
ggagcacugggcu

SEQ ID NO: 2687523 - RNA, 15 nt, Human
ggagcacugggcucc

SEQ ID NO: 2687524 - RNA, 18 nt, Human
ggagccgguaacuguccu

SEQ ID NO: 2687525 - RNA, 19 nt, Human
ggagccgguaacuguccug

SEQ ID NO: 2687526 - RNA, 20 nt, Human
ggagccgguaacuguccugu

SEQ ID NO: 2687527 - RNA, 23 nt, Human
ggagccgguaacuguccuguccu

SEQ ID NO: 2687528 - RNA, 19 nt, Human
ggagcggagguugcaguga

SEQ ID NO: 2687529 - RNA, 22 nt, Human
ggagcgagcaugucguggacac

SEQ ID NO: 2687530 - RNA, 19 nt, Human
ggagccuuuuuaaaacaca

SEQ ID NO: 2687531 - RNA, 20 nt, Human
ggagccuuugguucuggcca

SEQ ID NO: 2687532 - RNA, 23 nt, Human
ggagccugcauuuccucgcagcc

SEQ ID NO: 2687533 - RNA, 23 nt, Human
ucagacagaacuugaauguguca

SEQ ID NO: 2687534 - RNA, 16 nt, Human
ucagacagaacuugaa

SEQ ID NO: 2687535 - RNA, 15 nt, Human
ucagacagaacuuga

SEQ ID NO: 2687536 - RNA, 17 nt, Human
ucagacagagaggacug

SEQ ID NO: 2687537 - RNA, 22 nt, Human
ucagacagagaggacuguaggg

SEQ ID NO: 2687538 - RNA, 18 nt, Human
ucagaaacuugugaagug

SEQ ID NO: 2687539 - RNA, 17 nt, Human
ucagaaacuugugaagu

SEQ ID NO: 2687540 - RNA, 16 nt, Human
ucagaaacuugugaag

SEQ ID NO: 2687541 - RNA, 15 nt, Human
ucagaaacuugugaa

SEQ ID NO: 2687542 - RNA, 15 nt, Human
ucagacacccucaac

SEQ ID NO: 2687543 - RNA, 22 nt, Human
ucagacacccucaaccucuucu

SEQ ID NO: 2687544 - RNA, 17 nt, Human
ucagacacccucaaccu

SEQ ID NO: 2687545 - RNA, 23 nt, Human
ucagacacccucaaccucuucug

SEQ ID NO: 2687546 - RNA, 11 nt, Human
ucacugccagg

SEQ ID NO: 2687547 - RNA, 14 nt, Human
ucacugccaggcca

SEQ ID NO: 2687548 - RNA, 15 nt, Human
ucacugccacacucu

SEQ ID NO: 2687549 - RNA, 19 nt, Human
ucacugccacacucuccau

SEQ ID NO: 2687550 - RNA, 20 nt, Human
ucacugccacacucuccauc

SEQ ID NO: 2687551 - RNA, 18 nt, Human
ucacugcgaagacccucu

SEQ ID NO: 2687552 - RNA, 18 nt, Human
ucacugccaugccagcuu

SEQ ID NO: 2687553 - RNA, 20 nt, Human
ucacugccaggccagccucc

SEQ ID NO: 2687554 - RNA, 23 nt, Human
ucacugccaggccagccuccgag

SEQ ID NO: 2687555 - RNA, 15 nt, Human
ucacugccaggccag

SEQ ID NO: 2687556 - RNA, 16 nt, Human
ucacugccaggccagc

SEQ ID NO: 2687557 - RNA, 18 nt, Human
ucacugccaggccagccu

SEQ ID NO: 2687558 - RNA, 19 nt, Human
ucacugccaggccagccuc

SEQ ID NO: 2687559 - RNA, 23 nt, Human
ucaccagccccacugccagcagc

SEQ ID NO: 2687560 - RNA, 24 nt, Human
ucaccagccccacugccagcagca

SEQ ID NO: 2687561 - RNA, 21 nt, Human
ucaccagcccaucgccacaaa

SEQ ID NO: 2687562 - RNA, 15 nt, Human
ucaccagccccacug

SEQ ID NO: 2687563 - RNA, 19 nt, Human
ucaccagccccacugccag

SEQ ID NO: 2687564 - RNA, 21 nt, Human
ucaccagccccacugccagca

SEQ ID NO: 2687565 - RNA, 22 nt, Human
ucaccagccccacugccagcag

SEQ ID NO: 2687566 - RNA, 13 nt, Human
ucacuggggcaga

SEQ ID NO: 2687567 - RNA, 14 nt, Human
ucacuggggcagac

SEQ ID NO: 2687568 - RNA, 13 nt, Human
ucacuuguguuuu

SEQ ID NO: 2687569 - RNA, 17 nt, Human
ucacuggggccuacagc

SEQ ID NO: 2687570 - RNA, 15 nt, Human
ucacuggaaagggga

SEQ ID NO: 2687571 - RNA, 17 nt, Human
ucacuggaaaggggaga

SEQ ID NO: 2687572 - RNA, 18 nt, Human
ucacuggaaaggggagag

SEQ ID NO: 2687573 - RNA, 21 nt, Human
ucacuggaaaggggagagccu

SEQ ID NO: 2687574 - RNA, 23 nt, Human
ucacuggaaaggggagagccugc

SEQ ID NO: 2687575 - RNA, 16 nt, Human
ucagcugaaccugggu

SEQ ID NO: 2687576 - RNA, 15 nt, Human
ucagcugaaccuggg

SEQ ID NO: 2687577 - RNA, 19 nt, Human
ucagccugcuccagcuguu

SEQ ID NO: 2687578 - RNA, 18 nt, Human
ucagccugcuccagcugu

SEQ ID NO: 2687579 - RNA, 16 nt, Human
ucagagucagccagga

SEQ ID NO: 2687580 - RNA, 16 nt, Human
ucaggcaaagaaaaug

SEQ ID NO: 2687581 - RNA, 13 nt, Human
ucaggcucccagg

SEQ ID NO: 2687582 - RNA, 12 nt, Human
ucaggcucccag

SEQ ID NO: 2687583 - RNA, 13 nt, Human
ucagggccaugcu

SEQ ID NO: 2687584 - RNA, 14 nt, Human
ucagggccaugcug

SEQ ID NO: 2687585 - RNA, 17 nt, Human
ucagggccaugcugagg

SEQ ID NO: 2687586 - RNA, 14 nt, Human
ucagggcucccagg

SEQ ID NO: 2687587 - RNA, 16 nt, Human
ucagggcucccagggg

SEQ ID NO: 2687588 - RNA, 16 nt, Human
ucaggugagaagcaga

SEQ ID NO: 2687589 - RNA, 15 nt, Human
ucaggugagaagcag

SEQ ID NO: 2687590 - RNA, 18 nt, Human
ucagggccaugcugaggc

SEQ ID NO: 2687591 - RNA, 19 nt, Human
ucagggccaugcugaggcc

SEQ ID NO: 2687592 - RNA, 21 nt, Human
ucagggccaugcugaggccug

SEQ ID NO: 2687593 - RNA, 23 nt, Human
ucagggccaugcugaggccuggg

SEQ ID NO: 2687594 - RNA, 14 nt, Human
uccacccugccugc

SEQ ID NO: 2687595 - RNA, 11 nt, Human
ucauuucaucu

SEQ ID NO: 2687596 - RNA, 23 nt, Human
uccagccaaagccuccuccagcc

SEQ ID NO: 2687597 - RNA, 10 nt, Human
uccagccagc

SEQ ID NO: 2687598 - RNA, 11 nt, Human
uccagccagcg

SEQ ID NO: 2687599 - RNA, 12 nt, Human
uccagccagcgc

SEQ ID NO: 2687600 - RNA, 13 nt, Human
uccagccagcgcc

SEQ ID NO: 2687601 - RNA, 14 nt, Human
uccagccagcgccu

SEQ ID NO: 2687602 - RNA, 18 nt, Human
uccagccagcgccucccu

SEQ ID NO: 2687603 - RNA, 19 nt, Human
uccagccagcgccucccuc

SEQ ID NO: 2687604 - RNA, 20 nt, Human
uccagccagcgccucccucc

SEQ ID NO: 2687605 - RNA, 21 nt, Human
uccagccagcgccucccucca

SEQ ID NO: 2687606 - RNA, 22 nt, Human
uccagccagcgccucccuccac

SEQ ID NO: 2687607 - RNA, 23 nt, Human
uccagccagcgccucccuccacc

SEQ ID NO: 2687608 - RNA, 23 nt, Human
uccagccccgcgaccauguggcc

SEQ ID NO: 2687609 - RNA, 17 nt, Human
uccagcuguucagcugg

SEQ ID NO: 2687610 - RNA, 16 nt, Human
uccagcuuucugccau

SEQ ID NO: 2687611 - RNA, 14 nt, Human
uccaggugcagagg

SEQ ID NO: 2687612 - RNA, 15 nt, Human
uccaggugcagaggu

SEQ ID NO: 2687613 - RNA, 16 nt, Human
uccagggucccucugu

SEQ ID NO: 2687614 - RNA, 17 nt, Human
uccagggucccucugug

SEQ ID NO: 2687615 - RNA, 18 nt, Human
uccagggucccucugugu

SEQ ID NO: 2687616 - RNA, 17 nt, Human
ucauagccauaaaugau

SEQ ID NO: 2687617 - RNA, 23 nt, Human
ucaucacauuucuaugccaaaca

SEQ ID NO: 2687618 - RNA, 21 nt, Human
ucauaggcaccuuuuacugug

SEQ ID NO: 2687619 - RNA, 22 nt, Human
ucauaggcaccuuuuacuguga

SEQ ID NO: 2687620 - RNA, 12 nt, Human
ucaucugcaaaa

SEQ ID NO: 2687621 - RNA, 13 nt, Human
ucaucugcaaaag

SEQ ID NO: 2687622 - RNA, 18 nt, Human
ucaucacuacaguauuac

SEQ ID NO: 2687623 - RNA, 23 nt, Human
ucaucuuagguuggcaaaaaggc

SEQ ID NO: 2687624 - RNA, 21 nt, Human
ucaggugagaagcagaggaag

SEQ ID NO: 2687625 - RNA, 14 nt, Human
ucauagcccaguag

SEQ ID NO: 2687626 - RNA, 22 nt, Human
ucauagcccaguagaccuuguu

SEQ ID NO: 2687627 - RNA, 14 nt, Human
ucauuauucucugc

SEQ ID NO: 2687628 - RNA, 17 nt, Human
ucauuauucucugcuau

SEQ ID NO: 2687629 - RNA, 22 nt, Human
ucauucaaguguaaaauauuuu

SEQ ID NO: 2687630 - RNA, 14 nt, Human
ucauuucaucucau

SEQ ID NO: 2687631 - RNA, 15 nt, Human
ucauuucaucucauu

SEQ ID NO: 2687632 - RNA, 16 nt, Human
ucauuucaucucauuu

SEQ ID NO: 2687633 - RNA, 17 nt, Human
ucauuucaucucauuua

SEQ ID NO: 2687634 - RNA, 18 nt, Human
ucauuucaucucauuuaa

SEQ ID NO: 2687635 - RNA, 20 nt, Human
ucauuucaucucauuuaagg

SEQ ID NO: 2687636 - RNA, 21 nt, Human
ucauuucagaaguuaguuugu

SEQ ID NO: 2687637 - RNA, 13 nt, Human
ucauuucagaagu

SEQ ID NO: 2687638 - RNA, 13 nt, Human
uauuaauauuuaa

SEQ ID NO: 2687639 - RNA, 12 nt, Human
uauuaaucacug

SEQ ID NO: 2687640 - RNA, 14 nt, Human
uauuaaucacugug

SEQ ID NO: 2687641 - RNA, 13 nt, Human
uauuaaucacugu

SEQ ID NO: 2687642 - RNA, 19 nt, Human
uauuaaucacuguguauau

SEQ ID NO: 2687643 - RNA, 17 nt, Human
uauuaaucacuguguau

SEQ ID NO: 2687644 - RNA, 16 nt, Human
uauuaaucacugugua

SEQ ID NO: 2687645 - RNA, 15 nt, Human
uauuaaucacugugu

SEQ ID NO: 2687646 - RNA, 14 nt, Human
uauuaauauaugua

SEQ ID NO: 2687647 - RNA, 13 nt, Human
uauuaaugcacuu

SEQ ID NO: 2687648 - RNA, 14 nt, Human
uauuaaugcacuuu

SEQ ID NO: 2687649 - RNA, 17 nt, Human
uauuaaugcacuuucua

SEQ ID NO: 2687650 - RNA, 20 nt, Human
uauuaaugcacuuucuaucc

SEQ ID NO: 2687651 - RNA, 12 nt, Human
uauuaaugcacu

SEQ ID NO: 2687652 - RNA, 23 nt, Human
uauuaaucacuguguauauuuga

SEQ ID NO: 2687653 - RNA, 22 nt, Human
uauuaaucacuguguauauuug

SEQ ID NO: 2687654 - RNA, 20 nt, Human
uauuaaucacuguguauauu

SEQ ID NO: 2687655 - RNA, 22 nt, Human
uauguuucucuuugauuauuug

SEQ ID NO: 2687656 - RNA, 23 nt, Human
uauguuucucuuugauuauuugc

SEQ ID NO: 2687657 - RNA, 23 nt, Human
uauuaaauuuuuuuguaugaaaa

SEQ ID NO: 2687658 - RNA, 22 nt, Human
uauuaaauuuuuuuguaugaaa

SEQ ID NO: 2687659 - RNA, 21 nt, Human
uauuaaauuuuuuuguaugaa

SEQ ID NO: 2687660 - RNA, 20 nt, Human
uauuaaauuuuuuuguauga

SEQ ID NO: 2687661 - RNA, 18 nt, Human
uauuaaauuuuuuuguau

SEQ ID NO: 2687662 - RNA, 17 nt, Human
uauuaaauuuuuuugua

SEQ ID NO: 2687663 - RNA, 13 nt, Human
uauguauuauuua

SEQ ID NO: 2687664 - RNA, 19 nt, Human
uauguauuauuuacauuua

SEQ ID NO: 2687665 - RNA, 21 nt, Human
uauguauuauuuauaauuccu

SEQ ID NO: 2687666 - RNA, 21 nt, Human
uauguauuauuuacauuuaau

SEQ ID NO: 2687667 - RNA, 14 nt, Human
uauguauucuuuuc

SEQ ID NO: 2687668 - RNA, 15 nt, Human
uaugucaguacuauu

SEQ ID NO: 2687669 - RNA, 20 nt, Human
uauguuguuuauaauaaaaa

SEQ ID NO: 2687670 - RNA, 13 nt, Human
uauguuuaaaaua

SEQ ID NO: 2687671 - RNA, 13 nt, Human
uaugguuauguuu

SEQ ID NO: 2687672 - RNA, 14 nt, Human
uaugguuauguuuu

SEQ ID NO: 2687673 - RNA, 19 nt, Human
uaugguuacuucuucucuu

SEQ ID NO: 2687674 - RNA, 20 nt, Human
uaugguuacuucuucucuua

SEQ ID NO: 2687675 - RNA, 22 nt, Human
uaugguuacuucuucucuuaga

SEQ ID NO: 2687676 - RNA, 22 nt, Human
uauggcagaaaaaaugucugua

SEQ ID NO: 2687677 - RNA, 15 nt, Human
uauggauguuacucu

SEQ ID NO: 2687678 - RNA, 16 nt, Human
uauggaugauuuaagu

SEQ ID NO: 2687679 - RNA, 18 nt, Human
uauggaugauuuaagugu

SEQ ID NO: 2687680 - RNA, 15 nt, Human
uauguaaauaauucu

SEQ ID NO: 2687681 - RNA, 17 nt, Human
uauguaaauaauucuuu

SEQ ID NO: 2687682 - RNA, 14 nt, Human
uauguaaauaauuc

SEQ ID NO: 2687683 - RNA, 13 nt, Human
uauguaaauaauu

SEQ ID NO: 2687684 - RNA, 17 nt, Human
uauguaaucucuaggaa

SEQ ID NO: 2687685 - RNA, 18 nt, Human
uauguauauuaaaaaaga

SEQ ID NO: 2687686 - RNA, 12 nt, Human
uauguauaaaau

SEQ ID NO: 2687687 - RNA, 18 nt, Human
uauguaguaucuauauga

SEQ ID NO: 2687688 - RNA, 19 nt, Human
uauguaguaucuauaugac

SEQ ID NO: 2687689 - RNA, 22 nt, Human
uauguauguguuuagaauugaa

SEQ ID NO: 2687690 - RNA, 21 nt, Human
uauguauguguuuagaauuga

SEQ ID NO: 2687691 - RNA, 20 nt, Human
uauguauguguuuagaauug

SEQ ID NO: 2687692 - RNA, 17 nt, Human
uauguauguguuuagaa

SEQ ID NO: 2687693 - RNA, 16 nt, Human
uauguauguguuuaga

SEQ ID NO: 2687694 - RNA, 15 nt, Human
uauguauguguuuag

SEQ ID NO: 2687695 - RNA, 13 nt, Human
uauguauguguuu

SEQ ID NO: 2687696 - RNA, 17 nt, Human
uauguagguaagacugu

SEQ ID NO: 2687697 - RNA, 21 nt, Human
uauguagguaagacuguagau

SEQ ID NO: 2687698 - RNA, 13 nt, Human
uauguagaagcau

SEQ ID NO: 2687699 - RNA, 21 nt, Human
uauguacuuuuauuuuacaca

SEQ ID NO: 2687700 - RNA, 16 nt, Human
uauuguuucucugaaa

SEQ ID NO: 2687701 - RNA, 12 nt, Human
uauuguuucugc

SEQ ID NO: 2687702 - RNA, 13 nt, Human
uauuguuucugca

SEQ ID NO: 2687703 - RNA, 15 nt, Human
uauuguuucugcauu

SEQ ID NO: 2687704 - RNA, 15 nt, Human
uauuguuugguaaau

SEQ ID NO: 2687705 - RNA, 16 nt, Human
uauuguuugguaaaug

SEQ ID NO: 2687706 - RNA, 17 nt, Human
uauuguuugguaaaugu

SEQ ID NO: 2687707 - RNA, 15 nt, Human
uauuguuuuacaaua

SEQ ID NO: 2687708 - RNA, 14 nt, Human
uauuguuuuacaau

SEQ ID NO: 2687709 - RNA, 22 nt, Human
uauuguuuuacaauaguucugu

SEQ ID NO: 2687710 - RNA, 20 nt, Human
uauuguuuuacaauaguucu

SEQ ID NO: 2687711 - RNA, 17 nt, Human
uauuguuuuacaauagu

SEQ ID NO: 2687712 - RNA, 16 nt, Human
uauuguuaauacaagg

SEQ ID NO: 2687713 - RNA, 16 nt, Human
uauuuaaaaaaaaagu

SEQ ID NO: 2687714 - RNA, 15 nt, Human
uauuuaaaaauagaa

SEQ ID NO: 2687715 - RNA, 16 nt, Human
uauuuaaaaauagaaa

SEQ ID NO: 2687716 - RNA, 18 nt, Human
uauuuaaaaauagaaaca

SEQ ID NO: 2687717 - RNA, 22 nt, Human
uauuuaguuguaaaccaaguga

SEQ ID NO: 2687718 - RNA, 17 nt, Human
uauugccuuuuaauuuu

SEQ ID NO: 2687719 - RNA, 21 nt, Human
uauugccuuuuaauuuuuaau

SEQ ID NO: 2687720 - RNA, 22 nt, Human
uauuaauauucaggguaaauag

SEQ ID NO: 2687721 - RNA, 14 nt, Human
uauugauugggaaa

SEQ ID NO: 2687722 - RNA, 15 nt, Human
uauugauugggaaaa

SEQ ID NO: 2687723 - RNA, 18 nt, Human
uauugauugggaaaacau

SEQ ID NO: 2687724 - RNA, 19 nt, Human
uauugauugggaaaacauu

SEQ ID NO: 2687725 - RNA, 20 nt, Human
uauugauugggaaaacauuu

SEQ ID NO: 2687726 - RNA, 22 nt, Human
uauugauugggaaaacauuugc

SEQ ID NO: 2687727 - RNA, 14 nt, Human
uauugauuuaagcu

SEQ ID NO: 2687728 - RNA, 12 nt, Human
uauugcaaaaua

SEQ ID NO: 2687729 - RNA, 15 nt, Human
uauugcaaaauacau

SEQ ID NO: 2687730 - RNA, 16 nt, Human
uauugcaaaauacaug

SEQ ID NO: 2687731 - RNA, 17 nt, Human
uauugcaaaauacauga

SEQ ID NO: 2687732 - RNA, 18 nt, Human
uauugcaaaauacaugaa

SEQ ID NO: 2687733 - RNA, 19 nt, Human
uauugcaaaauacaugaag

SEQ ID NO: 2687734 - RNA, 15 nt, Human
uauuauuauaaucuu

SEQ ID NO: 2687735 - RNA, 22 nt, Human
uauuauuauaaucuuauaauug

SEQ ID NO: 2687736 - RNA, 15 nt, Human
uauuacaaugaucac

SEQ ID NO: 2687737 - RNA, 17 nt, Human
uauuaauguuuucaaaa

SEQ ID NO: 2687738 - RNA, 18 nt, Human
uauuaauguuuucaaaag

SEQ ID NO: 2687739 - RNA, 14 nt, Human
uauuacaaaaacaa

SEQ ID NO: 2687740 - RNA, 16 nt, Human
uauuacaaaaacaaaa

SEQ ID NO: 2687741 - RNA, 14 nt, Human
uauuacaaugauca

SEQ ID NO: 2687742 - RNA, 22 nt, Human
uauuccagaucuuucagaaaua

SEQ ID NO: 2687743 - RNA, 22 nt, Human
uauucgauacugcgacuuucug

SEQ ID NO: 2687744 - RNA, 19 nt, Human
uauucuauaaaacucugca

SEQ ID NO: 2687745 - RNA, 20 nt, Human
uauucuaauaagcuaguuga

SEQ ID NO: 2687746 - RNA, 17 nt, Human
uauucuaauaagcuagu

SEQ ID NO: 2687747 - RNA, 15 nt, Human
uauucuaauaagcua

SEQ ID NO: 2687748 - RNA, 13 nt, Human
uauucuaauaagc

SEQ ID NO: 2687749 - RNA, 15 nt, Human
uauuuauaauuccua

SEQ ID NO: 2687750 - RNA, 22 nt, Human
uauuuauaauagcaacuuuugu

SEQ ID NO: 2687751 - RNA, 13 nt, Human
uauuuuauuacug

SEQ ID NO: 2687752 - RNA, 14 nt, Human
uauuuuauuacugu

SEQ ID NO: 2687753 - RNA, 15 nt, Human
uauuuuauuacuguu

SEQ ID NO: 2687754 - RNA, 20 nt, Human
uauuuuauuuagacaagaga

SEQ ID NO: 2687755 - RNA, 17 nt, Human
uauuuuauuuagacaag

SEQ ID NO: 2687756 - RNA, 11 nt, Human
uauuuuuuccu

SEQ ID NO: 2687757 - RNA, 14 nt, Human
uauuuuuuccuuuu

SEQ ID NO: 2687758 - RNA, 20 nt, Human
uauuuucucuguacuuuuca

SEQ ID NO: 2687759 - RNA, 15 nt, Human
uauuuuuuuaaaauu

SEQ ID NO: 2687760 - RNA, 16 nt, Human
uauuuuuuuaaaauuu

SEQ ID NO: 2687761 - RNA, 15 nt, Human
uauuuuuuggacuuc

SEQ ID NO: 2687762 - RNA, 21 nt, Human
uauuuuuuggacuucaaagca

SEQ ID NO: 2687763 - RNA, 13 nt, Human
uauuuuuugaaaa

SEQ ID NO: 2687764 - RNA, 22 nt, Human
uauuuucccuauuagagaagag

SEQ ID NO: 2687765 - RNA, 12 nt, Human
uauuuuccuaaa

SEQ ID NO: 2687766 - RNA, 16 nt, Human
uauuuuccuaaagaga

SEQ ID NO: 2687767 - RNA, 14 nt, Human
uauuuucuacagug

SEQ ID NO: 2687768 - RNA, 14 nt, Human
uauuuucuauuuua

SEQ ID NO: 2687769 - RNA, 19 nt, Human
uauuuucuauuuuaagacu

SEQ ID NO: 2687770 - RNA, 15 nt, Human
uauuuucuaaagacu

SEQ ID NO: 2687771 - RNA, 15 nt, Human
uauuuucuacagugg

SEQ ID NO: 2687772 - RNA, 14 nt, Human
uauuuucuacguuu

SEQ ID NO: 2687773 - RNA, 20 nt, Human
uauuuucuacguuucuuuaa

SEQ ID NO: 2687774 - RNA, 15 nt, Human
ucaaaaaaagaaaaa

SEQ ID NO: 2687775 - RNA, 14 nt, Human
ucaaaaaaagaaaa

SEQ ID NO: 2687776 - RNA, 16 nt, Human
uauuuuuuuuaauugu

SEQ ID NO: 2687777 - RNA, 15 nt, Human
uauuuuuuuuaaaga

SEQ ID NO: 2687778 - RNA, 17 nt, Human
uauuuuuuuuaaagaaa

SEQ ID NO: 2687779 - RNA, 19 nt, Human
uauuuuuuuuaauuguauu

SEQ ID NO: 2687780 - RNA, 18 nt, Human
uauuuuuuuuaauuguau

SEQ ID NO: 2687781 - RNA, 16 nt, Human
uauuuuuuuuucuaag

SEQ ID NO: 2687782 - RNA, 19 nt, Human
uauuuuuuuuucuaagaga

SEQ ID NO: 2687783 - RNA, 16 nt, Human
uauuuuuuuuuucuuc

SEQ ID NO: 2687784 - RNA, 17 nt, Human
uauuuuuuuuuucuucu

SEQ ID NO: 2687785 - RNA, 19 nt, Human
uauuuuuuuuuucuucuug

SEQ ID NO: 2687786 - RNA, 21 nt, Human
uauuuuuuuuuucuucuuggg

SEQ ID NO: 2687787 - RNA, 13 nt, Human
uauuuuuuugaac

SEQ ID NO: 2687788 - RNA, 10 nt, Human
ucaaauuaau

SEQ ID NO: 2687789 - RNA, 18 nt, Human
ucaaauuaauugugugaa

SEQ ID NO: 2687790 - RNA, 17 nt, Human
ucaaauuaauuguguga

SEQ ID NO: 2687791 - RNA, 13 nt, Human
ucaaauuaauugu

SEQ ID NO: 2687792 - RNA, 16 nt, Human
ucaaauuaauugugug

SEQ ID NO: 2687793 - RNA, 15 nt, Human
ucaaauuaauugugu

SEQ ID NO: 2687794 - RNA, 15 nt, Human
ucaaaugaugugcaa

SEQ ID NO: 2687795 - RNA, 17 nt, Human
ucaaaugaugugcaaaa

SEQ ID NO: 2687796 - RNA, 21 nt, Human
ucaaaugaugugcaaaaccuu

SEQ ID NO: 2687797 - RNA, 21 nt, Human
ucaaagaccuggggcugcugu

SEQ ID NO: 2687798 - RNA, 23 nt, Human
ucaaagaccuggggcugcuguga

SEQ ID NO: 2687799 - RNA, 15 nt, Human
ucaaagaacaaacau

SEQ ID NO: 2687800 - RNA, 16 nt, Human
ucaaguuguaaauaau

SEQ ID NO: 2687801 - RNA, 14 nt, Human
ucaauacacuaguu

SEQ ID NO: 2687802 - RNA, 19 nt, Human
ucaauaauauauuuucugu

SEQ ID NO: 2687803 - RNA, 20 nt, Human
ucaauaauauauuuucuguu

SEQ ID NO: 2687804 - RNA, 15 nt, Human
ucaauaauauauuuu

SEQ ID NO: 2687805 - RNA, 18 nt, Human
ucaauaauauauuuucug

SEQ ID NO: 2687806 - RNA, 21 nt, Human
ucaauaaagugcuuuaaaaag

SEQ ID NO: 2687807 - RNA, 17 nt, Human
ucaaguugucagguuau

SEQ ID NO: 2687808 - RNA, 15 nt, Human
ucaaugucaaguacc

SEQ ID NO: 2687809 - RNA, 18 nt, Human
ucaauguggugaugaaau

SEQ ID NO: 2687810 - RNA, 19 nt, Human
ucaccagagacuuuagggg

SEQ ID NO: 2687811 - RNA, 16 nt, Human
ucacagugcuuuuaag

SEQ ID NO: 2687812 - RNA, 18 nt, Human
ucacagugcuuuuaagug

SEQ ID NO: 2687813 - RNA, 20 nt, Human
uccuuuguuuucugacuaau

SEQ ID NO: 2687814 - RNA, 18 nt, Human
uccuuuguuuucugacua

SEQ ID NO: 2687815 - RNA, 22 nt, Human
uccuuuguuuucugacuaauua

SEQ ID NO: 2687816 - RNA, 12 nt, Human
uccuuuuaacug

SEQ ID NO: 2687817 - RNA, 18 nt, Human
uccuuggagaaaugaaaa

SEQ ID NO: 2687818 - RNA, 19 nt, Human
uccuuggagaaaugaaaac

SEQ ID NO: 2687819 - RNA, 21 nt, Human
uccuuggagaaaugaaaacag

SEQ ID NO: 2687820 - RNA, 15 nt, Human
uccuuuguucccggc

SEQ ID NO: 2687821 - RNA, 13 nt, Human
uccuuuucccugc

SEQ ID NO: 2687822 - RNA, 14 nt, Human
uccuuuucccugcu

SEQ ID NO: 2687823 - RNA, 15 nt, Human
uccuuuucccugcuu

SEQ ID NO: 2687824 - RNA, 19 nt, Human
ucgaaaccugggauucagg

SEQ ID NO: 2687825 - RNA, 23 nt, Human
uccuugagacacggagcccagcc

SEQ ID NO: 2687826 - RNA, 21 nt, Human
uccuugagacacggagcccag

SEQ ID NO: 2687827 - RNA, 17 nt, Human
uccuugagacacggagc

SEQ ID NO: 2687828 - RNA, 16 nt, Human
uccuugagugcucuug

SEQ ID NO: 2687829 - RNA, 16 nt, Human
uccuugaguguaugag

SEQ ID NO: 2687830 - RNA, 17 nt, Human
uccugucccuugaccuu

SEQ ID NO: 2687831 - RNA, 13 nt, Human
uccuucagacacc

SEQ ID NO: 2687832 - RNA, 20 nt, Human
uccuugaagaacugcaggcc

SEQ ID NO: 2687833 - RNA, 21 nt, Human
uccuugaagaacugcaggccc

SEQ ID NO: 2687834 - RNA, 23 nt, Human
uccuugaagaacugcaggcccug

SEQ ID NO: 2687835 - RNA, 12 nt, Human
uccuucagacac

SEQ ID NO: 2687836 - RNA, 13 nt, Human
uccuguccugcuc

SEQ ID NO: 2687837 - RNA, 24 nt, Human
uccuguccugcucauuaugccacu

SEQ ID NO: 2687838 - RNA, 16 nt, Human
uccuggcagcccagag

SEQ ID NO: 2687839 - RNA, 13 nt, Human
uccuggcacugga

SEQ ID NO: 2687840 - RNA, 11 nt, Human
uccuggcagcc

SEQ ID NO: 2687841 - RNA, 19 nt, Human
uccuggcacuggaccccag

SEQ ID NO: 2687842 - RNA, 18 nt, Human
uccuggcacuggacccca

SEQ ID NO: 2687843 - RNA, 21 nt, Human
uccuggcacuggaccccagca

SEQ ID NO: 2687844 - RNA, 13 nt, Human
uccuggcagccca

SEQ ID NO: 2687845 - RNA, 14 nt, Human
uccuggcagcccag

SEQ ID NO: 2687846 - RNA, 15 nt, Human
uccuggcagcccaga

SEQ ID NO: 2687847 - RNA, 14 nt, Human
uccugccucagccu

SEQ ID NO: 2687848 - RNA, 19 nt, Human
ucuaauauauaugaauaaa

SEQ ID NO: 2687849 - RNA, 15 nt, Human
ucuaauauauaugaa

SEQ ID NO: 2687850 - RNA, 12 nt, Human
ucuaauagucuu

SEQ ID NO: 2687851 - RNA, 22 nt, Human
ucuaacagugaaguuuuacugu

SEQ ID NO: 2687852 - RNA, 21 nt, Human
ucuaaaucuauuuauuaauau

SEQ ID NO: 2687853 - RNA, 20 nt, Human
ucuaaaucuauuuauuaaua

SEQ ID NO: 2687854 - RNA, 19 nt, Human
ucuaaaucuauuuauuaau

SEQ ID NO: 2687855 - RNA, 17 nt, Human
ucuaaaucuauuuauua

SEQ ID NO: 2687856 - RNA, 16 nt, Human
ucuaaaucuauuuauu

SEQ ID NO: 2687857 - RNA, 14 nt, Human
ucuaaaucuauuua

SEQ ID NO: 2687858 - RNA, 21 nt, Human
ucguguguuucuauuuuuuga

SEQ ID NO: 2687859 - RNA, 12 nt, Human
ucguggggaggu

SEQ ID NO: 2687860 - RNA, 15 nt, Human
ucguggggugugcug

SEQ ID NO: 2687861 - RNA, 18 nt, Human
ucguggggugugcuggga

SEQ ID NO: 2687862 - RNA, 12 nt, Human
ucguggcuguca

SEQ ID NO: 2687863 - RNA, 13 nt, Human
ucguggcugucaa

SEQ ID NO: 2687864 - RNA, 12 nt, Human
ucgugccugugu

SEQ ID NO: 2687865 - RNA, 13 nt, Human
ucgugccuguguc

SEQ ID NO: 2687866 - RNA, 14 nt, Human
ucgugccugugucc

SEQ ID NO: 2687867 - RNA, 16 nt, Human
ucgugcuacugcacuc

SEQ ID NO: 2687868 - RNA, 22 nt, Human
ucgugcuacugcacuccagccu

SEQ ID NO: 2687869 - RNA, 15 nt, Human
ucgugccugugucca

SEQ ID NO: 2687870 - RNA, 21 nt, Human
ucgugccuguguccaugcgcu

SEQ ID NO: 2687871 - RNA, 16 nt, Human
ucucaaaggagcgagc

SEQ ID NO: 2687872 - RNA, 17 nt, Human
ucucaaagaccuggggc

SEQ ID NO: 2687873 - RNA, 12 nt, Human
ucuagugaugau

SEQ ID NO: 2687874 - RNA, 17 nt, Human
ucuaugcuuuccaaacc

SEQ ID NO: 2687875 - RNA, 13 nt, Human
ucuaugcuuucca

SEQ ID NO: 2687876 - RNA, 14 nt, Human
ucuagucuuggcca

SEQ ID NO: 2687877 - RNA, 14 nt, Human
ucuagaaacaaaca

SEQ ID NO: 2687878 - RNA, 18 nt, Human
ucuaauuaaccuuacuaa

SEQ ID NO: 2687879 - RNA, 23 nt, Human
ucuaauuaaccuuacuaauuaua

SEQ ID NO: 2687880 - RNA, 18 nt, Human
uccuauauccugugacug

SEQ ID NO: 2687881 - RNA, 14 nt, Human
uccuauauauuucu

SEQ ID NO: 2687882 - RNA, 15 nt, Human
uccuauauauuucua

SEQ ID NO: 2687883 - RNA, 16 nt, Human
uccuauauauuucuau

SEQ ID NO: 2687884 - RNA, 17 nt, Human
uccuauauauuucuauu

SEQ ID NO: 2687885 - RNA, 20 nt, Human
uccuauauauuucuauuauu

SEQ ID NO: 2687886 - RNA, 12 nt, Human
uccuauuagugu

SEQ ID NO: 2687887 - RNA, 19 nt, Human
uccuauuaguguuauauga

SEQ ID NO: 2687888 - RNA, 17 nt, Human
uccuauuaguguuauau

SEQ ID NO: 2687889 - RNA, 14 nt, Human
uccuauuaguguua

SEQ ID NO: 2687890 - RNA, 13 nt, Human
uccuauuaguguu

SEQ ID NO: 2687891 - RNA, 15 nt, Human
uccuauucuauaaaa

SEQ ID NO: 2687892 - RNA, 18 nt, Human
uccuauucuauaaaacuc

SEQ ID NO: 2687893 - RNA, 17 nt, Human
uccucauuagcauuuug

SEQ ID NO: 2687894 - RNA, 19 nt, Human
uccuaauuucuccucccuu

SEQ ID NO: 2687895 - RNA, 15 nt, Human
uccuaauuucuccuc

SEQ ID NO: 2687896 - RNA, 16 nt, Human
uccuaauuucuccucc

SEQ ID NO: 2687897 - RNA, 17 nt, Human
uccuaauggugaugcag

SEQ ID NO: 2687898 - RNA, 14 nt, Human
uccuaauggugaug

SEQ ID NO: 2687899 - RNA, 24 nt, Human
uccuaauggugaugcagucuuaga

SEQ ID NO: 2687900 - RNA, 20 nt, Human
uccuaauggugaugcagucu

SEQ ID NO: 2687901 - RNA, 18 nt, Human
uccucuagaagccaaggg

SEQ ID NO: 2687902 - RNA, 19 nt, Human
uccucuagaagccaaggga

SEQ ID NO: 2687903 - RNA, 15 nt, Human
uccucuggacggcag

SEQ ID NO: 2687904 - RNA, 17 nt, Human
uccucuggacggcaggc

SEQ ID NO: 2687905 - RNA, 22 nt, Human
uccucuagaagccaagggaaag

SEQ ID NO: 2687906 - RNA, 22 nt, Human
uccucuggacggcaggcucacu

SEQ ID NO: 2687907 - RNA, 18 nt, Human
uccucuggacggcaggcu

SEQ ID NO: 2687908 - RNA, 20 nt, Human
uccucuggacggcaggcuca

SEQ ID NO: 2687909 - RNA, 19 nt, Human
uccucauggcagccuacuc

SEQ ID NO: 2687910 - RNA, 22 nt, Human
uccucauggcagccuacucucc

SEQ ID NO: 2687911 - RNA, 16 nt, Human
uccucgguacucccau

SEQ ID NO: 2687912 - RNA, 14 nt, Human
uccucuagaagcca

SEQ ID NO: 2687913 - RNA, 16 nt, Human
uccucuagaagccaag

SEQ ID NO: 2687914 - RNA, 17 nt, Human
uccucuagaagccaagg

SEQ ID NO: 2687915 - RNA, 14 nt, Human
uccucgcagccucu

SEQ ID NO: 2687916 - RNA, 19 nt, Human
uccucgcagccucucagug

SEQ ID NO: 2687917 - RNA, 21 nt, Human
uccucgcagccucucagugcc

SEQ ID NO: 2687918 - RNA, 15 nt, Human
uccucgguacuccca

SEQ ID NO: 2687919 - RNA, 17 nt, Human
uccucgguacucccaua

SEQ ID NO: 2687920 - RNA, 19 nt, Human
ucccguuuuccccaugaca

SEQ ID NO: 2687921 - RNA, 17 nt, Human
ucccguuuuccccauga

SEQ ID NO: 2687922 - RNA, 16 nt, Human
ucccguuuuccccaug

SEQ ID NO: 2687923 - RNA, 18 nt, Human
uccagguuuaagcuguua

SEQ ID NO: 2687924 - RNA, 17 nt, Human
uccagguuuaagcuguu

SEQ ID NO: 2687925 - RNA, 17 nt, Human
ucccgggccccacagac

SEQ ID NO: 2687926 - RNA, 16 nt, Human
ucccuaaucuaugguc

SEQ ID NO: 2687927 - RNA, 23 nt, Human
ucccuaaucuauggucgggagac

SEQ ID NO: 2687928 - RNA, 16 nt, Human
ucccuauuagagaaga

SEQ ID NO: 2687929 - RNA, 16 nt, Human
ucccucuaaugagacu

SEQ ID NO: 2687930 - RNA, 17 nt, Human
ucccucuaaugagacug

SEQ ID NO: 2687931 - RNA, 19 nt, Human
ucccucuaaugagacugac

SEQ ID NO: 2687932 - RNA, 14 nt, Human
ucccuccuccaggc

SEQ ID NO: 2687933 - RNA, 16 nt, Human
ucccuccuccaggccu

SEQ ID NO: 2687934 - RNA, 17 nt, Human
ucccuccuccaggccug

SEQ ID NO: 2687935 - RNA, 21 nt, Human
ucccuccuccaggccugccuc

SEQ ID NO: 2687936 - RNA, 17 nt, Human
ucccuuccuuuucccug

SEQ ID NO: 2687937 - RNA, 18 nt, Human
ucccuuccuuuucccugc

SEQ ID NO: 2687938 - RNA, 19 nt, Human
ucccuuccuuuucccugcu

SEQ ID NO: 2687939 - RNA, 20 nt, Human
ucccuuccuuuucccugcuu

SEQ ID NO: 2687940 - RNA, 15 nt, Human
ucccuugagggcugc

SEQ ID NO: 2687941 - RNA, 17 nt, Human
ucccuugagggcugcag

SEQ ID NO: 2687942 - RNA, 18 nt, Human
ucccuugagggcugcagu

SEQ ID NO: 2687943 - RNA, 19 nt, Human
ucccuugagggcugcaguu

SEQ ID NO: 2687944 - RNA, 19 nt, Human
ucccugcuuuuuguguuuu

SEQ ID NO: 2687945 - RNA, 17 nt, Human
ucccuuccagaugguca

SEQ ID NO: 2687946 - RNA, 21 nt, Human
ucccuuccagauggucaucca

SEQ ID NO: 2687947 - RNA, 22 nt, Human
ucccuuccagauggucauccag

SEQ ID NO: 2687948 - RNA, 14 nt, Human
ucccucuccuaacu

SEQ ID NO: 2687949 - RNA, 12 nt, Human
ucccugccuggc

SEQ ID NO: 2687950 - RNA, 15 nt, Human
ucccugccuggcccc

SEQ ID NO: 2687951 - RNA, 12 nt, Human
ucccugcuucca

SEQ ID NO: 2687952 - RNA, 14 nt, Human
ucccugcuuccagg

SEQ ID NO: 2687953 - RNA, 18 nt, Human
ucccugcuuccaggaaac

SEQ ID NO: 2687954 - RNA, 16 nt, Human
ucccugcgccuuuccu

SEQ ID NO: 2687955 - RNA, 15 nt, Human
ucccugcgccuuucc

SEQ ID NO: 2687956 - RNA, 13 nt, Human
ucucuaggaaguc

SEQ ID NO: 2687957 - RNA, 17 nt, Human
ucucuaagguuuacaau

SEQ ID NO: 2687958 - RNA, 15 nt, Human
ucucuaagugggcau

SEQ ID NO: 2687959 - RNA, 20 nt, Human
ucucuaagugggcauugcca

SEQ ID NO: 2687960 - RNA, 23 nt, Human
ucucuaagugggcauugccaugu

SEQ ID NO: 2687961 - RNA, 11 nt, Human
ucuccuggagg

SEQ ID NO: 2687962 - RNA, 19 nt, Human
ucuccuggccuauccgcug

SEQ ID NO: 2687963 - RNA, 21 nt, Human
ucuccuggccuauccgcugcc

SEQ ID NO: 2687964 - RNA, 23 nt, Human
ucuccuggccuauccgcugccag

SEQ ID NO: 2687965 - RNA, 13 nt, Human
ucucaaugaaaaa

SEQ ID NO: 2687966 - RNA, 14 nt, Human
ucucaaguaauaua

SEQ ID NO: 2687967 - RNA, 22 nt, Human
ucucaauccuaauuucuccucc

SEQ ID NO: 2687968 - RNA, 19 nt, Human
ucucaaugaaccauaaauu

SEQ ID NO: 2687969 - RNA, 21 nt, Human
ucucaaugaaccauaaauuca

SEQ ID NO: 2687970 - RNA, 23 nt, Human
ucucaauccuaauuucuccuccc

SEQ ID NO: 2687971 - RNA, 12 nt, Human
ucucaaugaaaa

SEQ ID NO: 2687972 - RNA, 14 nt, Human
ucucaaugaaaaau

SEQ ID NO: 2687973 - RNA, 16 nt, Human
ucucuguacuuuucau

SEQ ID NO: 2687974 - RNA, 21 nt, Human
ucucuguacuuuucauucucu

SEQ ID NO: 2687975 - RNA, 19 nt, Human
ucucugucacccuuguccu

SEQ ID NO: 2687976 - RNA, 12 nt, Human
ucucugugccuu

SEQ ID NO: 2687977 - RNA, 17 nt, Human
ucucugugccuucgucu

SEQ ID NO: 2687978 - RNA, 13 nt, Human
ucucugugagaag

SEQ ID NO: 2687979 - RNA, 15 nt, Human
ucucugugagaaggu

SEQ ID NO: 2687980 - RNA, 19 nt, Human
ucucugugagaagguuuau

SEQ ID NO: 2687981 - RNA, 18 nt, Human
ucucuguggcuccaggcc

SEQ ID NO: 2687982 - RNA, 14 nt, Human
ucucucucuaaggu

SEQ ID NO: 2687983 - RNA, 15 nt, Human
ucucugaaugcccca

SEQ ID NO: 2687984 - RNA, 15 nt, Human
ucugcauuuaaaaaa

SEQ ID NO: 2687985 - RNA, 16 nt, Human
ucugcauucauuuuua

SEQ ID NO: 2687986 - RNA, 21 nt, Human
ucugcauucauuuuuauagca

SEQ ID NO: 2687987 - RNA, 17 nt, Human
ucugccacccugcugag

SEQ ID NO: 2687988 - RNA, 14 nt, Human
ucugcaacaagcau

SEQ ID NO: 2687989 - RNA, 16 nt, Human
ucugcaacaagcaugc

SEQ ID NO: 2687990 - RNA, 17 nt, Human
ucugcaacaagcaugca

SEQ ID NO: 2687991 - RNA, 22 nt, Human
ucugaggccguugcugacuuag

SEQ ID NO: 2687992 - RNA, 21 nt, Human
ucugaggccguugcugacuua

SEQ ID NO: 2687993 - RNA, 17 nt, Human
ucugaggccguugcuga

SEQ ID NO: 2687994 - RNA, 21 nt, Human
ucugcaagaauugaagcagga

SEQ ID NO: 2687995 - RNA, 20 nt, Human
ucugcaagaauugaagcagg

SEQ ID NO: 2687996 - RNA, 12 nt, Human
ucucuuuuuguu

SEQ ID NO: 2687997 - RNA, 14 nt, Human
ucucuuuuuguuug

SEQ ID NO: 2687998 - RNA, 15 nt, Human
ucugaaaagugugua

SEQ ID NO: 2687999 - RNA, 23 nt, Human
ucugaaaaguguguauauauuuu

SEQ ID NO: 2688000 - RNA, 19 nt, Human
ucuguuuuuaaugcuauuu

SEQ ID NO: 2688001 - RNA, 18 nt, Human
ucuuaaaguauucuucuc

SEQ ID NO: 2688002 - RNA, 22 nt, Human
ucuuaaaguauucuucucuucc

SEQ ID NO: 2688003 - RNA, 16 nt, Human
ucugucugguggcccc

SEQ ID NO: 2688004 - RNA, 17 nt, Human
ucugucugguggccccg

SEQ ID NO: 2688005 - RNA, 13 nt, Human
ucugucugguggc

SEQ ID NO: 2688006 - RNA, 12 nt, Human
ucugucuggcac

SEQ ID NO: 2688007 - RNA, 14 nt, Human
ucuuaagaaaugua

SEQ ID NO: 2688008 - RNA, 17 nt, Human
ucuucucauuacuuguu

SEQ ID NO: 2688009 - RNA, 15 nt, Human
ucuucucauuacuug

SEQ ID NO: 2688010 - RNA, 21 nt, Human
ucuuccuugaagaacugcagg

SEQ ID NO: 2688011 - RNA, 13 nt, Human
ucuucagaugcca

SEQ ID NO: 2688012 - RNA, 14 nt, Human
ucuucagaugccac

SEQ ID NO: 2688013 - RNA, 16 nt, Human
ucuucaucccauucca

SEQ ID NO: 2688014 - RNA, 17 nt, Human
ucuucaucccauuccag

SEQ ID NO: 2688015 - RNA, 23 nt, Human
ucuucauaucaucacaacauuau

SEQ ID NO: 2688016 - RNA, 13 nt, Human
ucuuccugugauc

SEQ ID NO: 2688017 - RNA, 20 nt, Human
ucugggaccugccaggcagg

SEQ ID NO: 2688018 - RNA, 21 nt, Human
ucugggaccugccaggcaggg

SEQ ID NO: 2688019 - RNA, 22 nt, Human
ucugggaccugccaggcagggg

SEQ ID NO: 2688020 - RNA, 12 nt, Human
ucugguuccagg

SEQ ID NO: 2688021 - RNA, 13 nt, Human
ucugguuccaggg

SEQ ID NO: 2688022 - RNA, 14 nt, Human
ucugguuccagggu

SEQ ID NO: 2688023 - RNA, 21 nt, Human
ucugguuccagggucccucug

SEQ ID NO: 2688024 - RNA, 23 nt, Human
ucugguuccagggucccucugug

SEQ ID NO: 2688025 - RNA, 13 nt, Human
ucugguuaaaaaa

SEQ ID NO: 2688026 - RNA, 16 nt, Human
ucugguggucuguugg

SEQ ID NO: 2688027 - RNA, 12 nt, Human
ucugguggcccc

SEQ ID NO: 2688028 - RNA, 14 nt, Human
ucugguggccccgu

SEQ ID NO: 2688029 - RNA, 21 nt, Human
ucugggacuugguuuccccaa

SEQ ID NO: 2688030 - RNA, 19 nt, Human
ucuggaaucuggagaccag

SEQ ID NO: 2688031 - RNA, 20 nt, Human
ucuggaauaugcaacauugu

SEQ ID NO: 2688032 - RNA, 23 nt, Human
ucugccagauguccuaaugguga

SEQ ID NO: 2688033 - RNA, 22 nt, Human
ucugccagauguccuaauggug

SEQ ID NO: 2688034 - RNA, 16 nt, Human
ucugcuccccagggga

SEQ ID NO: 2688035 - RNA, 21 nt, Human
uguaaugaaaaugaauaucua

SEQ ID NO: 2688036 - RNA, 17 nt, Human
uguacacauauuugaag

SEQ ID NO: 2688037 - RNA, 14 nt, Human
uguaauaauagacu

SEQ ID NO: 2688038 - RNA, 22 nt, Human
uguacagaacacauuucucuga

SEQ ID NO: 2688039 - RNA, 18 nt, Human
uguaaugaaaaugaauau

SEQ ID NO: 2688040 - RNA, 15 nt, Human
uguaaugaaaaugaa

SEQ ID NO: 2688041 - RNA, 13 nt, Human
uguaauaagcaau

SEQ ID NO: 2688042 - RNA, 22 nt, Human
uguaaacucaucugaaauguua

SEQ ID NO: 2688043 - RNA, 16 nt, Human
uguaacacuccucugc

SEQ ID NO: 2688044 - RNA, 20 nt, Human
uguaaauuuuguaugaaaaa

SEQ ID NO: 2688045 - RNA, 21 nt, Human
uguaaaauauuuugaaucaau

SEQ ID NO: 2688046 - RNA, 14 nt, Human
uguaaaacaaaauu

SEQ ID NO: 2688047 - RNA, 12 nt, Human
uguaaaaaucuu

SEQ ID NO: 2688048 - RNA, 16 nt, Human
uguaaaaaucuuuuga

SEQ ID NO: 2688049 - RNA, 23 nt, Human
uguaaaaaucuuuugaagcauag

SEQ ID NO: 2688050 - RNA, 12 nt, Human
uguaaaagaaau

SEQ ID NO: 2688051 - RNA, 13 nt, Human
uguaaaagaaauc

SEQ ID NO: 2688052 - RNA, 19 nt, Human
uguaaaauauuuugaauca

SEQ ID NO: 2688053 - RNA, 20 nt, Human
uguaaaauauuuugaaucaa

SEQ ID NO: 2688054 - RNA, 14 nt, Human
uguaaaaaaaccac

SEQ ID NO: 2688055 - RNA, 23 nt, Human
uguaaaaaaaccaccaaaaacaa

SEQ ID NO: 2688056 - RNA, 23 nt, Human
ugguuuuuaaaaaacugcugacu

SEQ ID NO: 2688057 - RNA, 16 nt, Human
ugguuuugugccaucu

SEQ ID NO: 2688058 - RNA, 18 nt, Human
ugguuuugugccaucugu

SEQ ID NO: 2688059 - RNA, 22 nt, Human
ugguuuugugccaucuguagcu

SEQ ID NO: 2688060 - RNA, 21 nt, Human
ugguuuuuaaaaaacugcuga

SEQ ID NO: 2688061 - RNA, 20 nt, Human
ugguuguguguccccuugca

SEQ ID NO: 2688062 - RNA, 11 nt, Human
ugguugcaugg

SEQ ID NO: 2688063 - RNA, 18 nt, Human
ugguuggcugggaaaucg

SEQ ID NO: 2688064 - RNA, 16 nt, Human
ugguugggaaugagga

SEQ ID NO: 2688065 - RNA, 23 nt, Human
ugguugggaaugaggaaaauucu

SEQ ID NO: 2688066 - RNA, 12 nt, Human
ugguucucaaug

SEQ ID NO: 2688067 - RNA, 11 nt, Human
ugguucucaau

SEQ ID NO: 2688068 - RNA, 12 nt, Human
ugguuccucugc

SEQ ID NO: 2688069 - RNA, 13 nt, Human
ugguuccucugcu

SEQ ID NO: 2688070 - RNA, 13 nt, Human
ugguucugugaac

SEQ ID NO: 2688071 - RNA, 17 nt, Human
ugguucuggcuguuuga

SEQ ID NO: 2688072 - RNA, 12 nt, Human
ugguucuggcca

SEQ ID NO: 2688073 - RNA, 16 nt, Human
ugguucucaaugaaaa

SEQ ID NO: 2688074 - RNA, 14 nt, Human
ugguucucaaugaa

SEQ ID NO: 2688075 - RNA, 15 nt, Human
ugguucucaaugaaa

SEQ ID NO: 2688076 - RNA, 12 nt, Human
ugguugaauaug

SEQ ID NO: 2688077 - RNA, 12 nt, Human
ugguuccagggu

SEQ ID NO: 2688078 - RNA, 21 nt, Human
ugguuccagggucccucugug

SEQ ID NO: 2688079 - RNA, 22 nt, Human
ugguuccagggucccucugugu

SEQ ID NO: 2688080 - RNA, 15 nt, Human
ugguguaauuugaag

SEQ ID NO: 2688081 - RNA, 17 nt, Human
ugguguaauuugaagau

SEQ ID NO: 2688082 - RNA, 18 nt, Human
ugguguagcccucccacu

SEQ ID NO: 2688083 - RNA, 21 nt, Human
ugguguagcccucccacuuug

SEQ ID NO: 2688084 - RNA, 14 nt, Human
uggugauuugaaaa

SEQ ID NO: 2688085 - RNA, 19 nt, Human
uggugauuugaaaaauaua

SEQ ID NO: 2688086 - RNA, 20 nt, Human
uggugauuugaaaaauauaa

SEQ ID NO: 2688087 - RNA, 21 nt, Human
uggugauuugaaaaauauaaa

SEQ ID NO: 2688088 - RNA, 22 nt, Human
uggugauuugaaaaauauaaaa

SEQ ID NO: 2688089 - RNA, 18 nt, Human
uggugggggccucggugu

SEQ ID NO: 2688090 - RNA, 16 nt, Human
uggugggggccucggu

SEQ ID NO: 2688091 - RNA, 15 nt, Human
ugguggucuguuggc

SEQ ID NO: 2688092 - RNA, 14 nt, Human
uggugguagagaag

SEQ ID NO: 2688093 - RNA, 22 nt, Human
uguccugccugcaauauuugaa

SEQ ID NO: 2688094 - RNA, 14 nt, Human
uguccucagccagu

SEQ ID NO: 2688095 - RNA, 16 nt, Human
uguccccgcagcccug

SEQ ID NO: 2688096 - RNA, 18 nt, Human
uguccccgcugcugugca

SEQ ID NO: 2688097 - RNA, 17 nt, Human
uguccuauuaguguuau

SEQ ID NO: 2688098 - RNA, 16 nt, Human
uguccuauuaguguua

SEQ ID NO: 2688099 - RNA, 13 nt, Human
ugucugauuucuu

SEQ ID NO: 2688100 - RNA, 14 nt, Human
ugucugucuggcac

SEQ ID NO: 2688101 - RNA, 14 nt, Human
ugucugugaacaga

SEQ ID NO: 2688102 - RNA, 19 nt, Human
ugucugugaacagagagac

SEQ ID NO: 2688103 - RNA, 15 nt, Human
ugucuuuuaaaaugc

SEQ ID NO: 2688104 - RNA, 16 nt, Human
ugucuuuuaaaaugca

SEQ ID NO: 2688105 - RNA, 20 nt, Human
ugucuuuuaaaaugcaaugu

SEQ ID NO: 2688106 - RNA, 15 nt, Human
ugucuauaaaagaaa

SEQ ID NO: 2688107 - RNA, 16 nt, Human
ugucuauaaaagaaac

SEQ ID NO: 2688108 - RNA, 19 nt, Human
ugucuaggauuuuggaugu

SEQ ID NO: 2688109 - RNA, 17 nt, Human
ugucucacuaaagcaug

SEQ ID NO: 2688110 - RNA, 20 nt, Human
ugucucacuaaagcaugaaa

SEQ ID NO: 2688111 - RNA, 23 nt, Human
ugucucacuaaagcaugaaaugu

SEQ ID NO: 2688112 - RNA, 21 nt, Human
ugucucaaaaaaagaaaaaga

SEQ ID NO: 2688113 - RNA, 13 nt, Human
uguauaaaauaca

SEQ ID NO: 2688114 - RNA, 14 nt, Human
uguauaaaauacau

SEQ ID NO: 2688115 - RNA, 16 nt, Human
uguauaaaauacauag

SEQ ID NO: 2688116 - RNA, 19 nt, Human
uguauaaaauacauaguga

SEQ ID NO: 2688117 - RNA, 22 nt, Human
uguauaaaauacauagugaaaa

SEQ ID NO: 2688118 - RNA, 14 nt, Human
uguacagauucuuu

SEQ ID NO: 2688119 - RNA, 18 nt, Human
uguacagauucuuucagu

SEQ ID NO: 2688120 - RNA, 19 nt, Human
uguacagauucuuucaguu

SEQ ID NO: 2688121 - RNA, 17 nt, Human
uguaugacugcacauga

SEQ ID NO: 2688122 - RNA, 16 nt, Human
uguaugaguagccagg

SEQ ID NO: 2688123 - RNA, 17 nt, Human
uguaugaguagccaggg

SEQ ID NO: 2688124 - RNA, 16 nt, Human
uguaugacugcacaug

SEQ ID NO: 2688125 - RNA, 19 nt, Human
uguaugaaaacauggaaca

SEQ ID NO: 2688126 - RNA, 13 nt, Human
uguaugaaaacau

SEQ ID NO: 2688127 - RNA, 18 nt, Human
uguaugaaaaauugggga

SEQ ID NO: 2688128 - RNA, 20 nt, Human
uguaugaaaaauuggggagg

SEQ ID NO: 2688129 - RNA, 21 nt, Human
uguaugaaaaauuggggagga

SEQ ID NO: 2688130 - RNA, 13 nt, Human
uguauagcaugaa

SEQ ID NO: 2688131 - RNA, 19 nt, Human
uguauagcaugaaauaaaa

SEQ ID NO: 2688132 - RNA, 12 nt, Human
uguauaaauaua

SEQ ID NO: 2688133 - RNA, 13 nt, Human
uguauaaauauac

SEQ ID NO: 2688134 - RNA, 14 nt, Human
uguauaaauauaca

SEQ ID NO: 2688135 - RNA, 19 nt, Human
uguauaaauauacaguaua

SEQ ID NO: 2688136 - RNA, 14 nt, Human
uguauguagaagca

SEQ ID NO: 2688137 - RNA, 15 nt, Human
uguauguagaagcau

SEQ ID NO: 2688138 - RNA, 15 nt, Human
ugucaauuucugugu

SEQ ID NO: 2688139 - RNA, 16 nt, Human
ugucaauuucuguguu

SEQ ID NO: 2688140 - RNA, 17 nt, Human
uguauggggaaucuaag

SEQ ID NO: 2688141 - RNA, 20 nt, Human
uguaugccaagugagaagau

SEQ ID NO: 2688142 - RNA, 18 nt, Human
uguaugccaagugagaag

SEQ ID NO: 2688143 - RNA, 16 nt, Human
uguaugccaagugaga

SEQ ID NO: 2688144 - RNA, 19 nt, Human
uggauauauaggcuauuuu

SEQ ID NO: 2688145 - RNA, 14 nt, Human
uggagauccuccug

SEQ ID NO: 2688146 - RNA, 16 nt, Human
uggagauccuccugca

SEQ ID NO: 2688147 - RNA, 18 nt, Human
uggagauccuccugcaga

SEQ ID NO: 2688148 - RNA, 20 nt, Human
uggagauccuccugcagacc

SEQ ID NO: 2688149 - RNA, 21 nt, Human
uggagauccuccugcagacca

SEQ ID NO: 2688150 - RNA, 13 nt, Human
uggcaaggacuuu

SEQ ID NO: 2688151 - RNA, 19 nt, Human
uggcaaggacuuuguacau

SEQ ID NO: 2688152 - RNA, 20 nt, Human
uggcaaggacuuuguacauu

SEQ ID NO: 2688153 - RNA, 21 nt, Human
uggcaaggacuuuguacauuu

SEQ ID NO: 2688154 - RNA, 16 nt, Human
uggcaacauucauugc

SEQ ID NO: 2688155 - RNA, 18 nt, Human
uggcacuggaugcagaaa

SEQ ID NO: 2688156 - RNA, 15 nt, Human
uggcacuggaugcag

SEQ ID NO: 2688157 - RNA, 13 nt, Human
uggcacuggaugc

SEQ ID NO: 2688158 - RNA, 18 nt, Human
uggcacuggaccccagca

SEQ ID NO: 2688159 - RNA, 16 nt, Human
uggcacuggaccccag

SEQ ID NO: 2688160 - RNA, 19 nt, Human
uggcacugacugggcauag

SEQ ID NO: 2688161 - RNA, 14 nt, Human
uggcacucgcugua

SEQ ID NO: 2688162 - RNA, 16 nt, Human
uggaagaacaggccuc

SEQ ID NO: 2688163 - RNA, 18 nt, Human
uggaagaacaggccucuc

SEQ ID NO: 2688164 - RNA, 12 nt, Human
uggaagaaggga

SEQ ID NO: 2688165 - RNA, 21 nt, Human
uggaagaagggagaagaaagg

SEQ ID NO: 2688166 - RNA, 13 nt, Human
uggaagaagggag

SEQ ID NO: 2688167 - RNA, 15 nt, Human
uggaagaagggagaa

SEQ ID NO: 2688168 - RNA, 17 nt, Human
uggaagaagggagaaga

SEQ ID NO: 2688169 - RNA, 19 nt, Human
uggaagaagggagaagaaa

SEQ ID NO: 2688170 - RNA, 22 nt, Human
uggacggcaggcucacugccag

SEQ ID NO: 2688171 - RNA, 23 nt, Human
uggacggcaggcucacugccagg

SEQ ID NO: 2688172 - RNA, 21 nt, Human
uggacggcaggcucacugcca

SEQ ID NO: 2688173 - RNA, 13 nt, Human
uggacuguggcac

SEQ ID NO: 2688174 - RNA, 12 nt, Human
uggacuguggca

SEQ ID NO: 2688175 - RNA, 18 nt, Human
uggacuguggcacuugcc

SEQ ID NO: 2688176 - RNA, 20 nt, Human
uggacuguggcacuugccug

SEQ ID NO: 2688177 - RNA, 22 nt, Human
uggacuguggcacuugccuggg

SEQ ID NO: 2688178 - RNA, 19 nt, Human
uggagaccagggagccuuu

SEQ ID NO: 2688179 - RNA, 18 nt, Human
uggagaccagggagccuu

SEQ ID NO: 2688180 - RNA, 21 nt, Human
uggacuguggcacuugccugg

SEQ ID NO: 2688181 - RNA, 12 nt, Human
ugcuucucugac

SEQ ID NO: 2688182 - RNA, 13 nt, Human
ugcuucucugacu

SEQ ID NO: 2688183 - RNA, 23 nt, Human
ugcuuccucccaacaagcagcug

SEQ ID NO: 2688184 - RNA, 15 nt, Human
ugcuucccuuacuuu

SEQ ID NO: 2688185 - RNA, 15 nt, Human
ugcuuccucccaaca

SEQ ID NO: 2688186 - RNA, 12 nt, Human
ugcuuccuccug

SEQ ID NO: 2688187 - RNA, 13 nt, Human
ugcuuccuccugg

SEQ ID NO: 2688188 - RNA, 12 nt, Human
ugcuucucacug

SEQ ID NO: 2688189 - RNA, 22 nt, Human
ugcuucucagauuucugaggaa

SEQ ID NO: 2688190 - RNA, 21 nt, Human
ugcuucucagauuucugagga

SEQ ID NO: 2688191 - RNA, 14 nt, Human
ugcuuccuccugga

SEQ ID NO: 2688192 - RNA, 15 nt, Human
ugcuuccuccuggaa

SEQ ID NO: 2688193 - RNA, 15 nt, Human
ugcuucccuaaucua

SEQ ID NO: 2688194 - RNA, 15 nt, Human
ugcuuaauaaauugu

SEQ ID NO: 2688195 - RNA, 14 nt, Human
ugcuuaaucuucaa

SEQ ID NO: 2688196 - RNA, 15 nt, Human
ugcuuaaucuucaaa

SEQ ID NO: 2688197 - RNA, 16 nt, Human
ugcuuaaucuucaaag

SEQ ID NO: 2688198 - RNA, 20 nt, Human
ugcuuaaucuucaaagccuu

SEQ ID NO: 2688199 - RNA, 21 nt, Human
ugcuuaaucuucaaagccuuc

SEQ ID NO: 2688200 - RNA, 13 nt, Human
ugcuuaaauuucu

SEQ ID NO: 2688201 - RNA, 15 nt, Human
ugcuuaaauuucuua

SEQ ID NO: 2688202 - RNA, 16 nt, Human
ugcuuaaauuucuuau

SEQ ID NO: 2688203 - RNA, 22 nt, Human
ugcuuaaauuucuuaugugaca

SEQ ID NO: 2688204 - RNA, 14 nt, Human
ugcuuaaaccacuu

SEQ ID NO: 2688205 - RNA, 21 nt, Human
ugcuuaaaccacuuaaacgaa

SEQ ID NO: 2688206 - RNA, 22 nt, Human
ugcuugucuucugguacuuucu

SEQ ID NO: 2688207 - RNA, 16 nt, Human
ugcuugugaaaaugug

SEQ ID NO: 2688208 - RNA, 20 nt, Human
ugcuugugaaaauguguucu

SEQ ID NO: 2688209 - RNA, 22 nt, Human
ugcuuucuccuuuaauuguaaa

SEQ ID NO: 2688210 - RNA, 15 nt, Human
ugcuuucuccuuuaa

SEQ ID NO: 2688211 - RNA, 20 nt, Human
ugcuuucuccuuuaauugua

SEQ ID NO: 2688212 - RNA, 12 nt, Human
uggcuuguucau

SEQ ID NO: 2688213 - RNA, 21 nt, Human
uggcuuguucaucauccagau

SEQ ID NO: 2688214 - RNA, 22 nt, Human
uggcuuguucaucauccagaug

SEQ ID NO: 2688215 - RNA, 15 nt, Human
uggcuuuaagccuuc

SEQ ID NO: 2688216 - RNA, 23 nt, Human
uggcuuuaagccuucaaaacuau

SEQ ID NO: 2688217 - RNA, 14 nt, Human
uggcuccaggccaa

SEQ ID NO: 2688218 - RNA, 15 nt, Human
uggcuccaggccaaa

SEQ ID NO: 2688219 - RNA, 14 nt, Human
uggcuccggccucu

SEQ ID NO: 2688220 - RNA, 15 nt, Human
uggcuccggccucug

SEQ ID NO: 2688221 - RNA, 18 nt, Human
uggcuccggccucugccu

SEQ ID NO: 2688222 - RNA, 19 nt, Human
uggcuccggccucugccuu

SEQ ID NO: 2688223 - RNA, 15 nt, Human
uggcucccuccucca

SEQ ID NO: 2688224 - RNA, 17 nt, Human
uggcucccuccuccagg

SEQ ID NO: 2688225 - RNA, 19 nt, Human
uggcucccuccuccaggcc

SEQ ID NO: 2688226 - RNA, 20 nt, Human
uggcucccuccuccaggccu

SEQ ID NO: 2688227 - RNA, 21 nt, Human
uggcucccuccuccaggccug

SEQ ID NO: 2688228 - RNA, 13 nt, Human
uggccccagcaca

SEQ ID NO: 2688229 - RNA, 14 nt, Human
uggccccagcacag

SEQ ID NO: 2688230 - RNA, 17 nt, Human
uggccccagcacagcuu

SEQ ID NO: 2688231 - RNA, 18 nt, Human
uggccccagcacagcuug

SEQ ID NO: 2688232 - RNA, 19 nt, Human
uggccccagcacagcuuga

SEQ ID NO: 2688233 - RNA, 13 nt, Human
uggccccagcccu

SEQ ID NO: 2688234 - RNA, 16 nt, Human
uggccccagcccugcu

SEQ ID NO: 2688235 - RNA, 18 nt, Human
uggccccagcccugcugg

SEQ ID NO: 2688236 - RNA, 19 nt, Human
uggccccagcccugcuggg

SEQ ID NO: 2688237 - RNA, 20 nt, Human
uggccccagcccugcugggg

SEQ ID NO: 2688238 - RNA, 21 nt, Human
uggccccagcccugcugggga

SEQ ID NO: 2688239 - RNA, 13 nt, Human
uggccucucuagc

SEQ ID NO: 2688240 - RNA, 16 nt, Human
ugggaggaucucuuga

SEQ ID NO: 2688241 - RNA, 15 nt, Human
ugggaggagggagag

SEQ ID NO: 2688242 - RNA, 18 nt, Human
ugggaggagggagaggga

SEQ ID NO: 2688243 - RNA, 19 nt, Human
ugggaggagggagagggag

SEQ ID NO: 2688244 - RNA, 13 nt, Human
uggcuugucuaua

SEQ ID NO: 2688245 - RNA, 20 nt, Human
ugggaguuuuuaugagaaac

SEQ ID NO: 2688246 - RNA, 16 nt, Human
ugggaugaaacuaaag

SEQ ID NO: 2688247 - RNA, 14 nt, Human
ugggaugaaugcca

SEQ ID NO: 2688248 - RNA, 13 nt, Human
ugggaugaccagg

SEQ ID NO: 2688249 - RNA, 20 nt, Human
ugggauauaagaggcagcgu

SEQ ID NO: 2688250 - RNA, 18 nt, Human
ugggauauugaauguuaa

SEQ ID NO: 2688251 - RNA, 19 nt, Human
ugggcagcugucccuugcu

SEQ ID NO: 2688252 - RNA, 14 nt, Human
ugggccgcugccac

SEQ ID NO: 2688253 - RNA, 20 nt, Human
ugggccguaucuccggcucc

SEQ ID NO: 2688254 - RNA, 21 nt, Human
ugggccguaucuccggcuccc

SEQ ID NO: 2688255 - RNA, 13 nt, Human
ugggccgcugcca

SEQ ID NO: 2688256 - RNA, 14 nt, Human
ugggcccugggcug

SEQ ID NO: 2688257 - RNA, 16 nt, Human
ugggcccugggcugga

SEQ ID NO: 2688258 - RNA, 17 nt, Human
ugggcccugggcuggaa

SEQ ID NO: 2688259 - RNA, 21 nt, Human
ugggcuugucuguagauuuua

SEQ ID NO: 2688260 - RNA, 17 nt, Human
ugggcuugucuguagau

SEQ ID NO: 2688261 - RNA, 15 nt, Human
ugggccucggccccu

SEQ ID NO: 2688262 - RNA, 19 nt, Human
ugggccucggccccuccca

SEQ ID NO: 2688263 - RNA, 20 nt, Human
uggggccaccaaagcugccc

SEQ ID NO: 2688264 - RNA, 21 nt, Human
uggggccaccaaagcugccca

SEQ ID NO: 2688265 - RNA, 19 nt, Human
ugggccgggacccagggcc

SEQ ID NO: 2688266 - RNA, 15 nt, Human
uggggggcauugagu

SEQ ID NO: 2688267 - RNA, 19 nt, Human
uggggggcugaggugggag

SEQ ID NO: 2688268 - RNA, 17 nt, Human
uggggggacccagugca

SEQ ID NO: 2688269 - RNA, 19 nt, Human
uggggggacccagugcaga

SEQ ID NO: 2688270 - RNA, 13 nt, Human
uggggugugcugg

SEQ ID NO: 2688271 - RNA, 15 nt, Human
uggggugugcuggga

SEQ ID NO: 2688272 - RNA, 15 nt, Human
ugacccugaugaaaa

SEQ ID NO: 2688273 - RNA, 11 nt, Human
ugacccuccaa

SEQ ID NO: 2688274 - RNA, 13 nt, Human
ugacccuccaaau

SEQ ID NO: 2688275 - RNA, 14 nt, Human
ugacccuccaaaug

SEQ ID NO: 2688276 - RNA, 13 nt, Human
ugaccuacucuca

SEQ ID NO: 2688277 - RNA, 16 nt, Human
ucuugaauccuuccau

SEQ ID NO: 2688278 - RNA, 11 nt, Human
ugacucugggu

SEQ ID NO: 2688279 - RNA, 15 nt, Human
ugacucuggguccuu

SEQ ID NO: 2688280 - RNA, 13 nt, Human
ugacucugggucc

SEQ ID NO: 2688281 - RNA, 20 nt, Human
ugacucuggguccuuccuga

SEQ ID NO: 2688282 - RNA, 19 nt, Human
ugacucuggguccuuccug

SEQ ID NO: 2688283 - RNA, 18 nt, Human
ugacucuggguccuuccu

SEQ ID NO: 2688284 - RNA, 17 nt, Human
ugacucuggguccuucc

SEQ ID NO: 2688285 - RNA, 22 nt, Human
ugacgugaccggacuuuucugc

SEQ ID NO: 2688286 - RNA, 24 nt, Human
ugacgugaccggacuuuucugcaa

SEQ ID NO: 2688287 - RNA, 23 nt, Human
ugacguacaaguaguucuguauu

SEQ ID NO: 2688288 - RNA, 22 nt, Human
ugacguacaaguaguucuguau

SEQ ID NO: 2688289 - RNA, 17 nt, Human
ugacgugaccggacuuu

SEQ ID NO: 2688290 - RNA, 21 nt, Human
ugacguacaaguaguucugua

SEQ ID NO: 2688291 - RNA, 19 nt, Human
ugacguacaaguaguucug

SEQ ID NO: 2688292 - RNA, 18 nt, Human
ugacguacaaguaguucu

SEQ ID NO: 2688293 - RNA, 21 nt, Human
ugacucuggguccuuccugaa

SEQ ID NO: 2688294 - RNA, 19 nt, Human
ugacugaggcaguuugagg

SEQ ID NO: 2688295 - RNA, 18 nt, Human
ugacugaggcaguuugag

SEQ ID NO: 2688296 - RNA, 13 nt, Human
ugacugaggcagu

SEQ ID NO: 2688297 - RNA, 16 nt, Human
ugaccucucucucugg

SEQ ID NO: 2688298 - RNA, 20 nt, Human
ugaccucucucucugggacu

SEQ ID NO: 2688299 - RNA, 14 nt, Human
ugacgaugauguac

SEQ ID NO: 2688300 - RNA, 21 nt, Human
ugacgaugauguacagauucu

SEQ ID NO: 2688301 - RNA, 14 nt, Human
ugagaaaugaaaua

SEQ ID NO: 2688302 - RNA, 18 nt, Human
ugagaaaugaaauauugu

SEQ ID NO: 2688303 - RNA, 15 nt, Human
ugacuggugcugcag

SEQ ID NO: 2688304 - RNA, 15 nt, Human
ugagacagucuugcu

SEQ ID NO: 2688305 - RNA, 12 nt, Human
ugagacccuguc

SEQ ID NO: 2688306 - RNA, 20 nt, Human
ugagaucgugcuacugcacu

SEQ ID NO: 2688307 - RNA, 21 nt, Human
ugagaucgugcuacugcacuc

SEQ ID NO: 2688308 - RNA, 23 nt, Human
ugagaucgugcuacugcacucca

SEQ ID NO: 2688309 - RNA, 16 nt, Human
ugagaggcaggcauag

SEQ ID NO: 2688310 - RNA, 12 nt, Human
ugagaggcaggc

SEQ ID NO: 2688311 - RNA, 20 nt, Human
ugagaggcaaugauuguuaa

SEQ ID NO: 2688312 - RNA, 13 nt, Human
ugagaggcaggca

SEQ ID NO: 2688313 - RNA, 14 nt, Human
ugagaggcaggcau

SEQ ID NO: 2688314 - RNA, 23 nt, Human
ugagaccgugaagauacuuugua

SEQ ID NO: 2688315 - RNA, 20 nt, Human
ugagaccgugaagauacuuu

SEQ ID NO: 2688316 - RNA, 21 nt, Human
ugagcucccacuucugccaga

SEQ ID NO: 2688317 - RNA, 20 nt, Human
ugagcucccacuucugccag

SEQ ID NO: 2688318 - RNA, 19 nt, Human
ugagcucccacuucugcca

SEQ ID NO: 2688319 - RNA, 21 nt, Human
ugagcucuuccuaucccucuc

SEQ ID NO: 2688320 - RNA, 12 nt, Human
ugagcucugaaa

SEQ ID NO: 2688321 - RNA, 15 nt, Human
ugagcucugaaaucu

SEQ ID NO: 2688322 - RNA, 16 nt, Human
ugagcucugaaaucuu

SEQ ID NO: 2688323 - RNA, 17 nt, Human
ugagcucugaaaucuuc

SEQ ID NO: 2688324 - RNA, 23 nt, Human
ugagcccuacucccugcagaugc

SEQ ID NO: 2688325 - RNA, 19 nt, Human
ugagcccuacucccugcag

SEQ ID NO: 2688326 - RNA, 20 nt, Human
ugagcccuacucccugcaga

SEQ ID NO: 2688327 - RNA, 15 nt, Human
ugagccgggccccug

SEQ ID NO: 2688328 - RNA, 16 nt, Human
ugagccgggccccugg

SEQ ID NO: 2688329 - RNA, 17 nt, Human
ugagccgggccccuggg

SEQ ID NO: 2688330 - RNA, 20 nt, Human
ugagccgggccccugggcuu

SEQ ID NO: 2688331 - RNA, 19 nt, Human
ugagccgggccccugggcu

SEQ ID NO: 2688332 - RNA, 21 nt, Human
ugaggcuguggucacagcgga

SEQ ID NO: 2688333 - RNA, 13 nt, Human
ugaggcuuagaga

SEQ ID NO: 2688334 - RNA, 11 nt, Human
ugaggcugugg

SEQ ID NO: 2688335 - RNA, 13 nt, Human
ugagggaaauguu

SEQ ID NO: 2688336 - RNA, 16 nt, Human
ugagggaaauguuuug

SEQ ID NO: 2688337 - RNA, 14 nt, Human
ugagguuccucugc

SEQ ID NO: 2688338 - RNA, 15 nt, Human
ugagguuccucugcc

SEQ ID NO: 2688339 - RNA, 16 nt, Human
ugagguuccucugccu

SEQ ID NO: 2688340 - RNA, 17 nt, Human
ugagguuccucugccug

SEQ ID NO: 2688341 - RNA, 18 nt, Human
ugagguuccucugccugc

SEQ ID NO: 2688342 - RNA, 19 nt, Human
ugagguuccucugccugcc

SEQ ID NO: 2688343 - RNA, 20 nt, Human
ugagguuccucugccugccc

SEQ ID NO: 2688344 - RNA, 21 nt, Human
ugagguuccucugccugcccc

SEQ ID NO: 2688345 - RNA, 19 nt, Human
ugagguuucaaaccucccu

SEQ ID NO: 2688346 - RNA, 18 nt, Human
ugaguccuugauuucaaa

SEQ ID NO: 2688347 - RNA, 14 nt, Human
ugaguuguuuuugu

SEQ ID NO: 2688348 - RNA, 16 nt, Human
ugaguuguuuuuguau

SEQ ID NO: 2688349 - RNA, 15 nt, Human
ugaguuguuuuugua

SEQ ID NO: 2688350 - RNA, 18 nt, Human
ugaguuguuuuuguauau

SEQ ID NO: 2688351 - RNA, 17 nt, Human
ugaguuguuuuuguaua

SEQ ID NO: 2688352 - RNA, 20 nt, Human
ugaguuguuuuuguauauug

SEQ ID NO: 2688353 - RNA, 19 nt, Human
ugaguugauucagcucugc

SEQ ID NO: 2688354 - RNA, 16 nt, Human
ugaguugauucagcuc

SEQ ID NO: 2688355 - RNA, 16 nt, Human
ugauagucuuuugcuu

SEQ ID NO: 2688356 - RNA, 17 nt, Human
ugauagucuuuugcuuu

SEQ ID NO: 2688357 - RNA, 15 nt, Human
ugauagggaacuggg

SEQ ID NO: 2688358 - RNA, 16 nt, Human
ugauagcauuguaagc

SEQ ID NO: 2688359 - RNA, 14 nt, Human
ugauagcauuguaa

SEQ ID NO: 2688360 - RNA, 13 nt, Human
ugauaaauccauc

SEQ ID NO: 2688361 - RNA, 15 nt, Human
ugauaucuauaaaau

SEQ ID NO: 2688362 - RNA, 16 nt, Human
ugauaucuauaaaaua

SEQ ID NO: 2688363 - RNA, 17 nt, Human
ugauaucuauaaaauag

SEQ ID NO: 2688364 - RNA, 18 nt, Human
ugauaucuauaaaauaga

SEQ ID NO: 2688365 - RNA, 23 nt, Human
ugauaucuauaaaauagauauaa

SEQ ID NO: 2688366 - RNA, 21 nt, Human
ugauccacccaacccuaucuc

SEQ ID NO: 2688367 - RNA, 15 nt, Human
ugauccacccaaccc

SEQ ID NO: 2688368 - RNA, 16 nt, Human
ugauccacccaacccu

SEQ ID NO: 2688369 - RNA, 17 nt, Human
ugauguacagauucuuu

SEQ ID NO: 2688370 - RNA, 20 nt, Human
ugauauaugagacuuuaugu

SEQ ID NO: 2688371 - RNA, 19 nt, Human
ugccucccuuguggcagca

SEQ ID NO: 2688372 - RNA, 18 nt, Human
ugccucccuccccagugc

SEQ ID NO: 2688373 - RNA, 21 nt, Human
ugccucugugcugugugugac

SEQ ID NO: 2688374 - RNA, 17 nt, Human
ugccucugugcugugug

SEQ ID NO: 2688375 - RNA, 17 nt, Human
ugccucuuccuugaaga

SEQ ID NO: 2688376 - RNA, 21 nt, Human
ugccucuucucuacucuaggg

SEQ ID NO: 2688377 - RNA, 12 nt, Human
ugccugcagggc

SEQ ID NO: 2688378 - RNA, 13 nt, Human
ugccugcagggcc

SEQ ID NO: 2688379 - RNA, 14 nt, Human
ugccugcagggcca

SEQ ID NO: 2688380 - RNA, 16 nt, Human
ugccugcagggccaug

SEQ ID NO: 2688381 - RNA, 17 nt, Human
ugccugcagggccaugg

SEQ ID NO: 2688382 - RNA, 22 nt, Human
ugccugcagggccauggcucag

SEQ ID NO: 2688383 - RNA, 23 nt, Human
ugccugcagggccauggcucagg

SEQ ID NO: 2688384 - RNA, 19 nt, Human
ugccugggguguuaguggc

SEQ ID NO: 2688385 - RNA, 23 nt, Human
ugccugggguguuaguggcaccg

SEQ ID NO: 2688386 - RNA, 18 nt, Human
ugcccagaauacugaugg

SEQ ID NO: 2688387 - RNA, 16 nt, Human
ugcccagaauacugau

SEQ ID NO: 2688388 - RNA, 19 nt, Human
ugcccagaauacugaugga

SEQ ID NO: 2688389 - RNA, 21 nt, Human
ugcccagaauaaguuauugca

SEQ ID NO: 2688390 - RNA, 14 nt, Human
ugcccagaauacug

SEQ ID NO: 2688391 - RNA, 21 nt, Human
ugcccacuguuucucuugagc

SEQ ID NO: 2688392 - RNA, 17 nt, Human
ugcccagaauaaguuau

SEQ ID NO: 2688393 - RNA, 19 nt, Human
ugcccagaauaaguuauug

SEQ ID NO: 2688394 - RNA, 19 nt, Human
ugcccguguaguccccaac

SEQ ID NO: 2688395 - RNA, 14 nt, Human
ugcccguucuugaa

SEQ ID NO: 2688396 - RNA, 17 nt, Human
ugcccguucuugaaaug

SEQ ID NO: 2688397 - RNA, 13 nt, Human
ugccgucaccacc

SEQ ID NO: 2688398 - RNA, 14 nt, Human
ugccgucaccacca

SEQ ID NO: 2688399 - RNA, 15 nt, Human
ugccgucaccaccac

SEQ ID NO: 2688400 - RNA, 16 nt, Human
ugccgucaccaccacc

SEQ ID NO: 2688401 - RNA, 17 nt, Human
ugccgucaccaccaccc

SEQ ID NO: 2688402 - RNA, 18 nt, Human
ugccgucaccaccacccc

SEQ ID NO: 2688403 - RNA, 15 nt, Human
ugccggugagaccca

SEQ ID NO: 2688404 - RNA, 12 nt, Human
ugccgucucugg

SEQ ID NO: 2688405 - RNA, 13 nt, Human
ugccgucucugga

SEQ ID NO: 2688406 - RNA, 14 nt, Human
ugccgucucuggag

SEQ ID NO: 2688407 - RNA, 13 nt, Human
ugccguggcacca

SEQ ID NO: 2688408 - RNA, 22 nt, Human
ugccguggcaccaggcgcugcc

SEQ ID NO: 2688409 - RNA, 23 nt, Human
ugccguggggccgccgccucuuu

SEQ ID NO: 2688410 - RNA, 22 nt, Human
ugccacaucaaaccuuugagua

SEQ ID NO: 2688411 - RNA, 17 nt, Human
ugccacaguagaacugu

SEQ ID NO: 2688412 - RNA, 22 nt, Human
ugccacaguagaacugucugug

SEQ ID NO: 2688413 - RNA, 19 nt, Human
ugcauuuuaacccuauuuu

SEQ ID NO: 2688414 - RNA, 18 nt, Human
ugcauuugugcuagaaau

SEQ ID NO: 2688415 - RNA, 17 nt, Human
ugcagaugccacccuag

SEQ ID NO: 2688416 - RNA, 20 nt, Human
ugcagaugccacccuagcca

SEQ ID NO: 2688417 - RNA, 13 nt, Human
ugcaucccugaga

SEQ ID NO: 2688418 - RNA, 14 nt, Human
ugcaucccugagac

SEQ ID NO: 2688419 - RNA, 17 nt, Human
ugcagauguuagauauu

SEQ ID NO: 2688420 - RNA, 22 nt, Human
ugcaucccaaaccacgccucuu

SEQ ID NO: 2688421 - RNA, 23 nt, Human
ugcaucccaaaccacgccucuug

SEQ ID NO: 2688422 - RNA, 18 nt, Human
ugcauguagaggcuuguu

SEQ ID NO: 2688423 - RNA, 21 nt, Human
ugcauguagaggcuuguuuac

SEQ ID NO: 2688424 - RNA, 13 nt, Human
ugcauguuauguu

SEQ ID NO: 2688425 - RNA, 14 nt, Human
ugcauguuauguuu

SEQ ID NO: 2688426 - RNA, 15 nt, Human
ugcauguuauguuua

SEQ ID NO: 2688427 - RNA, 16 nt, Human
ugcauguuauguuuaa

SEQ ID NO: 2688428 - RNA, 22 nt, Human
ugcauguuauguuuaauaagcu

SEQ ID NO: 2688429 - RNA, 20 nt, Human
ugccaugaagggacccuuug

SEQ ID NO: 2688430 - RNA, 20 nt, Human
ugccaugugcuucugccacc

SEQ ID NO: 2688431 - RNA, 15 nt, Human
ugccaugugcaccuu

SEQ ID NO: 2688432 - RNA, 22 nt, Human
ugccauguggaaggcaagccag

SEQ ID NO: 2688433 - RNA, 12 nt, Human
ugcccacuguuu

SEQ ID NO: 2688434 - RNA, 19 nt, Human
ugcccacggagucgugggg

SEQ ID NO: 2688435 - RNA, 15 nt, Human
ugccauguuggccag

SEQ ID NO: 2688436 - RNA, 16 nt, Human
ugccagggccgaccag

SEQ ID NO: 2688437 - RNA, 14 nt, Human
ugccaggugagaaa

SEQ ID NO: 2688438 - RNA, 17 nt, Human
ugccaggugagaaacug

SEQ ID NO: 2688439 - RNA, 19 nt, Human
ugccacucacuaggccccc

SEQ ID NO: 2688440 - RNA, 20 nt, Human
ugccacucacuaggccccca

SEQ ID NO: 2688441 - RNA, 21 nt, Human
ugccacucacuaggcccccac

SEQ ID NO: 2688442 - RNA, 22 nt, Human
ugccacucacuaggcccccacu

SEQ ID NO: 2688443 - RNA, 13 nt, Human
ugccacucacuag

SEQ ID NO: 2688444 - RNA, 14 nt, Human
ugccacucacuagg

SEQ ID NO: 2688445 - RNA, 15 nt, Human
ugccacucacuaggc

SEQ ID NO: 2688446 - RNA, 17 nt, Human
ugccacucacuaggccc

SEQ ID NO: 2688447 - RNA, 18 nt, Human
ugccacucacuaggcccc

SEQ ID NO: 2688448 - RNA, 13 nt, Human
ugauuuuuuucca

SEQ ID NO: 2688449 - RNA, 16 nt, Human
ugcaaaaccuuuuacu

SEQ ID NO: 2688450 - RNA, 17 nt, Human
ugcaaaaccuuuuacug

SEQ ID NO: 2688451 - RNA, 18 nt, Human
ugcaaaaccuuuuacugg

SEQ ID NO: 2688452 - RNA, 19 nt, Human
ugcaaaaccuuuuacuggu

SEQ ID NO: 2688453 - RNA, 21 nt, Human
ugcaaaaacucuuugagaggg

SEQ ID NO: 2688454 - RNA, 21 nt, Human
ugcaaaaagcuagucaacagu

SEQ ID NO: 2688455 - RNA, 20 nt, Human
ugauuuuuuuuuuuaaucua

SEQ ID NO: 2688456 - RNA, 13 nt, Human
ugauuuuuacugu

SEQ ID NO: 2688457 - RNA, 13 nt, Human
ugauuuucauugc

SEQ ID NO: 2688458 - RNA, 15 nt, Human
ugauuuucauugcug

SEQ ID NO: 2688459 - RNA, 17 nt, Human
ugaugucuuuuuauuaa

SEQ ID NO: 2688460 - RNA, 22 nt, Human
ugaugugcaaaaccuuuuacug

SEQ ID NO: 2688461 - RNA, 23 nt, Human
ugaugugcaaaaccuuuuacugg

SEQ ID NO: 2688462 - RNA, 20 nt, Human
ugcaaccaggaacagcaaau

SEQ ID NO: 2688463 - RNA, 24 nt, Human
ugcaacaggguauggacuaucugu

SEQ ID NO: 2688464 - RNA, 16 nt, Human
ugcaaccaagucacac

SEQ ID NO: 2688465 - RNA, 17 nt, Human
ugcaaccaagucacacg

SEQ ID NO: 2688466 - RNA, 12 nt, Human
ugcaaccaggaa

SEQ ID NO: 2688467 - RNA, 17 nt, Human
ugcaaccaggaacagca

SEQ ID NO: 2688468 - RNA, 12 nt, Human
ugcaaaauacau

SEQ ID NO: 2688469 - RNA, 13 nt, Human
ugcaaaauacaug

SEQ ID NO: 2688470 - RNA, 14 nt, Human
ugcaaaauacauga

SEQ ID NO: 2688471 - RNA, 15 nt, Human
ugcaaaauacaugaa

SEQ ID NO: 2688472 - RNA, 20 nt, Human
ugcaacggucuccugacugg

SEQ ID NO: 2688473 - RNA, 21 nt, Human
ugcaacggucuccugacuggu

SEQ ID NO: 2688474 - RNA, 22 nt, Human
ugcaacggucuccugacuggug

SEQ ID NO: 2688475 - RNA, 14 nt, Human
ugcaaccucgcuga

SEQ ID NO: 2688476 - RNA, 14 nt, Human
ugcacaguaaaaau

SEQ ID NO: 2688477 - RNA, 15 nt, Human
ugcacuuacuugcuu

SEQ ID NO: 2688478 - RNA, 20 nt, Human
ugcacuuaaguuagccucca

SEQ ID NO: 2688479 - RNA, 19 nt, Human
ugcacuuauugaccauuuu

SEQ ID NO: 2688480 - RNA, 23 nt, Human
ugcacuuauugaccauuuuuuaa

SEQ ID NO: 2688481 - RNA, 16 nt, Human
ugcacuuacuugcuua

SEQ ID NO: 2688482 - RNA, 18 nt, Human
ugcacuuacuugcuuauu

SEQ ID NO: 2688483 - RNA, 12 nt, Human
ugcacuguuuaa

SEQ ID NO: 2688484 - RNA, 13 nt, Human
ugcacuuaaagaa

SEQ ID NO: 2688485 - RNA, 14 nt, Human
ugcacuuaaagaag

SEQ ID NO: 2688486 - RNA, 19 nt, Human
ugcagaggguacuuuaaga

SEQ ID NO: 2688487 - RNA, 15 nt, Human
ugcagagguacccug

SEQ ID NO: 2688488 - RNA, 17 nt, Human
ugcagagguacccuggg

SEQ ID NO: 2688489 - RNA, 18 nt, Human
ugcagagguacccugggu

SEQ ID NO: 2688490 - RNA, 19 nt, Human
ugcagagguacccugggug

SEQ ID NO: 2688491 - RNA, 20 nt, Human
uuuuccccuaccaauauuag

SEQ ID NO: 2688492 - RNA, 22 nt, Human
uuuucccuauuagagaagagau

SEQ ID NO: 2688493 - RNA, 18 nt, Human
uuuucccuauuagagaag

SEQ ID NO: 2688494 - RNA, 17 nt, Human
uuuucacauucuuggcu

SEQ ID NO: 2688495 - RNA, 23 nt, Human
uuuucaccauucguacauaauac

SEQ ID NO: 2688496 - RNA, 20 nt, Human
uuuucaaaauccaaaaagaa

SEQ ID NO: 2688497 - RNA, 17 nt, Human
uuuucaaaagguauuau

SEQ ID NO: 2688498 - RNA, 16 nt, Human
uuuucuacguuucuuu

SEQ ID NO: 2688499 - RNA, 15 nt, Human
uuuucccuguacagu

SEQ ID NO: 2688500 - RNA, 17 nt, Human
uuuuccuaaagagagua

SEQ ID NO: 2688501 - RNA, 15 nt, Human
uuuuccccuuucugu

SEQ ID NO: 2688502 - RNA, 14 nt, Human
uuuuauauuuccuu

SEQ ID NO: 2688503 - RNA, 20 nt, Human
uuuuauauuuccuuuaugug

SEQ ID NO: 2688504 - RNA, 21 nt, Human
uuuuauauuuccuuuauguga

SEQ ID NO: 2688505 - RNA, 22 nt, Human
uuuuauauuuccuuuaugugaa

SEQ ID NO: 2688506 - RNA, 23 nt, Human
uuuuauauuuccuuuaugugaau

SEQ ID NO: 2688507 - RNA, 17 nt, Human
uuuuauagccuggacug

SEQ ID NO: 2688508 - RNA, 20 nt, Human
uuuuauagccuggacugcua

SEQ ID NO: 2688509 - RNA, 14 nt, Human
uuuucaaaagaaag

SEQ ID NO: 2688510 - RNA, 23 nt, Human
uuuuaucguuuuuguauuuucau

SEQ ID NO: 2688511 - RNA, 22 nt, Human
uuuuaucuauucugagaaaaca

SEQ ID NO: 2688512 - RNA, 15 nt, Human
uuuuaucuguuuccu

SEQ ID NO: 2688513 - RNA, 18 nt, Human
uuuuaaagguggauuuug

SEQ ID NO: 2688514 - RNA, 18 nt, Human
uuuuaaagaaaagaugaa

SEQ ID NO: 2688515 - RNA, 15 nt, Human
uuuguuguaaaacaa

SEQ ID NO: 2688516 - RNA, 16 nt, Human
uuuuaaagguggauuu

SEQ ID NO: 2688517 - RNA, 11 nt, Human
uuuuaaagaaa

SEQ ID NO: 2688518 - RNA, 14 nt, Human
uuuuaaaguugaua

SEQ ID NO: 2688519 - RNA, 13 nt, Human
uuuuaaagugcaa

SEQ ID NO: 2688520 - RNA, 14 nt, Human
uuuuaaagugcaaa

SEQ ID NO: 2688521 - RNA, 15 nt, Human
uuuuacaagauguau

SEQ ID NO: 2688522 - RNA, 14 nt, Human
uuuuauacaaaaua

SEQ ID NO: 2688523 - RNA, 14 nt, Human
uuuuauacaaaccu

SEQ ID NO: 2688524 - RNA, 19 nt, Human
uuuuaccuagcuaauuauu

SEQ ID NO: 2688525 - RNA, 15 nt, Human
uuuuacacagaaaca

SEQ ID NO: 2688526 - RNA, 17 nt, Human
uuuuacacagaaacacu

SEQ ID NO: 2688527 - RNA, 18 nt, Human
uuuuacacagaaacacug

SEQ ID NO: 2688528 - RNA, 21 nt, Human
uuuuacacagaaacacugccu

SEQ ID NO: 2688529 - RNA, 22 nt, Human
uuuuacacagaaacacugccuu

SEQ ID NO: 2688530 - RNA, 18 nt, Human
uuugcacugaggauauuc

SEQ ID NO: 2688531 - RNA, 14 nt, Human
uuugcacuaaauca

SEQ ID NO: 2688532 - RNA, 19 nt, Human
uuugcacuaaaucagagac

SEQ ID NO: 2688533 - RNA, 20 nt, Human
uuugcacuaaaucagagaca

SEQ ID NO: 2688534 - RNA, 21 nt, Human
uuugcacuaaaucagagacaa

SEQ ID NO: 2688535 - RNA, 13 nt, Human
uuuguauuuucau

SEQ ID NO: 2688536 - RNA, 14 nt, Human
uuuguauuuucaug

SEQ ID NO: 2688537 - RNA, 15 nt, Human
uuuguauuuucauga

SEQ ID NO: 2688538 - RNA, 21 nt, Human
uuuguauuuucaugaaaauac

SEQ ID NO: 2688539 - RNA, 22 nt, Human
uuuguauuguccuauuaguguu

SEQ ID NO: 2688540 - RNA, 15 nt, Human
uuuguauuguccuau

SEQ ID NO: 2688541 - RNA, 13 nt, Human
uuuguauuguccu

SEQ ID NO: 2688542 - RNA, 14 nt, Human
uuuguauuguauau

SEQ ID NO: 2688543 - RNA, 14 nt, Human
uuuuaaaauagaaa

SEQ ID NO: 2688544 - RNA, 16 nt, Human
uuuuaaaauagaaauu

SEQ ID NO: 2688545 - RNA, 18 nt, Human
uuuuaaaauagaaauuuu

SEQ ID NO: 2688546 - RNA, 21 nt, Human
uuuuaaaauagaaauuuugua

SEQ ID NO: 2688547 - RNA, 23 nt, Human
uuuuaaaauagaaauuuuguaag

SEQ ID NO: 2688548 - RNA, 12 nt, Human
uuuguuguaaaa

SEQ ID NO: 2688549 - RNA, 18 nt, Human
uuuguuguacuuaaaugg

SEQ ID NO: 2688550 - RNA, 17 nt, Human
uuuuaaaauaaggauuu

SEQ ID NO: 2688551 - RNA, 20 nt, Human
uuuuaaaaucugagggaaau

SEQ ID NO: 2688552 - RNA, 21 nt, Human
uuuuaaaaucugagggaaaug

SEQ ID NO: 2688553 - RNA, 23 nt, Human
uuuuaaaaucugagggaaauguu

SEQ ID NO: 2688554 - RNA, 17 nt, Human
uuuguuaggauuuucac

SEQ ID NO: 2688555 - RNA, 22 nt, Human
uuuguuaggauuuucacauucu

SEQ ID NO: 2688556 - RNA, 17 nt, Human
uuuguguguugucucuu

SEQ ID NO: 2688557 - RNA, 15 nt, Human
uuuguugucagcuga

SEQ ID NO: 2688558 - RNA, 16 nt, Human
uuuguugcaagaugug

SEQ ID NO: 2688559 - RNA, 18 nt, Human
uuuguugcaagaugugaa

SEQ ID NO: 2688560 - RNA, 19 nt, Human
uuuguugcaagaugugaau

SEQ ID NO: 2688561 - RNA, 12 nt, Human
uuuuuuaaagaa

SEQ ID NO: 2688562 - RNA, 13 nt, Human
uuuuuuaaagaaa

SEQ ID NO: 2688563 - RNA, 14 nt, Human
uuuuuuaaaauaga

SEQ ID NO: 2688564 - RNA, 12 nt, Human
uuuuuuaagcuu

SEQ ID NO: 2688565 - RNA, 15 nt, Human
uuuuuuaagcuucag

SEQ ID NO: 2688566 - RNA, 23 nt, Human
uuuuuuaagcuucaguugcuugu

SEQ ID NO: 2688567 - RNA, 12 nt, Human
uuuuuuauuucu

SEQ ID NO: 2688568 - RNA, 17 nt, Human
uuuuuuauuucuacugu

SEQ ID NO: 2688569 - RNA, 18 nt, Human
uuuuuuaaucuacugcau

SEQ ID NO: 2688570 - RNA, 18 nt, Human
uuuuuuaaguucuuauga

SEQ ID NO: 2688571 - RNA, 12 nt, Human
uuuuuuaaucua

SEQ ID NO: 2688572 - RNA, 13 nt, Human
uuuuuuguuuguu

SEQ ID NO: 2688573 - RNA, 14 nt, Human
uuuuuuuguacgac

SEQ ID NO: 2688574 - RNA, 14 nt, Human
uuuuuuuguuauua

SEQ ID NO: 2688575 - RNA, 12 nt, Human
uuuuuuucuauu

SEQ ID NO: 2688576 - RNA, 13 nt, Human
uuuuuuuguaaua

SEQ ID NO: 2688577 - RNA, 14 nt, Human
uuuuuuucuaagag

SEQ ID NO: 2688578 - RNA, 13 nt, Human
uuuuuuuccuuuu

SEQ ID NO: 2688579 - RNA, 13 nt, Human
uuuuuuuuuuggu

SEQ ID NO: 2688580 - RNA, 17 nt, Human
uuuugaacucuucucau

SEQ ID NO: 2688581 - RNA, 22 nt, Human
uuuuuaaucuacugcauuuagg

SEQ ID NO: 2688582 - RNA, 13 nt, Human
uuuuuaaugcuau

SEQ ID NO: 2688583 - RNA, 19 nt, Human
uuuuucacucuaagucaug

SEQ ID NO: 2688584 - RNA, 13 nt, Human
uuuugaagcauag

SEQ ID NO: 2688585 - RNA, 13 nt, Human
uuuuucauaaaca

SEQ ID NO: 2688586 - RNA, 18 nt, Human
uuuuucauaaacaaguuc

SEQ ID NO: 2688587 - RNA, 14 nt, Human
uuuuuuuuaaacua

SEQ ID NO: 2688588 - RNA, 12 nt, Human
uuuaacauuauu

SEQ ID NO: 2688589 - RNA, 16 nt, Human
uuuaaccuuguauaaa

SEQ ID NO: 2688590 - RNA, 12 nt, Human
uuguuuggagac

SEQ ID NO: 2688591 - RNA, 21 nt, Human
uuguuuggagacguuuauaaa

SEQ ID NO: 2688592 - RNA, 21 nt, Human
uuuaacagaaauuguauauug

SEQ ID NO: 2688593 - RNA, 13 nt, Human
uuuaacagaaauu

SEQ ID NO: 2688594 - RNA, 14 nt, Human
uuuaacagaaauug

SEQ ID NO: 2688595 - RNA, 16 nt, Human
uuuaacagaaauugua

SEQ ID NO: 2688596 - RNA, 19 nt, Human
uuuaacagaaauuguauau

SEQ ID NO: 2688597 - RNA, 16 nt, Human
uuuaacuuaacugaaa

SEQ ID NO: 2688598 - RNA, 20 nt, Human
uuuaauaagcuacuagcaaa

SEQ ID NO: 2688599 - RNA, 19 nt, Human
uuuaaguucuuaugaggag

SEQ ID NO: 2688600 - RNA, 18 nt, Human
uuuaaguuuugacaagcu

SEQ ID NO: 2688601 - RNA, 13 nt, Human
uuuaaguuuugac

SEQ ID NO: 2688602 - RNA, 17 nt, Human
uuuaagugucucacuaa

SEQ ID NO: 2688603 - RNA, 23 nt, Human
uuuacagcuuucaugauuagcaa

SEQ ID NO: 2688604 - RNA, 20 nt, Human
uuuacagcuuucaugauuag

SEQ ID NO: 2688605 - RNA, 22 nt, Human
uuuacaguaucuacuugcaugu

SEQ ID NO: 2688606 - RNA, 13 nt, Human
uuuacagaaaaag

SEQ ID NO: 2688607 - RNA, 13 nt, Human
uuuacagaaaugg

SEQ ID NO: 2688608 - RNA, 12 nt, Human
uuuacagaaaaa

SEQ ID NO: 2688609 - RNA, 11 nt, Human
uuuacagaaaa

SEQ ID NO: 2688610 - RNA, 12 nt, Human
uuuacacagaaa

SEQ ID NO: 2688611 - RNA, 14 nt, Human
uuuacacagaaaca

SEQ ID NO: 2688612 - RNA, 15 nt, Human
uuuacacagaaacac

SEQ ID NO: 2688613 - RNA, 19 nt, Human
uuuacacagaaacacugcc

SEQ ID NO: 2688614 - RNA, 20 nt, Human
uuuacacagaaacacugccu

SEQ ID NO: 2688615 - RNA, 22 nt, Human
uuuagacaagagaugggaauga

SEQ ID NO: 2688616 - RNA, 21 nt, Human
uuuagaauugaagguuuuuga

SEQ ID NO: 2688617 - RNA, 18 nt, Human
uuuagaauugaagguuuu

SEQ ID NO: 2688618 - RNA, 17 nt, Human
uuuagaauugaagguuu

SEQ ID NO: 2688619 - RNA, 15 nt, Human
uuuagaauugaaggu

SEQ ID NO: 2688620 - RNA, 13 nt, Human
uuuagaauugaag

SEQ ID NO: 2688621 - RNA, 11 nt, Human
uuuagaauuga

SEQ ID NO: 2688622 - RNA, 15 nt, Human
uuuacuuguuuugga

SEQ ID NO: 2688623 - RNA, 18 nt, Human
uuuauaauagcaacuuuu

SEQ ID NO: 2688624 - RNA, 15 nt, Human
uuuauaauuguacaa

SEQ ID NO: 2688625 - RNA, 17 nt, Human
uuuauaauuguacaaaa

SEQ ID NO: 2688626 - RNA, 20 nt, Human
uuuauaauuguacaaaauua

SEQ ID NO: 2688627 - RNA, 14 nt, Human
uuuauaauaaaaau

SEQ ID NO: 2688628 - RNA, 16 nt, Human
uuuauaauaaaaauau

SEQ ID NO: 2688629 - RNA, 19 nt, Human
uuuauaauaaaaauauauu

SEQ ID NO: 2688630 - RNA, 13 nt, Human
uuuauacaaaaua

SEQ ID NO: 2688631 - RNA, 12 nt, Human
uuuauacaaaau

SEQ ID NO: 2688632 - RNA, 15 nt, Human
uuuauuuagggaaca

SEQ ID NO: 2688633 - RNA, 22 nt, Human
uuucaagcagucgugccugugu

SEQ ID NO: 2688634 - RNA, 23 nt, Human
uuucaagcagucgugccuguguc

SEQ ID NO: 2688635 - RNA, 13 nt, Human
uuuagaauuaaaa

SEQ ID NO: 2688636 - RNA, 21 nt, Human
uuucaagagucuaauagucuu

SEQ ID NO: 2688637 - RNA, 22 nt, Human
uuucaagagucuaauagucuuu

SEQ ID NO: 2688638 - RNA, 19 nt, Human
uuuauuuaaauuacaauuu

SEQ ID NO: 2688639 - RNA, 20 nt, Human
uuuauuuacagaugaaugua

SEQ ID NO: 2688640 - RNA, 16 nt, Human
uuuauugacucuugag

SEQ ID NO: 2688641 - RNA, 19 nt, Human
uuucauuuaagggaaagaa

SEQ ID NO: 2688642 - RNA, 23 nt, Human
uuucauuuaagggaaagaaaaug

SEQ ID NO: 2688643 - RNA, 21 nt, Human
uuucauuuacucuaaaaacug

SEQ ID NO: 2688644 - RNA, 16 nt, Human
uuucaaguuguaaaua

SEQ ID NO: 2688645 - RNA, 15 nt, Human
uuucaauagcacaua

SEQ ID NO: 2688646 - RNA, 21 nt, Human
uuguuuaaaaaccgaauaaau

SEQ ID NO: 2688647 - RNA, 16 nt, Human
uuguuucguggggagg

SEQ ID NO: 2688648 - RNA, 13 nt, Human
uuguuugccagga

SEQ ID NO: 2688649 - RNA, 12 nt, Human
uuguuaucaaaa

SEQ ID NO: 2688650 - RNA, 14 nt, Human
uuguuaucaaaaua

SEQ ID NO: 2688651 - RNA, 16 nt, Human
uuguuaucaaaauagu

SEQ ID NO: 2688652 - RNA, 16 nt, Human
uugugcucagagacac

SEQ ID NO: 2688653 - RNA, 14 nt, Human
uuguuacuucugag

SEQ ID NO: 2688654 - RNA, 14 nt, Human
uuguuaagaaaaau

SEQ ID NO: 2688655 - RNA, 13 nt, Human
uuguuaauacaag

SEQ ID NO: 2688656 - RNA, 15 nt, Human
uuguuaauacaaggu

SEQ ID NO: 2688657 - RNA, 18 nt, Human
uuguuaauacaagguaua

SEQ ID NO: 2688658 - RNA, 15 nt, Human
uuguguuuuuuaaga

SEQ ID NO: 2688659 - RNA, 16 nt, Human
uuguguuuuuuaagau

SEQ ID NO: 2688660 - RNA, 17 nt, Human
uuguguuuuuuaagaua

SEQ ID NO: 2688661 - RNA, 21 nt, Human
uuguguuuuuuaagauagugu

SEQ ID NO: 2688662 - RNA, 13 nt, Human
uugugccuggggu

SEQ ID NO: 2688663 - RNA, 21 nt, Human
uugugccagaggaauccuggc

SEQ ID NO: 2688664 - RNA, 12 nt, Human
uugugccaucug

SEQ ID NO: 2688665 - RNA, 13 nt, Human
uugugccaucugu

SEQ ID NO: 2688666 - RNA, 13 nt, Human
uugugccagagga

SEQ ID NO: 2688667 - RNA, 16 nt, Human
uugugcuucacaguag

SEQ ID NO: 2688668 - RNA, 21 nt, Human
uugugcuucacaguagagcca

SEQ ID NO: 2688669 - RNA, 16 nt, Human
uugugcuagaaauuuu

SEQ ID NO: 2688670 - RNA, 18 nt, Human
uugugcuagaaauuuuca

SEQ ID NO: 2688671 - RNA, 12 nt, Human
uugugcacuguu

SEQ ID NO: 2688672 - RNA, 20 nt, Human
uuguguuccuacagacacuu

SEQ ID NO: 2688673 - RNA, 15 nt, Human
uugucuuaaaaagug

SEQ ID NO: 2688674 - RNA, 16 nt, Human
uugucugauuucuuag

SEQ ID NO: 2688675 - RNA, 21 nt, Human
uugucuggcaaggacuuugua

SEQ ID NO: 2688676 - RNA, 17 nt, Human
uugucugguuaaaaaau

SEQ ID NO: 2688677 - RNA, 18 nt, Human
uugucugguuaaaaaaua

SEQ ID NO: 2688678 - RNA, 20 nt, Human
uugucuggcaaggacuuugu

SEQ ID NO: 2688679 - RNA, 14 nt, Human
uugugauuucuuua

SEQ ID NO: 2688680 - RNA, 23 nt, Human
uugugauuucuuuaaaagaauga

SEQ ID NO: 2688681 - RNA, 16 nt, Human
uuguauuaaagacaga

SEQ ID NO: 2688682 - RNA, 14 nt, Human
uuguauuaaagaca

SEQ ID NO: 2688683 - RNA, 14 nt, Human
uuguacugaauuuu

SEQ ID NO: 2688684 - RNA, 21 nt, Human
uuguacugaauuuuuuuguaa

SEQ ID NO: 2688685 - RNA, 22 nt, Human
uuguacugaauuuuuuuguaau

SEQ ID NO: 2688686 - RNA, 19 nt, Human
uuguacauacgauuuaagg

SEQ ID NO: 2688687 - RNA, 22 nt, Human
uuguacauacgauuuaagguau

SEQ ID NO: 2688688 - RNA, 23 nt, Human
uuguacauacgauuuaagguauu

SEQ ID NO: 2688689 - RNA, 20 nt, Human
uuguacauguaacauuaaag

SEQ ID NO: 2688690 - RNA, 21 nt, Human
uuguacgacgucagauguuua

SEQ ID NO: 2688691 - RNA, 18 nt, Human
uuguacgacgucagaugu

SEQ ID NO: 2688692 - RNA, 12 nt, Human
uugguauauuuu

SEQ ID NO: 2688693 - RNA, 20 nt, Human
uugggugucuccuuaagcug

SEQ ID NO: 2688694 - RNA, 13 nt, Human
uuguaaaagaaau

SEQ ID NO: 2688695 - RNA, 15 nt, Human
uuguaaaagaaauca

SEQ ID NO: 2688696 - RNA, 18 nt, Human
uuguaaaagaaaucaugu

SEQ ID NO: 2688697 - RNA, 22 nt, Human
uuguaaaagaaaucauguccau

SEQ ID NO: 2688698 - RNA, 14 nt, Human
uuguaaauacacau

SEQ ID NO: 2688699 - RNA, 18 nt, Human
uuguaaaacaaaauuuga

SEQ ID NO: 2688700 - RNA, 18 nt, Human
uuguaaauaggauuuuua

SEQ ID NO: 2688701 - RNA, 14 nt, Human
uuguaaauucugau

SEQ ID NO: 2688702 - RNA, 13 nt, Human
uuguaaauucuga

SEQ ID NO: 2688703 - RNA, 12 nt, Human
uuguaaauucug

SEQ ID NO: 2688704 - RNA, 15 nt, Human
uuguaaauucugauu

SEQ ID NO: 2688705 - RNA, 11 nt, Human
uuauuaauauu

SEQ ID NO: 2688706 - RNA, 18 nt, Human
uuauuaauauuuaacauu

SEQ ID NO: 2688707 - RNA, 12 nt, Human
uuauuaaucacu

SEQ ID NO: 2688708 - RNA, 13 nt, Human
uuauuaaucacug

SEQ ID NO: 2688709 - RNA, 14 nt, Human
uuauuacuuccaug

SEQ ID NO: 2688710 - RNA, 15 nt, Human
uuauuacuuccauga

SEQ ID NO: 2688711 - RNA, 16 nt, Human
uuauuacuuccaugaa

SEQ ID NO: 2688712 - RNA, 17 nt, Human
uuauuacuuccaugaau

SEQ ID NO: 2688713 - RNA, 18 nt, Human
uuauuacuuccaugaauu

SEQ ID NO: 2688714 - RNA, 22 nt, Human
uuauuacccccuccuucagaca

SEQ ID NO: 2688715 - RNA, 20 nt, Human
uuauuacccccuccuucaga

SEQ ID NO: 2688716 - RNA, 19 nt, Human
uuauuacccccuccuucag

SEQ ID NO: 2688717 - RNA, 13 nt, Human
uuauuacauguaa

SEQ ID NO: 2688718 - RNA, 15 nt, Human
uuauuacauguaauu

SEQ ID NO: 2688719 - RNA, 18 nt, Human
uuauuacauguaauuuga

SEQ ID NO: 2688720 - RNA, 22 nt, Human
uuauguuuuuuaaaauauuuau

SEQ ID NO: 2688721 - RNA, 21 nt, Human
uuauuaaauuuuuuuguauga

SEQ ID NO: 2688722 - RNA, 20 nt, Human
uuauuaaauuuuuuuguaug

SEQ ID NO: 2688723 - RNA, 22 nt, Human
uuauuaaauuuuuuuguaugaa

SEQ ID NO: 2688724 - RNA, 17 nt, Human
uuauuaacuuaauaauc

SEQ ID NO: 2688725 - RNA, 14 nt, Human
uuauuaacuuaaua

SEQ ID NO: 2688726 - RNA, 19 nt, Human
uuauuaacuuaauaaucaa

SEQ ID NO: 2688727 - RNA, 14 nt, Human
uuauguuuaauaag

SEQ ID NO: 2688728 - RNA, 19 nt, Human
uuauguuguuuauaauaaa

SEQ ID NO: 2688729 - RNA, 16 nt, Human
uuauggaugauuuaag

SEQ ID NO: 2688730 - RNA, 17 nt, Human
uuauggaugauuuaagu

SEQ ID NO: 2688731 - RNA, 18 nt, Human
uuauauuuaugugucugu

SEQ ID NO: 2688732 - RNA, 15 nt, Human
uuaugauuguuaugu

SEQ ID NO: 2688733 - RNA, 20 nt, Human
uuaucuauucugagaaaaca

SEQ ID NO: 2688734 - RNA, 21 nt, Human
uuaucuccacaaccucuuccc

SEQ ID NO: 2688735 - RNA, 12 nt, Human
uuaucuguuucc

SEQ ID NO: 2688736 - RNA, 22 nt, Human
uuaucuguuuccugacauuguc

SEQ ID NO: 2688737 - RNA, 15 nt, Human
uuaucuuacaauauu

SEQ ID NO: 2688738 - RNA, 20 nt, Human
uuaucuuacaauauugauug

SEQ ID NO: 2688739 - RNA, 15 nt, Human
uuaucguuuuuguau

SEQ ID NO: 2688740 - RNA, 22 nt, Human
uuaucguuuuuguauuuucaug

SEQ ID NO: 2688741 - RNA, 15 nt, Human
uuauauuuauugacu

SEQ ID NO: 2688742 - RNA, 19 nt, Human
uuauauuuauauuucaggu

SEQ ID NO: 2688743 - RNA, 20 nt, Human
uuauauuuauugacucuuga

SEQ ID NO: 2688744 - RNA, 12 nt, Human
uuauauuuccuu

SEQ ID NO: 2688745 - RNA, 13 nt, Human
uuauauuuccuuu

SEQ ID NO: 2688746 - RNA, 14 nt, Human
uuauauuuccuuua

SEQ ID NO: 2688747 - RNA, 16 nt, Human
uuauauuuccuuuaug

SEQ ID NO: 2688748 - RNA, 20 nt, Human
uuauauuuccuuuaugugaa

SEQ ID NO: 2688749 - RNA, 21 nt, Human
uuauauuuccuuuaugugaau

SEQ ID NO: 2688750 - RNA, 22 nt, Human
uuauauuuccuuuaugugaauu

SEQ ID NO: 2688751 - RNA, 17 nt, Human
uuauaagugaagugaua

SEQ ID NO: 2688752 - RNA, 17 nt, Human
uuauaaggaaauuuuac

SEQ ID NO: 2688753 - RNA, 18 nt, Human
uuauaagaagaaguucau

SEQ ID NO: 2688754 - RNA, 21 nt, Human
uuauaagaagaaguucauguc

SEQ ID NO: 2688755 - RNA, 12 nt, Human
uuaguggcaccg

SEQ ID NO: 2688756 - RNA, 13 nt, Human
uuaguggcaccgc

SEQ ID NO: 2688757 - RNA, 15 nt, Human
ugugaaaagaaaaau

SEQ ID NO: 2688758 - RNA, 13 nt, Human
ugugaaaagaaaa

SEQ ID NO: 2688759 - RNA, 17 nt, Human
ugugaaaagaaaaauga

SEQ ID NO: 2688760 - RNA, 16 nt, Human
ugucuuuggaggugcu

SEQ ID NO: 2688761 - RNA, 11 nt, Human
uuauaauagca

SEQ ID NO: 2688762 - RNA, 15 nt, Human
uuauaauaaauauau

SEQ ID NO: 2688763 - RNA, 20 nt, Human
uuauaauaaauauauacauu

SEQ ID NO: 2688764 - RNA, 18 nt, Human
uuauaaucuuauaauugu

SEQ ID NO: 2688765 - RNA, 16 nt, Human
uuauaauccuuaaauc

SEQ ID NO: 2688766 - RNA, 24 nt, Human
uuauaauccuuaaaucuuaauguu

SEQ ID NO: 2688767 - RNA, 20 nt, Human
uuauaauuguacaaaauuaa

SEQ ID NO: 2688768 - RNA, 20 nt, Human
uuauaauuuuuuuuaaaaua

SEQ ID NO: 2688769 - RNA, 19 nt, Human
uuauacaaaauaagaacga

SEQ ID NO: 2688770 - RNA, 20 nt, Human
uuauacaaaccuaccaaaau

SEQ ID NO: 2688771 - RNA, 21 nt, Human
uuauacaaaccuaccaaaaug

SEQ ID NO: 2688772 - RNA, 14 nt, Human
uuauaucaugcaaa

SEQ ID NO: 2688773 - RNA, 16 nt, Human
uuauaucaugcaaaau

SEQ ID NO: 2688774 - RNA, 20 nt, Human
uuauaucaugcaaaauaugu

SEQ ID NO: 2688775 - RNA, 16 nt, Human
uuauaucuggccucug

SEQ ID NO: 2688776 - RNA, 13 nt, Human
uuauaugaacaua

SEQ ID NO: 2688777 - RNA, 17 nt, Human
uuauaugaacauacaaa

SEQ ID NO: 2688778 - RNA, 15 nt, Human
uuauaugaacauaca

SEQ ID NO: 2688779 - RNA, 21 nt, Human
uuauaugaacauacaaaugca

SEQ ID NO: 2688780 - RNA, 20 nt, Human
uuauaugcuuuauuaauguu

SEQ ID NO: 2688781 - RNA, 20 nt, Human
uuauauguauguguuuagaa

SEQ ID NO: 2688782 - RNA, 19 nt, Human
uuauauguauguguuuaga

SEQ ID NO: 2688783 - RNA, 21 nt, Human
uuauauguauguguuuagaau

SEQ ID NO: 2688784 - RNA, 12 nt, Human
uuauauguaugu

SEQ ID NO: 2688785 - RNA, 14 nt, Human
uuauauguacuguu

SEQ ID NO: 2688786 - RNA, 17 nt, Human
uuauauguauguguuua

SEQ ID NO: 2688787 - RNA, 16 nt, Human
uuauauguauguguuu

SEQ ID NO: 2688788 - RNA, 15 nt, Human
uuauauguauguguu

SEQ ID NO: 2688789 - RNA, 14 nt, Human
uuauauguaugugu

SEQ ID NO: 2688790 - RNA, 19 nt, Human
uuauauuacugacauuucu

SEQ ID NO: 2688791 - RNA, 17 nt, Human
uucacggaagagccuug

SEQ ID NO: 2688792 - RNA, 13 nt, Human
uucacggaagagc

SEQ ID NO: 2688793 - RNA, 15 nt, Human
uucaauauauugaac

SEQ ID NO: 2688794 - RNA, 17 nt, Human
uucaauauauugaacuu

SEQ ID NO: 2688795 - RNA, 18 nt, Human
uucaauauauugaacuuu

SEQ ID NO: 2688796 - RNA, 17 nt, Human
uucaauagcacauaugg

SEQ ID NO: 2688797 - RNA, 20 nt, Human
uuauuugaacaaugaaguug

SEQ ID NO: 2688798 - RNA, 22 nt, Human
uuauuagccagguaaugugaau

SEQ ID NO: 2688799 - RNA, 12 nt, Human
uuauuagauguu

SEQ ID NO: 2688800 - RNA, 13 nt, Human
uuauuugcauguu

SEQ ID NO: 2688801 - RNA, 14 nt, Human
uuauuugcauguua

SEQ ID NO: 2688802 - RNA, 15 nt, Human
uuauuugcauguuau

SEQ ID NO: 2688803 - RNA, 16 nt, Human
uuauuugcauguuaug

SEQ ID NO: 2688804 - RNA, 19 nt, Human
uuauuugcauguuauguuu

SEQ ID NO: 2688805 - RNA, 21 nt, Human
uuauuugcauguuauguuuaa

SEQ ID NO: 2688806 - RNA, 13 nt, Human
uuauuuguaaauu

SEQ ID NO: 2688807 - RNA, 15 nt, Human
uuauuuguaaauuua

SEQ ID NO: 2688808 - RNA, 19 nt, Human
uuauuuguaaauuuagugu

SEQ ID NO: 2688809 - RNA, 19 nt, Human
uuauuugauuauuuaagac

SEQ ID NO: 2688810 - RNA, 20 nt, Human
uuauuugauuauuuaagacu

SEQ ID NO: 2688811 - RNA, 14 nt, Human
uuauuuuguguaaa

SEQ ID NO: 2688812 - RNA, 21 nt, Human
uuauuuuggagauuauaauaa

SEQ ID NO: 2688813 - RNA, 20 nt, Human
uuccagacuuccuugagaca

SEQ ID NO: 2688814 - RNA, 18 nt, Human
uuccagaucacugccaca

SEQ ID NO: 2688815 - RNA, 16 nt, Human
uucaucugucuauauu

SEQ ID NO: 2688816 - RNA, 14 nt, Human
uucaguucuuugga

SEQ ID NO: 2688817 - RNA, 20 nt, Human
uucaguucuuuggauucuaa

SEQ ID NO: 2688818 - RNA, 15 nt, Human
uucauaaacaaguuc

SEQ ID NO: 2688819 - RNA, 22 nt, Human
uucacccuuauagucuaagacu

SEQ ID NO: 2688820 - RNA, 11 nt, Human
uucauaaacaa

SEQ ID NO: 2688821 - RNA, 14 nt, Human
uucauaaauuauuu

SEQ ID NO: 2688822 - RNA, 20 nt, Human
uucauaaauuauuugauuau

SEQ ID NO: 2688823 - RNA, 21 nt, Human
uucagcugguugagguuucaa

SEQ ID NO: 2688824 - RNA, 14 nt, Human
uuccuuuaugugaa

SEQ ID NO: 2688825 - RNA, 15 nt, Human
uuccuuuaugugaau

SEQ ID NO: 2688826 - RNA, 19 nt, Human
uuccuuuaugugaauuuuu

SEQ ID NO: 2688827 - RNA, 20 nt, Human
uuccuuguagcgacuaaacu

SEQ ID NO: 2688828 - RNA, 21 nt, Human
uuccuugaguugauucagcuc

SEQ ID NO: 2688829 - RNA, 17 nt, Human
uuccuggaauugccagc

SEQ ID NO: 2688830 - RNA, 18 nt, Human
uuccuggaauugccagcu

SEQ ID NO: 2688831 - RNA, 22 nt, Human
uuccuggaauugccagcugaca

SEQ ID NO: 2688832 - RNA, 15 nt, Human
uuccugcguccuccu

SEQ ID NO: 2688833 - RNA, 19 nt, Human
uuccugcguccuccucacc

SEQ ID NO: 2688834 - RNA, 16 nt, Human
uuccugcguccuccuc

SEQ ID NO: 2688835 - RNA, 17 nt, Human
uuccugcguccuccuca

SEQ ID NO: 2688836 - RNA, 15 nt, Human
uuccugacauugucu

SEQ ID NO: 2688837 - RNA, 18 nt, Human
uucguacauaauacugaa

SEQ ID NO: 2688838 - RNA, 13 nt, Human
uucguggggaggu

SEQ ID NO: 2688839 - RNA, 22 nt, Human
uucuaauuaaccuuacuaauua

SEQ ID NO: 2688840 - RNA, 15 nt, Human
uucuacagugguuuu

SEQ ID NO: 2688841 - RNA, 21 nt, Human
uucuacagugguuuuauacug

SEQ ID NO: 2688842 - RNA, 21 nt, Human
uucuaccacacagcagcaguu

SEQ ID NO: 2688843 - RNA, 19 nt, Human
uucuaccaaggucuucuua

SEQ ID NO: 2688844 - RNA, 17 nt, Human
uucuacugucaaaugau

SEQ ID NO: 2688845 - RNA, 19 nt, Human
uucuacugucaaaugaugu

SEQ ID NO: 2688846 - RNA, 23 nt, Human
uucuacugucaaaugaugugcaa

SEQ ID NO: 2688847 - RNA, 20 nt, Human
uucuauaggaacauaugaaa

SEQ ID NO: 2688848 - RNA, 19 nt, Human
uucuauagcaucacuuaaa

SEQ ID NO: 2688849 - RNA, 22 nt, Human
uucuauagcaucacuuaaaaca

SEQ ID NO: 2688850 - RNA, 20 nt, Human
uucuauagcaucacuuaaaa

SEQ ID NO: 2688851 - RNA, 13 nt, Human
uucuacgccaggg

SEQ ID NO: 2688852 - RNA, 20 nt, Human
uucuaccggcuuugccaugu

SEQ ID NO: 2688853 - RNA, 13 nt, Human
uucuacguuucuu

SEQ ID NO: 2688854 - RNA, 14 nt, Human
uucuacguuucuuu

SEQ ID NO: 2688855 - RNA, 13 nt, Human
uucuaccugcccu

SEQ ID NO: 2688856 - RNA, 23 nt, Human
uucugauucuggcuuuaagccuu

SEQ ID NO: 2688857 - RNA, 17 nt, Human
uucugcaacaagcaugc

SEQ ID NO: 2688858 - RNA, 13 nt, Human
uucugauuucuuu

SEQ ID NO: 2688859 - RNA, 20 nt, Human
uucugauuucuuuucaccau

SEQ ID NO: 2688860 - RNA, 14 nt, Human
uucuauccucugua

SEQ ID NO: 2688861 - RNA, 15 nt, Human
uucuauccucuguaa

SEQ ID NO: 2688862 - RNA, 20 nt, Human
uucucauugacuuuuauaaa

SEQ ID NO: 2688863 - RNA, 21 nt, Human
uucucauuacuuguugccuau

SEQ ID NO: 2688864 - RNA, 15 nt, Human
uucucauuacuuguu

SEQ ID NO: 2688865 - RNA, 21 nt, Human
uucuccaccucccacaaagga

SEQ ID NO: 2688866 - RNA, 14 nt, Human
uucuccacugugca

SEQ ID NO: 2688867 - RNA, 18 nt, Human
uucuccacugugcacacc

SEQ ID NO: 2688868 - RNA, 17 nt, Human
uucucugacuucugccu

SEQ ID NO: 2688869 - RNA, 14 nt, Human
uugacaacugugac

SEQ ID NO: 2688870 - RNA, 14 nt, Human
uugaauuuuucucu

SEQ ID NO: 2688871 - RNA, 15 nt, Human
uugaauuuuaaaucu

SEQ ID NO: 2688872 - RNA, 16 nt, Human
uugaauuuuaaaucua

SEQ ID NO: 2688873 - RNA, 16 nt, Human
uugacaacugugacug

SEQ ID NO: 2688874 - RNA, 14 nt, Human
uugacaagcuggcu

SEQ ID NO: 2688875 - RNA, 15 nt, Human
uugacaagcuggcuu

SEQ ID NO: 2688876 - RNA, 13 nt, Human
uugacucaucuua

SEQ ID NO: 2688877 - RNA, 15 nt, Human
uugacucaucuuaua

SEQ ID NO: 2688878 - RNA, 13 nt, Human
uugacucuggguc

SEQ ID NO: 2688879 - RNA, 12 nt, Human
uugacucugggu

SEQ ID NO: 2688880 - RNA, 19 nt, Human
uugacucuggguccuuccu

SEQ ID NO: 2688881 - RNA, 18 nt, Human
uugacucuggguccuucc

SEQ ID NO: 2688882 - RNA, 21 nt, Human
uugaugauacaaugaacacuu

SEQ ID NO: 2688883 - RNA, 17 nt, Human
uugauugggaaaacauu

SEQ ID NO: 2688884 - RNA, 19 nt, Human
uugauugggaaaacauuug

SEQ ID NO: 2688885 - RNA, 22 nt, Human
uugauugggaaaacauuugcug

SEQ ID NO: 2688886 - RNA, 13 nt, Human
uugcaaaguguau

SEQ ID NO: 2688887 - RNA, 18 nt, Human
uugauuugauugggauga

SEQ ID NO: 2688888 - RNA, 16 nt, Human
uugauagggaacuggg

SEQ ID NO: 2688889 - RNA, 19 nt, Human
uugauagggaacuggggaa

SEQ ID NO: 2688890 - RNA, 20 nt, Human
uugagccgggccccugggcu

SEQ ID NO: 2688891 - RNA, 11 nt, Human
uugagccuggg

SEQ ID NO: 2688892 - RNA, 19 nt, Human
uugagccgggccccugggc

SEQ ID NO: 2688893 - RNA, 13 nt, Human
uugagcccuggcu

SEQ ID NO: 2688894 - RNA, 14 nt, Human
uugagcccuggcug

SEQ ID NO: 2688895 - RNA, 15 nt, Human
uugagcccuggcugu

SEQ ID NO: 2688896 - RNA, 21 nt, Human
uugacucuggguccuuccuga

SEQ ID NO: 2688897 - RNA, 16 nt, Human
uucugugugucaguuu

SEQ ID NO: 2688898 - RNA, 17 nt, Human
uucugugugucaguuuu

SEQ ID NO: 2688899 - RNA, 18 nt, Human
uucugugugucaguuuuc

SEQ ID NO: 2688900 - RNA, 21 nt, Human
uucugugugucaguuuucaua

SEQ ID NO: 2688901 - RNA, 12 nt, Human
uucuguguuuau

SEQ ID NO: 2688902 - RNA, 18 nt, Human
uucuguguuuauaaaaua

SEQ ID NO: 2688903 - RNA, 18 nt, Human
uucuguauuuuguuuuug

SEQ ID NO: 2688904 - RNA, 20 nt, Human
uucuguauuuuuuuuucuaa

SEQ ID NO: 2688905 - RNA, 22 nt, Human
uucuguauuuuuuuuucuaaga

SEQ ID NO: 2688906 - RNA, 19 nt, Human
uucuguauuugaaagugcc

SEQ ID NO: 2688907 - RNA, 17 nt, Human
uucuguauuugaaagug

SEQ ID NO: 2688908 - RNA, 16 nt, Human
uucuguauuugaaagu

SEQ ID NO: 2688909 - RNA, 15 nt, Human
uucuguauuugaaag

SEQ ID NO: 2688910 - RNA, 14 nt, Human
uucuguauuugaaa

SEQ ID NO: 2688911 - RNA, 11 nt, Human
uucuggcaccg

SEQ ID NO: 2688912 - RNA, 19 nt, Human
uucuggacccuuauaaaau

SEQ ID NO: 2688913 - RNA, 17 nt, Human
uucugcuuuagacuuga

SEQ ID NO: 2688914 - RNA, 13 nt, Human
uucugcuuuagac

SEQ ID NO: 2688915 - RNA, 19 nt, Human
uucugcuuuagacuugaaa

SEQ ID NO: 2688916 - RNA, 13 nt, Human
uucugcuuuucug

SEQ ID NO: 2688917 - RNA, 17 nt, Human
uucugcuuuucugcccu

SEQ ID NO: 2688918 - RNA, 18 nt, Human
uucugcuuuucugcccug

SEQ ID NO: 2688919 - RNA, 19 nt, Human
uucugcuuuucugcccugg

SEQ ID NO: 2688920 - RNA, 12 nt, Human
uucuuucagaaa

SEQ ID NO: 2688921 - RNA, 19 nt, Human
uucuuucaguucuuuggau

SEQ ID NO: 2688922 - RNA, 13 nt, Human
uucuuuaaacugu

SEQ ID NO: 2688923 - RNA, 14 nt, Human
uucuuuaaacacuc

SEQ ID NO: 2688924 - RNA, 13 nt, Human
uucuuuaaaagaa

SEQ ID NO: 2688925 - RNA, 16 nt, Human
uucuuuaaaagaauga

SEQ ID NO: 2688926 - RNA, 17 nt, Human
uucuuuaaaagaaugac

SEQ ID NO: 2688927 - RNA, 18 nt, Human
uucuuuaaaagaaugacu

SEQ ID NO: 2688928 - RNA, 19 nt, Human
uucuuuaaaagaaugacua

SEQ ID NO: 2688929 - RNA, 13 nt, Human
uugaaaaauauaa

SEQ ID NO: 2688930 - RNA, 17 nt, Human
uugaaaaauauaaaauu

SEQ ID NO: 2688931 - RNA, 19 nt, Human
uugaaaaauauaaaauuau

SEQ ID NO: 2688932 - RNA, 20 nt, Human
uugaaaaauauaaaauuaug

SEQ ID NO: 2688933 - RNA, 17 nt, Human
uucuuuuuuuuuaaguu

SEQ ID NO: 2688934 - RNA, 20 nt, Human
uucuuuuuuuuuaaguucuu

SEQ ID NO: 2688935 - RNA, 21 nt, Human
uucuuuuuuuuuaaguucuua

SEQ ID NO: 2688936 - RNA, 21 nt, Human
uucuuuuuuuuuuuuuugaga

SEQ ID NO: 2688937 - RNA, 22 nt, Human
uucuuuuuuuuuuuuuugagac

SEQ ID NO: 2688938 - RNA, 13 nt, Human
uugaaaagagaca

SEQ ID NO: 2688939 - RNA, 15 nt, Human
uugaaaagcagacau

SEQ ID NO: 2688940 - RNA, 16 nt, Human
uugaaaacuucagaag

SEQ ID NO: 2688941 - RNA, 18 nt, Human
uugaaaacuucagaagca

SEQ ID NO: 2688942 - RNA, 22 nt, Human
uugaaaaguaauauuuauuaaa

SEQ ID NO: 2688943 - RNA, 17 nt, Human
uugaaaaguaauauuua

SEQ ID NO: 2688944 - RNA, 17 nt, Human
uugaaaagcagacauuu

SEQ ID NO: 2688945 - RNA, 18 nt, Human papillomavirus type 31
auaacaguaaaacagcaa

SEQ ID NO: 2688946 - RNA, 22 nt, Human papillomavirus type 31
aaccuuaacauauauaaguaca

SEQ ID NO: 2688947 - RNA, 23 nt, Human papillomavirus type 31
ggccaaagccuuacaagcuauug

SEQ ID NO: 2688948 - RNA, 15 nt, Human papillomavirus type 31
acauaaaaaugcuau

SEQ ID NO: 2688949 - RNA, 14 nt, Human papillomavirus type 31
uauuguaaccuuaa

SEQ ID NO: 2688950 - RNA, 18 nt, Human papillomavirus type 31
cacaguauuaaccaccag

SEQ ID NO: 2688951 - RNA, 23 nt, Human papillomavirus type 31
ugugcuguauuguauaugugugu

SEQ ID NO: 2688952 - RNA, 21 nt, Human papillomavirus type 31
caugcauuauacuaacuggaa

SEQ ID NO: 2688953 - RNA, 13 nt, Human papillomavirus type 31
auccaaacaaauu

SEQ ID NO: 2688954 - RNA, 18 nt, Human papillomavirus type 31
uguaugaacaagugucau

SEQ ID NO: 2688955 - RNA, 19 nt, Human papillomavirus type 31
auaaaaaugcuauuguaac

SEQ ID NO: 2688956 - RNA, 17 nt, Human papillomavirus type 31
cauguacuuauuucugc

SEQ ID NO: 2688957 - RNA, 14 nt, Human papillomavirus type 31
gguauauguauguu

SEQ ID NO: 2688958 - RNA, 17 nt, Human papillomavirus type 31
guauaccuauuagacca

SEQ ID NO: 2688959 - RNA, 14 nt, Human papillomavirus type 31
ucaggcagaagcag

SEQ ID NO: 2688960 - RNA, 20 nt, Human papillomavirus type 31
auagauggccaauguacugu

SEQ ID NO: 2688961 - RNA, 15 nt, Human papillomavirus type 31
uauaaagcaagagaa

SEQ ID NO: 2688962 - RNA, 21 nt, Human papillomavirus type 31
auacuguuguuuguauuggua

SEQ ID NO: 2688963 - RNA, 16 nt, Human papillomavirus type 31
gucuguauguguaugu

SEQ ID NO: 2688964 - RNA, 14 nt, Human papillomavirus type 31
auguauacaacaau

SEQ ID NO: 2688965 - RNA, 14 nt, Human papillomavirus type 31
uauuaaauaaauuu

SEQ ID NO: 2688966 - RNA, 16 nt, Human papillomavirus type 31
ugaacuuccagacagc

SEQ ID NO: 2688967 - RNA, 19 nt, Human papillomavirus type 31
uguaauucauacacaugca

SEQ ID NO: 2688968 - RNA, 12 nt, Human papillomavirus type 31
gauacuggggag

SEQ ID NO: 2688969 - RNA, 17 nt, Human papillomavirus type 31
caccuacguugcaagac

SEQ ID NO: 2688970 - RNA, 23 nt, Human papillomavirus type 31
acuuuuuuuuuauuauuaccaug

SEQ ID NO: 2688971 - RNA, 17 nt, Human papillomavirus type 31
cugaccuccacuguuau

SEQ ID NO: 2688972 - RNA, 19 nt, Human papillomavirus type 31
cauugugcuaugcuuuuug

SEQ ID NO: 2688973 - RNA, 17 nt, Human papillomavirus type 31
cguguguacuuguauau

SEQ ID NO: 2688974 - RNA, 19 nt, Human papillomavirus type 31
aguagugauacuggggagg

SEQ ID NO: 2688975 - RNA, 14 nt, Human papillomavirus type 31
agugucaacaggau

SEQ ID NO: 2688976 - RNA, 17 nt, Human papillomavirus type 31
caguaauugacagacag

SEQ ID NO: 2688977 - RNA, 16 nt, Human papillomavirus type 31
cuaugcuuuuugcuuu

SEQ ID NO: 2688978 - RNA, 21 nt, Human papillomavirus type 31
uugaugacacugaaaacucua

SEQ ID NO: 2688979 - RNA, 14 nt, Human papillomavirus type 31
uuguaaccuuaaca

SEQ ID NO: 2688980 - RNA, 22 nt, Human papillomavirus type 31
auguaauacaugugucuguaug

SEQ ID NO: 2688981 - RNA, 14 nt, Human papillomavirus type 31
ucacgccauaguaa

SEQ ID NO: 2688982 - RNA, 19 nt, Human papillomavirus type 31
uacuguuguggaagggcaa

SEQ ID NO: 2688983 - RNA, 18 nt, Human papillomavirus type 31
aacacgaaccaacauaua

SEQ ID NO: 2688984 - RNA, 17 nt, Human papillomavirus type 31
auguacuguuguggaag

SEQ ID NO: 2688985 - RNA, 14 nt, Human papillomavirus type 31
ggaggaacaugcag

SEQ ID NO: 2688986 - RNA, 23 nt, Human papillomavirus type 31
aagagaaaugggaauacacagua

SEQ ID NO: 2688987 - RNA, 17 nt, Human papillomavirus type 31
uuuuuuacuuguguaua

SEQ ID NO: 2688988 - RNA, 21 nt, Human papillomavirus type 31
auagaacauacuaccauugca

SEQ ID NO: 2688989 - RNA, 15 nt, Human papillomavirus type 31
uauuccauaccuaaa

SEQ ID NO: 2688990 - RNA, 17 nt, Human papillomavirus type 31
uauagacuauuggaaac

SEQ ID NO: 2688991 - RNA, 16 nt, Human papillomavirus type 31
gaaaauaacaguaaaa

SEQ ID NO: 2688992 - RNA, 21 nt, Human papillomavirus type 31
acacugaauacaaaaaugagg

SEQ ID NO: 2688993 - RNA, 20 nt, Human papillomavirus type 31
cuguguguguuguguauguu

SEQ ID NO: 2688994 - RNA, 23 nt, Human papillomavirus type 31
uaaauaaauuugaugacacugaa

SEQ ID NO: 2688995 - RNA, 15 nt, Human papillomavirus type 31
cuauuagaccaccag

SEQ ID NO: 2688996 - RNA, 15 nt, Human papillomavirus type 31
auuuuuuaaauacug

SEQ ID NO: 2688997 - RNA, 20 nt, Human papillomavirus type 31
aaacauuaaauaacacugaa

SEQ ID NO: 2688998 - RNA, 14 nt, Human papillomavirus type 31
guauguuuauguau

SEQ ID NO: 2688999 - RNA, 13 nt, Human papillomavirus type 31
gacagacagacag

SEQ ID NO: 2689000 - RNA, 15 nt, Human papillomavirus type 31
auacacaguauuaac

SEQ ID NO: 2689001 - RNA, 15 nt, Human papillomavirus type 31
ugauguuggaaacau

SEQ ID NO: 2689002 - RNA, 21 nt, Human papillomavirus type 31
uauucgacuugaauguguauu

SEQ ID NO: 2689003 - RNA, 17 nt, Human papillomavirus type 31
uauguuguccuuauaua

SEQ ID NO: 2689004 - RNA, 17 nt, Human papillomavirus type 31
uucgcauauugcaagag

SEQ ID NO: 2689005 - RNA, 23 nt, Human papillomavirus type 31
uauauauguauaguauguuaugu

SEQ ID NO: 2689006 - RNA, 13 nt, Human papillomavirus type 31
auauacuguagag

SEQ ID NO: 2689007 - RNA, 16 nt, Human papillomavirus type 31
caaaugauguuggaaa

SEQ ID NO: 2689008 - RNA, 15 nt, Human papillomavirus type 31
cagacagacagggga

SEQ ID NO: 2689009 - RNA, 13 nt, Human papillomavirus type 31
caaguauaccuau

SEQ ID NO: 2689010 - RNA, 18 nt, Human papillomavirus type 31
aaacauggauauacugua

SEQ ID NO: 2689011 - RNA, 14 nt, Human papillomavirus type 31
cacaggaagcggag

SEQ ID NO: 2689012 - RNA, 22 nt, Human papillomavirus type 31
aguauguuauguguguauguau

SEQ ID NO: 2689013 - RNA, 21 nt, Human papillomavirus type 31
guguguacuuguauauaugua

SEQ ID NO: 2689014 - RNA, 18 nt, Human papillomavirus type 31
cacgaaccaacauauauu

SEQ ID NO: 2689015 - RNA, 13 nt, Human papillomavirus type 31
gaggauaugguug

SEQ ID NO: 2689016 - RNA, 20 nt, Human papillomavirus type 31
auaguauguuauguguguau

SEQ ID NO: 2689017 - RNA, 22 nt, Human papillomavirus type 31
auaccuguguguguuguguaug

SEQ ID NO: 2689018 - RNA, 22 nt, Human papillomavirus type 31
agaagcaguaauugacagacag

SEQ ID NO: 2689019 - RNA, 13 nt, Human papillomavirus type 31
ucuacauggcauu

SEQ ID NO: 2689020 - RNA, 19 nt, Human papillomavirus type 31
uguauuaauguauaaagca

SEQ ID NO: 2689021 - RNA, 19 nt, Human papillomavirus type 31
gcaguaauugacagacaga

SEQ ID NO: 2689022 - RNA, 23 nt, Human papillomavirus type 31
uauguaugcguguguacuuguau

SEQ ID NO: 2689023 - RNA, 12 nt, Human papillomavirus type 31
cacaggaagcgg

SEQ ID NO: 2689024 - RNA, 13 nt, Human papillomavirus type 31
uuaaaaaaacaug

SEQ ID NO: 2689025 - RNA, 15 nt, Human papillomavirus type 31
uaacacugaauacaa

SEQ ID NO: 2689026 - RNA, 22 nt, Human papillomavirus type 31
gcaacacuacuauuauuaauug

SEQ ID NO: 2689027 - RNA, 19 nt, Human papillomavirus type 31
ugucaguaucaaaggccaa

SEQ ID NO: 2689028 - RNA, 21 nt, Human papillomavirus type 31
cuagacuguaacuacaauggc

SEQ ID NO: 2689029 - RNA, 18 nt, Human papillomavirus type 31
auaaacaauuguaugaac

SEQ ID NO: 2689030 - RNA, 14 nt, Human papillomavirus type 31
gucauguacuuauu

SEQ ID NO: 2689031 - RNA, 21 nt, Human papillomavirus type 31
cuugaacuguauuuaacugca

SEQ ID NO: 2689032 - RNA, 15 nt, Human papillomavirus type 31
aggcauuguuucaug

SEQ ID NO: 2689033 - RNA, 23 nt, Human papillomavirus type 31
caaauuuggauuuccugauacau

SEQ ID NO: 2689034 - RNA, 23 nt, Human papillomavirus type 31
acucuuugaacuuccagacagcg

SEQ ID NO: 2689035 - RNA, 18 nt, Human papillomavirus type 31
gaauguguauuaauguau

SEQ ID NO: 2689036 - RNA, 16 nt, Human papillomavirus type 31
ugcaaccucuccauua

SEQ ID NO: 2689037 - RNA, 12 nt, Human papillomavirus type 31
auguuguccuua

SEQ ID NO: 2689038 - RNA, 16 nt, Human papillomavirus type 31
uacuuguauauaugua

SEQ ID NO: 2689039 - RNA, 19 nt, Human papillomavirus type 31
caagagcuguuaaugggcu

SEQ ID NO: 2689040 - RNA, 18 nt, Human papillomavirus type 31
uauaaacaauuguaugaa

SEQ ID NO: 2689041 - RNA, 16 nt, Human papillomavirus type 31
aaugauugaacuaaau

SEQ ID NO: 2689042 - RNA, 19 nt, Human papillomavirus type 31
gacacauccaauuacaaua

SEQ ID NO: 2689043 - RNA, 17 nt, Human papillomavirus type 31
cggaggaacaugcagag

SEQ ID NO: 2689044 - RNA, 15 nt, Human papillomavirus type 31
caacaaucaggcaga

SEQ ID NO: 2689045 - RNA, 16 nt, Human papillomavirus type 31
gguacagauggggagg

SEQ ID NO: 2689046 - RNA, 14 nt, Human papillomavirus type 31
caaaaaugaggacu

SEQ ID NO: 2689047 - RNA, 13 nt, Human papillomavirus type 31
acuaacuggaaau

SEQ ID NO: 2689048 - RNA, 18 nt, Human papillomavirus type 31
guccacuugugcugucug

SEQ ID NO: 2689049 - RNA, 23 nt, Human papillomavirus type 31
ugucauacguccacuugugcugu

SEQ ID NO: 2689050 - RNA, 13 nt, Human papillomavirus type 31
auugacagacaga

SEQ ID NO: 2689051 - RNA, 23 nt, Human papillomavirus type 31
acaauuauaucaaacauguaaag

SEQ ID NO: 2689052 - RNA, 21 nt, Human papillomavirus type 31
caaucaggcagaagcagagac

SEQ ID NO: 2689053 - RNA, 17 nt, Human papillomavirus type 31
aucuuuuuauaauccug

SEQ ID NO: 2689054 - RNA, 19 nt, Human papillomavirus type 31
cggaggaacaugcagaggc

SEQ ID NO: 2689055 - RNA, 16 nt, Human papillomavirus type 31
auauaccuauguauag

SEQ ID NO: 2689056 - RNA, 13 nt, Human papillomavirus type 31
gcaaauauauuaa

SEQ ID NO: 2689057 - RNA, 19 nt, Human papillomavirus type 31
gacuggacaaugcagcaaa

SEQ ID NO: 2689058 - RNA, 16 nt, Human papillomavirus type 31
auacaugugucuguau

SEQ ID NO: 2689059 - RNA, 15 nt, Human papillomavirus type 31
uauaucaaacaugua

SEQ ID NO: 2689060 - RNA, 20 nt, Human papillomavirus type 31
uauuuaggguucguuuacca

SEQ ID NO: 2689061 - RNA, 18 nt, Human papillomavirus type 31
gucaguguaagucuacac

SEQ ID NO: 2689062 - RNA, 23 nt, Human papillomavirus type 31
agagacgauuuuuuaaauacugu

SEQ ID NO: 2689063 - RNA, 20 nt, Human papillomavirus type 31
ucgugugccccaacuguucu

SEQ ID NO: 2689064 - RNA, 21 nt, Human papillomavirus type 31
auucauacacaugcaucuuuu

SEQ ID NO: 2689065 - RNA, 17 nt, Human papillomavirus type 31
ugugccccaacuguucu

SEQ ID NO: 2689066 - RNA, 19 nt, Human papillomavirus type 31
agugucaucuacauggcau

SEQ ID NO: 2689067 - RNA, 19 nt, Human papillomavirus type 31
gugucaacaggauauauga

SEQ ID NO: 2689068 - RNA, 14 nt, Human papillomavirus type 31
uaugcguguguacu

SEQ ID NO: 2689069 - RNA, 16 nt, Human papillomavirus type 31
cgugugccccaacugu

SEQ ID NO: 2689070 - RNA, 14 nt, Human papillomavirus type 31
ugguauauguaugu

SEQ ID NO: 2689071 - RNA, 17 nt, Human papillomavirus type 31
aauaaauuugaugacac

SEQ ID NO: 2689072 - RNA, 15 nt, Human papillomavirus type 31
cugucccagugucua

SEQ ID NO: 2689073 - RNA, 22 nt, Human papillomavirus type 31
gaagcaguaauugacagacaga

SEQ ID NO: 2689074 - RNA, 13 nt, Human papillomavirus type 31
uauauuccauuau

SEQ ID NO: 2689075 - RNA, 23 nt, Human papillomavirus type 31
acaauggcugauccagcagguac

SEQ ID NO: 2689076 - RNA, 16 nt, Human papillomavirus type 31
uuauacuaacuggaaa

SEQ ID NO: 2689077 - RNA, 17 nt, Human papillomavirus type 31
aucagacguuauaccua

SEQ ID NO: 2689078 - RNA, 17 nt, Human papillomavirus type 31
uuuauaauccugaaacu

SEQ ID NO: 2689079 - RNA, 13 nt, Human papillomavirus type 31
uccuucuacagua

SEQ ID NO: 2689080 - RNA, 15 nt, Human papillomavirus type 31
uccucccaauaguca

SEQ ID NO: 2689081 - RNA, 13 nt, Human papillomavirus type 31
guuccuacuuguu

SEQ ID NO: 2689082 - RNA, 18 nt, Human papillomavirus type 31
auggcugauccagcaggu

SEQ ID NO: 2689083 - RNA, 16 nt, Human papillomavirus type 31
cagguacagaugggga

SEQ ID NO: 2689084 - RNA, 20 nt, Human papillomavirus type 31
cuacugucuacuuaccaccu

SEQ ID NO: 2689085 - RNA, 14 nt, Human papillomavirus type 31
uaguuguaccaaag

SEQ ID NO: 2689086 - RNA, 14 nt, Human papillomavirus type 31
ugugcugucugugu

SEQ ID NO: 2689087 - RNA, 19 nt, Human papillomavirus type 31
ugaggacuggacaaugcag

SEQ ID NO: 2689088 - RNA, 14 nt, Human papillomavirus type 31
gggaggggacggga

SEQ ID NO: 2689089 - RNA, 15 nt, Human papillomavirus type 31
gugucgguauaugca

SEQ ID NO: 2689090 - RNA, 22 nt, Human papillomavirus type 31
cugaaacucaacgcuuaguuug

SEQ ID NO: 2689091 - RNA, 18 nt, Human papillomavirus type 31
acuuguauauauguauag

SEQ ID NO: 2689092 - RNA, 16 nt, Human papillomavirus type 31
ccagcagguacagaug

SEQ ID NO: 2689093 - RNA, 17 nt, Human papillomavirus type 31
uguguauaccugugugu

SEQ ID NO: 2689094 - RNA, 12 nt, Human papillomavirus type 31
uguauauauguu

SEQ ID NO: 2689095 - RNA, 22 nt, Human papillomavirus type 31
aaacauguaaagcagcagguac

SEQ ID NO: 2689096 - RNA, 22 nt, Human papillomavirus type 31
aauugacagacagacaggggac

SEQ ID NO: 2689097 - RNA, 22 nt, Human papillomavirus type 31
uauagauggccaauguacuguu

SEQ ID NO: 2689098 - RNA, 22 nt, Human papillomavirus type 31
cugucccagugucuaaaguugu

SEQ ID NO: 2689099 - RNA, 15 nt, Human papillomavirus type 31
aggcugugcagguuc

SEQ ID NO: 2689100 - RNA, 15 nt, Human papillomavirus type 31
uuguuuuuguauaua

SEQ ID NO: 2689101 - RNA, 22 nt, Human papillomavirus type 31
cuacuagacuguaacuacaaug

SEQ ID NO: 2689102 - RNA, 17 nt, Human papillomavirus type 31
uauauuaaaauguuuaa

SEQ ID NO: 2689103 - RNA, 13 nt, Human papillomavirus type 31
auguuguccuuau

SEQ ID NO: 2689104 - RNA, 13 nt, Human papillomavirus type 31
auugguauuggua

SEQ ID NO: 2689105 - RNA, 14 nt, Human papillomavirus type 31
uuuugugugcuacu

SEQ ID NO: 2689106 - RNA, 12 nt, Human papillomavirus type 31
uacuuguuccug

SEQ ID NO: 2689107 - RNA, 22 nt, Human papillomavirus type 31
uguuuaagauauaggcugucaa

SEQ ID NO: 2689108 - RNA, 15 nt, Human papillomavirus type 31
cuauguauguuaaua

SEQ ID NO: 2689109 - RNA, 22 nt, Human papillomavirus type 31
acaggaagcggaggaacaugca

SEQ ID NO: 2689110 - RNA, 18 nt, Human papillomavirus type 31
uacacaugcaucuuuuuu

SEQ ID NO: 2689111 - RNA, 18 nt, Human papillomavirus type 31
ccaaacaaauuuggauuu

SEQ ID NO: 2689112 - RNA, 17 nt, Human papillomavirus type 31
aggugaugcaaauauau

SEQ ID NO: 2689113 - RNA, 13 nt, Human papillomavirus type 31
uauuaauugugau

SEQ ID NO: 2689114 - RNA, 17 nt, Human papillomavirus type 31
gaaccaacauauauuau

SEQ ID NO: 2689115 - RNA, 22 nt, Human papillomavirus type 31
ucauauagacuauuggaaacau

SEQ ID NO: 2689116 - RNA, 16 nt, Human papillomavirus type 31
uauuguuccuacuugu

SEQ ID NO: 2689117 - RNA, 22 nt, Human papillomavirus type 31
gaagacucuuugaacuuccaga

SEQ ID NO: 2689118 - RNA, 17 nt, Human papillomavirus type 31
acuguauuuaacugcac

SEQ ID NO: 2689119 - RNA, 14 nt, Human papillomavirus type 31
agugauacugggga

SEQ ID NO: 2689120 - RNA, 13 nt, Human papillomavirus type 31
ugaggacuggaca

SEQ ID NO: 2689121 - RNA, 16 nt, Human papillomavirus type 31
caagucuugaacugua

SEQ ID NO: 2689122 - RNA, 21 nt, Human papillomavirus type 31
agcuauugaacuacaaaugau

SEQ ID NO: 2689123 - RNA, 18 nt, Human papillomavirus type 31
auuucagaggacgaaaau

SEQ ID NO: 2689124 - RNA, 14 nt, Human papillomavirus type 31
uauguauguuuaug

SEQ ID NO: 2689125 - RNA, 16 nt, Human papillomavirus type 31
caaccucuccauuacg

SEQ ID NO: 2689126 - RNA, 12 nt, Human papillomavirus type 31
uuuugugugcua

SEQ ID NO: 2689127 - RNA, 21 nt, Human papillomavirus type 31
gacuauuuagccuaaugauug

SEQ ID NO: 2689128 - RNA, 15 nt, Human papillomavirus type 31
uguagaggugcaauu

SEQ ID NO: 2689129 - RNA, 21 nt, Human papillomavirus type 31
auacaugugucuguaugugua

SEQ ID NO: 2689130 - RNA, 21 nt, Human papillomavirus type 31
uggcugauccagcagguacag

SEQ ID NO: 2689131 - RNA, 16 nt, Human papillomavirus type 31
cggaggaacaugcaga

SEQ ID NO: 2689132 - RNA, 14 nt, Human papillomavirus type 31
gaggacuggacaau

SEQ ID NO: 2689133 - RNA, 15 nt, Human papillomavirus type 31
uuaaaaaaacaugga

SEQ ID NO: 2689134 - RNA, 21 nt, Human papillomavirus type 31
acacccgguccguuuuuugca

SEQ ID NO: 2689135 - RNA, 19 nt, Human papillomavirus type 31
uggacaaugcagcaaacaa

SEQ ID NO: 2689136 - RNA, 16 nt, Human papillomavirus type 31
auauuccauuauuugu

SEQ ID NO: 2689137 - RNA, 17 nt, Human papillomavirus type 31
agguacagauggggagg

SEQ ID NO: 2689138 - RNA, 22 nt, Human papillomavirus type 31
uucuacaguaagcauugugcua

SEQ ID NO: 2689139 - RNA, 14 nt, Human papillomavirus type 31
gaacuacaaaugau

SEQ ID NO: 2689140 - RNA, 13 nt, Human papillomavirus type 31
ugugcuacuauuu

SEQ ID NO: 2689141 - RNA, 19 nt, Human papillomavirus type 31
uuguaugaacaagugucau

SEQ ID NO: 2689142 - RNA, 22 nt, Human papillomavirus type 31
gacaguccagcuggacaagcag

SEQ ID NO: 2689143 - RNA, 18 nt, Human papillomavirus type 31
uauuaauguauaaagcaa

SEQ ID NO: 2689144 - RNA, 15 nt, Human papillomavirus type 31
auacuaacuggaaau

SEQ ID NO: 2689145 - RNA, 17 nt, Human papillomavirus type 31
ucaacaguaacuuuuuu

SEQ ID NO: 2689146 - RNA, 20 nt, Human papillomavirus type 31
uuauauacacccuauuagua

SEQ ID NO: 2689147 - RNA, 19 nt, Human papillomavirus type 31
acuuaaaaggugaugcaaa

SEQ ID NO: 2689148 - RNA, 15 nt, Human papillomavirus type 31
ugacagacagacagg

SEQ ID NO: 2689149 - RNA, 21 nt, Human papillomavirus type 31
gaacuaaauauuucuacagua

SEQ ID NO: 2689150 - RNA, 18 nt, Human papillomavirus type 31
cauacuauuacuauuuua

SEQ ID NO: 2689151 - RNA, 15 nt, Human papillomavirus type 31
uauaugguauaugua

SEQ ID NO: 2689152 - RNA, 16 nt, Human papillomavirus type 31
acuuguauauauguau

SEQ ID NO: 2689153 - RNA, 18 nt, Human papillomavirus type 31
aacacugaauacaaaaau

SEQ ID NO: 2689154 - RNA, 13 nt, Human papillomavirus type 31
guguacagagcac

SEQ ID NO: 2689155 - RNA, 23 nt, Human papillomavirus type 31
uccagcagguacagauggggagg

SEQ ID NO: 2689156 - RNA, 18 nt, Human papillomavirus type 31
cauagacaguccagcugg

SEQ ID NO: 2689157 - RNA, 14 nt, Human papillomavirus type 31
auuauuaccaugcg

SEQ ID NO: 2689158 - RNA, 17 nt, Human papillomavirus type 31
uauaaacaauuguauga

SEQ ID NO: 2689159 - RNA, 18 nt, Human papillomavirus type 31
acacaugcaucuuuuuua

SEQ ID NO: 2689160 - RNA, 20 nt, Human papillomavirus type 31
aaauuuauauaccuauguau

SEQ ID NO: 2689161 - RNA, 12 nt, Human papillomavirus type 31
ugugaucauaua

SEQ ID NO: 2689162 - RNA, 18 nt, Human papillomavirus type 31
guaggccauccauauuau

SEQ ID NO: 2689163 - RNA, 13 nt, Human papillomavirus type 31
cucuaauagauau

SEQ ID NO: 2689164 - RNA, 17 nt, Human papillomavirus type 31
uaaacgugcgucugcua

SEQ ID NO: 2689165 - RNA, 18 nt, Human papillomavirus type 31
aaauaacacugaauacaa

SEQ ID NO: 2689166 - RNA, 17 nt, Human papillomavirus type 31
auguguuagauuugcaa

SEQ ID NO: 2689167 - RNA, 23 nt, Human papillomavirus type 31
cugauacaucuuuuuauaauccu

SEQ ID NO: 2689168 - RNA, 23 nt, Human papillomavirus type 31
gagcaauuacccgacagcucaga

SEQ ID NO: 2689169 - RNA, 21 nt, Human papillomavirus type 31
gcaauuacccgacagcucaga

SEQ ID NO: 2689170 - RNA, 15 nt, Human papillomavirus type 31
uacuguuguuuguau

SEQ ID NO: 2689171 - RNA, 20 nt, Human papillomavirus type 31
uauggguguuuuuuuuggug

SEQ ID NO: 2689172 - RNA, 20 nt, Human papillomavirus type 31
agcauugugcuaugcuuuuu

SEQ ID NO: 2689173 - RNA, 15 nt, Human papillomavirus type 31
uuuguguguuauaua

SEQ ID NO: 2689174 - RNA, 20 nt, Human papillomavirus type 31
aucugaggcaaguauaccua

SEQ ID NO: 2689175 - RNA, 15 nt, Human papillomavirus type 31
caaaugauguuggaa

SEQ ID NO: 2689176 - RNA, 16 nt, Human papillomavirus type 31
aucaggcagaagcaga

SEQ ID NO: 2689177 - RNA, 17 nt, Human papillomavirus type 31
uuauauaccuauguaua

SEQ ID NO: 2689178 - RNA, 14 nt, Human papillomavirus type 31
auauuucuacagua

SEQ ID NO: 2689179 - RNA, 15 nt, Human papillomavirus type 31
gauauaggcugucaa

SEQ ID NO: 2689180 - RNA, 21 nt, Human papillomavirus type 31
guaguccuuuaagugauauua

SEQ ID NO: 2689181 - RNA, 18 nt, Human papillomavirus type 31
gaggaacaugcagaggcu

SEQ ID NO: 2689182 - RNA, 21 nt, Human papillomavirus type 31
gaaacauuaaauaacacugaa

SEQ ID NO: 2689183 - RNA, 19 nt, Human papillomavirus type 31
uauugcaagagcuguuaau

SEQ ID NO: 2689184 - RNA, 23 nt, Human papillomavirus type 31
ugauguuggaaacauuaaauaac

SEQ ID NO: 2689185 - RNA, 18 nt, Human papillomavirus type 31
uauaauccugaaacucaa

SEQ ID NO: 2689186 - RNA, 17 nt, Human papillomavirus type 31
agauauaggcugucaaa

SEQ ID NO: 2689187 - RNA, 14 nt, Human papillomavirus type 31
gacauguacagaug

SEQ ID NO: 2689188 - RNA, 18 nt, Human papillomavirus type 31
agcaaacaagucuugaac

SEQ ID NO: 2689189 - RNA, 17 nt, Human papillomavirus type 31
aauguacuguuguggaa

SEQ ID NO: 2689190 - RNA, 15 nt, Human papillomavirus type 31
ugucauagacagucc

SEQ ID NO: 2689191 - RNA, 23 nt, Human papillomavirus type 31
auacaugugucuguauguguaug

SEQ ID NO: 2689192 - RNA, 14 nt, Human papillomavirus type 31
cgggaugcaauggu

SEQ ID NO: 2689193 - RNA, 21 nt, Human papillomavirus type 31
acaggggacaacauuucagag

SEQ ID NO: 2689194 - RNA, 23 nt, Human papillomavirus type 31
ucagaggacgaaaaugaagacag

SEQ ID NO: 2689195 - RNA, 17 nt, Human papillomavirus type 31
ugcuaugcuuuuugcuu

SEQ ID NO: 2689196 - RNA, 16 nt, Human papillomavirus type 31
uggcugauccagcagg

SEQ ID NO: 2689197 - RNA, 22 nt, Human papillomavirus type 31
acaaaaaugaggacuggacaau

SEQ ID NO: 2689198 - RNA, 13 nt, Human papillomavirus type 31
uguguauguaugc

SEQ ID NO: 2689199 - RNA, 22 nt, Human papillomavirus type 31
guaacauacuauuacuauuuua

SEQ ID NO: 2689200 - RNA, 18 nt, Human papillomavirus type 31
auugacagacagacaggg

SEQ ID NO: 2689201 - RNA, 16 nt, Human papillomavirus type 31
uaaacuauuguuccua

SEQ ID NO: 2689202 - RNA, 20 nt, Human papillomavirus type 31
auguuggaaacauuaaauaa

SEQ ID NO: 2689203 - RNA, 16 nt, Human papillomavirus type 31
agauggggaggggacg

SEQ ID NO: 2689204 - RNA, 14 nt, Human papillomavirus type 31
acaagcuauugaac

SEQ ID NO: 2689205 - RNA, 11 nt, Human papillomavirus type 31
ccagacagcgg

SEQ ID NO: 2689206 - RNA, 15 nt, Human papillomavirus type 31
uauguaauacaugug

SEQ ID NO: 2689207 - RNA, 23 nt, Human papillomavirus type 31
ucuaaaacgaaaguauguaggua

SEQ ID NO: 2689208 - RNA, 17 nt, Human papillomavirus type 31
ugugucgguauaugcaa

SEQ ID NO: 2689209 - RNA, 12 nt, Human papillomavirus type 31
auguuggaaaca

SEQ ID NO: 2689210 - RNA, 19 nt, Human papillomavirus type 31
caaaauauaaacaauugua

SEQ ID NO: 2689211 - RNA, 12 nt, Human papillomavirus type 31
uauaauaaacuu

SEQ ID NO: 2689212 - RNA, 14 nt, Human papillomavirus type 31
uguauauauguaua

SEQ ID NO: 2689213 - RNA, 15 nt, Human papillomavirus type 31
uauagauggccaaug

SEQ ID NO: 2689214 - RNA, 22 nt, Human papillomavirus type 31
ugauguacacaacaccaugcau

SEQ ID NO: 2689215 - RNA, 19 nt, Human papillomavirus type 31
uuuauguagaagcaguaau

SEQ ID NO: 2689216 - RNA, 12 nt, Human papillomavirus type 31
cuugugcugucu

SEQ ID NO: 2689217 - RNA, 18 nt, Human papillomavirus type 31
ugucaacaggauauauga

SEQ ID NO: 2689218 - RNA, 15 nt, Human papillomavirus type 31
uauuguauaugugug

SEQ ID NO: 2689219 - RNA, 15 nt, Human papillomavirus type 31
ccugaggcaacugac

SEQ ID NO: 2689220 - RNA, 22 nt, Human papillomavirus type 31
caguaauugacagacagacagg

SEQ ID NO: 2689221 - RNA, 18 nt, Human papillomavirus type 31
aaauuugaugacacugaa

SEQ ID NO: 2689222 - RNA, 22 nt, Human papillomavirus type 31
guaauugacagacagacagggg

SEQ ID NO: 2689223 - RNA, 13 nt, Human papillomavirus type 31
uggauauacugua

SEQ ID NO: 2689224 - RNA, 12 nt, Human papillomavirus type 31
auagucauguac

SEQ ID NO: 2689225 - RNA, 14 nt, Human papillomavirus type 31
aauaaacuuuuuua

SEQ ID NO: 2689226 - RNA, 16 nt, Human papillomavirus type 31
ugcaacacuacuauua

SEQ ID NO: 2689227 - RNA, 19 nt, Human papillomavirus type 31
ugagcaauuacccgacagc

SEQ ID NO: 2689228 - RNA, 13 nt, Human papillomavirus type 31
caugcacaggaag

SEQ ID NO: 2689229 - RNA, 16 nt, Human papillomavirus type 31
ggccaauguacuguug

SEQ ID NO: 2689230 - RNA, 17 nt, Human papillomavirus type 31
uacuauuugugugucuu

SEQ ID NO: 2689231 - RNA, 20 nt, Human papillomavirus type 31
accuacaggguguuuaaaaa

SEQ ID NO: 2689232 - RNA, 15 nt, Human papillomavirus type 31
caguaauugacagac

SEQ ID NO: 2689233 - RNA, 13 nt, Human papillomavirus type 31
ugauguuggaaac

SEQ ID NO: 2689234 - RNA, 22 nt, Human papillomavirus type 31
ccagcuggacaagcagaaccgg

SEQ ID NO: 2689235 - RNA, 21 nt, Human papillomavirus type 31
gucaacaggauauaugacuau

SEQ ID NO: 2689236 - RNA, 16 nt, Human papillomavirus type 31
uaaaacagcaaaacga

SEQ ID NO: 2689237 - RNA, 14 nt, Human papillomavirus type 31
gcuggacaagcaga

SEQ ID NO: 2689238 - RNA, 16 nt, Human papillomavirus type 31
agucaacaguaacuuu

SEQ ID NO: 2689239 - RNA, 15 nt, Human papillomavirus type 31
caguaaaacagcaaa

SEQ ID NO: 2689240 - RNA, 18 nt, Human papillomavirus type 31
caacaaucaggcagaagc

SEQ ID NO: 2689241 - RNA, 21 nt, Human papillomavirus type 31
ggaggggacgggaugcaaugg

SEQ ID NO: 2689242 - RNA, 16 nt, Human papillomavirus type 31
uuaagugauauuagua

SEQ ID NO: 2689243 - RNA, 18 nt, Human papillomavirus type 31
gaaaauaacaguaaaaca

SEQ ID NO: 2689244 - RNA, 15 nt, Human papillomavirus type 31
uguauagauggccaa

SEQ ID NO: 2689245 - RNA, 16 nt, Human papillomavirus type 31
uccauaccuaaaucug

SEQ ID NO: 2689246 - RNA, 13 nt, Human papillomavirus type 31
gaugcaaugguug

SEQ ID NO: 2689247 - RNA, 13 nt, Human papillomavirus type 31
aaugcagcaaaca

SEQ ID NO: 2689248 - RNA, 16 nt, Human papillomavirus type 31
ugaggacuggacaaug

SEQ ID NO: 2689249 - RNA, 19 nt, Human papillomavirus type 31
ugugcagguucuaaaacga

SEQ ID NO: 2689250 - RNA, 21 nt, Human papillomavirus type 31
uugaauguguauuaauguaua

SEQ ID NO: 2689251 - RNA, 15 nt, Human papillomavirus type 31
cguuuguguguacag

SEQ ID NO: 2689252 - RNA, 21 nt, Human papillomavirus type 31
acuccauuuugauuuuaugca

SEQ ID NO: 2689253 - RNA, 13 nt, Human papillomavirus type 31
auguguguaugua

SEQ ID NO: 2689254 - RNA, 13 nt, Human papillomavirus type 31
cagacagacaggg

SEQ ID NO: 2689255 - RNA, 17 nt, Human papillomavirus type 31
uuuauggguuauugcaa

SEQ ID NO: 2689256 - RNA, 16 nt, Human papillomavirus type 31
caagagaaaugggaau

SEQ ID NO: 2689257 - RNA, 16 nt, Human papillomavirus type 31
cuaaaaaaauaguugu

SEQ ID NO: 2689258 - RNA, 14 nt, Human papillomavirus type 31
ugcaagagcuguua

SEQ ID NO: 2689259 - RNA, 19 nt, Human papillomavirus type 31
ugaacuguauuuaacugca

SEQ ID NO: 2689260 - RNA, 17 nt, Human papillomavirus type 31
uaauguauaaagcaaga

SEQ ID NO: 2689261 - RNA, 21 nt, Human papillomavirus type 31
uuauauaugguauauguaugu

SEQ ID NO: 2689262 - RNA, 16 nt, Human papillomavirus type 31
uaacaguaaaacagca

SEQ ID NO: 2689263 - RNA, 15 nt, Human papillomavirus type 31
gcagaggcugugcag

SEQ ID NO: 2689264 - RNA, 22 nt, Human papillomavirus type 31
uacuguaaaaauaccuaacaca

SEQ ID NO: 2689265 - RNA, 19 nt, Human papillomavirus type 31
gguuaaaagcuauaugcau

SEQ ID NO: 2689266 - RNA, 23 nt, Human papillomavirus type 31
ggaugucauagacaguccagcug

SEQ ID NO: 2689267 - RNA, 16 nt, Human papillomavirus type 31
gaaaaugaagacagua

SEQ ID NO: 2689268 - RNA, 22 nt, Human papillomavirus type 31
uguguacuuguauauauguaua

SEQ ID NO: 2689269 - RNA, 22 nt, Human papillomavirus type 31
cuagacuguaacuacaauggcu

SEQ ID NO: 2689270 - RNA, 20 nt, Human papillomavirus type 31
guccaucagacguuauaccu

SEQ ID NO: 2689271 - RNA, 17 nt, Human papillomavirus type 31
ugcaagacuauguguua

SEQ ID NO: 2689272 - RNA, 19 nt, Human papillomavirus type 31
uugguauaauaaacuuuuu

SEQ ID NO: 2689273 - RNA, 20 nt, Human papillomavirus type 31
aaaaggugaugcaaauauau

SEQ ID NO: 2689274 - RNA, 18 nt, Human papillomavirus type 31
aucagacguuauaccuaa

SEQ ID NO: 2689275 - RNA, 13 nt, Human papillomavirus type 31
guaccaaaggugu

SEQ ID NO: 2689276 - RNA, 22 nt, Human papillomavirus type 31
auuaaauaaauuugaugacacu

SEQ ID NO: 2689277 - RNA, 19 nt, Human papillomavirus type 31
uaggucgcgggcagccauu

SEQ ID NO: 2689278 - RNA, 17 nt, Human papillomavirus type 31
caccugucccagugucu

SEQ ID NO: 2689279 - RNA, 13 nt, Human papillomavirus type 31
uacguugcaagac

SEQ ID NO: 2689280 - RNA, 13 nt, Human papillomavirus type 31
uaaaaguuguaca

SEQ ID NO: 2689281 - RNA, 23 nt, Human papillomavirus type 31
ccugucccagugucuaaaguugu

SEQ ID NO: 2689282 - RNA, 16 nt, Human papillomavirus type 31
auacacaugcaucuuu

SEQ ID NO: 2689283 - RNA, 16 nt, Human papillomavirus type 31
uaauacaugugucugu

SEQ ID NO: 2689284 - RNA, 15 nt, Human papillomavirus type 31
uagguauuagugguc

SEQ ID NO: 2689285 - RNA, 21 nt, Human papillomavirus type 31
caaaugauguuggaaacauua

SEQ ID NO: 2689286 - RNA, 18 nt, Human papillomavirus type 31
uguauguaauacaugugu

SEQ ID NO: 2689287 - RNA, 17 nt, Human papillomavirus type 31
gucaacaggauauauga

SEQ ID NO: 2689288 - RNA, 18 nt, Human papillomavirus type 31
auaggcugucaaaauaua

SEQ ID NO: 2689289 - RNA, 21 nt, Human papillomavirus type 31
acaucuuuuuauaauccugaa

SEQ ID NO: 2689290 - RNA, 22 nt, Human papillomavirus type 31
uguauguuaauaaauaugugua

SEQ ID NO: 2689291 - RNA, 12 nt, Human papillomavirus type 31
uaaauaugugua

SEQ ID NO: 2689292 - RNA, 20 nt, Human papillomavirus type 31
uaaaaggugaugcaaauaua

SEQ ID NO: 2689293 - RNA, 22 nt, Human papillomavirus type 31
uacuauuugugugucuugucau

SEQ ID NO: 2689294 - RNA, 20 nt, Human papillomavirus type 31
agcauugacccuguaggucc

SEQ ID NO: 2689295 - RNA, 14 nt, Human papillomavirus type 31
gaacuuccagacag

SEQ ID NO: 2689296 - RNA, 22 nt, Human papillomavirus type 31
cuuacaagcuauugaacuacaa

SEQ ID NO: 2689297 - RNA, 20 nt, Human papillomavirus type 31
uacauggcauuggacaugua

SEQ ID NO: 2689298 - RNA, 22 nt, Human papillomavirus type 31
ugcaaugguugguuuuauguag

SEQ ID NO: 2689299 - RNA, 18 nt, Human papillomavirus type 31
uuaguacacguccuucua

SEQ ID NO: 2689300 - RNA, 22 nt, Human papillomavirus type 31
ugucauagacaguccagcugga

SEQ ID NO: 2689301 - RNA, 19 nt, Human papillomavirus type 31
acaccaugcauuauacuaa

SEQ ID NO: 2689302 - RNA, 15 nt, Human papillomavirus type 31
gaagcagagacagca

SEQ ID NO: 2689303 - RNA, 21 nt, Human papillomavirus type 31
ugagcaauuacccgacagcuc

SEQ ID NO: 2689304 - RNA, 15 nt, Human papillomavirus type 31
ggccuguguugguuu

SEQ ID NO: 2689305 - RNA, 21 nt, Human papillomavirus type 31
gaucauauagacuauuggaaa

SEQ ID NO: 2689306 - RNA, 22 nt, Human papillomavirus type 31
auggugauguacacaacaccau

SEQ ID NO: 2689307 - RNA, 17 nt, Human papillomavirus type 31
aacauggauauacugua

SEQ ID NO: 2689308 - RNA, 15 nt, Human papillomavirus type 31
cagaagcagagacag

SEQ ID NO: 2689309 - RNA, 22 nt, Human papillomavirus type 31
gcagccauuagguguagguauu

SEQ ID NO: 2689310 - RNA, 18 nt, Human papillomavirus type 31
uauuguaaccuuaacaua

SEQ ID NO: 2689311 - RNA, 21 nt, Human papillomavirus type 31
ggaagcggaggaacaugcaga

SEQ ID NO: 2689312 - RNA, 20 nt, Human papillomavirus type 31
uaaagcaagagaaaugggaa

SEQ ID NO: 2689313 - RNA, 16 nt, Human papillomavirus type 31
ugaggaggaugucaua

SEQ ID NO: 2689314 - RNA, 12 nt, Human papillomavirus type 31
uccugaaacuca

SEQ ID NO: 2689315 - RNA, 15 nt, Human papillomavirus type 31
gaugucauagacagu

SEQ ID NO: 2689316 - RNA, 17 nt, Human papillomavirus type 31
uaaauauuucuacagua

SEQ ID NO: 2689317 - RNA, 13 nt, Human papillomavirus type 31
uuauaauccugaa

SEQ ID NO: 2689318 - RNA, 13 nt, Human papillomavirus type 31
uguguauacuguu

SEQ ID NO: 2689319 - RNA, 22 nt, Human papillomavirus type 31
uauguauaguauguuaugugug

SEQ ID NO: 2689320 - RNA, 19 nt, Human papillomavirus type 31
cuugugcuguauuguauau

SEQ ID NO: 2689321 - RNA, 19 nt, Human papillomavirus type 31
uacaguaggccauccauau

SEQ ID NO: 2689322 - RNA, 23 nt, Human papillomavirus type 31
gacacugaaaacucuaauagaua

SEQ ID NO: 2689323 - RNA, 20 nt, Human papillomavirus type 31
guauguuguccuuauauaca

SEQ ID NO: 2689324 - RNA, 20 nt, Human papillomavirus type 31
uauuuagccuaaugauugaa

SEQ ID NO: 2689325 - RNA, 17 nt, Human papillomavirus type 31
uauguuguguuuauaua

SEQ ID NO: 2689326 - RNA, 22 nt, Human papillomavirus type 31
auguacacaacaccaugcauua

SEQ ID NO: 2689327 - RNA, 17 nt, Human papillomavirus type 31
auguauagauggccaau

SEQ ID NO: 2689328 - RNA, 18 nt, Human papillomavirus type 31
gcagaagcagagacagca

SEQ ID NO: 2689329 - RNA, 17 nt, Human papillomavirus type 31
caggcagaagcagagac

SEQ ID NO: 2689330 - RNA, 15 nt, Human papillomavirus type 31
gagacagcacaggca

SEQ ID NO: 2689331 - RNA, 19 nt, Human papillomavirus type 31
uaucacgcaggcagugcua

SEQ ID NO: 2689332 - RNA, 17 nt, Human papillomavirus type 31
gcaacugaccuccacug

SEQ ID NO: 2689333 - RNA, 14 nt, Human papillomavirus type 31
aacauacuaccauu

SEQ ID NO: 2689334 - RNA, 15 nt, Human papillomavirus type 31
aacuuuuuuacuugu

SEQ ID NO: 2689335 - RNA, 20 nt, Human papillomavirus type 31
cauagacaguccagcuggac

SEQ ID NO: 2689336 - RNA, 22 nt, Human papillomavirus type 31
uaagauauaggcugucaaaaua

SEQ ID NO: 2689337 - RNA, 15 nt, Human papillomavirus type 31
auaugguauauguau

SEQ ID NO: 2689338 - RNA, 14 nt, Human papillomavirus type 31
acauaaaaaugcua

SEQ ID NO: 2689339 - RNA, 17 nt, Human papillomavirus type 31
guaagcauugugcuaug

SEQ ID NO: 2689340 - RNA, 12 nt, Human papillomavirus type 31
acaugcagaggc

SEQ ID NO: 2689341 - RNA, 16 nt, Human papillomavirus type 31
aaagcaagagaaaugg

SEQ ID NO: 2689342 - RNA, 11 nt, Human papillomavirus type 31
uauaugugugu

SEQ ID NO: 2689343 - RNA, 16 nt, Human papillomavirus type 31
uacugucuacuuacca

SEQ ID NO: 2689344 - RNA, 16 nt, Human papillomavirus type 31
ucaggcagaagcagag

SEQ ID NO: 2689345 - RNA, 12 nt, Human papillomavirus type 31
caguccagcugg

SEQ ID NO: 2689346 - RNA, 17 nt, Human papillomavirus type 31
uuaauaaauauguguau

SEQ ID NO: 2689347 - RNA, 16 nt, Human papillomavirus type 31
cagagacagcacaggc

SEQ ID NO: 2689348 - RNA, 17 nt, Human papillomavirus type 31
ugauugaacuaaauauu

SEQ ID NO: 2689349 - RNA, 14 nt, Human papillomavirus type 31
uuugugugucuugu

SEQ ID NO: 2689350 - RNA, 13 nt, Human papillomavirus type 31
gauacuggggagg

SEQ ID NO: 2689351 - RNA, 15 nt, Human papillomavirus type 31
uccauuuugauuuua

SEQ ID NO: 2689352 - RNA, 12 nt, Human papillomavirus type 31
ucugacaauccu

SEQ ID NO: 2689353 - RNA, 15 nt, Human papillomavirus type 31
ucuacaguaagcauu

SEQ ID NO: 2689354 - RNA, 20 nt, Human papillomavirus type 31
guagaagcaguaauugacag

SEQ ID NO: 2689355 - RNA, 19 nt, Human papillomavirus type 31
agaagcagagacagcacag

SEQ ID NO: 2689356 - RNA, 15 nt, Human papillomavirus type 31
uauuauuaccaugcg

SEQ ID NO: 2689357 - RNA, 14 nt, Human papillomavirus type 31
cugaccuccacugu

SEQ ID NO: 2689358 - RNA, 23 nt, Human papillomavirus type 31
caucuuuuuuaagucaacaguaa

SEQ ID NO: 2689359 - RNA, 13 nt, Human papillomavirus type 31
cgcaggcagugcu

SEQ ID NO: 2689360 - RNA, 16 nt, Human papillomavirus type 31
aauagucauguacuua

SEQ ID NO: 2689361 - RNA, 22 nt, Human papillomavirus type 31
auauaugguauauguauguuua

SEQ ID NO: 2689362 - RNA, 21 nt, Human papillomavirus type 31
auauguaacacgaaccaacau

SEQ ID NO: 2689363 - RNA, 17 nt, Human papillomavirus type 31
aagcuauugaacuacaa

SEQ ID NO: 2689364 - RNA, 17 nt, Human papillomavirus type 31
uuggauuuccugauaca

SEQ ID NO: 2689365 - RNA, 17 nt, Human papillomavirus type 31
acgauuuuuuaaauacu

SEQ ID NO: 2689366 - RNA, 15 nt, Human papillomavirus type 31
ugucgguauaugcaa

SEQ ID NO: 2689367 - RNA, 14 nt, Human papillomavirus type 31
aucugacaauccua

SEQ ID NO: 2689368 - RNA, 17 nt, Human papillomavirus type 31
cuuugcuuuugugugcu

SEQ ID NO: 2689369 - RNA, 17 nt, Human papillomavirus type 31
cauauagacuauuggaa

SEQ ID NO: 2689370 - RNA, 16 nt, Human papillomavirus type 31
caugugucuguaugug

SEQ ID NO: 2689371 - RNA, 13 nt, Human papillomavirus type 31
ugauguacacaac

SEQ ID NO: 2689372 - RNA, 14 nt, Human papillomavirus type 31
acaugugucuguau

SEQ ID NO: 2689373 - RNA, 19 nt, Human papillomavirus type 31
ucaguaucaaaggccaaag

SEQ ID NO: 2689374 - RNA, 13 nt, Human papillomavirus type 31
uaauaaauaugug

SEQ ID NO: 2689375 - RNA, 16 nt, Human papillomavirus type 31
auugaacuacaaauga

SEQ ID NO: 2689376 - RNA, 23 nt, Human papillomavirus type 31
ccaugcauuauacuaacuggaaa

SEQ ID NO: 2689377 - RNA, 14 nt, Human papillomavirus type 31
guaaaaauaccuaa

SEQ ID NO: 2689378 - RNA, 20 nt, Human papillomavirus type 31
uaagucaacaguaacuuuuu

SEQ ID NO: 2689379 - RNA, 15 nt, Human papillomavirus type 31
guguguuguguaugu

SEQ ID NO: 2689380 - RNA, 17 nt, Human papillomavirus type 31
ggaggaacaugcagagg

SEQ ID NO: 2689381 - RNA, 23 nt, Human papillomavirus type 31
ugugauuuuauggguuauugcaa

SEQ ID NO: 2689382 - RNA, 17 nt, Human papillomavirus type 31
uagauaugccggugguc

SEQ ID NO: 2689383 - RNA, 19 nt, Human papillomavirus type 31
caaacauguaaagcagcag

SEQ ID NO: 2689384 - RNA, 22 nt, Human papillomavirus type 31
cuacuauuauuaauugugauuu

SEQ ID NO: 2689385 - RNA, 17 nt, Human papillomavirus type 31
uagugauacuggggagg

SEQ ID NO: 2689386 - RNA, 20 nt, Human papillomavirus type 31
ugagcaauuacccgacagcu

SEQ ID NO: 2689387 - RNA, 15 nt, Human papillomavirus type 31
acaguaacuuuuuua

SEQ ID NO: 2689388 - RNA, 19 nt, Human papillomavirus type 31
gauccagcagguacagaug

SEQ ID NO: 2689389 - RNA, 22 nt, Human papillomavirus type 31
cuugaacuguauuuaacugcac

SEQ ID NO: 2689390 - RNA, 23 nt, Human papillomavirus type 31
aauugacagacagacaggggaca

SEQ ID NO: 2689391 - RNA, 12 nt, Human papillomavirus type 31
uugacagacaga

SEQ ID NO: 2689392 - RNA, 19 nt, Human papillomavirus type 31
gaagcagagacagcacagg

SEQ ID NO: 2689393 - RNA, 17 nt, Human papillomavirus type 31
uaguauguuaugugugu

SEQ ID NO: 2689394 - RNA, 14 nt, Human papillomavirus type 31
uauauuaaaauguu

SEQ ID NO: 2689395 - RNA, 17 nt, Human papillomavirus type 31
cagacguuauaccuaaa

SEQ ID NO: 2689396 - RNA, 18 nt, Human papillomavirus type 31
uccauaccuaaaucugac

SEQ ID NO: 2689397 - RNA, 13 nt, Human papillomavirus type 31
aaaugcuauugua

SEQ ID NO: 2689398 - RNA, 17 nt, Human papillomavirus type 31
uaguaaaaguuguacac

SEQ ID NO: 2689399 - RNA, 18 nt, Human papillomavirus type 31
agcaagagaaaugggaau

SEQ ID NO: 2689400 - RNA, 16 nt, Human papillomavirus type 31
agguacagauggggag

SEQ ID NO: 2689401 - RNA, 14 nt, Human papillomavirus type 31
auggguuauugcaa

SEQ ID NO: 2689402 - RNA, 16 nt, Human papillomavirus type 31
gcaaugguugguuuua

SEQ ID NO: 2689403 - RNA, 14 nt, Human papillomavirus type 31
agaccaaauauuaa

SEQ ID NO: 2689404 - RNA, 18 nt, Human papillomavirus type 31
aaaacauggauauacugu

SEQ ID NO: 2689405 - RNA, 17 nt, Human papillomavirus type 31
ugacaauuguaauguau

SEQ ID NO: 2689406 - RNA, 16 nt, Human papillomavirus type 31
ucccaauagucaugua

SEQ ID NO: 2689407 - RNA, 16 nt, Human papillomavirus type 31
guaaccuuaacauaua

SEQ ID NO: 2689408 - RNA, 17 nt, Human papillomavirus type 31
auauaugguauauguau

SEQ ID NO: 2689409 - RNA, 16 nt, Human papillomavirus type 31
ccacuugugcugucug

SEQ ID NO: 2689410 - RNA, 20 nt, Human papillomavirus type 31
cauauagacuauuggaaaca

SEQ ID NO: 2689411 - RNA, 10 nt, Human papillomavirus type 31
cuuacaagcu

SEQ ID NO: 2689412 - RNA, 15 nt, Human papillomavirus type 31
cagcuggacaagcag

SEQ ID NO: 2689413 - RNA, 22 nt, Human papillomavirus type 31
auguaugcguguguacuuguau

SEQ ID NO: 2689414 - RNA, 12 nt, Human papillomavirus type 31
uuggaaacauua

SEQ ID NO: 2689415 - RNA, 19 nt, Human papillomavirus type 31
gaaacauauucgacuugaa

SEQ ID NO: 2689416 - RNA, 15 nt, Human papillomavirus type 31
gggacaacauuucag

SEQ ID NO: 2689417 - RNA, 15 nt, Human papillomavirus type 31
uauaauccugaaacu

SEQ ID NO: 2689418 - RNA, 12 nt, Human papillomavirus type 31
aacauuaaauaa

SEQ ID NO: 2689419 - RNA, 13 nt, Human papillomavirus type 31
uuaaauaaauuug

SEQ ID NO: 2689420 - RNA, 20 nt, Human papillomavirus type 31
uauuugugugucuugucaua

SEQ ID NO: 2689421 - RNA, 16 nt, Human papillomavirus type 31
ggaagcggaggaacau

SEQ ID NO: 2689422 - RNA, 16 nt, Human papillomavirus type 31
uagacaguccagcugg

SEQ ID NO: 2689423 - RNA, 21 nt, Human papillomavirus type 31
caccuacaggguguuuaaaaa

SEQ ID NO: 2689424 - RNA, 14 nt, Human papillomavirus type 31
uaaauauguguaua

SEQ ID NO: 2689425 - RNA, 21 nt, Human papillomavirus type 31
uacaugugucuguauguguau

SEQ ID NO: 2689426 - RNA, 22 nt, Human papillomavirus type 31
cuacuccauuuugauuuuaugc

SEQ ID NO: 2689427 - RNA, 21 nt, Human papillomavirus type 31
uauguaugcguguguacuugu

SEQ ID NO: 2689428 - RNA, 12 nt, Human papillomavirus type 31
aaauauguguau

SEQ ID NO: 2689429 - RNA, 13 nt, Human papillomavirus type 31
gaaaaugaagaca

SEQ ID NO: 2689430 - RNA, 15 nt, Human papillomavirus type 31
agugauacuggggag

SEQ ID NO: 2689431 - RNA, 16 nt, Human papillomavirus type 45
aaacgaugaagcagau

SEQ ID NO: 2689432 - RNA, 20 nt, Human papillomavirus type 45
cauguaugguguuacuguac

SEQ ID NO: 2689433 - RNA, 15 nt, Human papillomavirus type 45
gauuucgguugccug

SEQ ID NO: 2689434 - RNA, 23 nt, Human papillomavirus type 45
cacaagcauauuuuaucaugcag

SEQ ID NO: 2689435 - RNA, 13 nt, Human papillomavirus type 45
caugcgcaggaag

SEQ ID NO: 2689436 - RNA, 14 nt, Human papillomavirus type 45
auuugcuguauaca

SEQ ID NO: 2689437 - RNA, 17 nt, Human papillomavirus type 45
ugcuguauacauuuguu

SEQ ID NO: 2689438 - RNA, 21 nt, Human papillomavirus type 45
gucucgcacaagcauauuuua

SEQ ID NO: 2689439 - RNA, 15 nt, Human papillomavirus type 45
uugcaggaggcagca

SEQ ID NO: 2689440 - RNA, 21 nt, Human papillomavirus type 45
acaguauauauuauauaacug

SEQ ID NO: 2689441 - RNA, 16 nt, Human papillomavirus type 45
uggaaccucagaauga

SEQ ID NO: 2689442 - RNA, 18 nt, Human papillomavirus type 45
uaacagcauuugcuguau

SEQ ID NO: 2689443 - RNA, 15 nt, Human papillomavirus type 45
uacauuuguugcuau

SEQ ID NO: 2689444 - RNA, 13 nt, Human papillomavirus type 45
uaggggagcagcu

SEQ ID NO: 2689445 - RNA, 14 nt, Human papillomavirus type 45
cccauuaacagcau

SEQ ID NO: 2689446 - RNA, 14 nt, Human papillomavirus type 45
acaaaauuuugugu

SEQ ID NO: 2689447 - RNA, 19 nt, Human papillomavirus type 45
gcaaaacgacgguuguuua

SEQ ID NO: 2689448 - RNA, 17 nt, Human papillomavirus type 45
agagacagcacaggcau

SEQ ID NO: 2689449 - RNA, 20 nt, Human papillomavirus type 45
gagcaagagacagcacaggc

SEQ ID NO: 2689450 - RNA, 23 nt, Human papillomavirus type 45
ugccuuuaugugugcugcaaugu

SEQ ID NO: 2689451 - RNA, 23 nt, Human papillomavirus type 45
gaaaaugcaauacuauuuacagc

SEQ ID NO: 2689452 - RNA, 21 nt, Human papillomavirus type 45
ugcgcaggaaguucagaauga

SEQ ID NO: 2689453 - RNA, 18 nt, Human papillomavirus type 45
aaaacgaugaagcagaug

SEQ ID NO: 2689454 - RNA, 15 nt, Human papillomavirus type 45
cgagucagaggagga

SEQ ID NO: 2689455 - RNA, 22 nt, Human papillomavirus type 45
auauuguauacaguauguaaca

SEQ ID NO: 2689456 - RNA, 17 nt, Human papillomavirus type 45
gcaagagacagcacagg

SEQ ID NO: 2689457 - RNA, 21 nt, Human papillomavirus type 45
auuaacauuucaaaaagcaaa

SEQ ID NO: 2689458 - RNA, 19 nt, Human papillomavirus type 45
agcauauuuuaucaugcag

SEQ ID NO: 2689459 - RNA, 11 nt, Human papillomavirus type 45
ugaugcacagg

SEQ ID NO: 2689460 - RNA, 13 nt, Human papillomavirus type 45
ugcaggaggcagc

SEQ ID NO: 2689461 - RNA, 15 nt, Human papillomavirus type 45
uguugguguuucuuu

SEQ ID NO: 2689462 - RNA, 21 nt, Human papillomavirus type 45
cagccaaauaaguuauuggca

SEQ ID NO: 2689463 - RNA, 21 nt, Human papillomavirus type 45
uuugcgugcguguauguauga

SEQ ID NO: 2689464 - RNA, 18 nt, Human papillomavirus type 45
ggcagagcaagagacagc

SEQ ID NO: 2689465 - RNA, 16 nt, Human papillomavirus type 45
cauuugcuguauacau

SEQ ID NO: 2689466 - RNA, 15 nt, Human papillomavirus type 45
aaaagcaaagcacau

SEQ ID NO: 2689467 - RNA, 17 nt, Human papillomavirus type 45
acaguacaguguaacau

SEQ ID NO: 2689468 - RNA, 18 nt, Human papillomavirus type 45
auaugcaugcuuuacaca

SEQ ID NO: 2689469 - RNA, 12 nt, Human papillomavirus type 45
uacuauaaugua

SEQ ID NO: 2689470 - RNA, 19 nt, Human papillomavirus type 45
acauuucaaaaagcaaagc

SEQ ID NO: 2689471 - RNA, 15 nt, Human papillomavirus type 45
acacuacagcagcug

SEQ ID NO: 2689472 - RNA, 17 nt, Human papillomavirus type 45
cuguggcuuauauguga

SEQ ID NO: 2689473 - RNA, 14 nt, Human papillomavirus type 45
caaaacagcagcau

SEQ ID NO: 2689474 - RNA, 16 nt, Human papillomavirus type 45
acagcgucacaaaauu

SEQ ID NO: 2689475 - RNA, 17 nt, Human papillomavirus type 45
uaacauuacuaugcuau

SEQ ID NO: 2689476 - RNA, 15 nt, Human papillomavirus type 45
auacuauuuacagca

SEQ ID NO: 2689477 - RNA, 13 nt, Human papillomavirus type 45
gcaaagcacauaa

SEQ ID NO: 2689478 - RNA, 18 nt, Human papillomavirus type 45
aaauuggaugauacagaa

SEQ ID NO: 2689479 - RNA, 19 nt, Human papillomavirus type 45
uuagcacauauauguaugu

SEQ ID NO: 2689480 - RNA, 19 nt, Human papillomavirus type 45
cagggauaugggacaaaac

SEQ ID NO: 2689481 - RNA, 17 nt, Human papillomavirus type 45
uacuauaauguacagua

SEQ ID NO: 2689482 - RNA, 19 nt, Human papillomavirus type 45
uugcacaaagcaaguauaa

SEQ ID NO: 2689483 - RNA, 15 nt, Human papillomavirus type 45
auuucaaaaagcaaa

SEQ ID NO: 2689484 - RNA, 22 nt, Human papillomavirus type 45
guauggaaauuggucgugggca

SEQ ID NO: 2689485 - RNA, 18 nt, Human papillomavirus type 45
auauauguauguuuguau

SEQ ID NO: 2689486 - RNA, 16 nt, Human papillomavirus type 45
uagcacauauauguau

SEQ ID NO: 2689487 - RNA, 23 nt, Human papillomavirus type 45
aaagggccuugcacaaagcaagu

SEQ ID NO: 2689488 - RNA, 24 nt, Human papillomavirus type 45
auacuacacagcauccauuuuacu

SEQ ID NO: 2689489 - RNA, 15 nt, Human papillomavirus type 45
acacaccauacaaua

SEQ ID NO: 2689490 - RNA, 20 nt, Human papillomavirus type 45
ugcagucugucuaugugugu

SEQ ID NO: 2689491 - RNA, 13 nt, Human papillomavirus type 45
auaauugugguau

SEQ ID NO: 2689492 - RNA, 14 nt, Human papillomavirus type 45
gcaacagauacagg

SEQ ID NO: 2689493 - RNA, 17 nt, Human papillomavirus type 45
uauucuuuccuguauuu

SEQ ID NO: 2689494 - RNA, 17 nt, Human papillomavirus type 45
auaccugugaugugcau

SEQ ID NO: 2689495 - RNA, 20 nt, Human papillomavirus type 45
auguuagcacauauauguau

SEQ ID NO: 2689496 - RNA, 17 nt, Human papillomavirus type 45
cacauaaagcuauugaa

SEQ ID NO: 2689497 - RNA, 20 nt, Human papillomavirus type 45
cauaaagcuauugaacugca

SEQ ID NO: 2689498 - RNA, 17 nt, Human papillomavirus type 45
ugucccgcuugugcagu

SEQ ID NO: 2689499 - RNA, 14 nt, Human papillomavirus type 45
gacaacuguaugaa

SEQ ID NO: 2689500 - RNA, 20 nt, Human papillomavirus type 45
gauggcaacaaggacaacug

SEQ ID NO: 2689501 - RNA, 12 nt, Human papillomavirus type 45
caggcuguuccu

SEQ ID NO: 2689502 - RNA, 15 nt, Human papillomavirus type 45
cuauggaauacagaa

SEQ ID NO: 2689503 - RNA, 18 nt, Human papillomavirus type 45
guaucccaccgugcagca

SEQ ID NO: 2689504 - RNA, 14 nt, Human papillomavirus type 45
acaauaauuacuau

SEQ ID NO: 2689505 - RNA, 21 nt, Human papillomavirus type 45
auuguuccaugcgcaggaagu

SEQ ID NO: 2689506 - RNA, 23 nt, Human papillomavirus type 45
augcaauacuauuuacagcaagg

SEQ ID NO: 2689507 - RNA, 16 nt, Human papillomavirus type 45
aacugcaacagauaca

SEQ ID NO: 2689508 - RNA, 18 nt, Human papillomavirus type 45
cagaaagugcucaugcag

SEQ ID NO: 2689509 - RNA, 19 nt, Human papillomavirus type 45
uuauccauuugugaacagg

SEQ ID NO: 2689510 - RNA, 17 nt, Human papillomavirus type 45
ugugauauauuacugua

SEQ ID NO: 2689511 - RNA, 13 nt, Human papillomavirus type 45
guuugcaggaggc

SEQ ID NO: 2689512 - RNA, 14 nt, Human papillomavirus type 45
ucuaugugugugcu

SEQ ID NO: 2689513 - RNA, 18 nt, Human papillomavirus type 45
gcauuugcuguauacauu

SEQ ID NO: 2689514 - RNA, 17 nt, Human papillomavirus type 45
ugauauauuacuguauu

SEQ ID NO: 2689515 - RNA, 19 nt, Human papillomavirus type 45
aguuugcaggaggcagcaa

SEQ ID NO: 2689516 - RNA, 13 nt, Human papillomavirus type 45
aguuauaaacuug

SEQ ID NO: 2689517 - RNA, 20 nt, Human papillomavirus type 45
uacaguagagagcucggcag

SEQ ID NO: 2689518 - RNA, 15 nt, Human papillomavirus type 45
gcaggaggcagcaag

SEQ ID NO: 2689519 - RNA, 20 nt, Human papillomavirus type 45
uaacauuucaaaaagcaaag

SEQ ID NO: 2689520 - RNA, 19 nt, Human papillomavirus type 45
uuguauguauguauguauu

SEQ ID NO: 2689521 - RNA, 14 nt, Human papillomavirus type 45
uaauaguguugugu

SEQ ID NO: 2689522 - RNA, 20 nt, Human papillomavirus type 45
uguacaguacaguguaacau

SEQ ID NO: 2689523 - RNA, 22 nt, Human papillomavirus type 45
aucaguauaggguguuuagagu

SEQ ID NO: 2689524 - RNA, 15 nt, Human papillomavirus type 45
guauguuguauguau

SEQ ID NO: 2689525 - RNA, 20 nt, Human papillomavirus type 45
acaguauguaacauuacuau

SEQ ID NO: 2689526 - RNA, 17 nt, Human papillomavirus type 45
caaauaaguuauuggca

SEQ ID NO: 2689527 - RNA, 12 nt, Human papillomavirus type 45
uauauuacugua

SEQ ID NO: 2689528 - RNA, 15 nt, Human papillomavirus type 45
ugggacaguauauau

SEQ ID NO: 2689529 - RNA, 18 nt, Human papillomavirus type 45
uaugggacaaaacagcag

SEQ ID NO: 2689530 - RNA, 22 nt, Human papillomavirus type 45
guaaagacauaaacagccaaau

SEQ ID NO: 2689531 - RNA, 20 nt, Human papillomavirus type 45
ccugugaugugcauguuguu

SEQ ID NO: 2689532 - RNA, 19 nt, Human papillomavirus type 45
uggacacugcaagauacau

SEQ ID NO: 2689533 - RNA, 15 nt, Human papillomavirus type 45
cauguuguuguauuu

SEQ ID NO: 2689534 - RNA, 12 nt, Human papillomavirus type 45
guaauggcuggu

SEQ ID NO: 2689535 - RNA, 14 nt, Human papillomavirus type 45
gugcucaugcagcu

SEQ ID NO: 2689536 - RNA, 15 nt, Human papillomavirus type 45
ccuauguuuguauua

SEQ ID NO: 2689537 - RNA, 23 nt, Human papillomavirus type 45
ugguaucccaccgugcagcacgu

SEQ ID NO: 2689538 - RNA, 14 nt, Human papillomavirus type 45
cacaaagcaaguau

SEQ ID NO: 2689539 - RNA, 22 nt, Human papillomavirus type 45
aaauaaguuauuggcaacuuau

SEQ ID NO: 2689540 - RNA, 14 nt, Human papillomavirus type 45
ggaggcagcaagga

SEQ ID NO: 2689541 - RNA, 22 nt, Human papillomavirus type 45
aauggcugguucuuuguagaaa

SEQ ID NO: 2689542 - RNA, 20 nt, Human papillomavirus type 45
ugcuaucuuuaguguuuuua

SEQ ID NO: 2689543 - RNA, 18 nt, Human papillomavirus type 45
ccuaauaaauuuggauua

SEQ ID NO: 2689544 - RNA, 21 nt, Human papillomavirus type 45
uguaggguugcacccuuguga

SEQ ID NO: 2689545 - RNA, 13 nt, Human papillomavirus type 45
cuauuuacagcaa

SEQ ID NO: 2689546 - RNA, 21 nt, Human papillomavirus type 45
aggaccuuagaacacuacagc

SEQ ID NO: 2689547 - RNA, 14 nt, Human papillomavirus type 45
auaauguacaguac

SEQ ID NO: 2689548 - RNA, 19 nt, Human papillomavirus type 45
ggcagagcaagagacagca

SEQ ID NO: 2689549 - RNA, 18 nt, Human papillomavirus type 45
aaugucccgcuugugcag

SEQ ID NO: 2689550 - RNA, 22 nt, Human papillomavirus type 45
ccugaaacacaacguuugguuu

SEQ ID NO: 2689551 - RNA, 14 nt, Human papillomavirus type 45
gaguuagucaugca

SEQ ID NO: 2689552 - RNA, 16 nt, Human papillomavirus type 45
ucaaaaagcaaagcac

SEQ ID NO: 2689553 - RNA, 19 nt, Human papillomavirus type 45
gauaugggacaaaacagca

SEQ ID NO: 2689554 - RNA, 18 nt, Human papillomavirus type 45
cuuuaugugugcugcaau

SEQ ID NO: 2689555 - RNA, 21 nt, Human papillomavirus type 45
guuguaccuaauggugcaggu

SEQ ID NO: 2689556 - RNA, 11 nt, Human papillomavirus type 45
ggaaaaugcaa

SEQ ID NO: 2689557 - RNA, 14 nt, Human papillomavirus type 45
uuaacagcauuugc

SEQ ID NO: 2689558 - RNA, 12 nt, Human papillomavirus type 45
gcacaaagcaag

SEQ ID NO: 2689559 - RNA, 18 nt, Human papillomavirus type 45
augugcauguuguuguau

SEQ ID NO: 2689560 - RNA, 18 nt, Human papillomavirus type 45
aaagcacauaaagcuauu

SEQ ID NO: 2689561 - RNA, 13 nt, Human papillomavirus type 45
uguauuuuuguau

SEQ ID NO: 2689562 - RNA, 23 nt, Human papillomavirus type 45
aacagccaaauaaguuauuggca

SEQ ID NO: 2689563 - RNA, 22 nt, Human papillomavirus type 45
caacuaccagcccgacgagccg

SEQ ID NO: 2689564 - RNA, 12 nt, Human papillomavirus type 45
aauguacaguac

SEQ ID NO: 2689565 - RNA, 20 nt, Human papillomavirus type 45
gggacaaaacagcagcaugu

SEQ ID NO: 2689566 - RNA, 19 nt, Human papillomavirus type 45
aacugcaacagauacaggg

SEQ ID NO: 2689567 - RNA, 22 nt, Human papillomavirus type 45
cuuauacguuuggaaaaugcaa

SEQ ID NO: 2689568 - RNA, 13 nt, Human papillomavirus type 45
uauugaacugcaa

SEQ ID NO: 2689569 - RNA, 17 nt, Human papillomavirus type 45
ugugaugugcauguugu

SEQ ID NO: 2689570 - RNA, 23 nt, Human papillomavirus type 45
uauuuacagcaagggaacauggu

SEQ ID NO: 2689571 - RNA, 14 nt, Human papillomavirus type 45
auauauuacuguau

SEQ ID NO: 2689572 - RNA, 18 nt, Human papillomavirus type 45
uugcacccuugugaguaa

SEQ ID NO: 2689573 - RNA, 19 nt, Human papillomavirus type 45
augugucucgcacaagcau

SEQ ID NO: 2689574 - RNA, 19 nt, Human papillomavirus type 45
cugucuaugugugugcuuu

SEQ ID NO: 2689575 - RNA, 19 nt, Human papillomavirus type 45
cauuacuaugcuaucuuua

SEQ ID NO: 2689576 - RNA, 22 nt, Human papillomavirus type 45
cuugcacaaagcaaguauaaca

SEQ ID NO: 2689577 - RNA, 15 nt, Human papillomavirus type 45
gcaaggaaaacaguc

SEQ ID NO: 2689578 - RNA, 14 nt, Human papillomavirus type 45
ggaaaaugcaauac

SEQ ID NO: 2689579 - RNA, 16 nt, Human papillomavirus type 45
gcuuauaugugaccuu

SEQ ID NO: 2689580 - RNA, 15 nt, Human papillomavirus type 45
uguguguauguguau

SEQ ID NO: 2689581 - RNA, 15 nt, Human papillomavirus type 45
uauaacugagacagg

SEQ ID NO: 2689582 - RNA, 15 nt, Human papillomavirus type 45
cagguguugcaucuu

SEQ ID NO: 2689583 - RNA, 14 nt, Human papillomavirus type 45
auuuacagcaaggg

SEQ ID NO: 2689584 - RNA, 13 nt, Human papillomavirus type 45
cugugaugugcau

SEQ ID NO: 2689585 - RNA, 15 nt, Human papillomavirus type 45
augguuuuguauguu

SEQ ID NO: 2689586 - RNA, 16 nt, Human papillomavirus type 45
acaaggacaacuguau

SEQ ID NO: 2689587 - RNA, 14 nt, Human papillomavirus type 45
uuuuauugugcuuu

SEQ ID NO: 2689588 - RNA, 22 nt, Human papillomavirus type 45
cagguggugccuccuauuaaca

SEQ ID NO: 2689589 - RNA, 13 nt, Human papillomavirus type 45
ggauccagaaggu

SEQ ID NO: 2689590 - RNA, 19 nt, Human papillomavirus type 45
acauuuguugcuauuuacu

SEQ ID NO: 2689591 - RNA, 18 nt, Human papillomavirus type 45
ugucuaugugugugcuuu

SEQ ID NO: 2689592 - RNA, 21 nt, Human papillomavirus type 45
aacuuauacguuuggaaaaug

SEQ ID NO: 2689593 - RNA, 20 nt, Human papillomavirus type 45
ugcaauacuauuuacagcaa

SEQ ID NO: 2689594 - RNA, 23 nt, Human papillomavirus type 45
auagugggcacaaaaaagcaaaa

SEQ ID NO: 2689595 - RNA, 16 nt, Human papillomavirus type 45
acaaaacagcagcaug

SEQ ID NO: 2689596 - RNA, 16 nt, Human papillomavirus type 45
gucuaugugugugcuu

SEQ ID NO: 2689597 - RNA, 13 nt, Human papillomavirus type 45
acaaaaaagcaaa

SEQ ID NO: 2689598 - RNA, 15 nt, Human papillomavirus type 45
aaagcaaagcacaua

SEQ ID NO: 2689599 - RNA, 21 nt, Human papillomavirus type 45
ugcuuuacacaccauacaaua

SEQ ID NO: 2689600 - RNA, 13 nt, Human papillomavirus type 45
auggcaacaagga

SEQ ID NO: 2689601 - RNA, 17 nt, Human papillomavirus type 45
gcuuauaugugaccuuu

SEQ ID NO: 2689602 - RNA, 14 nt, Human papillomavirus type 45
auuguauacaguau

SEQ ID NO: 2689603 - RNA, 14 nt, Human papillomavirus type 45
uguggcauguaugg

SEQ ID NO: 2689604 - RNA, 20 nt, Human papillomavirus type 45
cauaauaccuaaacuggcac

SEQ ID NO: 2689605 - RNA, 15 nt, Human papillomavirus type 45
aaugaugcacaggug

SEQ ID NO: 2689606 - RNA, 17 nt, Human papillomavirus type 45
auuacuauaauguacag

SEQ ID NO: 2689607 - RNA, 15 nt, Human papillomavirus type 45
cauaugcaugcuuua

SEQ ID NO: 2689608 - RNA, 19 nt, Human papillomavirus type 45
uccauuugugaacaggcag

SEQ ID NO: 2689609 - RNA, 15 nt, Human papillomavirus type 45
ugccuuuaugugugc

SEQ ID NO: 2689610 - RNA, 13 nt, Human papillomavirus type 45
ugguguuacugua

SEQ ID NO: 2689611 - RNA, 23 nt, Human papillomavirus type 45
aagugcucaugcagcuacagcug

SEQ ID NO: 2689612 - RNA, 21 nt, Human papillomavirus type 45
auaauaaauuggaugauacag

SEQ ID NO: 2689613 - RNA, 13 nt, Human papillomavirus type 45
cauuuugcugugc

SEQ ID NO: 2689614 - RNA, 23 nt, Human papillomavirus type 45
guucccgauuauuaacuguaggc

SEQ ID NO: 2689615 - RNA, 22 nt, Human papillomavirus type 45
gaaugugccuuguggcauguau

SEQ ID NO: 2689616 - RNA, 23 nt, Human papillomavirus type 45
caacaaggacaacuguaugaacu

SEQ ID NO: 2689617 - RNA, 17 nt, Human papillomavirus type 45
uccccauuaacagcauu

SEQ ID NO: 2689618 - RNA, 20 nt, Human papillomavirus type 45
uaacuguaggcaauccauau

SEQ ID NO: 2689619 - RNA, 18 nt, Human papillomavirus type 45
agcaaagcacauaaagcu

SEQ ID NO: 2689620 - RNA, 16 nt, Human papillomavirus type 45
gcgucacaaaauuuug

SEQ ID NO: 2689621 - RNA, 15 nt, Human papillomavirus type 45
gaggaauggacacug

SEQ ID NO: 2689622 - RNA, 20 nt, Human papillomavirus type 45
ugugucucgcacaagcauau

SEQ ID NO: 2689623 - RNA, 19 nt, Human papillomavirus type 45
caguccauuaggggagcag

SEQ ID NO: 2689624 - RNA, 16 nt, Human papillomavirus type 45
gccuugcacaaagcaa

SEQ ID NO: 2689625 - RNA, 18 nt, Human papillomavirus type 45
uauuaacauuucaaaaag

SEQ ID NO: 2689626 - RNA, 14 nt, Human papillomavirus type 45
acaguauguaacau

SEQ ID NO: 2689627 - RNA, 19 nt, Human papillomavirus type 45
gaccccgggaaacacugca

SEQ ID NO: 2689628 - RNA, 19 nt, Human papillomavirus type 45
acauaaagcuauugaacug

SEQ ID NO: 2689629 - RNA, 21 nt, Human papillomavirus type 45
cauacuacacagcauccauuu

SEQ ID NO: 2689630 - RNA, 14 nt, Human papillomavirus type 45
uauuguauacagua

SEQ ID NO: 2689631 - RNA, 16 nt, Human papillomavirus type 45
agagaaaaaaacaggg

SEQ ID NO: 2689632 - RNA, 18 nt, Human papillomavirus type 45
aaauuucauuaaauagug

SEQ ID NO: 2689633 - RNA, 22 nt, Human papillomavirus type 45
uaaagggccuugcacaaagcaa

SEQ ID NO: 2689634 - RNA, 20 nt, Human papillomavirus type 45
augugccuuguggcauguau

SEQ ID NO: 2689635 - RNA, 16 nt, Human papillomavirus type 45
caauuaagcgagucag

SEQ ID NO: 2689636 - RNA, 20 nt, Human papillomavirus type 45
uaguguuuuuauugugcuuu

SEQ ID NO: 2689637 - RNA, 12 nt, Human papillomavirus type 45
acuguacauaau

SEQ ID NO: 2689638 - RNA, 16 nt, Human papillomavirus type 45
guauauuguauacagu

SEQ ID NO: 2689639 - RNA, 20 nt, Human papillomavirus type 45
uaucagaugaugaggaugaa

SEQ ID NO: 2689640 - RNA, 18 nt, Human papillomavirus type 45
aaugcaauacuauuuaca

SEQ ID NO: 2689641 - RNA, 13 nt, Human papillomavirus type 45
gcaaguauaacaa

SEQ ID NO: 2689642 - RNA, 16 nt, Human papillomavirus type 45
uacagcagcuguuuuu

SEQ ID NO: 2689643 - RNA, 13 nt, Human papillomavirus type 45
augaaugugccuu

SEQ ID NO: 2689644 - RNA, 21 nt, Human papillomavirus type 45
uguaugaaugugccuuguggc

SEQ ID NO: 2689645 - RNA, 13 nt, Human papillomavirus type 45
uugcuguauacau

SEQ ID NO: 2689646 - RNA, 17 nt, Human papillomavirus type 45
caaggaaaacaguccau

SEQ ID NO: 2689647 - RNA, 19 nt, Human papillomavirus type 45
guccauuaggggagcagcu

SEQ ID NO: 2689648 - RNA, 19 nt, Human papillomavirus type 45
guaucccaccgugcagcac

SEQ ID NO: 2689649 - RNA, 20 nt, Human papillomavirus type 45
auuggucgugggcagccuuu

SEQ ID NO: 2689650 - RNA, 15 nt, Human papillomavirus type 45
gaaugaugcacaggu

SEQ ID NO: 2689651 - RNA, 22 nt, Human papillomavirus type 45
uacuauuuguguguauguguau

SEQ ID NO: 2689652 - RNA, 10 nt, Human papillomavirus type 45
uauauguuua

SEQ ID NO: 2689653 - RNA, 14 nt, Human papillomavirus type 45
gacagcacaggcau

SEQ ID NO: 2689654 - RNA, 14 nt, Human papillomavirus type 45
cauauauguauguu

SEQ ID NO: 2689655 - RNA, 18 nt, Human papillomavirus type 45
aacgaaaguuugcaggag

SEQ ID NO: 2689656 - RNA, 18 nt, Human papillomavirus type 45
gacaaaacagcagcaugu

SEQ ID NO: 2689657 - RNA, 15 nt, Human papillomavirus type 45
uguuccaugcgcagg

SEQ ID NO: 2689658 - RNA, 15 nt, Human papillomavirus type 45
aauaaacaggcuguu

SEQ ID NO: 2689659 - RNA, 18 nt, Human papillomavirus type 45
acaguaaagacauaaaca

SEQ ID NO: 2689660 - RNA, 17 nt, Human papillomavirus type 45
gcuuuucugugugccuu

SEQ ID NO: 2689661 - RNA, 22 nt, Human papillomavirus type 45
accagguggugccuccuauuaa

SEQ ID NO: 2689662 - RNA, 20 nt, Human papillomavirus type 45
uuuguauguuguauguaugu

SEQ ID NO: 2689663 - RNA, 23 nt, Human papillomavirus type 45
gccuuaaagggccuugcacaaag

SEQ ID NO: 2689664 - RNA, 21 nt, Human papillomavirus type 45
ucuaugugugugcuuuugcuu

SEQ ID NO: 2689665 - RNA, 19 nt, Human papillomavirus type 45
auguaauaucagaugauga

SEQ ID NO: 2689666 - RNA, 13 nt, Human papillomavirus type 45
ggcagcaaggaaa

SEQ ID NO: 2689667 - RNA, 16 nt, Human papillomavirus type 45
auguaguaugggacag

SEQ ID NO: 2689668 - RNA, 16 nt, Human papillomavirus type 45
auggcaacaaggacaa

SEQ ID NO: 2689669 - RNA, 21 nt, Human papillomavirus type 45
gaaaguuugcaggaggcagca

SEQ ID NO: 2689670 - RNA, 18 nt, Human papillomavirus type 45
ccaugguaucccaccgug

SEQ ID NO: 2689671 - RNA, 17 nt, Human papillomavirus type 45
agguauccgcauaucag

SEQ ID NO: 2689672 - RNA, 17 nt, Human papillomavirus type 45
auacuauuuguguguau

SEQ ID NO: 2689673 - RNA, 19 nt, Human papillomavirus type 45
aagaaauuguauugcauuu

SEQ ID NO: 2689674 - RNA, 15 nt, Human papillomavirus type 45
ugcaggaggcagcaa

SEQ ID NO: 2689675 - RNA, 12 nt, Human papillomavirus type 45
cuguacauaauu

SEQ ID NO: 2689676 - RNA, 14 nt, Human papillomavirus type 45
cauuaacagcauuu

SEQ ID NO: 2689677 - RNA, 21 nt, Human papillomavirus type 45
uaacauaccugugaugugcau

SEQ ID NO: 2689678 - RNA, 14 nt, Human papillomavirus type 45
aacaauuguagaga

SEQ ID NO: 2689679 - RNA, 16 nt, Human papillomavirus type 45
acuguaggcaauccau

SEQ ID NO: 2689680 - RNA, 13 nt, Human papillomavirus type 45
ucaugcaggcagu

SEQ ID NO: 2689681 - RNA, 12 nt, Human papillomavirus type 45
uauguaugaaug

SEQ ID NO: 2689682 - RNA, 13 nt, Human papillomavirus type 45
gaaaaaaacaggg

SEQ ID NO: 2689683 - RNA, 12 nt, Human papillomavirus type 45
augcacaggugu

SEQ ID NO: 2689684 - RNA, 20 nt, Human papillomavirus type 45
uguauacauuuguugcuauu

SEQ ID NO: 2689685 - RNA, 13 nt, Human papillomavirus type 45
cuaccuauguuug

SEQ ID NO: 2689686 - RNA, 23 nt, Human papillomavirus type 45
gaaaacaguccauuaggggagca

SEQ ID NO: 2689687 - RNA, 16 nt, Human papillomavirus type 45
aauccauauuuuaggg

SEQ ID NO: 2689688 - RNA, 20 nt, Human papillomavirus type 45
guauuggccuaaguggccau

SEQ ID NO: 2689689 - RNA, 15 nt, Human papillomavirus type 45
auauauaauccugaa

SEQ ID NO: 2689690 - RNA, 14 nt, Human papillomavirus type 45
cauaugcaugcuuu

SEQ ID NO: 2689691 - RNA, 17 nt, Human papillomavirus type 45
ccauuuugcugugcaac

SEQ ID NO: 2689692 - RNA, 14 nt, Human papillomavirus type 45
gcuauugaacugca

SEQ ID NO: 2689693 - RNA, 14 nt, Human papillomavirus type 45
auaaagcuauugaa

SEQ ID NO: 2689694 - RNA, 15 nt, Human papillomavirus type 45
cauuuugcugugcaa

SEQ ID NO: 2689695 - RNA, 19 nt, Human papillomavirus type 45
guccacgguuacaagaaau

SEQ ID NO: 2689696 - RNA, 14 nt, Human papillomavirus type 45
cgugcguguaugua

SEQ ID NO: 2689697 - RNA, 20 nt, Human papillomavirus type 45
gcaauacuauuuacagcaag

SEQ ID NO: 2689698 - RNA, 22 nt, Human papillomavirus type 45
aagggccuugcacaaagcaagu

SEQ ID NO: 2689699 - RNA, 14 nt, Human papillomavirus type 45
aaaccgugcacgua

SEQ ID NO: 2689700 - RNA, 17 nt, Human papillomavirus type 45
aacuauggaauacagaa

SEQ ID NO: 2689701 - RNA, 23 nt, Human papillomavirus type 45
gauacaugcgaggaacuauggaa

SEQ ID NO: 2689702 - RNA, 16 nt, Human papillomavirus type 45
ugcaggaggcagcaag

SEQ ID NO: 2689703 - RNA, 16 nt, Human papillomavirus type 45
auguauguauguauuu

SEQ ID NO: 2689704 - RNA, 13 nt, Human papillomavirus type 45
aguucagaaugau

SEQ ID NO: 2689705 - RNA, 18 nt, Human papillomavirus type 45
uauaauaaauuggaugau

SEQ ID NO: 2689706 - RNA, 17 nt, Human papillomavirus type 45
caguauguaacauuacu

SEQ ID NO: 2689707 - RNA, 17 nt, Human papillomavirus type 45
uguaugguguuacugua

SEQ ID NO: 2689708 - RNA, 17 nt, Human papillomavirus type 45
cauauuuuaucaugcag

SEQ ID NO: 2689709 - RNA, 16 nt, Human papillomavirus type 45
uauuuuauauguuuaa

SEQ ID NO: 2689710 - RNA, 13 nt, Human papillomavirus type 45
cagaaugaugcac

SEQ ID NO: 2689711 - RNA, 20 nt, Human papillomavirus type 45
gugcagguaauaaacaggcu

SEQ ID NO: 2689712 - RNA, 16 nt, Human papillomavirus type 45
uuguauuuuuguauuu

SEQ ID NO: 2689713 - RNA, 17 nt, Human papillomavirus type 45
auguaugaaugugccuu

SEQ ID NO: 2689714 - RNA, 20 nt, Human papillomavirus type 45
uugugcuuuucugugugccu

SEQ ID NO: 2689715 - RNA, 13 nt, Human papillomavirus type 45
aucagaugaugag

SEQ ID NO: 2689716 - RNA, 15 nt, Human papillomavirus type 45
caagagacagcacag

SEQ ID NO: 2689717 - RNA, 23 nt, Human papillomavirus type 45
auaccuaaacuggcacauuuaca

SEQ ID NO: 2689718 - RNA, 14 nt, Human papillomavirus type 45
aguuugcaggaggc

SEQ ID NO: 2689719 - RNA, 18 nt, Human papillomavirus type 45
aggaggcagcaaggaaaa

SEQ ID NO: 2689720 - RNA, 22 nt, Human papillomavirus type 45
auuggccuaaguggccauccau

SEQ ID NO: 2689721 - RNA, 12 nt, Human papillomavirus type 45
cagcacaggcau

SEQ ID NO: 2689722 - RNA, 21 nt, Human papillomavirus type 45
ugguucuuuguagaaacaauu

SEQ ID NO: 2689723 - RNA, 16 nt, Human papillomavirus type 45
gagacagcacaggcau

SEQ ID NO: 2689724 - RNA, 22 nt, Human papillomavirus type 45
ggcagcaaggaaaacaguccau

SEQ ID NO: 2689725 - RNA, 13 nt, Human papillomavirus type 45
cuacaauggcgga

SEQ ID NO: 2689726 - RNA, 17 nt, Human papillomavirus type 45
uugucagcacugaugau

SEQ ID NO: 2689727 - RNA, 11 nt, Human papillomavirus type 45
auaugggacaa

SEQ ID NO: 2689728 - RNA, 15 nt, Human papillomavirus type 45
cuuuuaaacauaaua

SEQ ID NO: 2689729 - RNA, 13 nt, Human papillomavirus type 45
uauauuacuguau

SEQ ID NO: 2689730 - RNA, 15 nt, Human papillomavirus type 45
uccauuuuacuuaua

SEQ ID NO: 2689731 - RNA, 16 nt, Human papillomavirus type 45
uggcggauccagaagg

SEQ ID NO: 2689732 - RNA, 23 nt, Human papillomavirus type 45
auuguagagaaaaaaacagggga

SEQ ID NO: 2689733 - RNA, 19 nt, Human papillomavirus type 45
acagcagcuguuuuugagc

SEQ ID NO: 2689734 - RNA, 15 nt, Human papillomavirus type 45
uuuaugugugcugca

SEQ ID NO: 2689735 - RNA, 15 nt, Human papillomavirus type 45
uuguguguaugugua

SEQ ID NO: 2689736 - RNA, 16 nt, Human papillomavirus type 45
uauauuguauacagua

SEQ ID NO: 2689737 - RNA, 13 nt, Human papillomavirus type 45
uauuacuguauuu

SEQ ID NO: 2689738 - RNA, 12 nt, Human papillomavirus type 45
agugggcacaaa

SEQ ID NO: 2689739 - RNA, 15 nt, Human papillomavirus type 45
caaaaagcaaagcac

SEQ ID NO: 2689740 - RNA, 15 nt, Human papillomavirus type 45
gcaauccauauuuua

SEQ ID NO: 2689741 - RNA, 14 nt, Human papillomavirus type 45
auuaacauuucaaa

SEQ ID NO: 2689742 - RNA, 23 nt, Human papillomavirus type 45
guauggaaauuggucgugggcag

SEQ ID NO: 2689743 - RNA, 21 nt, Human papillomavirus type 45
aaaccaccagguggugccucc

SEQ ID NO: 2689744 - RNA, 17 nt, Human papillomavirus type 45
gucccgcuugugcaguc

SEQ ID NO: 2689745 - RNA, 17 nt, Human papillomavirus type 45
aggaggcagcaaggaaa

SEQ ID NO: 2689746 - RNA, 16 nt, Human papillomavirus type 45
cagcacaggcauuguu

SEQ ID NO: 2689747 - RNA, 18 nt, Human papillomavirus type 45
guaccuaauggugcaggu

SEQ ID NO: 2689748 - RNA, 14 nt, Human papillomavirus type 45
gcuuuacacaccau

SEQ ID NO: 2689749 - RNA, 23 nt, Human papillomavirus type 45
caagaaauuucauuaaauagugg

SEQ ID NO: 2689750 - RNA, 17 nt, Human papillomavirus type 45
uauaguuguuauuacau

SEQ ID NO: 2689751 - RNA, 15 nt, Human papillomavirus type 45
cugcaagaaauugua

SEQ ID NO: 2689752 - RNA, 18 nt, Human papillomavirus type 45
accaccuucuguggccag

SEQ ID NO: 2689753 - RNA, 14 nt, Human papillomavirus type 45
uauguaacauuacu

SEQ ID NO: 2689754 - RNA, 20 nt, Human papillomavirus type 45
acuauaauguacaguacagu

SEQ ID NO: 2689755 - RNA, 21 nt, Human papillomavirus type 45
caugguauuaccaaacuaaac

SEQ ID NO: 2689756 - RNA, 19 nt, Human papillomavirus type 45
uggcaacaaggacaacugu

SEQ ID NO: 2689757 - RNA, 16 nt, Human papillomavirus type 45
acagcaagggaacaug

SEQ ID NO: 2689758 - RNA, 21 nt, Human papillomavirus type 45
uauuuacuaccuauguuugua

SEQ ID NO: 2689759 - RNA, 22 nt, Human papillomavirus type 45
caauacuauuuguguguaugug

SEQ ID NO: 2689760 - RNA, 21 nt, Human papillomavirus type 45
agcuauugaacugcaaauggc

SEQ ID NO: 2689761 - RNA, 17 nt, Human papillomavirus type 45
acuuauacguuuggaaa

SEQ ID NO: 2689762 - RNA, 14 nt, Human papillomavirus type 45
acuaaccaauaauc

SEQ ID NO: 2689763 - RNA, 13 nt, Human papillomavirus type 45
gcaggcaguuccc

SEQ ID NO: 2689764 - RNA, 16 nt, Human papillomavirus type 45
uacauaauugugguau

SEQ ID NO: 2689765 - RNA, 23 nt, Human papillomavirus type 45
uuuauugugcuuuucugugugcc

SEQ ID NO: 2689766 - RNA, 17 nt, Human papillomavirus type 45
uacauuuguugcuauuu

SEQ ID NO: 2689767 - RNA, 17 nt, Human papillomavirus type 45
uuugauggcaacaagga

SEQ ID NO: 2689768 - RNA, 18 nt, Human papillomavirus type 45
gugaacaggcagagcaag

SEQ ID NO: 2689769 - RNA, 13 nt, Human papillomavirus type 45
uuuauugugcuuu

SEQ ID NO: 2689770 - RNA, 13 nt, Human papillomavirus type 45
aauguacaguaca

SEQ ID NO: 2689771 - RNA, 16 nt, Human papillomavirus type 45
guauguuuguauguau

SEQ ID NO: 2689772 - RNA, 14 nt, Human papillomavirus type 45
guuuggaaaaugca

SEQ ID NO: 2689773 - RNA, 16 nt, Human papillomavirus type 45
auauuguauacaguau

SEQ ID NO: 2689774 - RNA, 15 nt, Human papillomavirus type 45
uaccugugaugugca

SEQ ID NO: 2689775 - RNA, 16 nt, Human papillomavirus type 45
uauguuuguauuacau

SEQ ID NO: 2689776 - RNA, 18 nt, Human papillomavirus type 45
ggccuugcacaaagcaag

SEQ ID NO: 2689777 - RNA, 21 nt, Human papillomavirus type 45
guuguguaggguugcacccuu

SEQ ID NO: 2689778 - RNA, 17 nt, Human papillomavirus type 45
cugguucuuuguagaaa

SEQ ID NO: 2689779 - RNA, 13 nt, Human papillomavirus type 45
aaguauaacaaug

SEQ ID NO: 2689780 - RNA, 21 nt, Human papillomavirus type 45
auauguauguuuguauguaug

SEQ ID NO: 2689781 - RNA, 21 nt, Human papillomavirus type 45
aucuguauauuguauacagua

SEQ ID NO: 2689782 - RNA, 19 nt, Human papillomavirus type 45
guuguaccuaauggugcag

SEQ ID NO: 2689783 - RNA, 21 nt, Human papillomavirus type 45
guagagaaaaaaacaggggau

SEQ ID NO: 2689784 - RNA, 17 nt, Human papillomavirus type 45
ugaaacugcaacagaua

SEQ ID NO: 2689785 - RNA, 16 nt, Human papillomavirus type 45
agagcucggcagagga

SEQ ID NO: 2689786 - RNA, 17 nt, Human papillomavirus type 45
aaguucagaaugaugca

SEQ ID NO: 2689787 - RNA, 19 nt, Human papillomavirus type 45
gguuguaccuaauggugca

SEQ ID NO: 2689788 - RNA, 17 nt, Human papillomavirus type 45
acgagccgaaccacagc

SEQ ID NO: 2689789 - RNA, 15 nt, Human papillomavirus type 45
ccuugcacaaagcaa

SEQ ID NO: 2689790 - RNA, 22 nt, Human papillomavirus type 45
aucuuccaccaccuucuguggc

SEQ ID NO: 2689791 - RNA, 15 nt, Human papillomavirus type 45
uaagugugacggcag

SEQ ID NO: 2689792 - RNA, 17 nt, Human papillomavirus type 45
ugaggaauggacacugc

SEQ ID NO: 2689793 - RNA, 16 nt, Human papillomavirus type 45
accuuuuaaacauaau

SEQ ID NO: 2689794 - RNA, 21 nt, Human papillomavirus type 45
caguauauauuauauaacuga

SEQ ID NO: 2689795 - RNA, 13 nt, Human papillomavirus type 45
uaucaugcaggca

SEQ ID NO: 2689796 - RNA, 13 nt, Human papillomavirus type 45
aaggaaaacaguc

SEQ ID NO: 2689797 - RNA, 16 nt, Human papillomavirus type 45
uaguuguuauuacauc

SEQ ID NO: 2689798 - RNA, 17 nt, Human papillomavirus type 45
gaaacacugcaagaaau

SEQ ID NO: 2689799 - RNA, 14 nt, Human papillomavirus type 45
uaacuguaggcaau

SEQ ID NO: 2689800 - RNA, 17 nt, Human papillomavirus type 45
cauaauaccuaaacugg

SEQ ID NO: 2689801 - RNA, 22 nt, Human papillomavirus type 5
uaacuguaggucauccuuauuu

SEQ ID NO: 2689802 - RNA, 21 nt, Human papillomavirus type 5
gguguccgugucggaggaacc

SEQ ID NO: 2689803 - RNA, 18 nt, Human papillomavirus type 5
gguaguacaucuaaagaa

SEQ ID NO: 2689804 - RNA, 23 nt, Human papillomavirus type 5
aggagccugacaacgaaaggauc

SEQ ID NO: 2689805 - RNA, 14 nt, Human papillomavirus type 5
gauccuaacagauu

SEQ ID NO: 2689806 - RNA, 18 nt, Human papillomavirus type 5
ugcuaccaguugaccugu

SEQ ID NO: 2689807 - RNA, 20 nt, Human papillomavirus type 5
ccuggucauggguggcagga

SEQ ID NO: 2689808 - RNA, 19 nt, Human papillomavirus type 5
gcuccugugcccugacugu

SEQ ID NO: 2689809 - RNA, 21 nt, Human papillomavirus type 5
caguugaccuguuuugugaag

SEQ ID NO: 2689810 - RNA, 17 nt, Human papillomavirus type 5
ggaugauaaguggcaua

SEQ ID NO: 2689811 - RNA, 16 nt, Human papillomavirus type 5
caacgaaaggaucucu

SEQ ID NO: 2689812 - RNA, 16 nt, Human papillomavirus type 5
caaaggaguugauaag

SEQ ID NO: 2689813 - RNA, 13 nt, Human papillomavirus type 5
acucgagcugacu

SEQ ID NO: 2689814 - RNA, 20 nt, Human papillomavirus type 5
ucuccuggugaagugggagg

SEQ ID NO: 2689815 - RNA, 20 nt, Human papillomavirus type 5
agcucagugaggugcagccc

SEQ ID NO: 2689816 - RNA, 15 nt, Human papillomavirus type 5
agaagcgcuccagaa

SEQ ID NO: 2689817 - RNA, 17 nt, Human papillomavirus type 5
aaaggaguugauaaggc

SEQ ID NO: 2689818 - RNA, 21 nt, Human papillomavirus type 5
uccgugcgguugcaggaacug

SEQ ID NO: 2689819 - RNA, 18 nt, Human papillomavirus type 5
aagguaguacaucuaaag

SEQ ID NO: 2689820 - RNA, 22 nt, Human papillomavirus type 5
gcuacaggguacgugccacuug

SEQ ID NO: 2689821 - RNA, 23 nt, Human papillomavirus type 5
uugauaccagcauagaaacauuu

SEQ ID NO: 2689822 - RNA, 23 nt, Human papillomavirus type 5
guuuauuggaagcugacuguagu

SEQ ID NO: 2689823 - RNA, 18 nt, Human papillomavirus type 5
caguaucagaaacaaagg

SEQ ID NO: 2689824 - RNA, 17 nt, Human papillomavirus type 5
ggagugugagcagagcg

SEQ ID NO: 2689825 - RNA, 15 nt, Human papillomavirus type 5
acuaucaugcauuua

SEQ ID NO: 2689826 - RNA, 13 nt, Human papillomavirus type 5
gaacuauuucauc

SEQ ID NO: 2689827 - RNA, 11 nt, Human papillomavirus type 5
cgagcaggaaa

SEQ ID NO: 2689828 - RNA, 12 nt, Human papillomavirus type 5
aaggcuaaagaa

SEQ ID NO: 2689829 - RNA, 18 nt, Human papillomavirus type 5
caggagugugagcagagc

SEQ ID NO: 2689830 - RNA, 21 nt, Human papillomavirus type 5
cuuacgaaaagaaccuguauu

SEQ ID NO: 2689831 - RNA, 20 nt, Human papillomavirus type 5
gcucuuugcagagcaggaca

SEQ ID NO: 2689832 - RNA, 16 nt, Human papillomavirus type 5
acccgguacacucagu

SEQ ID NO: 2689833 - RNA, 17 nt, Human papillomavirus type 5
cgauaccccaaaggagu

SEQ ID NO: 2689834 - RNA, 17 nt, Human papillomavirus type 5
cauacuaacauacccua

SEQ ID NO: 2689835 - RNA, 16 nt, Human papillomavirus type 5
aauagguaggggccag

SEQ ID NO: 2689836 - RNA, 14 nt, Human papillomavirus type 5
cacuucaaaaaagg

SEQ ID NO: 2689837 - RNA, 15 nt, Human papillomavirus type 5
agcgucuaggcaggc

SEQ ID NO: 2689838 - RNA, 22 nt, Human papillomavirus type 5
uuugcucaugagccauggacuc

SEQ ID NO: 2689839 - RNA, 23 nt, Human papillomavirus type 5
aaguuauuuaugacaaugaucca

SEQ ID NO: 2689840 - RNA, 14 nt, Human papillomavirus type 5
agucuuccaaggau

SEQ ID NO: 2689841 - RNA, 19 nt, Human papillomavirus type 5
ccuguuuugugaagaggaa

SEQ ID NO: 2689842 - RNA, 15 nt, Human papillomavirus type 5
aauauagaaucagau

SEQ ID NO: 2689843 - RNA, 12 nt, Human papillomavirus type 5
ggagcucaguga

SEQ ID NO: 2689844 - RNA, 13 nt, Human papillomavirus type 5
aaugaagcugaag

SEQ ID NO: 2689845 - RNA, 22 nt, Human papillomavirus type 5
gugauugguguuuauuggaagc

SEQ ID NO: 2689846 - RNA, 22 nt, Human papillomavirus type 5
gcccugacugucgcggaaacug

SEQ ID NO: 2689847 - RNA, 16 nt, Human papillomavirus type 5
cugcaaacaggcaggc

SEQ ID NO: 2689848 - RNA, 12 nt, Human papillomavirus type 5
gaagcugaagau

SEQ ID NO: 2689849 - RNA, 14 nt, Human papillomavirus type 5
gagucaauuucauu

SEQ ID NO: 2689850 - RNA, 15 nt, Human papillomavirus type 5
gcaagaaguggggug

SEQ ID NO: 2689851 - RNA, 13 nt, Human papillomavirus type 5
agcaauggugcug

SEQ ID NO: 2689852 - RNA, 19 nt, Human papillomavirus type 5
agaaacaaaggcuaaagaa

SEQ ID NO: 2689853 - RNA, 22 nt, Human papillomavirus type 5
uacuggucacccuuauuucaau

SEQ ID NO: 2689854 - RNA, 15 nt, Human papillomavirus type 5
cgugccacuugggga

SEQ ID NO: 2689855 - RNA, 22 nt, Human papillomavirus type 5
aggggcggcuaacacacugaaa

SEQ ID NO: 2689856 - RNA, 14 nt, Human papillomavirus type 5
gcaaacaggcaggc

SEQ ID NO: 2689857 - RNA, 18 nt, Human papillomavirus type 5
gaaacaaaggcuaaagaa

SEQ ID NO: 2689858 - RNA, 13 nt, Human papillomavirus type 5
auucaaagaacaa

SEQ ID NO: 2689859 - RNA, 19 nt, Human papillomavirus type 5
auggugcugcagcuugagu

SEQ ID NO: 2689860 - RNA, 21 nt, Human papillomavirus type 5
cuccgugcgguugcaggaacu

SEQ ID NO: 2689861 - RNA, 14 nt, Human papillomavirus type 5
ggccuuccuugguu

SEQ ID NO: 2689862 - RNA, 19 nt, Human papillomavirus type 5
ggcaggcccagaaugcuca

SEQ ID NO: 2689863 - RNA, 12 nt, Human papillomavirus type 5
acauuuacuaau

SEQ ID NO: 2689864 - RNA, 14 nt, Human papillomavirus type 5
auucccuggaacua

SEQ ID NO: 2689865 - RNA, 15 nt, Human papillomavirus type 5
caccccagcagaagu

SEQ ID NO: 2689866 - RNA, 17 nt, Human papillomavirus type 5
agcagaagucuaagcga

SEQ ID NO: 2689867 - RNA, 20 nt, Human papillomavirus type 5
agcaggaaacggaggaggag

SEQ ID NO: 2689868 - RNA, 13 nt, Human papillomavirus type 5
aguacuaccuggu

SEQ ID NO: 2689869 - RNA, 19 nt, Human papillomavirus type 5
uguauacaauguggaccua

SEQ ID NO: 2689870 - RNA, 20 nt, Human papillomavirus type 5
agaggaauuaccaaacgagc

SEQ ID NO: 2689871 - RNA, 17 nt, Human papillomavirus type 5
uacauuuuguauuugcu

SEQ ID NO: 2689872 - RNA, 15 nt, Human papillomavirus type 5
acaggagugugagca

SEQ ID NO: 2689873 - RNA, 16 nt, Human papillomavirus type 5
gugagcagagcgagga

SEQ ID NO: 2689874 - RNA, 14 nt, Human papillomavirus type 5
uauuggaagcugac

SEQ ID NO: 2689875 - RNA, 17 nt, Human papillomavirus type 5
acuugagucaauuucau

SEQ ID NO: 2689876 - RNA, 18 nt, Human papillomavirus type 5
ucggauuuguuagaugau

SEQ ID NO: 2689877 - RNA, 16 nt, Human papillomavirus type 5
uacuggaagaagcucg

SEQ ID NO: 2689878 - RNA, 18 nt, Human papillomavirus type 5
uacuggucacccuuauuu

SEQ ID NO: 2689879 - RNA, 15 nt, Human papillomavirus type 5
gcuuuugcuacuaac

SEQ ID NO: 2689880 - RNA, 22 nt, Human papillomavirus type 5
ucaugcauuuagugacagauug

SEQ ID NO: 2689881 - RNA, 21 nt, Human papillomavirus type 5
gcacugagcgucuaggcaggc

SEQ ID NO: 2689882 - RNA, 19 nt, Human papillomavirus type 5
auauuuaccaaaccugcaa

SEQ ID NO: 2689883 - RNA, 14 nt, Human papillomavirus type 5
cuggagcucaguga

SEQ ID NO: 2689884 - RNA, 17 nt, Human papillomavirus type 5
uaaugcugcuuuugcua

SEQ ID NO: 2689885 - RNA, 16 nt, Human papillomavirus type 5
auuucaauaaaguaaa

SEQ ID NO: 2689886 - RNA, 16 nt, Human papillomavirus type 5
auccagauaaugccaa

SEQ ID NO: 2689887 - RNA, 18 nt, Human papillomavirus type 5
uuaguccgcgacuugagu

SEQ ID NO: 2689888 - RNA, 20 nt, Human papillomavirus type 5
caaaccugcaaacaggcagg

SEQ ID NO: 2689889 - RNA, 15 nt, Human papillomavirus type 5
gagucacuacagaca

SEQ ID NO: 2689890 - RNA, 16 nt, Human papillomavirus type 5
uggacucagaacagac

SEQ ID NO: 2689891 - RNA, 22 nt, Human papillomavirus type 5
auuugagagagauacagacucu

SEQ ID NO: 2689892 - RNA, 17 nt, Human papillomavirus type 5
cagaacaaacauugcag

SEQ ID NO: 2689893 - RNA, 19 nt, Human papillomavirus type 5
gacagucuuuaacauuuac

SEQ ID NO: 2689894 - RNA, 13 nt, Human papillomavirus type 5
gcugacuguagug

SEQ ID NO: 2689895 - RNA, 23 nt, Human papillomavirus type 5
ugaugaagcggugcgauacccca

SEQ ID NO: 2689896 - RNA, 20 nt, Human papillomavirus type 5
aguugauaaggccuauggca

SEQ ID NO: 2689897 - RNA, 18 nt, Human papillomavirus type 5
cugagcgucuaggcaggc

SEQ ID NO: 2689898 - RNA, 21 nt, Human papillomavirus type 5
gcgauaccccaaaggaguuga

SEQ ID NO: 2689899 - RNA, 20 nt, Human papillomavirus type 5
ugcugguguauuuuuuggug

SEQ ID NO: 2689900 - RNA, 17 nt, Human papillomavirus type 5
cauggguggcaggagau

SEQ ID NO: 2689901 - RNA, 21 nt, Human papillomavirus type 5
uacuaaugcugcuuuugcuac

SEQ ID NO: 2689902 - RNA, 15 nt, Human papillomavirus type 5
cacccuuauuucaau

SEQ ID NO: 2689903 - RNA, 18 nt, Human papillomavirus type 5
auauuauucuggagcuca

SEQ ID NO: 2689904 - RNA, 13 nt, Human papillomavirus type 5
ggaagcugacugu

SEQ ID NO: 2689905 - RNA, 18 nt, Human papillomavirus type 5
guguccgugucggaggaa

SEQ ID NO: 2689906 - RNA, 15 nt, Human papillomavirus type 5
uaguacaucuaaaga

SEQ ID NO: 2689907 - RNA, 16 nt, Human papillomavirus type 5
gugcgguugcaggaac

SEQ ID NO: 2689908 - RNA, 16 nt, Human papillomavirus type 5
auggcaaccuggacag

SEQ ID NO: 2689909 - RNA, 13 nt, Human papillomavirus type 5
ucuuugcagagca

SEQ ID NO: 2689910 - RNA, 18 nt, Human papillomavirus type 5
ggaagcugacuguaguga

SEQ ID NO: 2689911 - RNA, 21 nt, Human papillomavirus type 5
uggcaaaccuuacgaaaagaa

SEQ ID NO: 2689912 - RNA, 17 nt, Human papillomavirus type 5
acuaacauacccuagca

SEQ ID NO: 2689913 - RNA, 12 nt, Human papillomavirus type 5
gcgguugcagga

SEQ ID NO: 2689914 - RNA, 15 nt, Human papillomavirus type 5
ugcaagauauuauuc

SEQ ID NO: 2689915 - RNA, 23 nt, Human papillomavirus type 5
gaaacggaggaggagccugacaa

SEQ ID NO: 2689916 - RNA, 13 nt, Human papillomavirus type 5
gagugugagcaga

SEQ ID NO: 2689917 - RNA, 14 nt, Human papillomavirus type 5
acucgagcugacuu

SEQ ID NO: 2689918 - RNA, 14 nt, Human papillomavirus type 5
gccagaguccaaag

SEQ ID NO: 2689919 - RNA, 15 nt, Human papillomavirus type 5
ucuuuaacauuuacu

SEQ ID NO: 2689920 - RNA, 13 nt, Human papillomavirus type 5
cauccuuauuuca

SEQ ID NO: 2689921 - RNA, 16 nt, Human papillomavirus type 5
auuucgccuaaaauua

SEQ ID NO: 2689922 - RNA, 15 nt, Human papillomavirus type 5
gugccacuuggggaa

SEQ ID NO: 2689923 - RNA, 15 nt, Human papillomavirus type 5
gaagguccugguguc

SEQ ID NO: 2689924 - RNA, 15 nt, Human papillomavirus type 5
ggagauggcacugag

SEQ ID NO: 2689925 - RNA, 14 nt, Human papillomavirus type 5
acugaacuggagca

SEQ ID NO: 2689926 - RNA, 18 nt, Human papillomavirus type 5
uauauuuuuuuuuacauu

SEQ ID NO: 2689927 - RNA, 19 nt, Human papillomavirus type 5
caggccgaggaacuggggg

SEQ ID NO: 2689928 - RNA, 16 nt, Human papillomavirus type 5
agaucugcagcuccug

SEQ ID NO: 2689929 - RNA, 13 nt, Human papillomavirus type 5
ccugacaaagaac

SEQ ID NO: 2689930 - RNA, 19 nt, Human papillomavirus type 5
caguaucagaaacaaaggc

SEQ ID NO: 2689931 - RNA, 22 nt, Human papillomavirus type 5
gcagcuccugugcccugacugu

SEQ ID NO: 2689932 - RNA, 14 nt, Human papillomavirus type 5
ccaaaccugcaaac

SEQ ID NO: 2689933 - RNA, 13 nt, Human papillomavirus type 5
augaagcugaaga

SEQ ID NO: 2689934 - RNA, 17 nt, Human papillomavirus type 5
uguuuaggucauuuagu

SEQ ID NO: 2689935 - RNA, 22 nt, Human papillomavirus type 5
uacaauguggaccuauguguau

SEQ ID NO: 2689936 - RNA, 14 nt, Human papillomavirus type 5
cagcuccugugccc

SEQ ID NO: 2689937 - RNA, 17 nt, Human papillomavirus type 5
ccugcaaacaggcaggc

SEQ ID NO: 2689938 - RNA, 16 nt, Human papillomavirus type 5
cagagcaggacagcgg

SEQ ID NO: 2689939 - RNA, 17 nt, Human papillomavirus type 5
acaacaguugcugacaa

SEQ ID NO: 2689940 - RNA, 13 nt, Human papillomavirus type 5
gcaaccuggacag

SEQ ID NO: 2689941 - RNA, 21 nt, Human papillomavirus type 5
uaggcaggcccagaaugcuca

SEQ ID NO: 2689942 - RNA, 22 nt, Human papillomavirus type 5
aucugauuuugcucaugagcca

SEQ ID NO: 2689943 - RNA, 17 nt, Human papillomavirus type 5
aaugcugcuuuugcuac

SEQ ID NO: 2689944 - RNA, 14 nt, Human papillomavirus type 5
acugcaaacaugac

SEQ ID NO: 2689945 - RNA, 22 nt, Human papillomavirus type 5
uccagauaaugccaauuuguau

SEQ ID NO: 2689946 - RNA, 18 nt, Human papillomavirus type 5
acauuuuguauuugcuau

SEQ ID NO: 2689947 - RNA, 23 nt, Human papillomavirus type 5
gauugguguuuauuggaagcuga

SEQ ID NO: 2689948 - RNA, 23 nt, Human papillomavirus type 5
cugcagcuugagucacuacagac

SEQ ID NO: 2689949 - RNA, 22 nt, Human papillomavirus type 5
uugccaauauagaaucagauca

SEQ ID NO: 2689950 - RNA, 18 nt, Human papillomavirus type 5
ugcauuuagugacagauu

SEQ ID NO: 2689951 - RNA, 22 nt, Human papillomavirus type 5
aguacuggucacccuuauuuca

SEQ ID NO: 2689952 - RNA, 15 nt, Human papillomavirus type 5
uucaucaacaggagu

SEQ ID NO: 2689953 - RNA, 15 nt, Human papillomavirus type 5
agauccuaacagauu

SEQ ID NO: 2689954 - RNA, 13 nt, Human papillomavirus type 5
agaaccuguauua

SEQ ID NO: 2689955 - RNA, 17 nt, Human papillomavirus type 5
gcuccugugcccugacu

SEQ ID NO: 2689956 - RNA, 19 nt, Human papillomavirus type 5
aaggcucuuugcagagcag

SEQ ID NO: 2689957 - RNA, 16 nt, Human papillomavirus type 5
uagggaccuccccaaa

SEQ ID NO: 2689958 - RNA, 19 nt, Human papillomavirus type 5
aaauuaccagauccuaaca

SEQ ID NO: 2689959 - RNA, 19 nt, Human papillomavirus type 5
gucuuuaacauuuacuaau

SEQ ID NO: 2689960 - RNA, 22 nt, Human papillomavirus type 5
caaaggagagauuuugaugaag

SEQ ID NO: 2689961 - RNA, 22 nt, Human papillomavirus type 5
aacuggagcagggcaauucccu

SEQ ID NO: 2689962 - RNA, 23 nt, Human papillomavirus type 5
acuguagugauguagaaaaugau

SEQ ID NO: 2689963 - RNA, 23 nt, Human papillomavirus type 5
gcagcuccugugcccugacuguc

SEQ ID NO: 2689964 - RNA, 12 nt, Human papillomavirus type 5
auggacucuagu

SEQ ID NO: 2689965 - RNA, 16 nt, Human papillomavirus type 5
aucagaucagugccaa

SEQ ID NO: 2689966 - RNA, 17 nt, Human papillomavirus type 5
gccauagcaauggugcu

SEQ ID NO: 2689967 - RNA, 16 nt, Human papillomavirus type 5
ccagaguccaaagcac

SEQ ID NO: 2689968 - RNA, 16 nt, Human papillomavirus type 5
aguacuaccuggucau

SEQ ID NO: 2689969 - RNA, 15 nt, Human papillomavirus type 5
uuuugugaagaggaa

SEQ ID NO: 2689970 - RNA, 21 nt, Human papillomavirus type 5
gacucuguaacucauauuuac

SEQ ID NO: 2689971 - RNA, 21 nt, Human papillomavirus type 5
augauacugaacuggagcagg

SEQ ID NO: 2689972 - RNA, 19 nt, Human papillomavirus type 5
agagcuaaaauuaaauaca

SEQ ID NO: 2689973 - RNA, 13 nt, Human papillomavirus type 5
gguggccuuggua

SEQ ID NO: 2689974 - RNA, 17 nt, Human papillomavirus type 5
uaaacaaugaagcugaa

SEQ ID NO: 2689975 - RNA, 17 nt, Human papillomavirus type 5
caggagauggcacugag

SEQ ID NO: 2689976 - RNA, 15 nt, Human papillomavirus type 5
acagucuuuaacauu

SEQ ID NO: 2689977 - RNA, 16 nt, Human papillomavirus type 5
ucauuuaguacuaccu

SEQ ID NO: 2689978 - RNA, 15 nt, Human papillomavirus type 5
cuuauuucaauguau

SEQ ID NO: 2689979 - RNA, 14 nt, Human papillomavirus type 5
ugggacaauuauuu

SEQ ID NO: 2689980 - RNA, 22 nt, Human papillomavirus type 5
acuggucacccuuauuucaaua

SEQ ID NO: 2689981 - RNA, 23 nt, Human papillomavirus type 5
ugcagcccgaagugcuaccaguu

SEQ ID NO: 2689982 - RNA, 14 nt, Human papillomavirus type 5
gcgucuaggcaggc

SEQ ID NO: 2689983 - RNA, 10 nt, Human papillomavirus type 5
aacugugagg

SEQ ID NO: 2689984 - RNA, 15 nt, Human papillomavirus type 5
cauccuuauuucaau

SEQ ID NO: 2689985 - RNA, 13 nt, Human papillomavirus type 5
aaagcauacagga

SEQ ID NO: 2689986 - RNA, 22 nt, Human papillomavirus type 5
auacucaaaggagagauuuuga

SEQ ID NO: 2689987 - RNA, 15 nt, Human papillomavirus type 5
ggcucuuugcagagc

SEQ ID NO: 2689988 - RNA, 11 nt, Human papillomavirus type 5
cuaaugcugcu

SEQ ID NO: 2689989 - RNA, 23 nt, Human papillomavirus type 5
uacugaccggagaucugcagcuc

SEQ ID NO: 2689990 - RNA, 14 nt, Human papillomavirus type 5
auuggaagcugacu

SEQ ID NO: 2689991 - RNA, 23 nt, Human papillomavirus type 5
aaaggggcggcuaacacacugaa

SEQ ID NO: 2689992 - RNA, 14 nt, Human papillomavirus type 5
agguguuacaaggc

SEQ ID NO: 2689993 - RNA, 15 nt, Human papillomavirus type 5
ccaacagcuacugac

SEQ ID NO: 2689994 - RNA, 19 nt, Human papillomavirus type 5
guugauauuuugcccauug

SEQ ID NO: 2689995 - RNA, 13 nt, Human papillomavirus type 5
uggaagaagcucg

SEQ ID NO: 2689996 - RNA, 13 nt, Human papillomavirus type 5
auuugcuauggcg

SEQ ID NO: 2689997 - RNA, 21 nt, Human papillomavirus type 5
uaccagauccuaacagauuug

SEQ ID NO: 2689998 - RNA, 21 nt, Human papillomavirus type 5
aggucauccuuauuucaaugu

SEQ ID NO: 2689999 - RNA, 22 nt, Human papillomavirus type 5
ugcuuuugcuacuaacauacua

SEQ ID NO: 2690000 - RNA, 18 nt, Human papillomavirus type 5
ggagcucagugaggugca

SEQ ID NO: 2690001 - RNA, 21 nt, Human papillomavirus type 5
uagaaucagaucagugccaaa

SEQ ID NO: 2690002 - RNA, 11 nt, Human papillomavirus type 5
cggaggaggag

SEQ ID NO: 2690003 - RNA, 15 nt, Human papillomavirus type 5
gacaccgguggccag

SEQ ID NO: 2690004 - RNA, 14 nt, Human papillomavirus type 5
agaucugcagcucc

SEQ ID NO: 2690005 - RNA, 11 nt, Human papillomavirus type 5
uggaagcugac

SEQ ID NO: 2690006 - RNA, 15 nt, Human papillomavirus type 5
gaccuccccaaagaa

SEQ ID NO: 2690007 - RNA, 16 nt, Human papillomavirus type 5
agcgcuccagaagguc

SEQ ID NO: 2690008 - RNA, 19 nt, Human papillomavirus type 5
ggauuagggaccuccccaa

SEQ ID NO: 2690009 - RNA, 16 nt, Human papillomavirus type 5
ugcccauugauacagu

SEQ ID NO: 2690010 - RNA, 15 nt, Human papillomavirus type 5
aacagauuugcauua

SEQ ID NO: 2690011 - RNA, 22 nt, Human papillomavirus type 5
agaaugcucauuagcuuuucuu

SEQ ID NO: 2690012 - RNA, 22 nt, Human papillomavirus type 5
ugcaggcacaaauuaaacauug

SEQ ID NO: 2690013 - RNA, 22 nt, Human papillomavirus type 5
caaaagcugucgcacagcuuag

SEQ ID NO: 2690014 - RNA, 19 nt, Human papillomavirus type 5
agcuuuccaacagcuacug

SEQ ID NO: 2690015 - RNA, 16 nt, Human papillomavirus type 5
cuauacucaaaggaga

SEQ ID NO: 2690016 - RNA, 23 nt, Human papillomavirus type 5
cauuuagaagcgcuccagaaggu

SEQ ID NO: 2690017 - RNA, 16 nt, Human papillomavirus type 5
aaugcugcuuuugcua

SEQ ID NO: 2690018 - RNA, 22 nt, Human papillomavirus type 5
agcuccgugcgguugcaggaac

SEQ ID NO: 2690019 - RNA, 14 nt, Human papillomavirus type 5
gugccacuugggga

SEQ ID NO: 2690020 - RNA, 21 nt, Human papillomavirus type 5
cgagcaggaaacggaggagga

SEQ ID NO: 2690021 - RNA, 21 nt, Human papillomavirus type 5
ggagcucagugaggugcagcc

SEQ ID NO: 2690022 - RNA, 16 nt, Human papillomavirus type 5
aaguggcauaaggcaa

SEQ ID NO: 2690023 - RNA, 20 nt, Human papillomavirus type 5
uaucaaccugugccuguaaa

SEQ ID NO: 2690024 - RNA, 18 nt, Human papillomavirus type 5
uacauucaaagaacaaau

SEQ ID NO: 2690025 - RNA, 19 nt, Human papillomavirus type 5
uaccaaacgagcaggaaac

SEQ ID NO: 2690026 - RNA, 14 nt, Human papillomavirus type 5
cuguagugauguag

SEQ ID NO: 2690027 - RNA, 16 nt, Human papillomavirus type 5
ugagucacuacagaca

SEQ ID NO: 2690028 - RNA, 15 nt, Human papillomavirus type 5
aaccugcaaacaggc

SEQ ID NO: 2690029 - RNA, 13 nt, Human papillomavirus type 5
caaugaagcugaa

SEQ ID NO: 2690030 - RNA, 17 nt, Human papillomavirus type 5
cuacugaccggagaucu

SEQ ID NO: 2690031 - RNA, 16 nt, Human papillomavirus type 5
uugguauuaguacagg

SEQ ID NO: 2690032 - RNA, 17 nt, Human papillomavirus type 5
gacaauuauuugagaga

SEQ ID NO: 2690033 - RNA, 19 nt, Human papillomavirus type 5
uaaugcugcuuuugcuacu

SEQ ID NO: 2690034 - RNA, 17 nt, Human papillomavirus type 5
cuaaugcugcuuuugcu

SEQ ID NO: 2690035 - RNA, 18 nt, Human papillomavirus type 5
ggacucgagcugacuuua

SEQ ID NO: 2690036 - RNA, 17 nt, Human papillomavirus type 5
cuuggaagauuacugga

SEQ ID NO: 2690037 - RNA, 22 nt, Human papillomavirus type 5
aggccuauggcaaccuggacag

SEQ ID NO: 2690038 - RNA, 21 nt, Human papillomavirus type 5
acucagucaaguuguugccaa

SEQ ID NO: 2690039 - RNA, 14 nt, Human papillomavirus type 5
guggcaggagaugg

SEQ ID NO: 2690040 - RNA, 16 nt, Human papillomavirus type 5
cuacagacaucugauu

SEQ ID NO: 2690041 - RNA, 13 nt, Human papillomavirus type 5
gucuaggcaggcc

SEQ ID NO: 2690042 - RNA, 12 nt, Human papillomavirus type 5
gaagcugacugu

SEQ ID NO: 2690043 - RNA, 22 nt, Human papillomavirus type 5
cgaaggcucuuugcagagcagg

SEQ ID NO: 2690044 - RNA, 18 nt, Human papillomavirus type 5
caaagcauacaggacgac

SEQ ID NO: 2690045 - RNA, 14 nt, Human papillomavirus type 5
acuggagcagggca

SEQ ID NO: 2690046 - RNA, 13 nt, Human papillomavirus type 5
agaaacaaaggcu

SEQ ID NO: 2690047 - RNA, 13 nt, Human papillomavirus type 5
acaaugaagcuga

SEQ ID NO: 2690048 - RNA, 20 nt, Human papillomavirus type 5
gagaaagguguuacaaggcu

SEQ ID NO: 2690049 - RNA, 13 nt, Human papillomavirus type 5
uccugugcccuga

SEQ ID NO: 2690050 - RNA, 19 nt, Human papillomavirus type 5
cucuuugcagagcaggaca

SEQ ID NO: 2690051 - RNA, 13 nt, Human papillomavirus type 5
aggacgacuugga

SEQ ID NO: 2690052 - RNA, 20 nt, Human papillomavirus type 5
auuuaguacuaccuggucau

SEQ ID NO: 2690053 - RNA, 12 nt, Human papillomavirus type 5
aacaggcaggca

SEQ ID NO: 2690054 - RNA, 16 nt, Human papillomavirus type 5
cuuuaacauuuacuaa

SEQ ID NO: 2690055 - RNA, 12 nt, Human papillomavirus type 5
gaucugcagcuc

SEQ ID NO: 2690056 - RNA, 20 nt, Human papillomavirus type 5
auacauucaaagaacaaaua

SEQ ID NO: 2690057 - RNA, 17 nt, Human papillomavirus type 5
cugagcgucuaggcagg

SEQ ID NO: 2690058 - RNA, 22 nt, Human papillomavirus type 5
aaauuaccagauccuaacagau

SEQ ID NO: 2690059 - RNA, 14 nt, Human papillomavirus type 5
aagcugacuguagu

SEQ ID NO: 2690060 - RNA, 22 nt, Human papillomavirus type 5
gauacugaacuggagcagggca

SEQ ID NO: 2690061 - RNA, 16 nt, Human papillomavirus type 5
caaauaucuacuauca

SEQ ID NO: 2690062 - RNA, 16 nt, Human papillomavirus type 5
gucgcacagcuuaguc

SEQ ID NO: 2690063 - RNA, 16 nt, Human papillomavirus type 5
gucauggguggcagga

SEQ ID NO: 2690064 - RNA, 23 nt, Human papillomavirus type 5
gugcugguguauuuuuugguggc

SEQ ID NO: 2690065 - RNA, 17 nt, Human papillomavirus type 5
guacaggccgaggaacu

SEQ ID NO: 2690066 - RNA, 17 nt, Human papillomavirus type 5
uguuagaugauacugaa

SEQ ID NO: 2690067 - RNA, 18 nt, Human papillomavirus type 5
agaggcuuagaaauaggu

SEQ ID NO: 2690068 - RNA, 22 nt, Human papillomavirus type 5
auuuuaaaauauggcagugcug

SEQ ID NO: 2690069 - RNA, 21 nt, Human papillomavirus type 5
uguaggucauccuuauuucaa

SEQ ID NO: 2690070 - RNA, 15 nt, Human papillomavirus type 5
guauaagucuuccaa

SEQ ID NO: 2690071 - RNA, 22 nt, Human papillomavirus type 5
caagauauuauucuggagcuca

SEQ ID NO: 2690072 - RNA, 13 nt, Human papillomavirus type 5
agaacaaauaucu

SEQ ID NO: 2690073 - RNA, 22 nt, Human papillomavirus type 5
aucaacaggagugugagcagag

SEQ ID NO: 2690074 - RNA, 17 nt, Human papillomavirus type 5
ugacaaugauccagaua

SEQ ID NO: 2690075 - RNA, 22 nt, Human papillomavirus type 5
caggagugugagcagagcgagg

SEQ ID NO: 2690076 - RNA, 19 nt, Human papillomavirus type 5
uacauuuuguauuugcuau

SEQ ID NO: 2690077 - RNA, 19 nt, Human papillomavirus type 5
caaugaagcugaagauguu

SEQ ID NO: 2690078 - RNA, 20 nt, Human papillomavirus type 5
aucagugccaaacacaccgu

SEQ ID NO: 2690079 - RNA, 23 nt, Human papillomavirus type 5
uaaaauauggcagugcuggugua

SEQ ID NO: 2690080 - RNA, 17 nt, Human papillomavirus type 5
agagauacagacucuga

SEQ ID NO: 2690081 - RNA, 14 nt, Human papillomavirus type 5
ugcagagcaggaca

SEQ ID NO: 2690082 - RNA, 15 nt, Human papillomavirus type 5
gcagagcgaggagca

SEQ ID NO: 2690083 - RNA, 23 nt, Human papillomavirus type 5
ccgcgacuugagucaauuucauu

SEQ ID NO: 2690084 - RNA, 21 nt, Human papillomavirus type 5
aacaaaggcuaaagaagccau

SEQ ID NO: 2690085 - RNA, 14 nt, Human papillomavirus type 5
uaacagauuugcau

SEQ ID NO: 2690086 - RNA, 18 nt, Human papillomavirus type 5
gcucagugaggugcagcc

SEQ ID NO: 2690087 - RNA, 16 nt, Human papillomavirus type 5
cuggaacuauuucauc

SEQ ID NO: 2690088 - RNA, 23 nt, Human papillomavirus type 5
ugauugguguuuauuggaagcug

SEQ ID NO: 2690089 - RNA, 20 nt, Human papillomavirus type 5
uaacauuuacuaaugcugcu

SEQ ID NO: 2690090 - RNA, 16 nt, Human papillomavirus type 5
aggaacugugagguca

SEQ ID NO: 2690091 - RNA, 23 nt, Human papillomavirus type 5
ucaacaggagugugagcagagcg

SEQ ID NO: 2690092 - RNA, 18 nt, Human papillomavirus type 5
guuagaugauacugaacu

SEQ ID NO: 2690093 - RNA, 23 nt, Human papillomavirus type 5
agagcuaaaauuaaauacauggg

SEQ ID NO: 2690094 - RNA, 16 nt, Human papillomavirus type 5
acugagcgucuaggca

SEQ ID NO: 2690095 - RNA, 20 nt, Human papillomavirus type 5
uacauuuuguauuugcuaug

SEQ ID NO: 2690096 - RNA, 19 nt, Human papillomavirus type 5
caggagugugagcagagcg

SEQ ID NO: 2690097 - RNA, 20 nt, Human papillomavirus type 5
ccuuccuugguuccugaaac

SEQ ID NO: 2690098 - RNA, 20 nt, Human papillomavirus type 5
uaggucauccuuauuucaau

SEQ ID NO: 2690099 - RNA, 23 nt, Human papillomavirus type 5
cacagcuuaguccgcgacuugag

SEQ ID NO: 2690100 - RNA, 14 nt, Human papillomavirus type 5
aaacgagcaggaaa

SEQ ID NO: 2690101 - RNA, 14 nt, Human papillomavirus type 5
cgagcugacuuuaa

SEQ ID NO: 2690102 - RNA, 13 nt, Human papillomavirus type 5
ugagguuccuaag

SEQ ID NO: 2690103 - RNA, 22 nt, Human papillomavirus type 5
acuuuaaacaaugaagcugaag

SEQ ID NO: 2690104 - RNA, 20 nt, Human papillomavirus type 5
gaccuguuuugugaagagga

SEQ ID NO: 2690105 - RNA, 19 nt, Human papillomavirus type 5
uuuaaacaaugaagcugaa

SEQ ID NO: 2690106 - RNA, 15 nt, Human papillomavirus type 5
ggcccagaaugcuca

SEQ ID NO: 2690107 - RNA, 15 nt, Human papillomavirus type 5
auguauacaauauua

SEQ ID NO: 2690108 - RNA, 14 nt, Human papillomavirus type 6
gucuggguguacag

SEQ ID NO: 2690109 - RNA, 20 nt, Human papillomavirus type 6
agcucagaagaugaggugga

SEQ ID NO: 2690110 - RNA, 16 nt, Human papillomavirus type 6
gugggcaggggacagc

SEQ ID NO: 2690111 - RNA, 21 nt, Human papillomavirus type 6
gcacugggccuccucaaaggc

SEQ ID NO: 2690112 - RNA, 23 nt, Human papillomavirus type 6
ucaaacauguaaacucacuggaa

SEQ ID NO: 2690113 - RNA, 19 nt, Human papillomavirus type 6
gauuaugugguauggacag

SEQ ID NO: 2690114 - RNA, 11 nt, Human papillomavirus type 6
auauguaaaug

SEQ ID NO: 2690115 - RNA, 22 nt, Human papillomavirus type 6
uaauguaauuuauuuguguaau

SEQ ID NO: 2690116 - RNA, 17 nt, Human papillomavirus type 6
ucauccuuauuuuucca

SEQ ID NO: 2690117 - RNA, 20 nt, Human papillomavirus type 6
acauguauggaagugguacc

SEQ ID NO: 2690118 - RNA, 16 nt, Human papillomavirus type 6
uuaugaaauguggcaa

SEQ ID NO: 2690119 - RNA, 15 nt, Human papillomavirus type 6
cacuauagccgaggc

SEQ ID NO: 2690120 - RNA, 12 nt, Human papillomavirus type 6
uauaauugcauu

SEQ ID NO: 2690121 - RNA, 18 nt, Human papillomavirus type 6
aaggcgauaaacacacca

SEQ ID NO: 2690122 - RNA, 22 nt, Human papillomavirus type 6
acaauggauuaugugguaugga

SEQ ID NO: 2690123 - RNA, 22 nt, Human papillomavirus type 6
gucaggauaucaauacagggua

SEQ ID NO: 2690124 - RNA, 15 nt, Human papillomavirus type 6
ccuauuguaauuugu

SEQ ID NO: 2690125 - RNA, 17 nt, Human papillomavirus type 6
uguguauauauguguau

SEQ ID NO: 2690126 - RNA, 21 nt, Human papillomavirus type 6
guuaugaaauguggcaaacac

SEQ ID NO: 2690127 - RNA, 21 nt, Human papillomavirus type 6
aagccacauaggaaugcaagu

SEQ ID NO: 2690128 - RNA, 24 nt, Human papillomavirus type 6
uauaccauggcacauaguagggcc

SEQ ID NO: 2690129 - RNA, 15 nt, Human papillomavirus type 6
guaauacaacuguac

SEQ ID NO: 2690130 - RNA, 17 nt, Human papillomavirus type 6
guauguguguauaugua

SEQ ID NO: 2690131 - RNA, 19 nt, Human papillomavirus type 6
guccgaagcaaaaggacau

SEQ ID NO: 2690132 - RNA, 16 nt, Human papillomavirus type 6
ccacauaggaaugcaa

SEQ ID NO: 2690133 - RNA, 15 nt, Human papillomavirus type 6
ggguguaaguggaca

SEQ ID NO: 2690134 - RNA, 21 nt, Human papillomavirus type 6
aauauauuuuuauauuugcaa

SEQ ID NO: 2690135 - RNA, 21 nt, Human papillomavirus type 6
aagaaacaaguuaugaaaugu

SEQ ID NO: 2690136 - RNA, 16 nt, Human papillomavirus type 6
guugugcaguguacag

SEQ ID NO: 2690137 - RNA, 16 nt, Human papillomavirus type 6
auuuuuauauuugcaa

SEQ ID NO: 2690138 - RNA, 18 nt, Human papillomavirus type 6
aacaccaccuaaacgcug

SEQ ID NO: 2690139 - RNA, 17 nt, Human papillomavirus type 6
auacuuauuguauggau

SEQ ID NO: 2690140 - RNA, 15 nt, Human papillomavirus type 6
cauuuguuguauguu

SEQ ID NO: 2690141 - RNA, 23 nt, Human papillomavirus type 6
caaaacuguugugccaaaggugu

SEQ ID NO: 2690142 - RNA, 19 nt, Human papillomavirus type 6
caaacacaacuguaaugau

SEQ ID NO: 2690143 - RNA, 17 nt, Human papillomavirus type 6
acuccuggguaaaggug

SEQ ID NO: 2690144 - RNA, 19 nt, Human papillomavirus type 6
agaagcuauagugcaacac

SEQ ID NO: 2690145 - RNA, 14 nt, Human papillomavirus type 6
cuaaacaaacaugu

SEQ ID NO: 2690146 - RNA, 16 nt, Human papillomavirus type 6
ucagagaagugcaaca

SEQ ID NO: 2690147 - RNA, 16 nt, Human papillomavirus type 6
ucucuuuuugauccca

SEQ ID NO: 2690148 - RNA, 14 nt, Human papillomavirus type 6
uagguaguccauau

SEQ ID NO: 2690149 - RNA, 21 nt, Human papillomavirus type 6
gaggggucuggguguacagga

SEQ ID NO: 2690150 - RNA, 19 nt, Human papillomavirus type 6
agacaucagagaagugcaa

SEQ ID NO: 2690151 - RNA, 14 nt, Human papillomavirus type 6
uaaacaaacaugua

SEQ ID NO: 2690152 - RNA, 20 nt, Human papillomavirus type 6
uguauccaaaguuguugcca

SEQ ID NO: 2690153 - RNA, 20 nt, Human papillomavirus type 6
uaacaacccccuugcaauuu

SEQ ID NO: 2690154 - RNA, 22 nt, Human papillomavirus type 6
cgauggcggacgauucagguac

SEQ ID NO: 2690155 - RNA, 22 nt, Human papillomavirus type 6
gugguaccuguacaaauagcug

SEQ ID NO: 2690156 - RNA, 15 nt, Human papillomavirus type 6
ugaugacagcaauau

SEQ ID NO: 2690157 - RNA, 22 nt, Human papillomavirus type 6
aauuccuaagguggaacacaac

SEQ ID NO: 2690158 - RNA, 21 nt, Human papillomavirus type 6
guaugggcaugcacaggccua

SEQ ID NO: 2690159 - RNA, 14 nt, Human papillomavirus type 6
agagaagugcaaca

SEQ ID NO: 2690160 - RNA, 19 nt, Human papillomavirus type 6
cauacuuauuguauggaua

SEQ ID NO: 2690161 - RNA, 16 nt, Human papillomavirus type 6
cagguacacaaauauc

SEQ ID NO: 2690162 - RNA, 16 nt, Human papillomavirus type 6
ugaaaauucagggagu

SEQ ID NO: 2690163 - RNA, 17 nt, Human papillomavirus type 6
ucuauuacuagugggcc

SEQ ID NO: 2690164 - RNA, 17 nt, Human papillomavirus type 6
ggaacuucugcaaaacc

SEQ ID NO: 2690165 - RNA, 17 nt, Human papillomavirus type 6
auauauuuuuguuucca

SEQ ID NO: 2690166 - RNA, 17 nt, Human papillomavirus type 6
aguggugguaacccugg

SEQ ID NO: 2690167 - RNA, 14 nt, Human papillomavirus type 6
gcaaacaauacaau

SEQ ID NO: 2690168 - RNA, 20 nt, Human papillomavirus type 6
cuacauugugaacacacagc

SEQ ID NO: 2690169 - RNA, 14 nt, Human papillomavirus type 6
uuauacuuacuauu

SEQ ID NO: 2690170 - RNA, 15 nt, Human papillomavirus type 6
uaauguguaugugug

SEQ ID NO: 2690171 - RNA, 12 nt, Human papillomavirus type 6
caagacagccaa

SEQ ID NO: 2690172 - RNA, 22 nt, Human papillomavirus type 6
aauuugauggcugugcaaacaa

SEQ ID NO: 2690173 - RNA, 19 nt, Human papillomavirus type 6
caccgguuccggcacuggg

SEQ ID NO: 2690174 - RNA, 16 nt, Human papillomavirus type 6
uacagaaacagacauc

SEQ ID NO: 2690175 - RNA, 16 nt, Human papillomavirus type 6
augcgacugugcagga

SEQ ID NO: 2690176 - RNA, 20 nt, Human papillomavirus type 6
auguguguuuaugugcaaua

SEQ ID NO: 2690177 - RNA, 14 nt, Human papillomavirus type 6
ugggcaugcacagg

SEQ ID NO: 2690178 - RNA, 16 nt, Human papillomavirus type 6
ugcauuggaaaugcau

SEQ ID NO: 2690179 - RNA, 22 nt, Human papillomavirus type 6
aauuuguauauauguaaaugug

SEQ ID NO: 2690180 - RNA, 21 nt, Human papillomavirus type 6
gaagcuauagugcaacaccca

SEQ ID NO: 2690181 - RNA, 18 nt, Human papillomavirus type 6
uaaauguguaaauauaug

SEQ ID NO: 2690182 - RNA, 14 nt, Human papillomavirus type 6
uaacccuggacagg

SEQ ID NO: 2690183 - RNA, 13 nt, Human papillomavirus type 6
auauguaaaugug

SEQ ID NO: 2690184 - RNA, 22 nt, Human papillomavirus type 6
uagugccaccauuaaagguguc

SEQ ID NO: 2690185 - RNA, 16 nt, Human papillomavirus type 6
aauacaauggauuaug

SEQ ID NO: 2690186 - RNA, 15 nt, Human papillomavirus type 6
aacaaccagcacauu

SEQ ID NO: 2690187 - RNA, 22 nt, Human papillomavirus type 6
uauuaacaacccccuugcaauu

SEQ ID NO: 2690188 - RNA, 13 nt, Human papillomavirus type 6
augaggaugagga

SEQ ID NO: 2690189 - RNA, 13 nt, Human papillomavirus type 6
uguguuguguaua

SEQ ID NO: 2690190 - RNA, 19 nt, Human papillomavirus type 6
gcucagaagaugaggugga

SEQ ID NO: 2690191 - RNA, 18 nt, Human papillomavirus type 6
uaugauacugcuggugau

SEQ ID NO: 2690192 - RNA, 19 nt, Human papillomavirus type 6
agccacauaggaaugcaag

SEQ ID NO: 2690193 - RNA, 11 nt, Human papillomavirus type 6
aaacaaacaug

SEQ ID NO: 2690194 - RNA, 16 nt, Human papillomavirus type 6
acauuuauuugauuua

SEQ ID NO: 2690195 - RNA, 16 nt, Human papillomavirus type 6
agaggugggcagggga

SEQ ID NO: 2690196 - RNA, 17 nt, Human papillomavirus type 6
uaugugccuuuauugua

SEQ ID NO: 2690197 - RNA, 14 nt, Human papillomavirus type 6
uauguaacuaugca

SEQ ID NO: 2690198 - RNA, 20 nt, Human papillomavirus type 6
gagcaauuaguagacagcuc

SEQ ID NO: 2690199 - RNA, 15 nt, Human papillomavirus type 6
ggaggcggacaccca

SEQ ID NO: 2690200 - RNA, 19 nt, Human papillomavirus type 6
ccaauaauauauuuuuaua

SEQ ID NO: 2690201 - RNA, 20 nt, Human papillomavirus type 6
gccgaggcaguggaaaguga

SEQ ID NO: 2690202 - RNA, 20 nt, Human papillomavirus type 6
uguauguacuguuauguaua

SEQ ID NO: 2690203 - RNA, 16 nt, Human papillomavirus type 6
uuuguauauauguaaa

SEQ ID NO: 2690204 - RNA, 17 nt, Human papillomavirus type 6
uauagugcaacacccaa

SEQ ID NO: 2690205 - RNA, 23 nt, Human papillomavirus type 6
aucugugcuaguacuaacacugc

SEQ ID NO: 2690206 - RNA, 17 nt, Human papillomavirus type 6
cuaagguggaacacaac

SEQ ID NO: 2690207 - RNA, 12 nt, Human papillomavirus type 6
auauuuguaaca

SEQ ID NO: 2690208 - RNA, 13 nt, Human papillomavirus type 6
guauauauguaaa

SEQ ID NO: 2690209 - RNA, 16 nt, Human papillomavirus type 6
caaauaucagacgaug

SEQ ID NO: 2690210 - RNA, 14 nt, Human papillomavirus type 6
gccauugaaaugca

SEQ ID NO: 2690211 - RNA, 22 nt, Human papillomavirus type 6
gcaguguacagaaacagacauc

SEQ ID NO: 2690212 - RNA, 18 nt, Human papillomavirus type 6
gcaguguacagaaacaga

SEQ ID NO: 2690213 - RNA, 18 nt, Human papillomavirus type 6
agaagcuauagugcaaca

SEQ ID NO: 2690214 - RNA, 17 nt, Human papillomavirus type 6
ggguaaaggugcauagu

SEQ ID NO: 2690215 - RNA, 17 nt, Human papillomavirus type 6
uagaccugcaaccucca

SEQ ID NO: 2690216 - RNA, 16 nt, Human papillomavirus type 6
uauagugcaacaccca

SEQ ID NO: 2690217 - RNA, 15 nt, Human papillomavirus type 6
guguaauguguaugu

SEQ ID NO: 2690218 - RNA, 23 nt, Human papillomavirus type 6
cagauccuaacaaauuugcauug

SEQ ID NO: 2690219 - RNA, 13 nt, Human papillomavirus type 6
uagugaggaacaa

SEQ ID NO: 2690220 - RNA, 15 nt, Human papillomavirus type 6
uuguguaauguguau

SEQ ID NO: 2690221 - RNA, 14 nt, Human papillomavirus type 6
guacauguauggaa

SEQ ID NO: 2690222 - RNA, 17 nt, Human papillomavirus type 6
guuauguauauguguuu

SEQ ID NO: 2690223 - RNA, 19 nt, Human papillomavirus type 6
uaacuacauuauuguauau

SEQ ID NO: 2690224 - RNA, 19 nt, Human papillomavirus type 6
uagguguggguguaagugg

SEQ ID NO: 2690225 - RNA, 18 nt, Human papillomavirus type 6
caacaguuuuuaaauguu

SEQ ID NO: 2690226 - RNA, 18 nt, Human papillomavirus type 6
uuguuagcaucauacuua

SEQ ID NO: 2690227 - RNA, 12 nt, Human papillomavirus type 6
cccuggacagga

SEQ ID NO: 2690228 - RNA, 19 nt, Human papillomavirus type 6
agaaacagacaucagagaa

SEQ ID NO: 2690229 - RNA, 19 nt, Human papillomavirus type 6
ugagcaauuaguagacagc

SEQ ID NO: 2690230 - RNA, 15 nt, Human papillomavirus type 6
uguauauguacuguu

SEQ ID NO: 2690231 - RNA, 15 nt, Human papillomavirus type 6
ugauacugcugguga

SEQ ID NO: 2690232 - RNA, 14 nt, Human papillomavirus type 6
aacuguaaugauga

SEQ ID NO: 2690233 - RNA, 13 nt, Human papillomavirus type 6
uauuguguacaca

SEQ ID NO: 2690234 - RNA, 15 nt, Human papillomavirus type 6
caccuauuguaauuu

SEQ ID NO: 2690235 - RNA, 16 nt, Human papillomavirus type 6
cuagaggugggcaggg

SEQ ID NO: 2690236 - RNA, 21 nt, Human papillomavirus type 6
caggccuagaggugggcaggg

SEQ ID NO: 2690237 - RNA, 17 nt, Human papillomavirus type 6
cuauuguggcugcuauu

SEQ ID NO: 2690238 - RNA, 21 nt, Human papillomavirus type 6
guguguauauauguguaugug

SEQ ID NO: 2690239 - RNA, 21 nt, Human papillomavirus type 6
uggugguaacccuggacagga

SEQ ID NO: 2690240 - RNA, 19 nt, Human papillomavirus type 6
gguaacccuggacaggaua

SEQ ID NO: 2690241 - RNA, 13 nt, Human papillomavirus type 6
gugccuccuccua

SEQ ID NO: 2690242 - RNA, 21 nt, Human papillomavirus type 6
uuuuaucaugccagcaguucu

SEQ ID NO: 2690243 - RNA, 23 nt, Human papillomavirus type 6
uauagugcaacacccaacaggua

SEQ ID NO: 2690244 - RNA, 21 nt, Human papillomavirus type 6
aucauagugaggaacaaaggc

SEQ ID NO: 2690245 - RNA, 23 nt, Human papillomavirus type 6
cagauguguaugugcaggacacu

SEQ ID NO: 2690246 - RNA, 20 nt, Human papillomavirus type 6
uguacugcauuggaaaugca

SEQ ID NO: 2690247 - RNA, 15 nt, Human papillomavirus type 6
cagaagaugaggugg

SEQ ID NO: 2690248 - RNA, 16 nt, Human papillomavirus type 6
uuauaauugcauuugu

SEQ ID NO: 2690249 - RNA, 18 nt, Human papillomavirus type 6
ccuagaggugggcagggg

SEQ ID NO: 2690250 - RNA, 13 nt, Human papillomavirus type 6
aguuaugaaaugu

SEQ ID NO: 2690251 - RNA, 19 nt, Human papillomavirus type 6
guagaagcuauagugcaac

SEQ ID NO: 2690252 - RNA, 18 nt, Human papillomavirus type 6
ucagagaagugcaacagc

SEQ ID NO: 2690253 - RNA, 16 nt, Human papillomavirus type 6
uaacuacauuauugua

SEQ ID NO: 2690254 - RNA, 14 nt, Human papillomavirus type 6
gcauuggaaaugca

SEQ ID NO: 2690255 - RNA, 14 nt, Human papillomavirus type 6
gccaaaggugucag

SEQ ID NO: 2690256 - RNA, 22 nt, Human papillomavirus type 6
gguggacuuuauugaugacagc

SEQ ID NO: 2690257 - RNA, 13 nt, Human papillomavirus type 6
cuuacuauugugg

SEQ ID NO: 2690258 - RNA, 17 nt, Human papillomavirus type 6
aaaugcauuuagaauca

SEQ ID NO: 2690259 - RNA, 14 nt, Human papillomavirus type 6
agugggucauccuu

SEQ ID NO: 2690260 - RNA, 22 nt, Human papillomavirus type 6
uccauauguuaguccuauaaac

SEQ ID NO: 2690261 - RNA, 23 nt, Human papillomavirus type 6
uccacgauuggacgccauuaaac

SEQ ID NO: 2690262 - RNA, 15 nt, Human papillomavirus type 6
uacuguuauguauau

SEQ ID NO: 2690263 - RNA, 21 nt, Human papillomavirus type 6
agcucagaagaugagguggac

SEQ ID NO: 2690264 - RNA, 14 nt, Human papillomavirus type 6
auaaacaugccauu

SEQ ID NO: 2690265 - RNA, 23 nt, Human papillomavirus type 6
gugguauggacagauguguaugu

SEQ ID NO: 2690266 - RNA, 20 nt, Human papillomavirus type 6
aguggguaugacauggugga

SEQ ID NO: 2690267 - RNA, 19 nt, Human papillomavirus type 6
uacuguuauauguguguau

SEQ ID NO: 2690268 - RNA, 12 nt, Human papillomavirus type 6
auaccauggcac

SEQ ID NO: 2690269 - RNA, 23 nt, Human papillomavirus type 6
ucagggaguggugguaacccugg

SEQ ID NO: 2690270 - RNA, 16 nt, Human papillomavirus type 6
auuuguaacaguguau

SEQ ID NO: 2690271 - RNA, 13 nt, Human papillomavirus type 6
gauggcugugcaa

SEQ ID NO: 2690272 - RNA, 16 nt, Human papillomavirus type 6
acuauagccgaggcag

SEQ ID NO: 2690273 - RNA, 19 nt, Human papillomavirus type 6
aauguguaaauauauggua

SEQ ID NO: 2690274 - RNA, 14 nt, Human papillomavirus type 6
uuuguuagcaucau

SEQ ID NO: 2690275 - RNA, 20 nt, Human papillomavirus type 6
ugcaacacccaacagguaca

SEQ ID NO: 2690276 - RNA, 14 nt, Human papillomavirus type 6
uguuaccagauccu

SEQ ID NO: 2690277 - RNA, 9 nt, Human papillomavirus type 6
uaugugugu

SEQ ID NO: 2690278 - RNA, 21 nt, Human papillomavirus type 6
acagcaaugaugcuaacaugu

SEQ ID NO: 2690279 - RNA, 14 nt, Human papillomavirus type 6
auagagcuguacaa

SEQ ID NO: 2690280 - RNA, 20 nt, Human papillomavirus type 6
caacuguacauguauggaag

SEQ ID NO: 2690281 - RNA, 14 nt, Human papillomavirus type 6
uagcaucauacuua

SEQ ID NO: 2690282 - RNA, 19 nt, Human papillomavirus type 6
aguguacagaaacagacau

SEQ ID NO: 2690283 - RNA, 23 nt, Human papillomavirus type 6
uacuguuauauauauguguguau

SEQ ID NO: 2690284 - RNA, 19 nt, Human papillomavirus type 6
ugugcaggaccuaaaacga

SEQ ID NO: 2690285 - RNA, 19 nt, Human papillomavirus type 6
caaguguaacaaacacaac

SEQ ID NO: 2690286 - RNA, 14 nt, Human papillomavirus type 6
uguauaccauggca

SEQ ID NO: 2690287 - RNA, 21 nt, Human papillomavirus type 6
ggugauuauauauauaugaau

SEQ ID NO: 2690288 - RNA, 17 nt, Human papillomavirus type 6
uauuguaauuuguauau

SEQ ID NO: 2690289 - RNA, 11 nt, Human papillomavirus type 6
auguguaugug

SEQ ID NO: 2690290 - RNA, 13 nt, Human papillomavirus type 6
aaacacagacauu

SEQ ID NO: 2690291 - RNA, 11 nt, Human papillomavirus type 6
aacaggcagga

SEQ ID NO: 2690292 - RNA, 15 nt, Human papillomavirus type 6
ccuggguaaaggugc

SEQ ID NO: 2690293 - RNA, 13 nt, Human papillomavirus type 6
uauguguguauau

SEQ ID NO: 2690294 - RNA, 19 nt, Human papillomavirus type 6
aggaugguuuaugguagaa

SEQ ID NO: 2690295 - RNA, 18 nt, Human papillomavirus type 6
uccaccaauuuguuacaa

SEQ ID NO: 2690296 - RNA, 18 nt, Human papillomavirus type 6
cacuauagagcuguacaa

SEQ ID NO: 2690297 - RNA, 18 nt, Human papillomavirus type 6
uguuacacccugugacuc

SEQ ID NO: 2690298 - RNA, 22 nt, Human papillomavirus type 6
uguuauauacaccacuacauug

SEQ ID NO: 2690299 - RNA, 17 nt, Human papillomavirus type 6
auuauuaaugcacuaua

SEQ ID NO: 2690300 - RNA, 15 nt, Human papillomavirus type 6
agccgaggcagugga

SEQ ID NO: 2690301 - RNA, 16 nt, Human papillomavirus type 6
auaaugccauugaaau

SEQ ID NO: 2690302 - RNA, 13 nt, Human papillomavirus type 6
aaagacugaguau

SEQ ID NO: 2690303 - RNA, 17 nt, Human papillomavirus type 6
ugcaguguacagaaaca

SEQ ID NO: 2690304 - RNA, 19 nt, Human papillomavirus type 6
aaugacaaacacagacauu

SEQ ID NO: 2690305 - RNA, 21 nt, Human papillomavirus type 6
agauauaggcuaaaugacaaa

SEQ ID NO: 2690306 - RNA, 13 nt, Human papillomavirus type 6
uacaacuguacau

SEQ ID NO: 2690307 - RNA, 23 nt, Human papillomavirus type 6
gccgaggcaguggaaagugaaau

SEQ ID NO: 2690308 - RNA, 21 nt, Human papillomavirus type 6
cugccuguuauaauugcauuu

SEQ ID NO: 2690309 - RNA, 23 nt, Human papillomavirus type 6
cacaauuccuuggaagcacaggc

SEQ ID NO: 2690310 - RNA, 18 nt, Human papillomavirus type 6
uauguacuguuauaugug

SEQ ID NO: 2690311 - RNA, 12 nt, Human papillomavirus type 6
gcauuaugauac

SEQ ID NO: 2690312 - RNA, 16 nt, Human papillomavirus type 6
gccacauaggaaugca

SEQ ID NO: 2690313 - RNA, 14 nt, Human papillomavirus type 6
uccggcacuggggg

SEQ ID NO: 2690314 - RNA, 23 nt, Human papillomavirus type 6
augcauaagacaugaaaguguau

SEQ ID NO: 2690315 - RNA, 20 nt, Human papillomavirus type 6
uacaauggauuaugugguau

SEQ ID NO: 2690316 - RNA, 18 nt, Human papillomavirus type 6
aaacggggcaaaacugua

SEQ ID NO: 2690317 - RNA, 12 nt, Human papillomavirus type 6
ggagccuguggc

SEQ ID NO: 2690318 - RNA, 17 nt, Human papillomavirus type 6
gcucguccuccuguggu

SEQ ID NO: 2690319 - RNA, 17 nt, Human papillomavirus type 6
augaugauuauguaacu

SEQ ID NO: 2690320 - RNA, 14 nt, Human papillomavirus type 6
auguauauguguuu

SEQ ID NO: 2690321 - RNA, 15 nt, Human papillomavirus type 6
auaagacaugaaagu

SEQ ID NO: 2690322 - RNA, 15 nt, Human papillomavirus type 6
cagcucagaagauga

SEQ ID NO: 2690323 - RNA, 13 nt, Human papillomavirus type 6
agugguaccugua

SEQ ID NO: 2690324 - RNA, 14 nt, Human papillomavirus type 6
uauguguguuuaug

SEQ ID NO: 2690325 - RNA, 18 nt, Human papillomavirus type 6
ggauuaugugguauggac

SEQ ID NO: 2690326 - RNA, 18 nt, Human papillomavirus type 6
uuuccuacuaacuuuacu

SEQ ID NO: 2690327 - RNA, 18 nt, Human papillomavirus type 6
acuauagagcuguacaag

SEQ ID NO: 2690328 - RNA, 15 nt, Human papillomavirus type 6
uauauauaugugugu

SEQ ID NO: 2690329 - RNA, 15 nt, Human papillomavirus type 6
uauguauauguaugu

SEQ ID NO: 2690330 - RNA, 12 nt, Human papillomavirus type 6
aggacagugggu

SEQ ID NO: 2690331 - RNA, 13 nt, Human papillomavirus type 6
cuccuaacccugu

SEQ ID NO: 2690332 - RNA, 20 nt, Human papillomavirus type 6
ugcaguguacagaaacagac

SEQ ID NO: 2690333 - RNA, 17 nt, Human papillomavirus type 6
aagugguaccuguacaa

SEQ ID NO: 2690334 - RNA, 15 nt, Human papillomavirus type 6
agacuucuugcagug

SEQ ID NO: 2690335 - RNA, 14 nt, Human papillomavirus type 6
agcuauagugcaac

SEQ ID NO: 2690336 - RNA, 12 nt, Human papillomavirus type 6
gugccuuuauug

SEQ ID NO: 2690337 - RNA, 24 nt, Human papillomavirus type 6
ugaugcuaacaugucaauuuaaug

SEQ ID NO: 2690338 - RNA, 13 nt, Human papillomavirus type 6
auguguguauaua

SEQ ID NO: 2690339 - RNA, 19 nt, Human papillomavirus type 6
acauauuuuaucaugccag

SEQ ID NO: 2690340 - RNA, 14 nt, Human papillomavirus type 6
caacaccauugcag

SEQ ID NO: 2690341 - RNA, 18 nt, Human papillomavirus type 6
gugcaacacccaacaggu

SEQ ID NO: 2690342 - RNA, 22 nt, Human papillomavirus type 6
acaauuaacuacauuauuguau

SEQ ID NO: 2690343 - RNA, 19 nt, Human papillomavirus type 6
agugaccuguugcugugga

SEQ ID NO: 2690344 - RNA, 18 nt, Human papillomavirus type 6
cuagaggugggcagggga

SEQ ID NO: 2690345 - RNA, 22 nt, Human papillomavirus type 6
aaacacuauagccgaggcagug

SEQ ID NO: 2690346 - RNA, 15 nt, Human papillomavirus type 6
auauuacacacaauu

SEQ ID NO: 2690347 - RNA, 18 nt, Human papillomavirus type 6
aaucauuauuaaagacug

SEQ ID NO: 2690348 - RNA, 19 nt, Human papillomavirus type 6
cuagacuucuugcaguggg

SEQ ID NO: 2690349 - RNA, 13 nt, Human papillomavirus type 6
accuaaacgcugu

SEQ ID NO: 2690350 - RNA, 22 nt, Human papillomavirus type 6
uguacacaucugugcuaguacu

SEQ ID NO: 2690351 - RNA, 22 nt, Human papillomavirus type 6
aaguagugccaccauuaaaggu

SEQ ID NO: 2690352 - RNA, 16 nt, Human papillomavirus type 6
guauaucuuguuacac

SEQ ID NO: 2690353 - RNA, 17 nt, Human papillomavirus type 6
uauggauaucugacuuu

SEQ ID NO: 2690354 - RNA, 18 nt, Human papillomavirus type 6
uuccauaaaacgggcuaa

SEQ ID NO: 2690355 - RNA, 16 nt, Human papillomavirus type 6
uauguguuguguauau

SEQ ID NO: 2690356 - RNA, 20 nt, Human papillomavirus type 6
agacugaguauaguauggaa

SEQ ID NO: 2690357 - RNA, 19 nt, Human papillomavirus type 6
caaugcaccuauuguaauu

SEQ ID NO: 2690358 - RNA, 21 nt, Human papillomavirus type 6
ucugacuuuauuguguacaca

SEQ ID NO: 2690359 - RNA, 15 nt, Human papillomavirus type 6
guguaaguggacauc

SEQ ID NO: 2690360 - RNA, 18 nt, Human papillomavirus type 6
acugcauuggaaaugcau

SEQ ID NO: 2690361 - RNA, 23 nt, Human papillomavirus type 6
uguauauguguuuauguacuguu

SEQ ID NO: 2690362 - RNA, 18 nt, Human papillomavirus type 6
agacuucuugcagugggu

SEQ ID NO: 2690363 - RNA, 21 nt, Human papillomavirus type 6
ggcggacgauucagguacaga

SEQ ID NO: 2690364 - RNA, 18 nt, Human papillomavirus type 6
guagaagcuauagugcaa

SEQ ID NO: 2690365 - RNA, 22 nt, Human papillomavirus type 6
augucaauuuaaugauggagau

SEQ ID NO: 2690366 - RNA, 19 nt, Human papillomavirus type 6
uguguauauguacuguuau

SEQ ID NO: 2690367 - RNA, 20 nt, Human papillomavirus type 6
gaaacaaguuaugaaaugug

SEQ ID NO: 2690368 - RNA, 19 nt, Human papillomavirus type 6
agacugaguauaguaugga

SEQ ID NO: 2690369 - RNA, 23 nt, Human papillomavirus type 6
augaugauuauguaacuaugcau

SEQ ID NO: 2690370 - RNA, 18 nt, Human papillomavirus type 6
agguggaggacagugggu

SEQ ID NO: 2690371 - RNA, 16 nt, Human papillomavirus type 6
acaugccauuguaacu

SEQ ID NO: 2690372 - RNA, 18 nt, Human papillomavirus type 6
cauaacaacgauggcgga

SEQ ID NO: 2690373 - RNA, 19 nt, Human papillomavirus type 6
uagaagcuauagugcaaca

SEQ ID NO: 2690374 - RNA, 22 nt, Human papillomavirus type 6
cgacugguugugcaguguacag

SEQ ID NO: 2690375 - RNA, 16 nt, Human papillomavirus type 6
uguacagaaacagaca

SEQ ID NO: 2690376 - RNA, 12 nt, Human papillomavirus type 6
caauuuaaugau

SEQ ID NO: 2690377 - RNA, 23 nt, Human papillomavirus type 6
aacaguuuuuaaauguuguaaaa

SEQ ID NO: 2690378 - RNA, 22 nt, Human papillomavirus type 6
ggaggacaguggguaugacaug

SEQ ID NO: 2690379 - RNA, 21 nt, Human papillomavirus type 6
caacaguuuuuaaauguugua

SEQ ID NO: 2690380 - RNA, 12 nt, Human papillomavirus type 6
gagaagugcaac

SEQ ID NO: 2690381 - RNA, 18 nt, Human papillomavirus type 6
ccgaagcaaaaggacaua

SEQ ID NO: 2690382 - RNA, 16 nt, Human papillomavirus type 6
auuaggugugggugua

SEQ ID NO: 2690383 - RNA, 12 nt, Human papillomavirus type 6
cuaauuguuuaa

SEQ ID NO: 2690384 - RNA, 14 nt, Human papillomavirus type 6
uccuauaaacacua

SEQ ID NO: 2690385 - RNA, 18 nt, Human papillomavirus type 6
acaaacacaacuguaaug

SEQ ID NO: 2690386 - RNA, 14 nt, Human papillomavirus type 6
cagacaucagagaa

SEQ ID NO: 2690387 - RNA, 22 nt, Human papillomavirus type 6
agcgugcgucagcuacacagcu

SEQ ID NO: 2690388 - RNA, 17 nt, Human papillomavirus type 6
gggcaggggacagccau

SEQ ID NO: 2690389 - RNA, 15 nt, Human papillomavirus type 6
auguauauguaugug

SEQ ID NO: 2690390 - RNA, 21 nt, Human papillomavirus type 6
acagaaacagacaucagagaa

SEQ ID NO: 2690391 - RNA, 21 nt, Human papillomavirus type 6
guauuauuauauaaagcaaaa

SEQ ID NO: 2690392 - RNA, 19 nt, Human papillomavirus type 6
uauauauguguaugugugu

SEQ ID NO: 2690393 - RNA, 13 nt, Human papillomavirus type 6
agugcaacaccca

SEQ ID NO: 2690394 - RNA, 16 nt, Human papillomavirus type 6
accuaaacaaacaugu

SEQ ID NO: 2690395 - RNA, 13 nt, Human papillomavirus type 6
uauauauguguau

SEQ ID NO: 2690396 - RNA, 21 nt, Human papillomavirus type 6
acaugccccccagauguaauu

SEQ ID NO: 2690397 - RNA, 22 nt, Human papillomavirus type 6
aguacugaccuaaacaaacaug

SEQ ID NO: 2690398 - RNA, 24 nt, Human papillomavirus type 6
aagcgugcgucagcuacacagcua

SEQ ID NO: 2690399 - RNA, 16 nt, Human papillomavirus type 6
ccuaaacgcuguuuua

SEQ ID NO: 2690400 - RNA, 15 nt, Human papillomavirus type 6
auugcauuuguugua

SEQ ID NO: 2690401 - RNA, 14 nt, Human papillomavirus type 6
uguauauaugugua

SEQ ID NO: 2690402 - RNA, 11 nt, Human papillomavirus type 6
gaagcacaggc

SEQ ID NO: 2690403 - RNA, 17 nt, Human papillomavirus type 6
uauggacagauguguau

SEQ ID NO: 2690404 - RNA, 13 nt, Human papillomavirus type 6
ggguguacaggau

SEQ ID NO: 2690405 - RNA, 18 nt, Human papillomavirus type 6
caggaggcggacacccau

SEQ ID NO: 2690406 - RNA, 22 nt, Human papillomavirus type 6
caggaccuaaaacgaaaguauu

SEQ ID NO: 2690407 - RNA, 22 nt, Human papillomavirus type 6
caacagguacacaaauaucaga

SEQ ID NO: 2690408 - RNA, 12 nt, Human papillomavirus type 6
aaacaauacaau

SEQ ID NO: 2690409 - RNA, 22 nt, Human papillomavirus type 6
acaggguauuuaaggugguguu

SEQ ID NO: 2690410 - RNA, 14 nt, Human papillomavirus type 6
auuguguacacauc

SEQ ID NO: 2690411 - RNA, 12 nt, Human papillomavirus type 6
uuguaacuguaa

SEQ ID NO: 2690412 - RNA, 23 nt, Human papillomavirus type 6
aguguauuauuauauaaagcaaa

SEQ ID NO: 2690413 - RNA, 22 nt, Human papillomavirus type 6
cauaaugccauugaaaugcaaa

SEQ ID NO: 2690414 - RNA, 12 nt, Human papillomavirus type 6
guaacaagugua

SEQ ID NO: 2690415 - RNA, 16 nt, Human papillomavirus type 6
uaacuguaacauauca

SEQ ID NO: 2690416 - RNA, 15 nt, Human papillomavirus type 6
cugacuuuauugugu

SEQ ID NO: 2690417 - RNA, 18 nt, Human papillomavirus type 6
caauuuuuccuacuaacu

SEQ ID NO: 2690418 - RNA, 15 nt, Human papillomavirus type 6
uguguuuaugugcaa

SEQ ID NO: 2690419 - RNA, 15 nt, Human papillomavirus type 6
ugaaaugcaaaugca

SEQ ID NO: 2690420 - RNA, 19 nt, Human papillomavirus type 6
augguauugguguaauaca

SEQ ID NO: 2690421 - RNA, 12 nt, Human papillomavirus type 6
uauauaaagcaa

SEQ ID NO: 2690422 - RNA, 13 nt, Human papillomavirus type 6
auuguaacuguaa

SEQ ID NO: 2690423 - RNA, 17 nt, Human papillomavirus type 6
caaacacaacuguaaug

SEQ ID NO: 2690424 - RNA, 15 nt, Human papillomavirus type 6
acuuuauuguguaca

SEQ ID NO: 2690425 - RNA, 19 nt, Human papillomavirus type 6
uguguuuauguacuguuau

SEQ ID NO: 2690426 - RNA, 22 nt, Human papillomavirus type 6
uacuauuagacacaaacugggg

SEQ ID NO: 2690427 - RNA, 18 nt, Human papillomavirus type 6
guaacuaugcauuaugau

SEQ ID NO: 2690428 - RNA, 18 nt, Human papillomavirus type 6
uaauacaacuguacaugu

SEQ ID NO: 2690429 - RNA, 15 nt, Human papillomavirus type 6
cauuaugauacugcu

SEQ ID NO: 2690430 - RNA, 21 nt, Human papillomavirus type 6
gcuguuucaaaccagggaacu

SEQ ID NO: 2690431 - RNA, 13 nt, Human papillomavirus type 6
ucagguacagaaa

SEQ ID NO: 2690432 - RNA, 15 nt, Human papillomavirus type 6
cucguccuccugugg

SEQ ID NO: 2690433 - RNA, 12 nt, Human papillomavirus type 6
cugacuuuauug

SEQ ID NO: 2690434 - RNA, 21 nt, Human papillomavirus type 6
auuccuuggaagcacaggcau

SEQ ID NO: 2690435 - RNA, 15 nt, Human papillomavirus type 6
acagcaaugaugcua

SEQ ID NO: 2690436 - RNA, 18 nt, Human papillomavirus type 6
ugggaacacuaaacauag

SEQ ID NO: 2690437 - RNA, 17 nt, Human papillomavirus type 6
gccaccauuaaaggugu

SEQ ID NO: 2690438 - RNA, 17 nt, Human papillomavirus type 6
cagccauuagguguggg

SEQ ID NO: 2690439 - RNA, 16 nt, Human papillomavirus type 6
caaguagugccaccau

SEQ ID NO: 2690440 - RNA, 15 nt, Human papillomavirus type 6
ucagagaagugcaac

SEQ ID NO: 2690441 - RNA, 16 nt, Human papillomavirus type 6
uuuuaaauguuguaaa

SEQ ID NO: 2690442 - RNA, 21 nt, Human papillomavirus type 6
ccaacauauuuuaucaugcca

SEQ ID NO: 2690443 - RNA, 18 nt, Human papillomavirus type 6
guuauauauaugugugua

SEQ ID NO: 2690444 - RNA, 19 nt, Human papillomavirus type 6
guauguguguuuaugugca

SEQ ID NO: 2690445 - RNA, 13 nt, Human papillomavirus type 6
guggaaagugaaa

SEQ ID NO: 2690446 - RNA, 18 nt, Human papillomavirus type 6
uauguauauguguuuaug

SEQ ID NO: 2690447 - RNA, 13 nt, Human papillomavirus type 6
auaauugcauuug

SEQ ID NO: 2690448 - RNA, 19 nt, Human papillomavirus type 6
auauauuuuuauauuugca

SEQ ID NO: 2690449 - RNA, 14 nt, Human papillomavirus type 6
acauugugaacaca

SEQ ID NO: 2690450 - RNA, 14 nt, Human papillomavirus type 6
auauauguguguau

SEQ ID NO: 2690451 - RNA, 15 nt, Human papillomavirus type 6
uacuuguguguuacu

SEQ ID NO: 2690452 - RNA, 17 nt, Human papillomavirus type 6
gucaauuuaaugaugga

SEQ ID NO: 2690453 - RNA, 14 nt, Human papillomavirus type 6
uguguaauguguau

SEQ ID NO: 2690454 - RNA, 16 nt, Human papillomavirus type 6
cuacauugugaacaca

SEQ ID NO: 2690455 - RNA, 21 nt, Human papillomavirus type 6
gguugugcaguguacagaaac

SEQ ID NO: 2690456 - RNA, 17 nt, Human papillomavirus type 6
aggaggcggacacccau

SEQ ID NO: 2690457 - RNA, 18 nt, Human papillomavirus type 6
gauggagauaccuggcug

SEQ ID NO: 2690458 - RNA, 22 nt, Human papillomavirus type 6
uuaaaaaacggggcaaaacugu

SEQ ID NO: 2690459 - RNA, 17 nt, Human papillomavirus type 6
cugcauuggaaaugcau

SEQ ID NO: 2690460 - RNA, 21 nt, Human papillomavirus type 6
auaaacaugccauuguaacug

SEQ ID NO: 2690461 - RNA, 13 nt, Human papillomavirus type 6
guccgaagcaaaa

SEQ ID NO: 2690462 - RNA, 15 nt, Human papillomavirus type 6
gaagugcaacagcuu

SEQ ID NO: 2690463 - RNA, 15 nt, Human papillomavirus type 6
aaaggugcauaguau

SEQ ID NO: 2690464 - RNA, 14 nt, Human papillomavirus type 6
uccuccuguggugg

SEQ ID NO: 2690465 - RNA, 22 nt, Human papillomavirus type 6
cacaucugugcuaguacuaaca

SEQ ID NO: 2690466 - RNA, 23 nt, Human papillomavirus type 6
guguaugcuuuguauaccauggc

SEQ ID NO: 2690467 - RNA, 21 nt, Human papillomavirus type 6
ugccauugaaaugcaaaugca

SEQ ID NO: 2690468 - RNA, 16 nt, Human papillomavirus type 6
uauguacuguuaugua

SEQ ID NO: 2690469 - RNA, 14 nt, Human papillomavirus type 6
aucuaauuguuuaa

SEQ ID NO: 2690470 - RNA, 15 nt, Human papillomavirus type 6
uacacaucugugcua

SEQ ID NO: 2690471 - RNA, 14 nt, Human papillomavirus type 6
aaacacaacuguaa

SEQ ID NO: 2690472 - RNA, 14 nt, Human papillomavirus type 6
cuugcaguggguca

SEQ ID NO: 2690473 - RNA, 14 nt, Human papillomavirus type 6
uguaacuguaacau

SEQ ID NO: 2690474 - RNA, 15 nt, Human papillomavirus type 6
guaacccuggacagg

SEQ ID NO: 2690475 - RNA, 16 nt, Human papillomavirus type 6
aggaugaggaggugga

SEQ ID NO: 2690476 - RNA, 18 nt, Human papillomavirus type 6
gugcuaguacuaacacug

SEQ ID NO: 2690477 - RNA, 14 nt, Human papillomavirus type 6
uacagaaacagaca

SEQ ID NO: 2690478 - RNA, 21 nt, Human papillomavirus type 6
ugguagaagcuauagugcaac

SEQ ID NO: 2690479 - RNA, 15 nt, Human papillomavirus type 6
uauauauguguaugu

SEQ ID NO: 2690480 - RNA, 14 nt, Human papillomavirus type 6
gcuguggaugugac

SEQ ID NO: 2690481 - RNA, 22 nt, Human papillomavirus type 6
augugccuccuccuaacccugu

SEQ ID NO: 2690482 - RNA, 17 nt, Human papillomavirus type 6
guauauauguaaaugug

SEQ ID NO: 2690483 - RNA, 15 nt, Human papillomavirus type 6
uuguuacaacguguu

SEQ ID NO: 2690484 - RNA, 12 nt, Human papillomavirus type 6
auauauguguau

SEQ ID NO: 2690485 - RNA, 19 nt, Human papillomavirus type 6
acacaacuguaaugaugau

SEQ ID NO: 2690486 - RNA, 19 nt, Human papillomavirus type 6
gccaaaaaagguaaagcga

SEQ ID NO: 2690487 - RNA, 14 nt, Human papillomavirus type 6
ggaagcacaggcau

SEQ ID NO: 2690488 - RNA, 22 nt, Human papillomavirus type 6
augauuauguaacuaugcauua

SEQ ID NO: 2690489 - RNA, 21 nt, Human papillomavirus type 6
ggccuagaggugggcagggga

SEQ ID NO: 2690490 - RNA, 13 nt, Human papillomavirus type 6
uaauacugccugu

SEQ ID NO: 2690491 - RNA, 13 nt, Human papillomavirus type 6
gacagccaaaaaa

SEQ ID NO: 2690492 - RNA, 13 nt, Human papillomavirus type 6
uuuuaucaugcca

SEQ ID NO: 2690493 - RNA, 21 nt, Human papillomavirus type 6
auggcugugcaaacaauacaa

SEQ ID NO: 2690494 - RNA, 17 nt, Human papillomavirus type 6
aguguaacaaacacaac

SEQ ID NO: 2690495 - RNA, 12 nt, Human papillomavirus type 6
uguguuacuguc

SEQ ID NO: 2690496 - RNA, 20 nt, Human papillomavirus type 6
uaaacuuacaagacagccaa

SEQ ID NO: 2690497 - RNA, 17 nt, Human papillomavirus type 6
ugcauuggaaaugcaua

SEQ ID NO: 2690498 - RNA, 17 nt, Human papillomavirus type 6
cuauagagcuguacaag

SEQ ID NO: 2690499 - RNA, 20 nt, Human papillomavirus type 6
cuguugcuguggaugugaca

SEQ ID NO: 2690500 - RNA, 16 nt, Human papillomavirus type 6
cuaguacuaacacugc

SEQ ID NO: 2690501 - RNA, 20 nt, Human papillomavirus type 6
ugagcaauuaguagacagcu

SEQ ID NO: 2690502 - RNA, 22 nt, Human papillomavirus type 6
ugcuaugagcaauuaguagaca

SEQ ID NO: 2690503 - RNA, 22 nt, Human papillomavirus type 6
auaaacacuauagccgaggcag

SEQ ID NO: 2690504 - RNA, 15 nt, Human papillomavirus type 6
aaacuguagaaguua

SEQ ID NO: 2690505 - RNA, 16 nt, Human papillomavirus type 6
agaagcuauagugcaa

SEQ ID NO: 2690506 - RNA, 21 nt, Human papillomavirus type 6
cacagcaaugaugcuaacaug

SEQ ID NO: 2690507 - RNA, 16 nt, Human papillomavirus type 6
auuaauacugccuguu

SEQ ID NO: 2690508 - RNA, 15 nt, Human papillomavirus type 6
auguguuuauguacu

SEQ ID NO: 2690509 - RNA, 11 nt, Human papillomavirus type 6
uacuagugggc

SEQ ID NO: 2690510 - RNA, 21 nt, Human papillomavirus type 6
cagaaacagacaucagagaag

SEQ ID NO: 2690511 - RNA, 23 nt, Human papillomavirus type 6
augccauugaaaugcaaaugcau

SEQ ID NO: 2690512 - RNA, 14 nt, Human papillomavirus type 6
cauuggaaaugcau

SEQ ID NO: 2690513 - RNA, 18 nt, Human papillomavirus type 6
uuaacaggcaggaggcgg

SEQ ID NO: 2690514 - RNA, 16 nt, Human papillomavirus type 6
uaauguguaugugugu

SEQ ID NO: 2690515 - RNA, 23 nt, Human papillomavirus type 6
acuaacacugcuuuuauacuuac

SEQ ID NO: 2690516 - RNA, 23 nt, Human papillomavirus type 6
ugccauugaaaugcaaaugcauu

SEQ ID NO: 2690517 - RNA, 15 nt, Human papillomavirus type 6
aaacuuacaagacag

SEQ ID NO: 2690518 - RNA, 17 nt, Human papillomavirus type 6
guuagcaucauacuuau

SEQ ID NO: 2690519 - RNA, 12 nt, Human papillomavirus type 6
guuuaugucaau

SEQ ID NO: 2690520 - RNA, 18 nt, Human papillomavirus type 6
guauguacuguuauguau

SEQ ID NO: 2690521 - RNA, 23 nt, Human papillomavirus type 6
ccccuacuauuagacacaaacug

SEQ ID NO: 2690522 - RNA, 21 nt, Human papillomavirus type 6
acagccauuaggugugggugu

SEQ ID NO: 2690523 - RNA, 17 nt, Human papillomavirus type 6
uguguuauguguguaau

SEQ ID NO: 2690524 - RNA, 18 nt, Human papillomavirus type 6
cuugcagugggucauccu

SEQ ID NO: 2690525 - RNA, 20 nt, Human papillomavirus type 6
uuauauauauguguguaugu

SEQ ID NO: 2690526 - RNA, 21 nt, Human papillomavirus type 6
aggagguggaggacagugggu

SEQ ID NO: 2690527 - RNA, 18 nt, Human papillomavirus type 6
gaaaauucagggaguggu

SEQ ID NO: 2690528 - RNA, 19 nt, Human papillomavirus type 6
cagcacauuaauacugccu

SEQ ID NO: 2690529 - RNA, 21 nt, Human papillomavirus type 6
ucagcuacacagcuauaucaa

SEQ ID NO: 2690530 - RNA, 16 nt, Human papillomavirus type 6
caaugcaccuauugua

SEQ ID NO: 2690531 - RNA, 18 nt, Human papillomavirus type 6
gucuggguguacaggaug

SEQ ID NO: 2690532 - RNA, 16 nt, Human papillomavirus type 6
gcacuauagagcugua

SEQ ID NO: 2690533 - RNA, 17 nt, Human papillomavirus type 6
uguguauguacuguuau

SEQ ID NO: 2690534 - RNA, 17 nt, Human papillomavirus type 6
acuguagaaguuaaauu

SEQ ID NO: 2690535 - RNA, 11 nt, Human papillomavirus type 6
uggcacugggc

SEQ ID NO: 2690536 - RNA, 14 nt, Human papillomavirus type 6
agacaugaaagugu

SEQ ID NO: 2690537 - RNA, 13 nt, Human papillomavirus type 6
aaugcaaaugcau

SEQ ID NO: 2690538 - RNA, 16 nt, Human papillomavirus type 6
gaacacuaaacauagu

SEQ ID NO: 2690539 - RNA, 23 nt, Human papillomavirus type 6
uuauguauauguguuuauguacu

SEQ ID NO: 2690540 - RNA, 20 nt, Human papillomavirus type 6
ccuauuguaauuuguauaua

SEQ ID NO: 2690541 - RNA, 20 nt, Human papillomavirus type 6
acaucagagaagugcaacag

SEQ ID NO: 2690542 - RNA, 15 nt, Human papillomavirus type 6
agcaaaaggacauaa

SEQ ID NO: 2690543 - RNA, 14 nt, Human papillomavirus type 6
gaugaggaggugga

SEQ ID NO: 2690544 - RNA, 16 nt, Human papillomavirus type 6
uguguuuaugugcaau

SEQ ID NO: 2690545 - RNA, 17 nt, Human papillomavirus type 6
uuggaagcacaggcauu

SEQ ID NO: 2690546 - RNA, 18 nt, Human papillomavirus type 6
uuauguguguaauguaau

SEQ ID NO: 2690547 - RNA, 21 nt, Human papillomavirus type 6
aguggugguaacccuggacag

SEQ ID NO: 2690548 - RNA, 17 nt, Human papillomavirus type 6
caucagagaagugcaac

SEQ ID NO: 2690549 - RNA, 17 nt, Human papillomavirus type 6
aaacaugccauuguaac

SEQ ID NO: 2690550 - RNA, 15 nt, Human papillomavirus type 6
uggcacauaguaggg

SEQ ID NO: 2690551 - RNA, 12 nt, Human papillomavirus type 6
uauguaaaugug

SEQ ID NO: 2690552 - RNA, 22 nt, Human papillomavirus type 6
agguguggguguaaguggacau

SEQ ID NO: 2690553 - RNA, 14 nt, Human papillomavirus type 6
agcaucauacuuau

SEQ ID NO: 2690554 - RNA, 22 nt, Human papillomavirus type 6
uauaauugcauuuguuguaugu

SEQ ID NO: 2690555 - RNA, 22 nt, Human papillomavirus type 6
uugcauugccugacucgucucu

SEQ ID NO: 2690556 - RNA, 16 nt, Human papillomavirus type 6
cuguauccaaaguugu

SEQ ID NO: 2690557 - RNA, 14 nt, Human papillomavirus type 6
ugcuuuuauacuua

SEQ ID NO: 2690558 - RNA, 23 nt, Human papillomavirus type 6
caggcauuguuuaacaggcagga

SEQ ID NO: 2690559 - RNA, 19 nt, Human papillomavirus type 6
caggaugguuuaugguaga

SEQ ID NO: 2690560 - RNA, 14 nt, Human papillomavirus type 6
uguauguacuguua

SEQ ID NO: 2690561 - RNA, 13 nt, Human papillomavirus type 6
caauuuguuacaa

SEQ ID NO: 2690562 - RNA, 13 nt, Human papillomavirus type 6
gacaucagagaag

SEQ ID NO: 2690563 - RNA, 14 nt, Human papillomavirus type 6
ccacuacauuguga

SEQ ID NO: 2690564 - RNA, 15 nt, Human papillomavirus type 6
uauauguacuguuau

SEQ ID NO: 2690565 - RNA, 12 nt, Human papillomavirus type 6
uaaauguuguaa

SEQ ID NO: 2690566 - RNA, 18 nt, Human papillomavirus type 6
uauguacuguuauguaua

SEQ ID NO: 2690567 - RNA, 14 nt, Human papillomavirus type 6
aguuuuuaaauguu

SEQ ID NO: 2690568 - RNA, 13 nt, Human papillomavirus type 6
ugguaugggcaug

SEQ ID NO: 2690569 - RNA, 19 nt, Human papillomavirus type 6
gacagauguguaugugcag

SEQ ID NO: 2690570 - RNA, 14 nt, Human papillomavirus type 6
uggguaaaggugca

SEQ ID NO: 2690571 - RNA, 23 nt, Human papillomavirus type 6
cuaacuuuacuuguguguuacug

SEQ ID NO: 2690572 - RNA, 14 nt, Human papillomavirus type 6
guacuaacacugcu

SEQ ID NO: 2690573 - RNA, 20 nt, Human papillomavirus type 6
gaaucuaauuguuuaaagug

SEQ ID NO: 2690574 - RNA, 22 nt, Human papillomavirus type 6
uggagccuguggccccuucgga

SEQ ID NO: 2690575 - RNA, 14 nt, Human papillomavirus type 6
aguuaugaaaugug

SEQ ID NO: 2690576 - RNA, 15 nt, Human papillomavirus type 6
aauaucagacgauga

SEQ ID NO: 2690577 - RNA, 21 nt, Human papillomavirus type 6
acaggcauuguuuaacaggca

SEQ ID NO: 2690578 - RNA, 16 nt, Human papillomavirus type 6
uaaugaugauuaugua

SEQ ID NO: 2690579 - RNA, 17 nt, Human papillomavirus type 6
gcgacugugcaggaccu

SEQ ID NO: 2690580 - RNA, 14 nt, Human papillomavirus type 6
cugggguuuauguc

SEQ ID NO: 2690581 - RNA, 18 nt, Human papillomavirus type 6
guauguguguauauguau

SEQ ID NO: 2690582 - RNA, 14 nt, Human papillomavirus type 6
uagccgaggcagug

SEQ ID NO: 2690583 - RNA, 14 nt, Human papillomavirus type 6
cauaagacaugaaa

SEQ ID NO: 2690584 - RNA, 12 nt, Human papillomavirus type 6
cccuugcaauuu

SEQ ID NO: 2690585 - RNA, 22 nt, Human papillomavirus type 6
auguuaguccuauaaacacuau

SEQ ID NO: 2690586 - RNA, 15 nt, Human papillomavirus type 6
acugcauuggaaaug

SEQ ID NO: 2690587 - RNA, 24 nt, Human papillomavirus type 6
uaacacugcuuuuauacuuacuau

SEQ ID NO: 2690588 - RNA, 21 nt, Human papillomavirus type 6
ggacgauucagguacagaaaa

SEQ ID NO: 2690589 - RNA, 17 nt, Human papillomavirus type 6
gucuggguguacaggau

SEQ ID NO: 2690590 - RNA, 16 nt, Human papillomavirus type 6
gggcaugcacaggccu

SEQ ID NO: 2690591 - RNA, 16 nt, Human papillomavirus type 6
acaaguuaugaaaugu

SEQ ID NO: 2690592 - RNA, 16 nt, Human papillomavirus type 6
uguauauguacuguua

SEQ ID NO: 2690593 - RNA, 16 nt, Human papillomavirus type 6
auguguuguguauaua

SEQ ID NO: 2690594 - RNA, 19 nt, Human papillomavirus type 6
uggcucguccuccuguggu

SEQ ID NO: 2690595 - RNA, 23 nt, Human papillomavirus type 6
aauauauauauuuuuguuuccaa

SEQ ID NO: 2690596 - RNA, 20 nt, Human papillomavirus type 6
aggcaggaggcggacaccca

SEQ ID NO: 2690597 - RNA, 17 nt, Human papillomavirus type 6
gacuucuugcagugggu

SEQ ID NO: 2690598 - RNA, 13 nt, Human papillomavirus type 6
acagaaaaugagg

SEQ ID NO: 2690599 - RNA, 22 nt, Human papillomavirus type 6
gacugguugugcaguguacaga

SEQ ID NO: 2690600 - RNA, 18 nt, Human papillomavirus type 6
auguggcaaacaccaccu

SEQ ID NO: 2690601 - RNA, 19 nt, Human papillomavirus type 6
acauaaugccauugaaaug

SEQ ID NO: 2690602 - RNA, 22 nt, Human papillomavirus type 6
uugguguaauacaacuguacau

SEQ ID NO: 2690603 - RNA, 14 nt, Human papillomavirus type 6
acacaucugugcua

SEQ ID NO: 2690604 - RNA, 18 nt, Human papillomavirus type 6
aaaacaguacugaccuaa

SEQ ID NO: 2690605 - RNA, 20 nt, Human papillomavirus type 6
uauauacaccacuacauugu

SEQ ID NO: 2690606 - RNA, 16 nt, Human papillomavirus type 6
aaagcaaaacaaaugg

SEQ ID NO: 2690607 - RNA, 16 nt, Human papillomavirus type 6
uauguauauguaugug

SEQ ID NO: 2690608 - RNA, 16 nt, Human papillomavirus type 6
uacuaacuuuacuugu

SEQ ID NO: 2690609 - RNA, 23 nt, Human papillomavirus type 6
cgacugguugugcaguguacaga

SEQ ID NO: 2690610 - RNA, 20 nt, Human papillomavirus type 6
auuugauuuaauaucaucaa

SEQ ID NO: 2690611 - RNA, 21 nt, Human papillomavirus type 6
uacaagaaacaaguuaugaaa

SEQ ID NO: 2690612 - RNA, 19 nt, Human papillomavirus type 6
cauugaaaugcaaaugcau

SEQ ID NO: 2690613 - RNA, 21 nt, Human papillomavirus type 6
gucaaugcaccuauuguaauu

SEQ ID NO: 2690614 - RNA, 13 nt, Human papillomavirus type 6
gcuauagugcaac

SEQ ID NO: 2690615 - RNA, 18 nt, Human papillomavirus type 6
cuaguacuaacacugcuu

SEQ ID NO: 2690616 - RNA, 19 nt, Human papillomavirus type 6
accacauaaacaugccauu

SEQ ID NO: 2690617 - RNA, 15 nt, Human papillomavirus type 6
cacaacuguaaugau

SEQ ID NO: 2690618 - RNA, 15 nt, Human papillomavirus type 6
uguauguacuguuau

SEQ ID NO: 2690619 - RNA, 13 nt, Human papillomavirus type 6
uaucuuguuacac

SEQ ID NO: 2690620 - RNA, 14 nt, Human papillomavirus type 6
ccauugaaaugcaa

SEQ ID NO: 2690621 - RNA, 14 nt, Human papillomavirus type 6
cagggagugguggu

SEQ ID NO: 2690622 - RNA, 20 nt, Human papillomavirus type 6
agacaugaaaguguauuauu

SEQ ID NO: 2690623 - RNA, 21 nt, Human papillomavirus type 6
auacuuacuauuguggcugcu

SEQ ID NO: 2690624 - RNA, 18 nt, Human papillomavirus type 6
auguauauguauguguug

SEQ ID NO: 2690625 - RNA, 16 nt, Human papillomavirus type 6
acuuuauugaugacag

SEQ ID NO: 2690626 - RNA, 17 nt, Human papillomavirus type 6
aucauuauuaaagacug

SEQ ID NO: 2690627 - RNA, 19 nt, Human papillomavirus type 6
uggcuauguucccuuagga

SEQ ID NO: 2690628 - RNA, 14 nt, Human papillomavirus type 6
uauagccgaggcag

SEQ ID NO: 2690629 - RNA, 14 nt, Human papillomavirus type 6
aauuuaaugaugga

SEQ ID NO: 2690630 - RNA, 12 nt, Human papillomavirus type 6
cuauagugcaac

SEQ ID NO: 2690631 - RNA, 19 nt, Human papillomavirus type 6
cuaacaugucaauuuaaug

SEQ ID NO: 2690632 - RNA, 22 nt, Human papillomavirus type 6
uauguacuguuauauauaugug

SEQ ID NO: 2690633 - RNA, 21 nt, Human papillomavirus type 6
gccauuagguguggguguaag

SEQ ID NO: 2690634 - RNA, 20 nt, Human papillomavirus type 6
guguguauauauguguaugu

SEQ ID NO: 2690635 - RNA, 17 nt, Human papillomavirus type 6
cagacgaugaggaugag

SEQ ID NO: 2690636 - RNA, 13 nt, Human papillomavirus type 6
ggagauaccuggc

SEQ ID NO: 2690637 - RNA, 17 nt, Human papillomavirus type 6
gaugaggagguggagga

SEQ ID NO: 2690638 - RNA, 15 nt, Human papillomavirus type 6
cggggcaaaacugua

SEQ ID NO: 2690639 - RNA, 16 nt, Human papillomavirus type 6
aaacaaguuaugaaau

SEQ ID NO: 2690640 - RNA, 23 nt, Human papillomavirus type 6
uuauauauauguguguauguacu

SEQ ID NO: 2690641 - RNA, 20 nt, Human papillomavirus type 6
cauuaauacugccuguuaua

SEQ ID NO: 2690642 - RNA, 19 nt, Human papillomavirus type 6
auaauugcauuuguuguau

SEQ ID NO: 2690643 - RNA, 23 nt, Human papillomavirus type 6
gggaguggugguaacccuggaca

SEQ ID NO: 2690644 - RNA, 17 nt, Human papillomavirus type 6
acauuacaagaaacaag

SEQ ID NO: 2690645 - RNA, 23 nt, Human papillomavirus type 6
ccuaagccacauaggaaugcaag

SEQ ID NO: 2690646 - RNA, 21 nt, Human papillomavirus type 6
uauguacuguuauaugugugu

SEQ ID NO: 2690647 - RNA, 15 nt, Human papillomavirus type 6
ugcgcaccgaagaca

SEQ ID NO: 2690648 - RNA, 16 nt, Human papillomavirus type 6
uguuuauguacuguua

SEQ ID NO: 2690649 - RNA, 20 nt, Human papillomavirus type 6
ugauggagauaccuggcugg

SEQ ID NO: 2690650 - RNA, 15 nt, Human papillomavirus type 6
auaucaaacauguaa

SEQ ID NO: 2690651 - RNA, 13 nt, Human papillomavirus type 6
auugaugacagca

SEQ ID NO: 2690652 - RNA, 16 nt, Human papillomavirus type 6
uagcaucauacuuauu

SEQ ID NO: 2690653 - RNA, 13 nt, Human papillomavirus type 6
guguguauguacu

SEQ ID NO: 2690654 - RNA, 18 nt, Human papillomavirus type 6
uucagggaguggugguaa

SEQ ID NO: 2690655 - RNA, 14 nt, Human papillomavirus type 6
uagaggugggcagg

SEQ ID NO: 2690656 - RNA, 16 nt, Human papillomavirus type 6
guauauguauguguug

SEQ ID NO: 2690657 - RNA, 19 nt, Human papillomavirus type 6
uguaauacaacuguacaug

SEQ ID NO: 2690658 - RNA, 14 nt, Human papillomavirus type 6
cacagcaaugaugc

SEQ ID NO: 2690659 - RNA, 19 nt, Human papillomavirus type 6
aaagguguccgaagcaaaa

SEQ ID NO: 2690660 - RNA, 16 nt, Human papillomavirus type 6
acuuacaagacagcca

SEQ ID NO: 2690661 - RNA, 13 nt, Human papillomavirus type 6
aaacucacuggaa

SEQ ID NO: 2690662 - RNA, 14 nt, Human papillomavirus type 6
acagcaaugaugcu

SEQ ID NO: 2690663 - RNA, 15 nt, Human papillomavirus type 6
uagcugcaggaacaa

SEQ ID NO: 2690664 - RNA, 19 nt, Human papillomavirus type 6
cuauaucaaacauguaaac

SEQ ID NO: 2690665 - RNA, 13 nt, Human papillomavirus type 6
uggagccuguggc

SEQ ID NO: 2690666 - RNA, 22 nt, Human papillomavirus type 6
uaucuuguuacacccugugacu

SEQ ID NO: 2690667 - RNA, 13 nt, Human papillomavirus type 6
cagacgaugagga

SEQ ID NO: 2690668 - RNA, 13 nt, Human papillomavirus type 6
accgaagacauaa

SEQ ID NO: 2690669 - RNA, 22 nt, Human papillomavirus type 6
uauguacuguuauguauaugug

SEQ ID NO: 2690670 - RNA, 19 nt, Human papillomavirus type 6
aguucuagacuucuugcag

SEQ ID NO: 2690671 - RNA, 13 nt, Human papillomavirus type 6
aauacaacuguac

SEQ ID NO: 2690672 - RNA, 16 nt, Human papillomavirus type 6
acagcucagaagauga

SEQ ID NO: 2690673 - RNA, 16 nt, Human papillomavirus type 6
gacuucuugcaguggg

SEQ ID NO: 2690674 - RNA, 13 nt, Human papillomavirus type 6
auguguguaugua

SEQ ID NO: 2690675 - RNA, 17 nt, Human papillomavirus type 6
acaacuguaaugaugau

SEQ ID NO: 2690676 - RNA, 22 nt, Human papillomavirus type 6
gcuaacaugucaauuuaaugau

SEQ ID NO: 2690677 - RNA, 15 nt, Human papillomavirus type 6
caaacaauacaaugg

SEQ ID NO: 2690678 - RNA, 20 nt, Human papillomavirus type 6
auacaggguauuuaaggugg

SEQ ID NO: 2690679 - RNA, 13 nt, Human papillomavirus type 6
cuuguuauauaca

SEQ ID NO: 2690680 - RNA, 13 nt, Human papillomavirus type 6
ugauuuaauauca

SEQ ID NO: 2690681 - RNA, 18 nt, Human papillomavirus type 6
uaucaugccagcaguucu

SEQ ID NO: 2690682 - RNA, 13 nt, Human papillomavirus type 6
uauaauugcauuu

SEQ ID NO: 2690683 - RNA, 16 nt, Human papillomavirus type 6
aucauacuuauuguau

SEQ ID NO: 2690684 - RNA, 16 nt, Human papillomavirus type 6
aacauuaccaaauagu

SEQ ID NO: 2690685 - RNA, 14 nt, Human papillomavirus type 6
uauguguguauaua

SEQ ID NO: 2690686 - RNA, 13 nt, Human papillomavirus type 6
gcugugcaaacaa

SEQ ID NO: 2690687 - RNA, 12 nt, Human papillomavirus type 6
aagguaaagcga

SEQ ID NO: 2690688 - RNA, 15 nt, Human papillomavirus type 6
gcauuuguuguaugu

SEQ ID NO: 2690689 - RNA, 13 nt, Human papillomavirus type 6
uacugccuguuau

SEQ ID NO: 2690690 - RNA, 13 nt, Human papillomavirus type 6
auauaaagcaaaa

SEQ ID NO: 2690691 - RNA, 13 nt, Human papillomavirus type 8
guugagcaaacaa

SEQ ID NO: 2690692 - RNA, 23 nt, Human papillomavirus type 8
guguugcuauauuucgcuaggca

SEQ ID NO: 2690693 - RNA, 22 nt, Human papillomavirus type 8
cacauuuaucaaaccugcaaac

SEQ ID NO: 2690694 - RNA, 22 nt, Human papillomavirus type 8
agcuguguugcuauauuucgcu

SEQ ID NO: 2690695 - RNA, 16 nt, Human papillomavirus type 8
cagagcaggacagcgg

SEQ ID NO: 2690696 - RNA, 15 nt, Human papillomavirus type 8
gugagcagagcgagg

SEQ ID NO: 2690697 - RNA, 18 nt, Human papillomavirus type 8
caccaguggccagggugc

SEQ ID NO: 2690698 - RNA, 15 nt, Human papillomavirus type 8
gaugaauacauucaa

SEQ ID NO: 2690699 - RNA, 21 nt, Human papillomavirus type 8
agaaaucugaguuugcagaug

SEQ ID NO: 2690700 - RNA, 15 nt, Human papillomavirus type 8
ugacagacugcucac

SEQ ID NO: 2690701 - RNA, 22 nt, Human papillomavirus type 8
acuauguggaagcacauuuacu

SEQ ID NO: 2690702 - RNA, 13 nt, Human papillomavirus type 8
cacagugguacgg

SEQ ID NO: 2690703 - RNA, 22 nt, Human papillomavirus type 8
aagagagacucugucacacaca

SEQ ID NO: 2690704 - RNA, 16 nt, Human papillomavirus type 8
cguguuggaaauacuc

SEQ ID NO: 2690705 - RNA, 21 nt, Human papillomavirus type 8
gccaaucuauuuuggcagcgc

SEQ ID NO: 2690706 - RNA, 15 nt, Human papillomavirus type 8
caaagaacuaacauc

SEQ ID NO: 2690707 - RNA, 18 nt, Human papillomavirus type 8
uugcagaugagccuugga

SEQ ID NO: 2690708 - RNA, 17 nt, Human papillomavirus type 8
auuagguguugggagca

SEQ ID NO: 2690709 - RNA, 11 nt, Human papillomavirus type 8
cggaggaggag

SEQ ID NO: 2690710 - RNA, 18 nt, Human papillomavirus type 8
gagcuagacaucgaaaga

SEQ ID NO: 2690711 - RNA, 20 nt, Human papillomavirus type 8
cagagaccuacagcuucugu

SEQ ID NO: 2690712 - RNA, 17 nt, Human papillomavirus type 8
caauauuuuaaaauaug

SEQ ID NO: 2690713 - RNA, 18 nt, Human papillomavirus type 8
ucacucuaccuaagaaac

SEQ ID NO: 2690714 - RNA, 20 nt, Human papillomavirus type 8
auuacaaaaacuaaaacgaa

SEQ ID NO: 2690715 - RNA, 19 nt, Human papillomavirus type 8
guuuauucugacucagcau

SEQ ID NO: 2690716 - RNA, 20 nt, Human papillomavirus type 8
agcugcugucaggucaagcu

SEQ ID NO: 2690717 - RNA, 14 nt, Human papillomavirus type 8
gacauacugccaau

SEQ ID NO: 2690718 - RNA, 22 nt, Human papillomavirus type 8
agacaaugauuuugaacaauua

SEQ ID NO: 2690719 - RNA, 14 nt, Human papillomavirus type 8
ugaaguuaagugag

SEQ ID NO: 2690720 - RNA, 21 nt, Human papillomavirus type 8
caagaauugcuguucagagac

SEQ ID NO: 2690721 - RNA, 13 nt, Human papillomavirus type 8
gccgugguacagg

SEQ ID NO: 2690722 - RNA, 14 nt, Human papillomavirus type 8
auaauggugacaca

SEQ ID NO: 2690723 - RNA, 12 nt, Human papillomavirus type 8
caaacaacaguu

SEQ ID NO: 2690724 - RNA, 16 nt, Human papillomavirus type 8
caaacgaacaggaaac

SEQ ID NO: 2690725 - RNA, 18 nt, Human papillomavirus type 8
uugucaacgcaacugauu

SEQ ID NO: 2690726 - RNA, 21 nt, Human papillomavirus type 8
ugaacaauuauuugagcgaga

SEQ ID NO: 2690727 - RNA, 18 nt, Human papillomavirus type 8
ggaaauacucccacagug

SEQ ID NO: 2690728 - RNA, 14 nt, Human papillomavirus type 8
gaguaguugccaaa

SEQ ID NO: 2690729 - RNA, 17 nt, Human papillomavirus type 8
caauuauuugagcgaga

SEQ ID NO: 2690730 - RNA, 13 nt, Human papillomavirus type 8
ucuuugcagagca

SEQ ID NO: 2690731 - RNA, 18 nt, Human papillomavirus type 8
uccguguuggaaauacuc

SEQ ID NO: 2690732 - RNA, 17 nt, Human papillomavirus type 8
agggaaauucucuggaa

SEQ ID NO: 2690733 - RNA, 17 nt, Human papillomavirus type 8
uucaauguuuacaacaa

SEQ ID NO: 2690734 - RNA, 18 nt, Human papillomavirus type 8
ccaguugaccugcuuugu

SEQ ID NO: 2690735 - RNA, 17 nt, Human papillomavirus type 8
gcaaaagccaagcaggc

SEQ ID NO: 2690736 - RNA, 12 nt, Human papillomavirus type 8
acuaacacacua

SEQ ID NO: 2690737 - RNA, 15 nt, Human papillomavirus type 8
auguagacaaugauu

SEQ ID NO: 2690738 - RNA, 13 nt, Human papillomavirus type 8
agacuuauaagaa

SEQ ID NO: 2690739 - RNA, 22 nt, Human papillomavirus type 8
gaacuguauucaaaauuguugc

SEQ ID NO: 2690740 - RNA, 19 nt, Human papillomavirus type 8
gcagagcaggacagcggag

SEQ ID NO: 2690741 - RNA, 19 nt, Human papillomavirus type 8
agcuaacucuuaacaauga

SEQ ID NO: 2690742 - RNA, 16 nt, Human papillomavirus type 8
cuauuuuaauaaagug

SEQ ID NO: 2690743 - RNA, 22 nt, Human papillomavirus type 8
gauccaaauagguuugcacugg

SEQ ID NO: 2690744 - RNA, 17 nt, Human papillomavirus type 8
ccauauuucaauguuua

SEQ ID NO: 2690745 - RNA, 15 nt, Human papillomavirus type 8
acuguauucaaaauu

SEQ ID NO: 2690746 - RNA, 21 nt, Human papillomavirus type 8
gcuagacaucgaaagaacugu

SEQ ID NO: 2690747 - RNA, 11 nt, Human papillomavirus type 8
ccugcaaacag

SEQ ID NO: 2690748 - RNA, 22 nt, Human papillomavirus type 8
acagauggcaguguggcaaucg

SEQ ID NO: 2690749 - RNA, 13 nt, Human papillomavirus type 8
gucgccugccaag

SEQ ID NO: 2690750 - RNA, 22 nt, Human papillomavirus type 8
aauguuuguuuauucugacuca

SEQ ID NO: 2690751 - RNA, 17 nt, Human papillomavirus type 8
aggucgccugccaagga

SEQ ID NO: 2690752 - RNA, 14 nt, Human papillomavirus type 8
aucugaguuugcag

SEQ ID NO: 2690753 - RNA, 16 nt, Human papillomavirus type 8
acacuugaggcacaga

SEQ ID NO: 2690754 - RNA, 20 nt, Human papillomavirus type 8
cugauucggguaucaggacc

SEQ ID NO: 2690755 - RNA, 19 nt, Human papillomavirus type 8
aguugaccugcuuugugaa

SEQ ID NO: 2690756 - RNA, 14 nt, Human papillomavirus type 8
accuacagcuucug

SEQ ID NO: 2690757 - RNA, 19 nt, Human papillomavirus type 8
gcaaagcacggaugaauac

SEQ ID NO: 2690758 - RNA, 17 nt, Human papillomavirus type 8
acagauggcaguguggc

SEQ ID NO: 2690759 - RNA, 15 nt, Human papillomavirus type 8
gauguagacaaugau

SEQ ID NO: 2690760 - RNA, 16 nt, Human papillomavirus type 8
ggacauuaguggacac

SEQ ID NO: 2690761 - RNA, 14 nt, Human papillomavirus type 8
cacuagcagugucu

SEQ ID NO: 2690762 - RNA, 23 nt, Human papillomavirus type 8
ucaacaggagugugagcagagcg

SEQ ID NO: 2690763 - RNA, 21 nt, Human papillomavirus type 8
aaacacuugaggcacagauug

SEQ ID NO: 2690764 - RNA, 14 nt, Human papillomavirus type 8
agacucagauauuu

SEQ ID NO: 2690765 - RNA, 20 nt, Human papillomavirus type 8
ugcucggauuaggucgccug

SEQ ID NO: 2690766 - RNA, 14 nt, Human papillomavirus type 8
acauucaaagaacu

SEQ ID NO: 2690767 - RNA, 20 nt, Human papillomavirus type 8
agccuuggacauuaguggac

SEQ ID NO: 2690768 - RNA, 13 nt, Human papillomavirus type 8
aggucgccugcca

SEQ ID NO: 2690769 - RNA, 19 nt, Human papillomavirus type 8
aaggcucuuugcagagcag

SEQ ID NO: 2690770 - RNA, 16 nt, Human papillomavirus type 8
cugucgcgcagcucag

SEQ ID NO: 2690771 - RNA, 13 nt, Human papillomavirus type 8
ugaguaguugcca

SEQ ID NO: 2690772 - RNA, 19 nt, Human papillomavirus type 8
auuacagguucccaaagua

SEQ ID NO: 2690773 - RNA, 17 nt, Human papillomavirus type 8
agauacagacucagaua

SEQ ID NO: 2690774 - RNA, 15 nt, Human papillomavirus type 8
cucugucacacacau

SEQ ID NO: 2690775 - RNA, 21 nt, Human papillomavirus type 8
gucugaagcaaaagccaagca

SEQ ID NO: 2690776 - RNA, 17 nt, Human papillomavirus type 8
gacaaccauuagguguu

SEQ ID NO: 2690777 - RNA, 23 nt, Human papillomavirus type 8
gggacaaccauuagguguuggga

SEQ ID NO: 2690778 - RNA, 14 nt, Human papillomavirus type 8
aagcaaaagccaag

SEQ ID NO: 2690779 - RNA, 14 nt, Human papillomavirus type 8
cugcugucagguca

SEQ ID NO: 2690780 - RNA, 16 nt, Human papillomavirus type 8
gaccuggaucagggaa

SEQ ID NO: 2690781 - RNA, 15 nt, Human papillomavirus type 8
auguugcagcugcag

SEQ ID NO: 2690782 - RNA, 21 nt, Human papillomavirus type 8
ggaauaauguugcagcugcag

SEQ ID NO: 2690783 - RNA, 18 nt, Human papillomavirus type 8
cugcagucacuacagaaa

SEQ ID NO: 2690784 - RNA, 23 nt, Human papillomavirus type 8
ccaggauuggauaucaaccugug

SEQ ID NO: 2690785 - RNA, 18 nt, Human papillomavirus type 8
guguauuuuggaagcuga

SEQ ID NO: 2690786 - RNA, 15 nt, Human papillomavirus type 8
agaaauccaagcgaa

SEQ ID NO: 2690787 - RNA, 19 nt, Human papillomavirus type 8
cuauggacauacugccaau

SEQ ID NO: 2690788 - RNA, 23 nt, Human papillomavirus type 8
ccaaucuauuuuggcagcgcuuu

SEQ ID NO: 2690789 - RNA, 21 nt, Human papillomavirus type 8
aaaguugagcaaacaacaguu

SEQ ID NO: 2690790 - RNA, 17 nt, Human papillomavirus type 8
ggagugugagcagagcg

SEQ ID NO: 2690791 - RNA, 12 nt, Human papillomavirus type 8
cacaccugugga

SEQ ID NO: 2690792 - RNA, 18 nt, Human papillomavirus type 8
acugccaaucgacacuau

SEQ ID NO: 2690793 - RNA, 17 nt, Human papillomavirus type 8
gcuccagaaaaucauuu

SEQ ID NO: 2690794 - RNA, 21 nt, Human papillomavirus type 8
uugcagaggcuuagaaaucag

SEQ ID NO: 2690795 - RNA, 18 nt, Human papillomavirus type 8
cuuaacaaugaagcugaa

SEQ ID NO: 2690796 - RNA, 22 nt, Human papillomavirus type 8
accaguggccagggugcaaagc

SEQ ID NO: 2690797 - RNA, 13 nt, Human papillomavirus type 8
acuagcagugucu

SEQ ID NO: 2690798 - RNA, 18 nt, Human papillomavirus type 8
agguugguaugggcuugc

SEQ ID NO: 2690799 - RNA, 18 nt, Human papillomavirus type 8
guauucaaggaauguuug

SEQ ID NO: 2690800 - RNA, 16 nt, Human papillomavirus type 8
gugagcagagcgagga

SEQ ID NO: 2690801 - RNA, 13 nt, Human papillomavirus type 8
aaggguuaaguga

SEQ ID NO: 2690802 - RNA, 21 nt, Human papillomavirus type 8
guacaaaaccauaaacuuuua

SEQ ID NO: 2690803 - RNA, 19 nt, Human papillomavirus type 8
guauacacuauguggaagc

SEQ ID NO: 2690804 - RNA, 21 nt, Human papillomavirus type 8
uaaagcugucgcgcagcucag

SEQ ID NO: 2690805 - RNA, 16 nt, Human papillomavirus type 8
auguucguucaaacau

SEQ ID NO: 2690806 - RNA, 20 nt, Human papillomavirus type 8
aucggcuaccgguaagguuu

SEQ ID NO: 2690807 - RNA, 17 nt, Human papillomavirus type 8
ucaguuuagugccagaa

SEQ ID NO: 2690808 - RNA, 17 nt, Human papillomavirus type 8
gcuauaggaauaauguu

SEQ ID NO: 2690809 - RNA, 16 nt, Human papillomavirus type 8
aacaggagugugagca

SEQ ID NO: 2690810 - RNA, 16 nt, Human papillomavirus type 8
auaaacagccugacaa

SEQ ID NO: 2690811 - RNA, 20 nt, Human papillomavirus type 8
cuuauaagaaugcuccagaa

SEQ ID NO: 2690812 - RNA, 22 nt, Human papillomavirus type 8
caggagugugagcagagcgagg

SEQ ID NO: 2690813 - RNA, 13 nt, Human papillomavirus type 8
gacuuauuagaua

SEQ ID NO: 2690814 - RNA, 16 nt, Human papillomavirus type 8
gauccaaauagguuug

SEQ ID NO: 2690815 - RNA, 13 nt, Human papillomavirus type 8
acaaugaagcuga

SEQ ID NO: 2690816 - RNA, 14 nt, Human papillomavirus type 8
auauaugauaaaca

SEQ ID NO: 2690817 - RNA, 16 nt, Human papillomavirus type 8
auguuucucaugaggu

SEQ ID NO: 2690818 - RNA, 16 nt, Human papillomavirus type 8
aacucuuaacaaugaa

SEQ ID NO: 2690819 - RNA, 15 nt, Human papillomavirus type 8
aacuguauucaaaau

SEQ ID NO: 2690820 - RNA, 13 nt, Human papillomavirus type 8
agacgauaagugg

SEQ ID NO: 2690821 - RNA, 12 nt, Human papillomavirus type 8
ggcagugcuggu

SEQ ID NO: 2690822 - RNA, 16 nt, Human papillomavirus type 8
acauuaguggacacaa

SEQ ID NO: 2690823 - RNA, 13 nt, Human papillomavirus type 8
augaagcugaaga

SEQ ID NO: 2690824 - RNA, 15 nt, Human papillomavirus type 8
ucacugucaccucag

SEQ ID NO: 2690825 - RNA, 22 nt, Human papillomavirus type 8
acauuacagguucccaaaguau

SEQ ID NO: 2690826 - RNA, 19 nt, Human papillomavirus type 8
gcaaacaggcagguacaug

SEQ ID NO: 2690827 - RNA, 14 nt, Human papillomavirus type 8
aauacauucaaaga

SEQ ID NO: 2690828 - RNA, 22 nt, Human papillomavirus type 8
auuuuaaaauauggcagugcug

SEQ ID NO: 2690829 - RNA, 14 nt, Human papillomavirus type 8
ggaagcacauuuac

SEQ ID NO: 2690830 - RNA, 14 nt, Human papillomavirus type 8
ccaucccuauuuua

SEQ ID NO: 2690831 - RNA, 18 nt, Human papillomavirus type 8
ccaaucuauuuuggcagc

SEQ ID NO: 2690832 - RNA, 22 nt, Human papillomavirus type 8
gcaaacaacaguugcugacaau

SEQ ID NO: 2690833 - RNA, 21 nt, Human papillomavirus type 8
cagaugagccuuggacauuag

SEQ ID NO: 2690834 - RNA, 23 nt, Human papillomavirus type 8
cagacucaguuuagugccagaau

SEQ ID NO: 2690835 - RNA, 15 nt, Human papillomavirus type 8
cgaaaagaagcugug

SEQ ID NO: 2690836 - RNA, 22 nt, Human papillomavirus type 8
ggggccugguauccguguugga

SEQ ID NO: 2690837 - RNA, 22 nt, Human papillomavirus type 8
aagaauugcuguucagagaccu

SEQ ID NO: 2690838 - RNA, 16 nt, Human papillomavirus type 8
uaacaucuacuaucac

SEQ ID NO: 2690839 - RNA, 14 nt, Human papillomavirus type 8
aaacaggcagguac

SEQ ID NO: 2690840 - RNA, 15 nt, Human papillomavirus type 8
accggccgugguaca

SEQ ID NO: 2690841 - RNA, 13 nt, Human papillomavirus type 8
gcuaggcaaaaag

SEQ ID NO: 2690842 - RNA, 21 nt, Human papillomavirus type 8
auggugacacauuacagguuc

SEQ ID NO: 2690843 - RNA, 12 nt, Human papillomavirus type 8
guucguucaaac

SEQ ID NO: 2690844 - RNA, 18 nt, Human papillomavirus type 8
auuagauaauugugaccu

SEQ ID NO: 2690845 - RNA, 17 nt, Human papillomavirus type 8
agagacuuauaagaaug

SEQ ID NO: 2690846 - RNA, 20 nt, Human papillomavirus type 8
acaaugaagcugaagauguu

SEQ ID NO: 2690847 - RNA, 12 nt, Human papillomavirus type 8
aucgggaaauca

SEQ ID NO: 2690848 - RNA, 16 nt, Human papillomavirus type 8
cuuucgcuuaaaguua

SEQ ID NO: 2690849 - RNA, 16 nt, Human papillomavirus type 8
auucaaaauuguugca

SEQ ID NO: 2690850 - RNA, 23 nt, Human papillomavirus type 8
gaccgcacccgguacauaaaggu

SEQ ID NO: 2690851 - RNA, 16 nt, Human papillomavirus type 8
uauuuuggaagcugaa

SEQ ID NO: 2690852 - RNA, 14 nt, Human papillomavirus type 8
cgccugccaaggaa

SEQ ID NO: 2690853 - RNA, 11 nt, Human papillomavirus type 8
uuggcaucucc

SEQ ID NO: 2690854 - RNA, 21 nt, Human papillomavirus type 8
cuuauaagaaugcuccagaaa

SEQ ID NO: 2690855 - RNA, 19 nt, Human papillomavirus type 8
aggaauaauguugcagcug

SEQ ID NO: 2690856 - RNA, 19 nt, Human papillomavirus type 8
agaauagaccauguucguu

SEQ ID NO: 2690857 - RNA, 21 nt, Human papillomavirus type 8
gcuguucagagaccuacagcu

SEQ ID NO: 2690858 - RNA, 22 nt, Human papillomavirus type 8
aguugccaaaacagacucaguu

SEQ ID NO: 2690859 - RNA, 20 nt, Human papillomavirus type 8
agacaucgaaagaacuguau

SEQ ID NO: 2690860 - RNA, 20 nt, Human papillomavirus type 8
ugaacaauuauuugagcgag

SEQ ID NO: 2690861 - RNA, 17 nt, Human papillomavirus type 8
auucugacucagcauca

SEQ ID NO: 2690862 - RNA, 22 nt, Human papillomavirus type 8
uagacaucgaaagaacuguauu

SEQ ID NO: 2690863 - RNA, 23 nt, Human papillomavirus type 8
caggaaacggaggaggagcuaga

SEQ ID NO: 2690864 - RNA, 22 nt, Human papillomavirus type 8
ucccaaaguaucgggaaaucaa

SEQ ID NO: 2690865 - RNA, 14 nt, Human papillomavirus type 8
gucugaagcaaaag

SEQ ID NO: 2690866 - RNA, 19 nt, Human papillomavirus type 8
caggagugugagcagagcg

SEQ ID NO: 2690867 - RNA, 22 nt, Human papillomavirus type 8
uaacucuuaacaaugaagcuga

SEQ ID NO: 2690868 - RNA, 16 nt, Human papillomavirus type 8
auucugacucagcauc

SEQ ID NO: 2690869 - RNA, 20 nt, Human papillomavirus type 8
aacagccugacaaugccaau

SEQ ID NO: 2690870 - RNA, 17 nt, Human papillomavirus type 8
agccaagcaggcuauag

SEQ ID NO: 2690871 - RNA, 20 nt, Human papillomavirus type 8
gaccuuucaagaauugcugu

SEQ ID NO: 2690872 - RNA, 17 nt, Human papillomavirus type 8
acaacaguugcugacaa

SEQ ID NO: 2690873 - RNA, 14 nt, Human papillomavirus type 8
ucugucacacacau

SEQ ID NO: 2690874 - RNA, 11 nt, Human papillomavirus type 8
gaggcacagau

SEQ ID NO: 2690875 - RNA, 16 nt, Human papillomavirus type 8
uccuauggacauacug

SEQ ID NO: 2690876 - RNA, 18 nt, Human papillomavirus type 8
accaguggccagggugca

SEQ ID NO: 2690877 - RNA, 22 nt, Human papillomavirus type 8
aacucuuaacaaugaagcugaa

SEQ ID NO: 2690878 - RNA, 21 nt, Human papillomavirus type 8
accguguggcugcagcugcug

SEQ ID NO: 2690879 - RNA, 15 nt, Human papillomavirus type 8
ggcucuuugcagagc

SEQ ID NO: 2690880 - RNA, 19 nt, Human papillomavirus type 8
gcuacuaacacacuaacau

SEQ ID NO: 2690881 - RNA, 17 nt, Human papillomavirus type 8
accaguggccagggugc

SEQ ID NO: 2690882 - RNA, 19 nt, Human papillomavirus type 8
uuugcuuuuuacuauauuu

SEQ ID NO: 2690883 - RNA, 15 nt, Human papillomavirus type 8
agaaaccgaccgcac

SEQ ID NO: 2690884 - RNA, 15 nt, Human papillomavirus type 8
gcagagcgaggagca

SEQ ID NO: 2690885 - RNA, 16 nt, Human papillomavirus type 8
aagaauugcuguucag

SEQ ID NO: 2690886 - RNA, 19 nt, Human papillomavirus type 8
aacuguauucaaaauuguu

SEQ ID NO: 2690887 - RNA, 13 nt, Human papillomavirus type 8
acuaacacacuaa

SEQ ID NO: 2690888 - RNA, 13 nt, Human papillomavirus type 8
agcugcagucacu

SEQ ID NO: 2690889 - RNA, 17 nt, Human papillomavirus type 8
caauacugacagacugc

SEQ ID NO: 2690890 - RNA, 11 nt, Human papillomavirus type 8
uggaagcugaa

SEQ ID NO: 2690891 - RNA, 18 nt, Human papillomavirus type 8
agaauugcuguucagaga

SEQ ID NO: 2690892 - RNA, 20 nt, Human papillomavirus type 8
cuaaagaaggguuaagugag

SEQ ID NO: 2690893 - RNA, 20 nt, Human papillomavirus type 8
cuauaggaauaauguugcag

SEQ ID NO: 2690894 - RNA, 13 nt, Human papillomavirus type 8
gagugugagcaga

SEQ ID NO: 2690895 - RNA, 18 nt, Human papillomavirus type 8
agccuuggacauuagugg

SEQ ID NO: 2690896 - RNA, 13 nt, Human papillomavirus type 8
acagacucaguuu

SEQ ID NO: 2690897 - RNA, 13 nt, Human papillomavirus type 8
gcgguaacugcaa

SEQ ID NO: 2690898 - RNA, 14 nt, Human papillomavirus type 8
uaucaaaccugcaa

SEQ ID NO: 2690899 - RNA, 20 nt, Human papillomavirus type 8
cauuuacuacacugaugcag

SEQ ID NO: 2690900 - RNA, 14 nt, Human papillomavirus type 8
cccacagugguacg

SEQ ID NO: 2690901 - RNA, 21 nt, Human papillomavirus type 8
ccuggaucagggaaauucucu

SEQ ID NO: 2690902 - RNA, 21 nt, Human papillomavirus type 8
gugagauacaaccugaagugu

SEQ ID NO: 2690903 - RNA, 19 nt, Human papillomavirus type 8
guucaaacaugcucggauu

SEQ ID NO: 2690904 - RNA, 21 nt, Human papillomavirus type 8
acucuuaacaaugaagcugaa

SEQ ID NO: 2690905 - RNA, 21 nt, Human papillomavirus type 8
uauggcagugcugguguauuu

SEQ ID NO: 2690906 - RNA, 19 nt, Human papillomavirus type 8
gaacuaacaucuacuauca

SEQ ID NO: 2690907 - RNA, 14 nt, Human papillomavirus type 8
guccuaaagcuguc

SEQ ID NO: 2690908 - RNA, 22 nt, Human papillomavirus type 8
uaucaaccugugccgccacuag

SEQ ID NO: 2690909 - RNA, 15 nt, Human papillomavirus type 8
gcuaggcaaaaaggc

SEQ ID NO: 2690910 - RNA, 15 nt, Human papillomavirus type 8
gauaaguggcacaaa

SEQ ID NO: 2690911 - RNA, 17 nt, Human papillomavirus type 8
aggaauguuuguuuauu

SEQ ID NO: 2690912 - RNA, 19 nt, Human papillomavirus type 8
guuuguuuauucugacuca

SEQ ID NO: 2690913 - RNA, 16 nt, Human papillomavirus type 8
uguugaaguuaaguga

SEQ ID NO: 2690914 - RNA, 14 nt, Human papillomavirus type 8
cacacuaacauauu

SEQ ID NO: 2690915 - RNA, 22 nt, Human papillomavirus type 8
accguuuucgguacaaaaccau

SEQ ID NO: 2690916 - RNA, 16 nt, Human papillomavirus type 8
guuuucgguacaaaac

SEQ ID NO: 2690917 - RNA, 18 nt, Human papillomavirus type 8
cuugccaaucuauuuugg

SEQ ID NO: 2690918 - RNA, 17 nt, Human papillomavirus type 8
cagauugcgcauuggcu

SEQ ID NO: 2690919 - RNA, 13 nt, Human papillomavirus type 8
accuuucaagaau

SEQ ID NO: 2690920 - RNA, 20 nt, Human papillomavirus type 8
cagcugcagucacuacagaa

SEQ ID NO: 2690921 - RNA, 15 nt, Human papillomavirus type 8
agaagcgguaggucc

SEQ ID NO: 2690922 - RNA, 19 nt, Human papillomavirus type 8
cucuuugcagagcaggaca

SEQ ID NO: 2690923 - RNA, 15 nt, Human papillomavirus type 8
gauggcaguguggca

SEQ ID NO: 2690924 - RNA, 17 nt, Human papillomavirus type 8
auuucaucaacaggagu

SEQ ID NO: 2690925 - RNA, 17 nt, Human papillomavirus type 8
gaaaagaagcuguguug

SEQ ID NO: 2690926 - RNA, 16 nt, Human papillomavirus type 8
gccaauacugacagac

SEQ ID NO: 2690927 - RNA, 17 nt, Human papillomavirus type 8
caaucuauuuuggcagc

SEQ ID NO: 2690928 - RNA, 15 nt, Human papillomavirus type 8
auuuuggaagcugaa

SEQ ID NO: 2690929 - RNA, 22 nt, Human papillomavirus type 8
gauuggauaucaaccugugccg

SEQ ID NO: 2690930 - RNA, 22 nt, Human papillomavirus type 8
acugauucggguaucaggaccu

SEQ ID NO: 2690931 - RNA, 11 nt, Human papillomavirus type 8
gguaacugcaa

SEQ ID NO: 2690932 - RNA, 18 nt, Human papillomavirus type 8
gaacaauuauuugagcga

SEQ ID NO: 2690933 - RNA, 22 nt, Human papillomavirus type 8
caaagcacggaugaauacauuc

SEQ ID NO: 2690934 - RNA, 15 nt, Human papillomavirus type 8
auaugucuguauaca

SEQ ID NO: 2690935 - RNA, 12 nt, Human papillomavirus type 8
uugucaacgcaa

SEQ ID NO: 2690936 - RNA, 20 nt, Human papillomavirus type 8
ugagcgagauacagacucag

SEQ ID NO: 2690937 - RNA, 17 nt, Human papillomavirus type 8
ugcuuugugaagaggaa

SEQ ID NO: 2690938 - RNA, 17 nt, Human papillomavirus type 8
gacagacugcucacugu

SEQ ID NO: 2690939 - RNA, 21 nt, Human papillomavirus type 8
aggaccuuucaagaauugcug

SEQ ID NO: 2690940 - RNA, 17 nt, Human papillomavirus type 8
gcagaacaaacacuuga

SEQ ID NO: 2690941 - RNA, 11 nt, Human papillomavirus type 8
acuauguggaa

SEQ ID NO: 2690942 - RNA, 20 nt, Human papillomavirus type 8
gcucuuugcagagcaggaca

SEQ ID NO: 2690943 - RNA, 22 nt, Human papillomavirus type 8
cgaaggcucuuugcagagcagg

SEQ ID NO: 2690944 - RNA, 13 nt, Human papillomavirus type 8
auacauucaaaga

SEQ ID NO: 2690945 - RNA, 12 nt, Human papillomavirus type 8
ccugccaaggaa

SEQ ID NO: 2690946 - RNA, 14 nt, Human papillomavirus type 8
gaaaagaagcugug

SEQ ID NO: 2690947 - RNA, 19 nt, Human papillomavirus type 8
gaaguauugaucuugccaa

SEQ ID NO: 2690948 - RNA, 14 nt, Human
gcccuguuaaaaga

SEQ ID NO: 2690949 - RNA, 17 nt, Human
gcccuguuaaaagauga

SEQ ID NO: 2690950 - RNA, 13 nt, Human
gcccuguuaaaag

SEQ ID NO: 2690951 - RNA, 16 nt, Human
gcccccaggugccagu

SEQ ID NO: 2690952 - RNA, 23 nt, Human
gccagcaguucagagcugcccuc

SEQ ID NO: 2690953 - RNA, 22 nt, Human
gccagcaguucagagcugcccu

SEQ ID NO: 2690954 - RNA, 22 nt, Human
gccagacaucaacagauaaaua

SEQ ID NO: 2690955 - RNA, 19 nt, Human
gccagauuuuccugaaaac

SEQ ID NO: 2690956 - RNA, 15 nt, Human
gcuccccucggagaa

SEQ ID NO: 2690957 - RNA, 18 nt, Human
gcuccccucggagaagag

SEQ ID NO: 2690958 - RNA, 21 nt, Human
gcuaguaauuggaaaggcagc

SEQ ID NO: 2690959 - RNA, 16 nt, Human
gcuaguaucaaaagaa

SEQ ID NO: 2690960 - RNA, 17 nt, Human
gcuggagcucugcccau

SEQ ID NO: 2690961 - RNA, 14 nt, Human
gcuggagcucugcc

SEQ ID NO: 2690962 - RNA, 20 nt, Human
gcugccuccccuccucugcu

SEQ ID NO: 2690963 - RNA, 17 nt, Human
gcugccuccccuccucu

SEQ ID NO: 2690964 - RNA, 16 nt, Human
gcugccuccccuccuc

SEQ ID NO: 2690965 - RNA, 22 nt, Human
gcugccuccccuccucugcuug

SEQ ID NO: 2690966 - RNA, 21 nt, Human
gcugccuccccuccucugcuu

SEQ ID NO: 2690967 - RNA, 23 nt, Human
aaaauaauuuuuauauuugaaau

SEQ ID NO: 2690968 - RNA, 21 nt, Human
aaaauaauuuuuauauuugaa

SEQ ID NO: 2690969 - RNA, 20 nt, Human
aaaauaauuuuuauauuuga

SEQ ID NO: 2690970 - RNA, 21 nt, Human
gggauuuucagcccucagaau

SEQ ID NO: 2690971 - RNA, 17 nt, Human
gggauugaaggaugcug

SEQ ID NO: 2690972 - RNA, 23 nt, Human
gggcagcugccuccccuccucug

SEQ ID NO: 2690973 - RNA, 20 nt, Human
gggcagcugccuccccuccu

SEQ ID NO: 2690974 - RNA, 19 nt, Human
gggcagcugccuccccucc

SEQ ID NO: 2690975 - RNA, 14 nt, Human
gggcagcugccucc

SEQ ID NO: 2690976 - RNA, 13 nt, Human
gggcagcugccuc

SEQ ID NO: 2690977 - RNA, 12 nt, Human
gggcagcugccu

SEQ ID NO: 2690978 - RNA, 11 nt, Human
gggaggcagag

SEQ ID NO: 2690979 - RNA, 20 nt, Human
gggaggcagagguugcagug

SEQ ID NO: 2690980 - RNA, 22 nt, Human
aaaagcuccauuuuuagugaaa

SEQ ID NO: 2690981 - RNA, 21 nt, Human
aaaacuuuaugcuaagugaaa

SEQ ID NO: 2690982 - RNA, 20 nt, Human
aaagaggcagcuugaaacug

SEQ ID NO: 2690983 - RNA, 18 nt, Human
aaagagaacuuccagauc

SEQ ID NO: 2690984 - RNA, 22 nt, Human
aaagacuauucaaacagucuca

SEQ ID NO: 2690985 - RNA, 13 nt, Human
aaagacuccaaag

SEQ ID NO: 2690986 - RNA, 23 nt, Human
aaagacuauucaaacagucucag

SEQ ID NO: 2690987 - RNA, 16 nt, Human
aaagaaugauuaugaa

SEQ ID NO: 2690988 - RNA, 13 nt, Human
aaaggaauuuaaa

SEQ ID NO: 2690989 - RNA, 15 nt, Human
ggugccaguuauggc

SEQ ID NO: 2690990 - RNA, 20 nt, Human
ggugauuuagcaggaagcug

SEQ ID NO: 2690991 - RNA, 14 nt, Human
ggucugugagaugc

SEQ ID NO: 2690992 - RNA, 24 nt, Human
ggucugugagaugcuagaacuccc

SEQ ID NO: 2690993 - RNA, 16 nt, Human
aaaccacagcaguuga

SEQ ID NO: 2690994 - RNA, 15 nt, Human
aaaccacagcaguug

SEQ ID NO: 2690995 - RNA, 16 nt, Human
aaacucauuucuagca

SEQ ID NO: 2690996 - RNA, 19 nt, Human
aaaauuuuuucucuaggaa

SEQ ID NO: 2690997 - RNA, 17 nt, Human
aaacaaggaugaauuaa

SEQ ID NO: 2690998 - RNA, 14 nt, Human
aaacacaacuauau

SEQ ID NO: 2690999 - RNA, 13 nt, Human
aaacauauauaac

SEQ ID NO: 2691000 - RNA, 19 nt, Human
aaacauauauaacaaugcu

SEQ ID NO: 2691001 - RNA, 16 nt, Human
aaacauauauaacaau

SEQ ID NO: 2691002 - RNA, 21 nt, Human
aaacauauauaacaaugcugu

SEQ ID NO: 2691003 - RNA, 15 nt, Human
ggaggcugagauggg

SEQ ID NO: 2691004 - RNA, 19 nt, Human
ggaggcugagaugggagaa

SEQ ID NO: 2691005 - RNA, 12 nt, Human
ggauuuucagcc

SEQ ID NO: 2691006 - RNA, 23 nt, Human
ggaugguucccuugaugaagaag

SEQ ID NO: 2691007 - RNA, 22 nt, Human
ggaugguucccuugaugaagaa

SEQ ID NO: 2691008 - RNA, 16 nt, Human
ggccuccauccugagg

SEQ ID NO: 2691009 - RNA, 16 nt, Human
gacacacugaagaagc

SEQ ID NO: 2691010 - RNA, 15 nt, Human
gacacacugaagaag

SEQ ID NO: 2691011 - RNA, 21 nt, Human
gacagaaagcagaacagugau

SEQ ID NO: 2691012 - RNA, 17 nt, Human
gacauuugcucauggaa

SEQ ID NO: 2691013 - RNA, 16 nt, Human
gacauuugcucaugga

SEQ ID NO: 2691014 - RNA, 21 nt, Human
gacagugagacucugucucag

SEQ ID NO: 2691015 - RNA, 16 nt, Human
gacgcucucuggccuu

SEQ ID NO: 2691016 - RNA, 17 nt, Human
gacgcucucuggccuuc

SEQ ID NO: 2691017 - RNA, 15 nt, Human
gacgcucucuggccu

SEQ ID NO: 2691018 - RNA, 21 nt, Human
gacucuuaagaagacugcauu

SEQ ID NO: 2691019 - RNA, 14 nt, Human
gacucuuaagaaga

SEQ ID NO: 2691020 - RNA, 23 nt, Human
gaagcaacccaaauguucaucaa

SEQ ID NO: 2691021 - RNA, 14 nt, Human
gaagcaaaauuuuu

SEQ ID NO: 2691022 - RNA, 13 nt, Human
gaacugaaaucau

SEQ ID NO: 2691023 - RNA, 14 nt, Human
gaacugaaaucaua

SEQ ID NO: 2691024 - RNA, 19 nt, Human
gaacccgggaggcagaggu

SEQ ID NO: 2691025 - RNA, 20 nt, Human
gcaaguauuagaauaccaca

SEQ ID NO: 2691026 - RNA, 22 nt, Human
gcaauagucaaauugugugaaa

SEQ ID NO: 2691027 - RNA, 23 nt, Human
gcacaguuuucugagaaagacua

SEQ ID NO: 2691028 - RNA, 20 nt, Human
gcacaguuuucugagaaaga

SEQ ID NO: 2691029 - RNA, 22 nt, Human
gcacaguuuucugagaaagacu

SEQ ID NO: 2691030 - RNA, 16 nt, Human
gauuuaccacuugugu

SEQ ID NO: 2691031 - RNA, 15 nt, Human
gauuuaccacuugug

SEQ ID NO: 2691032 - RNA, 22 nt, Human
gaugguucccuugaugaagaag

SEQ ID NO: 2691033 - RNA, 17 nt, Human
gauguagaggagaaacu

SEQ ID NO: 2691034 - RNA, 18 nt, Human
gauguagaggagaaacug

SEQ ID NO: 2691035 - RNA, 16 nt, Human
gaugaucuuuaaaaua

SEQ ID NO: 2691036 - RNA, 15 nt, Human
gaggacgcucucugg

SEQ ID NO: 2691037 - RNA, 23 nt, Human
gaggcuccacuuggucugugaga

SEQ ID NO: 2691038 - RNA, 19 nt, Human
gaggcuccacuuggucugu

SEQ ID NO: 2691039 - RNA, 18 nt, Human
gaggcuccacuuggucug

SEQ ID NO: 2691040 - RNA, 16 nt, Human
gaguuuaaauuguaau

SEQ ID NO: 2691041 - RNA, 16 nt, Human
cugcacuccagccuga

SEQ ID NO: 2691042 - RNA, 17 nt, Human
cugcacuccagccugag

SEQ ID NO: 2691043 - RNA, 20 nt, Human
cugcacuccagccugagcga

SEQ ID NO: 2691044 - RNA, 20 nt, Human
cugcuuauccguuagccgug

SEQ ID NO: 2691045 - RNA, 21 nt, Human
cuggugccucaccccuugcca

SEQ ID NO: 2691046 - RNA, 12 nt, Human
cuggugccucac

SEQ ID NO: 2691047 - RNA, 15 nt, Human
cugggcagcugccuc

SEQ ID NO: 2691048 - RNA, 14 nt, Human
cugggcagcugccu

SEQ ID NO: 2691049 - RNA, 13 nt, Human
cugggcagcugcc

SEQ ID NO: 2691050 - RNA, 11 nt, Human
cuucagacaua

SEQ ID NO: 2691051 - RNA, 23 nt, Human
cuucaugcugucuacacuaagag

SEQ ID NO: 2691052 - RNA, 20 nt, Human
cuucuguuuuauaauuuugu

SEQ ID NO: 2691053 - RNA, 15 nt, Human
cuucuguuuuauaau

SEQ ID NO: 2691054 - RNA, 20 nt, Human
cuuuaaagggauggcaagau

SEQ ID NO: 2691055 - RNA, 21 nt, Human
cuuugagugucuuaauuaaaa

SEQ ID NO: 2691056 - RNA, 15 nt, Human
ccaggggccaugaau

SEQ ID NO: 2691057 - RNA, 20 nt, Human
ccacuuggucugugagaugc

SEQ ID NO: 2691058 - RNA, 22 nt, Human
ccacuuggucugugagaugcua

SEQ ID NO: 2691059 - RNA, 15 nt, Human
ccacuuggucuguga

SEQ ID NO: 2691060 - RNA, 16 nt, Human
ccacuuggucugugag

SEQ ID NO: 2691061 - RNA, 17 nt, Human
ccacuuggucugugaga

SEQ ID NO: 2691062 - RNA, 19 nt, Human
ccacuuggucugugagaug

SEQ ID NO: 2691063 - RNA, 12 nt, Human
ccacuuggucug

SEQ ID NO: 2691064 - RNA, 13 nt, Human
ccauuuaaagcuu

SEQ ID NO: 2691065 - RNA, 22 nt, Human
ccauuguggucacaggaaguag

SEQ ID NO: 2691066 - RNA, 18 nt, Human
ccaugggcacugugggua

SEQ ID NO: 2691067 - RNA, 15 nt, Human
ccccauuguggucac

SEQ ID NO: 2691068 - RNA, 22 nt, Human
ccucuccugggcagcugccucc

SEQ ID NO: 2691069 - RNA, 21 nt, Human
ccucuccugggcagcugccuc

SEQ ID NO: 2691070 - RNA, 16 nt, Human
ccucuccugggcagcu

SEQ ID NO: 2691071 - RNA, 15 nt, Human
ccucuccugggcagc

SEQ ID NO: 2691072 - RNA, 20 nt, Human
ccucuccugggcagcugccu

SEQ ID NO: 2691073 - RNA, 19 nt, Human
ccucuccugggcagcugcc

SEQ ID NO: 2691074 - RNA, 18 nt, Human
ccucuccugggcagcugc

SEQ ID NO: 2691075 - RNA, 17 nt, Human
ccucuccugggcagcug

SEQ ID NO: 2691076 - RNA, 13 nt, Human
cccucggagaaga

SEQ ID NO: 2691077 - RNA, 14 nt, Human
cccugagcaggauu

SEQ ID NO: 2691078 - RNA, 20 nt, Human
ccuaacgaaguauccuucag

SEQ ID NO: 2691079 - RNA, 19 nt, Human
cucuauguucuaagaagug

SEQ ID NO: 2691080 - RNA, 15 nt, Human
cucuccccaugaugu

SEQ ID NO: 2691081 - RNA, 16 nt, Human
cucuccccaugauguu

SEQ ID NO: 2691082 - RNA, 14 nt, Human
cucucuggccuucg

SEQ ID NO: 2691083 - RNA, 16 nt, Human
cucucuggccuucggc

SEQ ID NO: 2691084 - RNA, 13 nt, Human
cucucuggccuuc

SEQ ID NO: 2691085 - RNA, 21 nt, Human
cucucuguaauaaacucauuu

SEQ ID NO: 2691086 - RNA, 16 nt, Human
cucucuguaauaaacu

SEQ ID NO: 2691087 - RNA, 22 nt, Human
cucccuccaccucccugcaaua

SEQ ID NO: 2691088 - RNA, 21 nt, Human
cucccuccaccucccugcaau

SEQ ID NO: 2691089 - RNA, 20 nt, Human
cucccuccaccucccugcaa

SEQ ID NO: 2691090 - RNA, 19 nt, Human
cucccuccaccucccugca

SEQ ID NO: 2691091 - RNA, 16 nt, Human
cucaguccaugaagau

SEQ ID NO: 2691092 - RNA, 18 nt, Human
cuaucucauuuccaagca

SEQ ID NO: 2691093 - RNA, 18 nt, Human
cuauguucuaagaaguga

SEQ ID NO: 2691094 - RNA, 17 nt, Human
ccuucucuucacaguca

SEQ ID NO: 2691095 - RNA, 20 nt, Human
cuaacgaaguauccuucagc

SEQ ID NO: 2691096 - RNA, 20 nt, Human
cuacaaaaacacagcaaggg

SEQ ID NO: 2691097 - RNA, 12 nt, Human
ccuuuucccaac

SEQ ID NO: 2691098 - RNA, 22 nt, Human
auugaggacacugauauggguc

SEQ ID NO: 2691099 - RNA, 16 nt, Human
auuucagcagcugcag

SEQ ID NO: 2691100 - RNA, 16 nt, Human
auuuuuauauuugaaa

SEQ ID NO: 2691101 - RNA, 19 nt, Human
auuuuuauauuugaaauau

SEQ ID NO: 2691102 - RNA, 21 nt, Human
caaaagguauuuuaaucacca

SEQ ID NO: 2691103 - RNA, 19 nt, Human
auuuucuauaauuuaaaua

SEQ ID NO: 2691104 - RNA, 17 nt, Human
auuuucuauaauuuaaa

SEQ ID NO: 2691105 - RNA, 18 nt, Human
auuuucuauaauuuaaau

SEQ ID NO: 2691106 - RNA, 13 nt, Human
cacaucagcuugc

SEQ ID NO: 2691107 - RNA, 23 nt, Human
cacaucagcuugcccuguuaaaa

SEQ ID NO: 2691108 - RNA, 23 nt, Human
cacugaagaagcaccaaucauga

SEQ ID NO: 2691109 - RNA, 11 nt, Human
cacugaagaag

SEQ ID NO: 2691110 - RNA, 16 nt, Human
cacuccagugagacag

SEQ ID NO: 2691111 - RNA, 21 nt, Human
cacuccagugagacagcucug

SEQ ID NO: 2691112 - RNA, 14 nt, Human
caagcaaguauuag

SEQ ID NO: 2691113 - RNA, 12 nt, Human
caacuccagaaa

SEQ ID NO: 2691114 - RNA, 19 nt, Human
caacuaucucauuuccaag

SEQ ID NO: 2691115 - RNA, 19 nt, Human
caacuauauuguuugcuaa

SEQ ID NO: 2691116 - RNA, 17 nt, Human
caaucagccuaguugau

SEQ ID NO: 2691117 - RNA, 20 nt, Human
cagcugccuccccuccucug

SEQ ID NO: 2691118 - RNA, 19 nt, Human
cagcugccuccccuccucu

SEQ ID NO: 2691119 - RNA, 18 nt, Human
cagcugccuccccuccuc

SEQ ID NO: 2691120 - RNA, 17 nt, Human
cagcugccuccccuccu

SEQ ID NO: 2691121 - RNA, 16 nt, Human
cagcugccuccccucc

SEQ ID NO: 2691122 - RNA, 15 nt, Human
cagcugccuccccuc

SEQ ID NO: 2691123 - RNA, 14 nt, Human
cagcugccuccccu

SEQ ID NO: 2691124 - RNA, 9 nt, Human
cagcugccu

SEQ ID NO: 2691125 - RNA, 10 nt, Human
cagcugccuc

SEQ ID NO: 2691126 - RNA, 11 nt, Human
cagcugccucc

SEQ ID NO: 2691127 - RNA, 20 nt, Human
cagcuuauugucuagugaaa

SEQ ID NO: 2691128 - RNA, 20 nt, Human
cagcuguaugauucccagcc

SEQ ID NO: 2691129 - RNA, 14 nt, Human
cagcuuauugucua

SEQ ID NO: 2691130 - RNA, 20 nt, Human
caggaaagagaacuuccaga

SEQ ID NO: 2691131 - RNA, 16 nt, Human
caggaaagagaacuuc

SEQ ID NO: 2691132 - RNA, 11 nt, Human
caggcuacugu

SEQ ID NO: 2691133 - RNA, 23 nt, Human
cagagcugcccucuccugggcag

SEQ ID NO: 2691134 - RNA, 21 nt, Human
cagagcugcccucuccugggc

SEQ ID NO: 2691135 - RNA, 20 nt, Human
cagagcugcccucuccuggg

SEQ ID NO: 2691136 - RNA, 19 nt, Human
cagagcugcccucuccugg

SEQ ID NO: 2691137 - RNA, 18 nt, Human
cagagcugcccucuccug

SEQ ID NO: 2691138 - RNA, 14 nt, Human
cagccagacuggca

SEQ ID NO: 2691139 - RNA, 15 nt, Human
cagccagacuggcac

SEQ ID NO: 2691140 - RNA, 18 nt, Human
cagccagacuggcacagu

SEQ ID NO: 2691141 - RNA, 23 nt, Human
cagccagcaguucagagcugccc

SEQ ID NO: 2691142 - RNA, 20 nt, Human
cagccagacuggcacaguuu

SEQ ID NO: 2691143 - RNA, 19 nt, Human
cagacuggauaguccgucu

SEQ ID NO: 2691144 - RNA, 22 nt, Human
cagacuggcacaguuuucugag

SEQ ID NO: 2691145 - RNA, 23 nt, Human
cagacuggcacaguuuucugaga

SEQ ID NO: 2691146 - RNA, 17 nt, Human
cagacuggcacaguuuu

SEQ ID NO: 2691147 - RNA, 18 nt, Human
cagacuggcacaguuuuc

SEQ ID NO: 2691148 - RNA, 22 nt, Human
caguucagagcugcccucuccu

SEQ ID NO: 2691149 - RNA, 21 nt, Human
caguucagagcugcccucucc

SEQ ID NO: 2691150 - RNA, 19 nt, Human
caguucagagcugcccucu

SEQ ID NO: 2691151 - RNA, 18 nt, Human
caguucagagcugcccuc

SEQ ID NO: 2691152 - RNA, 24 nt, Human
caguucagagcugcccucuccugg

SEQ ID NO: 2691153 - RNA, 23 nt, Human
caguucagagcugcccucuccug

SEQ ID NO: 2691154 - RNA, 22 nt, Human
caguuauuauauuuacaaaugg

SEQ ID NO: 2691155 - RNA, 17 nt, Human
caguucagagcugcccu

SEQ ID NO: 2691156 - RNA, 16 nt, Human
caguucagagcugccc

SEQ ID NO: 2691157 - RNA, 15 nt, Human
caguucagagcugcc

SEQ ID NO: 2691158 - RNA, 22 nt, Human
cagugauuaccagggacugagg

SEQ ID NO: 2691159 - RNA, 13 nt, Human
caguuauggcuau

SEQ ID NO: 2691160 - RNA, 19 nt, Human
caguuauggcuauaggugc

SEQ ID NO: 2691161 - RNA, 20 nt, Human
caguuauggcuauaggugcu

SEQ ID NO: 2691162 - RNA, 17 nt, Human
caguuauuauauuuaca

SEQ ID NO: 2691163 - RNA, 21 nt, Human
caguuauuauauuuacaaaug

SEQ ID NO: 2691164 - RNA, 16 nt, Human
cauagguuuaauaauu

SEQ ID NO: 2691165 - RNA, 19 nt, Human
cauagcagcuuauucacaa

SEQ ID NO: 2691166 - RNA, 18 nt, Human
cauccugaggcuccacuu

SEQ ID NO: 2691167 - RNA, 19 nt, Human
cauccugaggcuccacuug

SEQ ID NO: 2691168 - RNA, 13 nt, Human
caucagcugcuga

SEQ ID NO: 2691169 - RNA, 19 nt, Human
cauuauauuuauuacugua

SEQ ID NO: 2691170 - RNA, 21 nt, Human
ccaacuccagaaagugacaag

SEQ ID NO: 2691171 - RNA, 14 nt, Human
ccaaaaggcagaag

SEQ ID NO: 2691172 - RNA, 16 nt, Human
cauuuguauaaaauaa

SEQ ID NO: 2691173 - RNA, 14 nt, Human
cauuuguauaaaau

SEQ ID NO: 2691174 - RNA, 22 nt, Human
auuuaccacuuguguuuugcaa

SEQ ID NO: 2691175 - RNA, 15 nt, Human
auuuaccacuugugu

SEQ ID NO: 2691176 - RNA, 16 nt, Human
auuguaguccuguaau

SEQ ID NO: 2691177 - RNA, 17 nt, Human
auuuaaaaaaaaaccug

SEQ ID NO: 2691178 - RNA, 20 nt, Human
auuuauuacuguaagaaaau

SEQ ID NO: 2691179 - RNA, 19 nt, Human
auuuauuacuguaagaaaa

SEQ ID NO: 2691180 - RNA, 21 nt, Human
auuuauuuuaauaauguuuca

SEQ ID NO: 2691181 - RNA, 20 nt, Human
auuucuugagguaaaagcau

SEQ ID NO: 2691182 - RNA, 17 nt, Human
auuggagcucgugggac

SEQ ID NO: 2691183 - RNA, 16 nt, Human
auuggagcucguggaa

SEQ ID NO: 2691184 - RNA, 17 nt, Human
auugaaggaugcugucu

SEQ ID NO: 2691185 - RNA, 24 nt, Human
auuccuagaaacugacacaugcug

SEQ ID NO: 2691186 - RNA, 16 nt, Human
uuuucuauaauuuaaa

SEQ ID NO: 2691187 - RNA, 20 nt, Human
uuuucaggcuagauguaugu

SEQ ID NO: 2691188 - RNA, 22 nt, Human
uuuuauggcacuaguauuucua

SEQ ID NO: 2691189 - RNA, 20 nt, Human
augugcuaguaauuggaaag

SEQ ID NO: 2691190 - RNA, 21 nt, Human
augugcuaguaauuggaaagg

SEQ ID NO: 2691191 - RNA, 19 nt, Human
auguauauuuuauaucaau

SEQ ID NO: 2691192 - RNA, 23 nt, Human
augucgucaaagcugaaauggac

SEQ ID NO: 2691193 - RNA, 17 nt, Human
uuuguaguguuggagaa

SEQ ID NO: 2691194 - RNA, 19 nt, Human
uuugcuaagcauuccaacu

SEQ ID NO: 2691195 - RNA, 20 nt, Human
uuugcuggagcucugcccau

SEQ ID NO: 2691196 - RNA, 22 nt, Human
auucaaacagucucaggaaauc

SEQ ID NO: 2691197 - RNA, 20 nt, Human
auuauauggcuugaguuuaa

SEQ ID NO: 2691198 - RNA, 17 nt, Human
auuccaagugauugaaa

SEQ ID NO: 2691199 - RNA, 17 nt, Human
uuuuuauauuugaaaua

SEQ ID NO: 2691200 - RNA, 15 nt, Human
uuuuugaagcuguau

SEQ ID NO: 2691201 - RNA, 15 nt, Human
uuuuguuuucauuau

SEQ ID NO: 2691202 - RNA, 14 nt, Human
uuuugugaagcaaa

SEQ ID NO: 2691203 - RNA, 16 nt, Human
auuacuguaagaaaau

SEQ ID NO: 2691204 - RNA, 15 nt, Human
auuacuguaagaaaa

SEQ ID NO: 2691205 - RNA, 20 nt, Human
uugucaauaaaauccauaca

SEQ ID NO: 2691206 - RNA, 17 nt, Human
augagguacugagagug

SEQ ID NO: 2691207 - RNA, 18 nt, Human
augagguacugagaguga

SEQ ID NO: 2691208 - RNA, 15 nt, Human
augagguacugagag

SEQ ID NO: 2691209 - RNA, 13 nt, Human
augauuucauuca

SEQ ID NO: 2691210 - RNA, 18 nt, Human
uuuaaaaaaauuccaagu

SEQ ID NO: 2691211 - RNA, 12 nt, Human
augcaaagcacu

SEQ ID NO: 2691212 - RNA, 13 nt, Human
augcaaagcacug

SEQ ID NO: 2691213 - RNA, 14 nt, Human
augcaaagcacuga

SEQ ID NO: 2691214 - RNA, 21 nt, Human
uuuaaauauaugcuaagucuu

SEQ ID NO: 2691215 - RNA, 19 nt, Human
uuucaaacauauauaacaa

SEQ ID NO: 2691216 - RNA, 21 nt, Human
augcuucuguuuuauaauuuu

SEQ ID NO: 2691217 - RNA, 22 nt, Human
augcuguauuuuaaaagaauga

SEQ ID NO: 2691218 - RNA, 19 nt, Human
augcuguauuuuaaaagaa

SEQ ID NO: 2691219 - RNA, 23 nt, Human
augcuguauuuuaaaagaaugau

SEQ ID NO: 2691220 - RNA, 18 nt, Human
augcuacaggauuugaaa

SEQ ID NO: 2691221 - RNA, 22 nt, Human
augccuuuucccaacuccagaa

SEQ ID NO: 2691222 - RNA, 20 nt, Human
augccuuuucccaacuccag

SEQ ID NO: 2691223 - RNA, 14 nt, Human
augccuuuucccaa

SEQ ID NO: 2691224 - RNA, 19 nt, Human
uuuauaugcuucuguuuua

SEQ ID NO: 2691225 - RNA, 21 nt, Human
uuuauaugcuucuguuuuaua

SEQ ID NO: 2691226 - RNA, 12 nt, Human
uugacuuuuuau

SEQ ID NO: 2691227 - RNA, 13 nt, Human
uugacaugggaca

SEQ ID NO: 2691228 - RNA, 19 nt, Human
aucucaaaacugcacuguc

SEQ ID NO: 2691229 - RNA, 20 nt, Human
aucucaaaacugcacuguca

SEQ ID NO: 2691230 - RNA, 15 nt, Human
aucucaaaacugcac

SEQ ID NO: 2691231 - RNA, 15 nt, Human
uuggagaagaacuga

SEQ ID NO: 2691232 - RNA, 22 nt, Human
uuggagaagaacugaaaucaua

SEQ ID NO: 2691233 - RNA, 17 nt, Human
uuggagaagaacugaaa

SEQ ID NO: 2691234 - RNA, 12 nt, Human
aucuuuaaaaua

SEQ ID NO: 2691235 - RNA, 15 nt, Human
aucuuuaaaauacac

SEQ ID NO: 2691236 - RNA, 16 nt, Human
aucuuauaauuuaaaa

SEQ ID NO: 2691237 - RNA, 15 nt, Human
aucuuauaauuuaaa

SEQ ID NO: 2691238 - RNA, 18 nt, Human
augaacuuguaaaggaau

SEQ ID NO: 2691239 - RNA, 23 nt, Human
auaugcaaagcacugacuucuaa

SEQ ID NO: 2691240 - RNA, 16 nt, Human
auaugcaaagcacuga

SEQ ID NO: 2691241 - RNA, 15 nt, Human
auaugcaaagcacug

SEQ ID NO: 2691242 - RNA, 15 nt, Human
uucagcccucagaau

SEQ ID NO: 2691243 - RNA, 15 nt, Human
auauaacaaugcugu

SEQ ID NO: 2691244 - RNA, 12 nt, Human
auauaacaaugc

SEQ ID NO: 2691245 - RNA, 19 nt, Human
auauaagcuuguauuccuu

SEQ ID NO: 2691246 - RNA, 18 nt, Human
auauauaacaaugcugua

SEQ ID NO: 2691247 - RNA, 17 nt, Human
auauauaacaaugcugu

SEQ ID NO: 2691248 - RNA, 19 nt, Human
auauauaacaaugcuguau

SEQ ID NO: 2691249 - RNA, 18 nt, Human
auagucaaauugugugaa

SEQ ID NO: 2691250 - RNA, 17 nt, Human
auagucaaauuguguga

SEQ ID NO: 2691251 - RNA, 15 nt, Human
uucaaacauauauaa

SEQ ID NO: 2691252 - RNA, 21 nt, Human
auaggaauugacccacaagaa

SEQ ID NO: 2691253 - RNA, 14 nt, Human
auagcuacuaauuu

SEQ ID NO: 2691254 - RNA, 17 nt, Human
auagcuacuaauuuuaa

SEQ ID NO: 2691255 - RNA, 18 nt, Human
auagcuacuaauuuuaaa

SEQ ID NO: 2691256 - RNA, 17 nt, Human
uuauuguuuaaaaucau

SEQ ID NO: 2691257 - RNA, 18 nt, Human
uucucaacuccaaacuga

SEQ ID NO: 2691258 - RNA, 14 nt, Human
uucucaacuccaaa

SEQ ID NO: 2691259 - RNA, 23 nt, Human
aucccucccuccaccucccugca

SEQ ID NO: 2691260 - RNA, 14 nt, Human
aucccucccuccac

SEQ ID NO: 2691261 - RNA, 13 nt, Human
aucccucccucca

SEQ ID NO: 2691262 - RNA, 11 nt, Human
aucccucccuc

SEQ ID NO: 2691263 - RNA, 16 nt, Human
uucugcaucagcugcu

SEQ ID NO: 2691264 - RNA, 23 nt, Human
uucugcaucagcugcugaaacaa

SEQ ID NO: 2691265 - RNA, 14 nt, Human
uucugaagaagaug

SEQ ID NO: 2691266 - RNA, 13 nt, Human
uucugaagaagau

SEQ ID NO: 2691267 - RNA, 12 nt, Human
uucugaagaaga

SEQ ID NO: 2691268 - RNA, 19 nt, Human
auauuugaaauauugacuu

SEQ ID NO: 2691269 - RNA, 14 nt, Human
auauuugaaauauu

SEQ ID NO: 2691270 - RNA, 23 nt, Human
auauuugaaauauugacuuuuua

SEQ ID NO: 2691271 - RNA, 12 nt, Human
auauuuuaacuu

SEQ ID NO: 2691272 - RNA, 22 nt, Human
auauuuguaucacaaaucuuaa

SEQ ID NO: 2691273 - RNA, 13 nt, Human
auauuugaaauau

SEQ ID NO: 2691274 - RNA, 14 nt, Human
uguuccuagugaaa

SEQ ID NO: 2691275 - RNA, 18 nt, Human
uguuccuagugaaagagg

SEQ ID NO: 2691276 - RNA, 15 nt, Human
uguuauaaucuuuca

SEQ ID NO: 2691277 - RNA, 13 nt, Human
uguguaaguagau

SEQ ID NO: 2691278 - RNA, 20 nt, Human
uguggucacaggaaguagag

SEQ ID NO: 2691279 - RNA, 15 nt, Human
agugaaagaaaauaa

SEQ ID NO: 2691280 - RNA, 16 nt, Human
agugaacaaauuuaca

SEQ ID NO: 2691281 - RNA, 20 nt, Human
agugaacaaauuuacagaga

SEQ ID NO: 2691282 - RNA, 22 nt, Human
agucucaggaaaucaaauaugc

SEQ ID NO: 2691283 - RNA, 15 nt, Human
ugugagaugcuagaa

SEQ ID NO: 2691284 - RNA, 19 nt, Human
ugugagaugcuagaacucc

SEQ ID NO: 2691285 - RNA, 19 nt, Human
auaaaauccauacauuugu

SEQ ID NO: 2691286 - RNA, 18 nt, Human
auaaaauccauacauuug

SEQ ID NO: 2691287 - RNA, 22 nt, Human
auaaaauaauuuuuauauuuga

SEQ ID NO: 2691288 - RNA, 21 nt, Human
auaaaauaauuuuuauauuug

SEQ ID NO: 2691289 - RNA, 16 nt, Human
auaaaauaauuuuuau

SEQ ID NO: 2691290 - RNA, 18 nt, Human
uuaaguaaugauaacugg

SEQ ID NO: 2691291 - RNA, 22 nt, Human
uuaagaagacugcauuauauuu

SEQ ID NO: 2691292 - RNA, 20 nt, Human
uuaagaagacugcauuauau

SEQ ID NO: 2691293 - RNA, 15 nt, Human
uuacuguaagaaaau

SEQ ID NO: 2691294 - RNA, 12 nt, Human
uuaccugggaaa

SEQ ID NO: 2691295 - RNA, 14 nt, Human
uuaccuuacagaag

SEQ ID NO: 2691296 - RNA, 16 nt, Human
aguuuagcuggaaaag

SEQ ID NO: 2691297 - RNA, 19 nt, Human
uguuuucauuaucucaaaa

SEQ ID NO: 2691298 - RNA, 14 nt, Human
uguuuugcaagcca

SEQ ID NO: 2691299 - RNA, 16 nt, Human
aguucugaagaagaug

SEQ ID NO: 2691300 - RNA, 16 nt, Human
aguucugcagauaaac

SEQ ID NO: 2691301 - RNA, 21 nt, Human
aguucugcagauaaacaguag

SEQ ID NO: 2691302 - RNA, 18 nt, Human
aggggagcaugggaagug

SEQ ID NO: 2691303 - RNA, 16 nt, Human
aggggaauugaggaca

SEQ ID NO: 2691304 - RNA, 21 nt, Human
agggaggacgcucucuggccu

SEQ ID NO: 2691305 - RNA, 22 nt, Human
agggaggacgcucucuggccuu

SEQ ID NO: 2691306 - RNA, 23 nt, Human
agggaggacgcucucuggccuuc

SEQ ID NO: 2691307 - RNA, 13 nt, Human
agggaaauuucag

SEQ ID NO: 2691308 - RNA, 13 nt, Human
aguaaaauccaca

SEQ ID NO: 2691309 - RNA, 20 nt, Human
aguaaugauaacuggaaacu

SEQ ID NO: 2691310 - RNA, 18 nt, Human
aguaaugauaacuggaaa

SEQ ID NO: 2691311 - RNA, 17 nt, Human
aguaaugauaacuggaa

SEQ ID NO: 2691312 - RNA, 16 nt, Human
uguagaggagaaacug

SEQ ID NO: 2691313 - RNA, 16 nt, Human
aguauuucuaugaaau

SEQ ID NO: 2691314 - RNA, 17 nt, Human
aguauuucuaugaaaua

SEQ ID NO: 2691315 - RNA, 18 nt, Human
aguauuucuaugaaauau

SEQ ID NO: 2691316 - RNA, 17 nt, Human
agucaccucauggaauu

SEQ ID NO: 2691317 - RNA, 15 nt, Human
agucaccucauggaa

SEQ ID NO: 2691318 - RNA, 14 nt, Human
agucaccucaugga

SEQ ID NO: 2691319 - RNA, 18 nt, Human
aguauuagaauaccacag

SEQ ID NO: 2691320 - RNA, 13 nt, Human
aguagucagacug

SEQ ID NO: 2691321 - RNA, 13 nt, Human
uguauuacaaauc

SEQ ID NO: 2691322 - RNA, 22 nt, Human
uguauuacaaauccaaugaaau

SEQ ID NO: 2691323 - RNA, 15 nt, Human
uguaucacaaaucuu

SEQ ID NO: 2691324 - RNA, 18 nt, Human
uguaucacaaaucuuaac

SEQ ID NO: 2691325 - RNA, 15 nt, Human
uguaguguuggagaa

SEQ ID NO: 2691326 - RNA, 14 nt, Human
uguaguguuggaga

SEQ ID NO: 2691327 - RNA, 16 nt, Human
uguaaaggaauuuaaa

SEQ ID NO: 2691328 - RNA, 14 nt, Human
agcuguucacagcc

SEQ ID NO: 2691329 - RNA, 16 nt, Human
agcugcccucuccugg

SEQ ID NO: 2691330 - RNA, 15 nt, Human
agcugcccucuccug

SEQ ID NO: 2691331 - RNA, 14 nt, Human
agcugcccucuccu

SEQ ID NO: 2691332 - RNA, 13 nt, Human
agcugcccucucc

SEQ ID NO: 2691333 - RNA, 20 nt, Human
ugcccuguuaaaagaugaaa

SEQ ID NO: 2691334 - RNA, 20 nt, Human
agcuugcccuggugccucac

SEQ ID NO: 2691335 - RNA, 16 nt, Human
agcuugcccuguuaaa

SEQ ID NO: 2691336 - RNA, 18 nt, Human
agcuugcccuguuaaaag

SEQ ID NO: 2691337 - RNA, 19 nt, Human
agcuugcccuguuaaaaga

SEQ ID NO: 2691338 - RNA, 14 nt, Human
ugcuacaaaaacac

SEQ ID NO: 2691339 - RNA, 15 nt, Human
ugcuacaaaaacaca

SEQ ID NO: 2691340 - RNA, 19 nt, Human
ugccuuuucccaacuccag

SEQ ID NO: 2691341 - RNA, 17 nt, Human
ugccuuuucccaacucc

SEQ ID NO: 2691342 - RNA, 20 nt, Human
aggaaaucaaauaugcaaag

SEQ ID NO: 2691343 - RNA, 21 nt, Human
aggaaaucaaauaugcaaagc

SEQ ID NO: 2691344 - RNA, 22 nt, Human
aggaaaucaaauaugcaaagca

SEQ ID NO: 2691345 - RNA, 15 nt, Human
aggcccccaggugcc

SEQ ID NO: 2691346 - RNA, 14 nt, Human
uggaguugaaaauc

SEQ ID NO: 2691347 - RNA, 15 nt, Human
aggcagcuugaaacu

SEQ ID NO: 2691348 - RNA, 20 nt, Human
aggcauuuaggccaugggac

SEQ ID NO: 2691349 - RNA, 21 nt, Human
uggagcucguggaacaguuac

SEQ ID NO: 2691350 - RNA, 17 nt, Human
uggagcucguggaacag

SEQ ID NO: 2691351 - RNA, 21 nt, Human
uggagcucgugggacagucac

SEQ ID NO: 2691352 - RNA, 17 nt, Human
ugcuuuuaaaaaaaaau

SEQ ID NO: 2691353 - RNA, 18 nt, Human
aggagaaacuggaacucu

SEQ ID NO: 2691354 - RNA, 19 nt, Human
aggagaaacuggaacucuc

SEQ ID NO: 2691355 - RNA, 17 nt, Human
aggagaaacuggaacuc

SEQ ID NO: 2691356 - RNA, 13 nt, Human
aggacgcucucug

SEQ ID NO: 2691357 - RNA, 14 nt, Human
aggacgcucucugg

SEQ ID NO: 2691358 - RNA, 16 nt, Human
aggacgcucucuggcc

SEQ ID NO: 2691359 - RNA, 17 nt, Human
aggacgcucucuggccu

SEQ ID NO: 2691360 - RNA, 19 nt, Human
aggacgcucucuggccuuc

SEQ ID NO: 2691361 - RNA, 20 nt, Human
aggacgcucucuggccuucg

SEQ ID NO: 2691362 - RNA, 15 nt, Human
ugcacuccagccuga

SEQ ID NO: 2691363 - RNA, 17 nt, Human
ugcacuccagccugagc

SEQ ID NO: 2691364 - RNA, 22 nt, Human
ugcagaagacaguauggcagcu

SEQ ID NO: 2691365 - RNA, 18 nt, Human
agccccgugggguuccuc

SEQ ID NO: 2691366 - RNA, 13 nt, Human
ugauuucauucaa

SEQ ID NO: 2691367 - RNA, 20 nt, Human
ugcaaagcacugacuucuaa

SEQ ID NO: 2691368 - RNA, 22 nt, Human
ugcaaagcacugacuucuaagu

SEQ ID NO: 2691369 - RNA, 18 nt, Human
ugcaaagcacugacuucu

SEQ ID NO: 2691370 - RNA, 21 nt, Human
ugcaagccagauuuuccugaa

SEQ ID NO: 2691371 - RNA, 15 nt, Human
ugcaagccagauuuu

SEQ ID NO: 2691372 - RNA, 21 nt, Human
ugcaauaaaauggguuuuacu

SEQ ID NO: 2691373 - RNA, 17 nt, Human
ugcaauaaaauggguuu

SEQ ID NO: 2691374 - RNA, 20 nt, Human
ugcauagauucccugagcag

SEQ ID NO: 2691375 - RNA, 13 nt, Human
ugcauacucauua

SEQ ID NO: 2691376 - RNA, 19 nt, Human
ugcauacucauuaggaugg

SEQ ID NO: 2691377 - RNA, 17 nt, Human
ugccaguuauggcuaua

SEQ ID NO: 2691378 - RNA, 13 nt, Human
ugccauaauuacu

SEQ ID NO: 2691379 - RNA, 18 nt, Human
agcagucaggaaagagaa

SEQ ID NO: 2691380 - RNA, 17 nt, Human
agcagucaggaaagaga

SEQ ID NO: 2691381 - RNA, 23 nt, Human
agcaguuugguuucuagcaugaa

SEQ ID NO: 2691382 - RNA, 22 nt, Human
agcaguuugguuucuagcauga

SEQ ID NO: 2691383 - RNA, 20 nt, Human
agcaguuugguuucuagcau

SEQ ID NO: 2691384 - RNA, 19 nt, Human
agcagucaggaaagagaac

SEQ ID NO: 2691385 - RNA, 13 nt, Human
agcauaccaacac

SEQ ID NO: 2691386 - RNA, 19 nt, Human
agcauaccaacacgagcag

SEQ ID NO: 2691387 - RNA, 22 nt, Human
agcauaccaacacgagcaggcu

SEQ ID NO: 2691388 - RNA, 19 nt, Human
agcagggcauggcugggaa

SEQ ID NO: 2691389 - RNA, 20 nt, Human
agcaggaagcugugagagca

SEQ ID NO: 2691390 - RNA, 16 nt, Human
agcaggcuacugucag

SEQ ID NO: 2691391 - RNA, 17 nt, Human
agcaggcuacugucagc

SEQ ID NO: 2691392 - RNA, 19 nt, Human
agcaggcuacugucagcuc

SEQ ID NO: 2691393 - RNA, 20 nt, Human
agcaggcuacugucagcucc

SEQ ID NO: 2691394 - RNA, 14 nt, Human
agcaggcuacuguc

SEQ ID NO: 2691395 - RNA, 15 nt, Human
ugauuaaguaaugau

SEQ ID NO: 2691396 - RNA, 16 nt, Human
ugauuaaguaaugaua

SEQ ID NO: 2691397 - RNA, 22 nt, Human
agcauuuagauguauagguuga

SEQ ID NO: 2691398 - RNA, 20 nt, Human
agcaucacaugaacuuguaa

SEQ ID NO: 2691399 - RNA, 17 nt, Human
ugaaauaagccagacau

SEQ ID NO: 2691400 - RNA, 18 nt, Human
ugaaauaagccagacauc

SEQ ID NO: 2691401 - RNA, 20 nt, Human
ugaaauaagccagacaucaa

SEQ ID NO: 2691402 - RNA, 23 nt, Human
ugaaauaagccagacaucaacag

SEQ ID NO: 2691403 - RNA, 14 nt, Human
agagcugcccucuc

SEQ ID NO: 2691404 - RNA, 13 nt, Human
agagcugcccucu

SEQ ID NO: 2691405 - RNA, 15 nt, Human
agagcugcccucucc

SEQ ID NO: 2691406 - RNA, 15 nt, Human
ugaaauuguauuaca

SEQ ID NO: 2691407 - RNA, 18 nt, Human
ugaaauauuauguuaaaa

SEQ ID NO: 2691408 - RNA, 19 nt, Human
ugaacaaauuuacagagac

SEQ ID NO: 2691409 - RNA, 20 nt, Human
ugaacaaauuuacagagaca

SEQ ID NO: 2691410 - RNA, 18 nt, Human
ugaacaaauuuacagaga

SEQ ID NO: 2691411 - RNA, 23 nt, Human
ugaacuagaguuuagcuggaaaa

SEQ ID NO: 2691412 - RNA, 22 nt, Human
agagcugcccucuccugggcag

SEQ ID NO: 2691413 - RNA, 21 nt, Human
agagcuguucacagccagacu

SEQ ID NO: 2691414 - RNA, 15 nt, Human
agagguugcagugag

SEQ ID NO: 2691415 - RNA, 17 nt, Human
ugacccacaagaaauga

SEQ ID NO: 2691416 - RNA, 17 nt, Human
agaugcaguucugaaga

SEQ ID NO: 2691417 - RNA, 19 nt, Human
agaugcaguucugaagaag

SEQ ID NO: 2691418 - RNA, 18 nt, Human
agaugcaguucugaagaa

SEQ ID NO: 2691419 - RNA, 14 nt, Human
agaugcuagaacuc

SEQ ID NO: 2691420 - RNA, 15 nt, Human
agaugcuagaacucc

SEQ ID NO: 2691421 - RNA, 17 nt, Human
agaguuuagcuggaaaa

SEQ ID NO: 2691422 - RNA, 16 nt, Human
agaguuuagcuggaaa

SEQ ID NO: 2691423 - RNA, 23 nt, Human
agacuauucaaacagucucagga

SEQ ID NO: 2691424 - RNA, 16 nt, Human
ucuuauuucauuucuu

SEQ ID NO: 2691425 - RNA, 15 nt, Human
ucuuauuucauuucu

SEQ ID NO: 2691426 - RNA, 24 nt, Human
agagacagaaagcagaacagugau

SEQ ID NO: 2691427 - RNA, 22 nt, Human
ucuuagaugcaguucugaagaa

SEQ ID NO: 2691428 - RNA, 23 nt, Human
ucuuagaugcaguucugaagaag

SEQ ID NO: 2691429 - RNA, 17 nt, Human
agacacacugaagaagc

SEQ ID NO: 2691430 - RNA, 16 nt, Human
agacacacugaagaag

SEQ ID NO: 2691431 - RNA, 16 nt, Human
acuuguguuuugcaag

SEQ ID NO: 2691432 - RNA, 12 nt, Human
ucucaggaaauc

SEQ ID NO: 2691433 - RNA, 23 nt, Human
acuucuaaguaaaaccacagcag

SEQ ID NO: 2691434 - RNA, 16 nt, Human
acuugucaauaaaauc

SEQ ID NO: 2691435 - RNA, 21 nt, Human
acuugaacccauauuuguaca

SEQ ID NO: 2691436 - RNA, 19 nt, Human
acuugaacccgggaggcag

SEQ ID NO: 2691437 - RNA, 20 nt, Human
acuugaacccgggaggcaga

SEQ ID NO: 2691438 - RNA, 12 nt, Human
ucucuggccuuc

SEQ ID NO: 2691439 - RNA, 23 nt, Human
ucucuggccuucggccuccaucc

SEQ ID NO: 2691440 - RNA, 21 nt, Human
ucucuggccuucggccuccau

SEQ ID NO: 2691441 - RNA, 22 nt, Human
ucucuggccuucggccuccauc

SEQ ID NO: 2691442 - RNA, 12 nt, Human
ucugaagaagau

SEQ ID NO: 2691443 - RNA, 14 nt, Human
agaaaugaaagcag

SEQ ID NO: 2691444 - RNA, 22 nt, Human
ucggguuuuauuguuuaaaauc

SEQ ID NO: 2691445 - RNA, 18 nt, Human
acuguggguagacacaca

SEQ ID NO: 2691446 - RNA, 21 nt, Human
acugucagcuccccucggaga

SEQ ID NO: 2691447 - RNA, 18 nt, Human
acugggacaggggagaac

SEQ ID NO: 2691448 - RNA, 23 nt, Human
ucuaaguaaaaccacagcaguug

SEQ ID NO: 2691449 - RNA, 16 nt, Human
ucuacauacuauggaa

SEQ ID NO: 2691450 - RNA, 21 nt, Human
ucuaaguaaaaccacagcagu

SEQ ID NO: 2691451 - RNA, 22 nt, Human
ucuaaguaaaaccacagcaguu

SEQ ID NO: 2691452 - RNA, 20 nt, Human
ucuaaagccauuguaguccu

SEQ ID NO: 2691453 - RNA, 13 nt, Human
acuggcacaguuu

SEQ ID NO: 2691454 - RNA, 19 nt, Human
acuggcacaguuuucugag

SEQ ID NO: 2691455 - RNA, 20 nt, Human
acuggcacaguuuucugaga

SEQ ID NO: 2691456 - RNA, 20 nt, Human
acugccuucucaacuccaaa

SEQ ID NO: 2691457 - RNA, 19 nt, Human
acugccuucucaacuccaa

SEQ ID NO: 2691458 - RNA, 13 nt, Human
acugccuucucaa

SEQ ID NO: 2691459 - RNA, 15 nt, Human
acugcauuauauuua

SEQ ID NO: 2691460 - RNA, 14 nt, Human
acugcauuauauuu

SEQ ID NO: 2691461 - RNA, 18 nt, Human
ucgcuccaccuugcagcu

SEQ ID NO: 2691462 - RNA, 19 nt, Human
acgagcaggcuacugucag

SEQ ID NO: 2691463 - RNA, 20 nt, Human
acgagcaggcuacugucagc

SEQ ID NO: 2691464 - RNA, 14 nt, Human
acgagaaaacaaua

SEQ ID NO: 2691465 - RNA, 13 nt, Human
accucccugcaau

SEQ ID NO: 2691466 - RNA, 12 nt, Human
accucccugcaa

SEQ ID NO: 2691467 - RNA, 16 nt, Human
ucaugaauuaguuuua

SEQ ID NO: 2691468 - RNA, 22 nt, Human
ucaggaaaucaaauaugcaaag

SEQ ID NO: 2691469 - RNA, 23 nt, Human
ucaggaaaucaaauaugcaaagc

SEQ ID NO: 2691470 - RNA, 21 nt, Human
accuagggugauauuaaccag

SEQ ID NO: 2691471 - RNA, 21 nt, Human
ucaugaauuaguuuuauaugc

SEQ ID NO: 2691472 - RNA, 21 nt, Human
acuccaaagaaauguaaggga

SEQ ID NO: 2691473 - RNA, 15 nt, Human
acuccaaagaaaugu

SEQ ID NO: 2691474 - RNA, 18 nt, Human
acuccaaagaaauguaag

SEQ ID NO: 2691475 - RNA, 14 nt, Human
acuccaaagaaaug

SEQ ID NO: 2691476 - RNA, 11 nt, Human
ucccugagcag

SEQ ID NO: 2691477 - RNA, 17 nt, Human
ucccucccuccaccucc

SEQ ID NO: 2691478 - RNA, 16 nt, Human
ucccucccuccaccuc

SEQ ID NO: 2691479 - RNA, 15 nt, Human
ucccucccuccaccu

SEQ ID NO: 2691480 - RNA, 23 nt, Human
ucccuccaccucccugcaauaaa

SEQ ID NO: 2691481 - RNA, 21 nt, Human
ucccuccaccucccugcaaua

SEQ ID NO: 2691482 - RNA, 14 nt, Human
ucccucccuccacc

SEQ ID NO: 2691483 - RNA, 13 nt, Human
ucccucccuccac

SEQ ID NO: 2691484 - RNA, 17 nt, Human
uccccucggagaagagc

SEQ ID NO: 2691485 - RNA, 16 nt, Human
uccccucggagaagag

SEQ ID NO: 2691486 - RNA, 18 nt, Human
ucccagccagcaguucag

SEQ ID NO: 2691487 - RNA, 17 nt, Human
ucccagccagcaguuca

SEQ ID NO: 2691488 - RNA, 14 nt, Human
ucccagucauuuaa

SEQ ID NO: 2691489 - RNA, 22 nt, Human
ucccagucauuuaauaaaugug

SEQ ID NO: 2691490 - RNA, 21 nt, Human
uccaugaagauguagaggaga

SEQ ID NO: 2691491 - RNA, 13 nt, Human
uccaugaagaugu

SEQ ID NO: 2691492 - RNA, 20 nt, Human
uccauccugaggcuccacuu

SEQ ID NO: 2691493 - RNA, 21 nt, Human
uccauccugaggcuccacuug

SEQ ID NO: 2691494 - RNA, 19 nt, Human
uccauccugaggcuccacu

SEQ ID NO: 2691495 - RNA, 20 nt, Human
ucaggaaaucaaauaugcaa

SEQ ID NO: 2691496 - RNA, 21 nt, Human
ucaggaaaucaaauaugcaaa

SEQ ID NO: 2691497 - RNA, 19 nt, Human
ucaggaaagagaacuucca

SEQ ID NO: 2691498 - RNA, 13 nt, Human
ucaggaaagagaa

SEQ ID NO: 2691499 - RNA, 12 nt, Human
ucagagcugccc

SEQ ID NO: 2691500 - RNA, 23 nt, Human
accauuucuugagguaaaagcau

SEQ ID NO: 2691501 - RNA, 15 nt, Human
accaaucaugaauua

SEQ ID NO: 2691502 - RNA, 13 nt, Human
accaaucaugaau

SEQ ID NO: 2691503 - RNA, 20 nt, Human
ucaauuuuucuuauuucauu

SEQ ID NO: 2691504 - RNA, 23 nt, Human
ucaauuuuucuuauuucauuucu

SEQ ID NO: 2691505 - RNA, 15 nt, Human
ucaauucuugccaaa

SEQ ID NO: 2691506 - RNA, 18 nt, Human
accacuuguguuuugcaa

SEQ ID NO: 2691507 - RNA, 14 nt, Human
accagggacugagg

SEQ ID NO: 2691508 - RNA, 14 nt, Human
acauagaauuaaca

SEQ ID NO: 2691509 - RNA, 18 nt, Human
acauagaauuaacacaug

SEQ ID NO: 2691510 - RNA, 19 nt, Human
acauauauaacaaugcugu

SEQ ID NO: 2691511 - RNA, 13 nt, Human
acaucaacagaua

SEQ ID NO: 2691512 - RNA, 13 nt, Human
uauuucauuucuu

SEQ ID NO: 2691513 - RNA, 21 nt, Human
uaugaaauauuauguuaaaac

SEQ ID NO: 2691514 - RNA, 18 nt, Human
acaguuuucugagaaaga

SEQ ID NO: 2691515 - RNA, 19 nt, Human
acaguuuucugagaaagac

SEQ ID NO: 2691516 - RNA, 20 nt, Human
acaguuuucugagaaagacu

SEQ ID NO: 2691517 - RNA, 21 nt, Human
acaguuuucugagaaagacua

SEQ ID NO: 2691518 - RNA, 16 nt, Human
acaguuuucugagaaa

SEQ ID NO: 2691519 - RNA, 17 nt, Human
acaguuuucugagaaag

SEQ ID NO: 2691520 - RNA, 15 nt, Human
acaguuuucugagaa

SEQ ID NO: 2691521 - RNA, 22 nt, Human
ucaagaugaugaugaucuuuaa

SEQ ID NO: 2691522 - RNA, 21 nt, Human
acaugcugaacaucacagcuu

SEQ ID NO: 2691523 - RNA, 14 nt, Human
acaugcugaacauc

SEQ ID NO: 2691524 - RNA, 21 nt, Human
ucaaaauaugccccauucaac

SEQ ID NO: 2691525 - RNA, 23 nt, Human
ucaaaauaccaugccauuuaaag

SEQ ID NO: 2691526 - RNA, 21 nt, Human
ucaaaauaccaugccauuuaa

SEQ ID NO: 2691527 - RNA, 18 nt, Human
ucaaaagaaagaaaauca

SEQ ID NO: 2691528 - RNA, 14 nt, Human
ucaaagcugaaaug

SEQ ID NO: 2691529 - RNA, 19 nt, Human
acaugauccugcaauucca

SEQ ID NO: 2691530 - RNA, 15 nt, Human
uauauuuauuacugu

SEQ ID NO: 2691531 - RNA, 19 nt, Human
uauauuuauuacuguaaga

SEQ ID NO: 2691532 - RNA, 21 nt, Human
acagcccuucuuuccacagaa

SEQ ID NO: 2691533 - RNA, 20 nt, Human
acagcccuucuuuccacaga

SEQ ID NO: 2691534 - RNA, 13 nt, Human
acacuuaaaaaug

SEQ ID NO: 2691535 - RNA, 15 nt, Human
acacuuaaaaauggu

SEQ ID NO: 2691536 - RNA, 12 nt, Human
uauauuuacaaa

SEQ ID NO: 2691537 - RNA, 14 nt, Human
acacugaagaagca

SEQ ID NO: 2691538 - RNA, 12 nt, Human
acacugaagaag

SEQ ID NO: 2691539 - RNA, 14 nt, Human
acacuccagugaga

SEQ ID NO: 2691540 - RNA, 18 nt, Human
acacaugcugaacaucac

SEQ ID NO: 2691541 - RNA, 19 nt, Human
acacuaagagagaaugaga

SEQ ID NO: 2691542 - RNA, 18 nt, Human
acacuaagagagaaugag

SEQ ID NO: 2691543 - RNA, 17 nt, Human
acacuaagagagaauga

SEQ ID NO: 2691544 - RNA, 12 nt, Human
uaguguuggaga

SEQ ID NO: 2691545 - RNA, 17 nt, Human
uaguguuggagaagaac

SEQ ID NO: 2691546 - RNA, 16 nt, Human
uaguguuggagaagaa

SEQ ID NO: 2691547 - RNA, 14 nt, Human
acacacugaagaag

SEQ ID NO: 2691548 - RNA, 17 nt, Human
acaaugcuguauuuuaa

SEQ ID NO: 2691549 - RNA, 14 nt, Human
acaaugcuguauuu

SEQ ID NO: 2691550 - RNA, 17 nt, Human
acacaacuauauuguuu

SEQ ID NO: 2691551 - RNA, 14 nt, Human
acacaacuauauug

SEQ ID NO: 2691552 - RNA, 20 nt, Human
acacacucaaaucaagaaac

SEQ ID NO: 2691553 - RNA, 13 nt, Human
acacacugaagaa

SEQ ID NO: 2691554 - RNA, 18 nt, Human
uacuaaaaauacaaaaaa

SEQ ID NO: 2691555 - RNA, 14 nt, Human
uacuaaaaauacaa

SEQ ID NO: 2691556 - RNA, 23 nt, Human
uacugggaaagggauuuucagcc

SEQ ID NO: 2691557 - RNA, 17 nt, Human
uacugagagugaacaaa

SEQ ID NO: 2691558 - RNA, 18 nt, Human
aauugaggacacugauau

SEQ ID NO: 2691559 - RNA, 19 nt, Human
aauuucucccagucauuua

SEQ ID NO: 2691560 - RNA, 15 nt, Human
aauuggagcucgugg

SEQ ID NO: 2691561 - RNA, 17 nt, Human
aauuuacagagacagaa

SEQ ID NO: 2691562 - RNA, 18 nt, Human
aauuuacagagacagaaa

SEQ ID NO: 2691563 - RNA, 19 nt, Human
uacuucuuaggguuaugau

SEQ ID NO: 2691564 - RNA, 16 nt, Human
uacuucaugcugucua

SEQ ID NO: 2691565 - RNA, 17 nt, Human
uagauaggccaugggca

SEQ ID NO: 2691566 - RNA, 22 nt, Human
uagauaggucagugcaaauacu

SEQ ID NO: 2691567 - RNA, 20 nt, Human
uagaugcaguucugaagaag

SEQ ID NO: 2691568 - RNA, 21 nt, Human
uagaugcaguucugaagaaga

SEQ ID NO: 2691569 - RNA, 21 nt, Human
aauuuuucuuauuucauuucu

SEQ ID NO: 2691570 - RNA, 22 nt, Human
aauuuuuucucuaggaaauauu

SEQ ID NO: 2691571 - RNA, 22 nt, Human
acaagcucacagaccuuugaac

SEQ ID NO: 2691572 - RNA, 17 nt, Human
acaaauuuacagagaca

SEQ ID NO: 2691573 - RNA, 16 nt, Human
uagcuacuaauuuuaa

SEQ ID NO: 2691574 - RNA, 18 nt, Human
aauaggcguaacuaauuu

SEQ ID NO: 2691575 - RNA, 12 nt, Human
aauaucacuugu

SEQ ID NO: 2691576 - RNA, 15 nt, Human
aauaucacuugucaa

SEQ ID NO: 2691577 - RNA, 15 nt, Human
aauaugcaaagcacu

SEQ ID NO: 2691578 - RNA, 17 nt, Human
aauaugcaaagcacuga

SEQ ID NO: 2691579 - RNA, 24 nt, Human
aauaugcaaagcacugacuucuaa

SEQ ID NO: 2691580 - RNA, 14 nt, Human
aauauuucagauaa

SEQ ID NO: 2691581 - RNA, 15 nt, Human
aauauuucagauaau

SEQ ID NO: 2691582 - RNA, 19 nt, Human
aauaucuuuuuuuuaauaa

SEQ ID NO: 2691583 - RNA, 21 nt, Human
aauaacaaugaaaguugauaa

SEQ ID NO: 2691584 - RNA, 16 nt, Human
aauaauuuuuauauuu

SEQ ID NO: 2691585 - RNA, 19 nt, Human
aauaauuuuuauauuugaa

SEQ ID NO: 2691586 - RNA, 17 nt, Human
aauaauuuuuauauuug

SEQ ID NO: 2691587 - RNA, 20 nt, Human
aauaauuuuuauauuugaaa

SEQ ID NO: 2691588 - RNA, 11 nt, Human
aaugugauaug

SEQ ID NO: 2691589 - RNA, 19 nt, Human
aauggacuuuuguacauag

SEQ ID NO: 2691590 - RNA, 19 nt, Human
uacacuaagagagaaugag

SEQ ID NO: 2691591 - RNA, 13 nt, Human
uacaaaaacacag

SEQ ID NO: 2691592 - RNA, 14 nt, Human
uacaaaaacacagc

SEQ ID NO: 2691593 - RNA, 16 nt, Human
uacaaaaacacagcaa

SEQ ID NO: 2691594 - RNA, 15 nt, Human
uacaaaaacacagca

SEQ ID NO: 2691595 - RNA, 14 nt, Human
aaucuuauaauuua

SEQ ID NO: 2691596 - RNA, 16 nt, Human
aaucuuauaauuuaaa

SEQ ID NO: 2691597 - RNA, 13 nt, Human
aauccuugaagau

SEQ ID NO: 2691598 - RNA, 15 nt, Human
aaucaucaagucuuu

SEQ ID NO: 2691599 - RNA, 17 nt, Human
aaucaugaauuaguuuu

SEQ ID NO: 2691600 - RNA, 19 nt, Human
aaucaugaauuaguuuuau

SEQ ID NO: 2691601 - RNA, 23 nt, Human
aaucaugaauuaguuuuauaugc

SEQ ID NO: 2691602 - RNA, 18 nt, Human
uaaguuuuuuuuuaaaaa

SEQ ID NO: 2691603 - RNA, 16 nt, Human
uaaugauaacuggaaa

SEQ ID NO: 2691604 - RNA, 21 nt, Human
aaugagagacacacugaagaa

SEQ ID NO: 2691605 - RNA, 18 nt, Human
aagaaugauuaugaauua

SEQ ID NO: 2691606 - RNA, 16 nt, Human
aagaaugauuaugaau

SEQ ID NO: 2691607 - RNA, 16 nt, Human
aagaagugaaaaucua

SEQ ID NO: 2691608 - RNA, 22 nt, Human
aagaagugaaaaucuacacucc

SEQ ID NO: 2691609 - RNA, 18 nt, Human
gugcuaguaauuggaaag

SEQ ID NO: 2691610 - RNA, 21 nt, Human
gugggacagucaccucaugga

SEQ ID NO: 2691611 - RNA, 19 nt, Human
aagagcuguucacagccag

SEQ ID NO: 2691612 - RNA, 21 nt, Human
gugugaccacugcagaagaca

SEQ ID NO: 2691613 - RNA, 13 nt, Human
guugacaugggac

SEQ ID NO: 2691614 - RNA, 18 nt, Human
guugacaugggacauuug

SEQ ID NO: 2691615 - RNA, 14 nt, Human
guugacaugggaca

SEQ ID NO: 2691616 - RNA, 23 nt, Human
aagcuuguauuccuuuuucucuc

SEQ ID NO: 2691617 - RNA, 23 nt, Human
guuuucugagaaagacuauucaa

SEQ ID NO: 2691618 - RNA, 13 nt, Human
aagguacuucaaa

SEQ ID NO: 2691619 - RNA, 21 nt, Human
guuucaaacauauauaacaau

SEQ ID NO: 2691620 - RNA, 10 nt, Human
guuuaaaauc

SEQ ID NO: 2691621 - RNA, 16 nt, Human
guuuaaaaucauuucu

SEQ ID NO: 2691622 - RNA, 18 nt, Human
guuguaccgcaaugugac

SEQ ID NO: 2691623 - RNA, 20 nt, Human
aacccauauuuguacaccaa

SEQ ID NO: 2691624 - RNA, 13 nt, Human
aacccaaauguuc

SEQ ID NO: 2691625 - RNA, 18 nt, Human
aacccaaauguucaucaa

SEQ ID NO: 2691626 - RNA, 20 nt, Human
aaccuagggugauauuaacc

SEQ ID NO: 2691627 - RNA, 12 nt, Human
aaccacagcagu

SEQ ID NO: 2691628 - RNA, 22 nt, Human
gucuuaauuaaaagaauauuuu

SEQ ID NO: 2691629 - RNA, 19 nt, Human
gucuuaauuaaaagaauau

SEQ ID NO: 2691630 - RNA, 21 nt, Human
gucuuaauuaaaagaauauuu

SEQ ID NO: 2691631 - RNA, 15 nt, Human
gugaacacaucagcu

SEQ ID NO: 2691632 - RNA, 18 nt, Human
aacucguuaauuuguagu

SEQ ID NO: 2691633 - RNA, 13 nt, Human
aacucccuuucaa

SEQ ID NO: 2691634 - RNA, 14 nt, Human
aacucccuuucaac

SEQ ID NO: 2691635 - RNA, 21 nt, Human
aacuccagaaagugacaagcu

SEQ ID NO: 2691636 - RNA, 14 nt, Human
aacuccagaaagug

SEQ ID NO: 2691637 - RNA, 24 nt, Human
guccaagcauaccaacacgagcag

SEQ ID NO: 2691638 - RNA, 21 nt, Human
guccaagcauuuagauguaua

SEQ ID NO: 2691639 - RNA, 15 nt, Human
aacaaggaugaauua

SEQ ID NO: 2691640 - RNA, 21 nt, Human
aacaagccuccuuuuaaagua

SEQ ID NO: 2691641 - RNA, 22 nt, Human
aacaguagugauaguuguaccg

SEQ ID NO: 2691642 - RNA, 18 nt, Human
aacauuugguaaggggaa

SEQ ID NO: 2691643 - RNA, 19 nt, Human
aaauggcuuccuggcaaua

SEQ ID NO: 2691644 - RNA, 14 nt, Human
aaaugcauuucuaa

SEQ ID NO: 2691645 - RNA, 21 nt, Human
aaaugaaagcagggacuugaa

SEQ ID NO: 2691646 - RNA, 22 nt, Human
aaaugaaagcagggacuugaac

SEQ ID NO: 2691647 - RNA, 14 nt, Human
aaauccuugaagau

SEQ ID NO: 2691648 - RNA, 19 nt, Human
aaaucuacacuccagugag

SEQ ID NO: 2691649 - RNA, 14 nt, Human
guaugauucccagc

SEQ ID NO: 2691650 - RNA, 22 nt, Human
aaauguaagggaaacugccagc

SEQ ID NO: 2691651 - RNA, 17 nt, Human
aaauuucagcagcugca

SEQ ID NO: 2691652 - RNA, 18 nt, Human
aaauuucagcagcugcag

SEQ ID NO: 2691653 - RNA, 15 nt, Human
aaacugcacugucaa

SEQ ID NO: 2691654 - RNA, 21 nt, Human
aaaaucauuucugcaucagcu

SEQ ID NO: 2691655 - RNA, 15 nt, Human
aaagcauuguaaaug

SEQ ID NO: 2691656 - RNA, 17 nt, Human
aaagcauuguaaaugug

SEQ ID NO: 2691657 - RNA, 11 nt, Human
aaaaucauuuc

SEQ ID NO: 2691658 - RNA, 12 nt, Human
aaaaucauuucu

SEQ ID NO: 2691659 - RNA, 10 nt, Human
aaaaucauuu

SEQ ID NO: 2691660 - RNA, 13 nt, Human
aaaagacuccaaa

SEQ ID NO: 2691661 - RNA, 11 nt, Human
aaaagaaugau

SEQ ID NO: 2691662 - RNA, 13 nt, Human
aaaagaauauuuu

SEQ ID NO: 2691663 - RNA, 20 nt, Human
aaaagacaaggaaaaaauaa

SEQ ID NO: 2691664 - RNA, 12 nt, Human
aaaagaauauuu

SEQ ID NO: 2691665 - RNA, 17 nt, Human
aaaagaaagaaaaucag

SEQ ID NO: 2691666 - RNA, 23 nt, Human
aaauguugacaugggacauuugc

SEQ ID NO: 2691667 - RNA, 22 nt, Human
aaauguugacaugggacauuug

SEQ ID NO: 2691668 - RNA, 17 nt, Human
aaauguucaucaaugaa

SEQ ID NO: 2691669 - RNA, 13 nt, Human
aaauguucaucaa

SEQ ID NO: 2691670 - RNA, 18 nt, Human
aaaucucaauauuucaga

SEQ ID NO: 2691671 - RNA, 21 nt, Human
aaauauuuauuuuaauaaugu

SEQ ID NO: 2691672 - RNA, 22 nt, Human
aagacagagccccacccucaga

SEQ ID NO: 2691673 - RNA, 15 nt, Human
aagaacugaaaucau

SEQ ID NO: 2691674 - RNA, 11 nt, Human
aagaacugaaa

SEQ ID NO: 2691675 - RNA, 13 nt, Human
aagaacugaaauc

SEQ ID NO: 2691676 - RNA, 12 nt, Human
aagaacugaaau

SEQ ID NO: 2691677 - RNA, 20 nt, Human
aacgcaggcccccaggugcc

SEQ ID NO: 2691678 - RNA, 15 nt, Human
aagaagacugcauua

SEQ ID NO: 2691679 - RNA, 20 nt, Human
aagaagacugcauuauauuu

SEQ ID NO: 2691680 - RNA, 21 nt, Human
aagacaaggaaaaaauaacaa

SEQ ID NO: 2691681 - RNA, 16 nt, Human
aaucucaauauuucag

SEQ ID NO: 2691682 - RNA, 20 nt, Human
aaugaauacuuuauaaagga

SEQ ID NO: 2691683 - RNA, 19 nt, Human
acugauaugggucuugaua

SEQ ID NO: 2691684 - RNA, 13 nt, Human
acugacacaugcu

SEQ ID NO: 2691685 - RNA, 19 nt, Human
acucguuaauuuguagugu

SEQ ID NO: 2691686 - RNA, 14 nt, Human
acucguuaauuugu

SEQ ID NO: 2691687 - RNA, 14 nt, Human
acucccuuucaaca

SEQ ID NO: 2691688 - RNA, 21 nt, Human
acuucagacauagaauuaaca

SEQ ID NO: 2691689 - RNA, 13 nt, Human
acuuggucuguga

SEQ ID NO: 2691690 - RNA, 22 nt, Human
acuuaaaaaugguuuaaauggu

SEQ ID NO: 2691691 - RNA, 17 nt, Human
acuucaaauccuugaag

SEQ ID NO: 2691692 - RNA, 18 nt, Human
acuucaaauccuugaaga

SEQ ID NO: 2691693 - RNA, 17 nt, Human
acuguaaaauaauaacu

SEQ ID NO: 2691694 - RNA, 21 nt, Human
acccugucucuacuaaaaaua

SEQ ID NO: 2691695 - RNA, 20 nt, Human
acccucagaugcacaugagc

SEQ ID NO: 2691696 - RNA, 20 nt, Human
accucugccucagaaaacaa

SEQ ID NO: 2691697 - RNA, 14 nt, Human
acgcacacugucug

SEQ ID NO: 2691698 - RNA, 21 nt, Human
acauuuguauaaaauaauuuu

SEQ ID NO: 2691699 - RNA, 19 nt, Human
acauuuguauaaaauaauu

SEQ ID NO: 2691700 - RNA, 16 nt, Human
acauuuguauaaaaua

SEQ ID NO: 2691701 - RNA, 16 nt, Human
acauuugcucauggaa

SEQ ID NO: 2691702 - RNA, 15 nt, Human
acauuugcucaugga

SEQ ID NO: 2691703 - RNA, 19 nt, Human
acagugauuaccagggacu

SEQ ID NO: 2691704 - RNA, 22 nt, Human
acaggaugguucccuugaugaa

SEQ ID NO: 2691705 - RNA, 24 nt, Human
acaggaugguucccuugaugaaga

SEQ ID NO: 2691706 - RNA, 15 nt, Human
acaccaauauucaua

SEQ ID NO: 2691707 - RNA, 22 nt, Human
aauuucauaccuaucaucuuaa

SEQ ID NO: 2691708 - RNA, 11 nt, Human
aauuguaauag

SEQ ID NO: 2691709 - RNA, 14 nt, Human
agccagcaguucag

SEQ ID NO: 2691710 - RNA, 17 nt, Human
agcacugacuucuaagu

SEQ ID NO: 2691711 - RNA, 19 nt, Human
agcacugacuucuaaguaa

SEQ ID NO: 2691712 - RNA, 20 nt, Human
agauagauaggucagugcaa

SEQ ID NO: 2691713 - RNA, 23 nt, Human
agcaaaauuuuuucucuaggaaa

SEQ ID NO: 2691714 - RNA, 21 nt, Human
agaagacugcauuauauuuau

SEQ ID NO: 2691715 - RNA, 20 nt, Human
agaagagcuguucacagcca

SEQ ID NO: 2691716 - RNA, 13 nt, Human
agaagauagcagg

SEQ ID NO: 2691717 - RNA, 13 nt, Human
agaagagcuguuc

SEQ ID NO: 2691718 - RNA, 22 nt, Human
agaacagugauuaccagggacu

SEQ ID NO: 2691719 - RNA, 19 nt, Human
agacaaggaaaaaauaaca

SEQ ID NO: 2691720 - RNA, 18 nt, Human
aggaaaaaauaacaauga

SEQ ID NO: 2691721 - RNA, 18 nt, Human
agcuguaugauucccagc

SEQ ID NO: 2691722 - RNA, 17 nt, Human
agcuguaugauucccag

SEQ ID NO: 2691723 - RNA, 14 nt, Human
agcugcugaaacaa

SEQ ID NO: 2691724 - RNA, 15 nt, Human
agcugcugaaacaac

SEQ ID NO: 2691725 - RNA, 16 nt, Human
agcugcugaaacaaca

SEQ ID NO: 2691726 - RNA, 20 nt, Human
agcugcugaaacaacaaaua

SEQ ID NO: 2691727 - RNA, 13 nt, Human
agcgacagugaga

SEQ ID NO: 2691728 - RNA, 15 nt, Human
agcgacagugagacu

SEQ ID NO: 2691729 - RNA, 12 nt, Human
agcuacaaaugc

SEQ ID NO: 2691730 - RNA, 13 nt, Human
agcuacaaaugca

SEQ ID NO: 2691731 - RNA, 20 nt, Human
aggcagagguugcagugagc

SEQ ID NO: 2691732 - RNA, 23 nt, Human
aggccaugggcacuguggguaga

SEQ ID NO: 2691733 - RNA, 17 nt, Human
agggacaggauaagagg

SEQ ID NO: 2691734 - RNA, 20 nt, Human
agggauuagggagagaagau

SEQ ID NO: 2691735 - RNA, 20 nt, Human
augggacauuugcucaugga

SEQ ID NO: 2691736 - RNA, 15 nt, Human
augggacagggagga

SEQ ID NO: 2691737 - RNA, 14 nt, Human
augggaaagcauug

SEQ ID NO: 2691738 - RNA, 20 nt, Human
augggaaagcauuguaaaug

SEQ ID NO: 2691739 - RNA, 23 nt, Human
auggcuuccuggcaauagucaaa

SEQ ID NO: 2691740 - RNA, 14 nt, Human
aucaaaagaaagaa

SEQ ID NO: 2691741 - RNA, 12 nt, Human
auccuugaagau

SEQ ID NO: 2691742 - RNA, 21 nt, Human
aucaugaauuaguuuuauaug

SEQ ID NO: 2691743 - RNA, 13 nt, Human
agucauuuaauaa

SEQ ID NO: 2691744 - RNA, 13 nt, Human
agugauuaccagg

SEQ ID NO: 2691745 - RNA, 19 nt, Human
agugaugucacuagggcag

SEQ ID NO: 2691746 - RNA, 13 nt, Human
aguacucauacau

SEQ ID NO: 2691747 - RNA, 16 nt, Human
auaaaagacagugaaa

SEQ ID NO: 2691748 - RNA, 15 nt, Human
auaaaagacagugaa

SEQ ID NO: 2691749 - RNA, 14 nt, Human
aguugaaaagacuc

SEQ ID NO: 2691750 - RNA, 21 nt, Human
cacaguuuucugagaaagacu

SEQ ID NO: 2691751 - RNA, 22 nt, Human
cacaguuuucugagaaagacua

SEQ ID NO: 2691752 - RNA, 16 nt, Human
cacaugaaguccaagc

SEQ ID NO: 2691753 - RNA, 20 nt, Human
cacaugaaguccaagcauuu

SEQ ID NO: 2691754 - RNA, 17 nt, Human
cacaugaaguccaagca

SEQ ID NO: 2691755 - RNA, 13 nt, Human
cacaagaaaugaa

SEQ ID NO: 2691756 - RNA, 15 nt, Human
cacaagaaaugaaag

SEQ ID NO: 2691757 - RNA, 23 nt, Human
cacaagaaaugaaagcagggacu

SEQ ID NO: 2691758 - RNA, 23 nt, Human
cacaagacccaaaaggcagaagc

SEQ ID NO: 2691759 - RNA, 16 nt, Human
caaauuuacagagaca

SEQ ID NO: 2691760 - RNA, 17 nt, Human
caaauuuacagagacag

SEQ ID NO: 2691761 - RNA, 23 nt, Human
caaauuuacagagacagaaagca

SEQ ID NO: 2691762 - RNA, 19 nt, Human
caagcauuuagauguauag

SEQ ID NO: 2691763 - RNA, 16 nt, Human
caagcauuuagaugua

SEQ ID NO: 2691764 - RNA, 21 nt, Human
caagcauaccaacacgagcag

SEQ ID NO: 2691765 - RNA, 16 nt, Human
caagcauaccaacacg

SEQ ID NO: 2691766 - RNA, 13 nt, Human
caagaaaugaaag

SEQ ID NO: 2691767 - RNA, 19 nt, Human
caagacugcacaucaaaau

SEQ ID NO: 2691768 - RNA, 14 nt, Human
caaagaaauguaag

SEQ ID NO: 2691769 - RNA, 19 nt, Human
auuuuaauaauguuucaaa

SEQ ID NO: 2691770 - RNA, 18 nt, Human
auuuuaauaauguuucaa

SEQ ID NO: 2691771 - RNA, 13 nt, Human
uuuuccugaaaac

SEQ ID NO: 2691772 - RNA, 20 nt, Human
uuuuauaugcuucuguuuua

SEQ ID NO: 2691773 - RNA, 15 nt, Human
uuuuauaugcuucug

SEQ ID NO: 2691774 - RNA, 20 nt, Human
uuuuauaucaauuuaaaaaa

SEQ ID NO: 2691775 - RNA, 10 nt, Human
uuuuauauuu

SEQ ID NO: 2691776 - RNA, 21 nt, Human
uuugcauagauucccugagca

SEQ ID NO: 2691777 - RNA, 21 nt, Human
uuuguauaaaauaauuuuuau

SEQ ID NO: 2691778 - RNA, 20 nt, Human
uuuagaaacacaacuauauu

SEQ ID NO: 2691779 - RNA, 12 nt, Human
uuuagaaacaca

SEQ ID NO: 2691780 - RNA, 22 nt, Human
uuuccucaaaacuucagacaua

SEQ ID NO: 2691781 - RNA, 22 nt, Human
uuucugagaaagacuauucaaa

SEQ ID NO: 2691782 - RNA, 15 nt, Human
uuucagauaaucaca

SEQ ID NO: 2691783 - RNA, 15 nt, Human
uuucagcagcugcag

SEQ ID NO: 2691784 - RNA, 21 nt, Human
uuucagauaaucacaauacau

SEQ ID NO: 2691785 - RNA, 23 nt, Human
uucucuccucuccccaugauguu

SEQ ID NO: 2691786 - RNA, 18 nt, Human
uucccuugaugaagaagu

SEQ ID NO: 2691787 - RNA, 12 nt, Human
uuccuagugaaa

SEQ ID NO: 2691788 - RNA, 22 nt, Human
uucggccuccauccugaggcuc

SEQ ID NO: 2691789 - RNA, 18 nt, Human
uucggccuccauccugag

SEQ ID NO: 2691790 - RNA, 19 nt, Human
uucggccuccauccugagg

SEQ ID NO: 2691791 - RNA, 19 nt, Human
uuccacuuauaggaauuga

SEQ ID NO: 2691792 - RNA, 23 nt, Human
uucagagcugcccucuccugggc

SEQ ID NO: 2691793 - RNA, 22 nt, Human
uucagagcugcccucuccuggg

SEQ ID NO: 2691794 - RNA, 21 nt, Human
uucagagcugcccucuccugg

SEQ ID NO: 2691795 - RNA, 12 nt, Human
uugaugaagaag

SEQ ID NO: 2691796 - RNA, 18 nt, Human
uugcauagauucccugag

SEQ ID NO: 2691797 - RNA, 14 nt, Human
uugaggacacugau

SEQ ID NO: 2691798 - RNA, 15 nt, Human
uugaggacacugaua

SEQ ID NO: 2691799 - RNA, 23 nt, Human
uugaaacugagaugugaacacau

SEQ ID NO: 2691800 - RNA, 16 nt, Human
uugaaaagacuccaaa

SEQ ID NO: 2691801 - RNA, 18 nt, Human
uugaaaagacuccaaaga

SEQ ID NO: 2691802 - RNA, 22 nt, Human
uugaaaagacuccaaagaaaug

SEQ ID NO: 2691803 - RNA, 23 nt, Human
uugaaaagacuccaaagaaaugu

SEQ ID NO: 2691804 - RNA, 15 nt, Human
uucuuauuucauuuc

SEQ ID NO: 2691805 - RNA, 15 nt, Human
uucugagaaagacua

SEQ ID NO: 2691806 - RNA, 14 nt, Human
uucugagcauuuaa

SEQ ID NO: 2691807 - RNA, 16 nt, Human
uuguaaaggaauuuaa

SEQ ID NO: 2691808 - RNA, 11 nt, Human
uuguaaaugug

SEQ ID NO: 2691809 - RNA, 14 nt, Human
uuguaaaugugcuu

SEQ ID NO: 2691810 - RNA, 18 nt, Human
uuguaaaugugcuuuuaa

SEQ ID NO: 2691811 - RNA, 19 nt, Human
uuguaucacaaaucuuaac

SEQ ID NO: 2691812 - RNA, 14 nt, Human
uuguauuacaaauc

SEQ ID NO: 2691813 - RNA, 12 nt, Human
uugggaggcuga

SEQ ID NO: 2691814 - RNA, 22 nt, Human
ugugaccacugcagaagacagu

SEQ ID NO: 2691815 - RNA, 21 nt, Human
ugucucaguccaugaagaugu

SEQ ID NO: 2691816 - RNA, 22 nt, Human
ugucucaguccaugaagaugua

SEQ ID NO: 2691817 - RNA, 14 nt, Human
ugugcguccugucg

SEQ ID NO: 2691818 - RNA, 15 nt, Human
uguaccgcaauguga

SEQ ID NO: 2691819 - RNA, 17 nt, Human
uguagauaauacaguuc

SEQ ID NO: 2691820 - RNA, 15 nt, Human
uguaaucacagcuac

SEQ ID NO: 2691821 - RNA, 14 nt, Human
uguaaucacagcua

SEQ ID NO: 2691822 - RNA, 16 nt, Human
uguaugauucccagcc

SEQ ID NO: 2691823 - RNA, 21 nt, Human
uguuggagaagaacugaaauc

SEQ ID NO: 2691824 - RNA, 14 nt, Human
uguuuaaaaucauu

SEQ ID NO: 2691825 - RNA, 13 nt, Human
uguuuaaaaucau

SEQ ID NO: 2691826 - RNA, 12 nt, Human
uguuauaaucuu

SEQ ID NO: 2691827 - RNA, 14 nt, Human
uguuagugcaaauu

SEQ ID NO: 2691828 - RNA, 16 nt, Human
uguucacagccagacu

SEQ ID NO: 2691829 - RNA, 19 nt, Human
ugugugcguccugucggag

SEQ ID NO: 2691830 - RNA, 21 nt, Human
uuaccacuuguguuuugcaag

SEQ ID NO: 2691831 - RNA, 20 nt, Human
uuacagagacagaaagcaga

SEQ ID NO: 2691832 - RNA, 15 nt, Human
uuacauuuguauaaa

SEQ ID NO: 2691833 - RNA, 14 nt, Human
uuacauuuguauaa

SEQ ID NO: 2691834 - RNA, 22 nt, Human
uuaaugucaauucuugccaaau

SEQ ID NO: 2691835 - RNA, 16 nt, Human
uuaauaauguuucaaa

SEQ ID NO: 2691836 - RNA, 18 nt, Human
uuaauaauguuucaaaca

SEQ ID NO: 2691837 - RNA, 20 nt, Human
uuaaagcuuauuaaaacuca

SEQ ID NO: 2691838 - RNA, 13 nt, Human
uuaaaagaaugau

SEQ ID NO: 2691839 - RNA, 19 nt, Human
uuaaaagaaugauuaugaa

SEQ ID NO: 2691840 - RNA, 17 nt, Human
uggccuucggccuccau

SEQ ID NO: 2691841 - RNA, 18 nt, Human
uggccuucggccuccauc

SEQ ID NO: 2691842 - RNA, 20 nt, Human
ugggacauuugcucauggaa

SEQ ID NO: 2691843 - RNA, 19 nt, Human
ugggacauuugcucaugga

SEQ ID NO: 2691844 - RNA, 21 nt, Human
ugggacagucaccucauggaa

SEQ ID NO: 2691845 - RNA, 20 nt, Human
ugggacagucaccucaugga

SEQ ID NO: 2691846 - RNA, 18 nt, Human
ugggacagucaccucaug

SEQ ID NO: 2691847 - RNA, 16 nt, Human
uggguagacacacaug

SEQ ID NO: 2691848 - RNA, 17 nt, Human
uggguagacacacauga

SEQ ID NO: 2691849 - RNA, 14 nt, Human
ugcuucuguuuuau

SEQ ID NO: 2691850 - RNA, 14 nt, Human
uggaacucucgagc

SEQ ID NO: 2691851 - RNA, 15 nt, Human
ugcauuauauuuauu

SEQ ID NO: 2691852 - RNA, 20 nt, Human
ugcauuauauuuauuacugu

SEQ ID NO: 2691853 - RNA, 14 nt, Human
ugcauuauauuuau

SEQ ID NO: 2691854 - RNA, 22 nt, Human
ugcaucagcugcugaaacaaca

SEQ ID NO: 2691855 - RNA, 20 nt, Human
ugccaucccucccuccaccu

SEQ ID NO: 2691856 - RNA, 19 nt, Human
ugccaucccucccuccacc

SEQ ID NO: 2691857 - RNA, 15 nt, Human
ugccaucccucccuc

SEQ ID NO: 2691858 - RNA, 22 nt, Human
ugccaucccucccuccaccucc

SEQ ID NO: 2691859 - RNA, 21 nt, Human
ugccaucccucccuccaccuc

SEQ ID NO: 2691860 - RNA, 15 nt, Human
ugcacaucaaaauau

SEQ ID NO: 2691861 - RNA, 17 nt, Human
ugcagauaaacaguagu

SEQ ID NO: 2691862 - RNA, 16 nt, Human
ugcagauaaacaguag

SEQ ID NO: 2691863 - RNA, 20 nt, Human
ugcuagaacucccuuucaac

SEQ ID NO: 2691864 - RNA, 21 nt, Human
ugcuagaacucccuuucaaca

SEQ ID NO: 2691865 - RNA, 19 nt, Human
ugcuagaacucccuuucaa

SEQ ID NO: 2691866 - RNA, 18 nt, Human
ugcuagaacucccuuuca

SEQ ID NO: 2691867 - RNA, 11 nt, Human
ugcucauggaa

SEQ ID NO: 2691868 - RNA, 17 nt, Human
ugccuucucaacuccaa

SEQ ID NO: 2691869 - RNA, 22 nt, Human
ugccuucucaacuccaaacuga

SEQ ID NO: 2691870 - RNA, 23 nt, Human
ugccuccccuccucugcuugcca

SEQ ID NO: 2691871 - RNA, 22 nt, Human
ugccuccccuccucugcuugcc

SEQ ID NO: 2691872 - RNA, 19 nt, Human
ugccuccccuccucugcuu

SEQ ID NO: 2691873 - RNA, 18 nt, Human
ugccuccccuccucugcu

SEQ ID NO: 2691874 - RNA, 24 nt, Human
ucuguaauaaacucauuucuagca

SEQ ID NO: 2691875 - RNA, 23 nt, Human
ucuguaauaaacucauuucuagc

SEQ ID NO: 2691876 - RNA, 19 nt, Human
ucuguaauaaacucauuuc

SEQ ID NO: 2691877 - RNA, 23 nt, Human
ucuggccuucggccuccauccug

SEQ ID NO: 2691878 - RNA, 22 nt, Human
ucuguuuuauaauuuugugaag

SEQ ID NO: 2691879 - RNA, 20 nt, Human
ucuguuuuauaauuuuguga

SEQ ID NO: 2691880 - RNA, 19 nt, Human
ugaaaacuuuaugcuaagu

SEQ ID NO: 2691881 - RNA, 15 nt, Human
ugaaaagacuccaaa

SEQ ID NO: 2691882 - RNA, 16 nt, Human
ugaaaagacuccaaag

SEQ ID NO: 2691883 - RNA, 17 nt, Human
ugaaaagacuccaaaga

SEQ ID NO: 2691884 - RNA, 19 nt, Human
ugaaaagacuccaaagaaa

SEQ ID NO: 2691885 - RNA, 22 nt, Human
ugaaaagacuccaaagaaaugu

SEQ ID NO: 2691886 - RNA, 18 nt, Human
ugaaacccugucucuacu

SEQ ID NO: 2691887 - RNA, 18 nt, Human
ugaaagcagggacuugaa

SEQ ID NO: 2691888 - RNA, 19 nt, Human
ugaaagcagggacuugaac

SEQ ID NO: 2691889 - RNA, 23 nt, Human
ugaaagcagggacuugaacccau

SEQ ID NO: 2691890 - RNA, 22 nt, Human
ugaaguccaagcauuuagaugu

SEQ ID NO: 2691891 - RNA, 21 nt, Human
ugaaguccaagcauuuagaug

SEQ ID NO: 2691892 - RNA, 22 nt, Human
ugaacuuguaaaggaauuuaaa

SEQ ID NO: 2691893 - RNA, 14 nt, Human
ugaacacaucagcu

SEQ ID NO: 2691894 - RNA, 17 nt, Human
ucuacacuccagugaga

SEQ ID NO: 2691895 - RNA, 21 nt, Human
ucuacacuaagagagaaugag

SEQ ID NO: 2691896 - RNA, 15 nt, Human
uccuugcaucaauuu

SEQ ID NO: 2691897 - RNA, 18 nt, Human
ucuccugggcagcugccu

SEQ ID NO: 2691898 - RNA, 17 nt, Human
ucuccugggcagcugcc

SEQ ID NO: 2691899 - RNA, 16 nt, Human
ucuccugggcagcugc

SEQ ID NO: 2691900 - RNA, 15 nt, Human
ucuccugggcagcug

SEQ ID NO: 2691901 - RNA, 13 nt, Human
ucuccugggcagc

SEQ ID NO: 2691902 - RNA, 14 nt, Human
ucuccugggcagcu

SEQ ID NO: 2691903 - RNA, 21 nt, Human
ucucagugucaaugcagcccc

SEQ ID NO: 2691904 - RNA, 20 nt, Human
ucuccugggcagcugccucc

SEQ ID NO: 2691905 - RNA, 19 nt, Human
ucuccugggcagcugccuc

SEQ ID NO: 2691906 - RNA, 21 nt, Human
ucuccugggcagcugccuccc

SEQ ID NO: 2691907 - RNA, 19 nt, Human
ucucuaggaaauauuuauu

SEQ ID NO: 2691908 - RNA, 13 nt, Human
ucucuaggaaaua

SEQ ID NO: 2691909 - RNA, 18 nt, Human
ucucuucacagucacauu

SEQ ID NO: 2691910 - RNA, 12 nt, Human
uccacuuggucu

SEQ ID NO: 2691911 - RNA, 13 nt, Human
uccacuuggucug

SEQ ID NO: 2691912 - RNA, 17 nt, Human
uccagauccuggaaauc

SEQ ID NO: 2691913 - RNA, 16 nt, Human
uccagauccuggaaau

SEQ ID NO: 2691914 - RNA, 14 nt, Human
uccagauccuggaa

SEQ ID NO: 2691915 - RNA, 20 nt, Human
uccaagcauuuagauguaua

SEQ ID NO: 2691916 - RNA, 14 nt, Human
uccaccuacaugag

SEQ ID NO: 2691917 - RNA, 12 nt, Human
uccaccucccug

SEQ ID NO: 2691918 - RNA, 23 nt, Human
uccaccucccugcaauaaaaugg

SEQ ID NO: 2691919 - RNA, 23 nt, Human
uccaaacugacucuuaagaagac

SEQ ID NO: 2691920 - RNA, 12 nt, Human
uccaaagaaaug

SEQ ID NO: 2691921 - RNA, 16 nt, Human
ucauuucugcaucagc

SEQ ID NO: 2691922 - RNA, 22 nt, Human
ucauuucugcaucagcugcuga

SEQ ID NO: 2691923 - RNA, 14 nt, Human
ucauuucuuugagu

SEQ ID NO: 2691924 - RNA, 23 nt, Human
uccaagcauaccaacacgagcag

SEQ ID NO: 2691925 - RNA, 17 nt, Human
uccaagcauuuagaugu

SEQ ID NO: 2691926 - RNA, 16 nt, Human
ucccaaauuucauacc

SEQ ID NO: 2691927 - RNA, 17 nt, Human
ucacuugucaauaaaau

SEQ ID NO: 2691928 - RNA, 22 nt, Human
ucagacauagaauuaacacaug

SEQ ID NO: 2691929 - RNA, 19 nt, Human
ucagacauagaauuaacac

SEQ ID NO: 2691930 - RNA, 14 nt, Human
ucacaggaaguaga

SEQ ID NO: 2691931 - RNA, 19 nt, Human
ucacaggaaguagaggagg

SEQ ID NO: 2691932 - RNA, 23 nt, Human
ucacaggacagcccuucuuucca

SEQ ID NO: 2691933 - RNA, 19 nt, Human
ucaacuccaaacugacucu

SEQ ID NO: 2691934 - RNA, 13 nt, Human
ucaaaacugcacu

SEQ ID NO: 2691935 - RNA, 22 nt, Human
uauuucuaugaaauauuauguu

SEQ ID NO: 2691936 - RNA, 21 nt, Human
uauuucuaugaaauauuaugu

SEQ ID NO: 2691937 - RNA, 18 nt, Human
uaaauauaugcuaagucu

SEQ ID NO: 2691938 - RNA, 17 nt, Human
uaaauaaaaauaauccu

SEQ ID NO: 2691939 - RNA, 14 nt, Human
uaaaggaauuuaaa

SEQ ID NO: 2691940 - RNA, 17 nt, Human
uaaaauggguuuuacug

SEQ ID NO: 2691941 - RNA, 18 nt, Human
uaaaauccauacauuugu

SEQ ID NO: 2691942 - RNA, 19 nt, Human
uaaaauccauacauuugug

SEQ ID NO: 2691943 - RNA, 14 nt, Human
uaaaagaugaaaau

SEQ ID NO: 2691944 - RNA, 16 nt, Human
guuuucauuaucucaa

SEQ ID NO: 2691945 - RNA, 18 nt, Human
guuuucaggcuagaugua

SEQ ID NO: 2691946 - RNA, 16 nt, Human
uaaaaaagaaacauuu

SEQ ID NO: 2691947 - RNA, 13 nt, Human
guuuagaaagcuu

SEQ ID NO: 2691948 - RNA, 17 nt, Human
guuuagaaagcuugccc

SEQ ID NO: 2691949 - RNA, 20 nt, Human
guuuaggauguugaaaaagu

SEQ ID NO: 2691950 - RNA, 20 nt, Human
uaagccagacaucaacagau

SEQ ID NO: 2691951 - RNA, 21 nt, Human
uaagccagacaucaacagaua

SEQ ID NO: 2691952 - RNA, 13 nt, Human
uaagccagacauc

SEQ ID NO: 2691953 - RNA, 18 nt, Human
uaagcauuccaacuaucu

SEQ ID NO: 2691954 - RNA, 16 nt, Human
uaagcauuccaacuau

SEQ ID NO: 2691955 - RNA, 20 nt, Human
uaagcauuccaacuaucuca

SEQ ID NO: 2691956 - RNA, 23 nt, Human
uaagagggauuagggagagaaga

SEQ ID NO: 2691957 - RNA, 23 nt, Human
uaaauugacacuuaaaaaugguu

SEQ ID NO: 2691958 - RNA, 14 nt, Human
uaauguuucaaaca

SEQ ID NO: 2691959 - RNA, 15 nt, Human
uaauguuucaaacau

SEQ ID NO: 2691960 - RNA, 20 nt, Human
uaauuaaaagaauauuuuaa

SEQ ID NO: 2691961 - RNA, 22 nt, Human
uaauuggaaaggcagcucuaaa

SEQ ID NO: 2691962 - RNA, 23 nt, Human
uaauuuguaguguuggagaagaa

SEQ ID NO: 2691963 - RNA, 20 nt, Human
uaauuuguaguguuggagaa

SEQ ID NO: 2691964 - RNA, 15 nt, Human
uaauaauguuucaaa

SEQ ID NO: 2691965 - RNA, 19 nt, Human
uaaugccacuaaauugaca

SEQ ID NO: 2691966 - RNA, 14 nt, Human
uacaggauuugaaa

SEQ ID NO: 2691967 - RNA, 13 nt, Human
uacagaauuuuau

SEQ ID NO: 2691968 - RNA, 16 nt, Human
uaccaacacgagcagg

SEQ ID NO: 2691969 - RNA, 16 nt, Human
uacauuuguauaaaau

SEQ ID NO: 2691970 - RNA, 11 nt, Human
uacauuugugu

SEQ ID NO: 2691971 - RNA, 17 nt, Human
uacauuuguauaaaaua

SEQ ID NO: 2691972 - RNA, 21 nt, Human
uacaugagguacugagaguga

SEQ ID NO: 2691973 - RNA, 22 nt, Human
uacaugagguacugagagugaa

SEQ ID NO: 2691974 - RNA, 23 nt, Human
uaccacaggaaccacaagacugc

SEQ ID NO: 2691975 - RNA, 23 nt, Human
uacugauguuccuagugaaagag

SEQ ID NO: 2691976 - RNA, 19 nt, Human
uacugagagugaacaaauu

SEQ ID NO: 2691977 - RNA, 23 nt, Human
uaccuuuguucccaaauuucaua

SEQ ID NO: 2691978 - RNA, 20 nt, Human
uagcagggcauggcugggaa

SEQ ID NO: 2691979 - RNA, 16 nt, Human
uagauguauguacuuc

SEQ ID NO: 2691980 - RNA, 20 nt, Human
uagauguauguacuucaugc

SEQ ID NO: 2691981 - RNA, 18 nt, Human
uagaguuuagcuggaaaa

SEQ ID NO: 2691982 - RNA, 17 nt, Human
uagaguuuagcuggaaa

SEQ ID NO: 2691983 - RNA, 13 nt, Human
uaggccaugggac

SEQ ID NO: 2691984 - RNA, 23 nt, Human
uaggaauugacccacaagaaaug

SEQ ID NO: 2691985 - RNA, 20 nt, Human
uaggaauugacccacaagaa

SEQ ID NO: 2691986 - RNA, 21 nt, Human
uaguuguaccgcaaugugacu

SEQ ID NO: 2691987 - RNA, 18 nt, Human
uagucaaauugugugaaa

SEQ ID NO: 2691988 - RNA, 13 nt, Human
uauauuugaaaua

SEQ ID NO: 2691989 - RNA, 14 nt, Human
uauauuugaaauau

SEQ ID NO: 2691990 - RNA, 23 nt, Human
uauauuuauuacuguaagaaaau

SEQ ID NO: 2691991 - RNA, 20 nt, Human
uauauuuauuacuguaagaa

SEQ ID NO: 2691992 - RNA, 19 nt, Human
uauauuuuuuguuaaauga

SEQ ID NO: 2691993 - RNA, 21 nt, Human
ggugcuacaaaaacacagcaa

SEQ ID NO: 2691994 - RNA, 23 nt, Human
ggugcuacaaaaacacagcaagg

SEQ ID NO: 2691995 - RNA, 22 nt, Human
ggcuugaguuuaaauuguaaua

SEQ ID NO: 2691996 - RNA, 20 nt, Human
ggaaaaaauaacaaugaaag

SEQ ID NO: 2691997 - RNA, 17 nt, Human
gcuuuuaaaaaaaaaua

SEQ ID NO: 2691998 - RNA, 16 nt, Human
gcuugccaucccuccc

SEQ ID NO: 2691999 - RNA, 18 nt, Human
gcuugcccuguuaaaaga

SEQ ID NO: 2692000 - RNA, 17 nt, Human
gcuugcccuggugccuc

SEQ ID NO: 2692001 - RNA, 19 nt, Human
gcuugcccuggugccucac

SEQ ID NO: 2692002 - RNA, 21 nt, Human
gcuugccaucccucccuccac

SEQ ID NO: 2692003 - RNA, 18 nt, Human
gcuugccaucccucccuc

SEQ ID NO: 2692004 - RNA, 15 nt, Human
gcuguucacagccag

SEQ ID NO: 2692005 - RNA, 16 nt, Human
gcuguucacagccaga

SEQ ID NO: 2692006 - RNA, 23 nt, Human
gcuguucacagccagacuggcac

SEQ ID NO: 2692007 - RNA, 18 nt, Human
ggaaauauuuauuuuaau

SEQ ID NO: 2692008 - RNA, 17 nt, Human
ggaaauauuuauuuuaa

SEQ ID NO: 2692009 - RNA, 12 nt, Human
ggaaauauuuau

SEQ ID NO: 2692010 - RNA, 15 nt, Human
ggaaauauuuauuuu

SEQ ID NO: 2692011 - RNA, 13 nt, Human
ggaaauauuuauu

SEQ ID NO: 2692012 - RNA, 16 nt, Human
ggaaaucaaauaugca

SEQ ID NO: 2692013 - RNA, 18 nt, Human
gcuagauguauguacuuc

SEQ ID NO: 2692014 - RNA, 22 nt, Human
gcuguauuuuaaaagaaugauu

SEQ ID NO: 2692015 - RNA, 19 nt, Human
ggaggacgcucucuggccu

SEQ ID NO: 2692016 - RNA, 20 nt, Human
ggaggacgcucucuggccuu

SEQ ID NO: 2692017 - RNA, 21 nt, Human
ggaggacgcucucuggccuuc

SEQ ID NO: 2692018 - RNA, 22 nt, Human
ggccaugggacagggaggacgc

SEQ ID NO: 2692019 - RNA, 21 nt, Human
ggcagcugccuccccuccucu

SEQ ID NO: 2692020 - RNA, 18 nt, Human
ggcagcugccuccccucc

SEQ ID NO: 2692021 - RNA, 22 nt, Human
ggcagcugccuccccuccucug

SEQ ID NO: 2692022 - RNA, 19 nt, Human
gcccuucuuuccacagaag

SEQ ID NO: 2692023 - RNA, 16 nt, Human
gccuccccuccucugc

SEQ ID NO: 2692024 - RNA, 14 nt, Human
gccuccccuccucu

SEQ ID NO: 2692025 - RNA, 13 nt, Human
gccuccccuccuc

SEQ ID NO: 2692026 - RNA, 12 nt, Human
gccuccccuccu

SEQ ID NO: 2692027 - RNA, 11 nt, Human
gccuccccucc

SEQ ID NO: 2692028 - RNA, 19 nt, Human
gcguccugucggagcccug

SEQ ID NO: 2692029 - RNA, 22 nt, Human
gcguccugucggagcccugucu

SEQ ID NO: 2692030 - RNA, 18 nt, Human
gccuguaaucacagcuac

SEQ ID NO: 2692031 - RNA, 19 nt, Human
gccuucggccuccauccug

SEQ ID NO: 2692032 - RNA, 18 nt, Human
gccuuggggcugaugcag

SEQ ID NO: 2692033 - RNA, 18 nt, Human
gccuucggccuccauccu

SEQ ID NO: 2692034 - RNA, 22 nt, Human
gcgacagugagacucugucuca

SEQ ID NO: 2692035 - RNA, 22 nt, Human
gccacguucuuacuaguuuccc

SEQ ID NO: 2692036 - RNA, 14 nt, Human
gccaucccucccuc

SEQ ID NO: 2692037 - RNA, 13 nt, Human
gccaucccucccu

SEQ ID NO: 2692038 - RNA, 11 nt, Human
gccaucccucc

SEQ ID NO: 2692039 - RNA, 14 nt, Human
gccaugggacaggg

SEQ ID NO: 2692040 - RNA, 19 nt, Human
gccaugggacagggaggac

SEQ ID NO: 2692041 - RNA, 16 nt, Human
gccaucccucccucca

SEQ ID NO: 2692042 - RNA, 15 nt, Human
gccaucccucccucc

SEQ ID NO: 2692043 - RNA, 22 nt, Human
gccauuuaaagcuuauuaaaac

SEQ ID NO: 2692044 - RNA, 16 nt, Human
gcccacagcuguauga

SEQ ID NO: 2692045 - RNA, 17 nt, Human
gccccgugggguuccuc

SEQ ID NO: 2692046 - RNA, 19 nt, Human
gccccugcacuccagccug

SEQ ID NO: 2692047 - RNA, 16 nt, Human
gcccucuccugggcag

SEQ ID NO: 2692048 - RNA, 15 nt, Human
gcccucuccugggca

SEQ ID NO: 2692049 - RNA, 21 nt, Human
gcccucuccugggcagcugcc

SEQ ID NO: 2692050 - RNA, 19 nt, Human
gcccucuccugggcagcug

SEQ ID NO: 2692051 - RNA, 18 nt, Human
gcccucuccugggcagcu

SEQ ID NO: 2692052 - RNA, 18 nt, Human
gcauagauucccugagca

SEQ ID NO: 2692053 - RNA, 14 nt, Human
gcaguucugaagaa

SEQ ID NO: 2692054 - RNA, 13 nt, Human
gcaguucugaaga

SEQ ID NO: 2692055 - RNA, 15 nt, Human
gcaggcuacugucag

SEQ ID NO: 2692056 - RNA, 20 nt, Human
gcacagccucuuagaugcag

SEQ ID NO: 2692057 - RNA, 15 nt, Human
gcacugucaagauga

SEQ ID NO: 2692058 - RNA, 14 nt, Human
gcagaagacaguau

SEQ ID NO: 2692059 - RNA, 14 nt, Human
gauuaaguaaugau

SEQ ID NO: 2692060 - RNA, 22 nt, Human
gauuaaguaaugauaacuggaa

SEQ ID NO: 2692061 - RNA, 16 nt, Human
gaugcuagaacucccu

SEQ ID NO: 2692062 - RNA, 12 nt, Human
gcaagauguggg

SEQ ID NO: 2692063 - RNA, 16 nt, Human
gcaagaugugggcagu

SEQ ID NO: 2692064 - RNA, 17 nt, Human
gauaggucagugcaaau

SEQ ID NO: 2692065 - RNA, 23 nt, Human
gaucagcuuauugucuagugaaa

SEQ ID NO: 2692066 - RNA, 13 nt, Human
gauaaacaguagu

SEQ ID NO: 2692067 - RNA, 14 nt, Human
gauccuggaaauca

SEQ ID NO: 2692068 - RNA, 13 nt, Human
gaucuuuaaaaua

SEQ ID NO: 2692069 - RNA, 15 nt, Human
gaacauaaaauacaa

SEQ ID NO: 2692070 - RNA, 14 nt, Human
gaacaucacagcuu

SEQ ID NO: 2692071 - RNA, 16 nt, Human
gaacagugauuaccag

SEQ ID NO: 2692072 - RNA, 20 nt, Human
gaacagugauuaccagggac

SEQ ID NO: 2692073 - RNA, 16 nt, Human
gaaauuguauuacaaa

SEQ ID NO: 2692074 - RNA, 18 nt, Human
gaaauuguauuacaaauc

SEQ ID NO: 2692075 - RNA, 19 nt, Human
gaagacugcauuauauuua

SEQ ID NO: 2692076 - RNA, 12 nt, Human
gaagaacugaaa

SEQ ID NO: 2692077 - RNA, 18 nt, Human
gaagauguagaggagaaa

SEQ ID NO: 2692078 - RNA, 16 nt, Human
gaauauuuuaacuucc

SEQ ID NO: 2692079 - RNA, 22 nt, Human
gaaguccaagcauuuagaugua

SEQ ID NO: 2692080 - RNA, 12 nt, Human
gaaguccaagca

SEQ ID NO: 2692081 - RNA, 16 nt, Human
gaaguauccuucagcc

SEQ ID NO: 2692082 - RNA, 14 nt, Human
gaaguauccuucag

SEQ ID NO: 2692083 - RNA, 21 nt, Human
gacagagccccacccucagau

SEQ ID NO: 2692084 - RNA, 23 nt, Human
gacaggaugguucccuugaugaa

SEQ ID NO: 2692085 - RNA, 18 nt, Human
gacccaaaaggcagaagc

SEQ ID NO: 2692086 - RNA, 19 nt, Human
gacccaaaaggcagaagca

SEQ ID NO: 2692087 - RNA, 20 nt, Human
gacccaaaaggcagaagcaa

SEQ ID NO: 2692088 - RNA, 16 nt, Human
gaccacugcagaagac

SEQ ID NO: 2692089 - RNA, 18 nt, Human
gaccacugcagaagacag

SEQ ID NO: 2692090 - RNA, 22 nt, Human
gacuggauaguccgucucugcu

SEQ ID NO: 2692091 - RNA, 18 nt, Human
gacuggcacaguuuucug

SEQ ID NO: 2692092 - RNA, 22 nt, Human
gacuggcacaguuuucugagaa

SEQ ID NO: 2692093 - RNA, 17 nt, Human
gacuggauaguccgucu

SEQ ID NO: 2692094 - RNA, 14 nt, Human
gacuggcacaguuu

SEQ ID NO: 2692095 - RNA, 16 nt, Human
gacugaggggagggga

SEQ ID NO: 2692096 - RNA, 24 nt, Human
gacugcauuauauuuauuacugua

SEQ ID NO: 2692097 - RNA, 22 nt, Human
cuugcagcucuccccuucucug

SEQ ID NO: 2692098 - RNA, 14 nt, Human
cuugcccuguuaaa

SEQ ID NO: 2692099 - RNA, 18 nt, Human
cuugcccuggugccucac

SEQ ID NO: 2692100 - RNA, 19 nt, Human
cuugccaucccucccucca

SEQ ID NO: 2692101 - RNA, 16 nt, Human
cuugccaucccucccu

SEQ ID NO: 2692102 - RNA, 15 nt, Human
cuugccaucccuccc

SEQ ID NO: 2692103 - RNA, 17 nt, Human
cuugccaucccucccuc

SEQ ID NO: 2692104 - RNA, 14 nt, Human
cuugccaucccucc

SEQ ID NO: 2692105 - RNA, 20 nt, Human
cuugcuugauuguauggugg

SEQ ID NO: 2692106 - RNA, 22 nt, Human
cuugcccuguuaaaagaugaaa

SEQ ID NO: 2692107 - RNA, 16 nt, Human
cuuggacucauuuuaa

SEQ ID NO: 2692108 - RNA, 16 nt, Human
cuuggggcugaugcag

SEQ ID NO: 2692109 - RNA, 18 nt, Human
cuuggggcugaugcaguu

SEQ ID NO: 2692110 - RNA, 17 nt, Human
cuuguacuuuauuuucu

SEQ ID NO: 2692111 - RNA, 19 nt, Human
cuuuccucaaaacuucaga

SEQ ID NO: 2692112 - RNA, 14 nt, Human
gaaaacaaggauga

SEQ ID NO: 2692113 - RNA, 14 nt, Human
gaaaaguauguuag

SEQ ID NO: 2692114 - RNA, 20 nt, Human
gaaaaguauguuagugcaaa

SEQ ID NO: 2692115 - RNA, 19 nt, Human
gaaaauaacaauaaaagac

SEQ ID NO: 2692116 - RNA, 18 nt, Human
cuuaaugccacuaaauug

SEQ ID NO: 2692117 - RNA, 19 nt, Human
cuguuuuauaauuuuguga

SEQ ID NO: 2692118 - RNA, 19 nt, Human
cuuacuaguuucccuugca

SEQ ID NO: 2692119 - RNA, 19 nt, Human
cuuagaugcaguucugaag

SEQ ID NO: 2692120 - RNA, 19 nt, Human
cuuauaggaauugacccac

SEQ ID NO: 2692121 - RNA, 14 nt, Human
cuuauaauuuaaaa

SEQ ID NO: 2692122 - RNA, 21 nt, Human
cuuaggguuaugauuaaguaa

SEQ ID NO: 2692123 - RNA, 13 nt, Human
cuuauaauuuaaa

SEQ ID NO: 2692124 - RNA, 19 nt, Human
cuuccagauccuggaaauc

SEQ ID NO: 2692125 - RNA, 18 nt, Human
cuucagcgguuuauauaa

SEQ ID NO: 2692126 - RNA, 19 nt, Human
cuuccuuggacucauuuua

SEQ ID NO: 2692127 - RNA, 18 nt, Human
cuucggccuccauccuga

SEQ ID NO: 2692128 - RNA, 19 nt, Human
cuucggccuccauccugag

SEQ ID NO: 2692129 - RNA, 17 nt, Human
cuucggccuccauccug

SEQ ID NO: 2692130 - RNA, 16 nt, Human
cucccuucucuucaca

SEQ ID NO: 2692131 - RNA, 13 nt, Human
cucccuuucaaca

SEQ ID NO: 2692132 - RNA, 12 nt, Human
cucccuuucaac

SEQ ID NO: 2692133 - RNA, 13 nt, Human
cucggagaagagc

SEQ ID NO: 2692134 - RNA, 20 nt, Human
cucggagaagagcuguucac

SEQ ID NO: 2692135 - RNA, 12 nt, Human
cucggagaagag

SEQ ID NO: 2692136 - RNA, 17 nt, Human
cucauuaggauggcuag

SEQ ID NO: 2692137 - RNA, 18 nt, Human
cucauuaggauggcuagu

SEQ ID NO: 2692138 - RNA, 21 nt, Human
cuccauccugaggcuccacuu

SEQ ID NO: 2692139 - RNA, 20 nt, Human
cuccauccugaggcuccacu

SEQ ID NO: 2692140 - RNA, 23 nt, Human
cuccauccugaggcuccacuugg

SEQ ID NO: 2692141 - RNA, 17 nt, Human
cucccagucauuuaaua

SEQ ID NO: 2692142 - RNA, 17 nt, Human
cuccaccucccugcaau

SEQ ID NO: 2692143 - RNA, 16 nt, Human
cuccaccucccugcaa

SEQ ID NO: 2692144 - RNA, 15 nt, Human
cuccaccucccugca

SEQ ID NO: 2692145 - RNA, 14 nt, Human
cuccaccucccugc

SEQ ID NO: 2692146 - RNA, 23 nt, Human
cuccaccucccugcaauaaaaug

SEQ ID NO: 2692147 - RNA, 23 nt, Human
cucugcauacucauuaggauggc

SEQ ID NO: 2692148 - RNA, 21 nt, Human
cucuccugggcagcugccucc

SEQ ID NO: 2692149 - RNA, 13 nt, Human
cucuuaagaagac

SEQ ID NO: 2692150 - RNA, 13 nt, Human
cugauguuccuag

SEQ ID NO: 2692151 - RNA, 18 nt, Human
cugauguuccuagugaaa

SEQ ID NO: 2692152 - RNA, 20 nt, Human
cugauguuccuagugaaaga

SEQ ID NO: 2692153 - RNA, 21 nt, Human
cugauguuccuagugaaagag

SEQ ID NO: 2692154 - RNA, 23 nt, Human
cugcagaagacaguauggcagcu

SEQ ID NO: 2692155 - RNA, 13 nt, Human
cugcagaagacag

SEQ ID NO: 2692156 - RNA, 15 nt, Human
cugccuaagugcagc

SEQ ID NO: 2692157 - RNA, 13 nt, Human
cugcugaaacaac

SEQ ID NO: 2692158 - RNA, 23 nt, Human
cuggaauaauccuaaacauauga

SEQ ID NO: 2692159 - RNA, 16 nt, Human
cuggccaacgggguga

SEQ ID NO: 2692160 - RNA, 18 nt, Human
cuggcacaguuuucugag

SEQ ID NO: 2692161 - RNA, 19 nt, Human
cuggcacaguuuucugaga

SEQ ID NO: 2692162 - RNA, 22 nt, Human
cugggaacccaaguccaagcau

SEQ ID NO: 2692163 - RNA, 21 nt, Human
cuggucccagccagcaguuca

SEQ ID NO: 2692164 - RNA, 22 nt, Human
ccgggaggcagagguugcagug

SEQ ID NO: 2692165 - RNA, 16 nt, Human
cccuugaugaagaagu

SEQ ID NO: 2692166 - RNA, 15 nt, Human
cccuugaugaagaag

SEQ ID NO: 2692167 - RNA, 23 nt, Human
ccucuuagaugcaguucugaaga

SEQ ID NO: 2692168 - RNA, 23 nt, Human
ccugaaagaggaaugaaguacuc

SEQ ID NO: 2692169 - RNA, 18 nt, Human
ccugaaagaggaaugaag

SEQ ID NO: 2692170 - RNA, 18 nt, Human
ccugaggcuccacuuggu

SEQ ID NO: 2692171 - RNA, 20 nt, Human
ccugaggcuccacuuggucu

SEQ ID NO: 2692172 - RNA, 17 nt, Human
ccugaggcuccacuugg

SEQ ID NO: 2692173 - RNA, 14 nt, Human
ccucuccugggcag

SEQ ID NO: 2692174 - RNA, 13 nt, Human
ccucuccugggca

SEQ ID NO: 2692175 - RNA, 12 nt, Human
ccucuccugggc

SEQ ID NO: 2692176 - RNA, 11 nt, Human
ccucuccuggg

SEQ ID NO: 2692177 - RNA, 21 nt, Human
ccucugcuugccaucccuccc

SEQ ID NO: 2692178 - RNA, 20 nt, Human
ccucugcuugccaucccucc

SEQ ID NO: 2692179 - RNA, 20 nt, Human
ccucagaaaacaaggaugaa

SEQ ID NO: 2692180 - RNA, 14 nt, Human
ccuccccuccucug

SEQ ID NO: 2692181 - RNA, 15 nt, Human
ccuccccuccucugc

SEQ ID NO: 2692182 - RNA, 11 nt, Human
ccuccucugcu

SEQ ID NO: 2692183 - RNA, 16 nt, Human
ccucccugcaauaaaa

SEQ ID NO: 2692184 - RNA, 12 nt, Human
ccucccugcaau

SEQ ID NO: 2692185 - RNA, 18 nt, Human
ccuccccuccucugcuug

SEQ ID NO: 2692186 - RNA, 17 nt, Human
ccuccccuccucugcuu

SEQ ID NO: 2692187 - RNA, 18 nt, Human
ccugggcagcugccuccc

SEQ ID NO: 2692188 - RNA, 17 nt, Human
ccugggcagcugccucc

SEQ ID NO: 2692189 - RNA, 16 nt, Human
ccugggcagcugccuc

SEQ ID NO: 2692190 - RNA, 15 nt, Human
ccugggcagcugccu

SEQ ID NO: 2692191 - RNA, 20 nt, Human
ccugggcagcugccuccccu

SEQ ID NO: 2692192 - RNA, 11 nt, Human
cgcaaugugac

SEQ ID NO: 2692193 - RNA, 16 nt, Human
cggccuccauccugag

SEQ ID NO: 2692194 - RNA, 17 nt, Human
cggccuccauccugagg

SEQ ID NO: 2692195 - RNA, 18 nt, Human
cauuugcucauggaauug

SEQ ID NO: 2692196 - RNA, 13 nt, Human
cauuugcucaugg

SEQ ID NO: 2692197 - RNA, 17 nt, Human
cauuuaggccaugggac

SEQ ID NO: 2692198 - RNA, 22 nt, Human
ccaagcauaccaacacgagcag

SEQ ID NO: 2692199 - RNA, 17 nt, Human
ccaagcauuuagaugua

SEQ ID NO: 2692200 - RNA, 14 nt, Human
ccaagcaaguauua

SEQ ID NO: 2692201 - RNA, 23 nt, Human
ccaaauuucauaccuaucaucuu

SEQ ID NO: 2692202 - RNA, 22 nt, Human
ccaaacugacucuuaagaagac

SEQ ID NO: 2692203 - RNA, 20 nt, Human
ccacaggaaccacaagacug

SEQ ID NO: 2692204 - RNA, 16 nt, Human
ccaauauucauagcag

SEQ ID NO: 2692205 - RNA, 13 nt, Human
ccacugcagaaga

SEQ ID NO: 2692206 - RNA, 18 nt, Human
ccacugcagaagacagua

SEQ ID NO: 2692207 - RNA, 17 nt, Human
ccaggugccaguuaugg

SEQ ID NO: 2692208 - RNA, 13 nt, Human
cccaaaaggcaga

SEQ ID NO: 2692209 - RNA, 18 nt, Human
cccaaaaggcagaagcaa

SEQ ID NO: 2692210 - RNA, 14 nt, Human
ccaugaagauguag

SEQ ID NO: 2692211 - RNA, 16 nt, Human
ccaugauguuuagaaa

SEQ ID NO: 2692212 - RNA, 18 nt, Human
ccaucaaggguacacugc

SEQ ID NO: 2692213 - RNA, 13 nt, Human
cccaggugccagu

SEQ ID NO: 2692214 - RNA, 15 nt, Human
gcucugcccauccug

SEQ ID NO: 2692215 - RNA, 21 nt, Human
gcucugcccauccugccccug

SEQ ID NO: 2692216 - RNA, 12 nt, Human
gcugaacaucac

SEQ ID NO: 2692217 - RNA, 16 nt, Human
gcugaaacaacaaaua

SEQ ID NO: 2692218 - RNA, 20 nt, Human
gcuccacuuggucugugaga

SEQ ID NO: 2692219 - RNA, 12 nt, Human
gcuguauuuuaa

SEQ ID NO: 2692220 - RNA, 13 nt, Human
gcuguauuuuaaa

SEQ ID NO: 2692221 - RNA, 17 nt, Human
gcuuauuuccucauuuu

SEQ ID NO: 2692222 - RNA, 19 nt, Human
gcuuccuggcaauagucaa

SEQ ID NO: 2692223 - RNA, 16 nt, Human
gccuccauccugaggc

SEQ ID NO: 2692224 - RNA, 20 nt, Human
gccuccauccugaggcucca

SEQ ID NO: 2692225 - RNA, 17 nt, Human
gcuacuugggaggcuga

SEQ ID NO: 2692226 - RNA, 15 nt, Human
gcuacugucagcucc

SEQ ID NO: 2692227 - RNA, 18 nt, Human
gcuacaaaaacacagcaa

SEQ ID NO: 2692228 - RNA, 19 nt, Human
gcuacaaaaacacagcaag

SEQ ID NO: 2692229 - RNA, 17 nt, Human
gcuacaaaaacacagca

SEQ ID NO: 2692230 - RNA, 18 nt, Human
gccccacccucagaugca

SEQ ID NO: 2692231 - RNA, 15 nt, Human
gccccacccucagau

SEQ ID NO: 2692232 - RNA, 22 nt, Human
gccaugugcuaguaauuggaaa

SEQ ID NO: 2692233 - RNA, 19 nt, Human
gccagcaguucagagcugc

SEQ ID NO: 2692234 - RNA, 14 nt, Human
gccagcaguucaga

SEQ ID NO: 2692235 - RNA, 13 nt, Human
gccagcaguucag

SEQ ID NO: 2692236 - RNA, 21 nt, Human
gccagcaguucagagcugccc

SEQ ID NO: 2692237 - RNA, 20 nt, Human
gccagcaguucagagcugcc

SEQ ID NO: 2692238 - RNA, 22 nt, Human
gccaguuauggcuauaggugcu

SEQ ID NO: 2692239 - RNA, 16 nt, Human
gccauaugaaaaggcu

SEQ ID NO: 2692240 - RNA, 22 nt, Human
ggauguugaaaaaguucugcag

SEQ ID NO: 2692241 - RNA, 12 nt, Human
ggauggcaagau

SEQ ID NO: 2692242 - RNA, 13 nt, Human
ggccuccauccug

SEQ ID NO: 2692243 - RNA, 23 nt, Human
ggccuucggccuccauccugagg

SEQ ID NO: 2692244 - RNA, 19 nt, Human
gggacauuugcucauggaa

SEQ ID NO: 2692245 - RNA, 21 nt, Human
gggacauuugcucauggaauu

SEQ ID NO: 2692246 - RNA, 20 nt, Human
gggacauuugcucauggaau

SEQ ID NO: 2692247 - RNA, 13 nt, Human
aaaaccacagcag

SEQ ID NO: 2692248 - RNA, 14 nt, Human
aaaaccacagcagu

SEQ ID NO: 2692249 - RNA, 17 nt, Human
aaaagaugaaaauauuu

SEQ ID NO: 2692250 - RNA, 13 nt, Human
aaaacucauuuuu

SEQ ID NO: 2692251 - RNA, 22 nt, Human
aaaaauggaacauaaaauacaa

SEQ ID NO: 2692252 - RNA, 12 nt, Human
aaaaccacagca

SEQ ID NO: 2692253 - RNA, 16 nt, Human
gggauuguaaaauggu

SEQ ID NO: 2692254 - RNA, 17 nt, Human
gggauuguaaaauggug

SEQ ID NO: 2692255 - RNA, 15 nt, Human
aaaaugugauaugua

SEQ ID NO: 2692256 - RNA, 22 nt, Human
aaaauuuuuucucuaggaaaua

SEQ ID NO: 2692257 - RNA, 20 nt, Human
aaacaagcacuaaacaaaga

SEQ ID NO: 2692258 - RNA, 20 nt, Human
aaacagucucaggaaaucaa

SEQ ID NO: 2692259 - RNA, 15 nt, Human
gggcgugguggugag

SEQ ID NO: 2692260 - RNA, 19 nt, Human
aaaaguauguuagugcaaa

SEQ ID NO: 2692261 - RNA, 14 nt, Human
aaagacuauucaaa

SEQ ID NO: 2692262 - RNA, 15 nt, Human
aaagacuauucaaac

SEQ ID NO: 2692263 - RNA, 17 nt, Human
aaagcagggacuugaac

SEQ ID NO: 2692264 - RNA, 16 nt, Human
ggugugaccacugcag

SEQ ID NO: 2692265 - RNA, 16 nt, Human
gguuuagaaagcuugc

SEQ ID NO: 2692266 - RNA, 20 nt, Human
aaauaauuuuuauauuugaa

SEQ ID NO: 2692267 - RNA, 18 nt, Human
aaauaauuuuuauauuug

SEQ ID NO: 2692268 - RNA, 15 nt, Human
aaauaauuuuuauau

SEQ ID NO: 2692269 - RNA, 20 nt, Human
gaaugagagacacacugaag

SEQ ID NO: 2692270 - RNA, 23 nt, Human
gaaugagagacacacugaagaag

SEQ ID NO: 2692271 - RNA, 22 nt, Human
gaaugagagacacacugaagaa

SEQ ID NO: 2692272 - RNA, 14 nt, Human
gacacacugaagaa

SEQ ID NO: 2692273 - RNA, 12 nt, Human
gacacacaugaa

SEQ ID NO: 2692274 - RNA, 13 nt, Human
gacacacugaaga

SEQ ID NO: 2692275 - RNA, 11 nt, Human
gaauuaguuuu

SEQ ID NO: 2692276 - RNA, 14 nt, Human
gacagugaaagaaa

SEQ ID NO: 2692277 - RNA, 17 nt, Human
gacagucaccucaugga

SEQ ID NO: 2692278 - RNA, 16 nt, Human
gacacuuaaaaauggu

SEQ ID NO: 2692279 - RNA, 22 nt, Human
gacuauucaaacagucucagga

SEQ ID NO: 2692280 - RNA, 16 nt, Human
gacucuuaagaagacu

SEQ ID NO: 2692281 - RNA, 15 nt, Human
gacucuuaagaagac

SEQ ID NO: 2692282 - RNA, 18 nt, Human
gacucuuaagaagacugc

SEQ ID NO: 2692283 - RNA, 17 nt, Human
gacucuuaagaagacug

SEQ ID NO: 2692284 - RNA, 14 nt, Human
gagaaucacuugaa

SEQ ID NO: 2692285 - RNA, 15 nt, Human
gagaaucacuugaac

SEQ ID NO: 2692286 - RNA, 19 nt, Human
gcagggacuugaacccaua

SEQ ID NO: 2692287 - RNA, 22 nt, Human
gcagcugccuccccuccucugc

SEQ ID NO: 2692288 - RNA, 18 nt, Human
gcagcugccuccccuccu

SEQ ID NO: 2692289 - RNA, 17 nt, Human
gcagcugccuccccucc

SEQ ID NO: 2692290 - RNA, 16 nt, Human
gcagcugccuccccuc

SEQ ID NO: 2692291 - RNA, 15 nt, Human
gcagcugccuccccu

SEQ ID NO: 2692292 - RNA, 13 nt, Human
gcagcugccuccc

SEQ ID NO: 2692293 - RNA, 12 nt, Human
gcagcugccucc

SEQ ID NO: 2692294 - RNA, 11 nt, Human
gcagcugccuc

SEQ ID NO: 2692295 - RNA, 21 nt, Human
gcacaugagcuggcgggauug

SEQ ID NO: 2692296 - RNA, 14 nt, Human
gcacaguuuucuga

SEQ ID NO: 2692297 - RNA, 17 nt, Human
gcacaguuuucugagaa

SEQ ID NO: 2692298 - RNA, 18 nt, Human
gcacaguuuucugagaaa

SEQ ID NO: 2692299 - RNA, 17 nt, Human
gauuagggagagaagau

SEQ ID NO: 2692300 - RNA, 14 nt, Human
gaugugaacacauc

SEQ ID NO: 2692301 - RNA, 16 nt, Human
gaugugaacacaucag

SEQ ID NO: 2692302 - RNA, 14 nt, Human
gauuaccagggacu

SEQ ID NO: 2692303 - RNA, 20 nt, Human
gauauguaccuaacgaagua

SEQ ID NO: 2692304 - RNA, 16 nt, Human
gaguuuagcuggaaaa

SEQ ID NO: 2692305 - RNA, 21 nt, Human
gagugcucaguagucagacug

SEQ ID NO: 2692306 - RNA, 10 nt, Human
cugggacagg

SEQ ID NO: 2692307 - RNA, 22 nt, Human
cugggcagcugccuccccuccu

SEQ ID NO: 2692308 - RNA, 21 nt, Human
cugggcagcugccuccccucc

SEQ ID NO: 2692309 - RNA, 20 nt, Human
cugggcagcugccuccccuc

SEQ ID NO: 2692310 - RNA, 19 nt, Human
cugggcagcugccuccccu

SEQ ID NO: 2692311 - RNA, 16 nt, Human
cugggcagcugccucc

SEQ ID NO: 2692312 - RNA, 16 nt, Human
cugugagaugcuagaa

SEQ ID NO: 2692313 - RNA, 21 nt, Human
cugucagcuccccucggagaa

SEQ ID NO: 2692314 - RNA, 23 nt, Human
cugucagcuccccucggagaaga

SEQ ID NO: 2692315 - RNA, 21 nt, Human
cuggaaaucaggguuaguauu

SEQ ID NO: 2692316 - RNA, 14 nt, Human
gaaagacuauucaa

SEQ ID NO: 2692317 - RNA, 15 nt, Human
gaaagacuauucaaa

SEQ ID NO: 2692318 - RNA, 17 nt, Human
gaaagacuauucaaaca

SEQ ID NO: 2692319 - RNA, 19 nt, Human
gaaaucaaauaugcaaagc

SEQ ID NO: 2692320 - RNA, 20 nt, Human
gaaaucaaauaugcaaagca

SEQ ID NO: 2692321 - RNA, 22 nt, Human
gaaauauuuauuuuaauaaugu

SEQ ID NO: 2692322 - RNA, 18 nt, Human
gaaauauuuauuuuaaua

SEQ ID NO: 2692323 - RNA, 18 nt, Human
gaaaucaaauaugcaaag

SEQ ID NO: 2692324 - RNA, 17 nt, Human
gaaauauuuauuuuaau

SEQ ID NO: 2692325 - RNA, 15 nt, Human
cuucacuguaaaaua

SEQ ID NO: 2692326 - RNA, 22 nt, Human
cuucuaaguaaaaccacagcag

SEQ ID NO: 2692327 - RNA, 23 nt, Human
cuucuaaguaaaaccacagcagu

SEQ ID NO: 2692328 - RNA, 12 nt, Human
cuugaugaagaa

SEQ ID NO: 2692329 - RNA, 13 nt, Human
cuugaugaagaag

SEQ ID NO: 2692330 - RNA, 20 nt, Human
cucuuagaugcaguucugaa

SEQ ID NO: 2692331 - RNA, 15 nt, Human
cucuuagaugcaguu

SEQ ID NO: 2692332 - RNA, 12 nt, Human
cucucuggccuu

SEQ ID NO: 2692333 - RNA, 11 nt, Human
cucucuggccu

SEQ ID NO: 2692334 - RNA, 16 nt, Human
cucccugcaauaaaau

SEQ ID NO: 2692335 - RNA, 14 nt, Human
cucccugcaauaaa

SEQ ID NO: 2692336 - RNA, 21 nt, Human
cuccagugagacagcucugca

SEQ ID NO: 2692337 - RNA, 23 nt, Human
cuaguugaucagcuuauugucua

SEQ ID NO: 2692338 - RNA, 16 nt, Human
cuagaacucccuuuca

SEQ ID NO: 2692339 - RNA, 17 nt, Human
cuagaacucccuuucaa

SEQ ID NO: 2692340 - RNA, 18 nt, Human
cuagaacucccuuucaac

SEQ ID NO: 2692341 - RNA, 19 nt, Human
cuagaacucccuuucaaca

SEQ ID NO: 2692342 - RNA, 15 nt, Human
cguggugauuuagca

SEQ ID NO: 2692343 - RNA, 15 nt, Human
cuacaugagguacug

SEQ ID NO: 2692344 - RNA, 20 nt, Human
cuaagugaaauaagccagac

SEQ ID NO: 2692345 - RNA, 23 nt, Human
cuaagugaaauaagccagacauc

SEQ ID NO: 2692346 - RNA, 15 nt, Human
cgacagugagacucu

SEQ ID NO: 2692347 - RNA, 16 nt, Human
cgacagugagacucug

SEQ ID NO: 2692348 - RNA, 17 nt, Human
cccuucuuuccacagaa

SEQ ID NO: 2692349 - RNA, 13 nt, Human
cccuucucuguau

SEQ ID NO: 2692350 - RNA, 24 nt, Human
ccguagacgugcacgcacacuguc

SEQ ID NO: 2692351 - RNA, 16 nt, Human
ccguagguuauuuuca

SEQ ID NO: 2692352 - RNA, 20 nt, Human
ccucauguccacugguucuu

SEQ ID NO: 2692353 - RNA, 15 nt, Human
ccucauguccacugg

SEQ ID NO: 2692354 - RNA, 17 nt, Human
ccucugcuugccauccc

SEQ ID NO: 2692355 - RNA, 13 nt, Human
ccucugcuugcca

SEQ ID NO: 2692356 - RNA, 15 nt, Human
ccagauccuggaaau

SEQ ID NO: 2692357 - RNA, 23 nt, Human
cccgggaggcagagguugcagug

SEQ ID NO: 2692358 - RNA, 22 nt, Human
cccauuguggucacaggaagua

SEQ ID NO: 2692359 - RNA, 23 nt, Human
cccauuguggucacaggaaguag

SEQ ID NO: 2692360 - RNA, 20 nt, Human
cccagccagcaguucagagc

SEQ ID NO: 2692361 - RNA, 17 nt, Human
cccagccagcaguucag

SEQ ID NO: 2692362 - RNA, 16 nt, Human
cccagccagcaguuca

SEQ ID NO: 2692363 - RNA, 20 nt, Human
cccauauuuguacaccaaua

SEQ ID NO: 2692364 - RNA, 22 nt, Human
cagcaguucagagcugcccucu

SEQ ID NO: 2692365 - RNA, 21 nt, Human
cagcaguucagagcugcccuc

SEQ ID NO: 2692366 - RNA, 20 nt, Human
cagcaguucagagcugcccu

SEQ ID NO: 2692367 - RNA, 19 nt, Human
cagcaguucagagcugccc

SEQ ID NO: 2692368 - RNA, 18 nt, Human
cagcaguucagagcugcc

SEQ ID NO: 2692369 - RNA, 19 nt, Human
cagccccgugggguuccuc

SEQ ID NO: 2692370 - RNA, 23 nt, Human
cagccugagcgacagugagacuc

SEQ ID NO: 2692371 - RNA, 22 nt, Human
cagggaggacgcucucuggccu

SEQ ID NO: 2692372 - RNA, 19 nt, Human
cagggaggacgcucucugg

SEQ ID NO: 2692373 - RNA, 16 nt, Human
cagcuuauucacaaga

SEQ ID NO: 2692374 - RNA, 17 nt, Human
cagcuuauucacaagac

SEQ ID NO: 2692375 - RNA, 19 nt, Human
caggaaaucaaauaugcaa

SEQ ID NO: 2692376 - RNA, 21 nt, Human
caggaaaucaaauaugcaaag

SEQ ID NO: 2692377 - RNA, 22 nt, Human
caggaaaucaaauaugcaaagc

SEQ ID NO: 2692378 - RNA, 24 nt, Human
caggacagcccuucuuuccacaga

SEQ ID NO: 2692379 - RNA, 23 nt, Human
caggacagcccuucuuuccacag

SEQ ID NO: 2692380 - RNA, 18 nt, Human
ccaaauguucaucaauga

SEQ ID NO: 2692381 - RNA, 15 nt, Human
cauuaggauggcuag

SEQ ID NO: 2692382 - RNA, 12 nt, Human
cauuuccaagca

SEQ ID NO: 2692383 - RNA, 17 nt, Human
cauagauucccugagca

SEQ ID NO: 2692384 - RNA, 18 nt, Human
cauagauucccugagcag

SEQ ID NO: 2692385 - RNA, 20 nt, Human
cauagcagcuuauucacaag

SEQ ID NO: 2692386 - RNA, 17 nt, Human
caucagcugcugaaaca

SEQ ID NO: 2692387 - RNA, 18 nt, Human
caucagcugcugaaacaa

SEQ ID NO: 2692388 - RNA, 15 nt, Human
caucagcugcugaaa

SEQ ID NO: 2692389 - RNA, 20 nt, Human
caucagcuugcccuguuaaa

SEQ ID NO: 2692390 - RNA, 16 nt, Human
caugaauuaguuuuau

SEQ ID NO: 2692391 - RNA, 22 nt, Human
cacugguucuucuuggucucag

SEQ ID NO: 2692392 - RNA, 16 nt, Human
cacuugucaauaaaau

SEQ ID NO: 2692393 - RNA, 19 nt, Human
cacuuguguuuugcaagcc

SEQ ID NO: 2692394 - RNA, 22 nt, Human
cacuuguguuuugcaagccaga

SEQ ID NO: 2692395 - RNA, 21 nt, Human
cacugcagaagacaguauggc

SEQ ID NO: 2692396 - RNA, 20 nt, Human
cacuagggcagggacaggau

SEQ ID NO: 2692397 - RNA, 21 nt, Human
cacuagggcagggacaggaua

SEQ ID NO: 2692398 - RNA, 14 nt, Human
caaguccaagcaua

SEQ ID NO: 2692399 - RNA, 15 nt, Human
caauucuugccaaau

SEQ ID NO: 2692400 - RNA, 17 nt, Human
caaugcuguauuuuaaa

SEQ ID NO: 2692401 - RNA, 16 nt, Human
caaugcuguauuuuaa

SEQ ID NO: 2692402 - RNA, 15 nt, Human
caaugcuguauuuua

SEQ ID NO: 2692403 - RNA, 18 nt, Human
cacaagacugcacaucaa

SEQ ID NO: 2692404 - RNA, 22 nt, Human
cacacaugaaguccaagcauuu

SEQ ID NO: 2692405 - RNA, 17 nt, Human
cacacaugaaguccaag

SEQ ID NO: 2692406 - RNA, 21 nt, Human
cacagccucuuagaugcaguu

SEQ ID NO: 2692407 - RNA, 17 nt, Human
cacagccucuuagaugc

SEQ ID NO: 2692408 - RNA, 14 nt, Human
auuguaaaauggug

SEQ ID NO: 2692409 - RNA, 23 nt, Human
auuguaauaggcguaacuaauuu

SEQ ID NO: 2692410 - RNA, 19 nt, Human
auucauagcagcuuauuca

SEQ ID NO: 2692411 - RNA, 22 nt, Human
auucauagcagcuuauucacaa

SEQ ID NO: 2692412 - RNA, 18 nt, Human
auuaugaauuacauuugu

SEQ ID NO: 2692413 - RNA, 19 nt, Human
auucacaagacccaaaagg

SEQ ID NO: 2692414 - RNA, 16 nt, Human
auuagggagagaagau

SEQ ID NO: 2692415 - RNA, 17 nt, Human
auuaugaauuacauuug

SEQ ID NO: 2692416 - RNA, 14 nt, Human
auuaugaauuacau

SEQ ID NO: 2692417 - RNA, 17 nt, Human
auuuuauagcuacuaau

SEQ ID NO: 2692418 - RNA, 19 nt, Human
auuuuauagcuacuaauuu

SEQ ID NO: 2692419 - RNA, 17 nt, Human
auuugcucauggaauug

SEQ ID NO: 2692420 - RNA, 14 nt, Human
auuugcucauggaa

SEQ ID NO: 2692421 - RNA, 13 nt, Human
caaacccaguguu

SEQ ID NO: 2692422 - RNA, 24 nt, Human
caaacccaguguuuuaggagcaug

SEQ ID NO: 2692423 - RNA, 15 nt, Human
caaaaggcagaagca

SEQ ID NO: 2692424 - RNA, 20 nt, Human
caaaaaaaaaaaaaaauuag

SEQ ID NO: 2692425 - RNA, 20 nt, Human
caaagcacugacuucuaagu

SEQ ID NO: 2692426 - RNA, 22 nt, Human
caaagcacugacuucuaaguaa

SEQ ID NO: 2692427 - RNA, 23 nt, Human
caacacgagcaggcuacugucag

SEQ ID NO: 2692428 - RNA, 15 nt, Human
caaauccuugaagau

SEQ ID NO: 2692429 - RNA, 19 nt, Human
augagagacacacugaaga

SEQ ID NO: 2692430 - RNA, 17 nt, Human
augagagacacacugaa

SEQ ID NO: 2692431 - RNA, 14 nt, Human
augagagacacacu

SEQ ID NO: 2692432 - RNA, 13 nt, Human
augagagacacac

SEQ ID NO: 2692433 - RNA, 17 nt, Human
uuguauaaaauaauuuu

SEQ ID NO: 2692434 - RNA, 16 nt, Human
uuguaucacaaaucuu

SEQ ID NO: 2692435 - RNA, 15 nt, Human
uuguauaaaauaauu

SEQ ID NO: 2692436 - RNA, 16 nt, Human
uuguauaaaauaauuu

SEQ ID NO: 2692437 - RNA, 18 nt, Human
augaagauguagaggaga

SEQ ID NO: 2692438 - RNA, 13 nt, Human
augaaugaauggc

SEQ ID NO: 2692439 - RNA, 17 nt, Human
augaaauauuauguuaa

SEQ ID NO: 2692440 - RNA, 13 nt, Human
augaaauauuaug

SEQ ID NO: 2692441 - RNA, 18 nt, Human
augaaauauuauguuaaa

SEQ ID NO: 2692442 - RNA, 15 nt, Human
augaaagcagggacu

SEQ ID NO: 2692443 - RNA, 13 nt, Human
aucuuuuucuaac

SEQ ID NO: 2692444 - RNA, 18 nt, Human
uugauggugguauguuuu

SEQ ID NO: 2692445 - RNA, 19 nt, Human
uugauggugguauguuuuc

SEQ ID NO: 2692446 - RNA, 23 nt, Human
aucucauuuccaagcaaguauua

SEQ ID NO: 2692447 - RNA, 21 nt, Human
aucucauuuccaagcaaguau

SEQ ID NO: 2692448 - RNA, 13 nt, Human
aucucaauauuuc

SEQ ID NO: 2692449 - RNA, 13 nt, Human
uugcccuguuaaa

SEQ ID NO: 2692450 - RNA, 22 nt, Human
uuuagcuggaaaaguauguuag

SEQ ID NO: 2692451 - RNA, 20 nt, Human
uuuagcuggaaaaguauguu

SEQ ID NO: 2692452 - RNA, 13 nt, Human
uuuauauaagcuu

SEQ ID NO: 2692453 - RNA, 15 nt, Human
augcuagaacucccu

SEQ ID NO: 2692454 - RNA, 16 nt, Human
augcuagaacucccuu

SEQ ID NO: 2692455 - RNA, 19 nt, Human
augcuagaacucccuuuca

SEQ ID NO: 2692456 - RNA, 22 nt, Human
augcugucuacacuaagagaga

SEQ ID NO: 2692457 - RNA, 20 nt, Human
auggcuaguaucaaaagaaa

SEQ ID NO: 2692458 - RNA, 17 nt, Human
augcaguucugaagaag

SEQ ID NO: 2692459 - RNA, 15 nt, Human
augcaguucugaaga

SEQ ID NO: 2692460 - RNA, 19 nt, Human
augcaguucugaagaagau

SEQ ID NO: 2692461 - RNA, 18 nt, Human
augcaguucugaagaaga

SEQ ID NO: 2692462 - RNA, 15 nt, Human
augccacuaaauuga

SEQ ID NO: 2692463 - RNA, 17 nt, Human
augccacuaaauugaca

SEQ ID NO: 2692464 - RNA, 14 nt, Human
uuguuuucauuauc

SEQ ID NO: 2692465 - RNA, 15 nt, Human
augcaaagcacugac

SEQ ID NO: 2692466 - RNA, 12 nt, Human
augauucccagc

SEQ ID NO: 2692467 - RNA, 22 nt, Human
augauuaugaauuacauuugua

SEQ ID NO: 2692468 - RNA, 21 nt, Human
augagagacacacugaagaag

SEQ ID NO: 2692469 - RNA, 20 nt, Human
augagagacacacugaagaa

SEQ ID NO: 2692470 - RNA, 23 nt, Human
augagagacacacugaagaagca

SEQ ID NO: 2692471 - RNA, 23 nt, Human
uugugugaaagguacuucaaauc

SEQ ID NO: 2692472 - RNA, 19 nt, Human
uugaaauauugacuuuuua

SEQ ID NO: 2692473 - RNA, 14 nt, Human
auccauacauuugu

SEQ ID NO: 2692474 - RNA, 20 nt, Human
aucauuucugcaucagcugc

SEQ ID NO: 2692475 - RNA, 13 nt, Human
uucuauaauuuaa

SEQ ID NO: 2692476 - RNA, 14 nt, Human
uucuauaauuuaaa

SEQ ID NO: 2692477 - RNA, 21 nt, Human
uucuaaguaaaaccacagcag

SEQ ID NO: 2692478 - RNA, 19 nt, Human
uucuaaguaaaaccacagc

SEQ ID NO: 2692479 - RNA, 20 nt, Human
uucuaaguaaaaccacagca

SEQ ID NO: 2692480 - RNA, 17 nt, Human
uucuaaguaaaaccaca

SEQ ID NO: 2692481 - RNA, 20 nt, Human
aucaaauaugcaaagcacug

SEQ ID NO: 2692482 - RNA, 12 nt, Human
uucccaaauuuc

SEQ ID NO: 2692483 - RNA, 18 nt, Human
uucccaacuccagaaagu

SEQ ID NO: 2692484 - RNA, 18 nt, Human
uucaaacagucucaggaa

SEQ ID NO: 2692485 - RNA, 14 nt, Human
uucaaacauauaua

SEQ ID NO: 2692486 - RNA, 22 nt, Human
auaggaauugacccacaagaaa

SEQ ID NO: 2692487 - RNA, 17 nt, Human
auaggcguaacuaauuu

SEQ ID NO: 2692488 - RNA, 23 nt, Human
uucacaagacccaaaaggcagaa

SEQ ID NO: 2692489 - RNA, 20 nt, Human
auaguuguaccgcaauguga

SEQ ID NO: 2692490 - RNA, 17 nt, Human
auauaacaaugcuguau

SEQ ID NO: 2692491 - RNA, 14 nt, Human
auauauaacaaugc

SEQ ID NO: 2692492 - RNA, 18 nt, Human
auuuguaguguuggagaa

SEQ ID NO: 2692493 - RNA, 23 nt, Human
auuugguaaggggaauugaggac

SEQ ID NO: 2692494 - RNA, 22 nt, Human
auuuauuacuguaagaaaauau

SEQ ID NO: 2692495 - RNA, 15 nt, Human
auuuguaucacaaau

SEQ ID NO: 2692496 - RNA, 21 nt, Human
auuuguauaaaauaauuuuua

SEQ ID NO: 2692497 - RNA, 16 nt, Human
auuuuaauaauguuuc

SEQ ID NO: 2692498 - RNA, 15 nt, Human
auuuuaauaauguuu

SEQ ID NO: 2692499 - RNA, 14 nt, Human
auuuuaauaauguu

SEQ ID NO: 2692500 - RNA, 21 nt, Human
auugacccacaagaaaugaaa

SEQ ID NO: 2692501 - RNA, 20 nt, Human
auugacacuuaaaaaugguu

SEQ ID NO: 2692502 - RNA, 13 nt, Human
auugugccccugc

SEQ ID NO: 2692503 - RNA, 15 nt, Human
auuguauuacaaauc

SEQ ID NO: 2692504 - RNA, 14 nt, Human
auuguauuacaaau

SEQ ID NO: 2692505 - RNA, 19 nt, Human
auuuaaagcuuauuaaaac

SEQ ID NO: 2692506 - RNA, 16 nt, Human
auuuacaaaugggaaa

SEQ ID NO: 2692507 - RNA, 20 nt, Human
auuccacuuauaggaauuga

SEQ ID NO: 2692508 - RNA, 14 nt, Human
auucaaacagucuc

SEQ ID NO: 2692509 - RNA, 15 nt, Human
auucaaacagucuca

SEQ ID NO: 2692510 - RNA, 13 nt, Human
auuacauuuguau

SEQ ID NO: 2692511 - RNA, 16 nt, Human
auuacauuuguauaaa

SEQ ID NO: 2692512 - RNA, 15 nt, Human
auuacauuuguauaa

SEQ ID NO: 2692513 - RNA, 23 nt, Human
uuuuuuaaaaaagaaacauuugg

SEQ ID NO: 2692514 - RNA, 15 nt, Human
auuaaguaaugauaa

SEQ ID NO: 2692515 - RNA, 13 nt, Human
auuaaguaaugau

SEQ ID NO: 2692516 - RNA, 16 nt, Human
auuauauuuacaaaug

SEQ ID NO: 2692517 - RNA, 20 nt, Human
auuauuaccuuacagaaguu

SEQ ID NO: 2692518 - RNA, 18 nt, Human
auuaucucaaaacugcac

SEQ ID NO: 2692519 - RNA, 23 nt, Human
auuaucucaaaacugcacuguca

SEQ ID NO: 2692520 - RNA, 17 nt, Human
auuauauuuacaaaugg

SEQ ID NO: 2692521 - RNA, 14 nt, Human
uuuuauaauuuugu

SEQ ID NO: 2692522 - RNA, 23 nt, Human
uuuuauggaggcuuugcauagau

SEQ ID NO: 2692523 - RNA, 19 nt, Human
uuuuauggcacuaguauuu

SEQ ID NO: 2692524 - RNA, 19 nt, Human
auguucaucaaugaaugaa

SEQ ID NO: 2692525 - RNA, 15 nt, Human
auguugacaugggac

SEQ ID NO: 2692526 - RNA, 16 nt, Human
auuaaaagaauauuuu

SEQ ID NO: 2692527 - RNA, 18 nt, Human
auguuucaaacauauaua

SEQ ID NO: 2692528 - RNA, 21 nt, Human
auguuucaaacauauauaaca

SEQ ID NO: 2692529 - RNA, 13 nt, Human
uuuuaaaaaagaa

SEQ ID NO: 2692530 - RNA, 15 nt, Human
uuuuaaaagaaugau

SEQ ID NO: 2692531 - RNA, 14 nt, Human
uuuuaaaagaauga

SEQ ID NO: 2692532 - RNA, 12 nt, Human
uuugcucaugga

SEQ ID NO: 2692533 - RNA, 11 nt, Human
uuugcucaugg

SEQ ID NO: 2692534 - RNA, 15 nt, Human
auggcuauaggugcu

SEQ ID NO: 2692535 - RNA, 13 nt, Human
uuugcucauggaa

SEQ ID NO: 2692536 - RNA, 15 nt, Human
auaaauaguuuauga

SEQ ID NO: 2692537 - RNA, 14 nt, Human
auaaauaaaaauaa

SEQ ID NO: 2692538 - RNA, 13 nt, Human
auaaauaaaaaua

SEQ ID NO: 2692539 - RNA, 22 nt, Human
auaacgauaaaagacagugaaa

SEQ ID NO: 2692540 - RNA, 14 nt, Human
uuagggagagaaga

SEQ ID NO: 2692541 - RNA, 18 nt, Human
auaauccuaaacauauga

SEQ ID NO: 2692542 - RNA, 14 nt, Human
aguuuaaauuguaa

SEQ ID NO: 2692543 - RNA, 13 nt, Human
uguuucaaacaua

SEQ ID NO: 2692544 - RNA, 12 nt, Human
auaaaauaauuu

SEQ ID NO: 2692545 - RNA, 15 nt, Human
auaaaauaauuuuua

SEQ ID NO: 2692546 - RNA, 19 nt, Human
aguuuucugagaaagacua

SEQ ID NO: 2692547 - RNA, 18 nt, Human
aguuuucugagaaagacu

SEQ ID NO: 2692548 - RNA, 23 nt, Human
aguuuucugagaaagacuauuca

SEQ ID NO: 2692549 - RNA, 19 nt, Human
aguucggugagcuacaaau

SEQ ID NO: 2692550 - RNA, 16 nt, Human
aguguuggagaagaac

SEQ ID NO: 2692551 - RNA, 14 nt, Human
aguguuggagaaga

SEQ ID NO: 2692552 - RNA, 18 nt, Human
aguguuggagaagaacug

SEQ ID NO: 2692553 - RNA, 17 nt, Human
aguguuggagaagaacu

SEQ ID NO: 2692554 - RNA, 23 nt, Human
aguguuggagaagaacugaaauc

SEQ ID NO: 2692555 - RNA, 21 nt, Human
agugcaaauugucacaggaca

SEQ ID NO: 2692556 - RNA, 18 nt, Human
agugcaaauugucacagg

SEQ ID NO: 2692557 - RNA, 22 nt, Human
agugcaaauugucacaggacag

SEQ ID NO: 2692558 - RNA, 21 nt, Human
agugccuguaaucacagcuac

SEQ ID NO: 2692559 - RNA, 23 nt, Human
agguacuucaaauccuugaagau

SEQ ID NO: 2692560 - RNA, 17 nt, Human
aggguuaugauuaagua

SEQ ID NO: 2692561 - RNA, 20 nt, Human
ugguaaggggaauugaggac

SEQ ID NO: 2692562 - RNA, 17 nt, Human
agggcagggacaggaua

SEQ ID NO: 2692563 - RNA, 23 nt, Human
agucagacuggauaguccgucuc

SEQ ID NO: 2692564 - RNA, 15 nt, Human
agucaggaaagagaa

SEQ ID NO: 2692565 - RNA, 16 nt, Human
agucaggaaagagaac

SEQ ID NO: 2692566 - RNA, 23 nt, Human
ugucauuugcuggagcucugccc

SEQ ID NO: 2692567 - RNA, 15 nt, Human
aguauuucuaugaaa

SEQ ID NO: 2692568 - RNA, 13 nt, Human
aguauuucuauga

SEQ ID NO: 2692569 - RNA, 22 nt, Human
aguauuucuaugaaauauuaug

SEQ ID NO: 2692570 - RNA, 20 nt, Human
ugucaaucagccuaguugau

SEQ ID NO: 2692571 - RNA, 21 nt, Human
ugucaauaaaauccauacauu

SEQ ID NO: 2692572 - RNA, 18 nt, Human
uguagaggagaaacugga

SEQ ID NO: 2692573 - RNA, 15 nt, Human
aguaaaaccacagca

SEQ ID NO: 2692574 - RNA, 19 nt, Human
aguagauaggccaugggca

SEQ ID NO: 2692575 - RNA, 14 nt, Human
ugcucauggaauug

SEQ ID NO: 2692576 - RNA, 12 nt, Human
aggaaauauuua

SEQ ID NO: 2692577 - RNA, 23 nt, Human
aggaaaucaaauaugcaaagcac

SEQ ID NO: 2692578 - RNA, 13 nt, Human
aggaaauauuuau

SEQ ID NO: 2692579 - RNA, 17 nt, Human
aggacacugauaugggu

SEQ ID NO: 2692580 - RNA, 22 nt, Human
ugcuguauuuuaaaagaaugau

SEQ ID NO: 2692581 - RNA, 21 nt, Human
ugcuguauuuuaaaagaauga

SEQ ID NO: 2692582 - RNA, 13 nt, Human
ugcuguauuuuaa

SEQ ID NO: 2692583 - RNA, 17 nt, Human
agcuugaaacugagaug

SEQ ID NO: 2692584 - RNA, 20 nt, Human
ugcuacaaaaacacagcaag

SEQ ID NO: 2692585 - RNA, 16 nt, Human
ugcuacaaaaacacag

SEQ ID NO: 2692586 - RNA, 17 nt, Human
ugcuacaaaaacacagc

SEQ ID NO: 2692587 - RNA, 18 nt, Human
ugcuacaaaaacacagca

SEQ ID NO: 2692588 - RNA, 19 nt, Human
ugcuacaaaaacacagcaa

SEQ ID NO: 2692589 - RNA, 16 nt, Human
agcugccuccccuccu

SEQ ID NO: 2692590 - RNA, 15 nt, Human
agcugccuccccucc

SEQ ID NO: 2692591 - RNA, 22 nt, Human
agcugcccucuccugggcagcu

SEQ ID NO: 2692592 - RNA, 16 nt, Human
agcuguucacagccag

SEQ ID NO: 2692593 - RNA, 19 nt, Human
agcuguucacagccagacu

SEQ ID NO: 2692594 - RNA, 18 nt, Human
uggcacaguuuucugaga

SEQ ID NO: 2692595 - RNA, 19 nt, Human
uggcacaguuuucugagaa

SEQ ID NO: 2692596 - RNA, 14 nt, Human
uggccuucggccuc

SEQ ID NO: 2692597 - RNA, 14 nt, Human
uggagaagaacuga

SEQ ID NO: 2692598 - RNA, 13 nt, Human
uggagaagaacug

SEQ ID NO: 2692599 - RNA, 14 nt, Human
uggagcucguggaa

SEQ ID NO: 2692600 - RNA, 20 nt, Human
agccuuggggcugaugcagu

SEQ ID NO: 2692601 - RNA, 17 nt, Human
agcuacuugggaggcug

SEQ ID NO: 2692602 - RNA, 18 nt, Human
agcuacuugggaggcuga

SEQ ID NO: 2692603 - RNA, 19 nt, Human
agcuacuaauuuuaaaaug

SEQ ID NO: 2692604 - RNA, 18 nt, Human
agcccauggcacucuaug

SEQ ID NO: 2692605 - RNA, 20 nt, Human
agccucauguccacugguuc

SEQ ID NO: 2692606 - RNA, 15 nt, Human
agccucauguccacu

SEQ ID NO: 2692607 - RNA, 22 nt, Human
agccugaaagaggaaugaagua

SEQ ID NO: 2692608 - RNA, 19 nt, Human
agccagacuggcacaguuu

SEQ ID NO: 2692609 - RNA, 14 nt, Human
agccagacuggcac

SEQ ID NO: 2692610 - RNA, 14 nt, Human
ugaugaucuuuaaa

SEQ ID NO: 2692611 - RNA, 17 nt, Human
ugaugaucuuuaaaaua

SEQ ID NO: 2692612 - RNA, 12 nt, Human
ugauuaaaccaa

SEQ ID NO: 2692613 - RNA, 14 nt, Human
ugauuaccagggac

SEQ ID NO: 2692614 - RNA, 17 nt, Human
ugaugaagaaguugaua

SEQ ID NO: 2692615 - RNA, 18 nt, Human
ugagugucuuaauuaaaa

SEQ ID NO: 2692616 - RNA, 23 nt, Human
agcauaaauguugacaugggaca

SEQ ID NO: 2692617 - RNA, 22 nt, Human
ugaguaacugauuuguaacaag

SEQ ID NO: 2692618 - RNA, 17 nt, Human
agcauuguaaaugugcu

SEQ ID NO: 2692619 - RNA, 18 nt, Human
agcauuguaaaugugcuu

SEQ ID NO: 2692620 - RNA, 17 nt, Human
agcaugucgucaaagcu

SEQ ID NO: 2692621 - RNA, 20 nt, Human
agcaugucgucaaagcugaa

SEQ ID NO: 2692622 - RNA, 12 nt, Human
ugauaugggucu

SEQ ID NO: 2692623 - RNA, 19 nt, Human
ugaaacucguuaauuugua

SEQ ID NO: 2692624 - RNA, 22 nt, Human
ugaaacugagaugugaacacau

SEQ ID NO: 2692625 - RNA, 22 nt, Human
ugaaaaaguucugcagauaaac

SEQ ID NO: 2692626 - RNA, 20 nt, Human
ugaaaagcuccauuuuuagu

SEQ ID NO: 2692627 - RNA, 23 nt, Human
agagcaguuugguuucuagcaug

SEQ ID NO: 2692628 - RNA, 21 nt, Human
agagcaguuugguuucuagca

SEQ ID NO: 2692629 - RNA, 17 nt, Human
agacaucaacagauaaa

SEQ ID NO: 2692630 - RNA, 18 nt, Human
agacaucaacagauaaau

SEQ ID NO: 2692631 - RNA, 14 nt, Human
agacauagaauuaa

SEQ ID NO: 2692632 - RNA, 21 nt, Human
agacauagaauuaacacauga

SEQ ID NO: 2692633 - RNA, 14 nt, Human
agaaucacuugaac

SEQ ID NO: 2692634 - RNA, 15 nt, Human
ucuucacaacagauu

SEQ ID NO: 2692635 - RNA, 16 nt, Human
agacuauucaaacagu

SEQ ID NO: 2692636 - RNA, 15 nt, Human
agacuauucaaacag

SEQ ID NO: 2692637 - RNA, 12 nt, Human
agacuauucaaa

SEQ ID NO: 2692638 - RNA, 14 nt, Human
agacuauucaaaca

SEQ ID NO: 2692639 - RNA, 17 nt, Human
ugacacuuaaaaauggu

SEQ ID NO: 2692640 - RNA, 16 nt, Human
ugacacuuaaaaaugg

SEQ ID NO: 2692641 - RNA, 16 nt, Human
agaugcaguucugaag

SEQ ID NO: 2692642 - RNA, 24 nt, Human
ugacuucuaaguaaaaccacagca

SEQ ID NO: 2692643 - RNA, 22 nt, Human
ugacuucuaaguaaaaccacag

SEQ ID NO: 2692644 - RNA, 23 nt, Human
ugacuucuaaguaaaaccacagc

SEQ ID NO: 2692645 - RNA, 15 nt, Human
ugacuucuaaguaaa

SEQ ID NO: 2692646 - RNA, 15 nt, Human
agauucccugagcag

SEQ ID NO: 2692647 - RNA, 23 nt, Human
agcaacgcaggcccccaggugcc

SEQ ID NO: 2692648 - RNA, 15 nt, Human
ugaauacuuuauaaa

SEQ ID NO: 2692649 - RNA, 10 nt, Human
ucuggccuuc

SEQ ID NO: 2692650 - RNA, 13 nt, Human
agaaguugauaug

SEQ ID NO: 2692651 - RNA, 17 nt, Human
agaacucccuuucaaca

SEQ ID NO: 2692652 - RNA, 15 nt, Human
agaacucccuuucaa

SEQ ID NO: 2692653 - RNA, 16 nt, Human
agaacucccuuucaac

SEQ ID NO: 2692654 - RNA, 20 nt, Human
ucugcccauccugccccuga

SEQ ID NO: 2692655 - RNA, 19 nt, Human
agaagcaccaaucaugaau

SEQ ID NO: 2692656 - RNA, 19 nt, Human
agaagcaacccaaauguuc

SEQ ID NO: 2692657 - RNA, 23 nt, Human
agaaacuuaagguuaccuuuguu

SEQ ID NO: 2692658 - RNA, 15 nt, Human
agaaacauuugguaa

SEQ ID NO: 2692659 - RNA, 16 nt, Human
agaaaacaaggaugaa

SEQ ID NO: 2692660 - RNA, 16 nt, Human
agaaacacaacuauau

SEQ ID NO: 2692661 - RNA, 16 nt, Human
agaaagacuauucaaa

SEQ ID NO: 2692662 - RNA, 20 nt, Human
agaaagcagaacagugauua

SEQ ID NO: 2692663 - RNA, 17 nt, Human
agaaagcagaacaguga

SEQ ID NO: 2692664 - RNA, 18 nt, Human
agaaagcagaacagugau

SEQ ID NO: 2692665 - RNA, 20 nt, Human
acuuccagauccuggaaauc

SEQ ID NO: 2692666 - RNA, 13 nt, Human
ucuauaauuuaaa

SEQ ID NO: 2692667 - RNA, 12 nt, Human
ucuagcaugaag

SEQ ID NO: 2692668 - RNA, 18 nt, Human
acuucuaaguaaaaccac

SEQ ID NO: 2692669 - RNA, 19 nt, Human
acuucuaaguaaaaccaca

SEQ ID NO: 2692670 - RNA, 13 nt, Human
acuucuaaguaaa

SEQ ID NO: 2692671 - RNA, 21 nt, Human
acuucuaaguaaaaccacagc

SEQ ID NO: 2692672 - RNA, 17 nt, Human
ucucaaaacugcacugu

SEQ ID NO: 2692673 - RNA, 23 nt, Human
acuugaacccgggaggcagaggu

SEQ ID NO: 2692674 - RNA, 21 nt, Human
acuugaacccgggaggcagag

SEQ ID NO: 2692675 - RNA, 22 nt, Human
acugaagaagcaccaaucauga

SEQ ID NO: 2692676 - RNA, 22 nt, Human
acugucagcuccccucggagaa

SEQ ID NO: 2692677 - RNA, 23 nt, Human
acugucagcuccccucggagaag

SEQ ID NO: 2692678 - RNA, 17 nt, Human
ucuaccaaaaaucucaa

SEQ ID NO: 2692679 - RNA, 13 nt, Human
acuguggguagac

SEQ ID NO: 2692680 - RNA, 16 nt, Human
acccaaauguucauca

SEQ ID NO: 2692681 - RNA, 20 nt, Human
acccaaauguucaucaauga

SEQ ID NO: 2692682 - RNA, 12 nt, Human
ucagcccucaga

SEQ ID NO: 2692683 - RNA, 13 nt, Human
ucagcccucagaa

SEQ ID NO: 2692684 - RNA, 14 nt, Human
ucagagcugcccuc

SEQ ID NO: 2692685 - RNA, 13 nt, Human
ucagagcugcccu

SEQ ID NO: 2692686 - RNA, 16 nt, Human
ucagagcugcccucuc

SEQ ID NO: 2692687 - RNA, 15 nt, Human
ucagagcugcccucu

SEQ ID NO: 2692688 - RNA, 17 nt, Human
ucagagcugcccucucc

SEQ ID NO: 2692689 - RNA, 18 nt, Human
ucagagcugcccucuccu

SEQ ID NO: 2692690 - RNA, 13 nt, Human
ucaguagucagac

SEQ ID NO: 2692691 - RNA, 13 nt, Human
ucaaacagucuca

SEQ ID NO: 2692692 - RNA, 20 nt, Human
ucaaacagucucaggaaauc

SEQ ID NO: 2692693 - RNA, 21 nt, Human
ucaaacagucucaggaaauca

SEQ ID NO: 2692694 - RNA, 22 nt, Human
uauuuuaauaauguuucaaaca

SEQ ID NO: 2692695 - RNA, 19 nt, Human
uauuuuaauaauguuucaa

SEQ ID NO: 2692696 - RNA, 14 nt, Human
uauuuuaaaagaau

SEQ ID NO: 2692697 - RNA, 18 nt, Human
uauuuuaaaagaaugauu

SEQ ID NO: 2692698 - RNA, 14 nt, Human
accaacacgagcag

SEQ ID NO: 2692699 - RNA, 19 nt, Human
accaacacgagcaggcuac

SEQ ID NO: 2692700 - RNA, 16 nt, Human
accacaagacugcaca

SEQ ID NO: 2692701 - RNA, 22 nt, Human
ucacagcuuauuuccucauuuu

SEQ ID NO: 2692702 - RNA, 17 nt, Human
ucacagccagacuggca

SEQ ID NO: 2692703 - RNA, 23 nt, Human
ucacagccagacuggcacaguuu

SEQ ID NO: 2692704 - RNA, 16 nt, Human
ucacagaccuuugaac

SEQ ID NO: 2692705 - RNA, 12 nt, Human
ucaauuuaaaaa

SEQ ID NO: 2692706 - RNA, 13 nt, Human
ucaauuuaaaaaa

SEQ ID NO: 2692707 - RNA, 23 nt, Human
ucaauauuucagauaaucacaau

SEQ ID NO: 2692708 - RNA, 22 nt, Human
uccaugaagauguagaggagaa

SEQ ID NO: 2692709 - RNA, 14 nt, Human
uccagugagacagc

SEQ ID NO: 2692710 - RNA, 15 nt, Human
acgcucucuggccuu

SEQ ID NO: 2692711 - RNA, 16 nt, Human
acgcucucuggccuuc

SEQ ID NO: 2692712 - RNA, 17 nt, Human
acgcucucuggccuucg

SEQ ID NO: 2692713 - RNA, 12 nt, Human
accugagcccca

SEQ ID NO: 2692714 - RNA, 17 nt, Human
accugagccccaaaagg

SEQ ID NO: 2692715 - RNA, 16 nt, Human
ucauaauaaguugcau

SEQ ID NO: 2692716 - RNA, 17 nt, Human
uccucuccccaugaugu

SEQ ID NO: 2692717 - RNA, 22 nt, Human
uccugaaaacccuugccaugug

SEQ ID NO: 2692718 - RNA, 21 nt, Human
uccugaaaacccuugccaugu

SEQ ID NO: 2692719 - RNA, 18 nt, Human
acuccagaaagugacaag

SEQ ID NO: 2692720 - RNA, 14 nt, Human
acuccagaaaguga

SEQ ID NO: 2692721 - RNA, 14 nt, Human
ucccuccaccuccc

SEQ ID NO: 2692722 - RNA, 17 nt, Human
ucccuccaccucccugc

SEQ ID NO: 2692723 - RNA, 15 nt, Human
ucccuccaccucccu

SEQ ID NO: 2692724 - RNA, 19 nt, Human
ucccuccaccucccugcaa

SEQ ID NO: 2692725 - RNA, 21 nt, Human
acuccaaacugacucuuaaga

SEQ ID NO: 2692726 - RNA, 20 nt, Human
acuagaguuuagcuggaaaa

SEQ ID NO: 2692727 - RNA, 24 nt, Human
uccccuccucugcuugccaucccu

SEQ ID NO: 2692728 - RNA, 18 nt, Human
uccccuccucugcuugcc

SEQ ID NO: 2692729 - RNA, 15 nt, Human
uccccuccucugcuu

SEQ ID NO: 2692730 - RNA, 14 nt, Human
uccccuccucugcu

SEQ ID NO: 2692731 - RNA, 13 nt, Human
acuauucaaacag

SEQ ID NO: 2692732 - RNA, 14 nt, Human
acuauucaaacagu

SEQ ID NO: 2692733 - RNA, 16 nt, Human
acuauucaaacagucu

SEQ ID NO: 2692734 - RNA, 18 nt, Human
acuauucaaacagucuca

SEQ ID NO: 2692735 - RNA, 13 nt, Human
acacaacuauauu

SEQ ID NO: 2692736 - RNA, 13 nt, Human
uaggauguugaaa

SEQ ID NO: 2692737 - RNA, 14 nt, Human
uagaggguguguaa

SEQ ID NO: 2692738 - RNA, 14 nt, Human
acaaaaacacagca

SEQ ID NO: 2692739 - RNA, 15 nt, Human
acaaaaacacagcaa

SEQ ID NO: 2692740 - RNA, 13 nt, Human
acaaaaacacagc

SEQ ID NO: 2692741 - RNA, 13 nt, Human
uagacacacauga

SEQ ID NO: 2692742 - RNA, 17 nt, Human
uagaacucccuuucaac

SEQ ID NO: 2692743 - RNA, 18 nt, Human
uagaacucccuuucaaca

SEQ ID NO: 2692744 - RNA, 16 nt, Human
uagaacucccuuucaa

SEQ ID NO: 2692745 - RNA, 15 nt, Human
uagaaacacaacuau

SEQ ID NO: 2692746 - RNA, 18 nt, Human
acagcaagggugauggga

SEQ ID NO: 2692747 - RNA, 19 nt, Human
acagcccuucuuuccacag

SEQ ID NO: 2692748 - RNA, 15 nt, Human
uaugccccauucaac

SEQ ID NO: 2692749 - RNA, 23 nt, Human
acagcuguaugauucccagccag

SEQ ID NO: 2692750 - RNA, 20 nt, Human
acagcuguaugauucccagc

SEQ ID NO: 2692751 - RNA, 19 nt, Human
acagcuguaugauucccag

SEQ ID NO: 2692752 - RNA, 14 nt, Human
acagcuguaugauu

SEQ ID NO: 2692753 - RNA, 22 nt, Human
acaggaaccacaagacugcaca

SEQ ID NO: 2692754 - RNA, 14 nt, Human
uaucacaaaucuua

SEQ ID NO: 2692755 - RNA, 16 nt, Human
uaucacaaaucuuaac

SEQ ID NO: 2692756 - RNA, 20 nt, Human
uaucacaaaucuuaacuuga

SEQ ID NO: 2692757 - RNA, 14 nt, Human
acagaccuuugaac

SEQ ID NO: 2692758 - RNA, 19 nt, Human
acagaaagcagaacaguga

SEQ ID NO: 2692759 - RNA, 12 nt, Human
uauaggaauuga

SEQ ID NO: 2692760 - RNA, 16 nt, Human
uauaggugcuacaaaa

SEQ ID NO: 2692761 - RNA, 13 nt, Human
acacucaaaucaa

SEQ ID NO: 2692762 - RNA, 18 nt, Human
acacucaaaucaagaaac

SEQ ID NO: 2692763 - RNA, 17 nt, Human
acacucaaaucaagaaa

SEQ ID NO: 2692764 - RNA, 13 nt, Human
aauuacauuugua

SEQ ID NO: 2692765 - RNA, 14 nt, Human
aauuacauuuguau

SEQ ID NO: 2692766 - RNA, 19 nt, Human
uaccagggacugaggggag

SEQ ID NO: 2692767 - RNA, 16 nt, Human
uaccaugccauuuaaa

SEQ ID NO: 2692768 - RNA, 13 nt, Human
aauguucaucaau

SEQ ID NO: 2692769 - RNA, 16 nt, Human
aauguucaucaaugaa

SEQ ID NO: 2692770 - RNA, 20 nt, Human
aauguucaucaaugaaugaa

SEQ ID NO: 2692771 - RNA, 23 nt, Human
aaugauuaugaauuacauuugua

SEQ ID NO: 2692772 - RNA, 22 nt, Human
aaugagagacacacugaagaag

SEQ ID NO: 2692773 - RNA, 16 nt, Human
aaugauuucauucaau

SEQ ID NO: 2692774 - RNA, 21 nt, Human
uaauuuuuauauuugaaauau

SEQ ID NO: 2692775 - RNA, 19 nt, Human
uaauuuuuauauuugaaau

SEQ ID NO: 2692776 - RNA, 18 nt, Human
uaauuuuuauauuugaaa

SEQ ID NO: 2692777 - RNA, 22 nt, Human
uaauuccguagguuauuuucag

SEQ ID NO: 2692778 - RNA, 17 nt, Human
uacagagacagaaagca

SEQ ID NO: 2692779 - RNA, 20 nt, Human
aauguaagggaaacugccag

SEQ ID NO: 2692780 - RNA, 21 nt, Human
aaugcuguauuuuaaaagaau

SEQ ID NO: 2692781 - RNA, 20 nt, Human
aaugcuguauuuuaaaagaa

SEQ ID NO: 2692782 - RNA, 22 nt, Human
aaugcuguauuuuaaaagaaug

SEQ ID NO: 2692783 - RNA, 21 nt, Human
uacaaaaaaaaaaaaaaauua

SEQ ID NO: 2692784 - RNA, 15 nt, Human
aauauuuauuuuaau

SEQ ID NO: 2692785 - RNA, 16 nt, Human
aaucagccuaguugau

SEQ ID NO: 2692786 - RNA, 15 nt, Human
uaagcaaaaugugau

SEQ ID NO: 2692787 - RNA, 21 nt, Human
uaagcaaaaugugauauguac

SEQ ID NO: 2692788 - RNA, 14 nt, Human
uaagcaaaauguga

SEQ ID NO: 2692789 - RNA, 18 nt, Human
uaagguuaccuuuguucc

SEQ ID NO: 2692790 - RNA, 13 nt, Human
uaaguaaaaccac

SEQ ID NO: 2692791 - RNA, 15 nt, Human
uaaguaaaaccacag

SEQ ID NO: 2692792 - RNA, 16 nt, Human
uaaguaaaaccacagc

SEQ ID NO: 2692793 - RNA, 17 nt, Human
uaaguaaaaccacagca

SEQ ID NO: 2692794 - RNA, 18 nt, Human
uaaguaaaaccacagcag

SEQ ID NO: 2692795 - RNA, 19 nt, Human
uaaguaaaaccacagcagu

SEQ ID NO: 2692796 - RNA, 20 nt, Human
uaaguaaugauaacuggaaa

SEQ ID NO: 2692797 - RNA, 20 nt, Human
aauccucaguuuuugugaaa

SEQ ID NO: 2692798 - RNA, 13 nt, Human
uaagaagugaaaa

SEQ ID NO: 2692799 - RNA, 21 nt, Human
uaacuuccuuggacucauuuu

SEQ ID NO: 2692800 - RNA, 19 nt, Human
aauagucaaauugugugaa

SEQ ID NO: 2692801 - RNA, 13 nt, Human
uaacaaugcugua

SEQ ID NO: 2692802 - RNA, 18 nt, Human
aauaccaugccauuuaaa

SEQ ID NO: 2692803 - RNA, 23 nt, Human
aauaccacaggaaccacaagacu

SEQ ID NO: 2692804 - RNA, 23 nt, Human
aauacaucccuuaccugggaaag

SEQ ID NO: 2692805 - RNA, 13 nt, Human
aagcauuguaaau

SEQ ID NO: 2692806 - RNA, 16 nt, Human
aagcauuuagauguau

SEQ ID NO: 2692807 - RNA, 20 nt, Human
aagcucacagaccuuugaac

SEQ ID NO: 2692808 - RNA, 14 nt, Human
aagcuccagguaga

SEQ ID NO: 2692809 - RNA, 13 nt, Human
aagcuccagguag

SEQ ID NO: 2692810 - RNA, 20 nt, Human
guuauuauauuuacaaaugg

SEQ ID NO: 2692811 - RNA, 23 nt, Human
aagaggaaugaaguacucauaca

SEQ ID NO: 2692812 - RNA, 17 nt, Human
aagacugcauuauauuu

SEQ ID NO: 2692813 - RNA, 16 nt, Human
aagacugcacaucaaa

SEQ ID NO: 2692814 - RNA, 13 nt, Human
aagaugaaaauau

SEQ ID NO: 2692815 - RNA, 14 nt, Human
aagaugaaaauauu

SEQ ID NO: 2692816 - RNA, 13 nt, Human
aagauguagagga

SEQ ID NO: 2692817 - RNA, 20 nt, Human
uaaaauaauuuuuauauuug

SEQ ID NO: 2692818 - RNA, 20 nt, Human
uaaaagacagugaaagaaaa

SEQ ID NO: 2692819 - RNA, 16 nt, Human
uaaaagaauauuuuaa

SEQ ID NO: 2692820 - RNA, 23 nt, Human
uaaaagaauauuuuaacuuccuu

SEQ ID NO: 2692821 - RNA, 12 nt, Human
uaaaagaaugau

SEQ ID NO: 2692822 - RNA, 19 nt, Human
aaguaaugauaacuggaaa

SEQ ID NO: 2692823 - RNA, 14 nt, Human
aaguaaugauaacu

SEQ ID NO: 2692824 - RNA, 13 nt, Human
aaguauuagaaua

SEQ ID NO: 2692825 - RNA, 16 nt, Human
aagucuuucacauuua

SEQ ID NO: 2692826 - RNA, 22 nt, Human
aagucuuauauauuguagauaa

SEQ ID NO: 2692827 - RNA, 14 nt, Human
aagguacuucaaau

SEQ ID NO: 2692828 - RNA, 19 nt, Human
aagggugaugggaaagcau

SEQ ID NO: 2692829 - RNA, 21 nt, Human
guauaaaauaauuuuuauauu

SEQ ID NO: 2692830 - RNA, 15 nt, Human
guauaaaauaauuuu

SEQ ID NO: 2692831 - RNA, 16 nt, Human
guauauuuuauaucaa

SEQ ID NO: 2692832 - RNA, 16 nt, Human
aaauguaagggaaacu

SEQ ID NO: 2692833 - RNA, 17 nt, Human
guaguguuggagaagaa

SEQ ID NO: 2692834 - RNA, 20 nt, Human
guaguguuggagaagaacug

SEQ ID NO: 2692835 - RNA, 15 nt, Human
aaauggguuuuacug

SEQ ID NO: 2692836 - RNA, 14 nt, Human
aaauggguuuuacu

SEQ ID NO: 2692837 - RNA, 16 nt, Human
gucaaauugugugaaa

SEQ ID NO: 2692838 - RNA, 18 nt, Human
guauguacuucaugcugu

SEQ ID NO: 2692839 - RNA, 16 nt, Human
aacagauaaauaguuu

SEQ ID NO: 2692840 - RNA, 15 nt, Human
aacagugauuaccag

SEQ ID NO: 2692841 - RNA, 22 nt, Human
aacagugauuaccagggacuga

SEQ ID NO: 2692842 - RNA, 15 nt, Human
aacacagcaagggug

SEQ ID NO: 2692843 - RNA, 22 nt, Human
aacaaugcuguauuuuaaaaga

SEQ ID NO: 2692844 - RNA, 17 nt, Human
aacaaugcuguauuuua

SEQ ID NO: 2692845 - RNA, 16 nt, Human
aacacaacuauauugu

SEQ ID NO: 2692846 - RNA, 15 nt, Human
aacacaacuauauug

SEQ ID NO: 2692847 - RNA, 15 nt, Human
aacaaugcuguauuu

SEQ ID NO: 2692848 - RNA, 14 nt, Human
aacaaugcuguauu

SEQ ID NO: 2692849 - RNA, 12 nt, Human
aacaauaaaaga

SEQ ID NO: 2692850 - RNA, 20 nt, Human
aaauuuuuucucuaggaaau

SEQ ID NO: 2692851 - RNA, 21 nt, Human
gugagaugcuagaacucccuu

SEQ ID NO: 2692852 - RNA, 12 nt, Human
aacugaaaucau

SEQ ID NO: 2692853 - RNA, 19 nt, Human
aacugcacugucaagauga

SEQ ID NO: 2692854 - RNA, 19 nt, Human
aacuggacugguucaaaug

SEQ ID NO: 2692855 - RNA, 17 nt, Human
aacugggacaggggaga

SEQ ID NO: 2692856 - RNA, 17 nt, Human
gugaugggaaagcauug

SEQ ID NO: 2692857 - RNA, 18 nt, Human
aacuuccagauccuggaa

SEQ ID NO: 2692858 - RNA, 21 nt, Human
aacuucagcgguuuauauaag

SEQ ID NO: 2692859 - RNA, 18 nt, Human
aacccaaguccaagcaua

SEQ ID NO: 2692860 - RNA, 23 nt, Human
aacccaaauguucaucaaugaau

SEQ ID NO: 2692861 - RNA, 16 nt, Human
aacccgggaggcagag

SEQ ID NO: 2692862 - RNA, 18 nt, Human
aaccugagccccaaaagg

SEQ ID NO: 2692863 - RNA, 20 nt, Human
aaccugagccccaaaaggua

SEQ ID NO: 2692864 - RNA, 16 nt, Human
gucuuucacauuuaaa

SEQ ID NO: 2692865 - RNA, 18 nt, Human
aaccuugaaaacuuuaug

SEQ ID NO: 2692866 - RNA, 21 nt, Human
aacuagaguuuagcuggaaaa

SEQ ID NO: 2692867 - RNA, 12 nt, Human
aacucauuucua

SEQ ID NO: 2692868 - RNA, 22 nt, Human
acuugggaggcugagaugggag

SEQ ID NO: 2692869 - RNA, 12 nt, Human
acuuuaugcuaa

SEQ ID NO: 2692870 - RNA, 17 nt, Human
acuuuaugcuaagugaa

SEQ ID NO: 2692871 - RNA, 19 nt, Human
acuucagcgguuuauauaa

SEQ ID NO: 2692872 - RNA, 18 nt, Human
acuucagcgguuuauaua

SEQ ID NO: 2692873 - RNA, 17 nt, Human
acuucagcgguuuauau

SEQ ID NO: 2692874 - RNA, 20 nt, Human
acuucaaauccuugaagauu

SEQ ID NO: 2692875 - RNA, 19 nt, Human
acuucaaauccuugaagau

SEQ ID NO: 2692876 - RNA, 13 nt, Human
acuuaaaaauggu

SEQ ID NO: 2692877 - RNA, 14 nt, Human
acuuaaaaaugguu

SEQ ID NO: 2692878 - RNA, 21 nt, Human
acuuaaaaaugguuuaaaugg

SEQ ID NO: 2692879 - RNA, 15 nt, Human
acucugucucagucc

SEQ ID NO: 2692880 - RNA, 17 nt, Human
acucugucucaguccau

SEQ ID NO: 2692881 - RNA, 20 nt, Human
acucuuaagaagacugcauu

SEQ ID NO: 2692882 - RNA, 15 nt, Human
acucuuaagaagacu

SEQ ID NO: 2692883 - RNA, 14 nt, Human
acucuuaagaagac

SEQ ID NO: 2692884 - RNA, 18 nt, Human
accucugccucagaaaac

SEQ ID NO: 2692885 - RNA, 17 nt, Human
accucugccucagaaaa

SEQ ID NO: 2692886 - RNA, 18 nt, Human
acuaguauuucuaugaaa

SEQ ID NO: 2692887 - RNA, 19 nt, Human
acuaguauuucuaugaaau

SEQ ID NO: 2692888 - RNA, 19 nt, Human
acggacgaaccuugaaaac

SEQ ID NO: 2692889 - RNA, 19 nt, Human
accaaggcugauuaaacca

SEQ ID NO: 2692890 - RNA, 20 nt, Human
accaaggcugauuaaaccaa

SEQ ID NO: 2692891 - RNA, 20 nt, Human
acaucccuuaccugggaaag

SEQ ID NO: 2692892 - RNA, 21 nt, Human
acagugauuaccagggacuga

SEQ ID NO: 2692893 - RNA, 20 nt, Human
acagugauuaccagggacug

SEQ ID NO: 2692894 - RNA, 18 nt, Human
aauuuugugaagcaaaau

SEQ ID NO: 2692895 - RNA, 17 nt, Human
aauuuugugaagcaaaa

SEQ ID NO: 2692896 - RNA, 13 nt, Human
acaagaaaugaaa

SEQ ID NO: 2692897 - RNA, 15 nt, Human
acaagaaaugaaagc

SEQ ID NO: 2692898 - RNA, 16 nt, Human
acaagaaaugaaagca

SEQ ID NO: 2692899 - RNA, 21 nt, Human
acaaggaugaauuaaguuuuu

SEQ ID NO: 2692900 - RNA, 16 nt, Human
acagaagcuccaggua

SEQ ID NO: 2692901 - RNA, 19 nt, Human
aaaggcagaagcaacccaa

SEQ ID NO: 2692902 - RNA, 19 nt, Human
aaagcauuguaaaugugcu

SEQ ID NO: 2692903 - RNA, 20 nt, Human
aaagcauuguaaaugugcuu

SEQ ID NO: 2692904 - RNA, 21 nt, Human
aaacccugucucuacuaaaaa

SEQ ID NO: 2692905 - RNA, 19 nt, Human
aaacccuugccaugugcua

SEQ ID NO: 2692906 - RNA, 13 nt, Human
aaagaaacauuug

SEQ ID NO: 2692907 - RNA, 19 nt, Human
aaaauccauacauuugugu

SEQ ID NO: 2692908 - RNA, 12 nt, Human
aacacaucagcu

SEQ ID NO: 2692909 - RNA, 22 nt, Human
aaauugacacuuaaaaaugguu

SEQ ID NO: 2692910 - RNA, 20 nt, Human
aaauguucaucaaugaauga

SEQ ID NO: 2692911 - RNA, 14 nt, Human
aaaucuuaacuuga

SEQ ID NO: 2692912 - RNA, 23 nt, Human
aacugagaugugaacacaucagc

SEQ ID NO: 2692913 - RNA, 16 nt, Human
aauccauacauuugug

SEQ ID NO: 2692914 - RNA, 17 nt, Human
aauccauacauuugugu

SEQ ID NO: 2692915 - RNA, 16 nt, Human
aaugauaacuggaaac

SEQ ID NO: 2692916 - RNA, 15 nt, Human
aaugauaacuggaaa

SEQ ID NO: 2692917 - RNA, 14 nt, Human
aaugauaacuggaa

SEQ ID NO: 2692918 - RNA, 22 nt, Human
aaucauuucugcaucagcugcu

SEQ ID NO: 2692919 - RNA, 15 nt, Human
aaucaaauaugcaaa

SEQ ID NO: 2692920 - RNA, 16 nt, Human
aaucaaauaugcaaag

SEQ ID NO: 2692921 - RNA, 22 nt, Human
aaucaaauaugcaaagcacuga

SEQ ID NO: 2692922 - RNA, 12 nt, Human
aauaauguuuca

SEQ ID NO: 2692923 - RNA, 19 nt, Human
aauaauguuucaaacauau

SEQ ID NO: 2692924 - RNA, 14 nt, Human
aauaauguuucaaa

SEQ ID NO: 2692925 - RNA, 10 nt, Human
aauaaaccau

SEQ ID NO: 2692926 - RNA, 22 nt, Human
aaguugauaugccuuuucccaa

SEQ ID NO: 2692927 - RNA, 17 nt, Human
aaguucugcagauaaac

SEQ ID NO: 2692928 - RNA, 14 nt, Human
aagauagcagggca

SEQ ID NO: 2692929 - RNA, 15 nt, Human
aagcagggacuugaa

SEQ ID NO: 2692930 - RNA, 15 nt, Human
aagagaacuuccaga

SEQ ID NO: 2692931 - RNA, 23 nt, Human
aagacagugaaagaaaauaacaa

SEQ ID NO: 2692932 - RNA, 19 nt, Human
aagccagauuuuccugaaa

SEQ ID NO: 2692933 - RNA, 12 nt, Human
aaguagaggagg

SEQ ID NO: 2692934 - RNA, 15 nt, Human
aagggauuuucagcc

SEQ ID NO: 2692935 - RNA, 14 nt, Human
aagggauggcaaga

SEQ ID NO: 2692936 - RNA, 17 nt, Human
aagggauggcaagaugu

SEQ ID NO: 2692937 - RNA, 23 nt, Human
aagggauuuucagcccucagaau

SEQ ID NO: 2692938 - RNA, 21 nt, Human
aagggauuuucagcccucaga

SEQ ID NO: 2692939 - RNA, 24 nt, Human
agcaaaauuuuuucucuaggaaau

SEQ ID NO: 2692940 - RNA, 16 nt, Human
agauguagaggagaaa

SEQ ID NO: 2692941 - RNA, 19 nt, Human
agauguagaggagaaacug

SEQ ID NO: 2692942 - RNA, 22 nt, Human
agaagagcuguucacagccaga

SEQ ID NO: 2692943 - RNA, 21 nt, Human
agaagagcuguucacagccag

SEQ ID NO: 2692944 - RNA, 18 nt, Human
agaagacugcauuauauu

SEQ ID NO: 2692945 - RNA, 21 nt, Human
agaagugaaaaucuacacucc

SEQ ID NO: 2692946 - RNA, 17 nt, Human
agaaugauuaugaauua

SEQ ID NO: 2692947 - RNA, 22 nt, Human
agaaugagagacacacugaaga

SEQ ID NO: 2692948 - RNA, 17 nt, Human
agaaugagagacacacu

SEQ ID NO: 2692949 - RNA, 17 nt, Human
agacccaaaaggcagaa

SEQ ID NO: 2692950 - RNA, 19 nt, Human
agacccaaaaggcagaagc

SEQ ID NO: 2692951 - RNA, 20 nt, Human
agacuggauaguccgucucu

SEQ ID NO: 2692952 - RNA, 16 nt, Human
agacuggauaguccgu

SEQ ID NO: 2692953 - RNA, 18 nt, Human
agacucugucucagucca

SEQ ID NO: 2692954 - RNA, 13 nt, Human
agaggaaugaagu

SEQ ID NO: 2692955 - RNA, 21 nt, Human
aggccaugggcacugugggua

SEQ ID NO: 2692956 - RNA, 15 nt, Human
agggacugaggggag

SEQ ID NO: 2692957 - RNA, 22 nt, Human
agggauuuucagcccucagaau

SEQ ID NO: 2692958 - RNA, 17 nt, Human
agggauuuucagcccuc

SEQ ID NO: 2692959 - RNA, 15 nt, Human
agggauuagggagag

SEQ ID NO: 2692960 - RNA, 13 nt, Human
aggaaguagagga

SEQ ID NO: 2692961 - RNA, 20 nt, Human
agcuuauuuccucauuuuua

SEQ ID NO: 2692962 - RNA, 20 nt, Human
agcuccccucggagaagagc

SEQ ID NO: 2692963 - RNA, 17 nt, Human
agcuccccucggagaag

SEQ ID NO: 2692964 - RNA, 19 nt, Human
agcuccccucggagaagag

SEQ ID NO: 2692965 - RNA, 17 nt, Human
agcgacagugagacucu

SEQ ID NO: 2692966 - RNA, 18 nt, Human
augaugaucuuuaaaaua

SEQ ID NO: 2692967 - RNA, 21 nt, Human
augaugaucuuuaaaauacac

SEQ ID NO: 2692968 - RNA, 16 nt, Human
augaucuuuaaaauac

SEQ ID NO: 2692969 - RNA, 21 nt, Human
augucaaucagccuaguugau

SEQ ID NO: 2692970 - RNA, 16 nt, Human
augucaaucagccuag

SEQ ID NO: 2692971 - RNA, 15 nt, Human
augugaacacaucag

SEQ ID NO: 2692972 - RNA, 15 nt, Human
auguuccuagugaaa

SEQ ID NO: 2692973 - RNA, 16 nt, Human
auguuccuagugaaag

SEQ ID NO: 2692974 - RNA, 17 nt, Human
auguuccuagugaaaga

SEQ ID NO: 2692975 - RNA, 22 nt, Human
aucagcuugcccuguuaaaaga

SEQ ID NO: 2692976 - RNA, 13 nt, Human
aucagcuuauugu

SEQ ID NO: 2692977 - RNA, 17 nt, Human
aucaugaauuaguuuua

SEQ ID NO: 2692978 - RNA, 14 nt, Human
aucaaauaugcaaa

SEQ ID NO: 2692979 - RNA, 21 nt, Human
aucgcuccaccuugcagcucu

SEQ ID NO: 2692980 - RNA, 17 nt, Human
aucgcuccaccuugcag

SEQ ID NO: 2692981 - RNA, 19 nt, Human
auccucaguuuuugugaaa

SEQ ID NO: 2692982 - RNA, 13 nt, Human
augaaguacucau

SEQ ID NO: 2692983 - RNA, 21 nt, Human
augaaguacucauacauguua

SEQ ID NO: 2692984 - RNA, 23 nt, Human
augaaguccaagcauuuagaugu

SEQ ID NO: 2692985 - RNA, 20 nt, Human
augaaguccaagcauuuaga

SEQ ID NO: 2692986 - RNA, 19 nt, Human
aguugaaaagacuccaaag

SEQ ID NO: 2692987 - RNA, 20 nt, Human
aguugaaaagacuccaaaga

SEQ ID NO: 2692988 - RNA, 18 nt, Human
aguugaaaagacuccaaa

SEQ ID NO: 2692989 - RNA, 20 nt, Human
aguucagagcugcccucucc

SEQ ID NO: 2692990 - RNA, 22 nt, Human
aguucagagcugcccucuccug

SEQ ID NO: 2692991 - RNA, 21 nt, Human
aguucagagcugcccucuccu

SEQ ID NO: 2692992 - RNA, 23 nt, Human
aguucagagcugcccucuccugg

SEQ ID NO: 2692993 - RNA, 19 nt, Human
agugucaaugcagccccca

SEQ ID NO: 2692994 - RNA, 11 nt, Human
aguccaagcau

SEQ ID NO: 2692995 - RNA, 15 nt, Human
auagcagcuuauuca

SEQ ID NO: 2692996 - RNA, 14 nt, Human
auauuauguuaaaa

SEQ ID NO: 2692997 - RNA, 13 nt, Human
auauuauguuaaa

SEQ ID NO: 2692998 - RNA, 21 nt, Human
auaacaaugcuguauuuuaaa

SEQ ID NO: 2692999 - RNA, 20 nt, Human
auaacaaugcuguauuuuaa

SEQ ID NO: 2693000 - RNA, 19 nt, Human
auaacaaugcuguauuuua

SEQ ID NO: 2693001 - RNA, 17 nt, Human
auaacaaugcuguauuu

SEQ ID NO: 2693002 - RNA, 15 nt, Human
auaacaaugcuguau

SEQ ID NO: 2693003 - RNA, 14 nt, Human
auaacaaugaaagu

SEQ ID NO: 2693004 - RNA, 18 nt, Human
auaauguuucaaacauau

SEQ ID NO: 2693005 - RNA, 21 nt, Human
auaagccagacaucaacagau

SEQ ID NO: 2693006 - RNA, 22 nt, Human
auaagccagacaucaacagaua

SEQ ID NO: 2693007 - RNA, 13 nt, Human
auaauguuucaaa

SEQ ID NO: 2693008 - RNA, 14 nt, Human
caaaacugcacugu

SEQ ID NO: 2693009 - RNA, 17 nt, Human
caaaacugcacugucaa

SEQ ID NO: 2693010 - RNA, 18 nt, Human
caaaacugcacugucaag

SEQ ID NO: 2693011 - RNA, 16 nt, Human
caaacugacucuuaag

SEQ ID NO: 2693012 - RNA, 21 nt, Human
caaacugacucuuaagaagac

SEQ ID NO: 2693013 - RNA, 17 nt, Human
caaacugacucuuaaga

SEQ ID NO: 2693014 - RNA, 15 nt, Human
caagaaaugaaagca

SEQ ID NO: 2693015 - RNA, 17 nt, Human
caagaaaugaaagcagg

SEQ ID NO: 2693016 - RNA, 19 nt, Human
caagaaaugaaagcaggga

SEQ ID NO: 2693017 - RNA, 14 nt, Human
caaauguucaucaa

SEQ ID NO: 2693018 - RNA, 18 nt, Human
caaauguucaucaaugaa

SEQ ID NO: 2693019 - RNA, 12 nt, Human
caaauaugcaaa

SEQ ID NO: 2693020 - RNA, 13 nt, Human
caaauaugcaaag

SEQ ID NO: 2693021 - RNA, 20 nt, Human
caaggaaaaaauaacaauga

SEQ ID NO: 2693022 - RNA, 18 nt, Human
caaggaaaaaauaacaau

SEQ ID NO: 2693023 - RNA, 19 nt, Human
caauagucaaauuguguga

SEQ ID NO: 2693024 - RNA, 17 nt, Human
caauagucaaauugugu

SEQ ID NO: 2693025 - RNA, 21 nt, Human
caagggugaugggaaagcauu

SEQ ID NO: 2693026 - RNA, 23 nt, Human
caagggugaugggaaagcauugu

SEQ ID NO: 2693027 - RNA, 13 nt, Human
cacacugaagaag

SEQ ID NO: 2693028 - RNA, 21 nt, Human
cacagcaguugaaaagacucc

SEQ ID NO: 2693029 - RNA, 19 nt, Human
cacagcaguugaaaagacu

SEQ ID NO: 2693030 - RNA, 17 nt, Human
cacagccagacuggcac

SEQ ID NO: 2693031 - RNA, 18 nt, Human
cacagccagacuggcaca

SEQ ID NO: 2693032 - RNA, 18 nt, Human
cacaagaaaugaaagcag

SEQ ID NO: 2693033 - RNA, 20 nt, Human
cacaagaaaugaaagcaggg

SEQ ID NO: 2693034 - RNA, 21 nt, Human
cacaagaaaugaaagcaggga

SEQ ID NO: 2693035 - RNA, 21 nt, Human
caauaucuuuuuuuuaauaaa

SEQ ID NO: 2693036 - RNA, 22 nt, Human
caauuuuucuuauuucauuucu

SEQ ID NO: 2693037 - RNA, 21 nt, Human
uguuaaaagaugaaaauauuu

SEQ ID NO: 2693038 - RNA, 22 nt, Human
ugugugaaagguacuucaaauc

SEQ ID NO: 2693039 - RNA, 21 nt, Human
ugugugaaagguacuucaaau

SEQ ID NO: 2693040 - RNA, 20 nt, Human
ugugugaaagguacuucaaa

SEQ ID NO: 2693041 - RNA, 19 nt, Human
uguguuuugcaagccagau

SEQ ID NO: 2693042 - RNA, 13 nt, Human
uguguuuugcaag

SEQ ID NO: 2693043 - RNA, 17 nt, Human
uguuuaaaaucauuucu

SEQ ID NO: 2693044 - RNA, 18 nt, Human
uguuuaaaaucauuucug

SEQ ID NO: 2693045 - RNA, 20 nt, Human
uguuggagaagaacugaaau

SEQ ID NO: 2693046 - RNA, 19 nt, Human
uguuggagaagaacugaaa

SEQ ID NO: 2693047 - RNA, 14 nt, Human
uguuggagaagaac

SEQ ID NO: 2693048 - RNA, 17 nt, Human
uguuggagaagaacuga

SEQ ID NO: 2693049 - RNA, 16 nt, Human
uguuggagaagaacug

SEQ ID NO: 2693050 - RNA, 20 nt, Human
uguugacaugggacauuugc

SEQ ID NO: 2693051 - RNA, 20 nt, Human
uuacauuuguauaaaauaau

SEQ ID NO: 2693052 - RNA, 22 nt, Human
uuaaaaaaaaaccugagcccca

SEQ ID NO: 2693053 - RNA, 18 nt, Human
uuaaaauacacacucaaa

SEQ ID NO: 2693054 - RNA, 20 nt, Human
uguaauaaacucauuucuag

SEQ ID NO: 2693055 - RNA, 16 nt, Human
uguaccgcaaugugac

SEQ ID NO: 2693056 - RNA, 22 nt, Human
uguaguguuggagaagaacuga

SEQ ID NO: 2693057 - RNA, 15 nt, Human
uguaugauucccagc

SEQ ID NO: 2693058 - RNA, 19 nt, Human
ugugcuaguaauuggaaag

SEQ ID NO: 2693059 - RNA, 22 nt, Human
uggaauaauccuaaacauauga

SEQ ID NO: 2693060 - RNA, 23 nt, Human
uggaaacuucagcgguuuauaua

SEQ ID NO: 2693061 - RNA, 20 nt, Human
uggaacauaaaauacaaugu

SEQ ID NO: 2693062 - RNA, 21 nt, Human
uggaacauaaaauacaauguu

SEQ ID NO: 2693063 - RNA, 11 nt, Human
uggagggaagc

SEQ ID NO: 2693064 - RNA, 21 nt, Human
ugguauguuuucaggcuagau

SEQ ID NO: 2693065 - RNA, 16 nt, Human
uggcuuccuggcaaua

SEQ ID NO: 2693066 - RNA, 21 nt, Human
uggcuugaguuuaaauuguaa

SEQ ID NO: 2693067 - RNA, 14 nt, Human
ugggaguacaaaag

SEQ ID NO: 2693068 - RNA, 19 nt, Human
ugccaaauauaaauaaaaa

SEQ ID NO: 2693069 - RNA, 22 nt, Human
ugccaaauauaaauaaaaauaa

SEQ ID NO: 2693070 - RNA, 17 nt, Human
ugccaaauauaaauaaa

SEQ ID NO: 2693071 - RNA, 18 nt, Human
ugccaaauauaaauaaaa

SEQ ID NO: 2693072 - RNA, 20 nt, Human
ugccacuaaauugacacuua

SEQ ID NO: 2693073 - RNA, 12 nt, Human
ugccaucccucc

SEQ ID NO: 2693074 - RNA, 11 nt, Human
ugccaucccuc

SEQ ID NO: 2693075 - RNA, 14 nt, Human
ugccaucccucccu

SEQ ID NO: 2693076 - RNA, 22 nt, Human
ugcaguucugaagaagauggua

SEQ ID NO: 2693077 - RNA, 19 nt, Human
ugcaguucugaagaagaug

SEQ ID NO: 2693078 - RNA, 18 nt, Human
ugcaguucugaagaagau

SEQ ID NO: 2693079 - RNA, 17 nt, Human
ugcaguucugaagaaga

SEQ ID NO: 2693080 - RNA, 16 nt, Human
ugcaguucugaagaag

SEQ ID NO: 2693081 - RNA, 15 nt, Human
ugcaguucugaagaa

SEQ ID NO: 2693082 - RNA, 19 nt, Human
ugcagugagccgagauugu

SEQ ID NO: 2693083 - RNA, 19 nt, Human
ugcacgcacacugucugcc

SEQ ID NO: 2693084 - RNA, 17 nt, Human
ugcugaaacaacaaaua

SEQ ID NO: 2693085 - RNA, 19 nt, Human
ugcuaagcauuccaacuau

SEQ ID NO: 2693086 - RNA, 15 nt, Human
ugcuaagcauuccaa

SEQ ID NO: 2693087 - RNA, 16 nt, Human
ugcucaguagucagac

SEQ ID NO: 2693088 - RNA, 15 nt, Human
ugccuucucaacucc

SEQ ID NO: 2693089 - RNA, 18 nt, Human
ugccuguaaucacagcua

SEQ ID NO: 2693090 - RNA, 19 nt, Human
uccucugcuugccaucccu

SEQ ID NO: 2693091 - RNA, 17 nt, Human
uccucugcuugccaucc

SEQ ID NO: 2693092 - RNA, 16 nt, Human
uccucugcuugccauc

SEQ ID NO: 2693093 - RNA, 15 nt, Human
uccucugcuugccau

SEQ ID NO: 2693094 - RNA, 14 nt, Human
uccucugcuugcca

SEQ ID NO: 2693095 - RNA, 16 nt, Human
uccugaggcuccacuu

SEQ ID NO: 2693096 - RNA, 17 nt, Human
uccugaggcuccacuug

SEQ ID NO: 2693097 - RNA, 21 nt, Human
uccugaggcuccacuuggucu

SEQ ID NO: 2693098 - RNA, 15 nt, Human
uccugaggcuccacu

SEQ ID NO: 2693099 - RNA, 17 nt, Human
uccuugcaucaauuuuu

SEQ ID NO: 2693100 - RNA, 15 nt, Human
ucggccuccauccug

SEQ ID NO: 2693101 - RNA, 16 nt, Human
ucggccuccauccuga

SEQ ID NO: 2693102 - RNA, 15 nt, Human
ucggagcccugucuc

SEQ ID NO: 2693103 - RNA, 14 nt, Human
ucggagcccugucu

SEQ ID NO: 2693104 - RNA, 12 nt, Human
ucuacuaaaaau

SEQ ID NO: 2693105 - RNA, 19 nt, Human
ucuacuaaaaauacaaaaa

SEQ ID NO: 2693106 - RNA, 15 nt, Human
ucuacuaaaaauaca

SEQ ID NO: 2693107 - RNA, 12 nt, Human
uccauacauuug

SEQ ID NO: 2693108 - RNA, 19 nt, Human
ucauggaauuggagcucgu

SEQ ID NO: 2693109 - RNA, 21 nt, Human
ucauggaauuggagcucgugg

SEQ ID NO: 2693110 - RNA, 18 nt, Human
ucaguccaugaagaugua

SEQ ID NO: 2693111 - RNA, 22 nt, Human
ucagcuccccucggagaagagc

SEQ ID NO: 2693112 - RNA, 21 nt, Human
ucagcuccccucggagaagag

SEQ ID NO: 2693113 - RNA, 16 nt, Human
ucagcugcugaaacaa

SEQ ID NO: 2693114 - RNA, 16 nt, Human
ucuucuuggucucagu

SEQ ID NO: 2693115 - RNA, 19 nt, Human
ucuugccaaauauaaauaa

SEQ ID NO: 2693116 - RNA, 22 nt, Human
ucuuaggguuaugauuaaguaa

SEQ ID NO: 2693117 - RNA, 13 nt, Human
ucuuauaauuuaa

SEQ ID NO: 2693118 - RNA, 14 nt, Human
ucuuauaauuuaaa

SEQ ID NO: 2693119 - RNA, 17 nt, Human
ucuuuccacagaagcuc

SEQ ID NO: 2693120 - RNA, 14 nt, Human
ucugucucagucca

SEQ ID NO: 2693121 - RNA, 15 nt, Human
ugagcaggauuuuaa

SEQ ID NO: 2693122 - RNA, 20 nt, Human
ugagcaggauuuuaaucuuu

SEQ ID NO: 2693123 - RNA, 15 nt, Human
ugagaaagacuauuc

SEQ ID NO: 2693124 - RNA, 13 nt, Human
ugacucuuaagaa

SEQ ID NO: 2693125 - RNA, 16 nt, Human
ugacucuuaagaagac

SEQ ID NO: 2693126 - RNA, 15 nt, Human
ugacucuuaagaaga

SEQ ID NO: 2693127 - RNA, 14 nt, Human
ugacucuuaagaag

SEQ ID NO: 2693128 - RNA, 15 nt, Human
ugaaugaauggcuaa

SEQ ID NO: 2693129 - RNA, 20 nt, Human
ugaaugaauggcuaagcaaa

SEQ ID NO: 2693130 - RNA, 16 nt, Human
ugaccacugcagaaga

SEQ ID NO: 2693131 - RNA, 17 nt, Human
ugaccacugcagaagac

SEQ ID NO: 2693132 - RNA, 18 nt, Human
ugaccacugcagaagaca

SEQ ID NO: 2693133 - RNA, 14 nt, Human
ugaauuaaguuuuu

SEQ ID NO: 2693134 - RNA, 13 nt, Human
ugaauuacauuug

SEQ ID NO: 2693135 - RNA, 14 nt, Human
ugaauuacauuugu

SEQ ID NO: 2693136 - RNA, 16 nt, Human
uaccuaucaucuuaag

SEQ ID NO: 2693137 - RNA, 22 nt, Human
uaccaaaaaucucaauauuuca

SEQ ID NO: 2693138 - RNA, 22 nt, Human
uaccuaacgaaguauccuucag

SEQ ID NO: 2693139 - RNA, 23 nt, Human
uacugucagcuccccucggagaa

SEQ ID NO: 2693140 - RNA, 23 nt, Human
uacaguucggugagcuacaaaug

SEQ ID NO: 2693141 - RNA, 14 nt, Human
uacacuccagugag

SEQ ID NO: 2693142 - RNA, 17 nt, Human
uacacacucaaaucaag

SEQ ID NO: 2693143 - RNA, 16 nt, Human
uacacacucaaaucaa

SEQ ID NO: 2693144 - RNA, 12 nt, Human
uaauuuuuauau

SEQ ID NO: 2693145 - RNA, 18 nt, Human
uaauuuugugaagcaaaa

SEQ ID NO: 2693146 - RNA, 17 nt, Human
uaauuuuuauauuugaa

SEQ ID NO: 2693147 - RNA, 16 nt, Human
uaauuuuuauauuuga

SEQ ID NO: 2693148 - RNA, 13 nt, Human
uaauuuugugaag

SEQ ID NO: 2693149 - RNA, 23 nt, Human
uagaauaccacaggaaccacaag

SEQ ID NO: 2693150 - RNA, 15 nt, Human
uagaauuaacacaug

SEQ ID NO: 2693151 - RNA, 16 nt, Human
uagaauuaacacauga

SEQ ID NO: 2693152 - RNA, 18 nt, Human
uagaauuaacacaugauc

SEQ ID NO: 2693153 - RNA, 16 nt, Human
uagcaugaagacagag

SEQ ID NO: 2693154 - RNA, 14 nt, Human
uagauaggccaugg

SEQ ID NO: 2693155 - RNA, 20 nt, Human
uaggugcuacaaaaacacag

SEQ ID NO: 2693156 - RNA, 22 nt, Human
uaggugcuacaaaaacacagca

SEQ ID NO: 2693157 - RNA, 23 nt, Human
uaggugcuacaaaaacacagcaa

SEQ ID NO: 2693158 - RNA, 18 nt, Human
uaggugcuacaaaaacac

SEQ ID NO: 2693159 - RNA, 17 nt, Human
uaguauuguccaggucu

SEQ ID NO: 2693160 - RNA, 19 nt, Human
uauauaacaaugcuguauu

SEQ ID NO: 2693161 - RNA, 17 nt, Human
uauauaacaaugcugua

SEQ ID NO: 2693162 - RNA, 14 nt, Human
uaucaaaagaaaga

SEQ ID NO: 2693163 - RNA, 21 nt, Human
uauauuuuuuguuaaaugauu

SEQ ID NO: 2693164 - RNA, 20 nt, Human
uauauuugaaauauugacuu

SEQ ID NO: 2693165 - RNA, 16 nt, Human
uauaugcuucuguuuu

SEQ ID NO: 2693166 - RNA, 14 nt, Human
uauaugcuucuguu

SEQ ID NO: 2693167 - RNA, 17 nt, Human
uaaccaggggccaugaa

SEQ ID NO: 2693168 - RNA, 21 nt, Human
uaagaaaauaucacuugucaa

SEQ ID NO: 2693169 - RNA, 23 nt, Human
uaagagagaaugagagacacacu

SEQ ID NO: 2693170 - RNA, 14 nt, Human
uaagagagaaugag

SEQ ID NO: 2693171 - RNA, 13 nt, Human
uaagagagaauga

SEQ ID NO: 2693172 - RNA, 15 nt, Human
uaacuggaaacuuca

SEQ ID NO: 2693173 - RNA, 20 nt, Human
uaaauggcuuccuggcaaua

SEQ ID NO: 2693174 - RNA, 20 nt, Human
uaaauugacacuuaaaaaug

SEQ ID NO: 2693175 - RNA, 16 nt, Human
uaaaugugcuuuuaaa

SEQ ID NO: 2693176 - RNA, 16 nt, Human
uaaaugugccuucauu

SEQ ID NO: 2693177 - RNA, 13 nt, Human
uaagugaaauaag

SEQ ID NO: 2693178 - RNA, 14 nt, Human
uaauaauguuucaa

SEQ ID NO: 2693179 - RNA, 22 nt, Human
uaauguuucaaacauauauaac

SEQ ID NO: 2693180 - RNA, 22 nt, Human
uaaugauaacuggaaacuucag

SEQ ID NO: 2693181 - RNA, 17 nt, Human
uaaugauaacuggaaac

SEQ ID NO: 2693182 - RNA, 23 nt, Human
uaaugauaacuggaaacuucagc

SEQ ID NO: 2693183 - RNA, 14 nt, Human
uaaaguguuugaaa

SEQ ID NO: 2693184 - RNA, 19 nt, Human
uaaaaaugguuuaaauggu

SEQ ID NO: 2693185 - RNA, 15 nt, Human
uaaaaaugguuuaaa

SEQ ID NO: 2693186 - RNA, 18 nt, Human
uaaaaaugguuuaaaugg

SEQ ID NO: 2693187 - RNA, 22 nt, Human
uaaaacaagcacuaaacaaaga

SEQ ID NO: 2693188 - RNA, 18 nt, Human
uaaaaucauuucugcauc

SEQ ID NO: 2693189 - RNA, 22 nt, Human
uaaaaucauuucugcaucagcu

SEQ ID NO: 2693190 - RNA, 17 nt, Human
uaaaauccauacauuug

SEQ ID NO: 2693191 - RNA, 15 nt, Human
uaaaauccauacauu

SEQ ID NO: 2693192 - RNA, 10 nt, Human
uaaaaucauu

SEQ ID NO: 2693193 - RNA, 13 nt, Human
uaaaaucauuucu

SEQ ID NO: 2693194 - RNA, 13 nt, Human
uaaaaccacagca

SEQ ID NO: 2693195 - RNA, 20 nt, Human
guuuauauaagcuuguauuc

SEQ ID NO: 2693196 - RNA, 21 nt, Human
guuuagcuggaaaaguauguu

SEQ ID NO: 2693197 - RNA, 20 nt, Human
guuuagcuggaaaaguaugu

SEQ ID NO: 2693198 - RNA, 21 nt, Human
gugcuacaaaaacacagcaag

SEQ ID NO: 2693199 - RNA, 15 nt, Human
gugcuacaaaaacac

SEQ ID NO: 2693200 - RNA, 20 nt, Human
gugcuacaaaaacacagcaa

SEQ ID NO: 2693201 - RNA, 21 nt, Human
guguaaguagauaggccaugg

SEQ ID NO: 2693202 - RNA, 14 nt, Human
gugugcguccuguc

SEQ ID NO: 2693203 - RNA, 16 nt, Human
gugugcguccugucgg

SEQ ID NO: 2693204 - RNA, 20 nt, Human
guuaaaagaugaaaauauuu

SEQ ID NO: 2693205 - RNA, 14 nt, Human
guuaaaagaugaaa

SEQ ID NO: 2693206 - RNA, 16 nt, Human
guuaaaagaugaaaau

SEQ ID NO: 2693207 - RNA, 16 nt, Human
guucaucaaugaauga

SEQ ID NO: 2693208 - RNA, 19 nt, Human
guucagagcugcccucucc

SEQ ID NO: 2693209 - RNA, 17 nt, Human
guucagagcugcccucu

SEQ ID NO: 2693210 - RNA, 16 nt, Human
guucagagcugcccuc

SEQ ID NO: 2693211 - RNA, 15 nt, Human
guucagagcugcccu

SEQ ID NO: 2693212 - RNA, 22 nt, Human
guucagagcugcccucuccugg

SEQ ID NO: 2693213 - RNA, 20 nt, Human
guucagagcugcccucuccu

SEQ ID NO: 2693214 - RNA, 23 nt, Human
guucagagcugcccucuccuggg

SEQ ID NO: 2693215 - RNA, 14 nt, Human
guucagagcugccc

SEQ ID NO: 2693216 - RNA, 13 nt, Human
guucagagcugcc

SEQ ID NO: 2693217 - RNA, 23 nt, Human
guuaccucugccucagaaaacaa

SEQ ID NO: 2693218 - RNA, 20 nt, Human
guugauggugguauguuuuc

SEQ ID NO: 2693219 - RNA, 21 nt, Human
guugauggugguauguuuuca

SEQ ID NO: 2693220 - RNA, 17 nt, Human
guugaaaagacuccaaa

SEQ ID NO: 2693221 - RNA, 22 nt, Human
guugaaaagacuccaaagaaau

SEQ ID NO: 2693222 - RNA, 23 nt, Human
guugaaaagacuccaaagaaaug

SEQ ID NO: 2693223 - RNA, 13 nt, Human
guucugaagaaga

SEQ ID NO: 2693224 - RNA, 12 nt, Human
guucugaagaag

SEQ ID NO: 2693225 - RNA, 15 nt, Human
guucugaagaagaug

SEQ ID NO: 2693226 - RNA, 14 nt, Human
guucugaagaagau

SEQ ID NO: 2693227 - RNA, 16 nt, Human
gugacaagcucacaga

SEQ ID NO: 2693228 - RNA, 13 nt, Human
gugaacacaucag

SEQ ID NO: 2693229 - RNA, 21 nt, Human
gugaacaaauuuacagagaca

SEQ ID NO: 2693230 - RNA, 13 nt, Human
gugcguccugucg

SEQ ID NO: 2693231 - RNA, 13 nt, Human
gucugacuguuuc

SEQ ID NO: 2693232 - RNA, 23 nt, Human
gucggguuuuauuguuuaaaauc

SEQ ID NO: 2693233 - RNA, 12 nt, Human
gucggagcccug

SEQ ID NO: 2693234 - RNA, 16 nt, Human
gucggagcccugucuc

SEQ ID NO: 2693235 - RNA, 18 nt, Human
gucgucaaagcugaaaug

SEQ ID NO: 2693236 - RNA, 15 nt, Human
gucugugagaugcua

SEQ ID NO: 2693237 - RNA, 16 nt, Human
gucugugagaugcuag

SEQ ID NO: 2693238 - RNA, 17 nt, Human
gucugugagaugcuaga

SEQ ID NO: 2693239 - RNA, 21 nt, Human
gucugugagaugcuagaacuc

SEQ ID NO: 2693240 - RNA, 22 nt, Human
gucugugagaugcuagaacucc

SEQ ID NO: 2693241 - RNA, 23 nt, Human
gucugugagaugcuagaacuccc

SEQ ID NO: 2693242 - RNA, 17 nt, Human
guauguuagugcaaauu

SEQ ID NO: 2693243 - RNA, 18 nt, Human
gcuauaggugcuacaaaa

SEQ ID NO: 2693244 - RNA, 15 nt, Human
guaguguuggagaag

SEQ ID NO: 2693245 - RNA, 14 nt, Human
guaguguuggagaa

SEQ ID NO: 2693246 - RNA, 19 nt, Human
gucagcuccccucggagaa

SEQ ID NO: 2693247 - RNA, 20 nt, Human
guauuuuaaaagaaugauua

SEQ ID NO: 2693248 - RNA, 13 nt, Human
guauuuuaaucac

SEQ ID NO: 2693249 - RNA, 18 nt, Human
guauuuuaaaagaaugau

SEQ ID NO: 2693250 - RNA, 15 nt, Human
gucaaugcagccccc

SEQ ID NO: 2693251 - RNA, 22 nt, Human
gucaauaaaauccauacauuug

SEQ ID NO: 2693252 - RNA, 23 nt, Human
gucaauaaaauccauacauuugu

SEQ ID NO: 2693253 - RNA, 23 nt, Human
gucagcuccccucggagaagagc

SEQ ID NO: 2693254 - RNA, 21 nt, Human
gucagcuccccucggagaaga

SEQ ID NO: 2693255 - RNA, 22 nt, Human
gucagcuccccucggagaagag

SEQ ID NO: 2693256 - RNA, 18 nt, Human
uuuuuaaaaaagaaacau

SEQ ID NO: 2693257 - RNA, 18 nt, Human
uuuuggucuggagggaag

SEQ ID NO: 2693258 - RNA, 14 nt, Human
uuuuccugaaaacc

SEQ ID NO: 2693259 - RNA, 19 nt, Human
uuuuucucuaggaaauauu

SEQ ID NO: 2693260 - RNA, 17 nt, Human
uuucuuauuucauuucu

SEQ ID NO: 2693261 - RNA, 18 nt, Human
uuugaaucaucaagucuu

SEQ ID NO: 2693262 - RNA, 18 nt, Human
uuuccucauuuuuauaau

SEQ ID NO: 2693263 - RNA, 13 nt, Human
uuucugagaaaga

SEQ ID NO: 2693264 - RNA, 15 nt, Human
uuucugagaaagacu

SEQ ID NO: 2693265 - RNA, 13 nt, Human
uuugguuucuagc

SEQ ID NO: 2693266 - RNA, 16 nt, Human
uuuguauaaaauaauu

SEQ ID NO: 2693267 - RNA, 14 nt, Human
uuuguauaaaauaa

SEQ ID NO: 2693268 - RNA, 13 nt, Human
uuuguauaaaaua

SEQ ID NO: 2693269 - RNA, 21 nt, Human
uuuuaaaagaaugauuaugaa

SEQ ID NO: 2693270 - RNA, 20 nt, Human
uuuuaauaauguuucaaaca

SEQ ID NO: 2693271 - RNA, 23 nt, Human
gccaucccucccuccaccucccu

SEQ ID NO: 2693272 - RNA, 18 nt, Human
gccaucccucccuccacc

SEQ ID NO: 2693273 - RNA, 19 nt, Human
gccaugggcacugugggua

SEQ ID NO: 2693274 - RNA, 22 nt, Human
gccuccccuccucugcuugcca

SEQ ID NO: 2693275 - RNA, 20 nt, Human
gccuccccuccucugcuugc

SEQ ID NO: 2693276 - RNA, 23 nt, Human
gccuccccuccucugcuugccau

SEQ ID NO: 2693277 - RNA, 19 nt, Human
gccuccccuccucugcuug

SEQ ID NO: 2693278 - RNA, 17 nt, Human
gccuccccuccucugcu

SEQ ID NO: 2693279 - RNA, 20 nt, Human
gccgggcgugguggugagug

SEQ ID NO: 2693280 - RNA, 22 nt, Human
gccgugugugugcguccugucg

SEQ ID NO: 2693281 - RNA, 23 nt, Human
gccguggugauuuagcaggaagc

SEQ ID NO: 2693282 - RNA, 13 nt, Human
gcuauaggugcua

SEQ ID NO: 2693283 - RNA, 19 nt, Human
gcuagaacucccuuucaac

SEQ ID NO: 2693284 - RNA, 12 nt, Human
gcgacagugaga

SEQ ID NO: 2693285 - RNA, 18 nt, Human
gcagauaaacaguaguga

SEQ ID NO: 2693286 - RNA, 20 nt, Human
gcagccccgugggguuccuc

SEQ ID NO: 2693287 - RNA, 12 nt, Human
gcaucagcugcu

SEQ ID NO: 2693288 - RNA, 13 nt, Human
gcauuauauuuau

SEQ ID NO: 2693289 - RNA, 17 nt, Human
gcauagguuuaauaauu

SEQ ID NO: 2693290 - RNA, 13 nt, Human
gcauagaaguaaa

SEQ ID NO: 2693291 - RNA, 17 nt, Human
gcaguucugaagaagau

SEQ ID NO: 2693292 - RNA, 18 nt, Human
gcaguucagagcugcccu

SEQ ID NO: 2693293 - RNA, 17 nt, Human
gcaguucagagcugccc

SEQ ID NO: 2693294 - RNA, 15 nt, Human
gcaguucugaagaag

SEQ ID NO: 2693295 - RNA, 16 nt, Human
gcaguucagagcugcc

SEQ ID NO: 2693296 - RNA, 15 nt, Human
gauuuuccugaaaac

SEQ ID NO: 2693297 - RNA, 19 nt, Human
gauuuucagcccucagaau

SEQ ID NO: 2693298 - RNA, 15 nt, Human
gauuuucagcccuca

SEQ ID NO: 2693299 - RNA, 11 nt, Human
gauuuucagcc

SEQ ID NO: 2693300 - RNA, 23 nt, Human
gcaaagcacugacuucuaaguaa

SEQ ID NO: 2693301 - RNA, 10 nt, Human
gcaagccaga

SEQ ID NO: 2693302 - RNA, 14 nt, Human
gcaagggugauggg

SEQ ID NO: 2693303 - RNA, 22 nt, Human
gauaaauaguuuaugauuccac

SEQ ID NO: 2693304 - RNA, 23 nt, Human
gauagauaggucagugcaaauac

SEQ ID NO: 2693305 - RNA, 13 nt, Human
gauagcagggcau

SEQ ID NO: 2693306 - RNA, 21 nt, Human
gauggcuaguaucaaaagaaa

SEQ ID NO: 2693307 - RNA, 14 nt, Human
gaugaaaauauuug

SEQ ID NO: 2693308 - RNA, 13 nt, Human
gauccuggaaauc

SEQ ID NO: 2693309 - RNA, 13 nt, Human
gagaaagacuauu

SEQ ID NO: 2693310 - RNA, 15 nt, Human
gagaaagacuauuca

SEQ ID NO: 2693311 - RNA, 17 nt, Human
gagaaagacuauucaaa

SEQ ID NO: 2693312 - RNA, 18 nt, Human
gagaaagacuauucaaac

SEQ ID NO: 2693313 - RNA, 16 nt, Human
gagaagaacugaaauc

SEQ ID NO: 2693314 - RNA, 14 nt, Human
gagaagaacugaaa

SEQ ID NO: 2693315 - RNA, 13 nt, Human
gagaagaacugaa

SEQ ID NO: 2693316 - RNA, 15 nt, Human
gagaagagcuguuca

SEQ ID NO: 2693317 - RNA, 22 nt, Human
gagaagagcuguucacagccag

SEQ ID NO: 2693318 - RNA, 18 nt, Human
gagacacacugaagaagc

SEQ ID NO: 2693319 - RNA, 15 nt, Human
gagacagcucugcau

SEQ ID NO: 2693320 - RNA, 18 nt, Human
gagacagcucugcauacu

SEQ ID NO: 2693321 - RNA, 13 nt, Human
gagacagcucugc

SEQ ID NO: 2693322 - RNA, 15 nt, Human
gagagugaacaaauu

SEQ ID NO: 2693323 - RNA, 19 nt, Human
gagagugaacaaauuuaca

SEQ ID NO: 2693324 - RNA, 17 nt, Human
gagauacagaauuuuau

SEQ ID NO: 2693325 - RNA, 19 nt, Human
gagagacacacugaagaag

SEQ ID NO: 2693326 - RNA, 16 nt, Human
gagcucgugggacagu

SEQ ID NO: 2693327 - RNA, 23 nt, Human
gagcugcccucuccugggcagcu

SEQ ID NO: 2693328 - RNA, 21 nt, Human
gagcugcccucuccugggcag

SEQ ID NO: 2693329 - RNA, 19 nt, Human
gagcugcccucuccugggc

SEQ ID NO: 2693330 - RNA, 18 nt, Human
gagcugcccucuccuggg

SEQ ID NO: 2693331 - RNA, 14 nt, Human
gacaucaacagaua

SEQ ID NO: 2693332 - RNA, 22 nt, Human
gacaugggacauuugcucaugg

SEQ ID NO: 2693333 - RNA, 17 nt, Human
gacaugggacauuugcu

SEQ ID NO: 2693334 - RNA, 23 nt, Human
gaccugauuucugagcauuuaau

SEQ ID NO: 2693335 - RNA, 13 nt, Human
cuucuuuccacag

SEQ ID NO: 2693336 - RNA, 19 nt, Human
cuucuuuccacagaagcuc

SEQ ID NO: 2693337 - RNA, 14 nt, Human
cuugaacccgggag

SEQ ID NO: 2693338 - RNA, 19 nt, Human
cuugaacccgggaggcaga

SEQ ID NO: 2693339 - RNA, 20 nt, Human
cuugaacccgggaggcagag

SEQ ID NO: 2693340 - RNA, 16 nt, Human
cuugagugcucaguag

SEQ ID NO: 2693341 - RNA, 23 nt, Human
cuugcaucaauuuuucuuauuuc

SEQ ID NO: 2693342 - RNA, 21 nt, Human
cuugcaugguuuagaaagcuu

SEQ ID NO: 2693343 - RNA, 18 nt, Human
cuuguaaaggaauuuaaa

SEQ ID NO: 2693344 - RNA, 17 nt, Human
cuugccaaauauaaaua

SEQ ID NO: 2693345 - RNA, 21 nt, Human
gaaagcuugcccuggugccuc

SEQ ID NO: 2693346 - RNA, 16 nt, Human
gaaacugacacaugcu

SEQ ID NO: 2693347 - RNA, 13 nt, Human
gaaacugccagca

SEQ ID NO: 2693348 - RNA, 15 nt, Human
gaaacugccagcaac

SEQ ID NO: 2693349 - RNA, 13 nt, Human
gaaagcagaacag

SEQ ID NO: 2693350 - RNA, 14 nt, Human
gaaagcagaacagu

SEQ ID NO: 2693351 - RNA, 22 nt, Human
gaaagacuauucaaacagucuc

SEQ ID NO: 2693352 - RNA, 23 nt, Human
gaaagacuauucaaacagucuca

SEQ ID NO: 2693353 - RNA, 19 nt, Human
gaaagacuauucaaacagu

SEQ ID NO: 2693354 - RNA, 24 nt, Human
gaacaguuaccucugccucagaaa

SEQ ID NO: 2693355 - RNA, 13 nt, Human
gaaauauuuauuu

SEQ ID NO: 2693356 - RNA, 16 nt, Human
gaaauauuuauuuuaa

SEQ ID NO: 2693357 - RNA, 15 nt, Human
gaaauauuuauuuua

SEQ ID NO: 2693358 - RNA, 14 nt, Human
gaaggaugcugucu

SEQ ID NO: 2693359 - RNA, 23 nt, Human
gaaguccaagcauuuagauguau

SEQ ID NO: 2693360 - RNA, 17 nt, Human
gaagauguagaggagaa

SEQ ID NO: 2693361 - RNA, 23 nt, Human
gaagagcuguucacagccagacu

SEQ ID NO: 2693362 - RNA, 13 nt, Human
gaagagcuguuca

SEQ ID NO: 2693363 - RNA, 15 nt, Human
gaagagcuguucaca

SEQ ID NO: 2693364 - RNA, 20 nt, Human
gaagagcuguucacagccag

SEQ ID NO: 2693365 - RNA, 22 nt, Human
gaacuuguaaaggaauuuaaaa

SEQ ID NO: 2693366 - RNA, 15 nt, Human
gaaccacaagacugc

SEQ ID NO: 2693367 - RNA, 14 nt, Human
gaaccacaagacug

SEQ ID NO: 2693368 - RNA, 16 nt, Human
gaacucccuuucaaca

SEQ ID NO: 2693369 - RNA, 15 nt, Human
cuguaugauucccag

SEQ ID NO: 2693370 - RNA, 16 nt, Human
cuguauuuuaaaagaa

SEQ ID NO: 2693371 - RNA, 13 nt, Human
cuguauuuuaaaa

SEQ ID NO: 2693372 - RNA, 18 nt, Human
cugucucuacuaaaaaua

SEQ ID NO: 2693373 - RNA, 17 nt, Human
cugucuccucucucugu

SEQ ID NO: 2693374 - RNA, 20 nt, Human
cugucuccucucucuguaau

SEQ ID NO: 2693375 - RNA, 22 nt, Human
cuguaauaaacucauuucuagc

SEQ ID NO: 2693376 - RNA, 16 nt, Human
cuggccuucggccucc

SEQ ID NO: 2693377 - RNA, 17 nt, Human
cuggccuucggccucca

SEQ ID NO: 2693378 - RNA, 18 nt, Human
cuggccuucggccuccau

SEQ ID NO: 2693379 - RNA, 21 nt, Human
cuggccuucggccuccauccu

SEQ ID NO: 2693380 - RNA, 15 nt, Human
cuggccuucggccuc

SEQ ID NO: 2693381 - RNA, 20 nt, Human
cugggaaagggauuuucagc

SEQ ID NO: 2693382 - RNA, 15 nt, Human
cugccagcaacgcag

SEQ ID NO: 2693383 - RNA, 12 nt, Human
cugcacugucaa

SEQ ID NO: 2693384 - RNA, 15 nt, Human
cugcuugccaucccu

SEQ ID NO: 2693385 - RNA, 16 nt, Human
cugcuugccaucccuc

SEQ ID NO: 2693386 - RNA, 22 nt, Human
cugcuugccaucccucccucca

SEQ ID NO: 2693387 - RNA, 20 nt, Human
cugcuugccaucccucccuc

SEQ ID NO: 2693388 - RNA, 19 nt, Human
cugcuugccaucccucccu

SEQ ID NO: 2693389 - RNA, 18 nt, Human
cugcuugccaucccuccc

SEQ ID NO: 2693390 - RNA, 15 nt, Human
cugcccucuccuggg

SEQ ID NO: 2693391 - RNA, 14 nt, Human
cugcccucuccugg

SEQ ID NO: 2693392 - RNA, 13 nt, Human
cugcccucuccug

SEQ ID NO: 2693393 - RNA, 12 nt, Human
cugcccucuccu

SEQ ID NO: 2693394 - RNA, 23 nt, Human
cugaagaagcaccaaucaugaau

SEQ ID NO: 2693395 - RNA, 17 nt, Human
cugaacaucacagcuua

SEQ ID NO: 2693396 - RNA, 22 nt, Human
cucuucuuuaaagggauggcaa

SEQ ID NO: 2693397 - RNA, 20 nt, Human
cucugcuugccaucccuccc

SEQ ID NO: 2693398 - RNA, 17 nt, Human
cucugcuugccaucccu

SEQ ID NO: 2693399 - RNA, 14 nt, Human
cucugcuugccauc

SEQ ID NO: 2693400 - RNA, 12 nt, Human
cucugcuugcca

SEQ ID NO: 2693401 - RNA, 12 nt, Human
cucuggccuucg

SEQ ID NO: 2693402 - RNA, 19 nt, Human
cucuggccuucggccucca

SEQ ID NO: 2693403 - RNA, 17 nt, Human
cugacucuuaagaagac

SEQ ID NO: 2693404 - RNA, 16 nt, Human
cugacuucuaaguaaa

SEQ ID NO: 2693405 - RNA, 13 nt, Human
cugacuucuaagu

SEQ ID NO: 2693406 - RNA, 15 nt, Human
cugacuucuaaguaa

SEQ ID NO: 2693407 - RNA, 22 nt, Human
cugagaaagacuauucaaacag

SEQ ID NO: 2693408 - RNA, 23 nt, Human
cugagaaagacuauucaaacagu

SEQ ID NO: 2693409 - RNA, 16 nt, Human
cugagcgacagugaga

SEQ ID NO: 2693410 - RNA, 20 nt, Human
cugagcgacagugagacucu

SEQ ID NO: 2693411 - RNA, 14 nt, Human
cuccauccugaggc

SEQ ID NO: 2693412 - RNA, 16 nt, Human
cuccauccugaggcuc

SEQ ID NO: 2693413 - RNA, 18 nt, Human
cuccauccugaggcucca

SEQ ID NO: 2693414 - RNA, 17 nt, Human
cucccuccaccucccug

SEQ ID NO: 2693415 - RNA, 15 nt, Human
cucccuccaccuccc

SEQ ID NO: 2693416 - RNA, 17 nt, Human
cucuaggaaauauuuau

SEQ ID NO: 2693417 - RNA, 15 nt, Human
cucuaggaaauauuu

SEQ ID NO: 2693418 - RNA, 12 nt, Human
cucuccugggca

SEQ ID NO: 2693419 - RNA, 19 nt, Human
cucuccugggcagcugccu

SEQ ID NO: 2693420 - RNA, 18 nt, Human
cucuccugggcagcugcc

SEQ ID NO: 2693421 - RNA, 16 nt, Human
cucuccugggcagcug

SEQ ID NO: 2693422 - RNA, 15 nt, Human
cucuccugggcagcu

SEQ ID NO: 2693423 - RNA, 20 nt, Human
cucuccugggcagcugccuc

SEQ ID NO: 2693424 - RNA, 17 nt, Human
cggugagcuacaaaugc

SEQ ID NO: 2693425 - RNA, 22 nt, Human
cggucggguuuuauuguuuaaa

SEQ ID NO: 2693426 - RNA, 21 nt, Human
cggguuuuauuguuuaaaauc

SEQ ID NO: 2693427 - RNA, 12 nt, Human
cggccuccaucc

SEQ ID NO: 2693428 - RNA, 14 nt, Human
cggccuccauccug

SEQ ID NO: 2693429 - RNA, 14 nt, Human
cgcucucuggccuu

SEQ ID NO: 2693430 - RNA, 15 nt, Human
cgcucucuggccuuc

SEQ ID NO: 2693431 - RNA, 18 nt, Human
cgcucucuggccuucggc

SEQ ID NO: 2693432 - RNA, 18 nt, Human
cgugcacgcacacugucu

SEQ ID NO: 2693433 - RNA, 23 nt, Human
cuaaauugacacuuaaaaauggu

SEQ ID NO: 2693434 - RNA, 17 nt, Human
cuacacuccagugagac

SEQ ID NO: 2693435 - RNA, 16 nt, Human
cuacacuccagugaga

SEQ ID NO: 2693436 - RNA, 15 nt, Human
cuaagcaaaauguga

SEQ ID NO: 2693437 - RNA, 18 nt, Human
cuaagcaaaaugugauau

SEQ ID NO: 2693438 - RNA, 14 nt, Human
cuaagcaaaaugug

SEQ ID NO: 2693439 - RNA, 19 nt, Human
cuacuugggaggcugagau

SEQ ID NO: 2693440 - RNA, 15 nt, Human
cuacuugggaggcug

SEQ ID NO: 2693441 - RNA, 18 nt, Human
cuacuugggaggcugaga

SEQ ID NO: 2693442 - RNA, 17 nt, Human
cucaccccuugccauaa

SEQ ID NO: 2693443 - RNA, 13 nt, Human
cucacauuuauau

SEQ ID NO: 2693444 - RNA, 22 nt, Human
cuauauuuuuuguuaaaugauu

SEQ ID NO: 2693445 - RNA, 18 nt, Human
cuaugaaauauuauguua

SEQ ID NO: 2693446 - RNA, 13 nt, Human
cuaugaaauauua

SEQ ID NO: 2693447 - RNA, 20 nt, Human
cuauauuuuuuguuaaauga

SEQ ID NO: 2693448 - RNA, 19 nt, Human
cuauauuguuugcuaagca

SEQ ID NO: 2693449 - RNA, 20 nt, Human
cuaguauuucuaugaaauau

SEQ ID NO: 2693450 - RNA, 19 nt, Human
cuaguauuucuaugaaaua

SEQ ID NO: 2693451 - RNA, 22 nt, Human
cuaguauuucuaugaaauauua

SEQ ID NO: 2693452 - RNA, 15 nt, Human
cuaguaucaaaagaa

SEQ ID NO: 2693453 - RNA, 17 nt, Human
cuaguaucaaaagaaag

SEQ ID NO: 2693454 - RNA, 23 nt, Human
cuaguaucaaaagaaagaaaauc

SEQ ID NO: 2693455 - RNA, 15 nt, Human
cccugcaauaaaaug

SEQ ID NO: 2693456 - RNA, 14 nt, Human
cccugcaauaaaau

SEQ ID NO: 2693457 - RNA, 14 nt, Human
ccccaggugccagu

SEQ ID NO: 2693458 - RNA, 12 nt, Human
cccucccuccac

SEQ ID NO: 2693459 - RNA, 13 nt, Human
cccucccuccacc

SEQ ID NO: 2693460 - RNA, 20 nt, Human
cccucccuccaccucccugc

SEQ ID NO: 2693461 - RNA, 12 nt, Human
ccuccauccuga

SEQ ID NO: 2693462 - RNA, 13 nt, Human
ccuccauccugag

SEQ ID NO: 2693463 - RNA, 13 nt, Human
ccuccccuccucu

SEQ ID NO: 2693464 - RNA, 12 nt, Human
ccuccccuccuc

SEQ ID NO: 2693465 - RNA, 20 nt, Human
ccucagaugcacaugagcug

SEQ ID NO: 2693466 - RNA, 13 nt, Human
ccuaaacauauga

SEQ ID NO: 2693467 - RNA, 16 nt, Human
ccauccugaggcucca

SEQ ID NO: 2693468 - RNA, 15 nt, Human
ccauccugaggcucc

SEQ ID NO: 2693469 - RNA, 23 nt, Human
ccauggcacucuauguucuaaga

SEQ ID NO: 2693470 - RNA, 17 nt, Human
cccaguguuuuaggagc

SEQ ID NO: 2693471 - RNA, 16 nt, Human
cccaguguuuuaggag

SEQ ID NO: 2693472 - RNA, 14 nt, Human
cauuugcucaugga

SEQ ID NO: 2693473 - RNA, 15 nt, Human
cauuugcucauggaa

SEQ ID NO: 2693474 - RNA, 16 nt, Human
cauuugcucauggaau

SEQ ID NO: 2693475 - RNA, 17 nt, Human
ccaaagaaauguaaggg

SEQ ID NO: 2693476 - RNA, 23 nt, Human
cauuucugcaucagcugcugaaa

SEQ ID NO: 2693477 - RNA, 19 nt, Human
cauuuaaagcuuauuaaaa

SEQ ID NO: 2693478 - RNA, 18 nt, Human
ccaaggcuagaaccaccu

SEQ ID NO: 2693479 - RNA, 19 nt, Human
ccaaggcugauuaaaccaa

SEQ ID NO: 2693480 - RNA, 20 nt, Human
ccaauauucauagcagcuua

SEQ ID NO: 2693481 - RNA, 16 nt, Human
ccacaagaaaugaaag

SEQ ID NO: 2693482 - RNA, 22 nt, Human
ccacaagaaaugaaagcaggga

SEQ ID NO: 2693483 - RNA, 14 nt, Human
ccaacacgagcagg

SEQ ID NO: 2693484 - RNA, 21 nt, Human
ccaacacgagcaggcuacugu

SEQ ID NO: 2693485 - RNA, 17 nt, Human
caugggacagggaggac

SEQ ID NO: 2693486 - RNA, 23 nt, Human
caugcugucuacacuaagagaga

SEQ ID NO: 2693487 - RNA, 20 nt, Human
cauauauaacaaugcuguau

SEQ ID NO: 2693488 - RNA, 22 nt, Human
caucaagucuuucacauuuaaa

SEQ ID NO: 2693489 - RNA, 18 nt, Human
caucaaugaaugaaugaa

SEQ ID NO: 2693490 - RNA, 13 nt, Human
caucccucccucc

SEQ ID NO: 2693491 - RNA, 12 nt, Human
caucccucccuc

SEQ ID NO: 2693492 - RNA, 14 nt, Human
caucccucccucca

SEQ ID NO: 2693493 - RNA, 14 nt, Human
caucuagugagcag

SEQ ID NO: 2693494 - RNA, 22 nt, Human
caucuagugagcagucaggaaa

SEQ ID NO: 2693495 - RNA, 14 nt, Human
caguuuucugagaa

SEQ ID NO: 2693496 - RNA, 15 nt, Human
caguuuucugagaaa

SEQ ID NO: 2693497 - RNA, 19 nt, Human
caguuuucugagaaagacu

SEQ ID NO: 2693498 - RNA, 20 nt, Human
caguuuucugagaaagacua

SEQ ID NO: 2693499 - RNA, 21 nt, Human
caguugaaaagacuccaaaga

SEQ ID NO: 2693500 - RNA, 22 nt, Human
caguugaaaagacuccaaagaa

SEQ ID NO: 2693501 - RNA, 23 nt, Human
caguugaaaagacuccaaagaaa

SEQ ID NO: 2693502 - RNA, 14 nt, Human
caguugaaaagacu

SEQ ID NO: 2693503 - RNA, 18 nt, Human
caguugaaaagacuccaa

SEQ ID NO: 2693504 - RNA, 17 nt, Human
cauaccaacacgagcag

SEQ ID NO: 2693505 - RNA, 22 nt, Human
caguucggugagcuacaaaugc

SEQ ID NO: 2693506 - RNA, 16 nt, Human
caguucugaagaagau

SEQ ID NO: 2693507 - RNA, 15 nt, Human
caguucugaagaaga

SEQ ID NO: 2693508 - RNA, 22 nt, Human
caguucugaagaagaugguacc

SEQ ID NO: 2693509 - RNA, 14 nt, Human
caguucugaagaag

SEQ ID NO: 2693510 - RNA, 13 nt, Human
caguucugaagaa

SEQ ID NO: 2693511 - RNA, 12 nt, Human
caguucugaaga

SEQ ID NO: 2693512 - RNA, 21 nt, Human
caguuaccucugccucagaaa

SEQ ID NO: 2693513 - RNA, 20 nt, Human
caguguuuuaggagcaugag

SEQ ID NO: 2693514 - RNA, 16 nt, Human
caguguuuuaggagca

SEQ ID NO: 2693515 - RNA, 14 nt, Human
cagugucaaugcag

SEQ ID NO: 2693516 - RNA, 21 nt, Human
gccuucggccuccauccugag

SEQ ID NO: 2693517 - RNA, 20 nt, Human
gccuucggccuccauccuga

SEQ ID NO: 2693518 - RNA, 12 nt, Human
gccuccauccug

SEQ ID NO: 2693519 - RNA, 15 nt, Human
gccucuuagaugcag

SEQ ID NO: 2693520 - RNA, 19 nt, Human
gcuccaccuugcagcucuc

SEQ ID NO: 2693521 - RNA, 15 nt, Human
gcuccacuuggucug

SEQ ID NO: 2693522 - RNA, 18 nt, Human
gcuccacuuggucuguga

SEQ ID NO: 2693523 - RNA, 19 nt, Human
gcuccacuuggucugugag

SEQ ID NO: 2693524 - RNA, 21 nt, Human
gcuccccucggagaagagcug

SEQ ID NO: 2693525 - RNA, 16 nt, Human
gcuagaacucccuuuc

SEQ ID NO: 2693526 - RNA, 18 nt, Human
gcuagaacucccuuucaa

SEQ ID NO: 2693527 - RNA, 12 nt, Human
gcuagaacuccc

SEQ ID NO: 2693528 - RNA, 13 nt, Human
gcuagaacucccu

SEQ ID NO: 2693529 - RNA, 14 nt, Human
gcuagaacucccuu

SEQ ID NO: 2693530 - RNA, 15 nt, Human
gcuagaacucccuuu

SEQ ID NO: 2693531 - RNA, 13 nt, Human
ggagaaacuggaa

SEQ ID NO: 2693532 - RNA, 22 nt, Human
ggacucauuuuaaaaaauggaa

SEQ ID NO: 2693533 - RNA, 14 nt, Human
ggccuccauccuga

SEQ ID NO: 2693534 - RNA, 15 nt, Human
ggccuccauccugag

SEQ ID NO: 2693535 - RNA, 21 nt, Human
ggcacaguuuucugagaaaga

SEQ ID NO: 2693536 - RNA, 14 nt, Human
ggcuccacuugguc

SEQ ID NO: 2693537 - RNA, 17 nt, Human
aaaaaugguuuaaaugg

SEQ ID NO: 2693538 - RNA, 15 nt, Human
aaaacuucagacaua

SEQ ID NO: 2693539 - RNA, 14 nt, Human
aaaaauaacaauga

SEQ ID NO: 2693540 - RNA, 20 nt, Human
gggaacccaaguccaagcau

SEQ ID NO: 2693541 - RNA, 22 nt, Human
gggacagucaccucauggaauu

SEQ ID NO: 2693542 - RNA, 21 nt, Human
gggacagucaccucauggaau

SEQ ID NO: 2693543 - RNA, 20 nt, Human
gggacagucaccucauggaa

SEQ ID NO: 2693544 - RNA, 11 nt, Human
aaacacagcaa

SEQ ID NO: 2693545 - RNA, 12 nt, Human
aaacacagcaag

SEQ ID NO: 2693546 - RNA, 14 nt, Human
aaacacagcaaggg

SEQ ID NO: 2693547 - RNA, 19 nt, Human
ggggaauugaggacacuga

SEQ ID NO: 2693548 - RNA, 15 nt, Human
aaacagucucaggaa

SEQ ID NO: 2693549 - RNA, 14 nt, Human
aaacaguagugaua

SEQ ID NO: 2693550 - RNA, 12 nt, Human
aaaccacagcag

SEQ ID NO: 2693551 - RNA, 15 nt, Human
aaacucguuaauuug

SEQ ID NO: 2693552 - RNA, 17 nt, Human
aaagcacugacuucuaa

SEQ ID NO: 2693553 - RNA, 21 nt, Human
aaagcacugacuucuaaguaa

SEQ ID NO: 2693554 - RNA, 14 nt, Human
aaagguacuucaaa

SEQ ID NO: 2693555 - RNA, 20 nt, Human
aaagggauggcaagaugugg

SEQ ID NO: 2693556 - RNA, 19 nt, Human
aaacuucagacauagaauu

SEQ ID NO: 2693557 - RNA, 23 nt, Human
aaacuucagcgguuuauauaagc

SEQ ID NO: 2693558 - RNA, 13 nt, Human
aaagacagugaaa

SEQ ID NO: 2693559 - RNA, 18 nt, Human
aaagacuauucaaacagu

SEQ ID NO: 2693560 - RNA, 19 nt, Human
aaagacuauucaaacaguc

SEQ ID NO: 2693561 - RNA, 17 nt, Human
aaagacuauucaaacag

SEQ ID NO: 2693562 - RNA, 21 nt, Human
aaagacuauucaaacagucuc

SEQ ID NO: 2693563 - RNA, 15 nt, Human
aaagacuccaaagaa

SEQ ID NO: 2693564 - RNA, 21 nt, Human
aaagacuccaaagaaauguaa

SEQ ID NO: 2693565 - RNA, 14 nt, Human
aaagacuccaaaga

SEQ ID NO: 2693566 - RNA, 15 nt, Human
aaagaggcagcuuga

SEQ ID NO: 2693567 - RNA, 15 nt, Human
aaagaggaaugaagu

SEQ ID NO: 2693568 - RNA, 23 nt, Human
aaaguucugcagauaaacaguag

SEQ ID NO: 2693569 - RNA, 20 nt, Human
aaagguauuuuaaucaccaa

SEQ ID NO: 2693570 - RNA, 18 nt, Human
aaaguauguuagugcaaa

SEQ ID NO: 2693571 - RNA, 19 nt, Human
aaauacacacucaaaucaa

SEQ ID NO: 2693572 - RNA, 23 nt, Human
aaauaauuuuuauauuugaaaua

SEQ ID NO: 2693573 - RNA, 22 nt, Human
aaauaauuuuuauauuugaaau

SEQ ID NO: 2693574 - RNA, 15 nt, Human
aaauacacacucaaa

SEQ ID NO: 2693575 - RNA, 21 nt, Human
aaauaauuuuuauauuugaaa

SEQ ID NO: 2693576 - RNA, 23 nt, Human
guacacugccuucucaacuccaa

SEQ ID NO: 2693577 - RNA, 20 nt, Human
guaauaggcguaacuaauuu

SEQ ID NO: 2693578 - RNA, 18 nt, Human
aaauccauacauuugugu

SEQ ID NO: 2693579 - RNA, 15 nt, Human
aaauccauacauuug

SEQ ID NO: 2693580 - RNA, 17 nt, Human
aaauauuauguuaaaac

SEQ ID NO: 2693581 - RNA, 12 nt, Human
aaaucauuucug

SEQ ID NO: 2693582 - RNA, 19 nt, Human
aaaucauuucugcaucagc

SEQ ID NO: 2693583 - RNA, 21 nt, Human
aaaucauuucugcaucagcug

SEQ ID NO: 2693584 - RNA, 22 nt, Human
aaaucauuucugcaucagcugc

SEQ ID NO: 2693585 - RNA, 23 nt, Human
aaaucauuucugcaucagcugcu

SEQ ID NO: 2693586 - RNA, 22 nt, Human
guacuucaaauccuugaagauu

SEQ ID NO: 2693587 - RNA, 21 nt, Human
guacuucaaauccuugaagau

SEQ ID NO: 2693588 - RNA, 15 nt, Human
guacuucaugcuguc

SEQ ID NO: 2693589 - RNA, 20 nt, Human
guagacgugcacgcacacug

SEQ ID NO: 2693590 - RNA, 23 nt, Human
guagacgugcacgcacacugucu

SEQ ID NO: 2693591 - RNA, 15 nt, Human
gacuauucaaacagu

SEQ ID NO: 2693592 - RNA, 16 nt, Human
gacuauucaaacaguc

SEQ ID NO: 2693593 - RNA, 20 nt, Human
gacaguauggcagcuuuccu

SEQ ID NO: 2693594 - RNA, 14 nt, Human
gacagaaagcagaa

SEQ ID NO: 2693595 - RNA, 20 nt, Human
gacagaaagcagaacaguga

SEQ ID NO: 2693596 - RNA, 21 nt, Human
gacagcccuucuuuccacaga

SEQ ID NO: 2693597 - RNA, 13 nt, Human
gagcgacagugag

SEQ ID NO: 2693598 - RNA, 15 nt, Human
gagcgacagugagac

SEQ ID NO: 2693599 - RNA, 22 nt, Human
gcaguugaaaagacuccaaaga

SEQ ID NO: 2693600 - RNA, 15 nt, Human
gcagcuuauucacaa

SEQ ID NO: 2693601 - RNA, 16 nt, Human
gcauuguaaaugugcu

SEQ ID NO: 2693602 - RNA, 21 nt, Human
gaugcugucuucguacuggga

SEQ ID NO: 2693603 - RNA, 16 nt, Human
gcaauaaaauggguuu

SEQ ID NO: 2693604 - RNA, 18 nt, Human
gcaauagucaaauugugu

SEQ ID NO: 2693605 - RNA, 13 nt, Human
cuucucacauuua

SEQ ID NO: 2693606 - RNA, 20 nt, Human
cuucucacauuuauauuuuu

SEQ ID NO: 2693607 - RNA, 21 nt, Human
cuucuaaguaaaaccacagca

SEQ ID NO: 2693608 - RNA, 13 nt, Human
cuucuaaguaaaa

SEQ ID NO: 2693609 - RNA, 17 nt, Human
cuucuaaguaaaaccac

SEQ ID NO: 2693610 - RNA, 16 nt, Human
cuuggucugugagaug

SEQ ID NO: 2693611 - RNA, 19 nt, Human
cuuggucugugagaugcua

SEQ ID NO: 2693612 - RNA, 18 nt, Human
gaaagaaaaucaggcugg

SEQ ID NO: 2693613 - RNA, 20 nt, Human
gaaagggauuuucagcccuc

SEQ ID NO: 2693614 - RNA, 12 nt, Human
gaaagggauuuu

SEQ ID NO: 2693615 - RNA, 21 nt, Human
gaaaacuuuaugcuaagugaa

SEQ ID NO: 2693616 - RNA, 16 nt, Human
gaaaagacuccaaaga

SEQ ID NO: 2693617 - RNA, 17 nt, Human
gaaaagacuccaaagaa

SEQ ID NO: 2693618 - RNA, 14 nt, Human
gaaaagacuccaaa

SEQ ID NO: 2693619 - RNA, 16 nt, Human
gaacccaaguccaagc

SEQ ID NO: 2693620 - RNA, 17 nt, Human
gaacccaaguccaagca

SEQ ID NO: 2693621 - RNA, 17 nt, Human
gaacccgggaggcagag

SEQ ID NO: 2693622 - RNA, 19 nt, Human
cuggauaguccgucucugc

SEQ ID NO: 2693623 - RNA, 18 nt, Human
cuggauaguccgucucug

SEQ ID NO: 2693624 - RNA, 21 nt, Human
cuuaaaaaugguuuaaauggu

SEQ ID NO: 2693625 - RNA, 19 nt, Human
cuguuauaaucuuucacag

SEQ ID NO: 2693626 - RNA, 13 nt, Human
cuguuauaaucuu

SEQ ID NO: 2693627 - RNA, 23 nt, Human
cugucggagcccugucuccucuc

SEQ ID NO: 2693628 - RNA, 17 nt, Human
cugucggagcccugucu

SEQ ID NO: 2693629 - RNA, 23 nt, Human
cuaugucauuugcuggagcucug

SEQ ID NO: 2693630 - RNA, 13 nt, Human
cucaaaacugcac

SEQ ID NO: 2693631 - RNA, 23 nt, Human
cucagaaaacaaggaugaauuaa

SEQ ID NO: 2693632 - RNA, 19 nt, Human
cucagaaaacaaggaugaa

SEQ ID NO: 2693633 - RNA, 14 nt, Human
cuaacuggacuggu

SEQ ID NO: 2693634 - RNA, 15 nt, Human
cgguuuauauaagcu

SEQ ID NO: 2693635 - RNA, 23 nt, Human
cggagaagagcuguucacagcca

SEQ ID NO: 2693636 - RNA, 24 nt, Human
cggagaagagcuguucacagccag

SEQ ID NO: 2693637 - RNA, 19 nt, Human
cucucuggccuucggccuc

SEQ ID NO: 2693638 - RNA, 22 nt, Human
cucucuggccuucggccuccau

SEQ ID NO: 2693639 - RNA, 17 nt, Human
cucucuggccuucggcc

SEQ ID NO: 2693640 - RNA, 21 nt, Human
cugacacaugcugaacaucac

SEQ ID NO: 2693641 - RNA, 13 nt, Human
cugaaagaggaau

SEQ ID NO: 2693642 - RNA, 17 nt, Human
cugaaagaggaaugaag

SEQ ID NO: 2693643 - RNA, 24 nt, Human
cccagccagcaguucagagcugcc

SEQ ID NO: 2693644 - RNA, 13 nt, Human
ccccugcacucca

SEQ ID NO: 2693645 - RNA, 22 nt, Human
cccuccucugcuugccaucccu

SEQ ID NO: 2693646 - RNA, 13 nt, Human
cccuccucugcuu

SEQ ID NO: 2693647 - RNA, 15 nt, Human
ccaucccucccucca

SEQ ID NO: 2693648 - RNA, 14 nt, Human
ccaucccucccucc

SEQ ID NO: 2693649 - RNA, 13 nt, Human
ccaucccucccuc

SEQ ID NO: 2693650 - RNA, 13 nt, Human
cccaacuccagaa

SEQ ID NO: 2693651 - RNA, 17 nt, Human
ccugucucuacuaaaaa

SEQ ID NO: 2693652 - RNA, 21 nt, Human
ccucauuuuuauaaugucccu

SEQ ID NO: 2693653 - RNA, 16 nt, Human
ccucccuucucuucac

SEQ ID NO: 2693654 - RNA, 12 nt, Human
ccucggagaaga

SEQ ID NO: 2693655 - RNA, 14 nt, Human
ccucggagaagagc

SEQ ID NO: 2693656 - RNA, 23 nt, Human
cacuccagccugagcgacaguga

SEQ ID NO: 2693657 - RNA, 12 nt, Human
cacuccagccug

SEQ ID NO: 2693658 - RNA, 13 nt, Human
cacuccagccuga

SEQ ID NO: 2693659 - RNA, 12 nt, Human
cagaacagugau

SEQ ID NO: 2693660 - RNA, 17 nt, Human
cagaacagugauuacca

SEQ ID NO: 2693661 - RNA, 11 nt, Human
cagaacaguga

SEQ ID NO: 2693662 - RNA, 18 nt, Human
cagaacagugauuaccag

SEQ ID NO: 2693663 - RNA, 17 nt, Human
cacuuguguuuugcaag

SEQ ID NO: 2693664 - RNA, 15 nt, Human
cacuuaaaaaugguu

SEQ ID NO: 2693665 - RNA, 23 nt, Human
caauaaaauccauacauuugugu

SEQ ID NO: 2693666 - RNA, 20 nt, Human
caauaaaauccauacauuug

SEQ ID NO: 2693667 - RNA, 15 nt, Human
caauaaaauggguuu

SEQ ID NO: 2693668 - RNA, 17 nt, Human
caaacauauauaacaau

SEQ ID NO: 2693669 - RNA, 16 nt, Human
caaacagucucaggaa

SEQ ID NO: 2693670 - RNA, 17 nt, Human
caaacagucucaggaaa

SEQ ID NO: 2693671 - RNA, 15 nt, Human
caaacagucucagga

SEQ ID NO: 2693672 - RNA, 21 nt, Human
caaaaggauaaugaauacuuu

SEQ ID NO: 2693673 - RNA, 15 nt, Human
auuuuuauauuugaa

SEQ ID NO: 2693674 - RNA, 21 nt, Human
auuuuauaucaauuuaaaaaa

SEQ ID NO: 2693675 - RNA, 19 nt, Human
caagacccaaaaggcagaa

SEQ ID NO: 2693676 - RNA, 21 nt, Human
caaaucuuaacuugaaggagu

SEQ ID NO: 2693677 - RNA, 22 nt, Human
auuaugaauuacauuuguauaa

SEQ ID NO: 2693678 - RNA, 20 nt, Human
auuaugaauuacauuuguau

SEQ ID NO: 2693679 - RNA, 19 nt, Human
auuaugaauuacauuugua

SEQ ID NO: 2693680 - RNA, 15 nt, Human
auuguuuaaaaucau

SEQ ID NO: 2693681 - RNA, 20 nt, Human
auuucauaccuaucaucuua

SEQ ID NO: 2693682 - RNA, 14 nt, Human
auuucuaugaaaua

SEQ ID NO: 2693683 - RNA, 16 nt, Human
auuuaauaaaugugcc

SEQ ID NO: 2693684 - RNA, 18 nt, Human
ccacagaagcuccaggua

SEQ ID NO: 2693685 - RNA, 18 nt, Human
ccaccagucugacuguuu

SEQ ID NO: 2693686 - RNA, 16 nt, Human
ccacagaagcuccagg

SEQ ID NO: 2693687 - RNA, 13 nt, Human
cauuaucucaaaa

SEQ ID NO: 2693688 - RNA, 12 nt, Human
cauuaucucaaa

SEQ ID NO: 2693689 - RNA, 17 nt, Human
cagggaggacgcucucu

SEQ ID NO: 2693690 - RNA, 18 nt, Human
cagggaggacgcucucug

SEQ ID NO: 2693691 - RNA, 15 nt, Human
cagucucaggaaauc

SEQ ID NO: 2693692 - RNA, 15 nt, Human
cagucaccucaugga

SEQ ID NO: 2693693 - RNA, 15 nt, Human
cagagcugcccucuc

SEQ ID NO: 2693694 - RNA, 13 nt, Human
cagagcugcccuc

SEQ ID NO: 2693695 - RNA, 17 nt, Human
cagagcugcccucuccu

SEQ ID NO: 2693696 - RNA, 22 nt, Human
cagcacagccucuuagaugcag

SEQ ID NO: 2693697 - RNA, 14 nt, Human
cagccagcaguuca

SEQ ID NO: 2693698 - RNA, 21 nt, Human
cagccagcaguucagagcugc

SEQ ID NO: 2693699 - RNA, 15 nt, Human
cagccagcaguucag

SEQ ID NO: 2693700 - RNA, 22 nt, Human
cagccagcaguucagagcugcc

SEQ ID NO: 2693701 - RNA, 20 nt, Human
cagcaguugaaaagacucca

SEQ ID NO: 2693702 - RNA, 21 nt, Human
cagcaguugaaaagacuccaa

SEQ ID NO: 2693703 - RNA, 17 nt, Human
cagcaguugaaaagacu

SEQ ID NO: 2693704 - RNA, 22 nt, Human
cagcaguugaaaagacuccaaa

SEQ ID NO: 2693705 - RNA, 19 nt, Human
cagccugagcgacagugag

SEQ ID NO: 2693706 - RNA, 22 nt, Human
cagccugagcgacagugagacu

SEQ ID NO: 2693707 - RNA, 18 nt, Human
cagccugagcgacaguga

SEQ ID NO: 2693708 - RNA, 20 nt, Human
cagcccuucuuuccacagaa

SEQ ID NO: 2693709 - RNA, 19 nt, Human
cagcccuucuuuccacaga

SEQ ID NO: 2693710 - RNA, 15 nt, Human
cagcccuucuuucca

SEQ ID NO: 2693711 - RNA, 22 nt, Human
cagcugccuccccuccucugcu

SEQ ID NO: 2693712 - RNA, 21 nt, Human
cagcugccuccccuccucugc

SEQ ID NO: 2693713 - RNA, 24 nt, Human
cagcugccuccccuccucugcuug

SEQ ID NO: 2693714 - RNA, 23 nt, Human
cagcugccuccccuccucugcuu

SEQ ID NO: 2693715 - RNA, 20 nt, Human
cagcuccccucggagaagag

SEQ ID NO: 2693716 - RNA, 17 nt, Human
cagcuccccucggagaa

SEQ ID NO: 2693717 - RNA, 18 nt, Human
cagcuccccucggagaag

SEQ ID NO: 2693718 - RNA, 16 nt, Human
cagcuccccucggaga

SEQ ID NO: 2693719 - RNA, 23 nt, Human
caggaaaucaaauaugcaaagca

SEQ ID NO: 2693720 - RNA, 18 nt, Human
auuauauuuauuacugua

SEQ ID NO: 2693721 - RNA, 15 nt, Human
auuauauuuauuacu

SEQ ID NO: 2693722 - RNA, 21 nt, Human
auuauguuaaaacugggacag

SEQ ID NO: 2693723 - RNA, 16 nt, Human
auucaaacagucucag

SEQ ID NO: 2693724 - RNA, 18 nt, Human
auucaaacagucucagga

SEQ ID NO: 2693725 - RNA, 19 nt, Human
auucaaacagucucaggaa

SEQ ID NO: 2693726 - RNA, 20 nt, Human
auucaaacagucucaggaaa

SEQ ID NO: 2693727 - RNA, 15 nt, Human
auuauauuuacaaau

SEQ ID NO: 2693728 - RNA, 19 nt, Human
auugacacuuaaaaauggu

SEQ ID NO: 2693729 - RNA, 15 nt, Human
auugacacuuaaaaa

SEQ ID NO: 2693730 - RNA, 17 nt, Human
auugacacuuaaaaaug

SEQ ID NO: 2693731 - RNA, 18 nt, Human
auuuuuuguuaaaugauu

SEQ ID NO: 2693732 - RNA, 23 nt, Human
auuuuuucucuaggaaauauuua

SEQ ID NO: 2693733 - RNA, 20 nt, Human
auuuuuucucuaggaaauau

SEQ ID NO: 2693734 - RNA, 21 nt, Human
auuuuuguuuucauuaucuca

SEQ ID NO: 2693735 - RNA, 22 nt, Human
auuuuugugauuuugugauuga

SEQ ID NO: 2693736 - RNA, 19 nt, Human
auuuuucuuauuucauuuc

SEQ ID NO: 2693737 - RNA, 20 nt, Human
auuuuucuuauuucauuucu

SEQ ID NO: 2693738 - RNA, 15 nt, Human
auuuuucuuauuuca

SEQ ID NO: 2693739 - RNA, 14 nt, Human
auuuuccugaaaac

SEQ ID NO: 2693740 - RNA, 14 nt, Human
auuuucuauaauuu

SEQ ID NO: 2693741 - RNA, 15 nt, Human
auuuucuauaauuua

SEQ ID NO: 2693742 - RNA, 12 nt, Human
auuuuaauaaug

SEQ ID NO: 2693743 - RNA, 16 nt, Human
auuuuaaaagaaugau

SEQ ID NO: 2693744 - RNA, 23 nt, Human
auuuuaaaagaaugauuaugaau

SEQ ID NO: 2693745 - RNA, 14 nt, Human
auuuguauaaaaua

SEQ ID NO: 2693746 - RNA, 22 nt, Human
auuuguaguguuggagaagaac

SEQ ID NO: 2693747 - RNA, 19 nt, Human
auuuguaguguuggagaag

SEQ ID NO: 2693748 - RNA, 14 nt, Human
auuuauuuuaauaa

SEQ ID NO: 2693749 - RNA, 13 nt, Human
auugucuagugaa

SEQ ID NO: 2693750 - RNA, 13 nt, Human
auugacuuuuuau

SEQ ID NO: 2693751 - RNA, 19 nt, Human
auuggagcucgugggacag

SEQ ID NO: 2693752 - RNA, 19 nt, Human
auuggacaguaaaauccac

SEQ ID NO: 2693753 - RNA, 20 nt, Human
augcuagaacucccuuucaa

SEQ ID NO: 2693754 - RNA, 21 nt, Human
augcuagaacucccuuucaac

SEQ ID NO: 2693755 - RNA, 22 nt, Human
augcuagaacucccuuucaaca

SEQ ID NO: 2693756 - RNA, 16 nt, Human
uuucaaacauauauaa

SEQ ID NO: 2693757 - RNA, 17 nt, Human
uuucaaacauauauaac

SEQ ID NO: 2693758 - RNA, 19 nt, Human
auggcuaagcaaaauguga

SEQ ID NO: 2693759 - RNA, 16 nt, Human
auggcacuaguauuuc

SEQ ID NO: 2693760 - RNA, 14 nt, Human
auggcacuaguauu

SEQ ID NO: 2693761 - RNA, 15 nt, Human
augauaacuggaaac

SEQ ID NO: 2693762 - RNA, 14 nt, Human
augauuaaguaaug

SEQ ID NO: 2693763 - RNA, 18 nt, Human
augauuaaguaaugauaa

SEQ ID NO: 2693764 - RNA, 17 nt, Human
augccauuuaaagcuua

SEQ ID NO: 2693765 - RNA, 21 nt, Human
augccauuuaaagcuuauuaa

SEQ ID NO: 2693766 - RNA, 13 nt, Human
augcaguucugaa

SEQ ID NO: 2693767 - RNA, 18 nt, Human
uuuaaauauaugcuaagu

SEQ ID NO: 2693768 - RNA, 15 nt, Human
uuugaaauauugacu

SEQ ID NO: 2693769 - RNA, 18 nt, Human
uuucucccagucauuuaa

SEQ ID NO: 2693770 - RNA, 17 nt, Human
uuucucccagucauuua

SEQ ID NO: 2693771 - RNA, 21 nt, Human
augguucccuugaugaagaag

SEQ ID NO: 2693772 - RNA, 14 nt, Human
uuugcaagccagau

SEQ ID NO: 2693773 - RNA, 16 nt, Human
auguacuucaugcugu

SEQ ID NO: 2693774 - RNA, 12 nt, Human
auguagaggaga

SEQ ID NO: 2693775 - RNA, 13 nt, Human
auguagaggagaa

SEQ ID NO: 2693776 - RNA, 17 nt, Human
auguagaggagaaacug

SEQ ID NO: 2693777 - RNA, 19 nt, Human
auguagaggagaaacugga

SEQ ID NO: 2693778 - RNA, 16 nt, Human
auguccacugguucuu

SEQ ID NO: 2693779 - RNA, 17 nt, Human
auguccacugguucuuc

SEQ ID NO: 2693780 - RNA, 17 nt, Human
uuugugaagcaaaauuu

SEQ ID NO: 2693781 - RNA, 21 nt, Human
uuuguaguguuggagaagaac

SEQ ID NO: 2693782 - RNA, 19 nt, Human
uuuguaguguuggagaaga

SEQ ID NO: 2693783 - RNA, 14 nt, Human
uucggccuccaucc

SEQ ID NO: 2693784 - RNA, 15 nt, Human
uucggccuccauccu

SEQ ID NO: 2693785 - RNA, 23 nt, Human
uucuaagaagugaaaaucuacac

SEQ ID NO: 2693786 - RNA, 13 nt, Human
uucuaagaaguga

SEQ ID NO: 2693787 - RNA, 15 nt, Human
uucuaaguaaaacca

SEQ ID NO: 2693788 - RNA, 16 nt, Human
uucuaaguaaaaccac

SEQ ID NO: 2693789 - RNA, 19 nt, Human
uucuagcaugaagacagag

SEQ ID NO: 2693790 - RNA, 17 nt, Human
aucaggguuaguauugu

SEQ ID NO: 2693791 - RNA, 22 nt, Human
aucacuugucaauaaaauccau

SEQ ID NO: 2693792 - RNA, 20 nt, Human
auauuuuuuguuaaaugauu

SEQ ID NO: 2693793 - RNA, 18 nt, Human
auauuuuuuguuaaauga

SEQ ID NO: 2693794 - RNA, 14 nt, Human
aucaacagauaaau

SEQ ID NO: 2693795 - RNA, 19 nt, Human
uuccguagguuauuuucag

SEQ ID NO: 2693796 - RNA, 12 nt, Human
uucucuaggaaa

SEQ ID NO: 2693797 - RNA, 19 nt, Human
uugaacccgggaggcagag

SEQ ID NO: 2693798 - RNA, 17 nt, Human
uugaaauuguauuacaa

SEQ ID NO: 2693799 - RNA, 18 nt, Human
uugaacccgggaggcaga

SEQ ID NO: 2693800 - RNA, 13 nt, Human
uugcaucaauuuu

SEQ ID NO: 2693801 - RNA, 22 nt, Human
uugcaagccagauuuuccugaa

SEQ ID NO: 2693802 - RNA, 14 nt, Human
aucucauuuccaag

SEQ ID NO: 2693803 - RNA, 17 nt, Human
uugaagggaaauuucag

SEQ ID NO: 2693804 - RNA, 19 nt, Human
aucuacacuccagugagac

SEQ ID NO: 2693805 - RNA, 18 nt, Human
aucuacacuccagugaga

SEQ ID NO: 2693806 - RNA, 14 nt, Human
aucuuauaauuuaa

SEQ ID NO: 2693807 - RNA, 16 nt, Human
augaauuacauuugua

SEQ ID NO: 2693808 - RNA, 15 nt, Human
augaauuacauuugu

SEQ ID NO: 2693809 - RNA, 15 nt, Human
augaauuaaguuuuu

SEQ ID NO: 2693810 - RNA, 23 nt, Human
augaauggcuaagcaaaauguga

SEQ ID NO: 2693811 - RNA, 14 nt, Human
auaagccagacauc

SEQ ID NO: 2693812 - RNA, 14 nt, Human
auaaucuuucacag

SEQ ID NO: 2693813 - RNA, 15 nt, Human
uuagggagagaagau

SEQ ID NO: 2693814 - RNA, 16 nt, Human
uuaggguuaugauuaa

SEQ ID NO: 2693815 - RNA, 14 nt, Human
uuaggguuaugauu

SEQ ID NO: 2693816 - RNA, 22 nt, Human
uuaaaaucauuucugcaucagc

SEQ ID NO: 2693817 - RNA, 14 nt, Human
uuaaaaucauuucu

SEQ ID NO: 2693818 - RNA, 16 nt, Human
uuaaaaaauggaacau

SEQ ID NO: 2693819 - RNA, 19 nt, Human
uuaaaaaagaaacauuugg

SEQ ID NO: 2693820 - RNA, 15 nt, Human
aguuuagcuggaaaa

SEQ ID NO: 2693821 - RNA, 17 nt, Human
aguuuaaauuguaauag

SEQ ID NO: 2693822 - RNA, 20 nt, Human
aguuuaaauuguaauaggcg

SEQ ID NO: 2693823 - RNA, 16 nt, Human
aguuuuauaugcuucu

SEQ ID NO: 2693824 - RNA, 15 nt, Human
uuauuauauuuacaa

SEQ ID NO: 2693825 - RNA, 14 nt, Human
uuauuauauuuaca

SEQ ID NO: 2693826 - RNA, 19 nt, Human
uuauguuaaaacugggaca

SEQ ID NO: 2693827 - RNA, 16 nt, Human
auacucauuaggaugg

SEQ ID NO: 2693828 - RNA, 18 nt, Human
auagauaggucagugcaa

SEQ ID NO: 2693829 - RNA, 17 nt, Human
auagaauuaacacauga

SEQ ID NO: 2693830 - RNA, 13 nt, Human
auagaaguaaaaa

SEQ ID NO: 2693831 - RNA, 19 nt, Human
uuaugauuaaguaaugaua

SEQ ID NO: 2693832 - RNA, 21 nt, Human
uuaugaauuacauuuguauaa

SEQ ID NO: 2693833 - RNA, 17 nt, Human
uuaugaauuacauuugu

SEQ ID NO: 2693834 - RNA, 16 nt, Human
uuaugaauuacauuug

SEQ ID NO: 2693835 - RNA, 14 nt, Human
uuaugaauuacauu

SEQ ID NO: 2693836 - RNA, 19 nt, Human
uuauauuugaaauauugac

SEQ ID NO: 2693837 - RNA, 17 nt, Human
auacuauggaauuucuc

SEQ ID NO: 2693838 - RNA, 14 nt, Human
agugcaaauuguca

SEQ ID NO: 2693839 - RNA, 22 nt, Human
agugaacaaauuuacagagaca

SEQ ID NO: 2693840 - RNA, 23 nt, Human
agugaacaaauuuacagagacag

SEQ ID NO: 2693841 - RNA, 21 nt, Human
agugaacaaauuuacagagac

SEQ ID NO: 2693842 - RNA, 18 nt, Human
agucuuucacauuuaaau

SEQ ID NO: 2693843 - RNA, 16 nt, Human
agucuuucacauuuaa

SEQ ID NO: 2693844 - RNA, 22 nt, Human
uguugcccacagcuguaugauu

SEQ ID NO: 2693845 - RNA, 15 nt, Human
uguucuaagaaguga

SEQ ID NO: 2693846 - RNA, 13 nt, Human
aguaaugauaacu

SEQ ID NO: 2693847 - RNA, 13 nt, Human
aguaauuggaaag

SEQ ID NO: 2693848 - RNA, 12 nt, Human
aguaauuggaaa

SEQ ID NO: 2693849 - RNA, 16 nt, Human
aguaaaaccacagcag

SEQ ID NO: 2693850 - RNA, 17 nt, Human
aguaaaaccacagcagu

SEQ ID NO: 2693851 - RNA, 19 nt, Human
aguaaaaccacagcaguug

SEQ ID NO: 2693852 - RNA, 20 nt, Human
aguaaaaccacagcaguuga

SEQ ID NO: 2693853 - RNA, 16 nt, Human
uguaguguuggagaag

SEQ ID NO: 2693854 - RNA, 18 nt, Human
uguaguguuggagaagaa

SEQ ID NO: 2693855 - RNA, 17 nt, Human
uguaguguuggagaaga

SEQ ID NO: 2693856 - RNA, 13 nt, Human
uguaagggaaacu

SEQ ID NO: 2693857 - RNA, 18 nt, Human
uguaagggaaacugccag

SEQ ID NO: 2693858 - RNA, 19 nt, Human
uguaagggaaacugccagc

SEQ ID NO: 2693859 - RNA, 14 nt, Human
agguugcagugagc

SEQ ID NO: 2693860 - RNA, 16 nt, Human
aggugcuacaaaaaca

SEQ ID NO: 2693861 - RNA, 16 nt, Human
agucucaggaaaucaa

SEQ ID NO: 2693862 - RNA, 13 nt, Human
agucucaggaaau

SEQ ID NO: 2693863 - RNA, 14 nt, Human
agucaggaaagaga

SEQ ID NO: 2693864 - RNA, 20 nt, Human
uguccagccccguagacgug

SEQ ID NO: 2693865 - RNA, 19 nt, Human
ugggaggcugagaugggag

SEQ ID NO: 2693866 - RNA, 13 nt, Human
agggagagaagau

SEQ ID NO: 2693867 - RNA, 14 nt, Human
agggagagaagaua

SEQ ID NO: 2693868 - RNA, 23 nt, Human
agggacuucugucuucacaacag

SEQ ID NO: 2693869 - RNA, 22 nt, Human
agggcuguuauaaucuuucaca

SEQ ID NO: 2693870 - RNA, 20 nt, Human
ugggaacccaaguccaagca

SEQ ID NO: 2693871 - RNA, 16 nt, Human
agggaaacugccagca

SEQ ID NO: 2693872 - RNA, 19 nt, Human
agggaaacugccagcaacg

SEQ ID NO: 2693873 - RNA, 21 nt, Human
agggaaacugccagcaacgca

SEQ ID NO: 2693874 - RNA, 23 nt, Human
agggaaacugccagcaacgcagg

SEQ ID NO: 2693875 - RNA, 14 nt, Human
agggaaacugccag

SEQ ID NO: 2693876 - RNA, 15 nt, Human
agggaaacugccagc

SEQ ID NO: 2693877 - RNA, 14 nt, Human
ugggaaagcauugu

SEQ ID NO: 2693878 - RNA, 16 nt, Human
ugggaaagcauuguaa

SEQ ID NO: 2693879 - RNA, 17 nt, Human
ugggaaagcauuguaaa

SEQ ID NO: 2693880 - RNA, 18 nt, Human
ugggaaagcauuguaaau

SEQ ID NO: 2693881 - RNA, 21 nt, Human
ugggaaagcauuguaaaugug

SEQ ID NO: 2693882 - RNA, 18 nt, Human
ugggaaacaaaaggauaa

SEQ ID NO: 2693883 - RNA, 23 nt, Human
uggcuauaggugcuacaaaaaca

SEQ ID NO: 2693884 - RNA, 18 nt, Human
uggcuaagcaaaauguga

SEQ ID NO: 2693885 - RNA, 15 nt, Human
uggcuauaggugcua

SEQ ID NO: 2693886 - RNA, 19 nt, Human
uggcuauaggugcuacaaa

SEQ ID NO: 2693887 - RNA, 11 nt, Human
aggcuccacuu

SEQ ID NO: 2693888 - RNA, 17 nt, Human
aggcuccacuuggucug

SEQ ID NO: 2693889 - RNA, 21 nt, Human
aggcuccacuuggucugugag

SEQ ID NO: 2693890 - RNA, 22 nt, Human
aggcuccacuuggucugugaga

SEQ ID NO: 2693891 - RNA, 16 nt, Human
uggagaagaacugaaa

SEQ ID NO: 2693892 - RNA, 20 nt, Human
aggcagcucuaaaugucaau

SEQ ID NO: 2693893 - RNA, 18 nt, Human
aggaaauauuuauuuuaa

SEQ ID NO: 2693894 - RNA, 14 nt, Human
aggaaauauuuauu

SEQ ID NO: 2693895 - RNA, 19 nt, Human
aggaaaucaaauaugcaaa

SEQ ID NO: 2693896 - RNA, 19 nt, Human
aggaauugacccacaagaa

SEQ ID NO: 2693897 - RNA, 21 nt, Human
agcuuauugucuagugaaacu

SEQ ID NO: 2693898 - RNA, 20 nt, Human
agcuuauuaaaacucauuuu

SEQ ID NO: 2693899 - RNA, 15 nt, Human
agcuuauuaaaacuc

SEQ ID NO: 2693900 - RNA, 19 nt, Human
aggaaagagaacuuccaga

SEQ ID NO: 2693901 - RNA, 13 nt, Human
aggaaagagaacu

SEQ ID NO: 2693902 - RNA, 14 nt, Human
ugcuaguaauugga

SEQ ID NO: 2693903 - RNA, 16 nt, Human
ugcuaguaauuggaaa

SEQ ID NO: 2693904 - RNA, 23 nt, Human
agcugccuccccuccucugcuug

SEQ ID NO: 2693905 - RNA, 22 nt, Human
agcugccuccccuccucugcuu

SEQ ID NO: 2693906 - RNA, 21 nt, Human
agcugccuccccuccucugcu

SEQ ID NO: 2693907 - RNA, 20 nt, Human
agcugccuccccuccucugc

SEQ ID NO: 2693908 - RNA, 19 nt, Human
agcugccuccccuccucug

SEQ ID NO: 2693909 - RNA, 18 nt, Human
agcugccuccccuccucu

SEQ ID NO: 2693910 - RNA, 17 nt, Human
agcugccuccccuccuc

SEQ ID NO: 2693911 - RNA, 13 nt, Human
agcuggaaaagua

SEQ ID NO: 2693912 - RNA, 14 nt, Human
ugcagugagccgag

SEQ ID NO: 2693913 - RNA, 19 nt, Human
agccugagcgacagugaga

SEQ ID NO: 2693914 - RNA, 18 nt, Human
agccugagcgacagugag

SEQ ID NO: 2693915 - RNA, 17 nt, Human
agcccuucuuuccacag

SEQ ID NO: 2693916 - RNA, 19 nt, Human
agcccuucuuuccacagaa

SEQ ID NO: 2693917 - RNA, 18 nt, Human
agcccuucuuuccacaga

SEQ ID NO: 2693918 - RNA, 19 nt, Human
agcuauggugucauaggcu

SEQ ID NO: 2693919 - RNA, 18 nt, Human
ucuguuuuauaauuuugu

SEQ ID NO: 2693920 - RNA, 18 nt, Human
ucuuaauuaaaagaauau

SEQ ID NO: 2693921 - RNA, 21 nt, Human
ucuuaauuaaaagaauauuuu

SEQ ID NO: 2693922 - RNA, 14 nt, Human
ucuuaauuaaaaga

SEQ ID NO: 2693923 - RNA, 21 nt, Human
agacuggauaguccgucucug

SEQ ID NO: 2693924 - RNA, 18 nt, Human
agacuggcacaguuuucu

SEQ ID NO: 2693925 - RNA, 14 nt, Human
agacuggcacaguu

SEQ ID NO: 2693926 - RNA, 15 nt, Human
agacuggcacaguuu

SEQ ID NO: 2693927 - RNA, 17 nt, Human
agagacacacugaagaa

SEQ ID NO: 2693928 - RNA, 15 nt, Human
agagaaugagagaca

SEQ ID NO: 2693929 - RNA, 20 nt, Human
agagacacacugaagaagca

SEQ ID NO: 2693930 - RNA, 18 nt, Human
agagacacacugaagaag

SEQ ID NO: 2693931 - RNA, 17 nt, Human
ucuuuaaaauacacacu

SEQ ID NO: 2693932 - RNA, 21 nt, Human
ucuuuaaagggauggcaagau

SEQ ID NO: 2693933 - RNA, 16 nt, Human
agacuccaaagaaaug

SEQ ID NO: 2693934 - RNA, 19 nt, Human
agacuccaaagaaauguaa

SEQ ID NO: 2693935 - RNA, 13 nt, Human
agacuccaaagaa

SEQ ID NO: 2693936 - RNA, 14 nt, Human
agacuccaaagaaa

SEQ ID NO: 2693937 - RNA, 12 nt, Human
agacuccaaaga

SEQ ID NO: 2693938 - RNA, 18 nt, Human
agacuauucaaacagucu

SEQ ID NO: 2693939 - RNA, 20 nt, Human
agacuauucaaacagucuca

SEQ ID NO: 2693940 - RNA, 21 nt, Human
agacuauucaaacagucucag

SEQ ID NO: 2693941 - RNA, 19 nt, Human
agaaagacuauucaaacag

SEQ ID NO: 2693942 - RNA, 18 nt, Human
agaaagacuauucaaaca

SEQ ID NO: 2693943 - RNA, 20 nt, Human
agaaagacuauucaaacagu

SEQ ID NO: 2693944 - RNA, 23 nt, Human
agaaagacuauucaaacagucuc

SEQ ID NO: 2693945 - RNA, 21 nt, Human
ucugacuguuuccaucaaggg

SEQ ID NO: 2693946 - RNA, 14 nt, Human
ucugagaaagacua

SEQ ID NO: 2693947 - RNA, 15 nt, Human
ucugagaaagacuau

SEQ ID NO: 2693948 - RNA, 19 nt, Human
ucugagaaagacuauucaa

SEQ ID NO: 2693949 - RNA, 20 nt, Human
ucugagaaagacuauucaaa

SEQ ID NO: 2693950 - RNA, 23 nt, Human
ucugagaaagacuauucaaacag

SEQ ID NO: 2693951 - RNA, 21 nt, Human
ucugagaaagacuauucaaac

SEQ ID NO: 2693952 - RNA, 22 nt, Human
ucugagaaagacuauucaaaca

SEQ ID NO: 2693953 - RNA, 14 nt, Human
agaacucccuuuca

SEQ ID NO: 2693954 - RNA, 21 nt, Human
agaagaacugaaaucauacuu

SEQ ID NO: 2693955 - RNA, 11 nt, Human
ucugcuugcca

SEQ ID NO: 2693956 - RNA, 14 nt, Human
agaagcuccaggua

SEQ ID NO: 2693957 - RNA, 14 nt, Human
ucugcuugccaucc

SEQ ID NO: 2693958 - RNA, 12 nt, Human
ucugcuugccau

SEQ ID NO: 2693959 - RNA, 15 nt, Human
ucucccagucauuua

SEQ ID NO: 2693960 - RNA, 15 nt, Human
ucuccucucucugua

SEQ ID NO: 2693961 - RNA, 22 nt, Human
acuuuuuauggcacuaguauuu

SEQ ID NO: 2693962 - RNA, 19 nt, Human
agaaaacaaggaugaauua

SEQ ID NO: 2693963 - RNA, 13 nt, Human
agaaacuggaacu

SEQ ID NO: 2693964 - RNA, 15 nt, Human
agaaacuggaacucu

SEQ ID NO: 2693965 - RNA, 14 nt, Human
agaaagaaaaucag

SEQ ID NO: 2693966 - RNA, 13 nt, Human
ucucuucuuuaaa

SEQ ID NO: 2693967 - RNA, 12 nt, Human
ucucuucuuuaa

SEQ ID NO: 2693968 - RNA, 16 nt, Human
ucucuggccuucggcc

SEQ ID NO: 2693969 - RNA, 17 nt, Human
ucucuggccuucggccu

SEQ ID NO: 2693970 - RNA, 13 nt, Human
ucucuggccuucg

SEQ ID NO: 2693971 - RNA, 16 nt, Human
agauuuaccacuugug

SEQ ID NO: 2693972 - RNA, 16 nt, Human
agauugugccccugca

SEQ ID NO: 2693973 - RNA, 15 nt, Human
ugacuguuuccauca

SEQ ID NO: 2693974 - RNA, 19 nt, Human
agaugaugaugaucuuuaa

SEQ ID NO: 2693975 - RNA, 23 nt, Human
agaugcuagaacucccuuucaac

SEQ ID NO: 2693976 - RNA, 22 nt, Human
agaugcuagaacucccuuucaa

SEQ ID NO: 2693977 - RNA, 20 nt, Human
ugaagaagcaccaaucauga

SEQ ID NO: 2693978 - RNA, 14 nt, Human
ugaagaagauggua

SEQ ID NO: 2693979 - RNA, 18 nt, Human
ugaagauguagaggagaa

SEQ ID NO: 2693980 - RNA, 17 nt, Human
ugaagauguagaggaga

SEQ ID NO: 2693981 - RNA, 14 nt, Human
agagugaacaaauu

SEQ ID NO: 2693982 - RNA, 22 nt, Human
agagugaacaaauuuacagaga

SEQ ID NO: 2693983 - RNA, 16 nt, Human
ugagcuacaaaugcau

SEQ ID NO: 2693984 - RNA, 13 nt, Human
ugagcuacaaaug

SEQ ID NO: 2693985 - RNA, 14 nt, Human
ugagcuacaaaugc

SEQ ID NO: 2693986 - RNA, 15 nt, Human
ugaggacacugauau

SEQ ID NO: 2693987 - RNA, 17 nt, Human
ugagguacugagaguga

SEQ ID NO: 2693988 - RNA, 22 nt, Human
ugagguacugagagugaacaaa

SEQ ID NO: 2693989 - RNA, 13 nt, Human
ugagcgacaguga

SEQ ID NO: 2693990 - RNA, 14 nt, Human
ugagcgacagugag

SEQ ID NO: 2693991 - RNA, 16 nt, Human
ugagcgacagugagac

SEQ ID NO: 2693992 - RNA, 20 nt, Human
ugagcgacagugagacucug

SEQ ID NO: 2693993 - RNA, 14 nt, Human
agcagaacagugau

SEQ ID NO: 2693994 - RNA, 14 nt, Human
agcaacgcaggccc

SEQ ID NO: 2693995 - RNA, 22 nt, Human
agcacagccucuuagaugcagu

SEQ ID NO: 2693996 - RNA, 16 nt, Human
agcaccaaucaugaau

SEQ ID NO: 2693997 - RNA, 23 nt, Human
accacuuguguuuugcaagccag

SEQ ID NO: 2693998 - RNA, 19 nt, Human
accacuuguguuuugcaag

SEQ ID NO: 2693999 - RNA, 14 nt, Human
accacugcagaaga

SEQ ID NO: 2694000 - RNA, 19 nt, Human
accacugcagaagacagua

SEQ ID NO: 2694001 - RNA, 13 nt, Human
accacugcagaag

SEQ ID NO: 2694002 - RNA, 11 nt, Human
accacagcagu

SEQ ID NO: 2694003 - RNA, 12 nt, Human
uauuucauuucu

SEQ ID NO: 2694004 - RNA, 21 nt, Human
acccaaauguucaucaaugaa

SEQ ID NO: 2694005 - RNA, 18 nt, Human
acccaaaaggcagaagca

SEQ ID NO: 2694006 - RNA, 13 nt, Human
acccaaaaggcag

SEQ ID NO: 2694007 - RNA, 15 nt, Human
acccaaaaggcagaa

SEQ ID NO: 2694008 - RNA, 18 nt, Human
ucagaugcacaugagcug

SEQ ID NO: 2694009 - RNA, 22 nt, Human
ucaugaauuaguuuuauaugcu

SEQ ID NO: 2694010 - RNA, 21 nt, Human
uccagccugagcgacagugag

SEQ ID NO: 2694011 - RNA, 20 nt, Human
uccagccugagcgacaguga

SEQ ID NO: 2694012 - RNA, 21 nt, Human
uccaacuaucucauuuccaag

SEQ ID NO: 2694013 - RNA, 17 nt, Human
acugaggggaggggagc

SEQ ID NO: 2694014 - RNA, 22 nt, Human
acugaggggaggggagcauggg

SEQ ID NO: 2694015 - RNA, 17 nt, Human
uccugggcagcugccuc

SEQ ID NO: 2694016 - RNA, 16 nt, Human
uccugggcagcugccu

SEQ ID NO: 2694017 - RNA, 15 nt, Human
uccugggcagcugcc

SEQ ID NO: 2694018 - RNA, 23 nt, Human
uccugggcagcugccuccccucc

SEQ ID NO: 2694019 - RNA, 22 nt, Human
uccugggcagcugccuccccuc

SEQ ID NO: 2694020 - RNA, 19 nt, Human
uccugggcagcugccuccc

SEQ ID NO: 2694021 - RNA, 18 nt, Human
uccugggcagcugccucc

SEQ ID NO: 2694022 - RNA, 22 nt, Human
acugccuucucaacuccaaacu

SEQ ID NO: 2694023 - RNA, 21 nt, Human
acuggcacaguuuucugagaa

SEQ ID NO: 2694024 - RNA, 22 nt, Human
acuggcacaguuuucugagaaa

SEQ ID NO: 2694025 - RNA, 13 nt, Human
uccuucagccuga

SEQ ID NO: 2694026 - RNA, 13 nt, Human
acuaaaaauacaa

SEQ ID NO: 2694027 - RNA, 12 nt, Human
uccccuccucug

SEQ ID NO: 2694028 - RNA, 20 nt, Human
uccucaaaacuucagacaua

SEQ ID NO: 2694029 - RNA, 20 nt, Human
acucauuuuaaaaaauggaa

SEQ ID NO: 2694030 - RNA, 22 nt, Human
uauaaaauaauuuuuauauuug

SEQ ID NO: 2694031 - RNA, 21 nt, Human
uauaaaauaauuuuuauauuu

SEQ ID NO: 2694032 - RNA, 22 nt, Human
acacaucagcuugcccuguuaa

SEQ ID NO: 2694033 - RNA, 23 nt, Human
uauaaaauaauuuuuauauuuga

SEQ ID NO: 2694034 - RNA, 22 nt, Human
uagugagcagucaggaaagaga

SEQ ID NO: 2694035 - RNA, 16 nt, Human
uaguuuuauaugcuuc

SEQ ID NO: 2694036 - RNA, 15 nt, Human
uaguuuuauaugcuu

SEQ ID NO: 2694037 - RNA, 19 nt, Human
uauaauuuugugaagcaaa

SEQ ID NO: 2694038 - RNA, 14 nt, Human
uauaauuuugugaa

SEQ ID NO: 2694039 - RNA, 18 nt, Human
uauaacaaugcuguauuu

SEQ ID NO: 2694040 - RNA, 21 nt, Human
uauaggugcuacaaaaacaca

SEQ ID NO: 2694041 - RNA, 20 nt, Human
uauaggugcuacaaaaacac

SEQ ID NO: 2694042 - RNA, 23 nt, Human
uauaggugcuacaaaaacacagc

SEQ ID NO: 2694043 - RNA, 14 nt, Human
uauaggaauugacc

SEQ ID NO: 2694044 - RNA, 19 nt, Human
uauaggaauugacccacaa

SEQ ID NO: 2694045 - RNA, 13 nt, Human
uauaggaauugac

SEQ ID NO: 2694046 - RNA, 16 nt, Human
uauggcuauaggugcu

SEQ ID NO: 2694047 - RNA, 17 nt, Human
uauggcuauaggugcua

SEQ ID NO: 2694048 - RNA, 14 nt, Human
uauauuuacaaaug

SEQ ID NO: 2694049 - RNA, 15 nt, Human
uauauuuacaaaugg

SEQ ID NO: 2694050 - RNA, 21 nt, Human
acaguauggcagcuuuccuca

SEQ ID NO: 2694051 - RNA, 14 nt, Human
acagugagacucug

SEQ ID NO: 2694052 - RNA, 18 nt, Human
acagugagacucugucuc

SEQ ID NO: 2694053 - RNA, 21 nt, Human
acaguuaccucugccucagaa

SEQ ID NO: 2694054 - RNA, 17 nt, Human
acagucucaggaaauca

SEQ ID NO: 2694055 - RNA, 20 nt, Human
acagugaaagaaaauaacaa

SEQ ID NO: 2694056 - RNA, 13 nt, Human
acagucucaggaa

SEQ ID NO: 2694057 - RNA, 14 nt, Human
acagucucaggaaa

SEQ ID NO: 2694058 - RNA, 15 nt, Human
acagucucaggaaau

SEQ ID NO: 2694059 - RNA, 16 nt, Human
acagucucaggaaauc

SEQ ID NO: 2694060 - RNA, 12 nt, Human
uauuaaaacuca

SEQ ID NO: 2694061 - RNA, 15 nt, Human
uauuagaauaccaca

SEQ ID NO: 2694062 - RNA, 23 nt, Human
uauucauagcagcuuauucacaa

SEQ ID NO: 2694063 - RNA, 19 nt, Human
acaguucggugagcuacaa

SEQ ID NO: 2694064 - RNA, 22 nt, Human
acaguucggugagcuacaaaug

SEQ ID NO: 2694065 - RNA, 23 nt, Human
acaguucggugagcuacaaaugc

SEQ ID NO: 2694066 - RNA, 17 nt, Human
uauugucuagugaaacu

SEQ ID NO: 2694067 - RNA, 18 nt, Human
uauuuauuuuaauaaugu

SEQ ID NO: 2694068 - RNA, 16 nt, Human
uauuuauuuuaauaau

SEQ ID NO: 2694069 - RNA, 14 nt, Human
uauuuauuuuaaua

SEQ ID NO: 2694070 - RNA, 16 nt, Human
uagaugcaguucugaa

SEQ ID NO: 2694071 - RNA, 19 nt, Human
uagaugcaguucugaagaa

SEQ ID NO: 2694072 - RNA, 17 nt, Human
uagaugcaguucugaag

SEQ ID NO: 2694073 - RNA, 21 nt, Human
uagcaugucgucaaagcugaa

SEQ ID NO: 2694074 - RNA, 18 nt, Human
uagcaugucgucaaagcu

SEQ ID NO: 2694075 - RNA, 18 nt, Human
acaagcacuaaacaaaga

SEQ ID NO: 2694076 - RNA, 22 nt, Human
acaagaaaugaaagcagggacu

SEQ ID NO: 2694077 - RNA, 15 nt, Human
uagaacucccuuuca

SEQ ID NO: 2694078 - RNA, 21 nt, Human
uacuucaaauccuugaagauu

SEQ ID NO: 2694079 - RNA, 19 nt, Human
aauuuuuauauuugaaaua

SEQ ID NO: 2694080 - RNA, 16 nt, Human
acaaaaacacagcaag

SEQ ID NO: 2694081 - RNA, 19 nt, Human
aauuuuuucucuaggaaau

SEQ ID NO: 2694082 - RNA, 19 nt, Human
uacuucaaauccuugaaga

SEQ ID NO: 2694083 - RNA, 14 nt, Human
uacuucaaauccuu

SEQ ID NO: 2694084 - RNA, 20 nt, Human
aauuucucccagucauuuaa

SEQ ID NO: 2694085 - RNA, 23 nt, Human
aauugugugaaagguacuucaaa

SEQ ID NO: 2694086 - RNA, 13 nt, Human
uacuguaagaaaa

SEQ ID NO: 2694087 - RNA, 21 nt, Human
aauucuugccaaauauaaaua

SEQ ID NO: 2694088 - RNA, 13 nt, Human
aauugacccacaa

SEQ ID NO: 2694089 - RNA, 16 nt, Human
aauugacccacaagaa

SEQ ID NO: 2694090 - RNA, 19 nt, Human
aauugacccacaagaaaug

SEQ ID NO: 2694091 - RNA, 18 nt, Human
aauguugacaugggacau

SEQ ID NO: 2694092 - RNA, 16 nt, Human
aaugguuuaaaugguc

SEQ ID NO: 2694093 - RNA, 17 nt, Human
uacaaaaacacagcaag

SEQ ID NO: 2694094 - RNA, 18 nt, Human
uacaaaaacacagcaagg

SEQ ID NO: 2694095 - RNA, 19 nt, Human
uaacaaugcuguauuuuaa

SEQ ID NO: 2694096 - RNA, 13 nt, Human
uaaucuuucacag

SEQ ID NO: 2694097 - RNA, 15 nt, Human
aaugaaugaaugaau

SEQ ID NO: 2694098 - RNA, 23 nt, Human
aacuaucucauuuccaagcaagu

SEQ ID NO: 2694099 - RNA, 20 nt, Human
aacuaucucauuuccaagca

SEQ ID NO: 2694100 - RNA, 13 nt, Human
aacuauauuguuu

SEQ ID NO: 2694101 - RNA, 20 nt, Human
aacugaaaucauacuucuua

SEQ ID NO: 2694102 - RNA, 13 nt, Human
aacugaaaucaua

SEQ ID NO: 2694103 - RNA, 13 nt, Human
gucuucacaacag

SEQ ID NO: 2694104 - RNA, 23 nt, Human
gucucaguccaugaagauguaga

SEQ ID NO: 2694105 - RNA, 16 nt, Human
aacauauauaacaaug

SEQ ID NO: 2694106 - RNA, 19 nt, Human
aacagauuauuaccuuaca

SEQ ID NO: 2694107 - RNA, 17 nt, Human
aacagucucaggaaauc

SEQ ID NO: 2694108 - RNA, 19 nt, Human
aacagucucaggaaaucaa

SEQ ID NO: 2694109 - RNA, 14 nt, Human
guggguagacacac

SEQ ID NO: 2694110 - RNA, 18 nt, Human
aagagcuguucacagcca

SEQ ID NO: 2694111 - RNA, 16 nt, Human
aagacuccaaagaaau

SEQ ID NO: 2694112 - RNA, 17 nt, Human
aagacuccaaagaaaug

SEQ ID NO: 2694113 - RNA, 14 nt, Human
aagacuccaaagaa

SEQ ID NO: 2694114 - RNA, 14 nt, Human
aagacuauucaaac

SEQ ID NO: 2694115 - RNA, 13 nt, Human
aagacuauucaaa

SEQ ID NO: 2694116 - RNA, 16 nt, Human
aagcaaguauuagaau

SEQ ID NO: 2694117 - RNA, 19 nt, Human
aagauguagaggagaaacu

SEQ ID NO: 2694118 - RNA, 13 nt, Human
aagcaaaauguga

SEQ ID NO: 2694119 - RNA, 22 nt, Human
aagauguagaggagaaacugga

SEQ ID NO: 2694120 - RNA, 19 nt, Human
aagcaaaauuuuuucucua

SEQ ID NO: 2694121 - RNA, 22 nt, Human
aagaagcaccaaucaugaauua

SEQ ID NO: 2694122 - RNA, 13 nt, Human
aagaaaauaucac

SEQ ID NO: 2694123 - RNA, 13 nt, Human
aagacccaaaagg

SEQ ID NO: 2694124 - RNA, 13 nt, Human
aagaauauuuuaa

SEQ ID NO: 2694125 - RNA, 15 nt, Human
guuuucugagaaaga

SEQ ID NO: 2694126 - RNA, 22 nt, Human
guuuuauaauuuugugaagcaa

SEQ ID NO: 2694127 - RNA, 15 nt, Human
guuuuauaauuuugu

SEQ ID NO: 2694128 - RNA, 21 nt, Human
guuucuagcaugaagacagag

SEQ ID NO: 2694129 - RNA, 17 nt, Human
aaguaaaaccacagcag

SEQ ID NO: 2694130 - RNA, 18 nt, Human
aaguaaaaccacagcagu

SEQ ID NO: 2694131 - RNA, 14 nt, Human
aaguaaaaccacag

SEQ ID NO: 2694132 - RNA, 15 nt, Human
aaguaaaaccacagc

SEQ ID NO: 2694133 - RNA, 16 nt, Human
aaguaaaaccacagca

SEQ ID NO: 2694134 - RNA, 21 nt, Human
aagggugaugggaaagcauug

SEQ ID NO: 2694135 - RNA, 16 nt, Human
guuuucugagaaagac

SEQ ID NO: 2694136 - RNA, 17 nt, Human
guuuucugagaaagacu

SEQ ID NO: 2694137 - RNA, 22 nt, Human
guuuucugagaaagacuauuca

SEQ ID NO: 2694138 - RNA, 21 nt, Human
aaguauguuagugcaaauugu

SEQ ID NO: 2694139 - RNA, 23 nt, Human
aaguauguuagugcaaauuguca

SEQ ID NO: 2694140 - RNA, 23 nt, Human
guuuuuuuuuaaaaaagaaacau

SEQ ID NO: 2694141 - RNA, 13 nt, Human
aaggauaaugaau

SEQ ID NO: 2694142 - RNA, 16 nt, Human
aaggaaaaaauaacaa

SEQ ID NO: 2694143 - RNA, 19 nt, Human
aaggaaaaaauaacaauga

SEQ ID NO: 2694144 - RNA, 17 nt, Human
uaaacucauuucuagca

SEQ ID NO: 2694145 - RNA, 12 nt, Human
uaaacucauuuc

SEQ ID NO: 2694146 - RNA, 19 nt, Human
uaaaccaaggcuagaacca

SEQ ID NO: 2694147 - RNA, 12 nt, Human
aauaaaugugcc

SEQ ID NO: 2694148 - RNA, 21 nt, Human
aauaaaugugccuucauuuuu

SEQ ID NO: 2694149 - RNA, 15 nt, Human
aauaacaauaaaaga

SEQ ID NO: 2694150 - RNA, 15 nt, Human
aauaacgauaaaaga

SEQ ID NO: 2694151 - RNA, 22 nt, Human
aauaaaauccauacauuugugu

SEQ ID NO: 2694152 - RNA, 12 nt, Human
aauaaaaauaau

SEQ ID NO: 2694153 - RNA, 15 nt, Human
uaaauguugacaugg

SEQ ID NO: 2694154 - RNA, 17 nt, Human
uaaaugauuucauucaa

SEQ ID NO: 2694155 - RNA, 17 nt, Human
uaacaaugcuguauuuu

SEQ ID NO: 2694156 - RNA, 15 nt, Human
uaacaaugcuguauu

SEQ ID NO: 2694157 - RNA, 14 nt, Human
aauacacacucaaa

SEQ ID NO: 2694158 - RNA, 18 nt, Human
aaaaacacagcaagggug

SEQ ID NO: 2694159 - RNA, 13 nt, Human
aaaaacacagcaa

SEQ ID NO: 2694160 - RNA, 21 nt, Human
aucagcugcugaaacaacaaa

SEQ ID NO: 2694161 - RNA, 15 nt, Human
auauuuauuuuaaua

SEQ ID NO: 2694162 - RNA, 14 nt, Human
auauuuauuuuaau

SEQ ID NO: 2694163 - RNA, 17 nt, Human
auauuuauuuuaauaau

SEQ ID NO: 2694164 - RNA, 22 nt, Human
aucagcugcugaaacaacaaau

SEQ ID NO: 2694165 - RNA, 23 nt, Human
aucagcugcugaaacaacaaaua

SEQ ID NO: 2694166 - RNA, 18 nt, Human
augugggcagugauguca

SEQ ID NO: 2694167 - RNA, 17 nt, Human
auguucuaagaagugaa

SEQ ID NO: 2694168 - RNA, 14 nt, Human
auguaagggaaacu

SEQ ID NO: 2694169 - RNA, 16 nt, Human
auguaagggaaacugc

SEQ ID NO: 2694170 - RNA, 19 nt, Human
auguaagggaaacugccag

SEQ ID NO: 2694171 - RNA, 12 nt, Human
aguccuguaaug

SEQ ID NO: 2694172 - RNA, 19 nt, Human
agucaaauugugugaaagg

SEQ ID NO: 2694173 - RNA, 23 nt, Human
agucaaauugugugaaagguacu

SEQ ID NO: 2694174 - RNA, 22 nt, Human
aguugaaaaucuuauaauuuaa

SEQ ID NO: 2694175 - RNA, 21 nt, Human
aguugaaaagacuccaaagaa

SEQ ID NO: 2694176 - RNA, 22 nt, Human
aguugaaaagacuccaaagaaa

SEQ ID NO: 2694177 - RNA, 23 nt, Human
aguugaaaaucuuauaauuuaaa

SEQ ID NO: 2694178 - RNA, 21 nt, Human
agugucuuaauuaaaagaaua

SEQ ID NO: 2694179 - RNA, 17 nt, Human
agugucuuaauuaaaag

SEQ ID NO: 2694180 - RNA, 18 nt, Human
agugucuuaauuaaaaga

SEQ ID NO: 2694181 - RNA, 15 nt, Human
agugucuuaauuaaa

SEQ ID NO: 2694182 - RNA, 15 nt, Human
auaaugucccuucac

SEQ ID NO: 2694183 - RNA, 23 nt, Human
auaauguuucaaacauauauaac

SEQ ID NO: 2694184 - RNA, 17 nt, Human
auacacacucaaaucaa

SEQ ID NO: 2694185 - RNA, 18 nt, Human
auacacacucaaaucaag

SEQ ID NO: 2694186 - RNA, 20 nt, Human
auacacacucaaaucaagaa

SEQ ID NO: 2694187 - RNA, 18 nt, Human
auaaaggauuaaugucaa

SEQ ID NO: 2694188 - RNA, 13 nt, Human
auauuuauuuuaa

SEQ ID NO: 2694189 - RNA, 22 nt, Human
auauuuauuacuguaagaaaau

SEQ ID NO: 2694190 - RNA, 16 nt, Human
auauuauguuaaaacu

SEQ ID NO: 2694191 - RNA, 22 nt, Human
auaugcuucuguuuuauaauuu

SEQ ID NO: 2694192 - RNA, 20 nt, Human
auaugcuucuguuuuauaau

SEQ ID NO: 2694193 - RNA, 18 nt, Human
auagcagcuuauucacaa

SEQ ID NO: 2694194 - RNA, 15 nt, Human
auaggugcuacaaaa

SEQ ID NO: 2694195 - RNA, 21 nt, Human
auaggugcuacaaaaacacag

SEQ ID NO: 2694196 - RNA, 23 nt, Human
auaggugcuacaaaaacacagca

SEQ ID NO: 2694197 - RNA, 14 nt, Human
auaggugcuacaaa

SEQ ID NO: 2694198 - RNA, 15 nt, Human
auagguuuaauaauu

SEQ ID NO: 2694199 - RNA, 14 nt, Human
auagucaaauugug

SEQ ID NO: 2694200 - RNA, 16 nt, Human
aggcuagauguaugua

SEQ ID NO: 2694201 - RNA, 15 nt, Human
aggcuagauguaugu

SEQ ID NO: 2694202 - RNA, 17 nt, Human
aggcuagauguauguac

SEQ ID NO: 2694203 - RNA, 21 nt, Human
aggcuagaaccaccugccuau

SEQ ID NO: 2694204 - RNA, 17 nt, Human
aggcuacugucagcucc

SEQ ID NO: 2694205 - RNA, 23 nt, Human
aggugcuacaaaaacacagcaag

SEQ ID NO: 2694206 - RNA, 24 nt, Human
aggugcuacaaaaacacagcaagg

SEQ ID NO: 2694207 - RNA, 20 nt, Human
agguaaaagcaucacaugaa

SEQ ID NO: 2694208 - RNA, 19 nt, Human
aggugcuacaaaaacacag

SEQ ID NO: 2694209 - RNA, 20 nt, Human
aggugcuacaaaaacacagc

SEQ ID NO: 2694210 - RNA, 21 nt, Human
aggugcuacaaaaacacagca

SEQ ID NO: 2694211 - RNA, 22 nt, Human
aggugcuacaaaaacacagcaa

SEQ ID NO: 2694212 - RNA, 18 nt, Human
aggugcuacaaaaacaca

SEQ ID NO: 2694213 - RNA, 22 nt, Human
agcuccccucggagaagagcug

SEQ ID NO: 2694214 - RNA, 23 nt, Human
aggaugguucccuugaugaagaa

SEQ ID NO: 2694215 - RNA, 17 nt, Human
agagaacuuccagaucc

SEQ ID NO: 2694216 - RNA, 21 nt, Human
agacugcauuauauuuauuac

SEQ ID NO: 2694217 - RNA, 22 nt, Human
agacgugcacgcacacugucug

SEQ ID NO: 2694218 - RNA, 21 nt, Human
agacgugcacgcacacugucu

SEQ ID NO: 2694219 - RNA, 16 nt, Human
agcacugacuucuaag

SEQ ID NO: 2694220 - RNA, 23 nt, Human
agcaguucagagcugcccucucc

SEQ ID NO: 2694221 - RNA, 13 nt, Human
agcaguugaaaag

SEQ ID NO: 2694222 - RNA, 16 nt, Human
agcaguugaaaagacu

SEQ ID NO: 2694223 - RNA, 23 nt, Human
aauguuucaaacauauauaacaa

SEQ ID NO: 2694224 - RNA, 21 nt, Human
aaugauuaugaauuacauuug

SEQ ID NO: 2694225 - RNA, 15 nt, Human
aaugauuaugaauua

SEQ ID NO: 2694226 - RNA, 15 nt, Human
aauccaaugaaauga

SEQ ID NO: 2694227 - RNA, 20 nt, Human
aaggcagcucuaaaugucaa

SEQ ID NO: 2694228 - RNA, 18 nt, Human
aaguccaagcauuuagau

SEQ ID NO: 2694229 - RNA, 17 nt, Human
aaguccaagcauaccaa

SEQ ID NO: 2694230 - RNA, 21 nt, Human
aaguagggacuucugucuuca

SEQ ID NO: 2694231 - RNA, 23 nt, Human
aagggaaacugccagcaacgcag

SEQ ID NO: 2694232 - RNA, 16 nt, Human
aagggaaacugccagc

SEQ ID NO: 2694233 - RNA, 17 nt, Human
aagggaaacugccagca

SEQ ID NO: 2694234 - RNA, 19 nt, Human
aaauugacacuuaaaaaug

SEQ ID NO: 2694235 - RNA, 17 nt, Human
aaaucuuauaauuuaaa

SEQ ID NO: 2694236 - RNA, 22 nt, Human
aaauguuguucucuucuuuaaa

SEQ ID NO: 2694237 - RNA, 18 nt, Human
aacaaauuuacagagaca

SEQ ID NO: 2694238 - RNA, 16 nt, Human
aacacaucagcuugcc

SEQ ID NO: 2694239 - RNA, 22 nt, Human
aaccacuggaaaguuuaugguu

SEQ ID NO: 2694240 - RNA, 17 nt, Human
aaccuagggugauauua

SEQ ID NO: 2694241 - RNA, 18 nt, Human
aacugacucuuaagaaga

SEQ ID NO: 2694242 - RNA, 15 nt, Human
aacugacucuuaaga

SEQ ID NO: 2694243 - RNA, 20 nt, Human
aacugacucuuaagaagacu

SEQ ID NO: 2694244 - RNA, 19 nt, Human
aacugacucuuaagaagac

SEQ ID NO: 2694245 - RNA, 20 nt, Human
aacugagaugugaacacauc

SEQ ID NO: 2694246 - RNA, 20 nt, Human
aacuuuaugcuaagugaaau

SEQ ID NO: 2694247 - RNA, 21 nt, Human
aacuuuaugcuaagugaaaua

SEQ ID NO: 2694248 - RNA, 16 nt, Human
aaaaagaaacauuugg

SEQ ID NO: 2694249 - RNA, 18 nt, Human
aaaaguucugcagauaaa

SEQ ID NO: 2694250 - RNA, 21 nt, Human
aaaaucuacacuccagugaga

SEQ ID NO: 2694251 - RNA, 16 nt, Human
aaaaucucaauauuuc

SEQ ID NO: 2694252 - RNA, 21 nt, Human
aaacugagaugugaacacauc

SEQ ID NO: 2694253 - RNA, 23 nt, Human
aaacugagaugugaacacaucag

SEQ ID NO: 2694254 - RNA, 15 nt, Human
aaagaaauguaaggg

SEQ ID NO: 2694255 - RNA, 15 nt, Human
aaaucaaauaugcaa

SEQ ID NO: 2694256 - RNA, 12 nt, Human
aaaucaaauaug

SEQ ID NO: 2694257 - RNA, 14 nt, Human
aaaucaaauaugca

SEQ ID NO: 2694258 - RNA, 20 nt, Human
aaauauuuauuuuaauaaug

SEQ ID NO: 2694259 - RNA, 13 nt, Human
aaauauuuauuuu

SEQ ID NO: 2694260 - RNA, 15 nt, Human
aaauauuuauuuuaa

SEQ ID NO: 2694261 - RNA, 14 nt, Human
aaaggcagaagcaa

SEQ ID NO: 2694262 - RNA, 13 nt, Human
aauuuugugaagc

SEQ ID NO: 2694263 - RNA, 14 nt, Human
acacgagcaggcua

SEQ ID NO: 2694264 - RNA, 19 nt, Human
acacgagcaggcuacuguc

SEQ ID NO: 2694265 - RNA, 21 nt, Human
acacgagcaggcuacugucag

SEQ ID NO: 2694266 - RNA, 22 nt, Human
acagcaguugaaaagacuccaa

SEQ ID NO: 2694267 - RNA, 23 nt, Human
acagcaguugaaaagacuccaaa

SEQ ID NO: 2694268 - RNA, 21 nt, Human
acagcaguugaaaagacucca

SEQ ID NO: 2694269 - RNA, 17 nt, Human
acccacaagaaaugaaa

SEQ ID NO: 2694270 - RNA, 21 nt, Human
acccacaagaaaugaaagcag

SEQ ID NO: 2694271 - RNA, 19 nt, Human
acccaguguuuuaggagca

SEQ ID NO: 2694272 - RNA, 22 nt, Human
acccaguguuuuaggagcauga

SEQ ID NO: 2694273 - RNA, 21 nt, Human
acuuggucugugagaugcuag

SEQ ID NO: 2694274 - RNA, 22 nt, Human
acuucugucuucacaacagauu

SEQ ID NO: 2694275 - RNA, 21 nt, Human
acuucugucuucacaacagau

SEQ ID NO: 2694276 - RNA, 12 nt, Human
acuucagacaua

SEQ ID NO: 2694277 - RNA, 13 nt, Human
acugccagcaacg

SEQ ID NO: 2694278 - RNA, 20 nt, Human
acucugucucaguccaugaa

SEQ ID NO: 2694279 - RNA, 18 nt, Human
acucugucucaguccaug

SEQ ID NO: 2694280 - RNA, 13 nt, Human
acuguaagaaaau

SEQ ID NO: 2694281 - RNA, 19 nt, Human
acuguaagaaaauaucacu

SEQ ID NO: 2694282 - RNA, 22 nt, Human
acuguaagaaaauaucacuugu

SEQ ID NO: 2694283 - RNA, 22 nt, Human
acuuuauuuucuauaauuuaaa

SEQ ID NO: 2694284 - RNA, 16 nt, Human
agaaaaucaggcuggc

SEQ ID NO: 2694285 - RNA, 14 nt, Human
agaaaauaacaaua

SEQ ID NO: 2694286 - RNA, 13 nt, Human
acuaagagagaau

SEQ ID NO: 2694287 - RNA, 19 nt, Human
acgcaggcccccaggugcc

SEQ ID NO: 2694288 - RNA, 22 nt, Human
acgcaggcccccaggugccagu

SEQ ID NO: 2694289 - RNA, 21 nt, Human
acuauucaaacagucucagga

SEQ ID NO: 2694290 - RNA, 20 nt, Human
acuaguauuucuaugaaaua

SEQ ID NO: 2694291 - RNA, 17 nt, Human
acucuauguucuaagaa

SEQ ID NO: 2694292 - RNA, 17 nt, Human
caagcacuaaacaaaga

SEQ ID NO: 2694293 - RNA, 15 nt, Human
caaauuuacagagac

SEQ ID NO: 2694294 - RNA, 14 nt, Human
caaauuuacagaga

SEQ ID NO: 2694295 - RNA, 14 nt, Human
caaauaugcaaagc

SEQ ID NO: 2694296 - RNA, 21 nt, Human
caaauguucaucaaugaauga

SEQ ID NO: 2694297 - RNA, 20 nt, Human
caaauguucaucaaugaaug

SEQ ID NO: 2694298 - RNA, 18 nt, Human
caaauaugcaaagcacug

SEQ ID NO: 2694299 - RNA, 16 nt, Human
caaauaugcaaagcac

SEQ ID NO: 2694300 - RNA, 17 nt, Human
caaauaugcaaagcacu

SEQ ID NO: 2694301 - RNA, 15 nt, Human
cacaguuuucugaga

SEQ ID NO: 2694302 - RNA, 14 nt, Human
cacaguuuucugag

SEQ ID NO: 2694303 - RNA, 19 nt, Human
cacaggaaccacaagacug

SEQ ID NO: 2694304 - RNA, 20 nt, Human
cacaggaaccacaagacugc

SEQ ID NO: 2694305 - RNA, 15 nt, Human
cacaggaaguagagg

SEQ ID NO: 2694306 - RNA, 22 nt, Human
cacagcaguugaaaagacucca

SEQ ID NO: 2694307 - RNA, 13 nt, Human
cacaacuauauug

SEQ ID NO: 2694308 - RNA, 14 nt, Human
cacacugaagaagc

SEQ ID NO: 2694309 - RNA, 19 nt, Human
cacacucaaaucaagaaac

SEQ ID NO: 2694310 - RNA, 11 nt, Human
cacaacagauu

SEQ ID NO: 2694311 - RNA, 22 nt, Human
caaugaaugaaugaauggcuaa

SEQ ID NO: 2694312 - RNA, 16 nt, Human
uugcuaagcauuccaa

SEQ ID NO: 2694313 - RNA, 18 nt, Human
uugcuaagcauuccaacu

SEQ ID NO: 2694314 - RNA, 16 nt, Human
uuguaccgcaauguga

SEQ ID NO: 2694315 - RNA, 20 nt, Human
uuguaaaauggugugaccac

SEQ ID NO: 2694316 - RNA, 20 nt, Human
uugguaaggggaauugagga

SEQ ID NO: 2694317 - RNA, 15 nt, Human
uuggucugugagaug

SEQ ID NO: 2694318 - RNA, 12 nt, Human
uuguaaaauggu

SEQ ID NO: 2694319 - RNA, 13 nt, Human
uuguaaaauggug

SEQ ID NO: 2694320 - RNA, 20 nt, Human
uugauaugccuuuucccaac

SEQ ID NO: 2694321 - RNA, 13 nt, Human
uugccaucccucc

SEQ ID NO: 2694322 - RNA, 18 nt, Human
uugccaucccucccucca

SEQ ID NO: 2694323 - RNA, 17 nt, Human
uugccaucccucccucc

SEQ ID NO: 2694324 - RNA, 16 nt, Human
uugccaucccucccuc

SEQ ID NO: 2694325 - RNA, 14 nt, Human
uugccaucccuccc

SEQ ID NO: 2694326 - RNA, 23 nt, Human
uugccaucccucccuccaccucc

SEQ ID NO: 2694327 - RNA, 22 nt, Human
uugccaucccucccuccaccuc

SEQ ID NO: 2694328 - RNA, 23 nt, Human
uugcagcucuccccuucucugua

SEQ ID NO: 2694329 - RNA, 24 nt, Human
uucuaaguaaaaccacagcaguug

SEQ ID NO: 2694330 - RNA, 19 nt, Human
uucuuaggguuaugauuaa

SEQ ID NO: 2694331 - RNA, 18 nt, Human
uucuuuccacagaagcuc

SEQ ID NO: 2694332 - RNA, 21 nt, Human
uugaaaaucuuauaauuuaaa

SEQ ID NO: 2694333 - RNA, 12 nt, Human
uuucucuaggaa

SEQ ID NO: 2694334 - RNA, 18 nt, Human
uuugguaaggggaauuga

SEQ ID NO: 2694335 - RNA, 21 nt, Human
uuugaaauuguauuacaaauc

SEQ ID NO: 2694336 - RNA, 18 nt, Human
uuguuuaaaaucauuucu

SEQ ID NO: 2694337 - RNA, 17 nt, Human
uuguuuaaaaucauuuc

SEQ ID NO: 2694338 - RNA, 12 nt, Human
uuuaaaaugucu

SEQ ID NO: 2694339 - RNA, 17 nt, Human
uuuaaaagaaugauuau

SEQ ID NO: 2694340 - RNA, 14 nt, Human
uuuaaaagaaugau

SEQ ID NO: 2694341 - RNA, 16 nt, Human
uuuaaaaucauuucug

SEQ ID NO: 2694342 - RNA, 19 nt, Human
uuuaaaauacacacucaaa

SEQ ID NO: 2694343 - RNA, 13 nt, Human
uuuacagagacag

SEQ ID NO: 2694344 - RNA, 19 nt, Human
uuuaauaauguuucaaaca

SEQ ID NO: 2694345 - RNA, 15 nt, Human
uuuaauaauguuuca

SEQ ID NO: 2694346 - RNA, 14 nt, Human
uuuaauaauguuuc

SEQ ID NO: 2694347 - RNA, 13 nt, Human
uuuaauaaaccau

SEQ ID NO: 2694348 - RNA, 21 nt, Human
uuauggcacuaguauuucuau

SEQ ID NO: 2694349 - RNA, 17 nt, Human
uuauggcuauaggugcu

SEQ ID NO: 2694350 - RNA, 16 nt, Human
uuauuacuguaagaaa

SEQ ID NO: 2694351 - RNA, 18 nt, Human
uuauuacuguaagaaaau

SEQ ID NO: 2694352 - RNA, 17 nt, Human
uuauuacuguaagaaaa

SEQ ID NO: 2694353 - RNA, 16 nt, Human
uucagacauagaauua

SEQ ID NO: 2694354 - RNA, 20 nt, Human
uucagacauagaauuaacac

SEQ ID NO: 2694355 - RNA, 14 nt, Human
uucagagcugcccu

SEQ ID NO: 2694356 - RNA, 13 nt, Human
uucagagcugccc

SEQ ID NO: 2694357 - RNA, 16 nt, Human
uuauuuuaauaauguu

SEQ ID NO: 2694358 - RNA, 15 nt, Human
uuauuuuaauaaugu

SEQ ID NO: 2694359 - RNA, 15 nt, Human
uuauugucuagugaa

SEQ ID NO: 2694360 - RNA, 17 nt, Human
uuauuuuaauaauguuu

SEQ ID NO: 2694361 - RNA, 17 nt, Human
uucaaauccuugaagau

SEQ ID NO: 2694362 - RNA, 19 nt, Human
uuccagauccuggaaauca

SEQ ID NO: 2694363 - RNA, 17 nt, Human
uuccuuggacucauuuu

SEQ ID NO: 2694364 - RNA, 20 nt, Human
uuccuuggacucauuuuaaa

SEQ ID NO: 2694365 - RNA, 17 nt, Human
uucccuugaugaagaag

SEQ ID NO: 2694366 - RNA, 17 nt, Human
uuacuaguuucccuugc

SEQ ID NO: 2694367 - RNA, 19 nt, Human
uuagaaacacaacuauauu

SEQ ID NO: 2694368 - RNA, 13 nt, Human
uuagcuggaaaag

SEQ ID NO: 2694369 - RNA, 12 nt, Human
uuagcuggaaaa

SEQ ID NO: 2694370 - RNA, 21 nt, Human
uuagaugcaguucugaagaag

SEQ ID NO: 2694371 - RNA, 20 nt, Human
uuagaugcaguucugaagaa

SEQ ID NO: 2694372 - RNA, 18 nt, Human
uuaggauguugaaaaagu

SEQ ID NO: 2694373 - RNA, 22 nt, Human
uguuucaaacauauauaacaau

SEQ ID NO: 2694374 - RNA, 21 nt, Human
uguuucaaacauauauaacaa

SEQ ID NO: 2694375 - RNA, 19 nt, Human
uguuucaaacauauauaac

SEQ ID NO: 2694376 - RNA, 21 nt, Human
uuaaaagaauauuuuaacuuc

SEQ ID NO: 2694377 - RNA, 22 nt, Human
uuaaaagaauauuuuaacuucc

SEQ ID NO: 2694378 - RNA, 15 nt, Human
uuaaaagaugaaaau

SEQ ID NO: 2694379 - RNA, 18 nt, Human
uuaaaagaugaaaauauu

SEQ ID NO: 2694380 - RNA, 19 nt, Human
uuaaaauacacacucaaau

SEQ ID NO: 2694381 - RNA, 15 nt, Human
ugggcagcugccucc

SEQ ID NO: 2694382 - RNA, 14 nt, Human
ugggcagcugccuc

SEQ ID NO: 2694383 - RNA, 13 nt, Human
ugggcagcugccu

SEQ ID NO: 2694384 - RNA, 19 nt, Human
ugggcagcugccuccccuc

SEQ ID NO: 2694385 - RNA, 17 nt, Human
ugggcagcugccucccc

SEQ ID NO: 2694386 - RNA, 22 nt, Human
uggugauuuagcaggaagcugu

SEQ ID NO: 2694387 - RNA, 16 nt, Human
uggugauuuagcagga

SEQ ID NO: 2694388 - RNA, 16 nt, Human
uggucccagccagcag

SEQ ID NO: 2694389 - RNA, 22 nt, Human
uggucacaggaaguagaggagg

SEQ ID NO: 2694390 - RNA, 17 nt, Human
uggucacaggaaguaga

SEQ ID NO: 2694391 - RNA, 13 nt, Human
ugguauguuuuca

SEQ ID NO: 2694392 - RNA, 20 nt, Human
uggcaauagucaaauugugu

SEQ ID NO: 2694393 - RNA, 15 nt, Human
uggcacuaguauuuc

SEQ ID NO: 2694394 - RNA, 16 nt, Human
ugccacuaaauugaca

SEQ ID NO: 2694395 - RNA, 13 nt, Human
ugcaucagcugcu

SEQ ID NO: 2694396 - RNA, 19 nt, Human
ugcaucagcugcugaaaca

SEQ ID NO: 2694397 - RNA, 14 nt, Human
ugcaguucugaaga

SEQ ID NO: 2694398 - RNA, 12 nt, Human
ugcaguucugaa

SEQ ID NO: 2694399 - RNA, 22 nt, Human
ugcaucaauuuuucuuauuuca

SEQ ID NO: 2694400 - RNA, 20 nt, Human
ugcugggggggauuguaaaa

SEQ ID NO: 2694401 - RNA, 13 nt, Human
ugcuagaacuccc

SEQ ID NO: 2694402 - RNA, 14 nt, Human
ugcuagaacucccu

SEQ ID NO: 2694403 - RNA, 15 nt, Human
ugcuagaacucccuu

SEQ ID NO: 2694404 - RNA, 17 nt, Human
ugcuagaacucccuuuc

SEQ ID NO: 2694405 - RNA, 18 nt, Human
ugaggcuccacuuggucu

SEQ ID NO: 2694406 - RNA, 20 nt, Human
ugaggcuccacuuggucugu

SEQ ID NO: 2694407 - RNA, 16 nt, Human
ugauaacuggaaacuu

SEQ ID NO: 2694408 - RNA, 13 nt, Human
ugagccccaaaag

SEQ ID NO: 2694409 - RNA, 16 nt, Human
ugagagugaacaaauu

SEQ ID NO: 2694410 - RNA, 17 nt, Human
ugaucagcuuauugucu

SEQ ID NO: 2694411 - RNA, 24 nt, Human
ugaucagcuuauugucuagugaaa

SEQ ID NO: 2694412 - RNA, 14 nt, Human
ugaucuuuaaaaua

SEQ ID NO: 2694413 - RNA, 17 nt, Human
ugaucuuuaaaauacac

SEQ ID NO: 2694414 - RNA, 23 nt, Human
ugaugcuacaggauuugaaauug

SEQ ID NO: 2694415 - RNA, 20 nt, Human
ugaugcuacaggauuugaaa

SEQ ID NO: 2694416 - RNA, 15 nt, Human
ugauggugguauguu

SEQ ID NO: 2694417 - RNA, 22 nt, Human
ugauuaugaauuacauuuguau

SEQ ID NO: 2694418 - RNA, 21 nt, Human
ugauuaugaauuacauuugua

SEQ ID NO: 2694419 - RNA, 19 nt, Human
ugauuaugaauuacauuug

SEQ ID NO: 2694420 - RNA, 17 nt, Human
ugauuaugaauuacauu

SEQ ID NO: 2694421 - RNA, 13 nt, Human
ugauuauauguca

SEQ ID NO: 2694422 - RNA, 22 nt, Human
ugauguuuagaaacacaacuau

SEQ ID NO: 2694423 - RNA, 16 nt, Human
ugauuaccagggacug

SEQ ID NO: 2694424 - RNA, 12 nt, Human
ucuuugccaagu

SEQ ID NO: 2694425 - RNA, 19 nt, Human
ucuuuccacagaagcucca

SEQ ID NO: 2694426 - RNA, 17 nt, Human
ucuuucacauuuaaaua

SEQ ID NO: 2694427 - RNA, 16 nt, Human
ugaaauauugacuuuu

SEQ ID NO: 2694428 - RNA, 19 nt, Human
ugaaauggacuuuuguaca

SEQ ID NO: 2694429 - RNA, 22 nt, Human
ugaaacaacaaauaggaauugu

SEQ ID NO: 2694430 - RNA, 18 nt, Human
ugaaagaggcagcuugaa

SEQ ID NO: 2694431 - RNA, 16 nt, Human
ugaaagguacuucaaa

SEQ ID NO: 2694432 - RNA, 15 nt, Human
ugaaagguacuucaa

SEQ ID NO: 2694433 - RNA, 18 nt, Human
ugaauuacauuuguauaa

SEQ ID NO: 2694434 - RNA, 16 nt, Human
ugaauuacauuuguau

SEQ ID NO: 2694435 - RNA, 15 nt, Human
ugaauuacauuugua

SEQ ID NO: 2694436 - RNA, 13 nt, Human
ugaaguccaagca

SEQ ID NO: 2694437 - RNA, 11 nt, Human
ugaaguccaag

SEQ ID NO: 2694438 - RNA, 18 nt, Human
ugacaugggacauuugcu

SEQ ID NO: 2694439 - RNA, 17 nt, Human
ugacaugggacauuugc

SEQ ID NO: 2694440 - RNA, 16 nt, Human
ugacaugggacauuug

SEQ ID NO: 2694441 - RNA, 20 nt, Human
ugaccacugcagaagacagu

SEQ ID NO: 2694442 - RNA, 20 nt, Human
ugacaagcucacagaccuuu

SEQ ID NO: 2694443 - RNA, 15 nt, Human
ugacaagcucacaga

SEQ ID NO: 2694444 - RNA, 12 nt, Human
ugacaagcucac

SEQ ID NO: 2694445 - RNA, 23 nt, Human
ucucaguccaugaagauguagag

SEQ ID NO: 2694446 - RNA, 14 nt, Human
ucggagaagagcug

SEQ ID NO: 2694447 - RNA, 16 nt, Human
ucggagaagagcuguu

SEQ ID NO: 2694448 - RNA, 12 nt, Human
ucggagaagagc

SEQ ID NO: 2694449 - RNA, 17 nt, Human
ucuacacuaagagagaa

SEQ ID NO: 2694450 - RNA, 18 nt, Human
ucuaugaaauauuauguu

SEQ ID NO: 2694451 - RNA, 17 nt, Human
uccugccccugagccca

SEQ ID NO: 2694452 - RNA, 18 nt, Human
uccugccccugagcccau

SEQ ID NO: 2694453 - RNA, 19 nt, Human
uccugaggcuccacuuggu

SEQ ID NO: 2694454 - RNA, 20 nt, Human
uccugaggcuccacuugguc

SEQ ID NO: 2694455 - RNA, 17 nt, Human
uccuggcaauagucaaa

SEQ ID NO: 2694456 - RNA, 20 nt, Human
ucccuucacaaacccagugu

SEQ ID NO: 2694457 - RNA, 14 nt, Human
uccuagugaaagag

SEQ ID NO: 2694458 - RNA, 23 nt, Human
uccuagugaaagaggcagcuuga

SEQ ID NO: 2694459 - RNA, 22 nt, Human
uccucauuuuuauaaugucccu

SEQ ID NO: 2694460 - RNA, 19 nt, Human
uccagguagagggugugua

SEQ ID NO: 2694461 - RNA, 15 nt, Human
uccauacauuugugu

SEQ ID NO: 2694462 - RNA, 20 nt, Human
uccaugggccauaugaaaag

SEQ ID NO: 2694463 - RNA, 23 nt, Human
uccacuuggucugugagaugcua

SEQ ID NO: 2694464 - RNA, 21 nt, Human
uccacuuggucugugagaugc

SEQ ID NO: 2694465 - RNA, 17 nt, Human
uccacuuggucugugag

SEQ ID NO: 2694466 - RNA, 17 nt, Human
ucaucaaugaaugaaug

SEQ ID NO: 2694467 - RNA, 11 nt, Human
ucauagcagcu

SEQ ID NO: 2694468 - RNA, 12 nt, Human
ucauagcagcuu

SEQ ID NO: 2694469 - RNA, 16 nt, Human
ucauuaggauggcuag

SEQ ID NO: 2694470 - RNA, 14 nt, Human
uccaaagaaaugua

SEQ ID NO: 2694471 - RNA, 17 nt, Human
uccaaagaaauguaagg

SEQ ID NO: 2694472 - RNA, 16 nt, Human
uaggucagugcaaaua

SEQ ID NO: 2694473 - RNA, 16 nt, Human
uaggccaugggacagg

SEQ ID NO: 2694474 - RNA, 18 nt, Human
uaggccaugggacaggga

SEQ ID NO: 2694475 - RNA, 12 nt, Human
uaggaauugacc

SEQ ID NO: 2694476 - RNA, 15 nt, Human
uagugcaaauuguca

SEQ ID NO: 2694477 - RNA, 14 nt, Human
uagugcaaauuguc

SEQ ID NO: 2694478 - RNA, 14 nt, Human
uagucaaauugugu

SEQ ID NO: 2694479 - RNA, 13 nt, Human
uagucaaauugug

SEQ ID NO: 2694480 - RNA, 16 nt, Human
uaguauuucuaugaaa

SEQ ID NO: 2694481 - RNA, 19 nt, Human
uaguauuucuaugaaauau

SEQ ID NO: 2694482 - RNA, 18 nt, Human
uaguauuucuaugaaaua

SEQ ID NO: 2694483 - RNA, 13 nt, Human
uaguaucaaaaga

SEQ ID NO: 2694484 - RNA, 13 nt, Human
uauauaacaaugc

SEQ ID NO: 2694485 - RNA, 13 nt, Human
uauaugcuucugu

SEQ ID NO: 2694486 - RNA, 16 nt, Human
uaugcuucuguuuuau

SEQ ID NO: 2694487 - RNA, 15 nt, Human
uaugcuucuguuuua

SEQ ID NO: 2694488 - RNA, 16 nt, Human
uaugauucccagccag

SEQ ID NO: 2694489 - RNA, 15 nt, Human
uaugcaaagcacuga

SEQ ID NO: 2694490 - RNA, 13 nt, Human
uaugcaaagcacu

SEQ ID NO: 2694491 - RNA, 14 nt, Human
uaugcaaagcacug

SEQ ID NO: 2694492 - RNA, 12 nt, Human
uaugcaaagcac

SEQ ID NO: 2694493 - RNA, 17 nt, Human
uaugaauuacauuugua

SEQ ID NO: 2694494 - RNA, 23 nt, Human
uaugaauuacauuuguauaaaau

SEQ ID NO: 2694495 - RNA, 15 nt, Human
uauccuucagccuga

SEQ ID NO: 2694496 - RNA, 14 nt, Human
uauccuucagccug

SEQ ID NO: 2694497 - RNA, 17 nt, Human
uauguucuaagaaguga

SEQ ID NO: 2694498 - RNA, 19 nt, Human
uauggaggcuuugcauaga

SEQ ID NO: 2694499 - RNA, 12 nt, Human
uauguuaaaacu

SEQ ID NO: 2694500 - RNA, 19 nt, Human
uauguuagugcaaauuguc

SEQ ID NO: 2694501 - RNA, 17 nt, Human
uauuauauuuacaaaug

SEQ ID NO: 2694502 - RNA, 16 nt, Human
uauuauguuaaaacug

SEQ ID NO: 2694503 - RNA, 20 nt, Human
uauuguuuaaaaucauuucu

SEQ ID NO: 2694504 - RNA, 15 nt, Human
uauuucuaugaaaua

SEQ ID NO: 2694505 - RNA, 14 nt, Human
uauuucuaugaaau

SEQ ID NO: 2694506 - RNA, 13 nt, Human
uauuuauuacugu

SEQ ID NO: 2694507 - RNA, 13 nt, Human
uauuucuaugaaa

SEQ ID NO: 2694508 - RNA, 14 nt, Human
uauuuauuacugua

SEQ ID NO: 2694509 - RNA, 15 nt, Human
uauuguuuaaaauca

SEQ ID NO: 2694510 - RNA, 16 nt, Human
uauuguuuaaaaucau

SEQ ID NO: 2694511 - RNA, 17 nt, Human
uauuguuuaaaaucauu

SEQ ID NO: 2694512 - RNA, 14 nt, Human
ucaauaaaauccau

SEQ ID NO: 2694513 - RNA, 22 nt, Human
ucacaagacccaaaaggcagaa

SEQ ID NO: 2694514 - RNA, 12 nt, Human
ucacauuuaaau

SEQ ID NO: 2694515 - RNA, 22 nt, Human
ucaacuccaaacugacucuuaa

SEQ ID NO: 2694516 - RNA, 16 nt, Human
ucaaauaugcaaagca

SEQ ID NO: 2694517 - RNA, 17 nt, Human
ucaaauaugcaaagcac

SEQ ID NO: 2694518 - RNA, 18 nt, Human
ucaaauaugcaaagcacu

SEQ ID NO: 2694519 - RNA, 19 nt, Human
ucaaauaugcaaagcacug

SEQ ID NO: 2694520 - RNA, 15 nt, Human
ucaaauccuugaaga

SEQ ID NO: 2694521 - RNA, 16 nt, Human
ucaaauccuugaagau

SEQ ID NO: 2694522 - RNA, 22 nt, Human
ucaaacagucucaggaaaucaa

SEQ ID NO: 2694523 - RNA, 17 nt, Human
ucaaacauauauaacaa

SEQ ID NO: 2694524 - RNA, 14 nt, Human
gugagcuacaaaug

SEQ ID NO: 2694525 - RNA, 16 nt, Human
gugagcagucaggaaa

SEQ ID NO: 2694526 - RNA, 19 nt, Human
gugaaagaaaauaacaaua

SEQ ID NO: 2694527 - RNA, 20 nt, Human
gugaaacucguuaauuugua

SEQ ID NO: 2694528 - RNA, 18 nt, Human
gugcaaauugucacagga

SEQ ID NO: 2694529 - RNA, 21 nt, Human
guccugucggagcccugucuc

SEQ ID NO: 2694530 - RNA, 20 nt, Human
guccugucggagcccugucu

SEQ ID NO: 2694531 - RNA, 18 nt, Human
guccugucggagcccugu

SEQ ID NO: 2694532 - RNA, 17 nt, Human
gucuacacuaagagaga

SEQ ID NO: 2694533 - RNA, 23 nt, Human
gucuacacuaagagagaaugaga

SEQ ID NO: 2694534 - RNA, 20 nt, Human
gucccagccagcaguucaga

SEQ ID NO: 2694535 - RNA, 21 nt, Human
gucaauaaaauccauacauuu

SEQ ID NO: 2694536 - RNA, 15 nt, Human
gucaauaaaauccau

SEQ ID NO: 2694537 - RNA, 14 nt, Human
gucaccucauggaa

SEQ ID NO: 2694538 - RNA, 17 nt, Human
guauuuuaaaagaauga

SEQ ID NO: 2694539 - RNA, 16 nt, Human
guauuuuaaaagaaug

SEQ ID NO: 2694540 - RNA, 17 nt, Human
guauuucuaugaaauau

SEQ ID NO: 2694541 - RNA, 22 nt, Human
guauuucuaugaaauauuaugu

SEQ ID NO: 2694542 - RNA, 19 nt, Human
ggugcuacaaaaacacagc

SEQ ID NO: 2694543 - RNA, 21 nt, Human
ggguagccacuggacugacga

SEQ ID NO: 2694544 - RNA, 22 nt, Human
gguacuucaaauccuugaagau

SEQ ID NO: 2694545 - RNA, 22 nt, Human
gguagacacacaugaaguccaa

SEQ ID NO: 2694546 - RNA, 15 nt, Human
gguagacacacauga

SEQ ID NO: 2694547 - RNA, 23 nt, Human
guaaaaccacagcaguugaaaag

SEQ ID NO: 2694548 - RNA, 14 nt, Human
guaaaaccacagca

SEQ ID NO: 2694549 - RNA, 15 nt, Human
guaaaaccacagcag

SEQ ID NO: 2694550 - RNA, 16 nt, Human
guaaaaccacagcagu

SEQ ID NO: 2694551 - RNA, 18 nt, Human
guaaaaccacagcaguug

SEQ ID NO: 2694552 - RNA, 17 nt, Human
guaagggaaacugccag

SEQ ID NO: 2694553 - RNA, 18 nt, Human
guaagggaaacugccagc

SEQ ID NO: 2694554 - RNA, 23 nt, Human
guacuuuauuuucuauaauuuaa

SEQ ID NO: 2694555 - RNA, 15 nt, Human
guagaggagaaacug

SEQ ID NO: 2694556 - RNA, 15 nt, Human
guaccgcaaugugac

SEQ ID NO: 2694557 - RNA, 15 nt, Human
guaauuggaaaggca

SEQ ID NO: 2694558 - RNA, 19 nt, Human
guaaugauaacuggaaacu

SEQ ID NO: 2694559 - RNA, 14 nt, Human
gcucucuggccuuc

SEQ ID NO: 2694560 - RNA, 15 nt, Human
gcucucuggccuucg

SEQ ID NO: 2694561 - RNA, 19 nt, Human
gcucucuggccuucggccu

SEQ ID NO: 2694562 - RNA, 20 nt, Human
gcucucuggccuucggccuc

SEQ ID NO: 2694563 - RNA, 12 nt, Human
gcucucuggccu

SEQ ID NO: 2694564 - RNA, 13 nt, Human
gcucucuggccuu

SEQ ID NO: 2694565 - RNA, 11 nt, Human
gcucucuggcc

SEQ ID NO: 2694566 - RNA, 17 nt, Human
gcuaagcaaaaugugau

SEQ ID NO: 2694567 - RNA, 14 nt, Human
gcuaagcauuccaa

SEQ ID NO: 2694568 - RNA, 23 nt, Human
gcccucuccugggcagcugccuc

SEQ ID NO: 2694569 - RNA, 22 nt, Human
gcccucuccugggcagcugccu

SEQ ID NO: 2694570 - RNA, 14 nt, Human
gcccucuccugggc

SEQ ID NO: 2694571 - RNA, 13 nt, Human
gcccucuccuggg

SEQ ID NO: 2694572 - RNA, 12 nt, Human
gcccucuccugg

SEQ ID NO: 2694573 - RNA, 22 nt, Human
gccuauauuuuuuguuaaauga

SEQ ID NO: 2694574 - RNA, 17 nt, Human
gccuaagugcagccccg

SEQ ID NO: 2694575 - RNA, 20 nt, Human
gcugucuacacuaagagaga

SEQ ID NO: 2694576 - RNA, 17 nt, Human
ggaaaucaaauaugcaa

SEQ ID NO: 2694577 - RNA, 23 nt, Human
ggaaagggauuuucagcccucag

SEQ ID NO: 2694578 - RNA, 20 nt, Human
ggaagugacgguuuaauggg

SEQ ID NO: 2694579 - RNA, 22 nt, Human
ggaauuggagcucgugggacag

SEQ ID NO: 2694580 - RNA, 16 nt, Human
ggaauuggagcucgug

SEQ ID NO: 2694581 - RNA, 23 nt, Human
ggaauuucucccagucauuuaau

SEQ ID NO: 2694582 - RNA, 15 nt, Human
ggagaaucacuugaa

SEQ ID NO: 2694583 - RNA, 19 nt, Human
ggagaaucacuugaacccg

SEQ ID NO: 2694584 - RNA, 13 nt, Human
ggacgcucucugg

SEQ ID NO: 2694585 - RNA, 14 nt, Human
ggacgcucucuggc

SEQ ID NO: 2694586 - RNA, 14 nt, Human
ggcauggcugggaa

SEQ ID NO: 2694587 - RNA, 17 nt, Human
ggauuagggagagaaga

SEQ ID NO: 2694588 - RNA, 15 nt, Human
ggauuguaaaauggu

SEQ ID NO: 2694589 - RNA, 16 nt, Human
gcaaauugucacagga

SEQ ID NO: 2694590 - RNA, 20 nt, Human
gaugcuagaacucccuuuca

SEQ ID NO: 2694591 - RNA, 22 nt, Human
gaugcuagaacucccuuucaac

SEQ ID NO: 2694592 - RNA, 18 nt, Human
gaugcuagaacucccuuu

SEQ ID NO: 2694593 - RNA, 13 nt, Human
gcacacugucugc

SEQ ID NO: 2694594 - RNA, 18 nt, Human
gcacugacuucuaaguaa

SEQ ID NO: 2694595 - RNA, 15 nt, Human
gcacugacuucuaag

SEQ ID NO: 2694596 - RNA, 22 nt, Human
gauaaauggcuuccuggcaaua

SEQ ID NO: 2694597 - RNA, 12 nt, Human
gagcccugucuc

SEQ ID NO: 2694598 - RNA, 20 nt, Human
gagacagcucugcauacuca

SEQ ID NO: 2694599 - RNA, 21 nt, Human
gagaaugagagacacacugaa

SEQ ID NO: 2694600 - RNA, 20 nt, Human
gagaaugagagacacacuga

SEQ ID NO: 2694601 - RNA, 22 nt, Human
gagaaccuagggugauauuaac

SEQ ID NO: 2694602 - RNA, 21 nt, Human
gagaaccuagggugauauuaa

SEQ ID NO: 2694603 - RNA, 23 nt, Human
gagaacuuccagauccuggaaau

SEQ ID NO: 2694604 - RNA, 22 nt, Human
gagaacuuccagauccuggaaa

SEQ ID NO: 2694605 - RNA, 17 nt, Human
gagaaugagagacacac

SEQ ID NO: 2694606 - RNA, 13 nt, Human
gagaagagcuguu

SEQ ID NO: 2694607 - RNA, 16 nt, Human
gacuucuaaguaaaac

SEQ ID NO: 2694608 - RNA, 17 nt, Human
gacuucuaaguaaaacc

SEQ ID NO: 2694609 - RNA, 18 nt, Human
gacuucuaaguaaaacca

SEQ ID NO: 2694610 - RNA, 20 nt, Human
gacuucugucuucacaacag

SEQ ID NO: 2694611 - RNA, 23 nt, Human
gacuucugucuucacaacagauu

SEQ ID NO: 2694612 - RNA, 19 nt, Human
gacuucuaaguaaaaccac

SEQ ID NO: 2694613 - RNA, 23 nt, Human
gacuucuaaguaaaaccacagca

SEQ ID NO: 2694614 - RNA, 24 nt, Human
gacuucuaaguaaaaccacagcag

SEQ ID NO: 2694615 - RNA, 16 nt, Human
gacuccaaagaaaugu

SEQ ID NO: 2694616 - RNA, 18 nt, Human
gacuccaaagaaauguaa

SEQ ID NO: 2694617 - RNA, 21 nt, Human
gacucauuuuaaaaaauggaa

SEQ ID NO: 2694618 - RNA, 11 nt, Human
gacuccaaaga

SEQ ID NO: 2694619 - RNA, 12 nt, Human
gacuccaaagaa

SEQ ID NO: 2694620 - RNA, 15 nt, Human
gacuccaaagaaaug

SEQ ID NO: 2694621 - RNA, 16 nt, Human
gacugcauuauauuua

SEQ ID NO: 2694622 - RNA, 14 nt, Human
gacugcauuauauu

SEQ ID NO: 2694623 - RNA, 16 nt, Human
gacuggauaguccguc

SEQ ID NO: 2694624 - RNA, 19 nt, Human
gacagagccccacccucag

SEQ ID NO: 2694625 - RNA, 20 nt, Human
gacauagaauuaacacauga

SEQ ID NO: 2694626 - RNA, 17 nt, Human
gacagggaggacgcucu

SEQ ID NO: 2694627 - RNA, 18 nt, Human
gacagggaggacgcucuc

SEQ ID NO: 2694628 - RNA, 16 nt, Human
gacaugggacauuugc

SEQ ID NO: 2694629 - RNA, 21 nt, Human
gaccacugcagaagacaguau

SEQ ID NO: 2694630 - RNA, 16 nt, Human
gacccaaaaggcagaa

SEQ ID NO: 2694631 - RNA, 15 nt, Human
gacccacaagaaaug

SEQ ID NO: 2694632 - RNA, 22 nt, Human
gacccacaagaaaugaaagcag

SEQ ID NO: 2694633 - RNA, 16 nt, Human
gacaaggaaaaaauaa

SEQ ID NO: 2694634 - RNA, 15 nt, Human
gacaagcucacagac

SEQ ID NO: 2694635 - RNA, 16 nt, Human
gaauuggagcucgugg

SEQ ID NO: 2694636 - RNA, 16 nt, Human
gaauugacccacaaga

SEQ ID NO: 2694637 - RNA, 21 nt, Human
gaauugacccacaagaaauga

SEQ ID NO: 2694638 - RNA, 21 nt, Human
cuguuaaaagaugaaaauauu

SEQ ID NO: 2694639 - RNA, 23 nt, Human
cuguuaaaagaugaaaauauuug

SEQ ID NO: 2694640 - RNA, 20 nt, Human
cuguuaaaagaugaaaauau

SEQ ID NO: 2694641 - RNA, 22 nt, Human
cugggggggauuguaaaauggu

SEQ ID NO: 2694642 - RNA, 23 nt, Human
cuguaaucacagcuacuugggag

SEQ ID NO: 2694643 - RNA, 20 nt, Human
cugucuacacuaagagagaa

SEQ ID NO: 2694644 - RNA, 22 nt, Human
cuguauuuuaaaagaaugauua

SEQ ID NO: 2694645 - RNA, 19 nt, Human
cuguauuuuaaaagaauga

SEQ ID NO: 2694646 - RNA, 20 nt, Human
cuguauuuuaaaagaaugau

SEQ ID NO: 2694647 - RNA, 12 nt, Human
cuggagcucugc

SEQ ID NO: 2694648 - RNA, 13 nt, Human
cuggagcucugcc

SEQ ID NO: 2694649 - RNA, 16 nt, Human
cuggagcucugcccau

SEQ ID NO: 2694650 - RNA, 23 nt, Human
cuggccuucggccuccauccuga

SEQ ID NO: 2694651 - RNA, 22 nt, Human
cuggccuucggccuccauccug

SEQ ID NO: 2694652 - RNA, 21 nt, Human
cuggcacaguuuucugagaaa

SEQ ID NO: 2694653 - RNA, 22 nt, Human
cuggcacaguuuucugagaaag

SEQ ID NO: 2694654 - RNA, 20 nt, Human
cuggcacaguuuucugagaa

SEQ ID NO: 2694655 - RNA, 18 nt, Human
cugcugaaacaacaaaua

SEQ ID NO: 2694656 - RNA, 13 nt, Human
cugccuccccucc

SEQ ID NO: 2694657 - RNA, 19 nt, Human
cugcccucuccugggcagc

SEQ ID NO: 2694658 - RNA, 18 nt, Human
cugcccucuccugggcag

SEQ ID NO: 2694659 - RNA, 16 nt, Human
cugcccucuccugggc

SEQ ID NO: 2694660 - RNA, 21 nt, Human
cugcccucuccugggcagcug

SEQ ID NO: 2694661 - RNA, 20 nt, Human
cugcccucuccugggcagcu

SEQ ID NO: 2694662 - RNA, 21 nt, Human
cuucugucuucacaacagauu

SEQ ID NO: 2694663 - RNA, 22 nt, Human
cuucugucuucacaacagauua

SEQ ID NO: 2694664 - RNA, 18 nt, Human
cuucugucuucacaacag

SEQ ID NO: 2694665 - RNA, 22 nt, Human
cuuagaugcaguucugaagaag

SEQ ID NO: 2694666 - RNA, 20 nt, Human
cuuagaugcaguucugaaga

SEQ ID NO: 2694667 - RNA, 15 nt, Human
cuuauuucauuucuu

SEQ ID NO: 2694668 - RNA, 15 nt, Human
cuuauuuccucauuu

SEQ ID NO: 2694669 - RNA, 14 nt, Human
cuuauuucauuucu

SEQ ID NO: 2694670 - RNA, 23 nt, Human
cuugucaauaaaauccauacauu

SEQ ID NO: 2694671 - RNA, 19 nt, Human
cuugaguuuaaauuguaau

SEQ ID NO: 2694672 - RNA, 18 nt, Human
gaaaauauuuguaucaca

SEQ ID NO: 2694673 - RNA, 22 nt, Human
gaaaaucuacacuccagugaga

SEQ ID NO: 2694674 - RNA, 18 nt, Human
gaaaaucuuauaauuuaa

SEQ ID NO: 2694675 - RNA, 14 nt, Human
gaaagcagggacuu

SEQ ID NO: 2694676 - RNA, 22 nt, Human
gaaagcagaacagugauuacca

SEQ ID NO: 2694677 - RNA, 17 nt, Human
gaaagcagaacagugau

SEQ ID NO: 2694678 - RNA, 20 nt, Human
gaaagaggcagcuugaaacu

SEQ ID NO: 2694679 - RNA, 21 nt, Human
gaaagaggaaugaaguacuca

SEQ ID NO: 2694680 - RNA, 17 nt, Human
gaaagagaacuuccaga

SEQ ID NO: 2694681 - RNA, 14 nt, Human
gaaacccugucucu

SEQ ID NO: 2694682 - RNA, 23 nt, Human
gaaacucguuaauuuguaguguu

SEQ ID NO: 2694683 - RNA, 11 nt, Human
gaaacauuugg

SEQ ID NO: 2694684 - RNA, 16 nt, Human
gaaacacaacuauauu

SEQ ID NO: 2694685 - RNA, 13 nt, Human
ccugaggcuccac

SEQ ID NO: 2694686 - RNA, 14 nt, Human
ccugaggcuccacu

SEQ ID NO: 2694687 - RNA, 13 nt, Human
ccugaaagaggaa

SEQ ID NO: 2694688 - RNA, 17 nt, Human
ccugccccugagcccau

SEQ ID NO: 2694689 - RNA, 14 nt, Human
ccugggcagcugcc

SEQ ID NO: 2694690 - RNA, 13 nt, Human
ccugggcagcugc

SEQ ID NO: 2694691 - RNA, 15 nt, Human
ccuuggacucauuuu

SEQ ID NO: 2694692 - RNA, 18 nt, Human
ccuucggccuccauccug

SEQ ID NO: 2694693 - RNA, 16 nt, Human
ccuucggccuccaucc

SEQ ID NO: 2694694 - RNA, 17 nt, Human
ccuucggccuccauccu

SEQ ID NO: 2694695 - RNA, 22 nt, Human
cuaggaaauauuuauuuuaaua

SEQ ID NO: 2694696 - RNA, 19 nt, Human
cuaaauugacacuuaaaaa

SEQ ID NO: 2694697 - RNA, 15 nt, Human
cuaagagagaaugag

SEQ ID NO: 2694698 - RNA, 14 nt, Human
cuaagagagaauga

SEQ ID NO: 2694699 - RNA, 20 nt, Human
cgggaggcagagguugcagu

SEQ ID NO: 2694700 - RNA, 14 nt, Human
cuacacuaagagag

SEQ ID NO: 2694701 - RNA, 23 nt, Human
cuacacgagauacagaauuuuau

SEQ ID NO: 2694702 - RNA, 21 nt, Human
cuaagcuucacuguaaaauaa

SEQ ID NO: 2694703 - RNA, 14 nt, Human
cuaaguaaaaccac

SEQ ID NO: 2694704 - RNA, 18 nt, Human
cuaaguaaaaccacagca

SEQ ID NO: 2694705 - RNA, 19 nt, Human
cuaaguaaaaccacagcag

SEQ ID NO: 2694706 - RNA, 20 nt, Human
cuaggaaauauuuauuuuaa

SEQ ID NO: 2694707 - RNA, 19 nt, Human
cuaggaaauauuuauuuua

SEQ ID NO: 2694708 - RNA, 15 nt, Human
cuaggaaauauuuau

SEQ ID NO: 2694709 - RNA, 14 nt, Human
cuaggaaauauuua

SEQ ID NO: 2694710 - RNA, 15 nt, Human
cuauaggugcuacaa

SEQ ID NO: 2694711 - RNA, 19 nt, Human
cuagaguuuagcuggaaaa

SEQ ID NO: 2694712 - RNA, 18 nt, Human
cuagaguuuagcuggaaa

SEQ ID NO: 2694713 - RNA, 19 nt, Human
cuaugaaauauuauguuaa

SEQ ID NO: 2694714 - RNA, 12 nt, Human
cuauaauuuaaa

SEQ ID NO: 2694715 - RNA, 13 nt, Human
cuauaauuuaaau

SEQ ID NO: 2694716 - RNA, 21 nt, Human
cucagaugcacaugagcuggc

SEQ ID NO: 2694717 - RNA, 22 nt, Human
cucaggaaaucaaauaugcaaa

SEQ ID NO: 2694718 - RNA, 14 nt, Human
cuccccucggagaa

SEQ ID NO: 2694719 - RNA, 23 nt, Human
cucauuuuuauaaugucccuuca

SEQ ID NO: 2694720 - RNA, 12 nt, Human
cucauuuccaag

SEQ ID NO: 2694721 - RNA, 14 nt, Human
cucauuuccaagca

SEQ ID NO: 2694722 - RNA, 13 nt, Human
cucauuuccaagc

SEQ ID NO: 2694723 - RNA, 17 nt, Human
cucauuuccaagcaagu

SEQ ID NO: 2694724 - RNA, 17 nt, Human
ccccuccucugcuugcc

SEQ ID NO: 2694725 - RNA, 14 nt, Human
ccccuccucugcuu

SEQ ID NO: 2694726 - RNA, 13 nt, Human
ccccuccucugcu

SEQ ID NO: 2694727 - RNA, 15 nt, Human
ccccucggagaagag

SEQ ID NO: 2694728 - RNA, 15 nt, Human
ccuaacgaaguaucc

SEQ ID NO: 2694729 - RNA, 22 nt, Human
cccucuccugggcagcugccuc

SEQ ID NO: 2694730 - RNA, 21 nt, Human
cccucuccugggcagcugccu

SEQ ID NO: 2694731 - RNA, 20 nt, Human
cccucuccugggcagcugcc

SEQ ID NO: 2694732 - RNA, 23 nt, Human
cccucuccugggcagcugccucc

SEQ ID NO: 2694733 - RNA, 12 nt, Human
ccaggugccagu

SEQ ID NO: 2694734 - RNA, 13 nt, Human
ccaggugccaguu

SEQ ID NO: 2694735 - RNA, 20 nt, Human
ccauccugaggcuccacuug

SEQ ID NO: 2694736 - RNA, 18 nt, Human
ccauccugaggcuccacu

SEQ ID NO: 2694737 - RNA, 20 nt, Human
ccagguagaggguguguaag

SEQ ID NO: 2694738 - RNA, 19 nt, Human
ccagccugagcgacaguga

SEQ ID NO: 2694739 - RNA, 15 nt, Human
ccacugguucuucuu

SEQ ID NO: 2694740 - RNA, 14 nt, Human
ccagacaucaacag

SEQ ID NO: 2694741 - RNA, 15 nt, Human
ccaccucccugcaau

SEQ ID NO: 2694742 - RNA, 21 nt, Human
ccaccucccugcaauaaaaug

SEQ ID NO: 2694743 - RNA, 19 nt, Human
ccaccucccugcaauaaaa

SEQ ID NO: 2694744 - RNA, 12 nt, Human
aaaaacacagca

SEQ ID NO: 2694745 - RNA, 17 nt, Human
aaaacaaggaugaauua

SEQ ID NO: 2694746 - RNA, 12 nt, Human
aaaacacagcaa

SEQ ID NO: 2694747 - RNA, 13 nt, Human
aaaacacagcaag

SEQ ID NO: 2694748 - RNA, 18 nt, Human
aaaacacagcaaggguga

SEQ ID NO: 2694749 - RNA, 14 nt, Human
aaaacaaggaugaa

SEQ ID NO: 2694750 - RNA, 15 nt, Human
agcaugaagacagag

SEQ ID NO: 2694751 - RNA, 12 nt, Human
agcaugaagaca

SEQ ID NO: 2694752 - RNA, 19 nt, Human
agccagauuuuccugaaaa

SEQ ID NO: 2694753 - RNA, 15 nt, Human
agccagauuuuccug

SEQ ID NO: 2694754 - RNA, 19 nt, Human
agcaguucagagcugcccu

SEQ ID NO: 2694755 - RNA, 20 nt, Human
agcaguucagagcugcccuc

SEQ ID NO: 2694756 - RNA, 18 nt, Human
agcaguucagagcugccc

SEQ ID NO: 2694757 - RNA, 17 nt, Human
agcaguucagagcugcc

SEQ ID NO: 2694758 - RNA, 15 nt, Human
agcaguucagagcug

SEQ ID NO: 2694759 - RNA, 16 nt, Human
agcaguucagagcugc

SEQ ID NO: 2694760 - RNA, 23 nt, Human
agcaguugaaaagacuccaaaga

SEQ ID NO: 2694761 - RNA, 21 nt, Human
agcaguugaaaagacuccaaa

SEQ ID NO: 2694762 - RNA, 14 nt, Human
agauguagaggaga

SEQ ID NO: 2694763 - RNA, 21 nt, Human
agaugggagaaucacuugaac

SEQ ID NO: 2694764 - RNA, 19 nt, Human
agccccacccucagaugca

SEQ ID NO: 2694765 - RNA, 21 nt, Human
agccgggcgugguggugagug

SEQ ID NO: 2694766 - RNA, 21 nt, Human
agauaggucagugcaaauacu

SEQ ID NO: 2694767 - RNA, 17 nt, Human
agacugcauuauauuua

SEQ ID NO: 2694768 - RNA, 14 nt, Human
aggauguugaaaaa

SEQ ID NO: 2694769 - RNA, 17 nt, Human
aggauguugaaaaaguu

SEQ ID NO: 2694770 - RNA, 18 nt, Human
agcuucacuguaaaauaa

SEQ ID NO: 2694771 - RNA, 14 nt, Human
agcuguaugauucc

SEQ ID NO: 2694772 - RNA, 21 nt, Human
auguaagggaaacugccagca

SEQ ID NO: 2694773 - RNA, 22 nt, Human
auguaagggaaacugccagcaa

SEQ ID NO: 2694774 - RNA, 20 nt, Human
auguaagggaaacugccagc

SEQ ID NO: 2694775 - RNA, 22 nt, Human
aucuuauaauuuaaaauaugcu

SEQ ID NO: 2694776 - RNA, 17 nt, Human
aucagcugcugaaacaa

SEQ ID NO: 2694777 - RNA, 21 nt, Human
aguccaagcauuuagauguau

SEQ ID NO: 2694778 - RNA, 16 nt, Human
aguccaagcauuuaga

SEQ ID NO: 2694779 - RNA, 17 nt, Human
agucaaauugugugaaa

SEQ ID NO: 2694780 - RNA, 15 nt, Human
agucaaauuguguga

SEQ ID NO: 2694781 - RNA, 13 nt, Human
agucaaauugugu

SEQ ID NO: 2694782 - RNA, 18 nt, Human
agugauuaccagggacug

SEQ ID NO: 2694783 - RNA, 15 nt, Human
agugauuaccaggga

SEQ ID NO: 2694784 - RNA, 18 nt, Human
aguuguaccgcaauguga

SEQ ID NO: 2694785 - RNA, 19 nt, Human
aguuguaccgcaaugugac

SEQ ID NO: 2694786 - RNA, 19 nt, Human
auauuuauuacuguaagaa

SEQ ID NO: 2694787 - RNA, 14 nt, Human
auauuuauuacugu

SEQ ID NO: 2694788 - RNA, 18 nt, Human
auauuuauuuuaauaaug

SEQ ID NO: 2694789 - RNA, 23 nt, Human
auauuucagauaaucacaauaca

SEQ ID NO: 2694790 - RNA, 23 nt, Human
auaugcuucuguuuuauaauuuu

SEQ ID NO: 2694791 - RNA, 15 nt, Human
auaucaauuuaaaaa

SEQ ID NO: 2694792 - RNA, 18 nt, Human
auaucacuugucaauaaa

SEQ ID NO: 2694793 - RNA, 14 nt, Human
auaauuacuauguc

SEQ ID NO: 2694794 - RNA, 16 nt, Human
acuaagagagaaugag

SEQ ID NO: 2694795 - RNA, 15 nt, Human
acuaagagagaauga

SEQ ID NO: 2694796 - RNA, 16 nt, Human
acgugcacgcacacug

SEQ ID NO: 2694797 - RNA, 12 nt, Human
acucccuuucaa

SEQ ID NO: 2694798 - RNA, 13 nt, Human
acucccuuucaac

SEQ ID NO: 2694799 - RNA, 14 nt, Human
acuagcuauggugu

SEQ ID NO: 2694800 - RNA, 14 nt, Human
acucaaaucaagaa

SEQ ID NO: 2694801 - RNA, 12 nt, Human
acuggaacucuc

SEQ ID NO: 2694802 - RNA, 19 nt, Human
acuuguaaaggaauuuaaa

SEQ ID NO: 2694803 - RNA, 20 nt, Human
acuuguaaaggaauuuaaaa

SEQ ID NO: 2694804 - RNA, 14 nt, Human
acuuggucugugag

SEQ ID NO: 2694805 - RNA, 15 nt, Human
acuuggucugugaga

SEQ ID NO: 2694806 - RNA, 18 nt, Human
acuuguaaaggaauuuaa

SEQ ID NO: 2694807 - RNA, 16 nt, Human
acccaaguccaagcau

SEQ ID NO: 2694808 - RNA, 15 nt, Human
acccacaagaaauga

SEQ ID NO: 2694809 - RNA, 14 nt, Human
acauuuguauaaaa

SEQ ID NO: 2694810 - RNA, 18 nt, Human
acauuugcucauggaauu

SEQ ID NO: 2694811 - RNA, 13 nt, Human
acauguuacaaca

SEQ ID NO: 2694812 - RNA, 15 nt, Human
acagcaguugaaaag

SEQ ID NO: 2694813 - RNA, 18 nt, Human
acagcaguugaaaagacu

SEQ ID NO: 2694814 - RNA, 16 nt, Human
acagccagacuggcac

SEQ ID NO: 2694815 - RNA, 13 nt, Human
acagccagacugg

SEQ ID NO: 2694816 - RNA, 15 nt, Human
acagccagacuggca

SEQ ID NO: 2694817 - RNA, 20 nt, Human
acagcucugcauacucauua

SEQ ID NO: 2694818 - RNA, 13 nt, Human
acaacuauauugu

SEQ ID NO: 2694819 - RNA, 15 nt, Human
aacacgagcaggcua

SEQ ID NO: 2694820 - RNA, 23 nt, Human
aacugacacaugcugaacaucac

SEQ ID NO: 2694821 - RNA, 13 nt, Human
aagaaauguaagg

SEQ ID NO: 2694822 - RNA, 14 nt, Human
aagaaauguaaggg

SEQ ID NO: 2694823 - RNA, 16 nt, Human
aaacugacucuuaaga

SEQ ID NO: 2694824 - RNA, 14 nt, Human
aaacugccagcaac

SEQ ID NO: 2694825 - RNA, 15 nt, Human
aaacugccagcaacg

SEQ ID NO: 2694826 - RNA, 17 nt, Human
aaacugacucuuaagaa

SEQ ID NO: 2694827 - RNA, 19 nt, Human
aaacugccagcaacgcagg

SEQ ID NO: 2694828 - RNA, 17 nt, Human
aaagaugaaaauauuug

SEQ ID NO: 2694829 - RNA, 13 nt, Human
aaagaugaaaaua

SEQ ID NO: 2694830 - RNA, 16 nt, Human
aaagaugaaaauauuu

SEQ ID NO: 2694831 - RNA, 12 nt, Human
aaauaacaauga

SEQ ID NO: 2694832 - RNA, 18 nt, Human
aaauggcuuccuggcaau

SEQ ID NO: 2694833 - RNA, 16 nt, Human
aaaucaaauaugcaaa

SEQ ID NO: 2694834 - RNA, 18 nt, Human
aaaucaaauaugcaaagc

SEQ ID NO: 2694835 - RNA, 19 nt, Human
aaaucaaauaugcaaagca

SEQ ID NO: 2694836 - RNA, 20 nt, Human
aauuaguuuuauaugcuucu

SEQ ID NO: 2694837 - RNA, 17 nt, Human
aauuaguuuuauaugcu

SEQ ID NO: 2694838 - RNA, 14 nt, Human
aauuaguuuuauau

SEQ ID NO: 2694839 - RNA, 16 nt, Human
aauauuauguuaaaac

SEQ ID NO: 2694840 - RNA, 13 nt, Human
aaucacaauacau

SEQ ID NO: 2694841 - RNA, 15 nt, Human
aaucaagaaacuuaa

SEQ ID NO: 2694842 - RNA, 14 nt, Human
aauccauacauuug

SEQ ID NO: 2694843 - RNA, 13 nt, Human
aauccauacauuu

SEQ ID NO: 2694844 - RNA, 17 nt, Human
aaugauaacuggaaacu

SEQ ID NO: 2694845 - RNA, 20 nt, Human
aaugauaacuggaaacuuca

SEQ ID NO: 2694846 - RNA, 19 nt, Human
aauaaaauggguuuuacug

SEQ ID NO: 2694847 - RNA, 14 nt, Human
aauaaaauggguuu

SEQ ID NO: 2694848 - RNA, 21 nt, Human
aauaauccuaaacauaugaau

SEQ ID NO: 2694849 - RNA, 13 nt, Human
aagccagauuuuc

SEQ ID NO: 2694850 - RNA, 16 nt, Human
aagauuuaccacuugu

SEQ ID NO: 2694851 - RNA, 21 nt, Human
gaaaagacuccaaagaaaugu

SEQ ID NO: 2694852 - RNA, 20 nt, Human
gaaaagacuccaaagaaaug

SEQ ID NO: 2694853 - RNA, 18 nt, Human
gaaaagacuccaaagaaa

SEQ ID NO: 2694854 - RNA, 23 nt, Human
gaaacuucagcgguuuauauaag

SEQ ID NO: 2694855 - RNA, 23 nt, Human
gaacaaauuuacagagacagaaa

SEQ ID NO: 2694856 - RNA, 17 nt, Human
gaacaaauuuacagaga

SEQ ID NO: 2694857 - RNA, 18 nt, Human
gaacaaauuuacagagac

SEQ ID NO: 2694858 - RNA, 18 nt, Human
gaaaugaaagcagggacu

SEQ ID NO: 2694859 - RNA, 23 nt, Human
gaaaucaaauaugcaaagcacug

SEQ ID NO: 2694860 - RNA, 17 nt, Human
gaaaugaaagcagggac

SEQ ID NO: 2694861 - RNA, 17 nt, Human
gaaaucaaauaugcaaa

SEQ ID NO: 2694862 - RNA, 21 nt, Human
gaaaucaaauaugcaaagcac

SEQ ID NO: 2694863 - RNA, 16 nt, Human
gaaaucaaauaugcaa

SEQ ID NO: 2694864 - RNA, 22 nt, Human
cuucucuguauuccuagaaacu

SEQ ID NO: 2694865 - RNA, 23 nt, Human
cuuggucucagugucaaugcagc

SEQ ID NO: 2694866 - RNA, 23 nt, Human
cuggaaaaguauguuagugcaaa

SEQ ID NO: 2694867 - RNA, 14 nt, Human
cugccuccccuccu

SEQ ID NO: 2694868 - RNA, 18 nt, Human
cugccuccccuccucugc

SEQ ID NO: 2694869 - RNA, 17 nt, Human
cugccuccccuccucug

SEQ ID NO: 2694870 - RNA, 20 nt, Human
cugccuccccuccucugcuu

SEQ ID NO: 2694871 - RNA, 19 nt, Human
cugccuccccuccucugcu

SEQ ID NO: 2694872 - RNA, 21 nt, Human
cugccuccccuccucugcuug

SEQ ID NO: 2694873 - RNA, 20 nt, Human
cuguaagaaaauaucacuug

SEQ ID NO: 2694874 - RNA, 21 nt, Human
cugugagaugcuagaacuccc

SEQ ID NO: 2694875 - RNA, 23 nt, Human
cugugagaugcuagaacucccuu

SEQ ID NO: 2694876 - RNA, 22 nt, Human
cuguucacagccagacuggcac

SEQ ID NO: 2694877 - RNA, 12 nt, Human
cuguucacagcc

SEQ ID NO: 2694878 - RNA, 19 nt, Human
cuguucacagccagacugg

SEQ ID NO: 2694879 - RNA, 13 nt, Human
cuuaaaaaugguu

SEQ ID NO: 2694880 - RNA, 20 nt, Human
cuuaaaaaugguuuaaaugg

SEQ ID NO: 2694881 - RNA, 12 nt, Human
cuuaaaaauggu

SEQ ID NO: 2694882 - RNA, 14 nt, Human
gacgcucucuggcc

SEQ ID NO: 2694883 - RNA, 18 nt, Human
gacagucaccucauggaa

SEQ ID NO: 2694884 - RNA, 12 nt, Human
gacagcucugca

SEQ ID NO: 2694885 - RNA, 14 nt, Human
gaaugaauggcuaa

SEQ ID NO: 2694886 - RNA, 20 nt, Human
gaauuacauuuguauaaaau

SEQ ID NO: 2694887 - RNA, 18 nt, Human
gaauuacauuuguauaaa

SEQ ID NO: 2694888 - RNA, 15 nt, Human
gaauuacauuuguau

SEQ ID NO: 2694889 - RNA, 13 nt, Human
gaauuacauuugu

SEQ ID NO: 2694890 - RNA, 14 nt, Human
gaauuaacacauga

SEQ ID NO: 2694891 - RNA, 15 nt, Human
gaauuaacacaugau

SEQ ID NO: 2694892 - RNA, 22 nt, Human
gaaugauuaugaauuacauuug

SEQ ID NO: 2694893 - RNA, 14 nt, Human
gaaugauuaugaau

SEQ ID NO: 2694894 - RNA, 15 nt, Human
gaaugaauggcuaag

SEQ ID NO: 2694895 - RNA, 20 nt, Human
gaaugaauggcuaagcaaaa

SEQ ID NO: 2694896 - RNA, 22 nt, Human
gagcuguucacagccagacugg

SEQ ID NO: 2694897 - RNA, 17 nt, Human
gagcuguucacagccag

SEQ ID NO: 2694898 - RNA, 20 nt, Human
gagcuguucacagccagacu

SEQ ID NO: 2694899 - RNA, 14 nt, Human
gagcagucaggaaa

SEQ ID NO: 2694900 - RNA, 17 nt, Human
gagccccacccucagau

SEQ ID NO: 2694901 - RNA, 16 nt, Human
gagccccacccucaga

SEQ ID NO: 2694902 - RNA, 21 nt, Human
gaggacgcucucuggccuucg

SEQ ID NO: 2694903 - RNA, 20 nt, Human
gaggacgcucucuggccuuc

SEQ ID NO: 2694904 - RNA, 12 nt, Human
gaggagaaacug

SEQ ID NO: 2694905 - RNA, 14 nt, Human
gaggagaaacugga

SEQ ID NO: 2694906 - RNA, 15 nt, Human
gaggcuccacuuggu

SEQ ID NO: 2694907 - RNA, 12 nt, Human
gaggcuccacuu

SEQ ID NO: 2694908 - RNA, 17 nt, Human
gaggcuccacuuggucu

SEQ ID NO: 2694909 - RNA, 18 nt, Human
gaggcugagaugggagaa

SEQ ID NO: 2694910 - RNA, 21 nt, Human
gagauugugccccugcacucc

SEQ ID NO: 2694911 - RNA, 16 nt, Human
gagaugcuagaacucc

SEQ ID NO: 2694912 - RNA, 20 nt, Human
gagaugcuagaacucccuuu

SEQ ID NO: 2694913 - RNA, 22 nt, Human
gacuuuuuauggcacuaguauu

SEQ ID NO: 2694914 - RNA, 22 nt, Human
gcaguuguugcccacagcugua

SEQ ID NO: 2694915 - RNA, 13 nt, Human
gcagugaugucac

SEQ ID NO: 2694916 - RNA, 20 nt, Human
gcaucuagcaugucgucaaa

SEQ ID NO: 2694917 - RNA, 15 nt, Human
gcagcucuccccuuc

SEQ ID NO: 2694918 - RNA, 12 nt, Human
gcagaacaguga

SEQ ID NO: 2694919 - RNA, 13 nt, Human
gcagaacagugau

SEQ ID NO: 2694920 - RNA, 18 nt, Human
gcagaacagugauuacca

SEQ ID NO: 2694921 - RNA, 22 nt, Human
gcagaacagugauuaccaggga

SEQ ID NO: 2694922 - RNA, 18 nt, Human
gcuguauuuuaaaagaau

SEQ ID NO: 2694923 - RNA, 20 nt, Human
gcuguauuuuaaaagaauga

SEQ ID NO: 2694924 - RNA, 21 nt, Human
gcuguauuuuaaaagaaugau

SEQ ID NO: 2694925 - RNA, 13 nt, Human
gcugcugaaacaa

SEQ ID NO: 2694926 - RNA, 14 nt, Human
gcugccuccccucc

SEQ ID NO: 2694927 - RNA, 13 nt, Human
ggaaacugccagc

SEQ ID NO: 2694928 - RNA, 16 nt, Human
ggaaaaaauaacaaug

SEQ ID NO: 2694929 - RNA, 19 nt, Human
ggaaaucaggguuaguauu

SEQ ID NO: 2694930 - RNA, 21 nt, Human
ggacagucaccucauggaauu

SEQ ID NO: 2694931 - RNA, 18 nt, Human
ggacagucaccucaugga

SEQ ID NO: 2694932 - RNA, 17 nt, Human
ggacagucaccucaugg

SEQ ID NO: 2694933 - RNA, 13 nt, Human
gcauuuagaugua

SEQ ID NO: 2694934 - RNA, 19 nt, Human
gcauuuaggccaugggaca

SEQ ID NO: 2694935 - RNA, 12 nt, Human
gcauuuagaugu

SEQ ID NO: 2694936 - RNA, 11 nt, Human
gccccaaaagg

SEQ ID NO: 2694937 - RNA, 22 nt, Human
gccucauguccacugguucuuc

SEQ ID NO: 2694938 - RNA, 13 nt, Human
gccuccauccuga

SEQ ID NO: 2694939 - RNA, 14 nt, Human
gccuccauccugag

SEQ ID NO: 2694940 - RNA, 15 nt, Human
gccuccauccugagg

SEQ ID NO: 2694941 - RNA, 23 nt, Human
gccuucggccuccauccugaggc

SEQ ID NO: 2694942 - RNA, 13 nt, Human
aaaaauacaaaaa

SEQ ID NO: 2694943 - RNA, 18 nt, Human
ggccuucggccuccaucc

SEQ ID NO: 2694944 - RNA, 22 nt, Human
ggccuucggccuccauccugag

SEQ ID NO: 2694945 - RNA, 16 nt, Human
ggccuucggccuccau

SEQ ID NO: 2694946 - RNA, 20 nt, Human
ggcuaagcuucacuguaaaa

SEQ ID NO: 2694947 - RNA, 16 nt, Human
aaaaugguuuaaaugg

SEQ ID NO: 2694948 - RNA, 18 nt, Human
aaaaugguuuaaaugguc

SEQ ID NO: 2694949 - RNA, 16 nt, Human
aaaauggguuuuacug

SEQ ID NO: 2694950 - RNA, 17 nt, Human
aaaaucucaauauuuca

SEQ ID NO: 2694951 - RNA, 11 nt, Human
aaaauaauuuu

SEQ ID NO: 2694952 - RNA, 17 nt, Human
aaaauaauuuuuauauu

SEQ ID NO: 2694953 - RNA, 16 nt, Human
aaaauaauuuuuauau

SEQ ID NO: 2694954 - RNA, 14 nt, Human
aaaauacacacuca

SEQ ID NO: 2694955 - RNA, 14 nt, Human
ggucagugcaaaua

SEQ ID NO: 2694956 - RNA, 20 nt, Human
ggguuuuauuguuuaaaauc

SEQ ID NO: 2694957 - RNA, 13 nt, Human
aaauaugcaaagc

SEQ ID NO: 2694958 - RNA, 15 nt, Human
aaauaugcaaagcac

SEQ ID NO: 2694959 - RNA, 16 nt, Human
aaauaugcaaagcacu

SEQ ID NO: 2694960 - RNA, 17 nt, Human
aaauaugcaaagcacug

SEQ ID NO: 2694961 - RNA, 21 nt, Human
aaauaccaugccauuuaaagc

SEQ ID NO: 2694962 - RNA, 18 nt, Human
aaauauaugcuaagucuu

SEQ ID NO: 2694963 - RNA, 22 nt, Human
aaauaucacuugucaauaaaau

SEQ ID NO: 2694964 - RNA, 13 nt, Human
guaauaaacucau

SEQ ID NO: 2694965 - RNA, 12 nt, Human
aaacuuuaugcu

SEQ ID NO: 2694966 - RNA, 19 nt, Human
aaacuuuaugcuaagugaa

SEQ ID NO: 2694967 - RNA, 16 nt, Human
aaagcagaacagugau

SEQ ID NO: 2694968 - RNA, 22 nt, Human
aaagggcuguuauaaucuuuca

SEQ ID NO: 2694969 - RNA, 20 nt, Human
aaagggcuguuauaaucuuu

SEQ ID NO: 2694970 - RNA, 13 nt, Human
aaagcuuauuaaa

SEQ ID NO: 2694971 - RNA, 17 nt, Human
aaaguauguuagugcaa

SEQ ID NO: 2694972 - RNA, 19 nt, Human
gguuuuauuguuuaaaauc

SEQ ID NO: 2694973 - RNA, 12 nt, Human
gguuucuagcau

SEQ ID NO: 2694974 - RNA, 16 nt, Human
cacaagacugcacauc

SEQ ID NO: 2694975 - RNA, 12 nt, Human
caauuuaaaaaa

SEQ ID NO: 2694976 - RNA, 23 nt, Human
caaugcuguauuuuaaaagaaug

SEQ ID NO: 2694977 - RNA, 14 nt, Human
caaugcuguauuuu

SEQ ID NO: 2694978 - RNA, 21 nt, Human
caauauuucagauaaucacaa

SEQ ID NO: 2694979 - RNA, 20 nt, Human
caauauuucagauaaucaca

SEQ ID NO: 2694980 - RNA, 12 nt, Human
caauauuucaga

SEQ ID NO: 2694981 - RNA, 20 nt, Human
caaguauuagaauaccacag

SEQ ID NO: 2694982 - RNA, 14 nt, Human
caaguauuagaaua

SEQ ID NO: 2694983 - RNA, 22 nt, Human
caccuugcagcucuccccuucu

SEQ ID NO: 2694984 - RNA, 15 nt, Human
caccuugcagcucuc

SEQ ID NO: 2694985 - RNA, 13 nt, Human
caccuugcagcuc

SEQ ID NO: 2694986 - RNA, 21 nt, Human
caccuacaugagguacugaga

SEQ ID NO: 2694987 - RNA, 23 nt, Human
caccucaaaauaccaugccauuu

SEQ ID NO: 2694988 - RNA, 17 nt, Human
cacuuggucugugagau

SEQ ID NO: 2694989 - RNA, 20 nt, Human
cacuuggucugugagaugcu

SEQ ID NO: 2694990 - RNA, 19 nt, Human
caacccaaauguucaucaa

SEQ ID NO: 2694991 - RNA, 21 nt, Human
caacuaucucauuuccaagca

SEQ ID NO: 2694992 - RNA, 15 nt, Human
caacacgagcaggcu

SEQ ID NO: 2694993 - RNA, 17 nt, Human
auucuugccaaauauaa

SEQ ID NO: 2694994 - RNA, 18 nt, Human
auugacuuuuuauggcac

SEQ ID NO: 2694995 - RNA, 18 nt, Human
auucacaagacccaaaag

SEQ ID NO: 2694996 - RNA, 14 nt, Human
auuguaaaugugcu

SEQ ID NO: 2694997 - RNA, 15 nt, Human
auuguaaaugugcuu

SEQ ID NO: 2694998 - RNA, 17 nt, Human
auuguaaaugugcuuuu

SEQ ID NO: 2694999 - RNA, 13 nt, Human
auuguaaaauggu

SEQ ID NO: 2695000 - RNA, 19 nt, Human
auuguuuaaaaucauuucu

SEQ ID NO: 2695001 - RNA, 18 nt, Human
auuucuaugaaauauuau

SEQ ID NO: 2695002 - RNA, 15 nt, Human
auuucuaugaaauau

SEQ ID NO: 2695003 - RNA, 20 nt, Human
auuucuaugaaauauuaugu

SEQ ID NO: 2695004 - RNA, 19 nt, Human
caggugccaguuauggcua

SEQ ID NO: 2695005 - RNA, 16 nt, Human
cagucaccucauggaa

SEQ ID NO: 2695006 - RNA, 15 nt, Human
cagucacauuccaag

SEQ ID NO: 2695007 - RNA, 19 nt, Human
cagucaccucauggaauug

SEQ ID NO: 2695008 - RNA, 20 nt, Human
cagucugacuguuuccauca

SEQ ID NO: 2695009 - RNA, 13 nt, Human
cagcaguucagag

SEQ ID NO: 2695010 - RNA, 17 nt, Human
cagagguugcagugagc

SEQ ID NO: 2695011 - RNA, 16 nt, Human
cagagguugcagugag

SEQ ID NO: 2695012 - RNA, 12 nt, Human
cagauccuggaa

SEQ ID NO: 2695013 - RNA, 21 nt, Human
cagcuccccucggagaagagc

SEQ ID NO: 2695014 - RNA, 22 nt, Human
cagcuccccucggagaagagcu

SEQ ID NO: 2695015 - RNA, 14 nt, Human
caugauguuuagaa

SEQ ID NO: 2695016 - RNA, 23 nt, Human
ccacagcaguugaaaagacucca

SEQ ID NO: 2695017 - RNA, 17 nt, Human
ccacagcaguugaaaag

SEQ ID NO: 2695018 - RNA, 18 nt, Human
ccacagcaguugaaaaga

SEQ ID NO: 2695019 - RNA, 12 nt, Human
ccacagcaguug

SEQ ID NO: 2695020 - RNA, 17 nt, Human
cauuuguauaaaauaau

SEQ ID NO: 2695021 - RNA, 20 nt, Human
cauuuguauaaaauaauuuu

SEQ ID NO: 2695022 - RNA, 19 nt, Human
cauuuguauaaaauaauuu

SEQ ID NO: 2695023 - RNA, 17 nt, Human
ccaaauguucaucaaug

SEQ ID NO: 2695024 - RNA, 18 nt, Human
ccccugcacuccagccug

SEQ ID NO: 2695025 - RNA, 14 nt, Human
ccauacauuugugu

SEQ ID NO: 2695026 - RNA, 13 nt, Human
ccauacauuugug

SEQ ID NO: 2695027 - RNA, 22 nt, Human
ccauuuaaagcuuauuaaaacu

SEQ ID NO: 2695028 - RNA, 19 nt, Human
cccugucuccucucucugu

SEQ ID NO: 2695029 - RNA, 23 nt, Human
ccucauggaauuggagcucgugg

SEQ ID NO: 2695030 - RNA, 15 nt, Human
ccuguaaucacagcu

SEQ ID NO: 2695031 - RNA, 21 nt, Human
ccugucggagcccugucuccu

SEQ ID NO: 2695032 - RNA, 17 nt, Human
ccugucggagcccuguc

SEQ ID NO: 2695033 - RNA, 16 nt, Human
ccugucggagcccugu

SEQ ID NO: 2695034 - RNA, 22 nt, Human
ccugucggagcccugucuccuc

SEQ ID NO: 2695035 - RNA, 15 nt, Human
cugaaacaacaaaua

SEQ ID NO: 2695036 - RNA, 16 nt, Human
cucuccccuucucugu

SEQ ID NO: 2695037 - RNA, 21 nt, Human
cucuuagaugcaguucugaag

SEQ ID NO: 2695038 - RNA, 22 nt, Human
cucuuagaugcaguucugaaga

SEQ ID NO: 2695039 - RNA, 16 nt, Human
cuccacuuggucugug

SEQ ID NO: 2695040 - RNA, 17 nt, Human
cuccacuuggucuguga

SEQ ID NO: 2695041 - RNA, 21 nt, Human
cuccacuuggucugugagaug

SEQ ID NO: 2695042 - RNA, 22 nt, Human
cuccacuuggucugugagaugc

SEQ ID NO: 2695043 - RNA, 13 nt, Human
cuccacuuggucu

SEQ ID NO: 2695044 - RNA, 15 nt, Human
cuccacuuggucugu

SEQ ID NO: 2695045 - RNA, 18 nt, Human
cucaguagucagacugga

SEQ ID NO: 2695046 - RNA, 19 nt, Human
cuccccaugauguuuagaa

SEQ ID NO: 2695047 - RNA, 23 nt, Human
cuccacuuggucugugagaugcu

SEQ ID NO: 2695048 - RNA, 14 nt, Human
cuccucugcuugcc

SEQ ID NO: 2695049 - RNA, 12 nt, Human
cuccucugcuug

SEQ ID NO: 2695050 - RNA, 12 nt, Human
cuccugggcagc

SEQ ID NO: 2695051 - RNA, 17 nt, Human
cuccugggcagcugccu

SEQ ID NO: 2695052 - RNA, 16 nt, Human
cuccugggcagcugcc

SEQ ID NO: 2695053 - RNA, 15 nt, Human
cuccugggcagcugc

SEQ ID NO: 2695054 - RNA, 14 nt, Human
cuccugggcagcug

SEQ ID NO: 2695055 - RNA, 19 nt, Human
cuccugggcagcugccucc

SEQ ID NO: 2695056 - RNA, 18 nt, Human
cuccugggcagcugccuc

SEQ ID NO: 2695057 - RNA, 22 nt, Human
cuccugggcagcugccuccccu

SEQ ID NO: 2695058 - RNA, 20 nt, Human
cuccucugcuugccaucccu

SEQ ID NO: 2695059 - RNA, 17 nt, Human
cuccucugcuugccauc

SEQ ID NO: 2695060 - RNA, 16 nt, Human
cuccucugcuugccau

SEQ ID NO: 2695061 - RNA, 15 nt, Human
cuccucugcuugcca

SEQ ID NO: 2695062 - RNA, 22 nt, Human
cuccucugcuugccaucccucc

SEQ ID NO: 2695063 - RNA, 21 nt, Human
cuccucugcuugccaucccuc

SEQ ID NO: 2695064 - RNA, 14 nt, Human
cucguuaauuugua

SEQ ID NO: 2695065 - RNA, 12 nt, Human
cuagaacucccu

SEQ ID NO: 2695066 - RNA, 13 nt, Human
cuagaacucccuu

SEQ ID NO: 2695067 - RNA, 22 nt, Human
cuaaguaaaaccacagcaguug

SEQ ID NO: 2695068 - RNA, 23 nt, Human
cuaaguaaaaccacagcaguuga

SEQ ID NO: 2695069 - RNA, 20 nt, Human
cgugugugugcguccugucg

SEQ ID NO: 2695070 - RNA, 20 nt, Human
cuaaguaaaaccacagcagu

SEQ ID NO: 2695071 - RNA, 20 nt, Human
cuacaugagguacugagagu

SEQ ID NO: 2695072 - RNA, 18 nt, Human
cuacaugagguacugaga

SEQ ID NO: 2695073 - RNA, 18 nt, Human
cuacauacuauggaauuu

SEQ ID NO: 2695074 - RNA, 16 nt, Human
cuacaaaaacacagca

SEQ ID NO: 2695075 - RNA, 17 nt, Human
cuacaaaaacacagcaa

SEQ ID NO: 2695076 - RNA, 18 nt, Human
cuacaaaaacacagcaag

SEQ ID NO: 2695077 - RNA, 15 nt, Human
cuacaaaaacacagc

SEQ ID NO: 2695078 - RNA, 16 nt, Human
cuagcaugaagacaga

SEQ ID NO: 2695079 - RNA, 23 nt, Human
cucaaaauaccaugccauuuaaa

SEQ ID NO: 2695080 - RNA, 17 nt, Human
cucaaaacugcacuguc

SEQ ID NO: 2695081 - RNA, 18 nt, Human
cgcaggcccccaggugcc

SEQ ID NO: 2695082 - RNA, 22 nt, Human
cguggugauuuagcaggaagcu

SEQ ID NO: 2695083 - RNA, 23 nt, Human
auuaaguaaugauaacuggaaac

SEQ ID NO: 2695084 - RNA, 21 nt, Human
auuaaguaaugauaacuggaa

SEQ ID NO: 2695085 - RNA, 19 nt, Human
uuuuugugaaaagcuccau

SEQ ID NO: 2695086 - RNA, 17 nt, Human
auuacauuuguauaaaa

SEQ ID NO: 2695087 - RNA, 20 nt, Human
auuacauuuguauaaaauaa

SEQ ID NO: 2695088 - RNA, 18 nt, Human
auuacauuuguauaaaau

SEQ ID NO: 2695089 - RNA, 12 nt, Human
auuaccagggac

SEQ ID NO: 2695090 - RNA, 19 nt, Human
uuuuuauauuugaaauauu

SEQ ID NO: 2695091 - RNA, 14 nt, Human
uuuuaauaauguuu

SEQ ID NO: 2695092 - RNA, 13 nt, Human
uuuuaauaauguu

SEQ ID NO: 2695093 - RNA, 12 nt, Human
uuuuaauaaugu

SEQ ID NO: 2695094 - RNA, 16 nt, Human
uuuuaauaauguuuca

SEQ ID NO: 2695095 - RNA, 19 nt, Human
augugcuaguaauuggaaa

SEQ ID NO: 2695096 - RNA, 18 nt, Human
auguucaucaaugaauga

SEQ ID NO: 2695097 - RNA, 15 nt, Human
auuaaaagaauauuu

SEQ ID NO: 2695098 - RNA, 15 nt, Human
auguuuucaggcuag

SEQ ID NO: 2695099 - RNA, 21 nt, Human
auguuuucaggcuagauguau

SEQ ID NO: 2695100 - RNA, 17 nt, Human
auguuuucaggcuagau

SEQ ID NO: 2695101 - RNA, 15 nt, Human
uuuucugagaaagac

SEQ ID NO: 2695102 - RNA, 18 nt, Human
uuuucugagaaagacuau

SEQ ID NO: 2695103 - RNA, 16 nt, Human
uuuucucuaggaaaua

SEQ ID NO: 2695104 - RNA, 14 nt, Human
uuuucucuaggaaa

SEQ ID NO: 2695105 - RNA, 22 nt, Human
auuuucaguuauuauauuuaca

SEQ ID NO: 2695106 - RNA, 22 nt, Human
auuuuaaaagaaugauuaugaa

SEQ ID NO: 2695107 - RNA, 18 nt, Human
auuuuaaaagaaugauua

SEQ ID NO: 2695108 - RNA, 18 nt, Human
auuuguauaaaauaauuu

SEQ ID NO: 2695109 - RNA, 15 nt, Human
auuuguauaaaauaa

SEQ ID NO: 2695110 - RNA, 19 nt, Human
auuuguauaaaauaauuuu

SEQ ID NO: 2695111 - RNA, 17 nt, Human
auuuuaaaagaaugauu

SEQ ID NO: 2695112 - RNA, 18 nt, Human
auugacccacaagaaaug

SEQ ID NO: 2695113 - RNA, 14 nt, Human
auuugaaauauuga

SEQ ID NO: 2695114 - RNA, 20 nt, Human
auuuauuuuaauaauguuuc

SEQ ID NO: 2695115 - RNA, 19 nt, Human
auuuauuuuaauaauguuu

SEQ ID NO: 2695116 - RNA, 12 nt, Human
auuucauuucuu

SEQ ID NO: 2695117 - RNA, 17 nt, Human
auuuauuuuaauaaugu

SEQ ID NO: 2695118 - RNA, 13 nt, Human
auuuagauguaua

SEQ ID NO: 2695119 - RNA, 20 nt, Human
augaaauauuauguuaaaac

SEQ ID NO: 2695120 - RNA, 21 nt, Human
augaaauauuauguuaaaacu

SEQ ID NO: 2695121 - RNA, 11 nt, Human
uugcucaugga

SEQ ID NO: 2695122 - RNA, 12 nt, Human
uugcucauggaa

SEQ ID NO: 2695123 - RNA, 23 nt, Human
augaauuaguuuuauaugcuucu

SEQ ID NO: 2695124 - RNA, 21 nt, Human
augaauuaguuuuauaugcuu

SEQ ID NO: 2695125 - RNA, 22 nt, Human
augaauuacauuuguauaaaau

SEQ ID NO: 2695126 - RNA, 23 nt, Human
uuguaguguuggagaagaacuga

SEQ ID NO: 2695127 - RNA, 13 nt, Human
uuguauaaaauaa

SEQ ID NO: 2695128 - RNA, 19 nt, Human
uuguauaaaauaauuuuua

SEQ ID NO: 2695129 - RNA, 17 nt, Human
augaauuacauuuguau

SEQ ID NO: 2695130 - RNA, 19 nt, Human
augaauuacauuuguauaa

SEQ ID NO: 2695131 - RNA, 18 nt, Human
augaauuacauuuguaua

SEQ ID NO: 2695132 - RNA, 20 nt, Human
uuuaaaaaagaaacauuugg

SEQ ID NO: 2695133 - RNA, 18 nt, Human
uugugaagcaaaauuuuu

SEQ ID NO: 2695134 - RNA, 14 nt, Human
augauaacuggaaa

SEQ ID NO: 2695135 - RNA, 16 nt, Human
auggaacauaaaauac

SEQ ID NO: 2695136 - RNA, 16 nt, Human
uuuauuuuaauaaugu

SEQ ID NO: 2695137 - RNA, 19 nt, Human
uuuauuacuguaagaaaau

SEQ ID NO: 2695138 - RNA, 23 nt, Human
augcugucuacacuaagagagaa

SEQ ID NO: 2695139 - RNA, 14 nt, Human
augcuguauuuuaa

SEQ ID NO: 2695140 - RNA, 23 nt, Human
auggaauuggagcucgugggaca

SEQ ID NO: 2695141 - RNA, 17 nt, Human
uuuauaugcuucuguuu

SEQ ID NO: 2695142 - RNA, 16 nt, Human
uuuauuacuguaagaa

SEQ ID NO: 2695143 - RNA, 24 nt, Human
uuuaaagcuuauuaaaacucauuu

SEQ ID NO: 2695144 - RNA, 13 nt, Human
augcuaagugaaa

SEQ ID NO: 2695145 - RNA, 13 nt, Human
uuucuaugaaaua

SEQ ID NO: 2695146 - RNA, 20 nt, Human
uuucuaugaaauauuauguu

SEQ ID NO: 2695147 - RNA, 14 nt, Human
uuucuaugaaauau

SEQ ID NO: 2695148 - RNA, 14 nt, Human
uuucugcaucagcu

SEQ ID NO: 2695149 - RNA, 14 nt, Human
uuugaaauauugac

SEQ ID NO: 2695150 - RNA, 17 nt, Human
auggaauuucucccagu

SEQ ID NO: 2695151 - RNA, 16 nt, Human
auggcuauaggugcua

SEQ ID NO: 2695152 - RNA, 19 nt, Human
auggcuauaggugcuacaa

SEQ ID NO: 2695153 - RNA, 21 nt, Human
auggcuauaggugcuacaaaa

SEQ ID NO: 2695154 - RNA, 23 nt, Human
auggcuauaggugcuacaaaaac

SEQ ID NO: 2695155 - RNA, 21 nt, Human
augggacauuugcucauggaa

SEQ ID NO: 2695156 - RNA, 22 nt, Human
augggacauuugcucauggaau

SEQ ID NO: 2695157 - RNA, 14 nt, Human
uucauuaucucaaa

SEQ ID NO: 2695158 - RNA, 13 nt, Human
auaugcaaagcac

SEQ ID NO: 2695159 - RNA, 14 nt, Human
auaugcaaagcacu

SEQ ID NO: 2695160 - RNA, 23 nt, Human
auauguaccuaacgaaguauccu

SEQ ID NO: 2695161 - RNA, 13 nt, Human
auauaugcuaagu

SEQ ID NO: 2695162 - RNA, 15 nt, Human
uucaucaaugaauga

SEQ ID NO: 2695163 - RNA, 17 nt, Human
uucagcgguuuauauaa

SEQ ID NO: 2695164 - RNA, 14 nt, Human
auauuguuugcuaa

SEQ ID NO: 2695165 - RNA, 13 nt, Human
auauuuacaaaug

SEQ ID NO: 2695166 - RNA, 15 nt, Human
aucaaauaugcaaag

SEQ ID NO: 2695167 - RNA, 16 nt, Human
aucaaggguacacugc

SEQ ID NO: 2695168 - RNA, 16 nt, Human
aucaaauaugcaaagc

SEQ ID NO: 2695169 - RNA, 17 nt, Human
aucaaauaugcaaagca

SEQ ID NO: 2695170 - RNA, 18 nt, Human
aucaaauaugcaaagcac

SEQ ID NO: 2695171 - RNA, 21 nt, Human
aucaaggguacacugccuucu

SEQ ID NO: 2695172 - RNA, 13 nt, Human
aucaauuuaaaaa

SEQ ID NO: 2695173 - RNA, 14 nt, Human
aucaauuuuucuua

SEQ ID NO: 2695174 - RNA, 19 nt, Human
aucaauuuuucuuauuuca

SEQ ID NO: 2695175 - RNA, 23 nt, Human
aucacuugaacccgggaggcaga

SEQ ID NO: 2695176 - RNA, 17 nt, Human
uucuguuuuauaauuuu

SEQ ID NO: 2695177 - RNA, 16 nt, Human
uucuguuuuauaauuu

SEQ ID NO: 2695178 - RNA, 21 nt, Human
aucccucccuccaccucccug

SEQ ID NO: 2695179 - RNA, 20 nt, Human
aucccucccuccaccucccu

SEQ ID NO: 2695180 - RNA, 18 nt, Human
aucccucccuccaccucc

SEQ ID NO: 2695181 - RNA, 17 nt, Human
aucccucccuccaccuc

SEQ ID NO: 2695182 - RNA, 16 nt, Human
aucccucccuccaccu

SEQ ID NO: 2695183 - RNA, 19 nt, Human
uugacacuuaaaaaugguu

SEQ ID NO: 2695184 - RNA, 17 nt, Human
uugacacuuaaaaaugg

SEQ ID NO: 2695185 - RNA, 16 nt, Human
uugaaggaugcugucu

SEQ ID NO: 2695186 - RNA, 14 nt, Human
uugaaggaugcugu

SEQ ID NO: 2695187 - RNA, 21 nt, Human
uugaaggaugcugucuucgua

SEQ ID NO: 2695188 - RNA, 16 nt, Human
auccugcaauuccacu

SEQ ID NO: 2695189 - RNA, 22 nt, Human
auccugaggcuccacuuggucu

SEQ ID NO: 2695190 - RNA, 13 nt, Human
auccugccccuga

SEQ ID NO: 2695191 - RNA, 11 nt, Human
auccugaggcu

SEQ ID NO: 2695192 - RNA, 13 nt, Human
auccugaggcucc

SEQ ID NO: 2695193 - RNA, 16 nt, Human
auccugaggcuccacu

SEQ ID NO: 2695194 - RNA, 18 nt, Human
auccugaggcuccacuug

SEQ ID NO: 2695195 - RNA, 22 nt, Human
uggcacaguuuucugagaaaga

SEQ ID NO: 2695196 - RNA, 20 nt, Human
uggcacaguuuucugagaaa

SEQ ID NO: 2695197 - RNA, 18 nt, Human
uggacgagaaaacaauaa

SEQ ID NO: 2695198 - RNA, 20 nt, Human
ugggaaagggauuuucagcc

SEQ ID NO: 2695199 - RNA, 18 nt, Human
aggaagcugugagagcag

SEQ ID NO: 2695200 - RNA, 23 nt, Human
aggaauugacccacaagaaauga

SEQ ID NO: 2695201 - RNA, 11 nt, Human
aggaauuuaaa

SEQ ID NO: 2695202 - RNA, 23 nt, Human
ugcuguauuuuaaaagaaugauu

SEQ ID NO: 2695203 - RNA, 13 nt, Human
ugcuggagcucug

SEQ ID NO: 2695204 - RNA, 14 nt, Human
ugcuggagcucugc

SEQ ID NO: 2695205 - RNA, 23 nt, Human
aggacagcccuucuuuccacaga

SEQ ID NO: 2695206 - RNA, 14 nt, Human
aggacacugauaug

SEQ ID NO: 2695207 - RNA, 11 nt, Human
aggagaaacug

SEQ ID NO: 2695208 - RNA, 13 nt, Human
uggaaaggcagcu

SEQ ID NO: 2695209 - RNA, 15 nt, Human
ugcuugccaucccuc

SEQ ID NO: 2695210 - RNA, 16 nt, Human
ugcuugccaucccucc

SEQ ID NO: 2695211 - RNA, 22 nt, Human
uggaauuucucccagucauuua

SEQ ID NO: 2695212 - RNA, 18 nt, Human
uggaauuggagcucgugg

SEQ ID NO: 2695213 - RNA, 21 nt, Human
agccagcaguucagagcugcc

SEQ ID NO: 2695214 - RNA, 20 nt, Human
agccagcaguucagagcugc

SEQ ID NO: 2695215 - RNA, 22 nt, Human
agccagcaguucagagcugccc

SEQ ID NO: 2695216 - RNA, 19 nt, Human
agccagcaguucagagcug

SEQ ID NO: 2695217 - RNA, 17 nt, Human
agccagcaguucagagc

SEQ ID NO: 2695218 - RNA, 15 nt, Human
agccagcaguucaga

SEQ ID NO: 2695219 - RNA, 18 nt, Human
ugauuaaguaaugauaac

SEQ ID NO: 2695220 - RNA, 23 nt, Human
ugauuaaguaaugauaacuggaa

SEQ ID NO: 2695221 - RNA, 12 nt, Human
ugaugaagaagu

SEQ ID NO: 2695222 - RNA, 11 nt, Human
ugaugaagaag

SEQ ID NO: 2695223 - RNA, 14 nt, Human
ugaugggaaagcau

SEQ ID NO: 2695224 - RNA, 19 nt, Human
ugaugggaaagcauuguaa

SEQ ID NO: 2695225 - RNA, 20 nt, Human
ugauuuagcaggaagcugug

SEQ ID NO: 2695226 - RNA, 17 nt, Human
ugauuuagcaggaagcu

SEQ ID NO: 2695227 - RNA, 15 nt, Human
ugcagaagacaguau

SEQ ID NO: 2695228 - RNA, 14 nt, Human
ugcagaagacagua

SEQ ID NO: 2695229 - RNA, 18 nt, Human
agcccugucuccucucuc

SEQ ID NO: 2695230 - RNA, 11 nt, Human
agcccugucuc

SEQ ID NO: 2695231 - RNA, 20 nt, Human
ugcagcucuccccuucucug

SEQ ID NO: 2695232 - RNA, 22 nt, Human
ugcagcucuccccuucucugua

SEQ ID NO: 2695233 - RNA, 16 nt, Human
ugccccauucaacauc

SEQ ID NO: 2695234 - RNA, 22 nt, Human
ugccauuuaaagcuuauuaaaa

SEQ ID NO: 2695235 - RNA, 12 nt, Human
ugcccucuccug

SEQ ID NO: 2695236 - RNA, 15 nt, Human
ugcccucuccugggc

SEQ ID NO: 2695237 - RNA, 14 nt, Human
ugcccucuccuggg

SEQ ID NO: 2695238 - RNA, 13 nt, Human
ugcccucuccugg

SEQ ID NO: 2695239 - RNA, 20 nt, Human
ugcccucuccugggcagcug

SEQ ID NO: 2695240 - RNA, 18 nt, Human
ugcccucuccugggcagc

SEQ ID NO: 2695241 - RNA, 17 nt, Human
ugcccucuccugggcag

SEQ ID NO: 2695242 - RNA, 16 nt, Human
ugcccucuccugggca

SEQ ID NO: 2695243 - RNA, 23 nt, Human
ugcccucuccugggcagcugccu

SEQ ID NO: 2695244 - RNA, 22 nt, Human
ugcccucuccugggcagcugcc

SEQ ID NO: 2695245 - RNA, 23 nt, Human
agcucugcccauccugccccuga

SEQ ID NO: 2695246 - RNA, 18 nt, Human
agcugcccucuccugggc

SEQ ID NO: 2695247 - RNA, 17 nt, Human
agcugcccucuccuggg

SEQ ID NO: 2695248 - RNA, 20 nt, Human
agcugcccucuccugggcag

SEQ ID NO: 2695249 - RNA, 19 nt, Human
agcugcccucuccugggca

SEQ ID NO: 2695250 - RNA, 21 nt, Human
agcugcccucuccugggcagc

SEQ ID NO: 2695251 - RNA, 19 nt, Human
ugcccuguuaaaagaugaa

SEQ ID NO: 2695252 - RNA, 15 nt, Human
ugccucaccccuugc

SEQ ID NO: 2695253 - RNA, 11 nt, Human
ugccuccccuc

SEQ ID NO: 2695254 - RNA, 15 nt, Human
ugccuccccuccucu

SEQ ID NO: 2695255 - RNA, 14 nt, Human
ugccuccccuccuc

SEQ ID NO: 2695256 - RNA, 13 nt, Human
ugccuccccuccu

SEQ ID NO: 2695257 - RNA, 12 nt, Human
ugccuccccucc

SEQ ID NO: 2695258 - RNA, 16 nt, Human
ugccuccccuccucug

SEQ ID NO: 2695259 - RNA, 18 nt, Human
ugccucagaaaacaagga

SEQ ID NO: 2695260 - RNA, 19 nt, Human
uguuugcuaagcauuccaa

SEQ ID NO: 2695261 - RNA, 15 nt, Human
uguuugcuaagcauu

SEQ ID NO: 2695262 - RNA, 20 nt, Human
uguuuuauaauuuugugaag

SEQ ID NO: 2695263 - RNA, 13 nt, Human
uguuuuauaauuu

SEQ ID NO: 2695264 - RNA, 14 nt, Human
uguuuuaggagcau

SEQ ID NO: 2695265 - RNA, 21 nt, Human
aguugauaugccuuuucccaa

SEQ ID NO: 2695266 - RNA, 14 nt, Human
aguucugaagaaga

SEQ ID NO: 2695267 - RNA, 13 nt, Human
aguucugaagaag

SEQ ID NO: 2695268 - RNA, 15 nt, Human
aguucugaagaagau

SEQ ID NO: 2695269 - RNA, 16 nt, Human
aguuugguuucuagca

SEQ ID NO: 2695270 - RNA, 20 nt, Human
uuaaaaaugguuuaaauggu

SEQ ID NO: 2695271 - RNA, 22 nt, Human
aguugcauagguuuaauaauuu

SEQ ID NO: 2695272 - RNA, 18 nt, Human
uuaaaaaagaaacauuug

SEQ ID NO: 2695273 - RNA, 15 nt, Human
uuaaaaaagaaacau

SEQ ID NO: 2695274 - RNA, 20 nt, Human
aguuauuauauuuacaaaug

SEQ ID NO: 2695275 - RNA, 19 nt, Human
aguuauggcuauaggugcu

SEQ ID NO: 2695276 - RNA, 19 nt, Human
aguucagagcugcccucuc

SEQ ID NO: 2695277 - RNA, 18 nt, Human
aguucagagcugcccucu

SEQ ID NO: 2695278 - RNA, 17 nt, Human
aguucagagcugcccuc

SEQ ID NO: 2695279 - RNA, 16 nt, Human
aguucagagcugcccu

SEQ ID NO: 2695280 - RNA, 15 nt, Human
aguucagagcugccc

SEQ ID NO: 2695281 - RNA, 14 nt, Human
aguucagagcugcc

SEQ ID NO: 2695282 - RNA, 20 nt, Human
aguucggugagcuacaaaug

SEQ ID NO: 2695283 - RNA, 21 nt, Human
auacaguucggugagcuacaa

SEQ ID NO: 2695284 - RNA, 20 nt, Human
auacaucccuuaccugggaa

SEQ ID NO: 2695285 - RNA, 22 nt, Human
auaccacaggaaccacaagacu

SEQ ID NO: 2695286 - RNA, 22 nt, Human
auaauuuuuauauuugaaauau

SEQ ID NO: 2695287 - RNA, 21 nt, Human
auaauuuuuauauuugaaaua

SEQ ID NO: 2695288 - RNA, 22 nt, Human
auacaaaaaaaaaaaaaaauua

SEQ ID NO: 2695289 - RNA, 20 nt, Human
auaauuuugugaagcaaaau

SEQ ID NO: 2695290 - RNA, 15 nt, Human
auaauuuugugaagc

SEQ ID NO: 2695291 - RNA, 14 nt, Human
auaauuuugugaag

SEQ ID NO: 2695292 - RNA, 13 nt, Human
auaauuuugugaa

SEQ ID NO: 2695293 - RNA, 19 nt, Human
auaauuuuuauauuugaaa

SEQ ID NO: 2695294 - RNA, 16 nt, Human
auaauuuuuauauuug

SEQ ID NO: 2695295 - RNA, 14 nt, Human
auaauuuuuauauu

SEQ ID NO: 2695296 - RNA, 18 nt, Human
uuauauaagcuuguauuc

SEQ ID NO: 2695297 - RNA, 21 nt, Human
uuagccguggugauuuagcag

SEQ ID NO: 2695298 - RNA, 15 nt, Human
auaaacucauuucua

SEQ ID NO: 2695299 - RNA, 12 nt, Human
aguuuucugaga

SEQ ID NO: 2695300 - RNA, 13 nt, Human
aguuuucugagaa

SEQ ID NO: 2695301 - RNA, 14 nt, Human
aguuuucugagaaa

SEQ ID NO: 2695302 - RNA, 17 nt, Human
aguuuucugagaaagac

SEQ ID NO: 2695303 - RNA, 19 nt, Human
auaaaugugccuucauuuu

SEQ ID NO: 2695304 - RNA, 12 nt, Human
auaacuggaaac

SEQ ID NO: 2695305 - RNA, 21 nt, Human
auaaucuuucacaggggacag

SEQ ID NO: 2695306 - RNA, 14 nt, Human
auaaugaauacuuu

SEQ ID NO: 2695307 - RNA, 18 nt, Human
uuagcaggaagcugugag

SEQ ID NO: 2695308 - RNA, 22 nt, Human
uuagaugcaguucugaagaaga

SEQ ID NO: 2695309 - RNA, 23 nt, Human
uuagaugcaguucugaagaagau

SEQ ID NO: 2695310 - RNA, 20 nt, Human
ugucagcuccccucggagaa

SEQ ID NO: 2695311 - RNA, 21 nt, Human
ugucagcuccccucggagaag

SEQ ID NO: 2695312 - RNA, 23 nt, Human
ugucagcuccccucggagaagag

SEQ ID NO: 2695313 - RNA, 16 nt, Human
aguauuguccaggucu

SEQ ID NO: 2695314 - RNA, 15 nt, Human
aguauuguccagguc

SEQ ID NO: 2695315 - RNA, 20 nt, Human
agucacauuccaagccucau

SEQ ID NO: 2695316 - RNA, 21 nt, Human
aguauguuagugcaaauuguc

SEQ ID NO: 2695317 - RNA, 18 nt, Human
aguauguuagugcaaauu

SEQ ID NO: 2695318 - RNA, 21 nt, Human
aguauuagaauaccacaggaa

SEQ ID NO: 2695319 - RNA, 14 nt, Human
ugucuuaauuaaaa

SEQ ID NO: 2695320 - RNA, 15 nt, Human
ugucuccucucucug

SEQ ID NO: 2695321 - RNA, 17 nt, Human
ugucucuacuaaaaaua

SEQ ID NO: 2695322 - RNA, 14 nt, Human
ugucuucacaacag

SEQ ID NO: 2695323 - RNA, 16 nt, Human
agugagccgagauugu

SEQ ID NO: 2695324 - RNA, 21 nt, Human
agugagcagucaggaaagaga

SEQ ID NO: 2695325 - RNA, 20 nt, Human
agugaaacucguuaauuugu

SEQ ID NO: 2695326 - RNA, 22 nt, Human
agugaaagaggcagcuugaaac

SEQ ID NO: 2695327 - RNA, 14 nt, Human
agugagacagcucu

SEQ ID NO: 2695328 - RNA, 16 nt, Human
agugaaagaggcagcu

SEQ ID NO: 2695329 - RNA, 17 nt, Human
agugaaagaaaauaaca

SEQ ID NO: 2695330 - RNA, 14 nt, Human
ugugaagcaaaauu

SEQ ID NO: 2695331 - RNA, 22 nt, Human
ugugagaugcuagaacucccuu

SEQ ID NO: 2695332 - RNA, 15 nt, Human
aggucagugcaaaua

SEQ ID NO: 2695333 - RNA, 20 nt, Human
aggguuuauguuuaggaugu

SEQ ID NO: 2695334 - RNA, 22 nt, Human
uggucugugagaugcuagaacu

SEQ ID NO: 2695335 - RNA, 22 nt, Human
ugguccaugggccauaugaaaa

SEQ ID NO: 2695336 - RNA, 21 nt, Human
agggugaugggaaagcauugu

SEQ ID NO: 2695337 - RNA, 22 nt, Human
agggugaugggaaagcauugua

SEQ ID NO: 2695338 - RNA, 23 nt, Human
uggugugaccacugcagaagaca

SEQ ID NO: 2695339 - RNA, 15 nt, Human
ugguuucuagcauga

SEQ ID NO: 2695340 - RNA, 18 nt, Human
uguaagaaaauaucacuu

SEQ ID NO: 2695341 - RNA, 17 nt, Human
uguaagaaaauaucacu

SEQ ID NO: 2695342 - RNA, 14 nt, Human
ugaaauaagccaga

SEQ ID NO: 2695343 - RNA, 20 nt, Human
agagcugcccucuccugggc

SEQ ID NO: 2695344 - RNA, 19 nt, Human
agagcugcccucuccuggg

SEQ ID NO: 2695345 - RNA, 18 nt, Human
agagcugcccucuccugg

SEQ ID NO: 2695346 - RNA, 17 nt, Human
agagcugcccucuccug

SEQ ID NO: 2695347 - RNA, 16 nt, Human
agagcugcccucuccu

SEQ ID NO: 2695348 - RNA, 13 nt, Human
ugaacaaauuuac

SEQ ID NO: 2695349 - RNA, 22 nt, Human
ugaacccauauuuguacaccaa

SEQ ID NO: 2695350 - RNA, 18 nt, Human
ugaacccgggaggcagag

SEQ ID NO: 2695351 - RNA, 22 nt, Human
ugaagaagcaccaaucaugaau

SEQ ID NO: 2695352 - RNA, 17 nt, Human
ugaaguacucauacaug

SEQ ID NO: 2695353 - RNA, 20 nt, Human
ugaagauuuaccacuugugu

SEQ ID NO: 2695354 - RNA, 17 nt, Human
ugaagauuuaccacuug

SEQ ID NO: 2695355 - RNA, 18 nt, Human
agagcuguucacagccag

SEQ ID NO: 2695356 - RNA, 19 nt, Human
agagcuguucacagccaga

SEQ ID NO: 2695357 - RNA, 23 nt, Human
agacuggcacaguuuucugagaa

SEQ ID NO: 2695358 - RNA, 20 nt, Human
agacuggcacaguuuucuga

SEQ ID NO: 2695359 - RNA, 21 nt, Human
agacuggcacaguuuucugag

SEQ ID NO: 2695360 - RNA, 22 nt, Human
agacuccaaagaaauguaaggg

SEQ ID NO: 2695361 - RNA, 14 nt, Human
agagacagaaagca

SEQ ID NO: 2695362 - RNA, 15 nt, Human
agagacagaaagcag

SEQ ID NO: 2695363 - RNA, 16 nt, Human
agagacacacugaaga

SEQ ID NO: 2695364 - RNA, 17 nt, Human
ugaaagaggaaugaagu

SEQ ID NO: 2695365 - RNA, 18 nt, Human
ugaaagaggaaugaagua

SEQ ID NO: 2695366 - RNA, 17 nt, Human
ugaaaauauuuguauca

SEQ ID NO: 2695367 - RNA, 20 nt, Human
ugaaaaucuuauaauuuaaa

SEQ ID NO: 2695368 - RNA, 21 nt, Human
ugaaaauauuuguaucacaaa

SEQ ID NO: 2695369 - RNA, 22 nt, Human
ugaaaauauuuguaucacaaau

SEQ ID NO: 2695370 - RNA, 13 nt, Human
ugaaagaaaauaa

SEQ ID NO: 2695371 - RNA, 24 nt, Human
ugagaugugaacacaucagcuugc

SEQ ID NO: 2695372 - RNA, 18 nt, Human
ugagaugugaacacauca

SEQ ID NO: 2695373 - RNA, 19 nt, Human
ugagaugugaacacaucag

SEQ ID NO: 2695374 - RNA, 13 nt, Human
ugagaugugaaca

SEQ ID NO: 2695375 - RNA, 23 nt, Human
ugagagcaguuugguuucuagca

SEQ ID NO: 2695376 - RNA, 21 nt, Human
ugagagcaguuugguuucuag

SEQ ID NO: 2695377 - RNA, 22 nt, Human
ugagagacacacugaagaagca

SEQ ID NO: 2695378 - RNA, 21 nt, Human
ugagagacacacugaagaagc

SEQ ID NO: 2695379 - RNA, 20 nt, Human
ugagagacacacugaagaag

SEQ ID NO: 2695380 - RNA, 19 nt, Human
ugagagacacacugaagaa

SEQ ID NO: 2695381 - RNA, 17 nt, Human
ugagagacacacugaag

SEQ ID NO: 2695382 - RNA, 16 nt, Human
ugagagacacacugaa

SEQ ID NO: 2695383 - RNA, 12 nt, Human
ugagacagcucu

SEQ ID NO: 2695384 - RNA, 20 nt, Human
ugagacucugucucagucca

SEQ ID NO: 2695385 - RNA, 14 nt, Human
agauuuuccugaaa

SEQ ID NO: 2695386 - RNA, 15 nt, Human
agauuuuccugaaaa

SEQ ID NO: 2695387 - RNA, 16 nt, Human
agauuuuccugaaaac

SEQ ID NO: 2695388 - RNA, 20 nt, Human
agcaagggugaugggaaagc

SEQ ID NO: 2695389 - RNA, 22 nt, Human
agcaagggugaugggaaagcau

SEQ ID NO: 2695390 - RNA, 16 nt, Human
agcaagggugauggga

SEQ ID NO: 2695391 - RNA, 21 nt, Human
agauugugccccugcacucca

SEQ ID NO: 2695392 - RNA, 22 nt, Human
agaugugaacacaucagcuugc

SEQ ID NO: 2695393 - RNA, 17 nt, Human
agaugugaacacaucag

SEQ ID NO: 2695394 - RNA, 22 nt, Human
agauguauguacuucaugcugu

SEQ ID NO: 2695395 - RNA, 15 nt, Human
ugacacuuaaaaaug

SEQ ID NO: 2695396 - RNA, 16 nt, Human
agaugcacaugagcug

SEQ ID NO: 2695397 - RNA, 20 nt, Human
agaugcaguucugaagaaga

SEQ ID NO: 2695398 - RNA, 13 nt, Human
agaugcacaugag

SEQ ID NO: 2695399 - RNA, 19 nt, Human
agaugcuagaacucccuuu

SEQ ID NO: 2695400 - RNA, 21 nt, Human
agaugcaguucugaagaagau

SEQ ID NO: 2695401 - RNA, 21 nt, Human
agaugcuagaacucccuuuca

SEQ ID NO: 2695402 - RNA, 14 nt, Human
agauccuggaaauc

SEQ ID NO: 2695403 - RNA, 13 nt, Human
agauccuggaaau

SEQ ID NO: 2695404 - RNA, 23 nt, Human
ucugcuugccaucccucccucca

SEQ ID NO: 2695405 - RNA, 20 nt, Human
ucugcuugccaucccucccu

SEQ ID NO: 2695406 - RNA, 17 nt, Human
ucugcuugccaucccuc

SEQ ID NO: 2695407 - RNA, 16 nt, Human
ucugcuugccaucccu

SEQ ID NO: 2695408 - RNA, 18 nt, Human
agaagaugguaccaccag

SEQ ID NO: 2695409 - RNA, 14 nt, Human
agaagaacugaaau

SEQ ID NO: 2695410 - RNA, 13 nt, Human
agaagaacugaaa

SEQ ID NO: 2695411 - RNA, 18 nt, Human
ucugcagauaaacaguag

SEQ ID NO: 2695412 - RNA, 15 nt, Human
ucugcagauaaacag

SEQ ID NO: 2695413 - RNA, 15 nt, Human
agacacacaugaagu

SEQ ID NO: 2695414 - RNA, 12 nt, Human
agacacacauga

SEQ ID NO: 2695415 - RNA, 22 nt, Human
agacagagccccacccucagau

SEQ ID NO: 2695416 - RNA, 24 nt, Human
agacagagccccacccucagaugc

SEQ ID NO: 2695417 - RNA, 14 nt, Human
ucugugagaugcua

SEQ ID NO: 2695418 - RNA, 23 nt, Human
ucugugagaugcuagaacucccu

SEQ ID NO: 2695419 - RNA, 17 nt, Human
ucugugagaugcuagaa

SEQ ID NO: 2695420 - RNA, 22 nt, Human
ucugugagaugcuagaacuccc

SEQ ID NO: 2695421 - RNA, 15 nt, Human
agaauuaacacauga

SEQ ID NO: 2695422 - RNA, 23 nt, Human
agaauuaacacaugauccugcaa

SEQ ID NO: 2695423 - RNA, 14 nt, Human
ucuaaguaaaacca

SEQ ID NO: 2695424 - RNA, 15 nt, Human
ucuaaguaaaaccac

SEQ ID NO: 2695425 - RNA, 19 nt, Human
ucuaaguaaaaccacagca

SEQ ID NO: 2695426 - RNA, 20 nt, Human
ucuaaguaaaaccacagcag

SEQ ID NO: 2695427 - RNA, 14 nt, Human
uccugggcagcugc

SEQ ID NO: 2695428 - RNA, 13 nt, Human
uccugggcagcug

SEQ ID NO: 2695429 - RNA, 12 nt, Human
uccugggcagcu

SEQ ID NO: 2695430 - RNA, 17 nt, Human
ucuaggaaauauuuauu

SEQ ID NO: 2695431 - RNA, 16 nt, Human
ucuaggaaauauuuau

SEQ ID NO: 2695432 - RNA, 15 nt, Human
acuugucaauaaaau

SEQ ID NO: 2695433 - RNA, 15 nt, Human
ucucauuuccaagca

SEQ ID NO: 2695434 - RNA, 14 nt, Human
ucucaggaaaucaa

SEQ ID NO: 2695435 - RNA, 21 nt, Human
ucucaggaaaucaaauaugca

SEQ ID NO: 2695436 - RNA, 23 nt, Human
ucucaggaaaucaaauaugcaaa

SEQ ID NO: 2695437 - RNA, 17 nt, Human
acuauauuguuugcuaa

SEQ ID NO: 2695438 - RNA, 22 nt, Human
acuauauuguuugcuaagcauu

SEQ ID NO: 2695439 - RNA, 15 nt, Human
acuaucucauuucca

SEQ ID NO: 2695440 - RNA, 17 nt, Human
acuaucucauuuccaag

SEQ ID NO: 2695441 - RNA, 16 nt, Human
acuaucucauuuccaa

SEQ ID NO: 2695442 - RNA, 15 nt, Human
acuaauuuuaaaaug

SEQ ID NO: 2695443 - RNA, 11 nt, Human
uccauccugag

SEQ ID NO: 2695444 - RNA, 12 nt, Human
uccauccugagg

SEQ ID NO: 2695445 - RNA, 15 nt, Human
uccauccugaggcuc

SEQ ID NO: 2695446 - RNA, 18 nt, Human
uccagugagacagcucug

SEQ ID NO: 2695447 - RNA, 11 nt, Human
acgcucucugg

SEQ ID NO: 2695448 - RNA, 14 nt, Human
acgcucucuggccu

SEQ ID NO: 2695449 - RNA, 20 nt, Human
accuuuuggucuggagggaa

SEQ ID NO: 2695450 - RNA, 22 nt, Human
uccacugguucuucuuggucuc

SEQ ID NO: 2695451 - RNA, 19 nt, Human
accuugaaaacuuuaugcu

SEQ ID NO: 2695452 - RNA, 12 nt, Human
acugaagaagca

SEQ ID NO: 2695453 - RNA, 16 nt, Human
acugacucuuaagaag

SEQ ID NO: 2695454 - RNA, 15 nt, Human
acugacucuuaagaa

SEQ ID NO: 2695455 - RNA, 14 nt, Human
acugacucuuaaga

SEQ ID NO: 2695456 - RNA, 13 nt, Human
acugacucuuaag

SEQ ID NO: 2695457 - RNA, 20 nt, Human
acugacucuuaagaagacug

SEQ ID NO: 2695458 - RNA, 18 nt, Human
acugacucuuaagaagac

SEQ ID NO: 2695459 - RNA, 17 nt, Human
acugacucuuaagaaga

SEQ ID NO: 2695460 - RNA, 13 nt, Human
acugacuucuaag

SEQ ID NO: 2695461 - RNA, 15 nt, Human
acugacuucuaagua

SEQ ID NO: 2695462 - RNA, 16 nt, Human
acugacuucuaaguaa

SEQ ID NO: 2695463 - RNA, 22 nt, Human
acugacuucuaaguaaaaccac

SEQ ID NO: 2695464 - RNA, 18 nt, Human
acugagagugaacaaauu

SEQ ID NO: 2695465 - RNA, 22 nt, Human
acugagaugugaacacaucagc

SEQ ID NO: 2695466 - RNA, 17 nt, Human
acugagaugugaacaca

SEQ ID NO: 2695467 - RNA, 16 nt, Human
uccuggaaaucagggu

SEQ ID NO: 2695468 - RNA, 21 nt, Human
acucuuaagaagacugcauua

SEQ ID NO: 2695469 - RNA, 19 nt, Human
acuccagugagacagcucu

SEQ ID NO: 2695470 - RNA, 14 nt, Human
ucagcccucagaau

SEQ ID NO: 2695471 - RNA, 15 nt, Human
acccgggaggcagag

SEQ ID NO: 2695472 - RNA, 17 nt, Human
acccgggaggcagaggu

SEQ ID NO: 2695473 - RNA, 16 nt, Human
accuagggugauauua

SEQ ID NO: 2695474 - RNA, 15 nt, Human
ucaguuuuugugaaa

SEQ ID NO: 2695475 - RNA, 17 nt, Human
ucaguuuuugugaaaag

SEQ ID NO: 2695476 - RNA, 14 nt, Human
acaugggacauuug

SEQ ID NO: 2695477 - RNA, 11 nt, Human
acaugggacau

SEQ ID NO: 2695478 - RNA, 20 nt, Human
acaugggacauuugcucaug

SEQ ID NO: 2695479 - RNA, 15 nt, Human
acaugggacauuugc

SEQ ID NO: 2695480 - RNA, 21 nt, Human
acaugggacauuugcucaugg

SEQ ID NO: 2695481 - RNA, 16 nt, Human
acaugagguacugaga

SEQ ID NO: 2695482 - RNA, 20 nt, Human
acaugagguacugagaguga

SEQ ID NO: 2695483 - RNA, 16 nt, Human
acaugaaguccaagca

SEQ ID NO: 2695484 - RNA, 23 nt, Human
acaugagguacugagagugaaca

SEQ ID NO: 2695485 - RNA, 15 nt, Human
ucaaauugugugaaa

SEQ ID NO: 2695486 - RNA, 18 nt, Human
ucaaauugugugaaaggu

SEQ ID NO: 2695487 - RNA, 23 nt, Human
accaaaaaucucaauauuucaga

SEQ ID NO: 2695488 - RNA, 19 nt, Human
ucaauauuucagauaauca

SEQ ID NO: 2695489 - RNA, 15 nt, Human
ucaauauuucagaua

SEQ ID NO: 2695490 - RNA, 23 nt, Human
ucaaugaaugaaugaauggcuaa

SEQ ID NO: 2695491 - RNA, 22 nt, Human
ucaauaucuuuuuuuuaauaaa

SEQ ID NO: 2695492 - RNA, 16 nt, Human
ucaauucuugccaaau

SEQ ID NO: 2695493 - RNA, 21 nt, Human
ucacaacagauuauuaccuua

SEQ ID NO: 2695494 - RNA, 14 nt, Human
ucaccucauggaau

SEQ ID NO: 2695495 - RNA, 13 nt, Human
ucaccucauggaa

SEQ ID NO: 2695496 - RNA, 12 nt, Human
ucaccucaugga

SEQ ID NO: 2695497 - RNA, 23 nt, Human
ucacuugaacccgggaggcagag

SEQ ID NO: 2695498 - RNA, 14 nt, Human
accagucugacugu

SEQ ID NO: 2695499 - RNA, 20 nt, Human
uaacgauaaaagacagugaa

SEQ ID NO: 2695500 - RNA, 18 nt, Human
uaagaagugaaaaucuac

SEQ ID NO: 2695501 - RNA, 16 nt, Human
aauagucaaauugugu

SEQ ID NO: 2695502 - RNA, 22 nt, Human
aauaucacuugucaauaaaauc

SEQ ID NO: 2695503 - RNA, 20 nt, Human
aauaucacuugucaauaaaa

SEQ ID NO: 2695504 - RNA, 21 nt, Human
aaucaggguuaguauugucca

SEQ ID NO: 2695505 - RNA, 16 nt, Human
aaucaggguuaguauu

SEQ ID NO: 2695506 - RNA, 22 nt, Human
aaucaggguuaguauuguccag

SEQ ID NO: 2695507 - RNA, 24 nt, Human
aauaugccccauucaacaucuagu

SEQ ID NO: 2695508 - RNA, 21 nt, Human
aauaugccccauucaacaucu

SEQ ID NO: 2695509 - RNA, 19 nt, Human
aauauuuauuuuaauaaug

SEQ ID NO: 2695510 - RNA, 18 nt, Human
aauauuuauuuuaauaau

SEQ ID NO: 2695511 - RNA, 22 nt, Human
aaugaauggcuaagcaaaaugu

SEQ ID NO: 2695512 - RNA, 15 nt, Human
aaucaugaauuaguu

SEQ ID NO: 2695513 - RNA, 12 nt, Human
aaucaugaauua

SEQ ID NO: 2695514 - RNA, 12 nt, Human
uaauaaacucau

SEQ ID NO: 2695515 - RNA, 16 nt, Human
uaagcuuguauuccuu

SEQ ID NO: 2695516 - RNA, 19 nt, Human
uaaguaaugauaacuggaa

SEQ ID NO: 2695517 - RNA, 19 nt, Human
aaucuacacuccagugaga

SEQ ID NO: 2695518 - RNA, 19 nt, Human
aaucuuauaauuuaaaaua

SEQ ID NO: 2695519 - RNA, 23 nt, Human
aaucgcuccaccuugcagcucuc

SEQ ID NO: 2695520 - RNA, 18 nt, Human
uaccaccagucugacugu

SEQ ID NO: 2695521 - RNA, 20 nt, Human
uacaucccuuaccugggaaa

SEQ ID NO: 2695522 - RNA, 18 nt, Human
uacacuaagagagaauga

SEQ ID NO: 2695523 - RNA, 14 nt, Human
uacacuaagagaga

SEQ ID NO: 2695524 - RNA, 16 nt, Human
aaugcuguauuuuaaa

SEQ ID NO: 2695525 - RNA, 18 nt, Human
aauuccaagugauugaaa

SEQ ID NO: 2695526 - RNA, 22 nt, Human
aauuccacuuauaggaauugac

SEQ ID NO: 2695527 - RNA, 14 nt, Human
uacuguaagaaaau

SEQ ID NO: 2695528 - RNA, 21 nt, Human
aauugacccacaagaaaugaa

SEQ ID NO: 2695529 - RNA, 22 nt, Human
aauugacccacaagaaaugaaa

SEQ ID NO: 2695530 - RNA, 16 nt, Human
uauuaaaacucauuuu

SEQ ID NO: 2695531 - RNA, 21 nt, Human
uauguuuucaggcuagaugua

SEQ ID NO: 2695532 - RNA, 17 nt, Human
acaggaaguagaggagg

SEQ ID NO: 2695533 - RNA, 23 nt, Human
uauucaaacagucucaggaaauc

SEQ ID NO: 2695534 - RNA, 15 nt, Human
uauucaaacagucuc

SEQ ID NO: 2695535 - RNA, 14 nt, Human
uauuacuguaagaa

SEQ ID NO: 2695536 - RNA, 16 nt, Human
acagucaccucaugga

SEQ ID NO: 2695537 - RNA, 18 nt, Human
acagucaccucauggaau

SEQ ID NO: 2695538 - RNA, 17 nt, Human
acagucaccucauggaa

SEQ ID NO: 2695539 - RNA, 20 nt, Human
acagggaggacgcucucugg

SEQ ID NO: 2695540 - RNA, 21 nt, Human
acagggaggacgcucucuggc

SEQ ID NO: 2695541 - RNA, 20 nt, Human
uaugauuaaguaaugauaac

SEQ ID NO: 2695542 - RNA, 16 nt, Human
uaugauuaaguaauga

SEQ ID NO: 2695543 - RNA, 21 nt, Human
uaugauuaaguaaugauaacu

SEQ ID NO: 2695544 - RNA, 19 nt, Human
uaugccccauucaacaucu

SEQ ID NO: 2695545 - RNA, 16 nt, Human
acagccucuuagaugc

SEQ ID NO: 2695546 - RNA, 15 nt, Human
uauauuguuugcuaa

SEQ ID NO: 2695547 - RNA, 17 nt, Human
uaucucaaaacugcacu

SEQ ID NO: 2695548 - RNA, 15 nt, Human
acacaucagcuugcc

SEQ ID NO: 2695549 - RNA, 15 nt, Human
acacaugaaguccaa

SEQ ID NO: 2695550 - RNA, 18 nt, Human
acacaugauccugcaauu

SEQ ID NO: 2695551 - RNA, 13 nt, Human
acacuaagagaga

SEQ ID NO: 2695552 - RNA, 14 nt, Human
acacuaagagagaa

SEQ ID NO: 2695553 - RNA, 19 nt, Human
acacucaaaucaagaaacu

SEQ ID NO: 2695554 - RNA, 22 nt, Human
acaaugcuguauuuuaaaagaa

SEQ ID NO: 2695555 - RNA, 18 nt, Human
acaaugcuguauuuuaaa

SEQ ID NO: 2695556 - RNA, 15 nt, Human
acacacucaaaucaa

SEQ ID NO: 2695557 - RNA, 23 nt, Human
uaguguuggagaagaacugaaau

SEQ ID NO: 2695558 - RNA, 22 nt, Human
uagugaaacucguuaauuugua

SEQ ID NO: 2695559 - RNA, 18 nt, Human
acaaauuuacagagacag

SEQ ID NO: 2695560 - RNA, 19 nt, Human
acaaauuuacagagacaga

SEQ ID NO: 2695561 - RNA, 20 nt, Human
acaagacccaaaaggcagaa

SEQ ID NO: 2695562 - RNA, 15 nt, Human
uagaugcaguucuga

SEQ ID NO: 2695563 - RNA, 22 nt, Human
uagaggagaaacuggaacucuc

SEQ ID NO: 2695564 - RNA, 19 nt, Human
uagaggagaaacuggaacu

SEQ ID NO: 2695565 - RNA, 18 nt, Human
acaaaaggauaaugaaua

SEQ ID NO: 2695566 - RNA, 14 nt, Human
acaagacugcacau

SEQ ID NO: 2695567 - RNA, 13 nt, Human
acaagacugcaca

SEQ ID NO: 2695568 - RNA, 23 nt, Human
acaauacaucccuuaccugggaa

SEQ ID NO: 2695569 - RNA, 12 nt, Human
uaggagcaugag

SEQ ID NO: 2695570 - RNA, 19 nt, Human
uaggaaauauuuauuuuaa

SEQ ID NO: 2695571 - RNA, 18 nt, Human
uaggaaauauuuauuuua

SEQ ID NO: 2695572 - RNA, 14 nt, Human
uagggagagaagau

SEQ ID NO: 2695573 - RNA, 15 nt, Human
uagggagagaagaua

SEQ ID NO: 2695574 - RNA, 24 nt, Human
aacucauuuuuguuuucauuaucu

SEQ ID NO: 2695575 - RNA, 21 nt, Human
aacucauuuuuguuuucauua

SEQ ID NO: 2695576 - RNA, 14 nt, Human
gucuuaauuaaaag

SEQ ID NO: 2695577 - RNA, 19 nt, Human
gucuuauauauuguagaua

SEQ ID NO: 2695578 - RNA, 11 nt, Human
aagaaacauuu

SEQ ID NO: 2695579 - RNA, 14 nt, Human
aagaaagaaaauca

SEQ ID NO: 2695580 - RNA, 13 nt, Human
aagaaagaaaauc

SEQ ID NO: 2695581 - RNA, 16 nt, Human
aagaaagaaaaucagg

SEQ ID NO: 2695582 - RNA, 22 nt, Human
gugcuacaaaaacacagcaagg

SEQ ID NO: 2695583 - RNA, 18 nt, Human
gugcacgcacacugucug

SEQ ID NO: 2695584 - RNA, 17 nt, Human
gugauuaccagggacug

SEQ ID NO: 2695585 - RNA, 11 nt, Human
gugauuaccag

SEQ ID NO: 2695586 - RNA, 16 nt, Human
gugauuaccagggacu

SEQ ID NO: 2695587 - RNA, 23 nt, Human
aacuuccuuggacucauuuuaaa

SEQ ID NO: 2695588 - RNA, 22 nt, Human
aacuuccuuggacucauuuuaa

SEQ ID NO: 2695589 - RNA, 18 nt, Human
aacuucagcgguuuauau

SEQ ID NO: 2695590 - RNA, 13 nt, Human
aacuucagacaua

SEQ ID NO: 2695591 - RNA, 22 nt, Human
guccaugaagauguagaggaga

SEQ ID NO: 2695592 - RNA, 23 nt, Human
guccaugaagauguagaggagaa

SEQ ID NO: 2695593 - RNA, 17 nt, Human
aacacaacuauauuguu

SEQ ID NO: 2695594 - RNA, 20 nt, Human
aacacagcaagggugauggg

SEQ ID NO: 2695595 - RNA, 18 nt, Human
aacacagcaagggugaug

SEQ ID NO: 2695596 - RNA, 12 nt, Human
aacauauauaac

SEQ ID NO: 2695597 - RNA, 14 nt, Human
aacagucucaggaa

SEQ ID NO: 2695598 - RNA, 14 nt, Human
aacauaaaauacaa

SEQ ID NO: 2695599 - RNA, 13 nt, Human
aacagucucagga

SEQ ID NO: 2695600 - RNA, 21 nt, Human
gucaauuuuguuauguauauu

SEQ ID NO: 2695601 - RNA, 13 nt, Human
gucacaggaagua

SEQ ID NO: 2695602 - RNA, 15 nt, Human
gucacaggaaguaga

SEQ ID NO: 2695603 - RNA, 20 nt, Human
gucacaggaaguagaggagg

SEQ ID NO: 2695604 - RNA, 13 nt, Human
gucaggaaagaga

SEQ ID NO: 2695605 - RNA, 14 nt, Human
gucaggaaagagaa

SEQ ID NO: 2695606 - RNA, 17 nt, Human
aaauuccaagugauuga

SEQ ID NO: 2695607 - RNA, 17 nt, Human
aaauuguauuacaaauc

SEQ ID NO: 2695608 - RNA, 18 nt, Human
aaaugugccuucauuuuu

SEQ ID NO: 2695609 - RNA, 15 nt, Human
aaaugugcuuuuaaa

SEQ ID NO: 2695610 - RNA, 11 nt, Human
aaaucauuucu

SEQ ID NO: 2695611 - RNA, 18 nt, Human
aagcuuauuaaaacucau

SEQ ID NO: 2695612 - RNA, 18 nt, Human
guucccuugaugaagaag

SEQ ID NO: 2695613 - RNA, 21 nt, Human
aagccuuggggcugaugcagu

SEQ ID NO: 2695614 - RNA, 17 nt, Human
guuauuauauuuacaaa

SEQ ID NO: 2695615 - RNA, 19 nt, Human
guuauuauauuuacaaaug

SEQ ID NO: 2695616 - RNA, 15 nt, Human
aagauagcagggcau

SEQ ID NO: 2695617 - RNA, 22 nt, Human
gugucuuaauuaaaagaauauu

SEQ ID NO: 2695618 - RNA, 17 nt, Human
aagcaacccaaauguuc

SEQ ID NO: 2695619 - RNA, 18 nt, Human
aagcauuguaaaugugcu

SEQ ID NO: 2695620 - RNA, 19 nt, Human
aagcacugacuucuaagua

SEQ ID NO: 2695621 - RNA, 20 nt, Human
aagcacugacuucuaaguaa

SEQ ID NO: 2695622 - RNA, 19 nt, Human
aagcauuguaaaugugcuu

SEQ ID NO: 2695623 - RNA, 16 nt, Human
aagcacugacuucuaa

SEQ ID NO: 2695624 - RNA, 17 nt, Human
aagcacugacuucuaag

SEQ ID NO: 2695625 - RNA, 16 nt, Human
aagcacuaaacaaaga

SEQ ID NO: 2695626 - RNA, 14 nt, Human
uaaaaccacagcag

SEQ ID NO: 2695627 - RNA, 15 nt, Human
uaaaaccacagcagu

SEQ ID NO: 2695628 - RNA, 21 nt, Human
uaaaaaaaaaccugagcccca

SEQ ID NO: 2695629 - RNA, 13 nt, Human
uaaaagaauauuu

SEQ ID NO: 2695630 - RNA, 21 nt, Human
uaaaauacacacucaaaucaa

SEQ ID NO: 2695631 - RNA, 22 nt, Human
uaaaauaauuuuuauauuugaa

SEQ ID NO: 2695632 - RNA, 9 nt, Human
uaaaauggu

SEQ ID NO: 2695633 - RNA, 19 nt, Human
aaguauguuagugcaaauu

SEQ ID NO: 2695634 - RNA, 18 nt, Human
aaguauguuagugcaaau

SEQ ID NO: 2695635 - RNA, 14 nt, Human
guuuaugauuccac

SEQ ID NO: 2695636 - RNA, 15 nt, Human
aagggcuguuauaau

SEQ ID NO: 2695637 - RNA, 17 nt, Human
aaggggaauugaggaca

SEQ ID NO: 2695638 - RNA, 17 nt, Human
aagggcuguuauaaucu

SEQ ID NO: 2695639 - RNA, 16 nt, Human
cacaguuuucugagaa

SEQ ID NO: 2695640 - RNA, 17 nt, Human
cacaguuuucugagaaa

SEQ ID NO: 2695641 - RNA, 19 nt, Human
cacaguuuucugagaaaga

SEQ ID NO: 2695642 - RNA, 20 nt, Human
cacaguuuucugagaaagac

SEQ ID NO: 2695643 - RNA, 22 nt, Human
caaaauuuuuucucuaggaaau

SEQ ID NO: 2695644 - RNA, 21 nt, Human
caaaauuuuuucucuaggaaa

SEQ ID NO: 2695645 - RNA, 16 nt, Human
caaaauuuuuucucua

SEQ ID NO: 2695646 - RNA, 15 nt, Human
caaauugugugaaag

SEQ ID NO: 2695647 - RNA, 19 nt, Human
caaauaugcaaagcacuga

SEQ ID NO: 2695648 - RNA, 21 nt, Human
caaauaugcaaagcacugacu

SEQ ID NO: 2695649 - RNA, 13 nt, Human
caaaaacacagca

SEQ ID NO: 2695650 - RNA, 14 nt, Human
caaaaacacagcaa

SEQ ID NO: 2695651 - RNA, 15 nt, Human
caaaaacacagcaag

SEQ ID NO: 2695652 - RNA, 17 nt, Human
caaaaacacagcaaggg

SEQ ID NO: 2695653 - RNA, 13 nt, Human
auuuuccugaaaa

SEQ ID NO: 2695654 - RNA, 19 nt, Human
caaaaaucucaauauuuca

SEQ ID NO: 2695655 - RNA, 23 nt, Human
caaaacuucagacauagaauuaa

SEQ ID NO: 2695656 - RNA, 23 nt, Human
caauacaucccuuaccugggaaa

SEQ ID NO: 2695657 - RNA, 22 nt, Human
caaugugacuuaaugccacuaa

SEQ ID NO: 2695658 - RNA, 21 nt, Human
caagccagauuuuccugaaaa

SEQ ID NO: 2695659 - RNA, 17 nt, Human
caaggcugauuaaacca

SEQ ID NO: 2695660 - RNA, 17 nt, Human
uucugucuucacaacag

SEQ ID NO: 2695661 - RNA, 14 nt, Human
uugaugaagaaguu

SEQ ID NO: 2695662 - RNA, 13 nt, Human
uugaugaagaagu

SEQ ID NO: 2695663 - RNA, 23 nt, Human
uugaugaagaaguugauaugccu

SEQ ID NO: 2695664 - RNA, 14 nt, Human
uugacccacaagaa

SEQ ID NO: 2695665 - RNA, 17 nt, Human
uugacccacaagaaaug

SEQ ID NO: 2695666 - RNA, 14 nt, Human
uucuaugaaauauu

SEQ ID NO: 2695667 - RNA, 21 nt, Human
uucuaugaaauauuauguuaa

SEQ ID NO: 2695668 - RNA, 16 nt, Human
uucugagaaagacuau

SEQ ID NO: 2695669 - RNA, 21 nt, Human
uucugagaaagacuauucaaa

SEQ ID NO: 2695670 - RNA, 15 nt, Human
uucuacauacuaugg

SEQ ID NO: 2695671 - RNA, 18 nt, Human
uucggugagcuacaaaug

SEQ ID NO: 2695672 - RNA, 23 nt, Human
uucaguuauuauauuuacaaaug

SEQ ID NO: 2695673 - RNA, 18 nt, Human
uuccagauccuggaaauc

SEQ ID NO: 2695674 - RNA, 19 nt, Human
uuauuuuaauaauguuuca

SEQ ID NO: 2695675 - RNA, 20 nt, Human
uuauuuuaauaauguuucaa

SEQ ID NO: 2695676 - RNA, 22 nt, Human
uucacaagacccaaaaggcaga

SEQ ID NO: 2695677 - RNA, 20 nt, Human
uucagauaaucacaauacau

SEQ ID NO: 2695678 - RNA, 20 nt, Human
uucagagcugcccucuccug

SEQ ID NO: 2695679 - RNA, 19 nt, Human
uucagagcugcccucuccu

SEQ ID NO: 2695680 - RNA, 18 nt, Human
uucagagcugcccucucc

SEQ ID NO: 2695681 - RNA, 17 nt, Human
uucagagcugcccucuc

SEQ ID NO: 2695682 - RNA, 15 nt, Human
uucagagcugcccuc

SEQ ID NO: 2695683 - RNA, 18 nt, Human
uuauaauuuugugaagca

SEQ ID NO: 2695684 - RNA, 17 nt, Human
uuauaauuuugugaagc

SEQ ID NO: 2695685 - RNA, 16 nt, Human
uuauaauuuugugaag

SEQ ID NO: 2695686 - RNA, 12 nt, Human
uuauaauuuaaa

SEQ ID NO: 2695687 - RNA, 15 nt, Human
uuauaauuuugugaa

SEQ ID NO: 2695688 - RNA, 14 nt, Human
uuauaauuuuguga

SEQ ID NO: 2695689 - RNA, 11 nt, Human
uuauaaucuuu

SEQ ID NO: 2695690 - RNA, 15 nt, Human
uuauauuugaaauau

SEQ ID NO: 2695691 - RNA, 13 nt, Human
uuauauuugaaau

SEQ ID NO: 2695692 - RNA, 12 nt, Human
uuauauuugaaa

SEQ ID NO: 2695693 - RNA, 20 nt, Human
uuauauuuauuacuguaaga

SEQ ID NO: 2695694 - RNA, 16 nt, Human
uuauauuuacaaaugg

SEQ ID NO: 2695695 - RNA, 11 nt, Human
uuaucucaaaa

SEQ ID NO: 2695696 - RNA, 22 nt, Human
uuaugauuaaguaaugauaacu

SEQ ID NO: 2695697 - RNA, 18 nt, Human
uuauggcuauaggugcua

SEQ ID NO: 2695698 - RNA, 16 nt, Human
uuggucugugagaugc

SEQ ID NO: 2695699 - RNA, 15 nt, Human
uugucuagugaaacu

SEQ ID NO: 2695700 - RNA, 12 nt, Human
uugugccccugc

SEQ ID NO: 2695701 - RNA, 18 nt, Human
uuguguuuugcaagccag

SEQ ID NO: 2695702 - RNA, 14 nt, Human
uuguuuaaaaucau

SEQ ID NO: 2695703 - RNA, 22 nt, Human
uuuauuguuuaaaaucauuucu

SEQ ID NO: 2695704 - RNA, 22 nt, Human
uuuauaauuuugugaagcaaaa

SEQ ID NO: 2695705 - RNA, 17 nt, Human
uuuauggcacuaguauu

SEQ ID NO: 2695706 - RNA, 13 nt, Human
uuuaccacuugug

SEQ ID NO: 2695707 - RNA, 13 nt, Human
uuuaauaauguuu

SEQ ID NO: 2695708 - RNA, 19 nt, Human
uuuaacucuauaauguguu

SEQ ID NO: 2695709 - RNA, 19 nt, Human
uuuguauaaaauaauuuuu

SEQ ID NO: 2695710 - RNA, 18 nt, Human
uuuguauaaaauaauuuu

SEQ ID NO: 2695711 - RNA, 17 nt, Human
uuuguauaaaauaauuu

SEQ ID NO: 2695712 - RNA, 15 nt, Human
uuuccacagaagcuc

SEQ ID NO: 2695713 - RNA, 23 nt, Human
uuuuauaauuuugugaagcaaaa

SEQ ID NO: 2695714 - RNA, 21 nt, Human
uuuuauaauuuugugaagcaa

SEQ ID NO: 2695715 - RNA, 21 nt, Human
uuuuaaaguaacccuacaaaa

SEQ ID NO: 2695716 - RNA, 18 nt, Human
uuuuauauuugaaauauu

SEQ ID NO: 2695717 - RNA, 13 nt, Human
uuuuauauuugaa

SEQ ID NO: 2695718 - RNA, 13 nt, Human
uuuucuuauuuca

SEQ ID NO: 2695719 - RNA, 16 nt, Human
ugcacugucaagauga

SEQ ID NO: 2695720 - RNA, 17 nt, Human
ugcacgcacacugucug

SEQ ID NO: 2695721 - RNA, 16 nt, Human
ugcacgcacacugucu

SEQ ID NO: 2695722 - RNA, 17 nt, Human
ugcaugguuuagaaagc

SEQ ID NO: 2695723 - RNA, 19 nt, Human
ugcagauaaacaguaguga

SEQ ID NO: 2695724 - RNA, 21 nt, Human
ugcauuauauuuauuacugua

SEQ ID NO: 2695725 - RNA, 24 nt, Human
ugauaguuguaccgcaaugugacu

SEQ ID NO: 2695726 - RNA, 15 nt, Human
ugagcagucaggaaa

SEQ ID NO: 2695727 - RNA, 17 nt, Human
ugagcagucaggaaaga

SEQ ID NO: 2695728 - RNA, 20 nt, Human
ugagcagucaggaaagagaa

SEQ ID NO: 2695729 - RNA, 14 nt, Human
ugagaugcuagaac

SEQ ID NO: 2695730 - RNA, 16 nt, Human
ugagaugcuagaacuc

SEQ ID NO: 2695731 - RNA, 20 nt, Human
ugagaugcuagaacucccuu

SEQ ID NO: 2695732 - RNA, 14 nt, Human
ugagacagcucugc

SEQ ID NO: 2695733 - RNA, 16 nt, Human
ugagacagcucugcau

SEQ ID NO: 2695734 - RNA, 18 nt, Human
ugagaaagacuauucaaa

SEQ ID NO: 2695735 - RNA, 20 nt, Human
ugagaaagacuauucaaaca

SEQ ID NO: 2695736 - RNA, 16 nt, Human
ugagaaagacuauuca

SEQ ID NO: 2695737 - RNA, 17 nt, Human
ugagaaagacuauucaa

SEQ ID NO: 2695738 - RNA, 12 nt, Human
ugacucuuaaga

SEQ ID NO: 2695739 - RNA, 23 nt, Human
ugggcagcugccuccccuccucu

SEQ ID NO: 2695740 - RNA, 22 nt, Human
ugggcagcugccuccccuccuc

SEQ ID NO: 2695741 - RNA, 20 nt, Human
ugggcagcugccuccccucc

SEQ ID NO: 2695742 - RNA, 12 nt, Human
ugggcagcugcc

SEQ ID NO: 2695743 - RNA, 14 nt, Human
ugggacagggagga

SEQ ID NO: 2695744 - RNA, 22 nt, Human
uggccuucggccuccauccuga

SEQ ID NO: 2695745 - RNA, 20 nt, Human
uggccuucggccuccauccu

SEQ ID NO: 2695746 - RNA, 23 nt, Human
uggccuucggccuccauccugag

SEQ ID NO: 2695747 - RNA, 22 nt, Human
ugcuucuguuuuauaauuuugu

SEQ ID NO: 2695748 - RNA, 22 nt, Human
uggaaaaguauguuagugcaaa

SEQ ID NO: 2695749 - RNA, 17 nt, Human
ugcuucuguuuuauaau

SEQ ID NO: 2695750 - RNA, 19 nt, Human
uguauuuuaaaagaaugau

SEQ ID NO: 2695751 - RNA, 18 nt, Human
uguauuuuaaaagaauga

SEQ ID NO: 2695752 - RNA, 14 nt, Human
uguauaaaauaauu

SEQ ID NO: 2695753 - RNA, 13 nt, Human
uguauaaaauaau

SEQ ID NO: 2695754 - RNA, 21 nt, Human
uguaguguuggagaagaacug

SEQ ID NO: 2695755 - RNA, 20 nt, Human
uguaguguuggagaagaacu

SEQ ID NO: 2695756 - RNA, 19 nt, Human
uguaguguuggagaagaac

SEQ ID NO: 2695757 - RNA, 12 nt, Human
ugucuuaauuaa

SEQ ID NO: 2695758 - RNA, 17 nt, Human
ugucuacacuaagagag

SEQ ID NO: 2695759 - RNA, 22 nt, Human
ugucuacacuaagagagaauga

SEQ ID NO: 2695760 - RNA, 14 nt, Human
uggguagacacaca

SEQ ID NO: 2695761 - RNA, 20 nt, Human
ugguucccuugaugaagaag

SEQ ID NO: 2695762 - RNA, 17 nt, Human
ugguucccuugaugaag

SEQ ID NO: 2695763 - RNA, 16 nt, Human
ugguucccuugaugaa

SEQ ID NO: 2695764 - RNA, 11 nt, Human
uguaaaauggu

SEQ ID NO: 2695765 - RNA, 12 nt, Human
uguaaaauggug

SEQ ID NO: 2695766 - RNA, 17 nt, Human
ucuggccuucggccucc

SEQ ID NO: 2695767 - RNA, 18 nt, Human
ucuggccuucggccucca

SEQ ID NO: 2695768 - RNA, 12 nt, Human
ucuuaagaagac

SEQ ID NO: 2695769 - RNA, 18 nt, Human
ucuuaagaagacugcauu

SEQ ID NO: 2695770 - RNA, 15 nt, Human
ucugucuucacaaca

SEQ ID NO: 2695771 - RNA, 19 nt, Human
ucugcaucagcugcugaaa

SEQ ID NO: 2695772 - RNA, 21 nt, Human
ucugcaucagcugcugaaaca

SEQ ID NO: 2695773 - RNA, 14 nt, Human
ucugcaucagcugc

SEQ ID NO: 2695774 - RNA, 22 nt, Human
ucucuguaauaaacucauuucu

SEQ ID NO: 2695775 - RNA, 18 nt, Human
ucucuguaauaaacucau

SEQ ID NO: 2695776 - RNA, 16 nt, Human
ucccugcaauaaaaug

SEQ ID NO: 2695777 - RNA, 16 nt, Human
ucccuugaugaagaag

SEQ ID NO: 2695778 - RNA, 15 nt, Human
ucccuugaugaagaa

SEQ ID NO: 2695779 - RNA, 22 nt, Human
uccucugcuugccaucccuccc

SEQ ID NO: 2695780 - RNA, 21 nt, Human
uccucugcuugccaucccucc

SEQ ID NO: 2695781 - RNA, 20 nt, Human
uccucugcuugccaucccuc

SEQ ID NO: 2695782 - RNA, 22 nt, Human
ucuagugagcagucaggaaaga

SEQ ID NO: 2695783 - RNA, 19 nt, Human
ucuagugagcagucaggaa

SEQ ID NO: 2695784 - RNA, 15 nt, Human
ucucaacuccaaacu

SEQ ID NO: 2695785 - RNA, 17 nt, Human
ucuaugaaauauuaugu

SEQ ID NO: 2695786 - RNA, 14 nt, Human
ucuaugaaauauua

SEQ ID NO: 2695787 - RNA, 13 nt, Human
ucuaugaaauauu

SEQ ID NO: 2695788 - RNA, 22 nt, Human
ucgugggacagucaccucaugg

SEQ ID NO: 2695789 - RNA, 21 nt, Human
ucguggaacaguuaccucugc

SEQ ID NO: 2695790 - RNA, 18 nt, Human
ucggccuccauccugagg

SEQ ID NO: 2695791 - RNA, 17 nt, Human
ucggccuccauccugag

SEQ ID NO: 2695792 - RNA, 13 nt, Human
ucguuaauuugua

SEQ ID NO: 2695793 - RNA, 20 nt, Human
uccugccuaagugcagcccc

SEQ ID NO: 2695794 - RNA, 19 nt, Human
uccugucggagcccugucu

SEQ ID NO: 2695795 - RNA, 22 nt, Human
uccugucggagcccugucuccu

SEQ ID NO: 2695796 - RNA, 16 nt, Human
uccuuggacucauuuu

SEQ ID NO: 2695797 - RNA, 14 nt, Human
ucaccaaggcugau

SEQ ID NO: 2695798 - RNA, 16 nt, Human
ucacagucacauucca

SEQ ID NO: 2695799 - RNA, 17 nt, Human
ucacaagacccaaaagg

SEQ ID NO: 2695800 - RNA, 18 nt, Human
ucacaagacccaaaaggc

SEQ ID NO: 2695801 - RNA, 13 nt, Human
ucacaagacccaa

SEQ ID NO: 2695802 - RNA, 13 nt, Human
ucaaugcagcccc

SEQ ID NO: 2695803 - RNA, 21 nt, Human
ucaauaaaauccauacauuug

SEQ ID NO: 2695804 - RNA, 14 nt, Human
ucaaauaugcaaag

SEQ ID NO: 2695805 - RNA, 20 nt, Human
ucaaaucaagaaacuuaagg

SEQ ID NO: 2695806 - RNA, 14 nt, Human
ucaaauugugugaa

SEQ ID NO: 2695807 - RNA, 16 nt, Human
uauuauucccauucua

SEQ ID NO: 2695808 - RNA, 17 nt, Human
uauguacuucaugcugu

SEQ ID NO: 2695809 - RNA, 13 nt, Human
uauguacuucaug

SEQ ID NO: 2695810 - RNA, 16 nt, Human
ucauuuccaagcaagu

SEQ ID NO: 2695811 - RNA, 13 nt, Human
ucauuuccaagca

SEQ ID NO: 2695812 - RNA, 19 nt, Human
ucauuaucucaaaacugca

SEQ ID NO: 2695813 - RNA, 20 nt, Human
ucauuaucucaaaacugcac

SEQ ID NO: 2695814 - RNA, 13 nt, Human
ucauuaucucaaa

SEQ ID NO: 2695815 - RNA, 18 nt, Human
ucauaccuaucaucuuaa

SEQ ID NO: 2695816 - RNA, 15 nt, Human
uccacuuggucugug

SEQ ID NO: 2695817 - RNA, 16 nt, Human
uccacuuggucuguga

SEQ ID NO: 2695818 - RNA, 14 nt, Human
uccacuuggucugu

SEQ ID NO: 2695819 - RNA, 17 nt, Human
uccaccucccugcaaua

SEQ ID NO: 2695820 - RNA, 16 nt, Human
uccaccucccugcaau

SEQ ID NO: 2695821 - RNA, 15 nt, Human
uccaccucccugcaa

SEQ ID NO: 2695822 - RNA, 14 nt, Human
uccaccucccugca

SEQ ID NO: 2695823 - RNA, 13 nt, Human
uccaccucccugc

SEQ ID NO: 2695824 - RNA, 19 nt, Human
uccacagaagcuccaggua

SEQ ID NO: 2695825 - RNA, 17 nt, Human
ucaggcuagauguaugu

SEQ ID NO: 2695826 - RNA, 13 nt, Human
ucaggcuagaugu

SEQ ID NO: 2695827 - RNA, 18 nt, Human
ucagcuccccucggagaa

SEQ ID NO: 2695828 - RNA, 17 nt, Human
ucagcuccccucggaga

SEQ ID NO: 2695829 - RNA, 23 nt, Human
ucagagcugcccucuccugggca

SEQ ID NO: 2695830 - RNA, 22 nt, Human
ucagagcugcccucuccugggc

SEQ ID NO: 2695831 - RNA, 21 nt, Human
ucagagcugcccucuccuggg

SEQ ID NO: 2695832 - RNA, 20 nt, Human
ucagagcugcccucuccugg

SEQ ID NO: 2695833 - RNA, 19 nt, Human
ucagagcugcccucuccug

SEQ ID NO: 2695834 - RNA, 23 nt, Human
ggagcccugucuccucucucugu

SEQ ID NO: 2695835 - RNA, 18 nt, Human
ggagcccugucuccucuc

SEQ ID NO: 2695836 - RNA, 16 nt, Human
ggaggacgcucucugg

SEQ ID NO: 2695837 - RNA, 19 nt, Human
ggaggggagcaugggaagu

SEQ ID NO: 2695838 - RNA, 15 nt, Human
ggacgcucucuggcc

SEQ ID NO: 2695839 - RNA, 16 nt, Human
ggacgcucucuggccu

SEQ ID NO: 2695840 - RNA, 19 nt, Human
ggacgcucucuggccuucg

SEQ ID NO: 2695841 - RNA, 23 nt, Human
ggagaagagcuguucacagccag

SEQ ID NO: 2695842 - RNA, 14 nt, Human
ggagaagaacugaa

SEQ ID NO: 2695843 - RNA, 11 nt, Human
ggagaagaacu

SEQ ID NO: 2695844 - RNA, 15 nt, Human
ggagaagagcuguuc

SEQ ID NO: 2695845 - RNA, 20 nt, Human
ggacauuugcucauggaauu

SEQ ID NO: 2695846 - RNA, 17 nt, Human
ggacauuugcucaugga

SEQ ID NO: 2695847 - RNA, 16 nt, Human
ggacauuugcucaugg

SEQ ID NO: 2695848 - RNA, 16 nt, Human
ggcagcugccuccccu

SEQ ID NO: 2695849 - RNA, 13 nt, Human
ggcagcugccucc

SEQ ID NO: 2695850 - RNA, 12 nt, Human
ggcagcugccuc

SEQ ID NO: 2695851 - RNA, 11 nt, Human
ggcagcugccu

SEQ ID NO: 2695852 - RNA, 21 nt, Human
ggcagagguugcagugagccg

SEQ ID NO: 2695853 - RNA, 19 nt, Human
ggauugaaggaugcugucu

SEQ ID NO: 2695854 - RNA, 17 nt, Human
gggaggacgcucucugg

SEQ ID NO: 2695855 - RNA, 20 nt, Human
gggaggacgcucucuggccu

SEQ ID NO: 2695856 - RNA, 21 nt, Human
gggacugaggggaggggagca

SEQ ID NO: 2695857 - RNA, 14 nt, Human
gggaauugaggaca

SEQ ID NO: 2695858 - RNA, 20 nt, Human
ggcuaguaucaaaagaaaga

SEQ ID NO: 2695859 - RNA, 23 nt, Human
ggcuauaggugcuacaaaaacac

SEQ ID NO: 2695860 - RNA, 16 nt, Human
ggcuccacuuggucug

SEQ ID NO: 2695861 - RNA, 17 nt, Human
gccugagcgacagugag

SEQ ID NO: 2695862 - RNA, 20 nt, Human
gccugagcgacagugagacu

SEQ ID NO: 2695863 - RNA, 16 nt, Human
gcuagauguauguacu

SEQ ID NO: 2695864 - RNA, 14 nt, Human
gcuagauguaugua

SEQ ID NO: 2695865 - RNA, 13 nt, Human
gcuagauguaugu

SEQ ID NO: 2695866 - RNA, 21 nt, Human
gcuauaggugcuacaaaaaca

SEQ ID NO: 2695867 - RNA, 19 nt, Human
gcuauaggugcuacaaaaa

SEQ ID NO: 2695868 - RNA, 20 nt, Human
gcuccauuuuuagugaaaua

SEQ ID NO: 2695869 - RNA, 21 nt, Human
gcuggaaaaguauguuagugc

SEQ ID NO: 2695870 - RNA, 23 nt, Human
gcuggaaaaguauguuagugcaa

SEQ ID NO: 2695871 - RNA, 23 nt, Human
gcugcccucuccugggcagcugc

SEQ ID NO: 2695872 - RNA, 22 nt, Human
gcugcccucuccugggcagcug

SEQ ID NO: 2695873 - RNA, 20 nt, Human
gcugcccucuccugggcagc

SEQ ID NO: 2695874 - RNA, 18 nt, Human
gcugcccucuccugggca

SEQ ID NO: 2695875 - RNA, 17 nt, Human
gcugcccucuccugggc

SEQ ID NO: 2695876 - RNA, 16 nt, Human
gcugcccucuccuggg

SEQ ID NO: 2695877 - RNA, 15 nt, Human
gcugcccucuccugg

SEQ ID NO: 2695878 - RNA, 14 nt, Human
gcugcccucuccug

SEQ ID NO: 2695879 - RNA, 13 nt, Human
gcugcccucuccu

SEQ ID NO: 2695880 - RNA, 21 nt, Human
gcugauuaaaccaaggcuaga

SEQ ID NO: 2695881 - RNA, 12 nt, Human
gcugcccucucc

SEQ ID NO: 2695882 - RNA, 23 nt, Human
gcuggucccagccagcaguucag

SEQ ID NO: 2695883 - RNA, 19 nt, Human
gcuucuguuuuauaauuuu

SEQ ID NO: 2695884 - RNA, 23 nt, Human
gcaguucagagcugcccucuccu

SEQ ID NO: 2695885 - RNA, 22 nt, Human
gcaguucagagcugcccucucc

SEQ ID NO: 2695886 - RNA, 20 nt, Human
gcaguucagagcugcccucu

SEQ ID NO: 2695887 - RNA, 19 nt, Human
gcaguucagagcugcccuc

SEQ ID NO: 2695888 - RNA, 21 nt, Human
gcaguugaaaagacuccaaag

SEQ ID NO: 2695889 - RNA, 16 nt, Human
gcaguugaaaagacuc

SEQ ID NO: 2695890 - RNA, 19 nt, Human
gcaguugaaaagacuccaa

SEQ ID NO: 2695891 - RNA, 15 nt, Human
gcaguugaaaagacu

SEQ ID NO: 2695892 - RNA, 22 nt, Human
gcaucagcugcugaaacaacaa

SEQ ID NO: 2695893 - RNA, 23 nt, Human
gcaucagcugcugaaacaacaaa

SEQ ID NO: 2695894 - RNA, 16 nt, Human
gcacgcacacugucug

SEQ ID NO: 2695895 - RNA, 15 nt, Human
gcacgcacacugucu

SEQ ID NO: 2695896 - RNA, 19 nt, Human
gcacuguggguagacacac

SEQ ID NO: 2695897 - RNA, 18 nt, Human
gcacagccucuuagaugc

SEQ ID NO: 2695898 - RNA, 15 nt, Human
gcacagccucuuaga

SEQ ID NO: 2695899 - RNA, 18 nt, Human
gcagagguugcagugagc

SEQ ID NO: 2695900 - RNA, 23 nt, Human
gcagagguugcagugagccgaga

SEQ ID NO: 2695901 - RNA, 16 nt, Human
gcaggaagcugugaga

SEQ ID NO: 2695902 - RNA, 19 nt, Human
gccagacuggcacaguuuu

SEQ ID NO: 2695903 - RNA, 15 nt, Human
gccagacuggcacag

SEQ ID NO: 2695904 - RNA, 18 nt, Human
gccagacuggcacaguuu

SEQ ID NO: 2695905 - RNA, 23 nt, Human
gccaugggacagggaggacgcuc

SEQ ID NO: 2695906 - RNA, 22 nt, Human
gccaugggacagggaggacgcu

SEQ ID NO: 2695907 - RNA, 19 nt, Human
gagugucuuaauuaaaaga

SEQ ID NO: 2695908 - RNA, 19 nt, Human
gagugaacaaauuuacaga

SEQ ID NO: 2695909 - RNA, 22 nt, Human
gagugaacaaauuuacagagac

SEQ ID NO: 2695910 - RNA, 23 nt, Human
gagugaacaaauuuacagagaca

SEQ ID NO: 2695911 - RNA, 21 nt, Human
gaguugaaaaucuuauaauuu

SEQ ID NO: 2695912 - RNA, 13 nt, Human
gauugugccccug

SEQ ID NO: 2695913 - RNA, 19 nt, Human
gauguugaaaaaguucugc

SEQ ID NO: 2695914 - RNA, 18 nt, Human
gaugcaguucugaagaag

SEQ ID NO: 2695915 - RNA, 16 nt, Human
gaugggaaagcauugu

SEQ ID NO: 2695916 - RNA, 14 nt, Human
gaucuuuaaaauac

SEQ ID NO: 2695917 - RNA, 19 nt, Human
gaggcagagguugcaguga

SEQ ID NO: 2695918 - RNA, 21 nt, Human
gagcaggcuacugucagcucc

SEQ ID NO: 2695919 - RNA, 12 nt, Human
gagcuacaaaug

SEQ ID NO: 2695920 - RNA, 13 nt, Human
gagcuacaaaugc

SEQ ID NO: 2695921 - RNA, 14 nt, Human
gagcuacaaaugca

SEQ ID NO: 2695922 - RNA, 16 nt, Human
gagcugcccucuccug

SEQ ID NO: 2695923 - RNA, 15 nt, Human
gagcugcccucuccu

SEQ ID NO: 2695924 - RNA, 17 nt, Human
gagcugcccucuccugg

SEQ ID NO: 2695925 - RNA, 14 nt, Human
gagcugcccucucc

SEQ ID NO: 2695926 - RNA, 19 nt, Human
cucuuaagaagacugcauu

SEQ ID NO: 2695927 - RNA, 22 nt, Human
cucuggccuucggccuccaucc

SEQ ID NO: 2695928 - RNA, 21 nt, Human
cucuggccuucggccuccauc

SEQ ID NO: 2695929 - RNA, 16 nt, Human
cugagcaggauuuuaa

SEQ ID NO: 2695930 - RNA, 16 nt, Human
cugagaugugaacaca

SEQ ID NO: 2695931 - RNA, 20 nt, Human
cugagaugugaacacaucag

SEQ ID NO: 2695932 - RNA, 19 nt, Human
cugagaaagacuauucaaa

SEQ ID NO: 2695933 - RNA, 20 nt, Human
cugagaaagacuauucaaac

SEQ ID NO: 2695934 - RNA, 21 nt, Human
cugagaugugaacacaucagc

SEQ ID NO: 2695935 - RNA, 12 nt, Human
cugagaaagacu

SEQ ID NO: 2695936 - RNA, 13 nt, Human
cugagaaagacua

SEQ ID NO: 2695937 - RNA, 15 nt, Human
cugagaaagacuauu

SEQ ID NO: 2695938 - RNA, 18 nt, Human
cugagaaagacuauucaa

SEQ ID NO: 2695939 - RNA, 23 nt, Human
cugacgacuugagugcucaguag

SEQ ID NO: 2695940 - RNA, 14 nt, Human
cugaagaagauggu

SEQ ID NO: 2695941 - RNA, 20 nt, Human
cugcaucagcugcugaaaca

SEQ ID NO: 2695942 - RNA, 21 nt, Human
cugaggcuccacuuggucugu

SEQ ID NO: 2695943 - RNA, 15 nt, Human
cugaggcuccacuug

SEQ ID NO: 2695944 - RNA, 22 nt, Human
cugcaauaaaauggguuuuacu

SEQ ID NO: 2695945 - RNA, 15 nt, Human
cugcaauaaaauggg

SEQ ID NO: 2695946 - RNA, 16 nt, Human
cuaguaauuggaaagg

SEQ ID NO: 2695947 - RNA, 20 nt, Human
cuagugaaacucguuaauuu

SEQ ID NO: 2695948 - RNA, 18 nt, Human
cuagugaaagaggcagcu

SEQ ID NO: 2695949 - RNA, 19 nt, Human
cuagugaaagaggcagcuu

SEQ ID NO: 2695950 - RNA, 21 nt, Human
cuagugagcagucaggaaaga

SEQ ID NO: 2695951 - RNA, 23 nt, Human
cuauucaaacagucucaggaaau

SEQ ID NO: 2695952 - RNA, 18 nt, Human
cuauucaaacagucucag

SEQ ID NO: 2695953 - RNA, 16 nt, Human
cuauucaaacagucuc

SEQ ID NO: 2695954 - RNA, 21 nt, Human
cuauaggugcuacaaaaacac

SEQ ID NO: 2695955 - RNA, 22 nt, Human
cuauaggugcuacaaaaacaca

SEQ ID NO: 2695956 - RNA, 20 nt, Human
cuauaggugcuacaaaaaca

SEQ ID NO: 2695957 - RNA, 18 nt, Human
cuauauuguuugcuaagc

SEQ ID NO: 2695958 - RNA, 21 nt, Human
cucauuuccaagcaaguauua

SEQ ID NO: 2695959 - RNA, 14 nt, Human
cucauuucuagcag

SEQ ID NO: 2695960 - RNA, 13 nt, Human
cuccaaagaaaug

SEQ ID NO: 2695961 - RNA, 12 nt, Human
cuccaaagaaau

SEQ ID NO: 2695962 - RNA, 21 nt, Human
cuccaaacugacucuuaagaa

SEQ ID NO: 2695963 - RNA, 17 nt, Human
cuccaccuugcagcucu

SEQ ID NO: 2695964 - RNA, 12 nt, Human
cuccauccugag

SEQ ID NO: 2695965 - RNA, 11 nt, Human
cuccauccuga

SEQ ID NO: 2695966 - RNA, 13 nt, Human
cuccccuccucug

SEQ ID NO: 2695967 - RNA, 11 nt, Human
cuccccuccuc

SEQ ID NO: 2695968 - RNA, 13 nt, Human
cuccauccugagg

SEQ ID NO: 2695969 - RNA, 20 nt, Human
cuccccuccucugcuugcca

SEQ ID NO: 2695970 - RNA, 21 nt, Human
cuugccaucccucccuccacc

SEQ ID NO: 2695971 - RNA, 22 nt, Human
cuugccaucccucccuccaccu

SEQ ID NO: 2695972 - RNA, 19 nt, Human
cuuguaaaggaauuuaaaa

SEQ ID NO: 2695973 - RNA, 13 nt, Human
cuuuccacagaag

SEQ ID NO: 2695974 - RNA, 21 nt, Human
cuuuauuuucuauaauuuaaa

SEQ ID NO: 2695975 - RNA, 18 nt, Human
cuuuaaagggauggcaag

SEQ ID NO: 2695976 - RNA, 22 nt, Human
gaaaacaauaacgauaaaagac

SEQ ID NO: 2695977 - RNA, 12 nt, Human
gaaaauaucacu

SEQ ID NO: 2695978 - RNA, 19 nt, Human
gaaaaucuuauaauuuaaa

SEQ ID NO: 2695979 - RNA, 19 nt, Human
gaaaauaacgauaaaagac

SEQ ID NO: 2695980 - RNA, 20 nt, Human
gaaaaucuuauaauuuaaaa

SEQ ID NO: 2695981 - RNA, 20 nt, Human
gaauaauccuaaacauauga

SEQ ID NO: 2695982 - RNA, 14 nt, Human
gaauacuuuauaaa

SEQ ID NO: 2695983 - RNA, 17 nt, Human
gaagacugcauuauauu

SEQ ID NO: 2695984 - RNA, 21 nt, Human
gaagccuuggggcugaugcag

SEQ ID NO: 2695985 - RNA, 16 nt, Human
gaaauauuauguuaaa

SEQ ID NO: 2695986 - RNA, 13 nt, Human
gaaauauuauguu

SEQ ID NO: 2695987 - RNA, 22 nt, Human
gaaauguaagggaaacugccag

SEQ ID NO: 2695988 - RNA, 21 nt, Human
gaagaagcaccaaucaugaau

SEQ ID NO: 2695989 - RNA, 21 nt, Human
gaacuuguaaaggaauuuaaa

SEQ ID NO: 2695990 - RNA, 22 nt, Human
gaacuuccagauccuggaaauc

SEQ ID NO: 2695991 - RNA, 15 nt, Human
gaacucccuuucaac

SEQ ID NO: 2695992 - RNA, 14 nt, Human
gaacucccuuucaa

SEQ ID NO: 2695993 - RNA, 22 nt, Human
gaacuagaguuuagcuggaaaa

SEQ ID NO: 2695994 - RNA, 21 nt, Human
gaacuagaguuuagcuggaaa

SEQ ID NO: 2695995 - RNA, 18 nt, Human
cugucuucacaacagauu

SEQ ID NO: 2695996 - RNA, 19 nt, Human
cuguuaaaagaugaaaaua

SEQ ID NO: 2695997 - RNA, 15 nt, Human
cuguuaaaagaugaa

SEQ ID NO: 2695998 - RNA, 16 nt, Human
cuguuaaaagaugaaa

SEQ ID NO: 2695999 - RNA, 23 nt, Human
cuuaagaagacugcauuauauuu

SEQ ID NO: 2696000 - RNA, 21 nt, Human
cuuaagaagacugcauuauau

SEQ ID NO: 2696001 - RNA, 19 nt, Human
cuuaauuaaaagaauauuu

SEQ ID NO: 2696002 - RNA, 20 nt, Human
cuuaauuaaaagaauauuuu

SEQ ID NO: 2696003 - RNA, 16 nt, Human
cuuaauuaaaagaaua

SEQ ID NO: 2696004 - RNA, 17 nt, Human
cuuaauuaaaagaauau

SEQ ID NO: 2696005 - RNA, 14 nt, Human
cuguuuuauaauuu

SEQ ID NO: 2696006 - RNA, 15 nt, Human
cuguuuuauaauuuu

SEQ ID NO: 2696007 - RNA, 12 nt, Human
cuucacaacaga

SEQ ID NO: 2696008 - RNA, 14 nt, Human
cuucacaacagauu

SEQ ID NO: 2696009 - RNA, 17 nt, Human
cuucaaauccuugaaga

SEQ ID NO: 2696010 - RNA, 16 nt, Human
cuucagcgguuuauau

SEQ ID NO: 2696011 - RNA, 15 nt, Human
cuucagccugaaaga

SEQ ID NO: 2696012 - RNA, 20 nt, Human
cuuccuuggacucauuuuaa

SEQ ID NO: 2696013 - RNA, 20 nt, Human
cuucggccuccauccugagg

SEQ ID NO: 2696014 - RNA, 17 nt, Human
ccucccuccaccucccu

SEQ ID NO: 2696015 - RNA, 20 nt, Human
ccucccuccaccucccugca

SEQ ID NO: 2696016 - RNA, 18 nt, Human
ccuccucugcuugccauc

SEQ ID NO: 2696017 - RNA, 13 nt, Human
ccuccucugcuug

SEQ ID NO: 2696018 - RNA, 16 nt, Human
ccuccucugcuugcca

SEQ ID NO: 2696019 - RNA, 14 nt, Human
ccuccauccugagg

SEQ ID NO: 2696020 - RNA, 22 nt, Human
ccuccaccucccugcaauaaaa

SEQ ID NO: 2696021 - RNA, 17 nt, Human
ccuccaccucccugcaa

SEQ ID NO: 2696022 - RNA, 15 nt, Human
ccuccaccucccugc

SEQ ID NO: 2696023 - RNA, 14 nt, Human
ccuccaccucccug

SEQ ID NO: 2696024 - RNA, 13 nt, Human
ccuccaccucccu

SEQ ID NO: 2696025 - RNA, 16 nt, Human
ccgggcguggugguga

SEQ ID NO: 2696026 - RNA, 13 nt, Human
cccacaagaaaug

SEQ ID NO: 2696027 - RNA, 20 nt, Human
cccacaagaaaugaaagcag

SEQ ID NO: 2696028 - RNA, 12 nt, Human
cccuccaccucc

SEQ ID NO: 2696029 - RNA, 14 nt, Human
cccuccaccucccu

SEQ ID NO: 2696030 - RNA, 17 nt, Human
cccuccaccucccugca

SEQ ID NO: 2696031 - RNA, 15 nt, Human
cccuccaccucccug

SEQ ID NO: 2696032 - RNA, 19 nt, Human
cccuccaccucccugcaau

SEQ ID NO: 2696033 - RNA, 15 nt, Human
cccucuccugggcag

SEQ ID NO: 2696034 - RNA, 14 nt, Human
cccucuccugggca

SEQ ID NO: 2696035 - RNA, 13 nt, Human
cccucuccugggc

SEQ ID NO: 2696036 - RNA, 12 nt, Human
cccucuccuggg

SEQ ID NO: 2696037 - RNA, 11 nt, Human
cccucuccugg

SEQ ID NO: 2696038 - RNA, 15 nt, Human
cccgugggguuccuc

SEQ ID NO: 2696039 - RNA, 22 nt, Human
ccugggcagcugccuccccucc

SEQ ID NO: 2696040 - RNA, 23 nt, Human
ccuggaaaucaggguuaguauug

SEQ ID NO: 2696041 - RNA, 11 nt, Human
ccugagcccca

SEQ ID NO: 2696042 - RNA, 16 nt, Human
ccugcaauaaaauggg

SEQ ID NO: 2696043 - RNA, 18 nt, Human
cgagcaggcuacugucag

SEQ ID NO: 2696044 - RNA, 20 nt, Human
ccuguuaaaagaugaaaaua

SEQ ID NO: 2696045 - RNA, 21 nt, Human
ccuguuaaaagaugaaaauau

SEQ ID NO: 2696046 - RNA, 14 nt, Human
ccuucggccuccau

SEQ ID NO: 2696047 - RNA, 19 nt, Human
ccuucggccuccauccuga

SEQ ID NO: 2696048 - RNA, 20 nt, Human
ccuucggccuccauccugag

SEQ ID NO: 2696049 - RNA, 12 nt, Human
ccuucagccuga

SEQ ID NO: 2696050 - RNA, 20 nt, Human
ccuugaaaacuuuaugcuaa

SEQ ID NO: 2696051 - RNA, 14 nt, Human
ccuugaugaagaag

SEQ ID NO: 2696052 - RNA, 19 nt, Human
ccuuggggcugaugcaguu

SEQ ID NO: 2696053 - RNA, 19 nt, Human
ccaguguuuuaggagcaug

SEQ ID NO: 2696054 - RNA, 14 nt, Human
ccaguuauggcuau

SEQ ID NO: 2696055 - RNA, 21 nt, Human
ccaguuauggcuauaggugcu

SEQ ID NO: 2696056 - RNA, 16 nt, Human
ccaugggacagggagg

SEQ ID NO: 2696057 - RNA, 19 nt, Human
ccaugggacagggaggacg

SEQ ID NO: 2696058 - RNA, 22 nt, Human
ccagccagcaguucagagcugc

SEQ ID NO: 2696059 - RNA, 23 nt, Human
ccagcaguucagagcugcccucu

SEQ ID NO: 2696060 - RNA, 22 nt, Human
ccagcaguucagagcugcccuc

SEQ ID NO: 2696061 - RNA, 21 nt, Human
ccagcaguucagagcugcccu

SEQ ID NO: 2696062 - RNA, 20 nt, Human
ccagcaguucagagcugccc

SEQ ID NO: 2696063 - RNA, 19 nt, Human
ccagcaguucagagcugcc

SEQ ID NO: 2696064 - RNA, 18 nt, Human
ccagcaguucagagcugc

SEQ ID NO: 2696065 - RNA, 13 nt, Human
ccagcaguucaga

SEQ ID NO: 2696066 - RNA, 14 nt, Human
ccaccucccugcaa

SEQ ID NO: 2696067 - RNA, 19 nt, Human
caugagguacugagaguga

SEQ ID NO: 2696068 - RNA, 16 nt, Human
caugagguacugagag

SEQ ID NO: 2696069 - RNA, 19 nt, Human
caugaagauguagaggaga

SEQ ID NO: 2696070 - RNA, 18 nt, Human
caugaagauguagaggag

SEQ ID NO: 2696071 - RNA, 15 nt, Human
cauauauaacaaugc

SEQ ID NO: 2696072 - RNA, 13 nt, Human
cauauauaacaau

SEQ ID NO: 2696073 - RNA, 23 nt, Human
caucccucccuccaccucccugc

SEQ ID NO: 2696074 - RNA, 22 nt, Human
caucccucccuccaccucccug

SEQ ID NO: 2696075 - RNA, 18 nt, Human
caucccuuaccugggaaa

SEQ ID NO: 2696076 - RNA, 20 nt, Human
caucccucccuccaccuccc

SEQ ID NO: 2696077 - RNA, 23 nt, Human
caugggacagggaggacgcucuc

SEQ ID NO: 2696078 - RNA, 20 nt, Human
cauggaauuggagcucgugg

SEQ ID NO: 2696079 - RNA, 20 nt, Human
caugugcuaguaauuggaaa

SEQ ID NO: 2696080 - RNA, 21 nt, Human
cauuguaaaugugcuuuuaaa

SEQ ID NO: 2696081 - RNA, 13 nt, Human
cauucuggaauaa

SEQ ID NO: 2696082 - RNA, 22 nt, Human
cauuccaacuaucucauuucca

SEQ ID NO: 2696083 - RNA, 13 nt, Human
caguccaugaaga

SEQ ID NO: 2696084 - RNA, 18 nt, Human
cagucaggaaagagaacu

SEQ ID NO: 2696085 - RNA, 15 nt, Human
cagucaggaaagaga

SEQ ID NO: 2696086 - RNA, 22 nt, Human
cagucaggaaagagaacuucca

SEQ ID NO: 2696087 - RNA, 12 nt, Human
caguagugauag

SEQ ID NO: 2696088 - RNA, 12 nt, Human
caguauggcagc

SEQ ID NO: 2696089 - RNA, 15 nt, Human
cagugagacagcucu

SEQ ID NO: 2696090 - RNA, 16 nt, Human
cagugaaagaaaauaa

SEQ ID NO: 2696091 - RNA, 20 nt, Human
cagugaaagaaaauaacaau

SEQ ID NO: 2696092 - RNA, 18 nt, Human
cagugauuaccagggacu

SEQ ID NO: 2696093 - RNA, 17 nt, Human
cagugauuaccagggac

SEQ ID NO: 2696094 - RNA, 23 nt, Human
caggaugguucccuugaugaaga

SEQ ID NO: 2696095 - RNA, 21 nt, Human
caggaugguucccuugaugaa

SEQ ID NO: 2696096 - RNA, 16 nt, Human
caggauuuuaaucuuu

SEQ ID NO: 2696097 - RNA, 20 nt, Human
caggcccccaggugccaguu

SEQ ID NO: 2696098 - RNA, 14 nt, Human
caggcccccaggug

SEQ ID NO: 2696099 - RNA, 19 nt, Human
caggcccccaggugccagu

SEQ ID NO: 2696100 - RNA, 18 nt, Human
cagggacaggauaagagg

SEQ ID NO: 2696101 - RNA, 17 nt, Human
cagggcauggcugggaa

SEQ ID NO: 2696102 - RNA, 16 nt, Human
caggggacaggauggu

SEQ ID NO: 2696103 - RNA, 11 nt, Human
caggggacagg

SEQ ID NO: 2696104 - RNA, 14 nt, Human
caggcuacugucag

SEQ ID NO: 2696105 - RNA, 19 nt, Human
caggcuagauguauguacu

SEQ ID NO: 2696106 - RNA, 13 nt, Human
caggcuagaugua

SEQ ID NO: 2696107 - RNA, 19 nt, Human
cagcaagggugaugggaaa

SEQ ID NO: 2696108 - RNA, 22 nt, Human
cagcaagggugaugggaaagca

SEQ ID NO: 2696109 - RNA, 23 nt, Human
cagcaagggugaugggaaagcau

SEQ ID NO: 2696110 - RNA, 15 nt, Human
cagauuuuccugaaa

SEQ ID NO: 2696111 - RNA, 14 nt, Human
cagauuuuccugaa

SEQ ID NO: 2696112 - RNA, 23 nt, Human
cagcaacgcaggcccccaggugc

SEQ ID NO: 2696113 - RNA, 19 nt, Human
cagcuacuugggaggcuga

SEQ ID NO: 2696114 - RNA, 16 nt, Human
cagccuaguugaucag

SEQ ID NO: 2696115 - RNA, 13 nt, Human
cagcccucagaau

SEQ ID NO: 2696116 - RNA, 16 nt, Human
cagcucuccccuucuc

SEQ ID NO: 2696117 - RNA, 20 nt, Human
cagcucugcauacucauuag

SEQ ID NO: 2696118 - RNA, 20 nt, Human
cagcugcugaaacaacaaau

SEQ ID NO: 2696119 - RNA, 21 nt, Human
cagcugcugaaacaacaaaua

SEQ ID NO: 2696120 - RNA, 18 nt, Human
cagcuguaugauucccag

SEQ ID NO: 2696121 - RNA, 18 nt, Human
caggaaccacaagacugc

SEQ ID NO: 2696122 - RNA, 23 nt, Human
cagcuuuccucaaaacuucagac

SEQ ID NO: 2696123 - RNA, 18 nt, Human
cagcuugaaacugagaug

SEQ ID NO: 2696124 - RNA, 19 nt, Human
cagcuguaugauucccagc

SEQ ID NO: 2696125 - RNA, 14 nt, Human
caggaagcugugag

SEQ ID NO: 2696126 - RNA, 13 nt, Human
caggaagcuguga

SEQ ID NO: 2696127 - RNA, 22 nt, Human
caggaagcugugagagcaguuu

SEQ ID NO: 2696128 - RNA, 16 nt, Human
caggaaguagaggagg

SEQ ID NO: 2696129 - RNA, 15 nt, Human
caggaaguagaggag

SEQ ID NO: 2696130 - RNA, 17 nt, Human
cagaugcacaugagcug

SEQ ID NO: 2696131 - RNA, 13 nt, Human
cagauccuggaaa

SEQ ID NO: 2696132 - RNA, 14 nt, Human
cagauccuggaaau

SEQ ID NO: 2696133 - RNA, 14 nt, Human
cagauaaacaguag

SEQ ID NO: 2696134 - RNA, 23 nt, Human
cagauaaauaguuuaugauucca

SEQ ID NO: 2696135 - RNA, 14 nt, Human
cagauaaucacaau

SEQ ID NO: 2696136 - RNA, 20 nt, Human
cagagccccacccucagaug

SEQ ID NO: 2696137 - RNA, 18 nt, Human
cagaaagcagaacaguga

SEQ ID NO: 2696138 - RNA, 23 nt, Human
cagaacagugauuaccagggacu

SEQ ID NO: 2696139 - RNA, 19 nt, Human
cagaaagcagaacagugau

SEQ ID NO: 2696140 - RNA, 23 nt, Human
cagaaucgcuccaccuugcagcu

SEQ ID NO: 2696141 - RNA, 21 nt, Human
cagaaucgcuccaccuugcag

SEQ ID NO: 2696142 - RNA, 19 nt, Human
cagaagcaacccaaauguu

SEQ ID NO: 2696143 - RNA, 20 nt, Human
cagaagcaacccaaauguuc

SEQ ID NO: 2696144 - RNA, 17 nt, Human
cagacauagaauuaaca

SEQ ID NO: 2696145 - RNA, 19 nt, Human
cagacauagaauuaacaca

SEQ ID NO: 2696146 - RNA, 20 nt, Human
cacccucagaugcacaugag

SEQ ID NO: 2696147 - RNA, 14 nt, Human
caccucauggaauu

SEQ ID NO: 2696148 - RNA, 12 nt, Human
caccucauggaa

SEQ ID NO: 2696149 - RNA, 11 nt, Human
caccucaugga

SEQ ID NO: 2696150 - RNA, 10 nt, Human
caccucccug

SEQ ID NO: 2696151 - RNA, 14 nt, Human
caccucccugcaau

SEQ ID NO: 2696152 - RNA, 13 nt, Human
caccucccugcaa

SEQ ID NO: 2696153 - RNA, 19 nt, Human
cacuaguauuucuaugaaa

SEQ ID NO: 2696154 - RNA, 14 nt, Human
cacuaguauuucua

SEQ ID NO: 2696155 - RNA, 17 nt, Human
cacuaagagagaaugag

SEQ ID NO: 2696156 - RNA, 21 nt, Human
cacuaaauugacacuuaaaaa

SEQ ID NO: 2696157 - RNA, 16 nt, Human
cacucaaaucaagaaa

SEQ ID NO: 2696158 - RNA, 15 nt, Human
cacgcacacugucug

SEQ ID NO: 2696159 - RNA, 22 nt, Human
cacgagcaggcuacugucagcu

SEQ ID NO: 2696160 - RNA, 17 nt, Human
cacgagcaggcuacugu

SEQ ID NO: 2696161 - RNA, 19 nt, Human
cacgagcaggcuacuguca

SEQ ID NO: 2696162 - RNA, 20 nt, Human
cacgagcaggcuacugucag

SEQ ID NO: 2696163 - RNA, 13 nt, Human
cacuaaacaaaga

SEQ ID NO: 2696164 - RNA, 22 nt, Human
cacguucuuacuaguuucccuu

SEQ ID NO: 2696165 - RNA, 20 nt, Human
cacugccuucucaacuccaa

SEQ ID NO: 2696166 - RNA, 21 nt, Human
cacugacuucuaaguaaaacc

SEQ ID NO: 2696167 - RNA, 14 nt, Human
cacugacuucuaag

SEQ ID NO: 2696168 - RNA, 15 nt, Human
cacugacuucuaagu

SEQ ID NO: 2696169 - RNA, 16 nt, Human
cacugacuucuaagua

SEQ ID NO: 2696170 - RNA, 20 nt, Human
cacugacuucuaaguaaaac

SEQ ID NO: 2696171 - RNA, 14 nt, Human
cacugucaagauga

SEQ ID NO: 2696172 - RNA, 24 nt, Human
cacuguggguagacacacaugaag

SEQ ID NO: 2696173 - RNA, 22 nt, Human
cacuguggguagacacacauga

SEQ ID NO: 2696174 - RNA, 19 nt, Human
cacuguggguagacacaca

SEQ ID NO: 2696175 - RNA, 15 nt, Human
cacuuggucugugag

SEQ ID NO: 2696176 - RNA, 20 nt, Human
cacuugaacccgggaggcag

SEQ ID NO: 2696177 - RNA, 21 nt, Human
cacuugaacccgggaggcaga

SEQ ID NO: 2696178 - RNA, 23 nt, Human
cacuugaacccgggaggcagagg

SEQ ID NO: 2696179 - RNA, 22 nt, Human
gaauaauccuaaacauaugaau

SEQ ID NO: 2696180 - RNA, 16 nt, Human
auuacauuuguauaaa

SEQ ID NO: 2696181 - RNA, 13 nt, Human
auuacuguaagaa

SEQ ID NO: 2696182 - RNA, 16 nt, Human
caugggacagggagga

SEQ ID NO: 2696183 - RNA, 21 nt, Human
auuuccaagcaaguauuagaa

SEQ ID NO: 2696184 - RNA, 13 nt, Human
gccaaauauaaau

SEQ ID NO: 2696185 - RNA, 22 nt, Human
gacagugaaagaaaauaacaau

SEQ ID NO: 2696186 - RNA, 20 nt, Human
gacaaggaaaaaauaacaau

SEQ ID NO: 2696187 - RNA, 21 nt, Human parainfluenza virus 1 strain Washington/1964
uauccagagccaacucaaaaa

SEQ ID NO: 2696188 - RNA, 21 nt, Human parainfluenza virus 1 strain Washington/1964
cgcauguuaaaaucugcaaau

SEQ ID NO: 2696189 - RNA, 10 nt, Human parainfluenza virus 1 strain Washington/1964
ugauggccaa

SEQ ID NO: 2696190 - RNA, 23 nt, Human parainfluenza virus 1 strain Washington/1964
caaaaucaauauccagagccaac

SEQ ID NO: 2696191 - RNA, 16 nt, Human parainfluenza virus 1 strain Washington/1964
ucacuugagaauaaag

SEQ ID NO: 2696192 - RNA, 20 nt, Human parainfluenza virus 1 strain Washington/1964
ugaaaucacaacaugaauuu

SEQ ID NO: 2696193 - RNA, 18 nt, Human parainfluenza virus 1 strain Washington/1964
aagaacgaagagucagca

SEQ ID NO: 2696194 - RNA, 18 nt, Human parainfluenza virus 1 strain Washington/1964
cuauaucaauuaugugaa

SEQ ID NO: 2696195 - RNA, 15 nt, Human parainfluenza virus 1 strain Washington/1964
aucaauauccagagc

SEQ ID NO: 2696196 - RNA, 18 nt, Human parainfluenza virus 1 strain Washington/1964
acuucaccaaucaggugu

SEQ ID NO: 2696197 - RNA, 22 nt, Human parainfluenza virus 1 strain Washington/1964
agagccaacucaaaaagcuccc

SEQ ID NO: 2696198 - RNA, 13 nt, Human parainfluenza virus 1 strain Washington/1964
aaaucuauccaca

SEQ ID NO: 2696199 - RNA, 13 nt, Human parainfluenza virus 1 strain Washington/1964
uaaugacacccau

SEQ ID NO: 2696200 - RNA, 14 nt, Human parainfluenza virus 1 strain Washington/1964
cugcaaauuacaaa

SEQ ID NO: 2696201 - RNA, 14 nt, Human parainfluenza virus 1 strain Washington/1964
caacucaaaaagcu

SEQ ID NO: 2696202 - RNA, 18 nt, Human parainfluenza virus 1 strain Washington/1964
cuaaaucguaccauuaau

SEQ ID NO: 2696203 - RNA, 16 nt, Human parainfluenza virus 1 strain Washington/1964
cccuuuaacugacuca

SEQ ID NO: 2696204 - RNA, 21 nt, Human parainfluenza virus 1 strain Washington/1964
ugagccucaagcauccaaugc

SEQ ID NO: 2696205 - RNA, 15 nt, Human parainfluenza virus 1 strain Washington/1964
cuucaccaaucaggu

SEQ ID NO: 2696206 - RNA, 22 nt, Human parainfluenza virus 1 strain Washington/1964
gagccaacucaaaaagcucccu

SEQ ID NO: 2696207 - RNA, 16 nt, Human parainfluenza virus 1 strain Washington/1964
aaucuacaauuucaac

SEQ ID NO: 2696208 - RNA, 15 nt, Human parainfluenza virus 1 strain Washington/1964
uccacaacuucacca

SEQ ID NO: 2696209 - RNA, 20 nt, Human parainfluenza virus 1 strain Washington/1964
cagaucaaaaguaagaaaaa

SEQ ID NO: 2696210 - RNA, 12 nt, Human parainfluenza virus 1 strain Washington/1964
gucuucacaaaa

SEQ ID NO: 2696211 - RNA, 18 nt, Human parainfluenza virus 1 strain Washington/1964
aucaagacccaacacuau

SEQ ID NO: 2696212 - RNA, 18 nt, Human parainfluenza virus 1 strain Washington/1964
aaccagcaaucaaaauca

SEQ ID NO: 2696213 - RNA, 16 nt, Human parainfluenza virus 1 strain Washington/1964
auacaaucaguucaaa

SEQ ID NO: 2696214 - RNA, 17 nt, Human parainfluenza virus 1 strain Washington/1964
caauauccagagccaac

SEQ ID NO: 2696215 - RNA, 20 nt, Human parainfluenza virus 1 strain Washington/1964
ugagagaugacaucaaaaau

SEQ ID NO: 2696216 - RNA, 21 nt, Human parainfluenza virus 1 strain Washington/1964
acuuggacaauagaagccaga

SEQ ID NO: 2696217 - RNA, 14 nt, Human parainfluenza virus 1 strain Washington/1964
uaugacaaauagaa

SEQ ID NO: 2696218 - RNA, 18 nt, Human parainfluenza virus 1 strain Washington/1964
ggacaauagaagccagau

SEQ ID NO: 2696219 - RNA, 19 nt, Human parainfluenza virus 1 strain Washington/1964
gcucuaggaggucaagagu

SEQ ID NO: 2696220 - RNA, 13 nt, Human parainfluenza virus 1 strain Washington/1964
aucaguucaaaua

SEQ ID NO: 2696221 - RNA, 15 nt, Human parainfluenza virus 1 strain Washington/1964
cgguacuagaagaaa

SEQ ID NO: 2696222 - RNA, 23 nt, Human parainfluenza virus 1 strain Washington/1964
cucaauaaugacacccauuagcu

SEQ ID NO: 2696223 - RNA, 14 nt, Human parainfluenza virus 1 strain Washington/1964
caauauccagagcc

SEQ ID NO: 2696224 - RNA, 15 nt, Human parainfluenza virus 1 strain Washington/1964
uguaaugaaaucaca

SEQ ID NO: 2696225 - RNA, 19 nt, Human parainfluenza virus 1 strain Washington/1964
ccaacacuauaucaauuau

SEQ ID NO: 2696226 - RNA, 13 nt, Human parainfluenza virus 1 strain Washington/1964
cuagaagaaaaca

SEQ ID NO: 2696227 - RNA, 20 nt, Human parainfluenza virus 1 strain Washington/1964
gaagccagaucaaaaguaag

SEQ ID NO: 2696228 - RNA, 17 nt, Human parainfluenza virus 1 strain Washington/1964
augacaaauagaauaag

SEQ ID NO: 2696229 - RNA, 13 nt, Human parainfluenza virus 1 strain Washington/1964
cuacaauuucaac

SEQ ID NO: 2696230 - RNA, 20 nt, Human parainfluenza virus 1 strain Washington/1964
aucguaccauuaaucaaaua

SEQ ID NO: 2696231 - RNA, 13 nt, Human parainfluenza virus 1 strain Washington/1964
auauccagagcca

SEQ ID NO: 2696232 - RNA, 17 nt, Human parainfluenza virus 1 strain Washington/1964
gcaaucaaaaucaauau

SEQ ID NO: 2696233 - RNA, 19 nt, Human parainfluenza virus 1 strain Washington/1964
cuuggacaauagaagccag

SEQ ID NO: 2696234 - RNA, 19 nt, Human parainfluenza virus 1 strain Washington/1964
ugaagaugccguucuacaa

SEQ ID NO: 2696235 - RNA, 12 nt, Human parainfluenza virus 1 strain Washington/1964
uauccagagcca

SEQ ID NO: 2696236 - RNA, 15 nt, Human parainfluenza virus 1 strain Washington/1964
aaucaguucaaauaa

SEQ ID NO: 2696237 - RNA, 14 nt, Human parainfluenza virus 1 strain Washington/1964
cauuguagcauaca

SEQ ID NO: 2696238 - RNA, 21 nt, Human parainfluenza virus 1 strain Washington/1964
ggacaauagaagccagaucaa

SEQ ID NO: 2696239 - RNA, 19 nt, Human parainfluenza virus 1 strain Washington/1964
uagaagccagaucaaaagu

SEQ ID NO: 2696240 - RNA, 20 nt, Human parainfluenza virus 1 strain Washington/1964
uucacaaaagggaaagacaa

SEQ ID NO: 2696241 - RNA, 20 nt, Human parainfluenza virus 1 strain Washington/1964
agaacgaagagucagcagcc

SEQ ID NO: 2696242 - RNA, 22 nt, Human parainfluenza virus 1 strain Washington/1964
aauauccagagccaacucaaaa

SEQ ID NO: 2696243 - RNA, 14 nt, Human parainfluenza virus 1 strain Washington/1964
auauaauuacagau

SEQ ID NO: 2696244 - RNA, 20 nt, Human parainfluenza virus 1 strain Washington/1964
caauuaugugaaaaccagau

SEQ ID NO: 2696245 - RNA, 16 nt, Human parainfluenza virus 1 strain Washington/1964
ggacaauagaagccag

SEQ ID NO: 2696246 - RNA, 20 nt, Human parainfluenza virus 1 strain Washington/1964
ccagaucaaaaguaagaaaa

SEQ ID NO: 2696247 - RNA, 17 nt, Human parainfluenza virus 1 strain Washington/1964
ucagcagccacuccaaa

SEQ ID NO: 2696248 - RNA, 23 nt, Human parainfluenza virus 1 strain Washington/1964
acuuaaacaaauucaagaggaaa

SEQ ID NO: 2696249 - RNA, 13 nt, Human parainfluenza virus 1 strain Washington/1964
cucaucuuuauua

SEQ ID NO: 2696250 - RNA, 18 nt, Human parainfluenza virus 1 strain Washington/1964
caauuucaaccagcaauc

SEQ ID NO: 2696251 - RNA, 13 nt, Human parainfluenza virus 1 strain Washington/1964
auuucaaccagca

SEQ ID NO: 2696252 - RNA, 16 nt, Human parainfluenza virus 1 strain Washington/1964
gagccucaagcaucca

SEQ ID NO: 2696253 - RNA, 20 nt, Human parainfluenza virus 1 strain Washington/1964
gaucaagacccaacacuaua

SEQ ID NO: 2696254 - RNA, 16 nt, Human parainfluenza virus 1 strain Washington/1964
uggacaauagaagcca

SEQ ID NO: 2696255 - RNA, 16 nt, Human parainfluenza virus 1 strain Washington/1964
gagagaugacaucaaa

SEQ ID NO: 2696256 - RNA, 16 nt, Human parainfluenza virus 1 strain Washington/1964
guuuaaagagaugagu

SEQ ID NO: 2696257 - RNA, 21 nt, Human parainfluenza virus 1 strain Washington/1964
uaccaacccaaguccagagcu

SEQ ID NO: 2696258 - RNA, 17 nt, Human parainfluenza virus 1 strain Washington/1964
aauauccagagccaacu

SEQ ID NO: 2696259 - RNA, 16 nt, Human parainfluenza virus 1 strain Washington/1964
cugaaaaacacacucu

SEQ ID NO: 2696260 - RNA, 12 nt, Human parainfluenza virus 1 strain Washington/1964
caugaauagaca

SEQ ID NO: 2696261 - RNA, 19 nt, Human parainfluenza virus 1 strain Washington/1964
aucaaguacauuguagcau

SEQ ID NO: 2696262 - RNA, 15 nt, Human parainfluenza virus 1 strain Washington/1964
aauuucaaccagcaa

SEQ ID NO: 2696263 - RNA, 21 nt, Human parainfluenza virus 1 strain Washington/1964
auagaagccagaucaaaagua

SEQ ID NO: 2696264 - RNA, 14 nt, Human parainfluenza virus 1 strain Washington/1964
aacaagugaaaaua

SEQ ID NO: 2696265 - RNA, 23 nt, Human parainfluenza virus 1 strain Washington/1964
uacuuggacaauagaagccagau

SEQ ID NO: 2696266 - RNA, 14 nt, Human parainfluenza virus 1 strain Washington/1964
uguagcauacauac

SEQ ID NO: 2696267 - RNA, 20 nt, Human parainfluenza virus 1 strain Washington/1964
aaagcucccucaaaacaauu

SEQ ID NO: 2696268 - RNA, 20 nt, Human parainfluenza virus 1 strain Washington/1964
ucggaauaccaaaaagaaca

SEQ ID NO: 2696269 - RNA, 12 nt, Human parainfluenza virus 1 strain Washington/1964
uacaauuucaac

SEQ ID NO: 2696270 - RNA, 14 nt, Human parainfluenza virus 1 strain Washington/1964
cagggaucuucaca

SEQ ID NO: 2696271 - RNA, 20 nt, Human parainfluenza virus 1 strain Washington/1964
acuucaccaaucagguguac

SEQ ID NO: 2696272 - RNA, 17 nt, Human parainfluenza virus 1 strain Washington/1964
cacuccucaauaaugac

SEQ ID NO: 2696273 - RNA, 21 nt, Human parainfluenza virus 1 strain Washington/1964
caaagcaugaauagacauuua

SEQ ID NO: 2696274 - RNA, 20 nt, Human parainfluenza virus 1 strain Washington/1964
acuauaucaauuaugugaaa

SEQ ID NO: 2696275 - RNA, 23 nt, Human parainfluenza virus 1 strain Washington/1964
uccguccacugaaaaacacacuc

SEQ ID NO: 2696276 - RNA, 13 nt, Human parainfluenza virus 1 strain Washington/1964
augaguuaacaag

SEQ ID NO: 2696277 - RNA, 21 nt, Human parainfluenza virus 1 strain Washington/1964
ccucuaagcagaguagagaag

SEQ ID NO: 2696278 - RNA, 21 nt, Human parainfluenza virus 1 strain Washington/1964
gaaucuacaauuucaaccagc

SEQ ID NO: 2696279 - RNA, 20 nt, Human parainfluenza virus 1 strain Washington/1964
acaauuucaaccagcaauca

SEQ ID NO: 2696280 - RNA, 22 nt, Human parainfluenza virus 1 strain Washington/1964
gagucagcagccacuccaaaga

SEQ ID NO: 2696281 - RNA, 24 nt, Human parainfluenza virus 1 strain Washington/1964
gagccaacucaaaaagcucccuca

SEQ ID NO: 2696282 - RNA, 14 nt, Human parainfluenza virus 1 strain Washington/1964
gauacuacaagguc

SEQ ID NO: 2696283 - RNA, 16 nt, Human parainfluenza virus 1 strain Washington/1964
aaggucaaaaagacaa

SEQ ID NO: 2696284 - RNA, 21 nt, Human parainfluenza virus 1 strain Washington/1964
cagagccaacucaaaaagcuc

SEQ ID NO: 2696285 - RNA, 20 nt, Human parainfluenza virus 1 strain Washington/1964
gcauacauacaacaaucaaa

SEQ ID NO: 2696286 - RNA, 13 nt, Human parainfluenza virus 1 strain Washington/1964
cuuuauuaucuaa

SEQ ID NO: 2696287 - RNA, 14 nt, Human parainfluenza virus 1 strain Washington/1964
uacaaagaaaugac

SEQ ID NO: 2696288 - RNA, 21 nt, Human parainfluenza virus 1 strain Washington/1964
ucaaaaucaauauccagagcc

SEQ ID NO: 2696289 - RNA, 12 nt, Human parainfluenza virus 1 strain Washington/1964
caaguaagaaaa

SEQ ID NO: 2696290 - RNA, 20 nt, Human parainfluenza virus 1 strain Washington/1964
acuuggacaauagaagccag

SEQ ID NO: 2696291 - RNA, 21 nt, Human parainfluenza virus 1 strain Washington/1964
caauuucaaccagcaaucaaa

SEQ ID NO: 2696292 - RNA, 15 nt, Human parainfluenza virus 1 strain Washington/1964
agaagccagaucaaa

SEQ ID NO: 2696293 - RNA, 16 nt, Human parainfluenza virus 1 strain Washington/1964
caaaaagcucccucaa

SEQ ID NO: 2696294 - RNA, 12 nt, Human parainfluenza virus 1 strain Washington/1964
ucagguguacaa

SEQ ID NO: 2696295 - RNA, 15 nt, Human parainfluenza virus 1 strain Washington/1964
aauuaugugaaaacc

SEQ ID NO: 2696296 - RNA, 16 nt, Human parainfluenza virus 1 strain Washington/1964
cuuggacaauagaagc

SEQ ID NO: 2696297 - RNA, 17 nt, Human parainfluenza virus 1 strain Washington/1964
aaucacuugagaauaaa

SEQ ID NO: 2696298 - RNA, 14 nt, Human parainfluenza virus 1 strain Washington/1964
caauagaagccaga

SEQ ID NO: 2696299 - RNA, 20 nt, Human parainfluenza virus 1 strain Washington/1964
guuaaaaucugcaaauuaca

SEQ ID NO: 2696300 - RNA, 15 nt, Human parainfluenza virus 1 strain Washington/1964
ucugcaaauuacaaa

SEQ ID NO: 2696301 - RNA, 24 nt, Human parainfluenza virus 1 strain Washington/1964
gcuugaagaugccguucuacaaag

SEQ ID NO: 2696302 - RNA, 21 nt, Human parainfluenza virus 1 strain Washington/1964
aaucaaaucuauccacaacuu

SEQ ID NO: 2696303 - RNA, 15 nt, Human parainfluenza virus 1 strain Washington/1964
cagagccaacucaaa

SEQ ID NO: 2696304 - RNA, 11 nt, Human parainfluenza virus 1 strain Washington/1964
ucuucacaaac

SEQ ID NO: 2696305 - RNA, 12 nt, Human parainfluenza virus 1 strain Washington/1964
auuaaucaaaua

SEQ ID NO: 2696306 - RNA, 15 nt, Human parainfluenza virus 1 strain Washington/1964
uuaugugaaaaccag

SEQ ID NO: 2696307 - RNA, 22 nt, Human parainfluenza virus 1 strain Washington/1964
aaucuacaauuucaaccagcaa

SEQ ID NO: 2696308 - RNA, 18 nt, Human parainfluenza virus 1 strain Washington/1964
acuugauaagagaggaug

SEQ ID NO: 2696309 - RNA, 17 nt, Human parainfluenza virus 1 strain Washington/1964
uuggacaauagaagcca

SEQ ID NO: 2696310 - RNA, 23 nt, Human parainfluenza virus 1 strain Washington/1964
caaggucaccaucagucuucaca

SEQ ID NO: 2696311 - RNA, 15 nt, Human parainfluenza virus 1 strain Washington/1964
gaucaaaaguaagaa

SEQ ID NO: 2696312 - RNA, 23 nt, Human parainfluenza virus 1 strain Washington/1964
guaccauuaaucaaauacagauc

SEQ ID NO: 2696313 - RNA, 16 nt, Human parainfluenza virus 1 strain Washington/1964
cagagccaacucaaaa

SEQ ID NO: 2696314 - RNA, 18 nt, Human parainfluenza virus 1 strain Washington/1964
uggacaauagaagccaga

SEQ ID NO: 2696315 - RNA, 21 nt, Human parainfluenza virus 1 strain Washington/1964
aggauacuuggacaauagaag

SEQ ID NO: 2696316 - RNA, 13 nt, Human parainfluenza virus 1 strain Washington/1964
gagccaacucaaa

SEQ ID NO: 2696317 - RNA, 21 nt, Human parainfluenza virus 1 strain Washington/1964
aauucgauacaaucaguucaa

SEQ ID NO: 2696318 - RNA, 20 nt, Human parainfluenza virus 1 strain Washington/1964
ccaagagguuaaaaauguaa

SEQ ID NO: 2696319 - RNA, 19 nt, Human parainfluenza virus 1 strain Washington/1964
agagccaacucaaaaagcu

SEQ ID NO: 2696320 - RNA, 23 nt, Human parainfluenza virus 1 strain Washington/1964
aaaaagcucccucaaaacaauua

SEQ ID NO: 2696321 - RNA, 19 nt, Human parainfluenza virus 1 strain Washington/1964
guguacaacaaguaagaaa

SEQ ID NO: 2696322 - RNA, 14 nt, Human parainfluenza virus 1 strain Washington/1964
auccagagccaacu

SEQ ID NO: 2696323 - RNA, 17 nt, Human parainfluenza virus 1 strain Washington/1964
ccagcaaucaaaaucaa

SEQ ID NO: 2696324 - RNA, 19 nt, Human parainfluenza virus 1 strain Washington/1964
aggucaaaaagacaagguu

SEQ ID NO: 2696325 - RNA, 17 nt, Human parainfluenza virus 1 strain Washington/1964
agccagaucaaaaguaa

SEQ ID NO: 2696326 - RNA, 22 nt, Human parainfluenza virus 1 strain Washington/1964
uggaagcucuaggaggucaaga

SEQ ID NO: 2696327 - RNA, 18 nt, Human parainfluenza virus 1 strain Washington/1964
gucaccaucagucuucac

SEQ ID NO: 2696328 - RNA, 15 nt, Human parainfluenza virus 1 strain Washington/1964
agaaaacaacaauga

SEQ ID NO: 2696329 - RNA, 22 nt, Human parainfluenza virus 1 strain Washington/1964
uaccaaaaagaacagaacucac

SEQ ID NO: 2696330 - RNA, 22 nt, Human parainfluenza virus 1 strain Washington/1964
caacaaucaaaucuauccacaa

SEQ ID NO: 2696331 - RNA, 18 nt, Human parainfluenza virus 1 strain Washington/1964
cucaaaacaauuaagaaa

SEQ ID NO: 2696332 - RNA, 16 nt, Human parainfluenza virus 1 strain Washington/1964
cuaguuaucgaaaaca

SEQ ID NO: 2696333 - RNA, 20 nt, Human parainfluenza virus 1 strain Washington/1964
auacauacaacaaucaaauc

SEQ ID NO: 2696334 - RNA, 14 nt, Human parainfluenza virus 1 strain Washington/1964
aucaaaaucaauau

SEQ ID NO: 2696335 - RNA, 21 nt, Human parainfluenza virus 1 strain Washington/1964
aucaaaucuauccacaacuuc

SEQ ID NO: 2696336 - RNA, 19 nt, Human parainfluenza virus 1 strain Washington/1964
ccaacucaaaaagcucccu

SEQ ID NO: 2696337 - RNA, 23 nt, Human parainfluenza virus 1 strain Washington/1964
aucuacaauuucaaccagcaauc

SEQ ID NO: 2696338 - RNA, 19 nt, Human parainfluenza virus 1 strain Washington/1964
aagaugccguucuacaaag

SEQ ID NO: 2696339 - RNA, 14 nt, Human parainfluenza virus 1 strain Washington/1964
augagccucaagca

SEQ ID NO: 2696340 - RNA, 23 nt, Human parainfluenza virus 1 strain Washington/1964
gagccaacucaaaaagcucccuc

SEQ ID NO: 2696341 - RNA, 22 nt, Human parainfluenza virus 1 strain Washington/1964
ucagcagccacuccaaagaaca

SEQ ID NO: 2696342 - RNA, 15 nt, Human parainfluenza virus 1 strain Washington/1964
uacuuaaacaaauuc

SEQ ID NO: 2696343 - RNA, 19 nt, Human parainfluenza virus 1 strain Washington/1964
acucaaaaagcucccucaa

SEQ ID NO: 2696344 - RNA, 17 nt, Human parainfluenza virus 1 strain Washington/1964
gaaucuacaauuucaac

SEQ ID NO: 2696345 - RNA, 18 nt, Human parainfluenza virus 1 strain Washington/1964
cagaucaaaaguaagaaa

SEQ ID NO: 2696346 - RNA, 14 nt, Human parainfluenza virus 1 strain Washington/1964
uuaaucaaauacag

SEQ ID NO: 2696347 - RNA, 12 nt, Human parainfluenza virus 1 strain Washington/1964
ucaaguacauug

SEQ ID NO: 2696348 - RNA, 19 nt, Human parainfluenza virus 1 strain Washington/1964
ucccucaaaacaauuaaga

SEQ ID NO: 2696349 - RNA, 19 nt, Human parainfluenza virus 1 strain Washington/1964
gagccaacucaaaaagcuc

SEQ ID NO: 2696350 - RNA, 13 nt, Human parainfluenza virus 1 strain Washington/1964
ucuacaauuucaa

SEQ ID NO: 2696351 - RNA, 16 nt, Human parainfluenza virus 1 strain Washington/1964
auuucaaccagcaauc

SEQ ID NO: 2696352 - RNA, 13 nt, Human parainfluenza virus 1 strain Washington/1964
uauccagagccaa

SEQ ID NO: 2696353 - RNA, 16 nt, Human parainfluenza virus 1 strain Washington/1964
gugauacuacaagguc

SEQ ID NO: 2696354 - RNA, 20 nt, Human parainfluenza virus 1 strain Washington/1964
acaguccucuaagcagagua

SEQ ID NO: 2696355 - RNA, 16 nt, Human parainfluenza virus 1 strain Washington/1964
acaauagaagccagau

SEQ ID NO: 2696356 - RNA, 21 nt, Human parainfluenza virus 1 strain Washington/1964
ccaacucaaaaagcucccuca

SEQ ID NO: 2696357 - RNA, 18 nt, Human parainfluenza virus 1 strain Washington/1964
aaaucaauauccagagcc

SEQ ID NO: 2696358 - RNA, 13 nt, Human parainfluenza virus 1 strain Washington/1964
aucagucuucaca

SEQ ID NO: 2696359 - RNA, 20 nt, Human parainfluenza virus 1 strain Washington/1964
aauauccagagccaacucaa

SEQ ID NO: 2696360 - RNA, 18 nt, Human parainfluenza virus 1 strain Washington/1964
cagugauacuacaagguc

SEQ ID NO: 2696361 - RNA, 15 nt, Human parainfluenza virus 1 strain Washington/1964
cuucucaucuuuauu

SEQ ID NO: 2696362 - RNA, 13 nt, Human parainfluenza virus 1 strain Washington/1964
cagagccaacuca

SEQ ID NO: 2696363 - RNA, 14 nt, Human parainfluenza virus 1 strain Washington/1964
ucuauccacacucc

SEQ ID NO: 2696364 - RNA, 15 nt, Human parainfluenza virus 1 strain Washington/1964
ccagagccaacucaa

SEQ ID NO: 2696365 - RNA, 15 nt, Human parainfluenza virus 1 strain Washington/1964
caaucaaaaucaaua

SEQ ID NO: 2696366 - RNA, 22 nt, Human parainfluenza virus 1 strain Washington/1964
aacacuauaucaauuaugugaa

SEQ ID NO: 2696367 - RNA, 22 nt, Human parainfluenza virus 1 strain Washington/1964
acuccucaauaaugacacccau

SEQ ID NO: 2696368 - RNA, 16 nt, Human parainfluenza virus 1 strain Washington/1964
ugacaaauagaauaag

SEQ ID NO: 2696369 - RNA, 13 nt, Human parainfluenza virus 1 strain Washington/1964
caaauagaauaag

SEQ ID NO: 2696370 - RNA, 22 nt, Human parainfluenza virus 1 strain Washington/1964
acacuauaucaauuaugugaaa

SEQ ID NO: 2696371 - RNA, 15 nt, Human parainfluenza virus 1 strain Washington/1964
uaaaaucugcaaauu

SEQ ID NO: 2696372 - RNA, 22 nt, Human parainfluenza virus 1 strain Washington/1964
ugugaaaaccagauaugaugua

SEQ ID NO: 2696373 - RNA, 14 nt, Human parainfluenza virus 1 strain Washington/1964
ucuucucaucuuua

SEQ ID NO: 2696374 - RNA, 17 nt, Human parainfluenza virus 1 strain Washington/1964
cauuaaucaaauacaga

SEQ ID NO: 2696375 - RNA, 19 nt, Human parainfluenza virus 1 strain Washington/1964
cuuaaacaaauucaagagg

SEQ ID NO: 2696376 - RNA, 23 nt, Human parainfluenza virus 1 strain Washington/1964
auacuuggacaauagaagccaga

SEQ ID NO: 2696377 - RNA, 22 nt, Human parainfluenza virus 1 strain Washington/1964
ucccucaaaacaauuaagaaaa

SEQ ID NO: 2696378 - RNA, 14 nt, Human parainfluenza virus 1 strain Washington/1964
aacaaagcaugaau

SEQ ID NO: 2696379 - RNA, 16 nt, Human parainfluenza virus 1 strain Washington/1964
ucaauauccagagcca

SEQ ID NO: 2696380 - RNA, 14 nt, Human parainfluenza virus 1 strain Washington/1964
acaacaaacaaugc

SEQ ID NO: 2696381 - RNA, 21 nt, Human parainfluenza virus 1 strain Washington/1964
acuccucaauaaugacaccca

SEQ ID NO: 2696382 - RNA, 18 nt, Human parainfluenza virus 1 strain Washington/1964
aaagcaugaauagacauu

SEQ ID NO: 2696383 - RNA, 17 nt, Human parainfluenza virus 1 strain Washington/1964
agugauacuacaagguc

SEQ ID NO: 2696384 - RNA, 23 nt, Human parainfluenza virus 1 strain Washington/1964
auuucaaccagcaaucaaaauca

SEQ ID NO: 2696385 - RNA, 21 nt, Human parainfluenza virus 1 strain Washington/1964
gaaaucccuuuaacugacuca

SEQ ID NO: 2696386 - RNA, 17 nt, Human parainfluenza virus 1 strain Washington/1964
auccagggaucuucaca

SEQ ID NO: 2696387 - RNA, 17 nt, Human parainfluenza virus 1 strain Washington/1964
gucaaaaagacaagguu

SEQ ID NO: 2696388 - RNA, 21 nt, Human parainfluenza virus 1 strain Washington/1964
aaaccagauaugauguauaaa

SEQ ID NO: 2696389 - RNA, 19 nt, Human parainfluenza virus 1 strain Washington/1964
caacucaaaaagcucccuc

SEQ ID NO: 2696390 - RNA, 17 nt, Human parainfluenza virus 1 strain Washington/1964
aaaguccaccaacuccc

SEQ ID NO: 2696391 - RNA, 17 nt, Human parainfluenza virus 1 strain Washington/1964
aaccagcaaucaaaauc

SEQ ID NO: 2696392 - RNA, 21 nt, Human parainfluenza virus 1 strain Washington/1964
aaaaccagauaugauguauaa

SEQ ID NO: 2696393 - RNA, 18 nt, Human parainfluenza virus 1 strain Washington/1964
caacucaaaaagcucccu

SEQ ID NO: 2696394 - RNA, 14 nt, Human parainfluenza virus 1 strain Washington/1964
aaucccuuuaacug

SEQ ID NO: 2696395 - RNA, 14 nt, Human parainfluenza virus 1 strain Washington/1964
uccagagccaacuc

SEQ ID NO: 2696396 - RNA, 14 nt, Human parainfluenza virus 1 strain Washington/1964
aaucaauauccaga

SEQ ID NO: 2696397 - RNA, 14 nt, Human parainfluenza virus 1 strain Washington/1964
gcaaucaaaaucaa

SEQ ID NO: 2696398 - RNA, 13 nt, Human parainfluenza virus 1 strain Washington/1964
aaacaauuaagaa

SEQ ID NO: 2696399 - RNA, 21 nt, Human parainfluenza virus 1 strain Washington/1964
ucaaaucuauccacaacuuca

SEQ ID NO: 2696400 - RNA, 20 nt, Human parainfluenza virus 1 strain Washington/1964
gccagaucaaaaguaagaaa

SEQ ID NO: 2696401 - RNA, 23 nt, Human parainfluenza virus 1 strain Washington/1964
guuaaaaucugcaaauuacaaag

SEQ ID NO: 2696402 - RNA, 22 nt, Human parainfluenza virus 1 strain Washington/1964
uaacuaaacaugaaucuacaau

SEQ ID NO: 2696403 - RNA, 20 nt, Human parainfluenza virus 1 strain Washington/1964
aaaagcucccucaaaacaau

SEQ ID NO: 2696404 - RNA, 16 nt, Human parainfluenza virus 1 strain Washington/1964
auuuauaugacaaaua

SEQ ID NO: 2696405 - RNA, 14 nt, Human parainfluenza virus 1 strain Washington/1964
uacaauuucaacca

SEQ ID NO: 2696406 - RNA, 19 nt, Human parainfluenza virus 1 strain Washington/1964
acuuggacaauagaagcca

SEQ ID NO: 2696407 - RNA, 19 nt, Human parainfluenza virus 1 strain Washington/1964
aauuuaaaaacaaagcaug

SEQ ID NO: 2696408 - RNA, 17 nt, Human parainfluenza virus 1 strain Washington/1964
caugaauagacauuuau

SEQ ID NO: 2696409 - RNA, 14 nt, Human parainfluenza virus 1 strain Washington/1964
uguaaugaaaucac

SEQ ID NO: 2696410 - RNA, 21 nt, Human parainfluenza virus 1 strain Washington/1964
agaaggcuuacaucaaauccc

SEQ ID NO: 2696411 - RNA, 17 nt, Human parainfluenza virus 1 strain Washington/1964
augaaaucacaacauga

SEQ ID NO: 2696412 - RNA, 21 nt, Human parainfluenza virus 1 strain Washington/1964
uucaaccagcaaucaaaauca

SEQ ID NO: 2696413 - RNA, 20 nt, Human parainfluenza virus 1 strain Washington/1964
uaaacaugaaucuacaauuu

SEQ ID NO: 2696414 - RNA, 16 nt, Human parainfluenza virus 1 strain Washington/1964
cucaaaacaauuaaga

SEQ ID NO: 2696415 - RNA, 13 nt, Human parainfluenza virus 1 strain Washington/1964
ccagaucaaaagu

SEQ ID NO: 2696416 - RNA, 21 nt, Human parainfluenza virus 1 strain Washington/1964
cucccucaaaacaauuaagaa

SEQ ID NO: 2696417 - RNA, 19 nt, Human parainfluenza virus 1 strain Washington/1964
cgacgcaaccgcaaaugaa

SEQ ID NO: 2696418 - RNA, 19 nt, Human parainfluenza virus 1 strain Washington/1964
acaacaaucaaaucuaucc

SEQ ID NO: 2696419 - RNA, 15 nt, Human parainfluenza virus 1 strain Washington/1964
uuuauaugacaaaua

SEQ ID NO: 2696420 - RNA, 12 nt, Human parainfluenza virus 1 strain Washington/1964
ugaaucuacaau

SEQ ID NO: 2696421 - RNA, 21 nt, Human parainfluenza virus 1 strain Washington/1964
uguagcauacauacaacaauc

SEQ ID NO: 2696422 - RNA, 22 nt, Human parainfluenza virus 1 strain Washington/1964
cuugagaauaaaguagaagaaa

SEQ ID NO: 2696423 - RNA, 20 nt, Human parainfluenza virus 1 strain Washington/1964
uaccauuaaucaaauacaga

SEQ ID NO: 2696424 - RNA, 16 nt, Human parainfluenza virus 1 strain Washington/1964
ucaaccagcaaucaaa

SEQ ID NO: 2696425 - RNA, 18 nt, Human parainfluenza virus 1 strain Washington/1964
auagacauuuauaugaca

SEQ ID NO: 2696426 - RNA, 21 nt, Human parainfluenza virus 1 strain Washington/1964
caggauacuuggacaauagaa

SEQ ID NO: 2696427 - RNA, 19 nt, Human parainfluenza virus 1 strain Washington/1964
acaauuucaaccagcaauc

SEQ ID NO: 2696428 - RNA, 15 nt, Human parainfluenza virus 1 strain Washington/1964
ccuuuaacugacuca

SEQ ID NO: 2696429 - RNA, 17 nt, Human parainfluenza virus 1 strain Washington/1964
gauaagaaaucccuuua

SEQ ID NO: 2696430 - RNA, 15 nt, Human parainfluenza virus 1 strain Washington/1964
aaucuacaauuucaa

SEQ ID NO: 2696431 - RNA, 21 nt, Human parainfluenza virus 1 strain Washington/1964
cuuggacaauagaagccagau

SEQ ID NO: 2696432 - RNA, 17 nt, Human parainfluenza virus 1 strain Washington/1964
acaauuucaaccagcaa

SEQ ID NO: 2696433 - RNA, 14 nt, Human parainfluenza virus 1 strain Washington/1964
caaaaagcucccuc

SEQ ID NO: 2696434 - RNA, 22 nt, Human parainfluenza virus 1 strain Washington/1964
cccaacacuauaucaauuaugu

SEQ ID NO: 2696435 - RNA, 17 nt, Human parainfluenza virus 1 strain Washington/1964
aaucaaaucuauccaca

SEQ ID NO: 2696436 - RNA, 12 nt, Human parainfluenza virus 1 strain Washington/1964
acuccacaaauc

SEQ ID NO: 2696437 - RNA, 16 nt, Human parainfluenza virus 1 strain Washington/1964
cagggaucuucacaaa

SEQ ID NO: 2696438 - RNA, 22 nt, Human parainfluenza virus 1 strain Washington/1964
auuaucuaauuuguuuaaagag

SEQ ID NO: 2696439 - RNA, 20 nt, Human parainfluenza virus 1 strain Washington/1964
aaaaucugcaaauuacaaag

SEQ ID NO: 2696440 - RNA, 14 nt, Human parainfluenza virus 1 strain Washington/1964
gaugagauggccaa

SEQ ID NO: 2696441 - RNA, 21 nt, Human parainfluenza virus 1 strain Washington/1964
agaagccagaucaaaaguaag

SEQ ID NO: 2696442 - RNA, 18 nt, Human parainfluenza virus 1 strain Washington/1964
ggucaaaaagacaagguu

SEQ ID NO: 2696443 - RNA, 23 nt, Human parainfluenza virus 1 strain Washington/1964
gcaaucaaaaucaauauccagag

SEQ ID NO: 2696444 - RNA, 21 nt, Human parainfluenza virus 1 strain Washington/1964
ugaguuaacaagauaagaaau

SEQ ID NO: 2696445 - RNA, 16 nt, Human parainfluenza virus 1 strain Washington/1964
agacaauaaggucaaa

SEQ ID NO: 2696446 - RNA, 23 nt, Human parainfluenza virus 1 strain Washington/1964
augaaucuacaauuucaaccagc

SEQ ID NO: 2696447 - RNA, 22 nt, Human parainfluenza virus 1 strain Washington/1964
uaccauuaaucaaauacagauc

SEQ ID NO: 2696448 - RNA, 22 nt, Human parainfluenza virus 1 strain Washington/1964
gauacuuggacaauagaagcca

SEQ ID NO: 2696449 - RNA, 18 nt, Human parainfluenza virus 1 strain Washington/1964
agccaacucaaaaagcuc

SEQ ID NO: 2696450 - RNA, 17 nt, Human parainfluenza virus 1 strain Washington/1964
gacaauagaagccagau

SEQ ID NO: 2696451 - RNA, 20 nt, Human parainfluenza virus 1 strain Washington/1964
ucuaauuuguuuaaagagau

SEQ ID NO: 2696452 - RNA, 18 nt, Human parainfluenza virus 1 strain Washington/1964
agccagaucaaaaguaag

SEQ ID NO: 2696453 - RNA, 20 nt, Human parainfluenza virus 1 strain Washington/1964
uacauacaacaaucaaaucu

SEQ ID NO: 2696454 - RNA, 17 nt, Human parainfluenza virus 1 strain Washington/1964
aaaacaaagcaugaaua

SEQ ID NO: 2696455 - RNA, 22 nt, Human parainfluenza virus 1 strain Washington/1964
uugagaauaaaguagaagaaaa

SEQ ID NO: 2696456 - RNA, 18 nt, Human parainfluenza virus 1 strain Washington/1964
gauacuuggacaauagaa

SEQ ID NO: 2696457 - RNA, 13 nt, Human parainfluenza virus 1 strain Washington/1964
caagaggaaauaa

SEQ ID NO: 2696458 - RNA, 18 nt, Human parainfluenza virus 1 strain Washington/1964
aaucaauauccagagcca

SEQ ID NO: 2696459 - RNA, 15 nt, Human parainfluenza virus 1 strain Washington/1964
caauauccagagcca

SEQ ID NO: 2696460 - RNA, 17 nt, Human parainfluenza virus 1 strain Washington/1964
caaccagcaaucaaaau

SEQ ID NO: 2696461 - RNA, 14 nt, Human parainfluenza virus 1 strain Washington/1964
agaucaaaaguaag

SEQ ID NO: 2696462 - RNA, 21 nt, Human parainfluenza virus 1 strain Washington/1964
ccucaauaaugacacccauua

SEQ ID NO: 2696463 - RNA, 16 nt, Human parainfluenza virus 1 strain Washington/1964
uacaacaaucaaaucu

SEQ ID NO: 2696464 - RNA, 18 nt, Human parainfluenza virus 1 strain Washington/1964
auuucaaccagcaaucaa

SEQ ID NO: 2696465 - RNA, 12 nt, Human parainfluenza virus 1 strain Washington/1964
aagcucccucaa

SEQ ID NO: 2696466 - RNA, 17 nt, Human parainfluenza virus 1 strain Washington/1964
auacuuggacaauagaa

SEQ ID NO: 2696467 - RNA, 19 nt, Human parainfluenza virus 1 strain Washington/1964
caaaaucaauauccagagc

SEQ ID NO: 2696468 - RNA, 12 nt, Human parainfluenza virus 1 strain Washington/1964
ugauacuacaag

SEQ ID NO: 2696469 - RNA, 23 nt, Human parainfluenza virus 1 strain Washington/1964
ucagaacuccacaaaucaacaag

SEQ ID NO: 2696470 - RNA, 16 nt, Human parainfluenza virus 1 strain Washington/1964
ucugcacucacucaaa

SEQ ID NO: 2696471 - RNA, 13 nt, Human parainfluenza virus 1 strain Washington/1964
ucaagaguucaag

SEQ ID NO: 2696472 - RNA, 21 nt, Human parainfluenza virus 1 strain Washington/1964
uuuaaaaacaaagcaugaaua

SEQ ID NO: 2696473 - RNA, 13 nt, Human parainfluenza virus 1 strain Washington/1964
uaaagagaugagu

SEQ ID NO: 2696474 - RNA, 17 nt, Human parainfluenza virus 1 strain Washington/1964
ggacaauagaagccaga

SEQ ID NO: 2696475 - RNA, 17 nt, Human parainfluenza virus 1 strain Washington/1964
auaucaauuaugugaaa

SEQ ID NO: 2696476 - RNA, 12 nt, Human parainfluenza virus 1 strain Washington/1964
ucgauacaauca

SEQ ID NO: 2696477 - RNA, 18 nt, Human parainfluenza virus 1 strain Washington/1964
cauuguagcauacauaca

SEQ ID NO: 2696478 - RNA, 15 nt, Human parainfluenza virus 1 strain Washington/1964
caaucagguguacaa

SEQ ID NO: 2696479 - RNA, 19 nt, Human parainfluenza virus 1 strain Washington/1964
agaugaguuaacaagauaa

SEQ ID NO: 2696480 - RNA, 17 nt, Human parainfluenza virus 1 strain Washington/1964
uagaagaaaacaacaau

SEQ ID NO: 2696481 - RNA, 20 nt, Human parainfluenza virus 1 strain Washington/1964
gagccaacucaaaaagcucc

SEQ ID NO: 2696482 - RNA, 16 nt, Human parainfluenza virus 1 strain Washington/1964
caaagcaugaauagac

SEQ ID NO: 2696483 - RNA, 15 nt, Human parainfluenza virus 1 strain Washington/1964
caaaugaagaggaaa

SEQ ID NO: 2696484 - RNA, 18 nt, Human parainfluenza virus 1 strain Washington/1964
ugaguuaacaagauaaga

SEQ ID NO: 2696485 - RNA, 13 nt, Human parainfluenza virus 1 strain Washington/1964
caaaaagcucccu

SEQ ID NO: 2696486 - RNA, 22 nt, Human parainfluenza virus 1 strain Washington/1964
ucauaaaaacauaguaagaaaa

SEQ ID NO: 2696487 - RNA, 21 nt, Human parainfluenza virus 1 strain Washington/1964
uaaugacacccauuagcucua

SEQ ID NO: 2696488 - RNA, 22 nt, Human parainfluenza virus 1 strain Washington/1964
cuucaccaaucagguguacaac

SEQ ID NO: 2696489 - RNA, 15 nt, Human parainfluenza virus 1 strain Washington/1964
aguugaaaaaucacu

SEQ ID NO: 2696490 - RNA, 15 nt, Human parainfluenza virus 1 strain Washington/1964
aagccagaucaaaag

SEQ ID NO: 2696491 - RNA, 20 nt, Human parainfluenza virus 1 strain Washington/1964
aaccacaaccacagaaaaac

SEQ ID NO: 2696492 - RNA, 18 nt, Human parainfluenza virus 1 strain Washington/1964
guuuaaagagaugaguua

SEQ ID NO: 2696493 - RNA, 12 nt, Human parainfluenza virus 1 strain Washington/1964
cauuagcucuaa

SEQ ID NO: 2696494 - RNA, 20 nt, Human parainfluenza virus 1 strain Washington/1964
uaccaaaaagaacagaacuc

SEQ ID NO: 2696495 - RNA, 18 nt, Human parainfluenza virus 1 strain Washington/1964
ucauccagggaucuucac

SEQ ID NO: 2696496 - RNA, 16 nt, Human parainfluenza virus 1 strain Washington/1964
ucaauaaugacaccca

SEQ ID NO: 2696497 - RNA, 18 nt, Human parainfluenza virus 1 strain Washington/1964
uucacuaacuaacuaaac

SEQ ID NO: 2696498 - RNA, 14 nt, Human parainfluenza virus 1 strain Washington/1964
auuuauaugacaaa

SEQ ID NO: 2696499 - RNA, 18 nt, Human parainfluenza virus 1 strain Washington/1964
ucaguucaaauaagaaaa

SEQ ID NO: 2696500 - RNA, 22 nt, Human parainfluenza virus 1 strain Washington/1964
cuccucaauaaugacacccauu

SEQ ID NO: 2696501 - RNA, 14 nt, Human parainfluenza virus 1 strain Washington/1964
acacagaguucaga

SEQ ID NO: 2696502 - RNA, 22 nt, Human parainfluenza virus 1 strain Washington/1964
ucuucacaaaagggaaagacaa

SEQ ID NO: 2696503 - RNA, 17 nt, Human parainfluenza virus 1 strain Washington/1964
ucaauauccagagccaa

SEQ ID NO: 2696504 - RNA, 20 nt, Human parainfluenza virus 1 strain Washington/1964
cucaauaaugacacccauua

SEQ ID NO: 2696505 - RNA, 16 nt, Human parainfluenza virus 1 strain Washington/1964
cuaaaucguaccauua

SEQ ID NO: 2696506 - RNA, 15 nt, Human
auaaaagacagugaa

SEQ ID NO: 2696507 - RNA, 16 nt, Human
auaaaagacagugaaa

SEQ ID NO: 2696508 - RNA, 13 nt, Human
aguacucauacau

SEQ ID NO: 2696509 - RNA, 19 nt, Human
agugaugucacuagggcag

SEQ ID NO: 2696510 - RNA, 13 nt, Human
agugauuaccagg

SEQ ID NO: 2696511 - RNA, 13 nt, Human
agucauuuaauaa

SEQ ID NO: 2696512 - RNA, 21 nt, Human
aucaugaauuaguuuuauaug

SEQ ID NO: 2696513 - RNA, 12 nt, Human
auccuugaagau

SEQ ID NO: 2696514 - RNA, 14 nt, Human
aucaaaagaaagaa

SEQ ID NO: 2696515 - RNA, 23 nt, Human
auggcuuccuggcaauagucaaa

SEQ ID NO: 2696516 - RNA, 20 nt, Human
augggaaagcauuguaaaug

SEQ ID NO: 2696517 - RNA, 14 nt, Human
augggaaagcauug

SEQ ID NO: 2696518 - RNA, 15 nt, Human
augggacagggagga

SEQ ID NO: 2696519 - RNA, 20 nt, Human
augggacauuugcucaugga

SEQ ID NO: 2696520 - RNA, 20 nt, Human
agggauuagggagagaagau

SEQ ID NO: 2696521 - RNA, 17 nt, Human
agggacaggauaagagg

SEQ ID NO: 2696522 - RNA, 23 nt, Human
aggccaugggcacuguggguaga

SEQ ID NO: 2696523 - RNA, 20 nt, Human
aggcagagguugcagugagc

SEQ ID NO: 2696524 - RNA, 13 nt, Human
agcuacaaaugca

SEQ ID NO: 2696525 - RNA, 12 nt, Human
agcuacaaaugc

SEQ ID NO: 2696526 - RNA, 15 nt, Human
agcgacagugagacu

SEQ ID NO: 2696527 - RNA, 13 nt, Human
agcgacagugaga

SEQ ID NO: 2696528 - RNA, 20 nt, Human
agcugcugaaacaacaaaua

SEQ ID NO: 2696529 - RNA, 16 nt, Human
agcugcugaaacaaca

SEQ ID NO: 2696530 - RNA, 15 nt, Human
agcugcugaaacaac

SEQ ID NO: 2696531 - RNA, 14 nt, Human
agcugcugaaacaa

SEQ ID NO: 2696532 - RNA, 17 nt, Human
agcuguaugauucccag

SEQ ID NO: 2696533 - RNA, 18 nt, Human
agcuguaugauucccagc

SEQ ID NO: 2696534 - RNA, 18 nt, Human
aggaaaaaauaacaauga

SEQ ID NO: 2696535 - RNA, 19 nt, Human
agacaaggaaaaaauaaca

SEQ ID NO: 2696536 - RNA, 22 nt, Human
agaacagugauuaccagggacu

SEQ ID NO: 2696537 - RNA, 13 nt, Human
agaagagcuguuc

SEQ ID NO: 2696538 - RNA, 13 nt, Human
agaagauagcagg

SEQ ID NO: 2696539 - RNA, 20 nt, Human
agaagagcuguucacagcca

SEQ ID NO: 2696540 - RNA, 21 nt, Human
agaagacugcauuauauuuau

SEQ ID NO: 2696541 - RNA, 23 nt, Human
agcaaaauuuuuucucuaggaaa

SEQ ID NO: 2696542 - RNA, 20 nt, Human
agauagauaggucagugcaa

SEQ ID NO: 2696543 - RNA, 19 nt, Human
agcacugacuucuaaguaa

SEQ ID NO: 2696544 - RNA, 17 nt, Human
agcacugacuucuaagu

SEQ ID NO: 2696545 - RNA, 14 nt, Human
agccagcaguucag

SEQ ID NO: 2696546 - RNA, 11 nt, Human
aauuguaauag

SEQ ID NO: 2696547 - RNA, 22 nt, Human
aauuucauaccuaucaucuuaa

SEQ ID NO: 2696548 - RNA, 15 nt, Human
acaccaauauucaua

SEQ ID NO: 2696549 - RNA, 24 nt, Human
acaggaugguucccuugaugaaga

SEQ ID NO: 2696550 - RNA, 22 nt, Human
acaggaugguucccuugaugaa

SEQ ID NO: 2696551 - RNA, 19 nt, Human
acagugauuaccagggacu

SEQ ID NO: 2696552 - RNA, 15 nt, Human
acauuugcucaugga

SEQ ID NO: 2696553 - RNA, 16 nt, Human
acauuuguauaaaaua

SEQ ID NO: 2696554 - RNA, 19 nt, Human
acauuuguauaaaauaauu

SEQ ID NO: 2696555 - RNA, 21 nt, Human
acauuuguauaaaauaauuuu

SEQ ID NO: 2696556 - RNA, 14 nt, Human
acgcacacugucug

SEQ ID NO: 2696557 - RNA, 20 nt, Human
accucugccucagaaaacaa

SEQ ID NO: 2696558 - RNA, 20 nt, Human
acccucagaugcacaugagc

SEQ ID NO: 2696559 - RNA, 21 nt, Human
acccugucucuacuaaaaaua

SEQ ID NO: 2696560 - RNA, 17 nt, Human
acuguaaaauaauaacu

SEQ ID NO: 2696561 - RNA, 18 nt, Human
acuucaaauccuugaaga

SEQ ID NO: 2696562 - RNA, 17 nt, Human
acuucaaauccuugaag

SEQ ID NO: 2696563 - RNA, 22 nt, Human
acuuaaaaaugguuuaaauggu

SEQ ID NO: 2696564 - RNA, 21 nt, Human
acuuaaaaaugguuuaaaugg

SEQ ID NO: 2696565 - RNA, 13 nt, Human
acuuggucuguga

SEQ ID NO: 2696566 - RNA, 21 nt, Human
acuucagacauagaauuaaca

SEQ ID NO: 2696567 - RNA, 14 nt, Human
acucccuuucaaca

SEQ ID NO: 2696568 - RNA, 14 nt, Human
acucguuaauuugu

SEQ ID NO: 2696569 - RNA, 19 nt, Human
acucguuaauuuguagugu

SEQ ID NO: 2696570 - RNA, 13 nt, Human
acugacacaugcu

SEQ ID NO: 2696571 - RNA, 19 nt, Human
acugauaugggucuugaua

SEQ ID NO: 2696572 - RNA, 20 nt, Human
aaugaauacuuuauaaagga

SEQ ID NO: 2696573 - RNA, 16 nt, Human
aaucucaauauuucag

SEQ ID NO: 2696574 - RNA, 21 nt, Human
aagacaaggaaaaaauaacaa

SEQ ID NO: 2696575 - RNA, 20 nt, Human
aagaagacugcauuauauuu

SEQ ID NO: 2696576 - RNA, 15 nt, Human
aagaagacugcauua

SEQ ID NO: 2696577 - RNA, 20 nt, Human
aacgcaggcccccaggugcc

SEQ ID NO: 2696578 - RNA, 12 nt, Human
aagaacugaaau

SEQ ID NO: 2696579 - RNA, 13 nt, Human
aagaacugaaauc

SEQ ID NO: 2696580 - RNA, 11 nt, Human
aagaacugaaa

SEQ ID NO: 2696581 - RNA, 15 nt, Human
aagaacugaaaucau

SEQ ID NO: 2696582 - RNA, 22 nt, Human
aagacagagccccacccucaga

SEQ ID NO: 2696583 - RNA, 21 nt, Human
aaauauuuauuuuaauaaugu

SEQ ID NO: 2696584 - RNA, 18 nt, Human
aaaucucaauauuucaga

SEQ ID NO: 2696585 - RNA, 13 nt, Human
aaauguucaucaa

SEQ ID NO: 2696586 - RNA, 17 nt, Human
aaauguucaucaaugaa

SEQ ID NO: 2696587 - RNA, 22 nt, Human
aaauguugacaugggacauuug

SEQ ID NO: 2696588 - RNA, 23 nt, Human
aaauguugacaugggacauuugc

SEQ ID NO: 2696589 - RNA, 17 nt, Human
aaaagaaagaaaaucag

SEQ ID NO: 2696590 - RNA, 12 nt, Human
aaaagaauauuu

SEQ ID NO: 2696591 - RNA, 20 nt, Human
aaaagacaaggaaaaaauaa

SEQ ID NO: 2696592 - RNA, 13 nt, Human
aaaagaauauuuu

SEQ ID NO: 2696593 - RNA, 11 nt, Human
aaaagaaugau

SEQ ID NO: 2696594 - RNA, 13 nt, Human
aaaagacuccaaa

SEQ ID NO: 2696595 - RNA, 10 nt, Human
aaaaucauuu

SEQ ID NO: 2696596 - RNA, 12 nt, Human
aaaaucauuucu

SEQ ID NO: 2696597 - RNA, 11 nt, Human
aaaaucauuuc

SEQ ID NO: 2696598 - RNA, 17 nt, Human
aaagcauuguaaaugug

SEQ ID NO: 2696599 - RNA, 15 nt, Human
aaagcauuguaaaug

SEQ ID NO: 2696600 - RNA, 21 nt, Human
aaaaucauuucugcaucagcu

SEQ ID NO: 2696601 - RNA, 15 nt, Human
aaacugcacugucaa

SEQ ID NO: 2696602 - RNA, 16 nt, Human
gcccccaggugccagu

SEQ ID NO: 2696603 - RNA, 13 nt, Human
gcccuguuaaaag

SEQ ID NO: 2696604 - RNA, 17 nt, Human
gcccuguuaaaagauga

SEQ ID NO: 2696605 - RNA, 14 nt, Human
gcccuguuaaaaga

SEQ ID NO: 2696606 - RNA, 19 nt, Human
gccagauuuuccugaaaac

SEQ ID NO: 2696607 - RNA, 22 nt, Human
gccagacaucaacagauaaaua

SEQ ID NO: 2696608 - RNA, 22 nt, Human
gccagcaguucagagcugcccu

SEQ ID NO: 2696609 - RNA, 23 nt, Human
gccagcaguucagagcugcccuc

SEQ ID NO: 2696610 - RNA, 16 nt, Human
gcuaguaucaaaagaa

SEQ ID NO: 2696611 - RNA, 21 nt, Human
gcuaguaauuggaaaggcagc

SEQ ID NO: 2696612 - RNA, 18 nt, Human
gcuccccucggagaagag

SEQ ID NO: 2696613 - RNA, 15 nt, Human
gcuccccucggagaa

SEQ ID NO: 2696614 - RNA, 21 nt, Human
gcugccuccccuccucugcuu

SEQ ID NO: 2696615 - RNA, 22 nt, Human
gcugccuccccuccucugcuug

SEQ ID NO: 2696616 - RNA, 16 nt, Human
gcugccuccccuccuc

SEQ ID NO: 2696617 - RNA, 17 nt, Human
gcugccuccccuccucu

SEQ ID NO: 2696618 - RNA, 20 nt, Human
gcugccuccccuccucugcu

SEQ ID NO: 2696619 - RNA, 14 nt, Human
gcuggagcucugcc

SEQ ID NO: 2696620 - RNA, 17 nt, Human
gcuggagcucugcccau

SEQ ID NO: 2696621 - RNA, 19 nt, Human
ggaggcugagaugggagaa

SEQ ID NO: 2696622 - RNA, 15 nt, Human
ggaggcugagauggg

SEQ ID NO: 2696623 - RNA, 22 nt, Human
ggaugguucccuugaugaagaa

SEQ ID NO: 2696624 - RNA, 23 nt, Human
ggaugguucccuugaugaagaag

SEQ ID NO: 2696625 - RNA, 12 nt, Human
ggauuuucagcc

SEQ ID NO: 2696626 - RNA, 16 nt, Human
ggccuccauccugagg

SEQ ID NO: 2696627 - RNA, 21 nt, Human
aaacauauauaacaaugcugu

SEQ ID NO: 2696628 - RNA, 16 nt, Human
aaacauauauaacaau

SEQ ID NO: 2696629 - RNA, 19 nt, Human
aaacauauauaacaaugcu

SEQ ID NO: 2696630 - RNA, 13 nt, Human
aaacauauauaac

SEQ ID NO: 2696631 - RNA, 14 nt, Human
aaacacaacuauau

SEQ ID NO: 2696632 - RNA, 17 nt, Human
aaacaaggaugaauuaa

SEQ ID NO: 2696633 - RNA, 19 nt, Human
aaaauuuuuucucuaggaa

SEQ ID NO: 2696634 - RNA, 16 nt, Human
aaacucauuucuagca

SEQ ID NO: 2696635 - RNA, 15 nt, Human
aaaccacagcaguug

SEQ ID NO: 2696636 - RNA, 16 nt, Human
aaaccacagcaguuga

SEQ ID NO: 2696637 - RNA, 24 nt, Human
ggucugugagaugcuagaacuccc

SEQ ID NO: 2696638 - RNA, 14 nt, Human
ggucugugagaugc

SEQ ID NO: 2696639 - RNA, 20 nt, Human
ggugauuuagcaggaagcug

SEQ ID NO: 2696640 - RNA, 15 nt, Human
ggugccaguuauggc

SEQ ID NO: 2696641 - RNA, 13 nt, Human
aaaggaauuuaaa

SEQ ID NO: 2696642 - RNA, 16 nt, Human
aaagaaugauuaugaa

SEQ ID NO: 2696643 - RNA, 23 nt, Human
aaagacuauucaaacagucucag

SEQ ID NO: 2696644 - RNA, 13 nt, Human
aaagacuccaaag

SEQ ID NO: 2696645 - RNA, 22 nt, Human
aaagacuauucaaacagucuca

SEQ ID NO: 2696646 - RNA, 18 nt, Human
aaagagaacuuccagauc

SEQ ID NO: 2696647 - RNA, 20 nt, Human
aaagaggcagcuugaaacug

SEQ ID NO: 2696648 - RNA, 21 nt, Human
aaaacuuuaugcuaagugaaa

SEQ ID NO: 2696649 - RNA, 22 nt, Human
aaaagcuccauuuuuagugaaa

SEQ ID NO: 2696650 - RNA, 20 nt, Human
gggaggcagagguugcagug

SEQ ID NO: 2696651 - RNA, 11 nt, Human
gggaggcagag

SEQ ID NO: 2696652 - RNA, 12 nt, Human
gggcagcugccu

SEQ ID NO: 2696653 - RNA, 13 nt, Human
gggcagcugccuc

SEQ ID NO: 2696654 - RNA, 14 nt, Human
gggcagcugccucc

SEQ ID NO: 2696655 - RNA, 19 nt, Human
gggcagcugccuccccucc

SEQ ID NO: 2696656 - RNA, 20 nt, Human
gggcagcugccuccccuccu

SEQ ID NO: 2696657 - RNA, 23 nt, Human
gggcagcugccuccccuccucug

SEQ ID NO: 2696658 - RNA, 17 nt, Human
gggauugaaggaugcug

SEQ ID NO: 2696659 - RNA, 21 nt, Human
gggauuuucagcccucagaau

SEQ ID NO: 2696660 - RNA, 20 nt, Human
aaaauaauuuuuauauuuga

SEQ ID NO: 2696661 - RNA, 21 nt, Human
aaaauaauuuuuauauuugaa

SEQ ID NO: 2696662 - RNA, 23 nt, Human
aaaauaauuuuuauauuugaaau

SEQ ID NO: 2696663 - RNA, 16 nt, Human
gacauuugcucaugga

SEQ ID NO: 2696664 - RNA, 17 nt, Human
gacauuugcucauggaa

SEQ ID NO: 2696665 - RNA, 21 nt, Human
gacagugagacucugucucag

SEQ ID NO: 2696666 - RNA, 21 nt, Human
gacagaaagcagaacagugau

SEQ ID NO: 2696667 - RNA, 15 nt, Human
gacacacugaagaag

SEQ ID NO: 2696668 - RNA, 16 nt, Human
gacacacugaagaagc

SEQ ID NO: 2696669 - RNA, 14 nt, Human
gacucuuaagaaga

SEQ ID NO: 2696670 - RNA, 18 nt, Human
gacucuuaagaagacugc

SEQ ID NO: 2696671 - RNA, 21 nt, Human
gacucuuaagaagacugcauu

SEQ ID NO: 2696672 - RNA, 15 nt, Human
gacgcucucuggccu

SEQ ID NO: 2696673 - RNA, 17 nt, Human
gacgcucucuggccuuc

SEQ ID NO: 2696674 - RNA, 16 nt, Human
gacgcucucuggccuu

SEQ ID NO: 2696675 - RNA, 19 nt, Human
gaacccgggaggcagaggu

SEQ ID NO: 2696676 - RNA, 14 nt, Human
gaacugaaaucaua

SEQ ID NO: 2696677 - RNA, 13 nt, Human
gaacugaaaucau

SEQ ID NO: 2696678 - RNA, 14 nt, Human
gaagcaaaauuuuu

SEQ ID NO: 2696679 - RNA, 23 nt, Human
gaagcaacccaaauguucaucaa

SEQ ID NO: 2696680 - RNA, 20 nt, Human
gcaaguauuagaauaccaca

SEQ ID NO: 2696681 - RNA, 22 nt, Human
gcaauagucaaauugugugaaa

SEQ ID NO: 2696682 - RNA, 22 nt, Human
gcacaguuuucugagaaagacu

SEQ ID NO: 2696683 - RNA, 20 nt, Human
gcacaguuuucugagaaaga

SEQ ID NO: 2696684 - RNA, 23 nt, Human
gcacaguuuucugagaaagacua

SEQ ID NO: 2696685 - RNA, 16 nt, Human
gaugaucuuuaaaaua

SEQ ID NO: 2696686 - RNA, 18 nt, Human
gauguagaggagaaacug

SEQ ID NO: 2696687 - RNA, 17 nt, Human
gauguagaggagaaacu

SEQ ID NO: 2696688 - RNA, 22 nt, Human
gaugguucccuugaugaagaag

SEQ ID NO: 2696689 - RNA, 15 nt, Human
gauuuaccacuugug

SEQ ID NO: 2696690 - RNA, 16 nt, Human
gauuuaccacuugugu

SEQ ID NO: 2696691 - RNA, 16 nt, Human
gaguuuaaauuguaau

SEQ ID NO: 2696692 - RNA, 18 nt, Human
gaggcuccacuuggucug

SEQ ID NO: 2696693 - RNA, 19 nt, Human
gaggcuccacuuggucugu

SEQ ID NO: 2696694 - RNA, 23 nt, Human
gaggcuccacuuggucugugaga

SEQ ID NO: 2696695 - RNA, 15 nt, Human
gaggacgcucucugg

SEQ ID NO: 2696696 - RNA, 23 nt, Human
cuucaugcugucuacacuaagag

SEQ ID NO: 2696697 - RNA, 11 nt, Human
cuucagacaua

SEQ ID NO: 2696698 - RNA, 15 nt, Human
cuucuguuuuauaau

SEQ ID NO: 2696699 - RNA, 20 nt, Human
cuucuguuuuauaauuuugu

SEQ ID NO: 2696700 - RNA, 20 nt, Human
cuuuaaagggauggcaagau

SEQ ID NO: 2696701 - RNA, 21 nt, Human
cuuugagugucuuaauuaaaa

SEQ ID NO: 2696702 - RNA, 20 nt, Human
cugcuuauccguuagccgug

SEQ ID NO: 2696703 - RNA, 12 nt, Human
cuggugccucac

SEQ ID NO: 2696704 - RNA, 21 nt, Human
cuggugccucaccccuugcca

SEQ ID NO: 2696705 - RNA, 13 nt, Human
cugggcagcugcc

SEQ ID NO: 2696706 - RNA, 14 nt, Human
cugggcagcugccu

SEQ ID NO: 2696707 - RNA, 15 nt, Human
cugggcagcugccuc

SEQ ID NO: 2696708 - RNA, 20 nt, Human
cugcacuccagccugagcga

SEQ ID NO: 2696709 - RNA, 17 nt, Human
cugcacuccagccugag

SEQ ID NO: 2696710 - RNA, 16 nt, Human
cugcacuccagccuga

SEQ ID NO: 2696711 - RNA, 14 nt, Human
cauuuguauaaaau

SEQ ID NO: 2696712 - RNA, 16 nt, Human
cauuuguauaaaauaa

SEQ ID NO: 2696713 - RNA, 14 nt, Human
ccaaaaggcagaag

SEQ ID NO: 2696714 - RNA, 21 nt, Human
ccaacuccagaaagugacaag

SEQ ID NO: 2696715 - RNA, 19 nt, Human
cauuauauuuauuacugua

SEQ ID NO: 2696716 - RNA, 13 nt, Human
caucagcugcuga

SEQ ID NO: 2696717 - RNA, 19 nt, Human
cauccugaggcuccacuug

SEQ ID NO: 2696718 - RNA, 18 nt, Human
cauccugaggcuccacuu

SEQ ID NO: 2696719 - RNA, 19 nt, Human
cauagcagcuuauucacaa

SEQ ID NO: 2696720 - RNA, 16 nt, Human
cauagguuuaauaauu

SEQ ID NO: 2696721 - RNA, 21 nt, Human
caguuauuauauuuacaaaug

SEQ ID NO: 2696722 - RNA, 17 nt, Human
caguuauuauauuuaca

SEQ ID NO: 2696723 - RNA, 20 nt, Human
caguuauggcuauaggugcu

SEQ ID NO: 2696724 - RNA, 19 nt, Human
caguuauggcuauaggugc

SEQ ID NO: 2696725 - RNA, 13 nt, Human
caguuauggcuau

SEQ ID NO: 2696726 - RNA, 22 nt, Human
cagugauuaccagggacugagg

SEQ ID NO: 2696727 - RNA, 15 nt, Human
caguucagagcugcc

SEQ ID NO: 2696728 - RNA, 16 nt, Human
caguucagagcugccc

SEQ ID NO: 2696729 - RNA, 17 nt, Human
caguucagagcugcccu

SEQ ID NO: 2696730 - RNA, 22 nt, Human
caguuauuauauuuacaaaugg

SEQ ID NO: 2696731 - RNA, 23 nt, Human
caguucagagcugcccucuccug

SEQ ID NO: 2696732 - RNA, 24 nt, Human
caguucagagcugcccucuccugg

SEQ ID NO: 2696733 - RNA, 18 nt, Human
caguucagagcugcccuc

SEQ ID NO: 2696734 - RNA, 19 nt, Human
caguucagagcugcccucu

SEQ ID NO: 2696735 - RNA, 21 nt, Human
caguucagagcugcccucucc

SEQ ID NO: 2696736 - RNA, 22 nt, Human
caguucagagcugcccucuccu

SEQ ID NO: 2696737 - RNA, 18 nt, Human
cagacuggcacaguuuuc

SEQ ID NO: 2696738 - RNA, 17 nt, Human
cagacuggcacaguuuu

SEQ ID NO: 2696739 - RNA, 23 nt, Human
cagacuggcacaguuuucugaga

SEQ ID NO: 2696740 - RNA, 22 nt, Human
cagacuggcacaguuuucugag

SEQ ID NO: 2696741 - RNA, 19 nt, Human
cagacuggauaguccgucu

SEQ ID NO: 2696742 - RNA, 23 nt, Human
cagccagcaguucagagcugccc

SEQ ID NO: 2696743 - RNA, 18 nt, Human
cagccagacuggcacagu

SEQ ID NO: 2696744 - RNA, 15 nt, Human
cagccagacuggcac

SEQ ID NO: 2696745 - RNA, 14 nt, Human
cagccagacuggca

SEQ ID NO: 2696746 - RNA, 18 nt, Human
cagagcugcccucuccug

SEQ ID NO: 2696747 - RNA, 19 nt, Human
cagagcugcccucuccugg

SEQ ID NO: 2696748 - RNA, 20 nt, Human
cagagcugcccucuccuggg

SEQ ID NO: 2696749 - RNA, 21 nt, Human
cagagcugcccucuccugggc

SEQ ID NO: 2696750 - RNA, 23 nt, Human
cagagcugcccucuccugggcag

SEQ ID NO: 2696751 - RNA, 11 nt, Human
caggcuacugu

SEQ ID NO: 2696752 - RNA, 16 nt, Human
caggaaagagaacuuc

SEQ ID NO: 2696753 - RNA, 20 nt, Human
caggaaagagaacuuccaga

SEQ ID NO: 2696754 - RNA, 14 nt, Human
cagcuuauugucua

SEQ ID NO: 2696755 - RNA, 20 nt, Human
cagcuguaugauucccagcc

SEQ ID NO: 2696756 - RNA, 20 nt, Human
cagcuuauugucuagugaaa

SEQ ID NO: 2696757 - RNA, 17 nt, Human
cagcuuauucacaagac

SEQ ID NO: 2696758 - RNA, 11 nt, Human
cagcugccucc

SEQ ID NO: 2696759 - RNA, 10 nt, Human
cagcugccuc

SEQ ID NO: 2696760 - RNA, 9 nt, Human
cagcugccu

SEQ ID NO: 2696761 - RNA, 14 nt, Human
cagcugccuccccu

SEQ ID NO: 2696762 - RNA, 15 nt, Human
cagcugccuccccuc

SEQ ID NO: 2696763 - RNA, 16 nt, Human
cagcugccuccccucc

SEQ ID NO: 2696764 - RNA, 17 nt, Human
cagcugccuccccuccu

SEQ ID NO: 2696765 - RNA, 18 nt, Human
cagcugccuccccuccuc

SEQ ID NO: 2696766 - RNA, 19 nt, Human
cagcugccuccccuccucu

SEQ ID NO: 2696767 - RNA, 20 nt, Human
cagcugccuccccuccucug

SEQ ID NO: 2696768 - RNA, 19 nt, Human
cagcuguaugauucccagc

SEQ ID NO: 2696769 - RNA, 17 nt, Human
caaucagccuaguugau

SEQ ID NO: 2696770 - RNA, 19 nt, Human
caacuauauuguuugcuaa

SEQ ID NO: 2696771 - RNA, 19 nt, Human
caacuaucucauuuccaag

SEQ ID NO: 2696772 - RNA, 12 nt, Human
caacuccagaaa

SEQ ID NO: 2696773 - RNA, 14 nt, Human
caagcaaguauuag

SEQ ID NO: 2696774 - RNA, 21 nt, Human
cacuccagugagacagcucug

SEQ ID NO: 2696775 - RNA, 16 nt, Human
cacuccagugagacag

SEQ ID NO: 2696776 - RNA, 11 nt, Human
cacugaagaag

SEQ ID NO: 2696777 - RNA, 23 nt, Human
cacugaagaagcaccaaucauga

SEQ ID NO: 2696778 - RNA, 23 nt, Human
cacaucagcuugcccuguuaaaa

SEQ ID NO: 2696779 - RNA, 13 nt, Human
cacaucagcuugc

SEQ ID NO: 2696780 - RNA, 18 nt, Human
auuuucuauaauuuaaau

SEQ ID NO: 2696781 - RNA, 17 nt, Human
auuuucuauaauuuaaa

SEQ ID NO: 2696782 - RNA, 19 nt, Human
auuuucuauaauuuaaaua

SEQ ID NO: 2696783 - RNA, 21 nt, Human
caaaagguauuuuaaucacca

SEQ ID NO: 2696784 - RNA, 17 nt, Human
caaacauauauaacaau

SEQ ID NO: 2696785 - RNA, 19 nt, Human
auuuuuauauuugaaauau

SEQ ID NO: 2696786 - RNA, 16 nt, Human
auuuuuauauuugaaa

SEQ ID NO: 2696787 - RNA, 16 nt, Human
auuucagcagcugcag

SEQ ID NO: 2696788 - RNA, 22 nt, Human
auugaggacacugauauggguc

SEQ ID NO: 2696789 - RNA, 12 nt, Human
ccuuuucccaac

SEQ ID NO: 2696790 - RNA, 20 nt, Human
cuacaaaaacacagcaaggg

SEQ ID NO: 2696791 - RNA, 20 nt, Human
cuaacgaaguauccuucagc

SEQ ID NO: 2696792 - RNA, 17 nt, Human
ccuucucuucacaguca

SEQ ID NO: 2696793 - RNA, 18 nt, Human
cuauguucuaagaaguga

SEQ ID NO: 2696794 - RNA, 18 nt, Human
cuaucucauuuccaagca

SEQ ID NO: 2696795 - RNA, 23 nt, Human
cuaugucauuugcuggagcucug

SEQ ID NO: 2696796 - RNA, 16 nt, Human
cucaguccaugaagau

SEQ ID NO: 2696797 - RNA, 19 nt, Human
cucccuccaccucccugca

SEQ ID NO: 2696798 - RNA, 20 nt, Human
cucccuccaccucccugcaa

SEQ ID NO: 2696799 - RNA, 21 nt, Human
cucccuccaccucccugcaau

SEQ ID NO: 2696800 - RNA, 22 nt, Human
cucccuccaccucccugcaaua

SEQ ID NO: 2696801 - RNA, 16 nt, Human
cucucuguaauaaacu

SEQ ID NO: 2696802 - RNA, 21 nt, Human
cucucuguaauaaacucauuu

SEQ ID NO: 2696803 - RNA, 13 nt, Human
cucucuggccuuc

SEQ ID NO: 2696804 - RNA, 16 nt, Human
cucucuggccuucggc

SEQ ID NO: 2696805 - RNA, 14 nt, Human
cucucuggccuucg

SEQ ID NO: 2696806 - RNA, 16 nt, Human
cucuccccaugauguu

SEQ ID NO: 2696807 - RNA, 15 nt, Human
cucuccccaugaugu

SEQ ID NO: 2696808 - RNA, 19 nt, Human
cucuauguucuaagaagug

SEQ ID NO: 2696809 - RNA, 20 nt, Human
ccuaacgaaguauccuucag

SEQ ID NO: 2696810 - RNA, 14 nt, Human
cccugagcaggauu

SEQ ID NO: 2696811 - RNA, 13 nt, Human
cccucggagaaga

SEQ ID NO: 2696812 - RNA, 17 nt, Human
ccucuccugggcagcug

SEQ ID NO: 2696813 - RNA, 18 nt, Human
ccucuccugggcagcugc

SEQ ID NO: 2696814 - RNA, 19 nt, Human
ccucuccugggcagcugcc

SEQ ID NO: 2696815 - RNA, 20 nt, Human
ccucuccugggcagcugccu

SEQ ID NO: 2696816 - RNA, 15 nt, Human
ccucuccugggcagc

SEQ ID NO: 2696817 - RNA, 16 nt, Human
ccucuccugggcagcu

SEQ ID NO: 2696818 - RNA, 21 nt, Human
ccucuccugggcagcugccuc

SEQ ID NO: 2696819 - RNA, 22 nt, Human
ccucuccugggcagcugccucc

SEQ ID NO: 2696820 - RNA, 15 nt, Human
ccccauuguggucac

SEQ ID NO: 2696821 - RNA, 18 nt, Human
ccaugggcacugugggua

SEQ ID NO: 2696822 - RNA, 22 nt, Human
ccauuguggucacaggaaguag

SEQ ID NO: 2696823 - RNA, 13 nt, Human
ccauuuaaagcuu

SEQ ID NO: 2696824 - RNA, 12 nt, Human
ccacuuggucug

SEQ ID NO: 2696825 - RNA, 19 nt, Human
ccacuuggucugugagaug

SEQ ID NO: 2696826 - RNA, 17 nt, Human
ccacuuggucugugaga

SEQ ID NO: 2696827 - RNA, 16 nt, Human
ccacuuggucugugag

SEQ ID NO: 2696828 - RNA, 15 nt, Human
ccacuuggucuguga

SEQ ID NO: 2696829 - RNA, 22 nt, Human
ccacuuggucugugagaugcua

SEQ ID NO: 2696830 - RNA, 20 nt, Human
ccacuuggucugugagaugc

SEQ ID NO: 2696831 - RNA, 15 nt, Human
ccaggggccaugaau

SEQ ID NO: 2696832 - RNA, 18 nt, Human
aaauuucagcagcugcag

SEQ ID NO: 2696833 - RNA, 17 nt, Human
aaauuucagcagcugca

SEQ ID NO: 2696834 - RNA, 22 nt, Human
aaauguaagggaaacugccagc

SEQ ID NO: 2696835 - RNA, 14 nt, Human
guaugauucccagc

SEQ ID NO: 2696836 - RNA, 19 nt, Human
aaaucuacacuccagugag

SEQ ID NO: 2696837 - RNA, 14 nt, Human
aaauccuugaagau

SEQ ID NO: 2696838 - RNA, 22 nt, Human
aaaugaaagcagggacuugaac

SEQ ID NO: 2696839 - RNA, 21 nt, Human
aaaugaaagcagggacuugaa

SEQ ID NO: 2696840 - RNA, 14 nt, Human
aaaugcauuucuaa

SEQ ID NO: 2696841 - RNA, 19 nt, Human
aaauggcuuccuggcaaua

SEQ ID NO: 2696842 - RNA, 18 nt, Human
aacauuugguaaggggaa

SEQ ID NO: 2696843 - RNA, 22 nt, Human
aacaguagugauaguuguaccg

SEQ ID NO: 2696844 - RNA, 21 nt, Human
aacaagccuccuuuuaaagua

SEQ ID NO: 2696845 - RNA, 15 nt, Human
aacaaggaugaauua

SEQ ID NO: 2696846 - RNA, 21 nt, Human
guccaagcauuuagauguaua

SEQ ID NO: 2696847 - RNA, 24 nt, Human
guccaagcauaccaacacgagcag

SEQ ID NO: 2696848 - RNA, 14 nt, Human
aacuccagaaagug

SEQ ID NO: 2696849 - RNA, 21 nt, Human
aacuccagaaagugacaagcu

SEQ ID NO: 2696850 - RNA, 14 nt, Human
aacucccuuucaac

SEQ ID NO: 2696851 - RNA, 13 nt, Human
aacucccuuucaa

SEQ ID NO: 2696852 - RNA, 18 nt, Human
aacucguuaauuuguagu

SEQ ID NO: 2696853 - RNA, 15 nt, Human
gugaacacaucagcu

SEQ ID NO: 2696854 - RNA, 21 nt, Human
gucuuaauuaaaagaauauuu

SEQ ID NO: 2696855 - RNA, 19 nt, Human
gucuuaauuaaaagaauau

SEQ ID NO: 2696856 - RNA, 22 nt, Human
gucuuaauuaaaagaauauuuu

SEQ ID NO: 2696857 - RNA, 12 nt, Human
aaccacagcagu

SEQ ID NO: 2696858 - RNA, 20 nt, Human
aaccuagggugauauuaacc

SEQ ID NO: 2696859 - RNA, 18 nt, Human
aacccaaauguucaucaa

SEQ ID NO: 2696860 - RNA, 13 nt, Human
aacccaaauguuc

SEQ ID NO: 2696861 - RNA, 20 nt, Human
aacccauauuuguacaccaa

SEQ ID NO: 2696862 - RNA, 18 nt, Human
guuguaccgcaaugugac

SEQ ID NO: 2696863 - RNA, 16 nt, Human
guuuaaaaucauuucu

SEQ ID NO: 2696864 - RNA, 10 nt, Human
guuuaaaauc

SEQ ID NO: 2696865 - RNA, 21 nt, Human
guuucaaacauauauaacaau

SEQ ID NO: 2696866 - RNA, 13 nt, Human
aagguacuucaaa

SEQ ID NO: 2696867 - RNA, 23 nt, Human
guuuucugagaaagacuauucaa

SEQ ID NO: 2696868 - RNA, 23 nt, Human
aagcuuguauuccuuuuucucuc

SEQ ID NO: 2696869 - RNA, 14 nt, Human
guugacaugggaca

SEQ ID NO: 2696870 - RNA, 18 nt, Human
guugacaugggacauuug

SEQ ID NO: 2696871 - RNA, 13 nt, Human
guugacaugggac

SEQ ID NO: 2696872 - RNA, 21 nt, Human
gugugaccacugcagaagaca

SEQ ID NO: 2696873 - RNA, 19 nt, Human
aagagcuguucacagccag

SEQ ID NO: 2696874 - RNA, 21 nt, Human
gugggacagucaccucaugga

SEQ ID NO: 2696875 - RNA, 18 nt, Human
gugcuaguaauuggaaag

SEQ ID NO: 2696876 - RNA, 22 nt, Human
aagaagugaaaaucuacacucc

SEQ ID NO: 2696877 - RNA, 16 nt, Human
aagaagugaaaaucua

SEQ ID NO: 2696878 - RNA, 16 nt, Human
aagaaugauuaugaau

SEQ ID NO: 2696879 - RNA, 18 nt, Human
aagaaugauuaugaauua

SEQ ID NO: 2696880 - RNA, 21 nt, Human
aaugagagacacacugaagaa

SEQ ID NO: 2696881 - RNA, 16 nt, Human
uaaugauaacuggaaa

SEQ ID NO: 2696882 - RNA, 18 nt, Human
uaaguuuuuuuuuaaaaa

SEQ ID NO: 2696883 - RNA, 23 nt, Human
aaucaugaauuaguuuuauaugc

SEQ ID NO: 2696884 - RNA, 19 nt, Human
aaucaugaauuaguuuuau

SEQ ID NO: 2696885 - RNA, 17 nt, Human
aaucaugaauuaguuuu

SEQ ID NO: 2696886 - RNA, 15 nt, Human
aaucaucaagucuuu

SEQ ID NO: 2696887 - RNA, 13 nt, Human
aauccuugaagau

SEQ ID NO: 2696888 - RNA, 16 nt, Human
aaucuuauaauuuaaa

SEQ ID NO: 2696889 - RNA, 14 nt, Human
aaucuuauaauuua

SEQ ID NO: 2696890 - RNA, 15 nt, Human
uacaaaaacacagca

SEQ ID NO: 2696891 - RNA, 16 nt, Human
uacaaaaacacagcaa

SEQ ID NO: 2696892 - RNA, 14 nt, Human
uacaaaaacacagc

SEQ ID NO: 2696893 - RNA, 13 nt, Human
uacaaaaacacag

SEQ ID NO: 2696894 - RNA, 19 nt, Human
uacacuaagagagaaugag

SEQ ID NO: 2696895 - RNA, 19 nt, Human
aauggacuuuuguacauag

SEQ ID NO: 2696896 - RNA, 11 nt, Human
aaugugauaug

SEQ ID NO: 2696897 - RNA, 20 nt, Human
aauaauuuuuauauuugaaa

SEQ ID NO: 2696898 - RNA, 17 nt, Human
aauaauuuuuauauuug

SEQ ID NO: 2696899 - RNA, 19 nt, Human
aauaauuuuuauauuugaa

SEQ ID NO: 2696900 - RNA, 16 nt, Human
aauaauuuuuauauuu

SEQ ID NO: 2696901 - RNA, 21 nt, Human
aauaacaaugaaaguugauaa

SEQ ID NO: 2696902 - RNA, 19 nt, Human
aauaucuuuuuuuuaauaa

SEQ ID NO: 2696903 - RNA, 15 nt, Human
aauauuucagauaau

SEQ ID NO: 2696904 - RNA, 14 nt, Human
aauauuucagauaa

SEQ ID NO: 2696905 - RNA, 24 nt, Human
aauaugcaaagcacugacuucuaa

SEQ ID NO: 2696906 - RNA, 17 nt, Human
aauaugcaaagcacuga

SEQ ID NO: 2696907 - RNA, 15 nt, Human
aauaugcaaagcacu

SEQ ID NO: 2696908 - RNA, 15 nt, Human
aauaucacuugucaa

SEQ ID NO: 2696909 - RNA, 12 nt, Human
aauaucacuugu

SEQ ID NO: 2696910 - RNA, 18 nt, Human
aauaggcguaacuaauuu

SEQ ID NO: 2696911 - RNA, 16 nt, Human
uagcuacuaauuuuaa

SEQ ID NO: 2696912 - RNA, 17 nt, Human
acaaauuuacagagaca

SEQ ID NO: 2696913 - RNA, 22 nt, Human
acaagcucacagaccuuugaac

SEQ ID NO: 2696914 - RNA, 22 nt, Human
aauuuuuucucuaggaaauauu

SEQ ID NO: 2696915 - RNA, 21 nt, Human
aauuuuucuuauuucauuucu

SEQ ID NO: 2696916 - RNA, 21 nt, Human
uagaugcaguucugaagaaga

SEQ ID NO: 2696917 - RNA, 20 nt, Human
uagaugcaguucugaagaag

SEQ ID NO: 2696918 - RNA, 22 nt, Human
uagauaggucagugcaaauacu

SEQ ID NO: 2696919 - RNA, 17 nt, Human
uagauaggccaugggca

SEQ ID NO: 2696920 - RNA, 16 nt, Human
uacuucaugcugucua

SEQ ID NO: 2696921 - RNA, 19 nt, Human
uacuucuuaggguuaugau

SEQ ID NO: 2696922 - RNA, 18 nt, Human
aauuuacagagacagaaa

SEQ ID NO: 2696923 - RNA, 17 nt, Human
aauuuacagagacagaa

SEQ ID NO: 2696924 - RNA, 15 nt, Human
aauuggagcucgugg

SEQ ID NO: 2696925 - RNA, 19 nt, Human
aauuucucccagucauuua

SEQ ID NO: 2696926 - RNA, 18 nt, Human
aauugaggacacugauau

SEQ ID NO: 2696927 - RNA, 17 nt, Human
uacugagagugaacaaa

SEQ ID NO: 2696928 - RNA, 23 nt, Human
uacugggaaagggauuuucagcc

SEQ ID NO: 2696929 - RNA, 14 nt, Human
uacuaaaaauacaa

SEQ ID NO: 2696930 - RNA, 18 nt, Human
uacuaaaaauacaaaaaa

SEQ ID NO: 2696931 - RNA, 13 nt, Human
acacacugaagaa

SEQ ID NO: 2696932 - RNA, 20 nt, Human
acacacucaaaucaagaaac

SEQ ID NO: 2696933 - RNA, 14 nt, Human
acacaacuauauug

SEQ ID NO: 2696934 - RNA, 17 nt, Human
acacaacuauauuguuu

SEQ ID NO: 2696935 - RNA, 14 nt, Human
acaaugcuguauuu

SEQ ID NO: 2696936 - RNA, 17 nt, Human
acaaugcuguauuuuaa

SEQ ID NO: 2696937 - RNA, 14 nt, Human
acacacugaagaag

SEQ ID NO: 2696938 - RNA, 16 nt, Human
uaguguuggagaagaa

SEQ ID NO: 2696939 - RNA, 17 nt, Human
uaguguuggagaagaac

SEQ ID NO: 2696940 - RNA, 12 nt, Human
uaguguuggaga

SEQ ID NO: 2696941 - RNA, 17 nt, Human
acacuaagagagaauga

SEQ ID NO: 2696942 - RNA, 18 nt, Human
acacuaagagagaaugag

SEQ ID NO: 2696943 - RNA, 19 nt, Human
acacuaagagagaaugaga

SEQ ID NO: 2696944 - RNA, 18 nt, Human
acacaugcugaacaucac

SEQ ID NO: 2696945 - RNA, 23 nt, Human
uauaaaauaauuuuuauauuuga

SEQ ID NO: 2696946 - RNA, 14 nt, Human
acacuccagugaga

SEQ ID NO: 2696947 - RNA, 12 nt, Human
acacugaagaag

SEQ ID NO: 2696948 - RNA, 14 nt, Human
acacugaagaagca

SEQ ID NO: 2696949 - RNA, 12 nt, Human
uauauuuacaaa

SEQ ID NO: 2696950 - RNA, 15 nt, Human
acacuuaaaaauggu

SEQ ID NO: 2696951 - RNA, 13 nt, Human
acacuuaaaaaug

SEQ ID NO: 2696952 - RNA, 20 nt, Human
acagcccuucuuuccacaga

SEQ ID NO: 2696953 - RNA, 21 nt, Human
acagcccuucuuuccacagaa

SEQ ID NO: 2696954 - RNA, 19 nt, Human
uauauuuauuacuguaaga

SEQ ID NO: 2696955 - RNA, 15 nt, Human
uauauuuauuacugu

SEQ ID NO: 2696956 - RNA, 19 nt, Human
acaugauccugcaauucca

SEQ ID NO: 2696957 - RNA, 14 nt, Human
ucaaagcugaaaug

SEQ ID NO: 2696958 - RNA, 18 nt, Human
ucaaaagaaagaaaauca

SEQ ID NO: 2696959 - RNA, 21 nt, Human
ucaaaauaccaugccauuuaa

SEQ ID NO: 2696960 - RNA, 23 nt, Human
ucaaaauaccaugccauuuaaag

SEQ ID NO: 2696961 - RNA, 21 nt, Human
ucaaaauaugccccauucaac

SEQ ID NO: 2696962 - RNA, 14 nt, Human
acaugcugaacauc

SEQ ID NO: 2696963 - RNA, 21 nt, Human
acaugcugaacaucacagcuu

SEQ ID NO: 2696964 - RNA, 22 nt, Human
ucaagaugaugaugaucuuuaa

SEQ ID NO: 2696965 - RNA, 15 nt, Human
acaguuuucugagaa

SEQ ID NO: 2696966 - RNA, 17 nt, Human
acaguuuucugagaaag

SEQ ID NO: 2696967 - RNA, 16 nt, Human
acaguuuucugagaaa

SEQ ID NO: 2696968 - RNA, 21 nt, Human
acaguuuucugagaaagacua

SEQ ID NO: 2696969 - RNA, 20 nt, Human
acaguuuucugagaaagacu

SEQ ID NO: 2696970 - RNA, 19 nt, Human
acaguuuucugagaaagac

SEQ ID NO: 2696971 - RNA, 18 nt, Human
acaguuuucugagaaaga

SEQ ID NO: 2696972 - RNA, 21 nt, Human
uaugaaauauuauguuaaaac

SEQ ID NO: 2696973 - RNA, 13 nt, Human
uauuucauuucuu

SEQ ID NO: 2696974 - RNA, 13 nt, Human
acaucaacagaua

SEQ ID NO: 2696975 - RNA, 19 nt, Human
acauauauaacaaugcugu

SEQ ID NO: 2696976 - RNA, 18 nt, Human
acauagaauuaacacaug

SEQ ID NO: 2696977 - RNA, 14 nt, Human
acauagaauuaaca

SEQ ID NO: 2696978 - RNA, 14 nt, Human
accagggacugagg

SEQ ID NO: 2696979 - RNA, 18 nt, Human
accacuuguguuuugcaa

SEQ ID NO: 2696980 - RNA, 15 nt, Human
ucaauucuugccaaa

SEQ ID NO: 2696981 - RNA, 23 nt, Human
ucaauuuuucuuauuucauuucu

SEQ ID NO: 2696982 - RNA, 20 nt, Human
ucaauuuuucuuauuucauu

SEQ ID NO: 2696983 - RNA, 13 nt, Human
accaaucaugaau

SEQ ID NO: 2696984 - RNA, 15 nt, Human
accaaucaugaauua

SEQ ID NO: 2696985 - RNA, 23 nt, Human
accauuucuugagguaaaagcau

SEQ ID NO: 2696986 - RNA, 12 nt, Human
ucagagcugccc

SEQ ID NO: 2696987 - RNA, 13 nt, Human
ucaggaaagagaa

SEQ ID NO: 2696988 - RNA, 19 nt, Human
ucaggaaagagaacuucca

SEQ ID NO: 2696989 - RNA, 21 nt, Human
ucaggaaaucaaauaugcaaa

SEQ ID NO: 2696990 - RNA, 20 nt, Human
ucaggaaaucaaauaugcaa

SEQ ID NO: 2696991 - RNA, 19 nt, Human
uccauccugaggcuccacu

SEQ ID NO: 2696992 - RNA, 21 nt, Human
uccauccugaggcuccacuug

SEQ ID NO: 2696993 - RNA, 20 nt, Human
uccauccugaggcuccacuu

SEQ ID NO: 2696994 - RNA, 13 nt, Human
uccaugaagaugu

SEQ ID NO: 2696995 - RNA, 21 nt, Human
uccaugaagauguagaggaga

SEQ ID NO: 2696996 - RNA, 22 nt, Human
ucccagucauuuaauaaaugug

SEQ ID NO: 2696997 - RNA, 14 nt, Human
ucccagucauuuaa

SEQ ID NO: 2696998 - RNA, 17 nt, Human
ucccagccagcaguuca

SEQ ID NO: 2696999 - RNA, 18 nt, Human
ucccagccagcaguucag

SEQ ID NO: 2697000 - RNA, 16 nt, Human
uccccucggagaagag

SEQ ID NO: 2697001 - RNA, 17 nt, Human
uccccucggagaagagc

SEQ ID NO: 2697002 - RNA, 13 nt, Human
ucccucccuccac

SEQ ID NO: 2697003 - RNA, 14 nt, Human
ucccucccuccacc

SEQ ID NO: 2697004 - RNA, 21 nt, Human
ucccuccaccucccugcaaua

SEQ ID NO: 2697005 - RNA, 23 nt, Human
ucccuccaccucccugcaauaaa

SEQ ID NO: 2697006 - RNA, 15 nt, Human
ucccucccuccaccu

SEQ ID NO: 2697007 - RNA, 16 nt, Human
ucccucccuccaccuc

SEQ ID NO: 2697008 - RNA, 11 nt, Human
ucccugagcag

SEQ ID NO: 2697009 - RNA, 14 nt, Human
acuccaaagaaaug

SEQ ID NO: 2697010 - RNA, 18 nt, Human
acuccaaagaaauguaag

SEQ ID NO: 2697011 - RNA, 15 nt, Human
acuccaaagaaaugu

SEQ ID NO: 2697012 - RNA, 21 nt, Human
acuccaaagaaauguaaggga

SEQ ID NO: 2697013 - RNA, 21 nt, Human
ucaugaauuaguuuuauaugc

SEQ ID NO: 2697014 - RNA, 21 nt, Human
accuagggugauauuaaccag

SEQ ID NO: 2697015 - RNA, 23 nt, Human
ucaggaaaucaaauaugcaaagc

SEQ ID NO: 2697016 - RNA, 22 nt, Human
ucaggaaaucaaauaugcaaag

SEQ ID NO: 2697017 - RNA, 16 nt, Human
ucaugaauuaguuuua

SEQ ID NO: 2697018 - RNA, 12 nt, Human
accucccugcaa

SEQ ID NO: 2697019 - RNA, 13 nt, Human
accucccugcaau

SEQ ID NO: 2697020 - RNA, 14 nt, Human
acgagaaaacaaua

SEQ ID NO: 2697021 - RNA, 20 nt, Human
acgagcaggcuacugucagc

SEQ ID NO: 2697022 - RNA, 19 nt, Human
acgagcaggcuacugucag

SEQ ID NO: 2697023 - RNA, 21 nt, Human
uccaacuaucucauuuccaag

SEQ ID NO: 2697024 - RNA, 18 nt, Human
ucgcuccaccuugcagcu

SEQ ID NO: 2697025 - RNA, 14 nt, Human
acugcauuauauuu

SEQ ID NO: 2697026 - RNA, 15 nt, Human
acugcauuauauuua

SEQ ID NO: 2697027 - RNA, 13 nt, Human
acugccuucucaa

SEQ ID NO: 2697028 - RNA, 19 nt, Human
acugccuucucaacuccaa

SEQ ID NO: 2697029 - RNA, 20 nt, Human
acugccuucucaacuccaaa

SEQ ID NO: 2697030 - RNA, 20 nt, Human
acuggcacaguuuucugaga

SEQ ID NO: 2697031 - RNA, 19 nt, Human
acuggcacaguuuucugag

SEQ ID NO: 2697032 - RNA, 13 nt, Human
acuggcacaguuu

SEQ ID NO: 2697033 - RNA, 20 nt, Human
ucuaaagccauuguaguccu

SEQ ID NO: 2697034 - RNA, 22 nt, Human
ucuaaguaaaaccacagcaguu

SEQ ID NO: 2697035 - RNA, 21 nt, Human
ucuaaguaaaaccacagcagu

SEQ ID NO: 2697036 - RNA, 16 nt, Human
ucuacauacuauggaa

SEQ ID NO: 2697037 - RNA, 23 nt, Human
ucuaaguaaaaccacagcaguug

SEQ ID NO: 2697038 - RNA, 18 nt, Human
acugggacaggggagaac

SEQ ID NO: 2697039 - RNA, 21 nt, Human
acugucagcuccccucggaga

SEQ ID NO: 2697040 - RNA, 18 nt, Human
acuguggguagacacaca

SEQ ID NO: 2697041 - RNA, 22 nt, Human
ucggguuuuauuguuuaaaauc

SEQ ID NO: 2697042 - RNA, 14 nt, Human
agaaaugaaagcag

SEQ ID NO: 2697043 - RNA, 12 nt, Human
ucugaagaagau

SEQ ID NO: 2697044 - RNA, 22 nt, Human
ucucuggccuucggccuccauc

SEQ ID NO: 2697045 - RNA, 21 nt, Human
ucucuggccuucggccuccau

SEQ ID NO: 2697046 - RNA, 23 nt, Human
ucucuggccuucggccuccaucc

SEQ ID NO: 2697047 - RNA, 12 nt, Human
ucucuggccuuc

SEQ ID NO: 2697048 - RNA, 20 nt, Human
acuugaacccgggaggcaga

SEQ ID NO: 2697049 - RNA, 19 nt, Human
acuugaacccgggaggcag

SEQ ID NO: 2697050 - RNA, 21 nt, Human
acuugaacccauauuuguaca

SEQ ID NO: 2697051 - RNA, 16 nt, Human
acuugucaauaaaauc

SEQ ID NO: 2697052 - RNA, 23 nt, Human
acuucuaaguaaaaccacagcag

SEQ ID NO: 2697053 - RNA, 12 nt, Human
ucucaggaaauc

SEQ ID NO: 2697054 - RNA, 16 nt, Human
acuuguguuuugcaag

SEQ ID NO: 2697055 - RNA, 16 nt, Human
agacacacugaagaag

SEQ ID NO: 2697056 - RNA, 17 nt, Human
agacacacugaagaagc

SEQ ID NO: 2697057 - RNA, 23 nt, Human
ucuuagaugcaguucugaagaag

SEQ ID NO: 2697058 - RNA, 22 nt, Human
ucuuagaugcaguucugaagaa

SEQ ID NO: 2697059 - RNA, 24 nt, Human
agagacagaaagcagaacagugau

SEQ ID NO: 2697060 - RNA, 15 nt, Human
ucuuauuucauuucu

SEQ ID NO: 2697061 - RNA, 16 nt, Human
ucuuauuucauuucuu

SEQ ID NO: 2697062 - RNA, 23 nt, Human
agacuauucaaacagucucagga

SEQ ID NO: 2697063 - RNA, 16 nt, Human
agaguuuagcuggaaa

SEQ ID NO: 2697064 - RNA, 17 nt, Human
agaguuuagcuggaaaa

SEQ ID NO: 2697065 - RNA, 15 nt, Human
agaugcuagaacucc

SEQ ID NO: 2697066 - RNA, 14 nt, Human
agaugcuagaacuc

SEQ ID NO: 2697067 - RNA, 18 nt, Human
agaugcaguucugaagaa

SEQ ID NO: 2697068 - RNA, 19 nt, Human
agaugcaguucugaagaag

SEQ ID NO: 2697069 - RNA, 17 nt, Human
agaugcaguucugaaga

SEQ ID NO: 2697070 - RNA, 17 nt, Human
ugacccacaagaaauga

SEQ ID NO: 2697071 - RNA, 15 nt, Human
agagguugcagugag

SEQ ID NO: 2697072 - RNA, 21 nt, Human
agagcuguucacagccagacu

SEQ ID NO: 2697073 - RNA, 19 nt, Human
agagcuguucacagccaga

SEQ ID NO: 2697074 - RNA, 22 nt, Human
agagcugcccucuccugggcag

SEQ ID NO: 2697075 - RNA, 23 nt, Human
ugaacuagaguuuagcuggaaaa

SEQ ID NO: 2697076 - RNA, 18 nt, Human
ugaacaaauuuacagaga

SEQ ID NO: 2697077 - RNA, 20 nt, Human
ugaacaaauuuacagagaca

SEQ ID NO: 2697078 - RNA, 19 nt, Human
ugaacaaauuuacagagac

SEQ ID NO: 2697079 - RNA, 18 nt, Human
ugaaauauuauguuaaaa

SEQ ID NO: 2697080 - RNA, 15 nt, Human
ugaaauuguauuaca

SEQ ID NO: 2697081 - RNA, 15 nt, Human
agagcugcccucucc

SEQ ID NO: 2697082 - RNA, 13 nt, Human
agagcugcccucu

SEQ ID NO: 2697083 - RNA, 14 nt, Human
agagcugcccucuc

SEQ ID NO: 2697084 - RNA, 23 nt, Human
ugaaauaagccagacaucaacag

SEQ ID NO: 2697085 - RNA, 20 nt, Human
ugaaauaagccagacaucaa

SEQ ID NO: 2697086 - RNA, 18 nt, Human
ugaaauaagccagacauc

SEQ ID NO: 2697087 - RNA, 17 nt, Human
ugaaauaagccagacau

SEQ ID NO: 2697088 - RNA, 20 nt, Human
agcaucacaugaacuuguaa

SEQ ID NO: 2697089 - RNA, 22 nt, Human
agcauuuagauguauagguuga

SEQ ID NO: 2697090 - RNA, 16 nt, Human
ugauuaaguaaugaua

SEQ ID NO: 2697091 - RNA, 15 nt, Human
ugauuaaguaaugau

SEQ ID NO: 2697092 - RNA, 14 nt, Human
agcaggcuacuguc

SEQ ID NO: 2697093 - RNA, 20 nt, Human
agcaggcuacugucagcucc

SEQ ID NO: 2697094 - RNA, 19 nt, Human
agcaggcuacugucagcuc

SEQ ID NO: 2697095 - RNA, 17 nt, Human
agcaggcuacugucagc

SEQ ID NO: 2697096 - RNA, 16 nt, Human
agcaggcuacugucag

SEQ ID NO: 2697097 - RNA, 20 nt, Human
agcaggaagcugugagagca

SEQ ID NO: 2697098 - RNA, 19 nt, Human
agcagggcauggcugggaa

SEQ ID NO: 2697099 - RNA, 22 nt, Human
agcauaccaacacgagcaggcu

SEQ ID NO: 2697100 - RNA, 19 nt, Human
agcauaccaacacgagcag

SEQ ID NO: 2697101 - RNA, 13 nt, Human
agcauaccaacac

SEQ ID NO: 2697102 - RNA, 19 nt, Human
agcagucaggaaagagaac

SEQ ID NO: 2697103 - RNA, 20 nt, Human
agcaguuugguuucuagcau

SEQ ID NO: 2697104 - RNA, 22 nt, Human
agcaguuugguuucuagcauga

SEQ ID NO: 2697105 - RNA, 23 nt, Human
agcaguuugguuucuagcaugaa

SEQ ID NO: 2697106 - RNA, 17 nt, Human
agcagucaggaaagaga

SEQ ID NO: 2697107 - RNA, 18 nt, Human
agcagucaggaaagagaa

SEQ ID NO: 2697108 - RNA, 13 nt, Human
ugccauaauuacu

SEQ ID NO: 2697109 - RNA, 17 nt, Human
ugccaguuauggcuaua

SEQ ID NO: 2697110 - RNA, 19 nt, Human
agccugagcgacagugaga

SEQ ID NO: 2697111 - RNA, 19 nt, Human
ugcauacucauuaggaugg

SEQ ID NO: 2697112 - RNA, 13 nt, Human
ugcauacucauua

SEQ ID NO: 2697113 - RNA, 20 nt, Human
ugcauagauucccugagcag

SEQ ID NO: 2697114 - RNA, 17 nt, Human
ugcaauaaaauggguuu

SEQ ID NO: 2697115 - RNA, 21 nt, Human
ugcaauaaaauggguuuuacu

SEQ ID NO: 2697116 - RNA, 15 nt, Human
ugcaagccagauuuu

SEQ ID NO: 2697117 - RNA, 21 nt, Human
ugcaagccagauuuuccugaa

SEQ ID NO: 2697118 - RNA, 18 nt, Human
ugcaaagcacugacuucu

SEQ ID NO: 2697119 - RNA, 22 nt, Human
ugcaaagcacugacuucuaagu

SEQ ID NO: 2697120 - RNA, 20 nt, Human
ugcaaagcacugacuucuaa

SEQ ID NO: 2697121 - RNA, 13 nt, Human
ugauuucauucaa

SEQ ID NO: 2697122 - RNA, 22 nt, Human
ugcagaagacaguauggcagcu

SEQ ID NO: 2697123 - RNA, 17 nt, Human
ugcacuccagccugagc

SEQ ID NO: 2697124 - RNA, 15 nt, Human
ugcacuccagccuga

SEQ ID NO: 2697125 - RNA, 20 nt, Human
aggacgcucucuggccuucg

SEQ ID NO: 2697126 - RNA, 19 nt, Human
aggacgcucucuggccuuc

SEQ ID NO: 2697127 - RNA, 17 nt, Human
aggacgcucucuggccu

SEQ ID NO: 2697128 - RNA, 16 nt, Human
aggacgcucucuggcc

SEQ ID NO: 2697129 - RNA, 14 nt, Human
aggacgcucucugg

SEQ ID NO: 2697130 - RNA, 13 nt, Human
aggacgcucucug

SEQ ID NO: 2697131 - RNA, 17 nt, Human
aggagaaacuggaacuc

SEQ ID NO: 2697132 - RNA, 19 nt, Human
aggagaaacuggaacucuc

SEQ ID NO: 2697133 - RNA, 18 nt, Human
aggagaaacuggaacucu

SEQ ID NO: 2697134 - RNA, 17 nt, Human
ugcuuuuaaaaaaaaau

SEQ ID NO: 2697135 - RNA, 21 nt, Human
uggagcucgugggacagucac

SEQ ID NO: 2697136 - RNA, 17 nt, Human
uggagcucguggaacag

SEQ ID NO: 2697137 - RNA, 21 nt, Human
uggagcucguggaacaguuac

SEQ ID NO: 2697138 - RNA, 20 nt, Human
aggcauuuaggccaugggac

SEQ ID NO: 2697139 - RNA, 15 nt, Human
aggcagcuugaaacu

SEQ ID NO: 2697140 - RNA, 14 nt, Human
uggaguugaaaauc

SEQ ID NO: 2697141 - RNA, 15 nt, Human
aggcccccaggugcc

SEQ ID NO: 2697142 - RNA, 22 nt, Human
aggaaaucaaauaugcaaagca

SEQ ID NO: 2697143 - RNA, 21 nt, Human
aggaaaucaaauaugcaaagc

SEQ ID NO: 2697144 - RNA, 20 nt, Human
aggaaaucaaauaugcaaag

SEQ ID NO: 2697145 - RNA, 17 nt, Human
ugccuuuucccaacucc

SEQ ID NO: 2697146 - RNA, 19 nt, Human
ugccuuuucccaacuccag

SEQ ID NO: 2697147 - RNA, 14 nt, Human
ugcuacaaaaacac

SEQ ID NO: 2697148 - RNA, 19 nt, Human
agcuugcccuguuaaaaga

SEQ ID NO: 2697149 - RNA, 18 nt, Human
agcuugcccuguuaaaag

SEQ ID NO: 2697150 - RNA, 16 nt, Human
agcuugcccuguuaaa

SEQ ID NO: 2697151 - RNA, 20 nt, Human
agcuugcccuggugccucac

SEQ ID NO: 2697152 - RNA, 20 nt, Human
ugcccuguuaaaagaugaaa

SEQ ID NO: 2697153 - RNA, 13 nt, Human
agcugcccucucc

SEQ ID NO: 2697154 - RNA, 14 nt, Human
agcugcccucuccu

SEQ ID NO: 2697155 - RNA, 15 nt, Human
agcugcccucuccug

SEQ ID NO: 2697156 - RNA, 16 nt, Human
agcugcccucuccugg

SEQ ID NO: 2697157 - RNA, 14 nt, Human
agcuguucacagcc

SEQ ID NO: 2697158 - RNA, 16 nt, Human
uguaaaggaauuuaaa

SEQ ID NO: 2697159 - RNA, 14 nt, Human
uguaguguuggaga

SEQ ID NO: 2697160 - RNA, 15 nt, Human
uguaguguuggagaa

SEQ ID NO: 2697161 - RNA, 18 nt, Human
uguaucacaaaucuuaac

SEQ ID NO: 2697162 - RNA, 15 nt, Human
uguaucacaaaucuu

SEQ ID NO: 2697163 - RNA, 22 nt, Human
uguauuacaaauccaaugaaau

SEQ ID NO: 2697164 - RNA, 13 nt, Human
uguauuacaaauc

SEQ ID NO: 2697165 - RNA, 13 nt, Human
aguagucagacug

SEQ ID NO: 2697166 - RNA, 18 nt, Human
aguauuagaauaccacag

SEQ ID NO: 2697167 - RNA, 14 nt, Human
agucaccucaugga

SEQ ID NO: 2697168 - RNA, 15 nt, Human
agucaccucauggaa

SEQ ID NO: 2697169 - RNA, 17 nt, Human
agucaccucauggaauu

SEQ ID NO: 2697170 - RNA, 18 nt, Human
aguauuucuaugaaauau

SEQ ID NO: 2697171 - RNA, 17 nt, Human
aguauuucuaugaaaua

SEQ ID NO: 2697172 - RNA, 16 nt, Human
aguauuucuaugaaau

SEQ ID NO: 2697173 - RNA, 16 nt, Human
uguagaggagaaacug

SEQ ID NO: 2697174 - RNA, 17 nt, Human
aguaaugauaacuggaa

SEQ ID NO: 2697175 - RNA, 18 nt, Human
aguaaugauaacuggaaa

SEQ ID NO: 2697176 - RNA, 20 nt, Human
aguaaugauaacuggaaacu

SEQ ID NO: 2697177 - RNA, 13 nt, Human
aguaaaauccaca

SEQ ID NO: 2697178 - RNA, 13 nt, Human
agggaaauuucag

SEQ ID NO: 2697179 - RNA, 23 nt, Human
agggaggacgcucucuggccuuc

SEQ ID NO: 2697180 - RNA, 22 nt, Human
agggaggacgcucucuggccuu

SEQ ID NO: 2697181 - RNA, 21 nt, Human
agggaggacgcucucuggccu

SEQ ID NO: 2697182 - RNA, 18 nt, Human
aggggagcaugggaagug

SEQ ID NO: 2697183 - RNA, 21 nt, Human
aguucugcagauaaacaguag

SEQ ID NO: 2697184 - RNA, 16 nt, Human
aguucugcagauaaac

SEQ ID NO: 2697185 - RNA, 16 nt, Human
aguucugaagaagaug

SEQ ID NO: 2697186 - RNA, 14 nt, Human
uguuuugcaagcca

SEQ ID NO: 2697187 - RNA, 19 nt, Human
uguuuucauuaucucaaaa

SEQ ID NO: 2697188 - RNA, 16 nt, Human
aguuuagcuggaaaag

SEQ ID NO: 2697189 - RNA, 14 nt, Human
uuaccuuacagaag

SEQ ID NO: 2697190 - RNA, 12 nt, Human
uuaccugggaaa

SEQ ID NO: 2697191 - RNA, 15 nt, Human
uuacuguaagaaaau

SEQ ID NO: 2697192 - RNA, 20 nt, Human
uuaagaagacugcauuauau

SEQ ID NO: 2697193 - RNA, 22 nt, Human
uuaagaagacugcauuauauuu

SEQ ID NO: 2697194 - RNA, 18 nt, Human
uuaaguaaugauaacugg

SEQ ID NO: 2697195 - RNA, 16 nt, Human
auaaaauaauuuuuau

SEQ ID NO: 2697196 - RNA, 21 nt, Human
auaaaauaauuuuuauauuug

SEQ ID NO: 2697197 - RNA, 18 nt, Human
auaaaauccauacauuug

SEQ ID NO: 2697198 - RNA, 19 nt, Human
auaaaauccauacauuugu

SEQ ID NO: 2697199 - RNA, 19 nt, Human
ugugagaugcuagaacucc

SEQ ID NO: 2697200 - RNA, 15 nt, Human
ugugagaugcuagaa

SEQ ID NO: 2697201 - RNA, 22 nt, Human
agucucaggaaaucaaauaugc

SEQ ID NO: 2697202 - RNA, 20 nt, Human
agugaacaaauuuacagaga

SEQ ID NO: 2697203 - RNA, 16 nt, Human
agugaacaaauuuaca

SEQ ID NO: 2697204 - RNA, 15 nt, Human
agugaaagaaaauaa

SEQ ID NO: 2697205 - RNA, 20 nt, Human
uguggucacaggaaguagag

SEQ ID NO: 2697206 - RNA, 13 nt, Human
uguguaaguagau

SEQ ID NO: 2697207 - RNA, 15 nt, Human
uguuauaaucuuuca

SEQ ID NO: 2697208 - RNA, 18 nt, Human
uguuccuagugaaagagg

SEQ ID NO: 2697209 - RNA, 14 nt, Human
uguuccuagugaaa

SEQ ID NO: 2697210 - RNA, 13 nt, Human
auauuugaaauau

SEQ ID NO: 2697211 - RNA, 22 nt, Human
auauuuguaucacaaaucuuaa

SEQ ID NO: 2697212 - RNA, 12 nt, Human
auauuuuaacuu

SEQ ID NO: 2697213 - RNA, 23 nt, Human
auauuugaaauauugacuuuuua

SEQ ID NO: 2697214 - RNA, 14 nt, Human
auauuugaaauauu

SEQ ID NO: 2697215 - RNA, 19 nt, Human
auauuugaaauauugacuu

SEQ ID NO: 2697216 - RNA, 12 nt, Human
uucugaagaaga

SEQ ID NO: 2697217 - RNA, 13 nt, Human
uucugaagaagau

SEQ ID NO: 2697218 - RNA, 14 nt, Human
uucugaagaagaug

SEQ ID NO: 2697219 - RNA, 23 nt, Human
uucugcaucagcugcugaaacaa

SEQ ID NO: 2697220 - RNA, 16 nt, Human
uucugcaucagcugcu

SEQ ID NO: 2697221 - RNA, 11 nt, Human
aucccucccuc

SEQ ID NO: 2697222 - RNA, 13 nt, Human
aucccucccucca

SEQ ID NO: 2697223 - RNA, 14 nt, Human
aucccucccuccac

SEQ ID NO: 2697224 - RNA, 23 nt, Human
aucccucccuccaccucccugca

SEQ ID NO: 2697225 - RNA, 14 nt, Human
uucucaacuccaaa

SEQ ID NO: 2697226 - RNA, 18 nt, Human
uucucaacuccaaacuga

SEQ ID NO: 2697227 - RNA, 17 nt, Human
uuauuguuuaaaaucau

SEQ ID NO: 2697228 - RNA, 18 nt, Human
auagcuacuaauuuuaaa

SEQ ID NO: 2697229 - RNA, 17 nt, Human
auagcuacuaauuuuaa

SEQ ID NO: 2697230 - RNA, 14 nt, Human
auagcuacuaauuu

SEQ ID NO: 2697231 - RNA, 21 nt, Human
auaggaauugacccacaagaa

SEQ ID NO: 2697232 - RNA, 15 nt, Human
uucaaacauauauaa

SEQ ID NO: 2697233 - RNA, 17 nt, Human
auagucaaauuguguga

SEQ ID NO: 2697234 - RNA, 18 nt, Human
auagucaaauugugugaa

SEQ ID NO: 2697235 - RNA, 19 nt, Human
auauauaacaaugcuguau

SEQ ID NO: 2697236 - RNA, 17 nt, Human
auauauaacaaugcugu

SEQ ID NO: 2697237 - RNA, 18 nt, Human
auauauaacaaugcugua

SEQ ID NO: 2697238 - RNA, 19 nt, Human
auauaagcuuguauuccuu

SEQ ID NO: 2697239 - RNA, 12 nt, Human
auauaacaaugc

SEQ ID NO: 2697240 - RNA, 15 nt, Human
auauaacaaugcugu

SEQ ID NO: 2697241 - RNA, 15 nt, Human
uucagcccucagaau

SEQ ID NO: 2697242 - RNA, 15 nt, Human
auaugcaaagcacug

SEQ ID NO: 2697243 - RNA, 16 nt, Human
auaugcaaagcacuga

SEQ ID NO: 2697244 - RNA, 23 nt, Human
auaugcaaagcacugacuucuaa

SEQ ID NO: 2697245 - RNA, 18 nt, Human
augaacuuguaaaggaau

SEQ ID NO: 2697246 - RNA, 15 nt, Human
aucuuauaauuuaaa

SEQ ID NO: 2697247 - RNA, 16 nt, Human
aucuuauaauuuaaaa

SEQ ID NO: 2697248 - RNA, 15 nt, Human
aucuuuaaaauacac

SEQ ID NO: 2697249 - RNA, 12 nt, Human
aucuuuaaaaua

SEQ ID NO: 2697250 - RNA, 17 nt, Human
uuggagaagaacugaaa

SEQ ID NO: 2697251 - RNA, 22 nt, Human
uuggagaagaacugaaaucaua

SEQ ID NO: 2697252 - RNA, 15 nt, Human
uuggagaagaacuga

SEQ ID NO: 2697253 - RNA, 15 nt, Human
aucucaaaacugcac

SEQ ID NO: 2697254 - RNA, 20 nt, Human
aucucaaaacugcacuguca

SEQ ID NO: 2697255 - RNA, 19 nt, Human
aucucaaaacugcacuguc

SEQ ID NO: 2697256 - RNA, 13 nt, Human
uugacaugggaca

SEQ ID NO: 2697257 - RNA, 12 nt, Human
uugacuuuuuau

SEQ ID NO: 2697258 - RNA, 21 nt, Human
uuuauaugcuucuguuuuaua

SEQ ID NO: 2697259 - RNA, 19 nt, Human
uuuauaugcuucuguuuua

SEQ ID NO: 2697260 - RNA, 14 nt, Human
augccuuuucccaa

SEQ ID NO: 2697261 - RNA, 20 nt, Human
augccuuuucccaacuccag

SEQ ID NO: 2697262 - RNA, 22 nt, Human
augccuuuucccaacuccagaa

SEQ ID NO: 2697263 - RNA, 18 nt, Human
augcuacaggauuugaaa

SEQ ID NO: 2697264 - RNA, 23 nt, Human
augcuguauuuuaaaagaaugau

SEQ ID NO: 2697265 - RNA, 19 nt, Human
augcuguauuuuaaaagaa

SEQ ID NO: 2697266 - RNA, 22 nt, Human
augcuguauuuuaaaagaauga

SEQ ID NO: 2697267 - RNA, 21 nt, Human
augcuucuguuuuauaauuuu

SEQ ID NO: 2697268 - RNA, 19 nt, Human
uuucaaacauauauaacaa

SEQ ID NO: 2697269 - RNA, 17 nt, Human
uuucaaacauauauaac

SEQ ID NO: 2697270 - RNA, 21 nt, Human
uuuaaauauaugcuaagucuu

SEQ ID NO: 2697271 - RNA, 14 nt, Human
augcaaagcacuga

SEQ ID NO: 2697272 - RNA, 13 nt, Human
augcaaagcacug

SEQ ID NO: 2697273 - RNA, 12 nt, Human
augcaaagcacu

SEQ ID NO: 2697274 - RNA, 18 nt, Human
uuuaaaaaaauuccaagu

SEQ ID NO: 2697275 - RNA, 13 nt, Human
augauuucauuca

SEQ ID NO: 2697276 - RNA, 15 nt, Human
augagguacugagag

SEQ ID NO: 2697277 - RNA, 18 nt, Human
augagguacugagaguga

SEQ ID NO: 2697278 - RNA, 17 nt, Human
augagguacugagagug

SEQ ID NO: 2697279 - RNA, 20 nt, Human
uugucaauaaaauccauaca

SEQ ID NO: 2697280 - RNA, 15 nt, Human
auuacuguaagaaaa

SEQ ID NO: 2697281 - RNA, 16 nt, Human
auuacuguaagaaaau

SEQ ID NO: 2697282 - RNA, 14 nt, Human
uuuugugaagcaaa

SEQ ID NO: 2697283 - RNA, 15 nt, Human
uuuuguuuucauuau

SEQ ID NO: 2697284 - RNA, 15 nt, Human
uuuuugaagcuguau

SEQ ID NO: 2697285 - RNA, 17 nt, Human
auuccaagugauugaaa

SEQ ID NO: 2697286 - RNA, 20 nt, Human
auuauauggcuugaguuuaa

SEQ ID NO: 2697287 - RNA, 22 nt, Human
auucaaacagucucaggaaauc

SEQ ID NO: 2697288 - RNA, 20 nt, Human
uuugcuggagcucugcccau

SEQ ID NO: 2697289 - RNA, 19 nt, Human
uuugcuaagcauuccaacu

SEQ ID NO: 2697290 - RNA, 17 nt, Human
uuuguaguguuggagaa

SEQ ID NO: 2697291 - RNA, 23 nt, Human
augucgucaaagcugaaauggac

SEQ ID NO: 2697292 - RNA, 19 nt, Human
auguauauuuuauaucaau

SEQ ID NO: 2697293 - RNA, 21 nt, Human
augugcuaguaauuggaaagg

SEQ ID NO: 2697294 - RNA, 20 nt, Human
augugcuaguaauuggaaag

SEQ ID NO: 2697295 - RNA, 22 nt, Human
uuuuauggcacuaguauuucua

SEQ ID NO: 2697296 - RNA, 20 nt, Human
uuuucaggcuagauguaugu

SEQ ID NO: 2697297 - RNA, 16 nt, Human
uuuucuauaauuuaaa

SEQ ID NO: 2697298 - RNA, 16 nt, Human
uuuucucuaggaaaua

SEQ ID NO: 2697299 - RNA, 24 nt, Human
auuccuagaaacugacacaugcug

SEQ ID NO: 2697300 - RNA, 17 nt, Human
auugaaggaugcugucu

SEQ ID NO: 2697301 - RNA, 16 nt, Human
auuggagcucguggaa

SEQ ID NO: 2697302 - RNA, 17 nt, Human
auuggagcucgugggac

SEQ ID NO: 2697303 - RNA, 20 nt, Human
auuucuugagguaaaagcau

SEQ ID NO: 2697304 - RNA, 21 nt, Human
auuuauuuuaauaauguuuca

SEQ ID NO: 2697305 - RNA, 19 nt, Human
auuuauuacuguaagaaaa

SEQ ID NO: 2697306 - RNA, 20 nt, Human
auuuauuacuguaagaaaau

SEQ ID NO: 2697307 - RNA, 17 nt, Human
auuuaaaaaaaaaccug

SEQ ID NO: 2697308 - RNA, 16 nt, Human
auuguaguccuguaau

SEQ ID NO: 2697309 - RNA, 15 nt, Human
auuuaccacuugugu

SEQ ID NO: 2697310 - RNA, 22 nt, Human
auuuaccacuuguguuuugcaa

SEQ ID NO: 2697311 - RNA, 18 nt, Human
auuuuaauaauguuucaa

SEQ ID NO: 2697312 - RNA, 19 nt, Human
auuuuaauaauguuucaaa

SEQ ID NO: 2697313 - RNA, 14 nt, Human
caaagaaauguaag

SEQ ID NO: 2697314 - RNA, 19 nt, Human
caagacugcacaucaaaau

SEQ ID NO: 2697315 - RNA, 13 nt, Human
caagaaaugaaag

SEQ ID NO: 2697316 - RNA, 16 nt, Human
caagcauaccaacacg

SEQ ID NO: 2697317 - RNA, 21 nt, Human
caagcauaccaacacgagcag

SEQ ID NO: 2697318 - RNA, 16 nt, Human
caagcauuuagaugua

SEQ ID NO: 2697319 - RNA, 19 nt, Human
caagcauuuagauguauag

SEQ ID NO: 2697320 - RNA, 23 nt, Human
caaauuuacagagacagaaagca

SEQ ID NO: 2697321 - RNA, 17 nt, Human
caaauuuacagagacag

SEQ ID NO: 2697322 - RNA, 16 nt, Human
caaauuuacagagaca

SEQ ID NO: 2697323 - RNA, 23 nt, Human
cacaagacccaaaaggcagaagc

SEQ ID NO: 2697324 - RNA, 23 nt, Human
cacaagaaaugaaagcagggacu

SEQ ID NO: 2697325 - RNA, 15 nt, Human
cacaagaaaugaaag

SEQ ID NO: 2697326 - RNA, 13 nt, Human
cacaagaaaugaa

SEQ ID NO: 2697327 - RNA, 17 nt, Human
cacaugaaguccaagca

SEQ ID NO: 2697328 - RNA, 20 nt, Human
cacaugaaguccaagcauuu

SEQ ID NO: 2697329 - RNA, 16 nt, Human
cacaugaaguccaagc

SEQ ID NO: 2697330 - RNA, 20 nt, Human
cacaguuuucugagaaagac

SEQ ID NO: 2697331 - RNA, 22 nt, Human
cacaguuuucugagaaagacua

SEQ ID NO: 2697332 - RNA, 21 nt, Human
cacaguuuucugagaaagacu

SEQ ID NO: 2697333 - RNA, 13 nt, Human
cccaggugccagu

SEQ ID NO: 2697334 - RNA, 18 nt, Human
ccaucaaggguacacugc

SEQ ID NO: 2697335 - RNA, 16 nt, Human
ccaugauguuuagaaa

SEQ ID NO: 2697336 - RNA, 14 nt, Human
ccaugaagauguag

SEQ ID NO: 2697337 - RNA, 18 nt, Human
cccaaaaggcagaagcaa

SEQ ID NO: 2697338 - RNA, 13 nt, Human
cccaaaaggcaga

SEQ ID NO: 2697339 - RNA, 17 nt, Human
ccaggugccaguuaugg

SEQ ID NO: 2697340 - RNA, 18 nt, Human
ccacugcagaagacagua

SEQ ID NO: 2697341 - RNA, 13 nt, Human
ccacugcagaaga

SEQ ID NO: 2697342 - RNA, 16 nt, Human
ccaauauucauagcag

SEQ ID NO: 2697343 - RNA, 20 nt, Human
ccacaggaaccacaagacug

SEQ ID NO: 2697344 - RNA, 22 nt, Human
ccaaacugacucuuaagaagac

SEQ ID NO: 2697345 - RNA, 23 nt, Human
ccaaauuucauaccuaucaucuu

SEQ ID NO: 2697346 - RNA, 14 nt, Human
ccaagcaaguauua

SEQ ID NO: 2697347 - RNA, 17 nt, Human
ccaagcauuuagaugua

SEQ ID NO: 2697348 - RNA, 22 nt, Human
ccaagcauaccaacacgagcag

SEQ ID NO: 2697349 - RNA, 17 nt, Human
cauuuaggccaugggac

SEQ ID NO: 2697350 - RNA, 13 nt, Human
cauuugcucaugg

SEQ ID NO: 2697351 - RNA, 18 nt, Human
cauuugcucauggaauug

SEQ ID NO: 2697352 - RNA, 17 nt, Human
cggccuccauccugagg

SEQ ID NO: 2697353 - RNA, 16 nt, Human
cggccuccauccugag

SEQ ID NO: 2697354 - RNA, 14 nt, Human
cggccuccauccug

SEQ ID NO: 2697355 - RNA, 11 nt, Human
cgcaaugugac

SEQ ID NO: 2697356 - RNA, 20 nt, Human
ccugggcagcugccuccccu

SEQ ID NO: 2697357 - RNA, 15 nt, Human
ccugggcagcugccu

SEQ ID NO: 2697358 - RNA, 16 nt, Human
ccugggcagcugccuc

SEQ ID NO: 2697359 - RNA, 17 nt, Human
ccugggcagcugccucc

SEQ ID NO: 2697360 - RNA, 18 nt, Human
ccugggcagcugccuccc

SEQ ID NO: 2697361 - RNA, 12 nt, Human
ccuucagccuga

SEQ ID NO: 2697362 - RNA, 17 nt, Human
ccuccccuccucugcuu

SEQ ID NO: 2697363 - RNA, 18 nt, Human
ccuccccuccucugcuug

SEQ ID NO: 2697364 - RNA, 12 nt, Human
ccucccugcaau

SEQ ID NO: 2697365 - RNA, 16 nt, Human
ccucccugcaauaaaa

SEQ ID NO: 2697366 - RNA, 11 nt, Human
ccuccucugcu

SEQ ID NO: 2697367 - RNA, 15 nt, Human
ccuccccuccucugc

SEQ ID NO: 2697368 - RNA, 14 nt, Human
ccuccccuccucug

SEQ ID NO: 2697369 - RNA, 20 nt, Human
ccucagaaaacaaggaugaa

SEQ ID NO: 2697370 - RNA, 20 nt, Human
ccucugcuugccaucccucc

SEQ ID NO: 2697371 - RNA, 21 nt, Human
ccucugcuugccaucccuccc

SEQ ID NO: 2697372 - RNA, 11 nt, Human
ccucuccuggg

SEQ ID NO: 2697373 - RNA, 12 nt, Human
ccucuccugggc

SEQ ID NO: 2697374 - RNA, 13 nt, Human
ccucuccugggca

SEQ ID NO: 2697375 - RNA, 14 nt, Human
ccucuccugggcag

SEQ ID NO: 2697376 - RNA, 17 nt, Human
ccugaggcuccacuugg

SEQ ID NO: 2697377 - RNA, 20 nt, Human
ccugaggcuccacuuggucu

SEQ ID NO: 2697378 - RNA, 18 nt, Human
ccugaggcuccacuuggu

SEQ ID NO: 2697379 - RNA, 18 nt, Human
ccugaaagaggaaugaag

SEQ ID NO: 2697380 - RNA, 23 nt, Human
ccugaaagaggaaugaaguacuc

SEQ ID NO: 2697381 - RNA, 23 nt, Human
ccucuuagaugcaguucugaaga

SEQ ID NO: 2697382 - RNA, 15 nt, Human
cccuugaugaagaag

SEQ ID NO: 2697383 - RNA, 16 nt, Human
cccuugaugaagaagu

SEQ ID NO: 2697384 - RNA, 22 nt, Human
ccgggaggcagagguugcagug

SEQ ID NO: 2697385 - RNA, 21 nt, Human
cuggucccagccagcaguuca

SEQ ID NO: 2697386 - RNA, 22 nt, Human
cugggaacccaaguccaagcau

SEQ ID NO: 2697387 - RNA, 19 nt, Human
cuggcacaguuuucugaga

SEQ ID NO: 2697388 - RNA, 18 nt, Human
cuggcacaguuuucugag

SEQ ID NO: 2697389 - RNA, 16 nt, Human
cuggccaacgggguga

SEQ ID NO: 2697390 - RNA, 23 nt, Human
cuggaauaauccuaaacauauga

SEQ ID NO: 2697391 - RNA, 13 nt, Human
cugcugaaacaac

SEQ ID NO: 2697392 - RNA, 15 nt, Human
cugccuaagugcagc

SEQ ID NO: 2697393 - RNA, 13 nt, Human
cugcagaagacag

SEQ ID NO: 2697394 - RNA, 23 nt, Human
cugcagaagacaguauggcagcu

SEQ ID NO: 2697395 - RNA, 21 nt, Human
cugauguuccuagugaaagag

SEQ ID NO: 2697396 - RNA, 20 nt, Human
cugauguuccuagugaaaga

SEQ ID NO: 2697397 - RNA, 18 nt, Human
cugauguuccuagugaaa

SEQ ID NO: 2697398 - RNA, 13 nt, Human
cugauguuccuag

SEQ ID NO: 2697399 - RNA, 13 nt, Human
cucuuaagaagac

SEQ ID NO: 2697400 - RNA, 21 nt, Human
cucuccugggcagcugccucc

SEQ ID NO: 2697401 - RNA, 23 nt, Human
cucugcauacucauuaggauggc

SEQ ID NO: 2697402 - RNA, 23 nt, Human
cuccaccucccugcaauaaaaug

SEQ ID NO: 2697403 - RNA, 14 nt, Human
cuccaccucccugc

SEQ ID NO: 2697404 - RNA, 15 nt, Human
cuccaccucccugca

SEQ ID NO: 2697405 - RNA, 16 nt, Human
cuccaccucccugcaa

SEQ ID NO: 2697406 - RNA, 17 nt, Human
cuccaccucccugcaau

SEQ ID NO: 2697407 - RNA, 17 nt, Human
cucccagucauuuaaua

SEQ ID NO: 2697408 - RNA, 23 nt, Human
cuccauccugaggcuccacuugg

SEQ ID NO: 2697409 - RNA, 20 nt, Human
cuccauccugaggcuccacu

SEQ ID NO: 2697410 - RNA, 21 nt, Human
cuccauccugaggcuccacuu

SEQ ID NO: 2697411 - RNA, 18 nt, Human
cucauuaggauggcuagu

SEQ ID NO: 2697412 - RNA, 17 nt, Human
cucauuaggauggcuag

SEQ ID NO: 2697413 - RNA, 12 nt, Human
cucggagaagag

SEQ ID NO: 2697414 - RNA, 20 nt, Human
cucggagaagagcuguucac

SEQ ID NO: 2697415 - RNA, 13 nt, Human
cucggagaagagc

SEQ ID NO: 2697416 - RNA, 12 nt, Human
cucccuuucaac

SEQ ID NO: 2697417 - RNA, 13 nt, Human
cucccuuucaaca

SEQ ID NO: 2697418 - RNA, 16 nt, Human
cucccuucucuucaca

SEQ ID NO: 2697419 - RNA, 17 nt, Human
cuucggccuccauccug

SEQ ID NO: 2697420 - RNA, 19 nt, Human
cuucggccuccauccugag

SEQ ID NO: 2697421 - RNA, 18 nt, Human
cuucggccuccauccuga

SEQ ID NO: 2697422 - RNA, 19 nt, Human
cuuccuuggacucauuuua

SEQ ID NO: 2697423 - RNA, 18 nt, Human
cuucagcgguuuauauaa

SEQ ID NO: 2697424 - RNA, 19 nt, Human
cuuccagauccuggaaauc

SEQ ID NO: 2697425 - RNA, 13 nt, Human
cuuauaauuuaaa

SEQ ID NO: 2697426 - RNA, 21 nt, Human
cuuaggguuaugauuaaguaa

SEQ ID NO: 2697427 - RNA, 14 nt, Human
cuuauaauuuaaaa

SEQ ID NO: 2697428 - RNA, 19 nt, Human
cuuauaggaauugacccac

SEQ ID NO: 2697429 - RNA, 19 nt, Human
cuuagaugcaguucugaag

SEQ ID NO: 2697430 - RNA, 19 nt, Human
cuuacuaguuucccuugca

SEQ ID NO: 2697431 - RNA, 19 nt, Human
cuguuuuauaauuuuguga

SEQ ID NO: 2697432 - RNA, 18 nt, Human
cuuaaugccacuaaauug

SEQ ID NO: 2697433 - RNA, 19 nt, Human
gaaaauaacaauaaaagac

SEQ ID NO: 2697434 - RNA, 20 nt, Human
gaaaaguauguuagugcaaa

SEQ ID NO: 2697435 - RNA, 14 nt, Human
gaaaaguauguuag

SEQ ID NO: 2697436 - RNA, 14 nt, Human
gaaaacaaggauga

SEQ ID NO: 2697437 - RNA, 19 nt, Human
cuuuccucaaaacuucaga

SEQ ID NO: 2697438 - RNA, 17 nt, Human
cuuguacuuuauuuucu

SEQ ID NO: 2697439 - RNA, 18 nt, Human
cuuggggcugaugcaguu

SEQ ID NO: 2697440 - RNA, 16 nt, Human
cuuggggcugaugcag

SEQ ID NO: 2697441 - RNA, 16 nt, Human
cuuggacucauuuuaa

SEQ ID NO: 2697442 - RNA, 22 nt, Human
cuugcccuguuaaaagaugaaa

SEQ ID NO: 2697443 - RNA, 20 nt, Human
cuugcuugauuguauggugg

SEQ ID NO: 2697444 - RNA, 14 nt, Human
cuugccaucccucc

SEQ ID NO: 2697445 - RNA, 17 nt, Human
cuugccaucccucccuc

SEQ ID NO: 2697446 - RNA, 15 nt, Human
cuugccaucccuccc

SEQ ID NO: 2697447 - RNA, 16 nt, Human
cuugccaucccucccu

SEQ ID NO: 2697448 - RNA, 19 nt, Human
cuugccaucccucccucca

SEQ ID NO: 2697449 - RNA, 18 nt, Human
cuugcccuggugccucac

SEQ ID NO: 2697450 - RNA, 14 nt, Human
cuugcccuguuaaa

SEQ ID NO: 2697451 - RNA, 22 nt, Human
cuugcagcucuccccuucucug

SEQ ID NO: 2697452 - RNA, 24 nt, Human
gacugcauuauauuuauuacugua

SEQ ID NO: 2697453 - RNA, 16 nt, Human
gacugaggggagggga

SEQ ID NO: 2697454 - RNA, 14 nt, Human
gacuggcacaguuu

SEQ ID NO: 2697455 - RNA, 17 nt, Human
gacuggauaguccgucu

SEQ ID NO: 2697456 - RNA, 22 nt, Human
gacuggcacaguuuucugagaa

SEQ ID NO: 2697457 - RNA, 18 nt, Human
gacuggcacaguuuucug

SEQ ID NO: 2697458 - RNA, 22 nt, Human
gacuggauaguccgucucugcu

SEQ ID NO: 2697459 - RNA, 18 nt, Human
gaccacugcagaagacag

SEQ ID NO: 2697460 - RNA, 16 nt, Human
gaccacugcagaagac

SEQ ID NO: 2697461 - RNA, 20 nt, Human
gacccaaaaggcagaagcaa

SEQ ID NO: 2697462 - RNA, 19 nt, Human
gacccaaaaggcagaagca

SEQ ID NO: 2697463 - RNA, 18 nt, Human
gacccaaaaggcagaagc

SEQ ID NO: 2697464 - RNA, 23 nt, Human
gacaggaugguucccuugaugaa

SEQ ID NO: 2697465 - RNA, 14 nt, Human
gacaucaacagaua

SEQ ID NO: 2697466 - RNA, 21 nt, Human
gacagagccccacccucagau

SEQ ID NO: 2697467 - RNA, 14 nt, Human
gaaguauccuucag

SEQ ID NO: 2697468 - RNA, 16 nt, Human
gaaguauccuucagcc

SEQ ID NO: 2697469 - RNA, 12 nt, Human
gaaguccaagca

SEQ ID NO: 2697470 - RNA, 22 nt, Human
gaaguccaagcauuuagaugua

SEQ ID NO: 2697471 - RNA, 16 nt, Human
gaauauuuuaacuucc

SEQ ID NO: 2697472 - RNA, 18 nt, Human
gaagauguagaggagaaa

SEQ ID NO: 2697473 - RNA, 17 nt, Human
gaagauguagaggagaa

SEQ ID NO: 2697474 - RNA, 12 nt, Human
gaagaacugaaa

SEQ ID NO: 2697475 - RNA, 19 nt, Human
gaagacugcauuauauuua

SEQ ID NO: 2697476 - RNA, 18 nt, Human
gaaauuguauuacaaauc

SEQ ID NO: 2697477 - RNA, 16 nt, Human
gaaauuguauuacaaa

SEQ ID NO: 2697478 - RNA, 20 nt, Human
gaacagugauuaccagggac

SEQ ID NO: 2697479 - RNA, 16 nt, Human
gaacagugauuaccag

SEQ ID NO: 2697480 - RNA, 14 nt, Human
gaacaucacagcuu

SEQ ID NO: 2697481 - RNA, 15 nt, Human
gaacauaaaauacaa

SEQ ID NO: 2697482 - RNA, 13 nt, Human
gaucuuuaaaaua

SEQ ID NO: 2697483 - RNA, 14 nt, Human
gauccuggaaauca

SEQ ID NO: 2697484 - RNA, 13 nt, Human
gauaaacaguagu

SEQ ID NO: 2697485 - RNA, 23 nt, Human
gaucagcuuauugucuagugaaa

SEQ ID NO: 2697486 - RNA, 17 nt, Human
gauaggucagugcaaau

SEQ ID NO: 2697487 - RNA, 16 nt, Human
gcaagaugugggcagu

SEQ ID NO: 2697488 - RNA, 12 nt, Human
gcaagauguggg

SEQ ID NO: 2697489 - RNA, 16 nt, Human
gaugcuagaacucccu

SEQ ID NO: 2697490 - RNA, 22 nt, Human
gauuaaguaaugauaacuggaa

SEQ ID NO: 2697491 - RNA, 14 nt, Human
gauuaaguaaugau

SEQ ID NO: 2697492 - RNA, 14 nt, Human
gcagaagacaguau

SEQ ID NO: 2697493 - RNA, 15 nt, Human
gcacugucaagauga

SEQ ID NO: 2697494 - RNA, 20 nt, Human
gcacagccucuuagaugcag

SEQ ID NO: 2697495 - RNA, 15 nt, Human
gcaggcuacugucag

SEQ ID NO: 2697496 - RNA, 13 nt, Human
gcaguucugaaga

SEQ ID NO: 2697497 - RNA, 14 nt, Human
gcaguucugaagaa

SEQ ID NO: 2697498 - RNA, 18 nt, Human
gcauagauucccugagca

SEQ ID NO: 2697499 - RNA, 18 nt, Human
gcccucuccugggcagcu

SEQ ID NO: 2697500 - RNA, 19 nt, Human
gcccucuccugggcagcug

SEQ ID NO: 2697501 - RNA, 21 nt, Human
gcccucuccugggcagcugcc

SEQ ID NO: 2697502 - RNA, 15 nt, Human
gcccucuccugggca

SEQ ID NO: 2697503 - RNA, 16 nt, Human
gcccucuccugggcag

SEQ ID NO: 2697504 - RNA, 19 nt, Human
gccccugcacuccagccug

SEQ ID NO: 2697505 - RNA, 17 nt, Human
gccccgugggguuccuc

SEQ ID NO: 2697506 - RNA, 16 nt, Human
gcccacagcuguauga

SEQ ID NO: 2697507 - RNA, 22 nt, Human
gccauuuaaagcuuauuaaaac

SEQ ID NO: 2697508 - RNA, 15 nt, Human
gccaucccucccucc

SEQ ID NO: 2697509 - RNA, 16 nt, Human
gccaucccucccucca

SEQ ID NO: 2697510 - RNA, 19 nt, Human
gccaugggacagggaggac

SEQ ID NO: 2697511 - RNA, 14 nt, Human
gccaugggacaggg

SEQ ID NO: 2697512 - RNA, 11 nt, Human
gccaucccucc

SEQ ID NO: 2697513 - RNA, 13 nt, Human
gccaucccucccu

SEQ ID NO: 2697514 - RNA, 14 nt, Human
gccaucccucccuc

SEQ ID NO: 2697515 - RNA, 22 nt, Human
gccacguucuuacuaguuuccc

SEQ ID NO: 2697516 - RNA, 22 nt, Human
gcgacagugagacucugucuca

SEQ ID NO: 2697517 - RNA, 18 nt, Human
gccuucggccuccauccu

SEQ ID NO: 2697518 - RNA, 19 nt, Human
gccuucggccuccauccug

SEQ ID NO: 2697519 - RNA, 18 nt, Human
gccuguaaucacagcuac

SEQ ID NO: 2697520 - RNA, 22 nt, Human
gcguccugucggagcccugucu

SEQ ID NO: 2697521 - RNA, 19 nt, Human
gcguccugucggagcccug

SEQ ID NO: 2697522 - RNA, 11 nt, Human
gccuccccucc

SEQ ID NO: 2697523 - RNA, 12 nt, Human
gccuccccuccu

SEQ ID NO: 2697524 - RNA, 13 nt, Human
gccuccccuccuc

SEQ ID NO: 2697525 - RNA, 14 nt, Human
gccuccccuccucu

SEQ ID NO: 2697526 - RNA, 16 nt, Human
gccuccccuccucugc

SEQ ID NO: 2697527 - RNA, 19 nt, Human
gcccuucuuuccacagaag

SEQ ID NO: 2697528 - RNA, 22 nt, Human
ggcagcugccuccccuccucug

SEQ ID NO: 2697529 - RNA, 18 nt, Human
ggcagcugccuccccucc

SEQ ID NO: 2697530 - RNA, 21 nt, Human
ggcagcugccuccccuccucu

SEQ ID NO: 2697531 - RNA, 22 nt, Human
ggccaugggacagggaggacgc

SEQ ID NO: 2697532 - RNA, 21 nt, Human
ggaggacgcucucuggccuuc

SEQ ID NO: 2697533 - RNA, 20 nt, Human
ggaggacgcucucuggccuu

SEQ ID NO: 2697534 - RNA, 19 nt, Human
ggaggacgcucucuggccu

SEQ ID NO: 2697535 - RNA, 22 nt, Human
gcuguauuuuaaaagaaugauu

SEQ ID NO: 2697536 - RNA, 18 nt, Human
gcuagauguauguacuuc

SEQ ID NO: 2697537 - RNA, 16 nt, Human
ggaaaucaaauaugca

SEQ ID NO: 2697538 - RNA, 13 nt, Human
ggaaauauuuauu

SEQ ID NO: 2697539 - RNA, 15 nt, Human
ggaaauauuuauuuu

SEQ ID NO: 2697540 - RNA, 12 nt, Human
ggaaauauuuau

SEQ ID NO: 2697541 - RNA, 17 nt, Human
ggaaauauuuauuuuaa

SEQ ID NO: 2697542 - RNA, 18 nt, Human
ggaaauauuuauuuuaau

SEQ ID NO: 2697543 - RNA, 23 nt, Human
gcuguucacagccagacuggcac

SEQ ID NO: 2697544 - RNA, 16 nt, Human
gcuguucacagccaga

SEQ ID NO: 2697545 - RNA, 15 nt, Human
gcuguucacagccag

SEQ ID NO: 2697546 - RNA, 18 nt, Human
gcuugccaucccucccuc

SEQ ID NO: 2697547 - RNA, 21 nt, Human
gcuugccaucccucccuccac

SEQ ID NO: 2697548 - RNA, 19 nt, Human
gcuugcccuggugccucac

SEQ ID NO: 2697549 - RNA, 17 nt, Human
gcuugcccuggugccuc

SEQ ID NO: 2697550 - RNA, 18 nt, Human
gcuugcccuguuaaaaga

SEQ ID NO: 2697551 - RNA, 16 nt, Human
gcuugccaucccuccc

SEQ ID NO: 2697552 - RNA, 17 nt, Human
gcuuuuaaaaaaaaaua

SEQ ID NO: 2697553 - RNA, 20 nt, Human
ggaaaaaauaacaaugaaag

SEQ ID NO: 2697554 - RNA, 22 nt, Human
ggcuugaguuuaaauuguaaua

SEQ ID NO: 2697555 - RNA, 23 nt, Human
ggugcuacaaaaacacagcaagg

SEQ ID NO: 2697556 - RNA, 21 nt, Human
ggugcuacaaaaacacagcaa

SEQ ID NO: 2697557 - RNA, 19 nt, Human
uauauuuuuuguuaaauga

SEQ ID NO: 2697558 - RNA, 20 nt, Human
uauauuuauuacuguaagaa

SEQ ID NO: 2697559 - RNA, 23 nt, Human
uauauuuauuacuguaagaaaau

SEQ ID NO: 2697560 - RNA, 14 nt, Human
uauauuugaaauau

SEQ ID NO: 2697561 - RNA, 13 nt, Human
uauauuugaaaua

SEQ ID NO: 2697562 - RNA, 18 nt, Human
uagucaaauugugugaaa

SEQ ID NO: 2697563 - RNA, 21 nt, Human
uaguuguaccgcaaugugacu

SEQ ID NO: 2697564 - RNA, 20 nt, Human
uaggaauugacccacaagaa

SEQ ID NO: 2697565 - RNA, 23 nt, Human
uaggaauugacccacaagaaaug

SEQ ID NO: 2697566 - RNA, 13 nt, Human
uaggccaugggac

SEQ ID NO: 2697567 - RNA, 17 nt, Human
uagaguuuagcuggaaa

SEQ ID NO: 2697568 - RNA, 18 nt, Human
uagaguuuagcuggaaaa

SEQ ID NO: 2697569 - RNA, 20 nt, Human
uagauguauguacuucaugc

SEQ ID NO: 2697570 - RNA, 16 nt, Human
uagauguauguacuuc

SEQ ID NO: 2697571 - RNA, 20 nt, Human
uagcagggcauggcugggaa

SEQ ID NO: 2697572 - RNA, 23 nt, Human
uaccuuuguucccaaauuucaua

SEQ ID NO: 2697573 - RNA, 19 nt, Human
uacugagagugaacaaauu

SEQ ID NO: 2697574 - RNA, 23 nt, Human
uacugauguuccuagugaaagag

SEQ ID NO: 2697575 - RNA, 23 nt, Human
uaccacaggaaccacaagacugc

SEQ ID NO: 2697576 - RNA, 22 nt, Human
uacaugagguacugagagugaa

SEQ ID NO: 2697577 - RNA, 21 nt, Human
uacaugagguacugagaguga

SEQ ID NO: 2697578 - RNA, 17 nt, Human
uacauuuguauaaaaua

SEQ ID NO: 2697579 - RNA, 11 nt, Human
uacauuugugu

SEQ ID NO: 2697580 - RNA, 16 nt, Human
uacauuuguauaaaau

SEQ ID NO: 2697581 - RNA, 16 nt, Human
uaccaacacgagcagg

SEQ ID NO: 2697582 - RNA, 13 nt, Human
uacagaauuuuau

SEQ ID NO: 2697583 - RNA, 14 nt, Human
uacaggauuugaaa

SEQ ID NO: 2697584 - RNA, 19 nt, Human
uaaugccacuaaauugaca

SEQ ID NO: 2697585 - RNA, 15 nt, Human
uaauaauguuucaaa

SEQ ID NO: 2697586 - RNA, 20 nt, Human
uaauuuguaguguuggagaa

SEQ ID NO: 2697587 - RNA, 23 nt, Human
uaauuuguaguguuggagaagaa

SEQ ID NO: 2697588 - RNA, 22 nt, Human
uaauuggaaaggcagcucuaaa

SEQ ID NO: 2697589 - RNA, 20 nt, Human
uaauuaaaagaauauuuuaa

SEQ ID NO: 2697590 - RNA, 15 nt, Human
uaauguuucaaacau

SEQ ID NO: 2697591 - RNA, 14 nt, Human
uaauguuucaaaca

SEQ ID NO: 2697592 - RNA, 23 nt, Human
uaaauugacacuuaaaaaugguu

SEQ ID NO: 2697593 - RNA, 23 nt, Human
uaagagggauuagggagagaaga

SEQ ID NO: 2697594 - RNA, 20 nt, Human
uaagcauuccaacuaucuca

SEQ ID NO: 2697595 - RNA, 16 nt, Human
uaagcauuccaacuau

SEQ ID NO: 2697596 - RNA, 18 nt, Human
uaagcauuccaacuaucu

SEQ ID NO: 2697597 - RNA, 13 nt, Human
uaagccagacauc

SEQ ID NO: 2697598 - RNA, 21 nt, Human
uaagccagacaucaacagaua

SEQ ID NO: 2697599 - RNA, 20 nt, Human
uaagccagacaucaacagau

SEQ ID NO: 2697600 - RNA, 20 nt, Human
guuuaggauguugaaaaagu

SEQ ID NO: 2697601 - RNA, 17 nt, Human
guuuagaaagcuugccc

SEQ ID NO: 2697602 - RNA, 13 nt, Human
guuuagaaagcuu

SEQ ID NO: 2697603 - RNA, 16 nt, Human
uaaaaaagaaacauuu

SEQ ID NO: 2697604 - RNA, 18 nt, Human
guuuucaggcuagaugua

SEQ ID NO: 2697605 - RNA, 16 nt, Human
guuuucauuaucucaa

SEQ ID NO: 2697606 - RNA, 14 nt, Human
uaaaagaugaaaau

SEQ ID NO: 2697607 - RNA, 19 nt, Human
uaaaauccauacauuugug

SEQ ID NO: 2697608 - RNA, 18 nt, Human
uaaaauccauacauuugu

SEQ ID NO: 2697609 - RNA, 17 nt, Human
uaaaauggguuuuacug

SEQ ID NO: 2697610 - RNA, 14 nt, Human
uaaaggaauuuaaa

SEQ ID NO: 2697611 - RNA, 17 nt, Human
uaaauaaaaauaauccu

SEQ ID NO: 2697612 - RNA, 18 nt, Human
uaaauauaugcuaagucu

SEQ ID NO: 2697613 - RNA, 21 nt, Human
uauuucuaugaaauauuaugu

SEQ ID NO: 2697614 - RNA, 22 nt, Human
uauuucuaugaaauauuauguu

SEQ ID NO: 2697615 - RNA, 13 nt, Human
ucaaaacugcacu

SEQ ID NO: 2697616 - RNA, 19 nt, Human
ucaacuccaaacugacucu

SEQ ID NO: 2697617 - RNA, 23 nt, Human
ucacaggacagcccuucuuucca

SEQ ID NO: 2697618 - RNA, 19 nt, Human
ucacaggaaguagaggagg

SEQ ID NO: 2697619 - RNA, 14 nt, Human
ucacaggaaguaga

SEQ ID NO: 2697620 - RNA, 19 nt, Human
ucagacauagaauuaacac

SEQ ID NO: 2697621 - RNA, 22 nt, Human
ucagacauagaauuaacacaug

SEQ ID NO: 2697622 - RNA, 17 nt, Human
ucacuugucaauaaaau

SEQ ID NO: 2697623 - RNA, 16 nt, Human
ucccaaauuucauacc

SEQ ID NO: 2697624 - RNA, 17 nt, Human
ucccucccuccaccucc

SEQ ID NO: 2697625 - RNA, 17 nt, Human
uccaagcauuuagaugu

SEQ ID NO: 2697626 - RNA, 23 nt, Human
uccaagcauaccaacacgagcag

SEQ ID NO: 2697627 - RNA, 14 nt, Human
ucauuucuuugagu

SEQ ID NO: 2697628 - RNA, 22 nt, Human
ucauuucugcaucagcugcuga

SEQ ID NO: 2697629 - RNA, 16 nt, Human
ucauuucugcaucagc

SEQ ID NO: 2697630 - RNA, 12 nt, Human
uccaaagaaaug

SEQ ID NO: 2697631 - RNA, 23 nt, Human
uccaaacugacucuuaagaagac

SEQ ID NO: 2697632 - RNA, 23 nt, Human
uccaccucccugcaauaaaaugg

SEQ ID NO: 2697633 - RNA, 12 nt, Human
uccaccucccug

SEQ ID NO: 2697634 - RNA, 14 nt, Human
uccaccuacaugag

SEQ ID NO: 2697635 - RNA, 20 nt, Human
uccaagcauuuagauguaua

SEQ ID NO: 2697636 - RNA, 14 nt, Human
uccagauccuggaa

SEQ ID NO: 2697637 - RNA, 16 nt, Human
uccagauccuggaaau

SEQ ID NO: 2697638 - RNA, 17 nt, Human
uccagauccuggaaauc

SEQ ID NO: 2697639 - RNA, 13 nt, Human
uccacuuggucug

SEQ ID NO: 2697640 - RNA, 12 nt, Human
uccacuuggucu

SEQ ID NO: 2697641 - RNA, 18 nt, Human
ucucuucacagucacauu

SEQ ID NO: 2697642 - RNA, 13 nt, Human
ucucuaggaaaua

SEQ ID NO: 2697643 - RNA, 19 nt, Human
ucucuaggaaauauuuauu

SEQ ID NO: 2697644 - RNA, 21 nt, Human
ucuccugggcagcugccuccc

SEQ ID NO: 2697645 - RNA, 19 nt, Human
ucuccugggcagcugccuc

SEQ ID NO: 2697646 - RNA, 20 nt, Human
ucuccugggcagcugccucc

SEQ ID NO: 2697647 - RNA, 21 nt, Human
ucucagugucaaugcagcccc

SEQ ID NO: 2697648 - RNA, 14 nt, Human
ucuccugggcagcu

SEQ ID NO: 2697649 - RNA, 13 nt, Human
ucuccugggcagc

SEQ ID NO: 2697650 - RNA, 15 nt, Human
ucuccugggcagcug

SEQ ID NO: 2697651 - RNA, 16 nt, Human
ucuccugggcagcugc

SEQ ID NO: 2697652 - RNA, 17 nt, Human
ucuccugggcagcugcc

SEQ ID NO: 2697653 - RNA, 18 nt, Human
ucuccugggcagcugccu

SEQ ID NO: 2697654 - RNA, 15 nt, Human
uccuugcaucaauuu

SEQ ID NO: 2697655 - RNA, 21 nt, Human
ucuacacuaagagagaaugag

SEQ ID NO: 2697656 - RNA, 17 nt, Human
ucuacacuccagugaga

SEQ ID NO: 2697657 - RNA, 14 nt, Human
ugaacacaucagcu

SEQ ID NO: 2697658 - RNA, 22 nt, Human
ugaacuuguaaaggaauuuaaa

SEQ ID NO: 2697659 - RNA, 21 nt, Human
ugaaguccaagcauuuagaug

SEQ ID NO: 2697660 - RNA, 22 nt, Human
ugaaguccaagcauuuagaugu

SEQ ID NO: 2697661 - RNA, 23 nt, Human
ugaaagcagggacuugaacccau

SEQ ID NO: 2697662 - RNA, 19 nt, Human
ugaaagcagggacuugaac

SEQ ID NO: 2697663 - RNA, 18 nt, Human
ugaaagcagggacuugaa

SEQ ID NO: 2697664 - RNA, 18 nt, Human
ugaaacccugucucuacu

SEQ ID NO: 2697665 - RNA, 22 nt, Human
ugaaaagacuccaaagaaaugu

SEQ ID NO: 2697666 - RNA, 19 nt, Human
ugaaaagacuccaaagaaa

SEQ ID NO: 2697667 - RNA, 17 nt, Human
ugaaaagacuccaaaga

SEQ ID NO: 2697668 - RNA, 16 nt, Human
ugaaaagacuccaaag

SEQ ID NO: 2697669 - RNA, 15 nt, Human
ugaaaagacuccaaa

SEQ ID NO: 2697670 - RNA, 19 nt, Human
ugaaaacuuuaugcuaagu

SEQ ID NO: 2697671 - RNA, 20 nt, Human
ucuguuuuauaauuuuguga

SEQ ID NO: 2697672 - RNA, 22 nt, Human
ucuguuuuauaauuuugugaag

SEQ ID NO: 2697673 - RNA, 23 nt, Human
ucuggccuucggccuccauccug

SEQ ID NO: 2697674 - RNA, 19 nt, Human
ucuguaauaaacucauuuc

SEQ ID NO: 2697675 - RNA, 23 nt, Human
ucuguaauaaacucauuucuagc

SEQ ID NO: 2697676 - RNA, 24 nt, Human
ucuguaauaaacucauuucuagca

SEQ ID NO: 2697677 - RNA, 18 nt, Human
ugccuccccuccucugcu

SEQ ID NO: 2697678 - RNA, 19 nt, Human
ugccuccccuccucugcuu

SEQ ID NO: 2697679 - RNA, 22 nt, Human
ugccuccccuccucugcuugcc

SEQ ID NO: 2697680 - RNA, 23 nt, Human
ugccuccccuccucugcuugcca

SEQ ID NO: 2697681 - RNA, 22 nt, Human
ugccuucucaacuccaaacuga

SEQ ID NO: 2697682 - RNA, 17 nt, Human
ugccuucucaacuccaa

SEQ ID NO: 2697683 - RNA, 18 nt, Human
ugcuagaacucccuuuca

SEQ ID NO: 2697684 - RNA, 19 nt, Human
ugcuagaacucccuuucaa

SEQ ID NO: 2697685 - RNA, 21 nt, Human
ugcuagaacucccuuucaaca

SEQ ID NO: 2697686 - RNA, 20 nt, Human
ugcuagaacucccuuucaac

SEQ ID NO: 2697687 - RNA, 16 nt, Human
ugcagauaaacaguag

SEQ ID NO: 2697688 - RNA, 17 nt, Human
ugcagauaaacaguagu

SEQ ID NO: 2697689 - RNA, 15 nt, Human
ugcacaucaaaauau

SEQ ID NO: 2697690 - RNA, 21 nt, Human
ugccaucccucccuccaccuc

SEQ ID NO: 2697691 - RNA, 22 nt, Human
ugccaucccucccuccaccucc

SEQ ID NO: 2697692 - RNA, 15 nt, Human
ugccaucccucccuc

SEQ ID NO: 2697693 - RNA, 19 nt, Human
ugccaucccucccuccacc

SEQ ID NO: 2697694 - RNA, 20 nt, Human
ugccaucccucccuccaccu

SEQ ID NO: 2697695 - RNA, 22 nt, Human
ugcaucagcugcugaaacaaca

SEQ ID NO: 2697696 - RNA, 19 nt, Human
ugcaucagcugcugaaaca

SEQ ID NO: 2697697 - RNA, 14 nt, Human
ugcauuauauuuau

SEQ ID NO: 2697698 - RNA, 20 nt, Human
ugcauuauauuuauuacugu

SEQ ID NO: 2697699 - RNA, 15 nt, Human
ugcauuauauuuauu

SEQ ID NO: 2697700 - RNA, 14 nt, Human
uggaacucucgagc

SEQ ID NO: 2697701 - RNA, 14 nt, Human
ugcuucuguuuuau

SEQ ID NO: 2697702 - RNA, 17 nt, Human
uggguagacacacauga

SEQ ID NO: 2697703 - RNA, 16 nt, Human
uggguagacacacaug

SEQ ID NO: 2697704 - RNA, 18 nt, Human
ugggacagucaccucaug

SEQ ID NO: 2697705 - RNA, 20 nt, Human
ugggacagucaccucaugga

SEQ ID NO: 2697706 - RNA, 21 nt, Human
ugggacagucaccucauggaa

SEQ ID NO: 2697707 - RNA, 19 nt, Human
ugggacauuugcucaugga

SEQ ID NO: 2697708 - RNA, 20 nt, Human
ugggacauuugcucauggaa

SEQ ID NO: 2697709 - RNA, 18 nt, Human
uggccuucggccuccauc

SEQ ID NO: 2697710 - RNA, 17 nt, Human
uggccuucggccuccau

SEQ ID NO: 2697711 - RNA, 14 nt, Human
uggccuucggccuc

SEQ ID NO: 2697712 - RNA, 19 nt, Human
uuaaaagaaugauuaugaa

SEQ ID NO: 2697713 - RNA, 13 nt, Human
uuaaaagaaugau

SEQ ID NO: 2697714 - RNA, 20 nt, Human
uuaaagcuuauuaaaacuca

SEQ ID NO: 2697715 - RNA, 18 nt, Human
uuaauaauguuucaaaca

SEQ ID NO: 2697716 - RNA, 16 nt, Human
uuaauaauguuucaaa

SEQ ID NO: 2697717 - RNA, 22 nt, Human
uuaaugucaauucuugccaaau

SEQ ID NO: 2697718 - RNA, 14 nt, Human
uuacauuuguauaa

SEQ ID NO: 2697719 - RNA, 15 nt, Human
uuacauuuguauaaa

SEQ ID NO: 2697720 - RNA, 20 nt, Human
uuacagagacagaaagcaga

SEQ ID NO: 2697721 - RNA, 21 nt, Human
uuaccacuuguguuuugcaag

SEQ ID NO: 2697722 - RNA, 19 nt, Human
ugugugcguccugucggag

SEQ ID NO: 2697723 - RNA, 16 nt, Human
uguucacagccagacu

SEQ ID NO: 2697724 - RNA, 14 nt, Human
uguuagugcaaauu

SEQ ID NO: 2697725 - RNA, 12 nt, Human
uguuauaaucuu

SEQ ID NO: 2697726 - RNA, 13 nt, Human
uguuuaaaaucau

SEQ ID NO: 2697727 - RNA, 14 nt, Human
uguuuaaaaucauu

SEQ ID NO: 2697728 - RNA, 21 nt, Human
uguuggagaagaacugaaauc

SEQ ID NO: 2697729 - RNA, 16 nt, Human
uguaugauucccagcc

SEQ ID NO: 2697730 - RNA, 14 nt, Human
uguaaucacagcua

SEQ ID NO: 2697731 - RNA, 15 nt, Human
uguaaucacagcuac

SEQ ID NO: 2697732 - RNA, 17 nt, Human
uguagauaauacaguuc

SEQ ID NO: 2697733 - RNA, 15 nt, Human
uguaccgcaauguga

SEQ ID NO: 2697734 - RNA, 14 nt, Human
ugugcguccugucg

SEQ ID NO: 2697735 - RNA, 22 nt, Human
ugucucaguccaugaagaugua

SEQ ID NO: 2697736 - RNA, 21 nt, Human
ugucucaguccaugaagaugu

SEQ ID NO: 2697737 - RNA, 22 nt, Human
ugugaccacugcagaagacagu

SEQ ID NO: 2697738 - RNA, 12 nt, Human
uugggaggcuga

SEQ ID NO: 2697739 - RNA, 14 nt, Human
uuguauuacaaauc

SEQ ID NO: 2697740 - RNA, 19 nt, Human
uuguaucacaaaucuuaac

SEQ ID NO: 2697741 - RNA, 18 nt, Human
uuguaaaugugcuuuuaa

SEQ ID NO: 2697742 - RNA, 14 nt, Human
uuguaaaugugcuu

SEQ ID NO: 2697743 - RNA, 11 nt, Human
uuguaaaugug

SEQ ID NO: 2697744 - RNA, 16 nt, Human
uuguaaaggaauuuaa

SEQ ID NO: 2697745 - RNA, 14 nt, Human
uucugagcauuuaa

SEQ ID NO: 2697746 - RNA, 15 nt, Human
uucugagaaagacua

SEQ ID NO: 2697747 - RNA, 15 nt, Human
uucuuauuucauuuc

SEQ ID NO: 2697748 - RNA, 23 nt, Human
uugaaaagacuccaaagaaaugu

SEQ ID NO: 2697749 - RNA, 22 nt, Human
uugaaaagacuccaaagaaaug

SEQ ID NO: 2697750 - RNA, 18 nt, Human
uugaaaagacuccaaaga

SEQ ID NO: 2697751 - RNA, 16 nt, Human
uugaaaagacuccaaa

SEQ ID NO: 2697752 - RNA, 23 nt, Human
uugaaacugagaugugaacacau

SEQ ID NO: 2697753 - RNA, 15 nt, Human
uugaggacacugaua

SEQ ID NO: 2697754 - RNA, 14 nt, Human
uugaggacacugau

SEQ ID NO: 2697755 - RNA, 18 nt, Human
uugcauagauucccugag

SEQ ID NO: 2697756 - RNA, 12 nt, Human
uugaugaagaag

SEQ ID NO: 2697757 - RNA, 21 nt, Human
uucagagcugcccucuccugg

SEQ ID NO: 2697758 - RNA, 22 nt, Human
uucagagcugcccucuccuggg

SEQ ID NO: 2697759 - RNA, 23 nt, Human
uucagagcugcccucuccugggc

SEQ ID NO: 2697760 - RNA, 19 nt, Human
uuccacuuauaggaauuga

SEQ ID NO: 2697761 - RNA, 19 nt, Human
uucggccuccauccugagg

SEQ ID NO: 2697762 - RNA, 18 nt, Human
uucggccuccauccugag

SEQ ID NO: 2697763 - RNA, 22 nt, Human
uucggccuccauccugaggcuc

SEQ ID NO: 2697764 - RNA, 12 nt, Human
uuccuagugaaa

SEQ ID NO: 2697765 - RNA, 18 nt, Human
uucccuugaugaagaagu

SEQ ID NO: 2697766 - RNA, 23 nt, Human
uucucuccucuccccaugauguu

SEQ ID NO: 2697767 - RNA, 21 nt, Human
uuucagauaaucacaauacau

SEQ ID NO: 2697768 - RNA, 15 nt, Human
uuucagcagcugcag

SEQ ID NO: 2697769 - RNA, 15 nt, Human
uuucagauaaucaca

SEQ ID NO: 2697770 - RNA, 22 nt, Human
uuucugagaaagacuauucaaa

SEQ ID NO: 2697771 - RNA, 12 nt, Human
uuuagaaacaca

SEQ ID NO: 2697772 - RNA, 20 nt, Human
uuuagaaacacaacuauauu

SEQ ID NO: 2697773 - RNA, 21 nt, Human
uuuguauaaaauaauuuuuau

SEQ ID NO: 2697774 - RNA, 21 nt, Human
uuugcauagauucccugagca

SEQ ID NO: 2697775 - RNA, 10 nt, Human
uuuuauauuu

SEQ ID NO: 2697776 - RNA, 20 nt, Human
uuuuauaucaauuuaaaaaa

SEQ ID NO: 2697777 - RNA, 15 nt, Human
uuuuauaugcuucug

SEQ ID NO: 2697778 - RNA, 20 nt, Human
uuuuauaugcuucuguuuua

SEQ ID NO: 2697779 - RNA, 13 nt, Human
uuuuccugaaaac

SEQ ID NO: 2697780 - RNA, 13 nt, Human
auaauguuucaaa

SEQ ID NO: 2697781 - RNA, 22 nt, Human
auaagccagacaucaacagaua

SEQ ID NO: 2697782 - RNA, 21 nt, Human
auaagccagacaucaacagau

SEQ ID NO: 2697783 - RNA, 18 nt, Human
auaauguuucaaacauau

SEQ ID NO: 2697784 - RNA, 14 nt, Human
auaacaaugaaagu

SEQ ID NO: 2697785 - RNA, 15 nt, Human
auaacaaugcuguau

SEQ ID NO: 2697786 - RNA, 17 nt, Human
auaacaaugcuguauuu

SEQ ID NO: 2697787 - RNA, 19 nt, Human
auaacaaugcuguauuuua

SEQ ID NO: 2697788 - RNA, 20 nt, Human
auaacaaugcuguauuuuaa

SEQ ID NO: 2697789 - RNA, 21 nt, Human
auaacaaugcuguauuuuaaa

SEQ ID NO: 2697790 - RNA, 13 nt, Human
auauuauguuaaa

SEQ ID NO: 2697791 - RNA, 14 nt, Human
auauuauguuaaaa

SEQ ID NO: 2697792 - RNA, 15 nt, Human
auagcagcuuauuca

SEQ ID NO: 2697793 - RNA, 11 nt, Human
aguccaagcau

SEQ ID NO: 2697794 - RNA, 19 nt, Human
agugucaaugcagccccca

SEQ ID NO: 2697795 - RNA, 23 nt, Human
aguucagagcugcccucuccugg

SEQ ID NO: 2697796 - RNA, 21 nt, Human
aguucagagcugcccucuccu

SEQ ID NO: 2697797 - RNA, 22 nt, Human
aguucagagcugcccucuccug

SEQ ID NO: 2697798 - RNA, 20 nt, Human
aguucagagcugcccucucc

SEQ ID NO: 2697799 - RNA, 18 nt, Human
aguugaaaagacuccaaa

SEQ ID NO: 2697800 - RNA, 14 nt, Human
aguugaaaagacuc

SEQ ID NO: 2697801 - RNA, 20 nt, Human
aguugaaaagacuccaaaga

SEQ ID NO: 2697802 - RNA, 19 nt, Human
aguugaaaagacuccaaag

SEQ ID NO: 2697803 - RNA, 20 nt, Human
augaaguccaagcauuuaga

SEQ ID NO: 2697804 - RNA, 23 nt, Human
augaaguccaagcauuuagaugu

SEQ ID NO: 2697805 - RNA, 21 nt, Human
augaaguacucauacauguua

SEQ ID NO: 2697806 - RNA, 13 nt, Human
augaaguacucau

SEQ ID NO: 2697807 - RNA, 19 nt, Human
auccucaguuuuugugaaa

SEQ ID NO: 2697808 - RNA, 17 nt, Human
aucgcuccaccuugcag

SEQ ID NO: 2697809 - RNA, 21 nt, Human
aucgcuccaccuugcagcucu

SEQ ID NO: 2697810 - RNA, 14 nt, Human
aucaaauaugcaaa

SEQ ID NO: 2697811 - RNA, 17 nt, Human
aucaugaauuaguuuua

SEQ ID NO: 2697812 - RNA, 13 nt, Human
aucagcuuauugu

SEQ ID NO: 2697813 - RNA, 22 nt, Human
aucagcuugcccuguuaaaaga

SEQ ID NO: 2697814 - RNA, 17 nt, Human
auguuccuagugaaaga

SEQ ID NO: 2697815 - RNA, 16 nt, Human
auguuccuagugaaag

SEQ ID NO: 2697816 - RNA, 15 nt, Human
auguuccuagugaaa

SEQ ID NO: 2697817 - RNA, 15 nt, Human
augugaacacaucag

SEQ ID NO: 2697818 - RNA, 16 nt, Human
augucaaucagccuag

SEQ ID NO: 2697819 - RNA, 21 nt, Human
augucaaucagccuaguugau

SEQ ID NO: 2697820 - RNA, 16 nt, Human
augaucuuuaaaauac

SEQ ID NO: 2697821 - RNA, 21 nt, Human
augaugaucuuuaaaauacac

SEQ ID NO: 2697822 - RNA, 18 nt, Human
augaugaucuuuaaaaua

SEQ ID NO: 2697823 - RNA, 17 nt, Human
agcgacagugagacucu

SEQ ID NO: 2697824 - RNA, 19 nt, Human
agcuccccucggagaagag

SEQ ID NO: 2697825 - RNA, 17 nt, Human
agcuccccucggagaag

SEQ ID NO: 2697826 - RNA, 20 nt, Human
agcuccccucggagaagagc

SEQ ID NO: 2697827 - RNA, 20 nt, Human
agcuuauuuccucauuuuua

SEQ ID NO: 2697828 - RNA, 13 nt, Human
aggaaguagagga

SEQ ID NO: 2697829 - RNA, 15 nt, Human
agggauuagggagag

SEQ ID NO: 2697830 - RNA, 17 nt, Human
agggauuuucagcccuc

SEQ ID NO: 2697831 - RNA, 22 nt, Human
agggauuuucagcccucagaau

SEQ ID NO: 2697832 - RNA, 15 nt, Human
agggacugaggggag

SEQ ID NO: 2697833 - RNA, 21 nt, Human
aggccaugggcacugugggua

SEQ ID NO: 2697834 - RNA, 13 nt, Human
agaggaaugaagu

SEQ ID NO: 2697835 - RNA, 18 nt, Human
agacucugucucagucca

SEQ ID NO: 2697836 - RNA, 16 nt, Human
agacuggauaguccgu

SEQ ID NO: 2697837 - RNA, 20 nt, Human
agacuggauaguccgucucu

SEQ ID NO: 2697838 - RNA, 19 nt, Human
agacccaaaaggcagaagc

SEQ ID NO: 2697839 - RNA, 17 nt, Human
agacccaaaaggcagaa

SEQ ID NO: 2697840 - RNA, 17 nt, Human
agaaugagagacacacu

SEQ ID NO: 2697841 - RNA, 22 nt, Human
agaaugagagacacacugaaga

SEQ ID NO: 2697842 - RNA, 17 nt, Human
agaaugauuaugaauua

SEQ ID NO: 2697843 - RNA, 21 nt, Human
agaagugaaaaucuacacucc

SEQ ID NO: 2697844 - RNA, 18 nt, Human
agaagacugcauuauauu

SEQ ID NO: 2697845 - RNA, 21 nt, Human
agaagagcuguucacagccag

SEQ ID NO: 2697846 - RNA, 22 nt, Human
agaagagcuguucacagccaga

SEQ ID NO: 2697847 - RNA, 19 nt, Human
agauguagaggagaaacug

SEQ ID NO: 2697848 - RNA, 16 nt, Human
agauguagaggagaaa

SEQ ID NO: 2697849 - RNA, 24 nt, Human
agcaaaauuuuuucucuaggaaau

SEQ ID NO: 2697850 - RNA, 21 nt, Human
aagggauuuucagcccucaga

SEQ ID NO: 2697851 - RNA, 23 nt, Human
aagggauuuucagcccucagaau

SEQ ID NO: 2697852 - RNA, 17 nt, Human
aagggauggcaagaugu

SEQ ID NO: 2697853 - RNA, 14 nt, Human
aagggauggcaaga

SEQ ID NO: 2697854 - RNA, 15 nt, Human
aagggauuuucagcc

SEQ ID NO: 2697855 - RNA, 12 nt, Human
aaguagaggagg

SEQ ID NO: 2697856 - RNA, 19 nt, Human
aagccagauuuuccugaaa

SEQ ID NO: 2697857 - RNA, 23 nt, Human
aagacagugaaagaaaauaacaa

SEQ ID NO: 2697858 - RNA, 15 nt, Human
aagagaacuuccaga

SEQ ID NO: 2697859 - RNA, 15 nt, Human
aagcagggacuugaa

SEQ ID NO: 2697860 - RNA, 14 nt, Human
aagauagcagggca

SEQ ID NO: 2697861 - RNA, 17 nt, Human
aaguucugcagauaaac

SEQ ID NO: 2697862 - RNA, 22 nt, Human
aaguugauaugccuuuucccaa

SEQ ID NO: 2697863 - RNA, 10 nt, Human
aauaaaccau

SEQ ID NO: 2697864 - RNA, 14 nt, Human
aauaauguuucaaa

SEQ ID NO: 2697865 - RNA, 19 nt, Human
aauaauguuucaaacauau

SEQ ID NO: 2697866 - RNA, 12 nt, Human
aauaauguuuca

SEQ ID NO: 2697867 - RNA, 22 nt, Human
aaucaaauaugcaaagcacuga

SEQ ID NO: 2697868 - RNA, 16 nt, Human
aaucaaauaugcaaag

SEQ ID NO: 2697869 - RNA, 15 nt, Human
aaucaaauaugcaaa

SEQ ID NO: 2697870 - RNA, 22 nt, Human
aaucauuucugcaucagcugcu

SEQ ID NO: 2697871 - RNA, 14 nt, Human
aaugauaacuggaa

SEQ ID NO: 2697872 - RNA, 15 nt, Human
aaugauaacuggaaa

SEQ ID NO: 2697873 - RNA, 16 nt, Human
aaugauaacuggaaac

SEQ ID NO: 2697874 - RNA, 17 nt, Human
aauccauacauuugugu

SEQ ID NO: 2697875 - RNA, 16 nt, Human
aauccauacauuugug

SEQ ID NO: 2697876 - RNA, 15 nt, Human
aauccaaugaaauga

SEQ ID NO: 2697877 - RNA, 23 nt, Human
aacugagaugugaacacaucagc

SEQ ID NO: 2697878 - RNA, 14 nt, Human
aaaucuuaacuuga

SEQ ID NO: 2697879 - RNA, 20 nt, Human
aaauguucaucaaugaauga

SEQ ID NO: 2697880 - RNA, 22 nt, Human
aaauugacacuuaaaaaugguu

SEQ ID NO: 2697881 - RNA, 12 nt, Human
aacacaucagcu

SEQ ID NO: 2697882 - RNA, 19 nt, Human
aaaauccauacauuugugu

SEQ ID NO: 2697883 - RNA, 13 nt, Human
aaagaaacauuug

SEQ ID NO: 2697884 - RNA, 19 nt, Human
aaacccuugccaugugcua

SEQ ID NO: 2697885 - RNA, 21 nt, Human
aaacccugucucuacuaaaaa

SEQ ID NO: 2697886 - RNA, 20 nt, Human
aaagcauuguaaaugugcuu

SEQ ID NO: 2697887 - RNA, 19 nt, Human
aaagcauuguaaaugugcu

SEQ ID NO: 2697888 - RNA, 19 nt, Human
aaaggcagaagcaacccaa

SEQ ID NO: 2697889 - RNA, 16 nt, Human
acagaagcuccaggua

SEQ ID NO: 2697890 - RNA, 21 nt, Human
acaaggaugaauuaaguuuuu

SEQ ID NO: 2697891 - RNA, 16 nt, Human
acaagaaaugaaagca

SEQ ID NO: 2697892 - RNA, 15 nt, Human
acaagaaaugaaagc

SEQ ID NO: 2697893 - RNA, 13 nt, Human
acaagaaaugaaa

SEQ ID NO: 2697894 - RNA, 17 nt, Human
aauuuugugaagcaaaa

SEQ ID NO: 2697895 - RNA, 18 nt, Human
aauuuugugaagcaaaau

SEQ ID NO: 2697896 - RNA, 20 nt, Human
acagugauuaccagggacug

SEQ ID NO: 2697897 - RNA, 21 nt, Human
acagugauuaccagggacuga

SEQ ID NO: 2697898 - RNA, 20 nt, Human
acaucccuuaccugggaaag

SEQ ID NO: 2697899 - RNA, 20 nt, Human
accaaggcugauuaaaccaa

SEQ ID NO: 2697900 - RNA, 19 nt, Human
accaaggcugauuaaacca

SEQ ID NO: 2697901 - RNA, 19 nt, Human
acggacgaaccuugaaaac

SEQ ID NO: 2697902 - RNA, 19 nt, Human
acuaguauuucuaugaaau

SEQ ID NO: 2697903 - RNA, 18 nt, Human
acuaguauuucuaugaaa

SEQ ID NO: 2697904 - RNA, 17 nt, Human
accucugccucagaaaa

SEQ ID NO: 2697905 - RNA, 18 nt, Human
accucugccucagaaaac

SEQ ID NO: 2697906 - RNA, 14 nt, Human
acucuuaagaagac

SEQ ID NO: 2697907 - RNA, 15 nt, Human
acucuuaagaagacu

SEQ ID NO: 2697908 - RNA, 20 nt, Human
acucuuaagaagacugcauu

SEQ ID NO: 2697909 - RNA, 17 nt, Human
acucugucucaguccau

SEQ ID NO: 2697910 - RNA, 15 nt, Human
acucugucucagucc

SEQ ID NO: 2697911 - RNA, 14 nt, Human
acuuaaaaaugguu

SEQ ID NO: 2697912 - RNA, 13 nt, Human
acuuaaaaauggu

SEQ ID NO: 2697913 - RNA, 19 nt, Human
acuucaaauccuugaagau

SEQ ID NO: 2697914 - RNA, 20 nt, Human
acuucaaauccuugaagauu

SEQ ID NO: 2697915 - RNA, 17 nt, Human
acuucagcgguuuauau

SEQ ID NO: 2697916 - RNA, 18 nt, Human
acuucagcgguuuauaua

SEQ ID NO: 2697917 - RNA, 19 nt, Human
acuucagcgguuuauauaa

SEQ ID NO: 2697918 - RNA, 17 nt, Human
acuuuaugcuaagugaa

SEQ ID NO: 2697919 - RNA, 12 nt, Human
acuuuaugcuaa

SEQ ID NO: 2697920 - RNA, 22 nt, Human
acuugggaggcugagaugggag

SEQ ID NO: 2697921 - RNA, 20 nt, Human
gcuccacuuggucugugaga

SEQ ID NO: 2697922 - RNA, 16 nt, Human
gcugaaacaacaaaua

SEQ ID NO: 2697923 - RNA, 12 nt, Human
gcugaacaucac

SEQ ID NO: 2697924 - RNA, 21 nt, Human
gcucugcccauccugccccug

SEQ ID NO: 2697925 - RNA, 15 nt, Human
gcucugcccauccug

SEQ ID NO: 2697926 - RNA, 13 nt, Human
gcuguauuuuaaa

SEQ ID NO: 2697927 - RNA, 12 nt, Human
gcuguauuuuaa

SEQ ID NO: 2697928 - RNA, 17 nt, Human
gcuuauuuccucauuuu

SEQ ID NO: 2697929 - RNA, 19 nt, Human
gcuuccuggcaauagucaa

SEQ ID NO: 2697930 - RNA, 20 nt, Human
gccuccauccugaggcucca

SEQ ID NO: 2697931 - RNA, 16 nt, Human
gccuccauccugaggc

SEQ ID NO: 2697932 - RNA, 15 nt, Human
gccuccauccugagg

SEQ ID NO: 2697933 - RNA, 17 nt, Human
gcuacaaaaacacagca

SEQ ID NO: 2697934 - RNA, 19 nt, Human
gcuacaaaaacacagcaag

SEQ ID NO: 2697935 - RNA, 18 nt, Human
gcuacaaaaacacagcaa

SEQ ID NO: 2697936 - RNA, 15 nt, Human
gcuacugucagcucc

SEQ ID NO: 2697937 - RNA, 17 nt, Human
gcuacuugggaggcuga

SEQ ID NO: 2697938 - RNA, 15 nt, Human
gccccacccucagau

SEQ ID NO: 2697939 - RNA, 18 nt, Human
gccccacccucagaugca

SEQ ID NO: 2697940 - RNA, 22 nt, Human
gccaugugcuaguaauuggaaa

SEQ ID NO: 2697941 - RNA, 20 nt, Human
gccagcaguucagagcugcc

SEQ ID NO: 2697942 - RNA, 21 nt, Human
gccagcaguucagagcugccc

SEQ ID NO: 2697943 - RNA, 13 nt, Human
gccagcaguucag

SEQ ID NO: 2697944 - RNA, 14 nt, Human
gccagcaguucaga

SEQ ID NO: 2697945 - RNA, 19 nt, Human
gccagcaguucagagcugc

SEQ ID NO: 2697946 - RNA, 22 nt, Human
gccaguuauggcuauaggugcu

SEQ ID NO: 2697947 - RNA, 16 nt, Human
gccauaugaaaaggcu

SEQ ID NO: 2697948 - RNA, 22 nt, Human
ggauguugaaaaaguucugcag

SEQ ID NO: 2697949 - RNA, 12 nt, Human
ggauggcaagau

SEQ ID NO: 2697950 - RNA, 23 nt, Human
ggccuucggccuccauccugagg

SEQ ID NO: 2697951 - RNA, 22 nt, Human
ggccuucggccuccauccugag

SEQ ID NO: 2697952 - RNA, 13 nt, Human
ggccuccauccug

SEQ ID NO: 2697953 - RNA, 20 nt, Human
gggacauuugcucauggaau

SEQ ID NO: 2697954 - RNA, 21 nt, Human
gggacauuugcucauggaauu

SEQ ID NO: 2697955 - RNA, 19 nt, Human
gggacauuugcucauggaa

SEQ ID NO: 2697956 - RNA, 12 nt, Human
aaaaccacagca

SEQ ID NO: 2697957 - RNA, 22 nt, Human
aaaaauggaacauaaaauacaa

SEQ ID NO: 2697958 - RNA, 13 nt, Human
aaaacucauuuuu

SEQ ID NO: 2697959 - RNA, 17 nt, Human
aaaagaugaaaauauuu

SEQ ID NO: 2697960 - RNA, 14 nt, Human
aaaaccacagcagu

SEQ ID NO: 2697961 - RNA, 13 nt, Human
aaaaccacagcag

SEQ ID NO: 2697962 - RNA, 17 nt, Human
gggauuguaaaauggug

SEQ ID NO: 2697963 - RNA, 16 nt, Human
gggauuguaaaauggu

SEQ ID NO: 2697964 - RNA, 19 nt, Human
aaaaguauguuagugcaaa

SEQ ID NO: 2697965 - RNA, 15 nt, Human
gggcgugguggugag

SEQ ID NO: 2697966 - RNA, 20 nt, Human
aaacagucucaggaaaucaa

SEQ ID NO: 2697967 - RNA, 20 nt, Human
aaacaagcacuaaacaaaga

SEQ ID NO: 2697968 - RNA, 22 nt, Human
aaaauuuuuucucuaggaaaua

SEQ ID NO: 2697969 - RNA, 15 nt, Human
aaaaugugauaugua

SEQ ID NO: 2697970 - RNA, 15 nt, Human
aaauaauuuuuauau

SEQ ID NO: 2697971 - RNA, 18 nt, Human
aaauaauuuuuauauuug

SEQ ID NO: 2697972 - RNA, 20 nt, Human
aaauaauuuuuauauuugaa

SEQ ID NO: 2697973 - RNA, 16 nt, Human
gguuuagaaagcuugc

SEQ ID NO: 2697974 - RNA, 12 nt, Human
gguuucuagcau

SEQ ID NO: 2697975 - RNA, 16 nt, Human
ggugugaccacugcag

SEQ ID NO: 2697976 - RNA, 17 nt, Human
aaagcagggacuugaac

SEQ ID NO: 2697977 - RNA, 15 nt, Human
aaagacuauucaaac

SEQ ID NO: 2697978 - RNA, 14 nt, Human
aaagacuauucaaa

SEQ ID NO: 2697979 - RNA, 22 nt, Human
gaaugagagacacacugaagaa

SEQ ID NO: 2697980 - RNA, 23 nt, Human
gaaugagagacacacugaagaag

SEQ ID NO: 2697981 - RNA, 20 nt, Human
gaaugagagacacacugaag

SEQ ID NO: 2697982 - RNA, 16 nt, Human
gacacuuaaaaauggu

SEQ ID NO: 2697983 - RNA, 17 nt, Human
gacagucaccucaugga

SEQ ID NO: 2697984 - RNA, 14 nt, Human
gacagugaaagaaa

SEQ ID NO: 2697985 - RNA, 11 nt, Human
gaauuaguuuu

SEQ ID NO: 2697986 - RNA, 13 nt, Human
gacacacugaaga

SEQ ID NO: 2697987 - RNA, 12 nt, Human
gacacacaugaa

SEQ ID NO: 2697988 - RNA, 14 nt, Human
gacacacugaagaa

SEQ ID NO: 2697989 - RNA, 17 nt, Human
gacucuuaagaagacug

SEQ ID NO: 2697990 - RNA, 15 nt, Human
gacucuuaagaagac

SEQ ID NO: 2697991 - RNA, 16 nt, Human
gacucuuaagaagacu

SEQ ID NO: 2697992 - RNA, 22 nt, Human
gacuauucaaacagucucagga

SEQ ID NO: 2697993 - RNA, 15 nt, Human
gagaaucacuugaac

SEQ ID NO: 2697994 - RNA, 14 nt, Human
gagaaucacuugaa

SEQ ID NO: 2697995 - RNA, 11 nt, Human
gcagcugccuc

SEQ ID NO: 2697996 - RNA, 12 nt, Human
gcagcugccucc

SEQ ID NO: 2697997 - RNA, 13 nt, Human
gcagcugccuccc

SEQ ID NO: 2697998 - RNA, 15 nt, Human
gcagcugccuccccu

SEQ ID NO: 2697999 - RNA, 16 nt, Human
gcagcugccuccccuc

SEQ ID NO: 2698000 - RNA, 17 nt, Human
gcagcugccuccccucc

SEQ ID NO: 2698001 - RNA, 18 nt, Human
gcagcugccuccccuccu

SEQ ID NO: 2698002 - RNA, 22 nt, Human
gcagcugccuccccuccucugc

SEQ ID NO: 2698003 - RNA, 19 nt, Human
gcagggacuugaacccaua

SEQ ID NO: 2698004 - RNA, 18 nt, Human
gcacaguuuucugagaaa

SEQ ID NO: 2698005 - RNA, 17 nt, Human
gcacaguuuucugagaa

SEQ ID NO: 2698006 - RNA, 14 nt, Human
gcacaguuuucuga

SEQ ID NO: 2698007 - RNA, 21 nt, Human
gcacaugagcuggcgggauug

SEQ ID NO: 2698008 - RNA, 14 nt, Human
gauuaccagggacu

SEQ ID NO: 2698009 - RNA, 16 nt, Human
gaugugaacacaucag

SEQ ID NO: 2698010 - RNA, 14 nt, Human
gaugugaacacauc

SEQ ID NO: 2698011 - RNA, 17 nt, Human
gauuagggagagaagau

SEQ ID NO: 2698012 - RNA, 20 nt, Human
gauauguaccuaacgaagua

SEQ ID NO: 2698013 - RNA, 21 nt, Human
gagugcucaguagucagacug

SEQ ID NO: 2698014 - RNA, 16 nt, Human
gaguuuagcuggaaaa

SEQ ID NO: 2698015 - RNA, 17 nt, Human
gaaagacuauucaaaca

SEQ ID NO: 2698016 - RNA, 15 nt, Human
gaaagacuauucaaa

SEQ ID NO: 2698017 - RNA, 14 nt, Human
gaaagacuauucaa

SEQ ID NO: 2698018 - RNA, 17 nt, Human
gaaauauuuauuuuaau

SEQ ID NO: 2698019 - RNA, 18 nt, Human
gaaaucaaauaugcaaag

SEQ ID NO: 2698020 - RNA, 18 nt, Human
gaaauauuuauuuuaaua

SEQ ID NO: 2698021 - RNA, 22 nt, Human
gaaauauuuauuuuaauaaugu

SEQ ID NO: 2698022 - RNA, 20 nt, Human
gaaaucaaauaugcaaagca

SEQ ID NO: 2698023 - RNA, 19 nt, Human
gaaaucaaauaugcaaagc

SEQ ID NO: 2698024 - RNA, 15 nt, Human
cuucacuguaaaaua

SEQ ID NO: 2698025 - RNA, 13 nt, Human
cuugaugaagaag

SEQ ID NO: 2698026 - RNA, 12 nt, Human
cuugaugaagaa

SEQ ID NO: 2698027 - RNA, 23 nt, Human
cuucuaaguaaaaccacagcagu

SEQ ID NO: 2698028 - RNA, 22 nt, Human
cuucuaaguaaaaccacagcag

SEQ ID NO: 2698029 - RNA, 10 nt, Human
cugggacagg

SEQ ID NO: 2698030 - RNA, 16 nt, Human
cugggcagcugccucc

SEQ ID NO: 2698031 - RNA, 19 nt, Human
cugggcagcugccuccccu

SEQ ID NO: 2698032 - RNA, 20 nt, Human
cugggcagcugccuccccuc

SEQ ID NO: 2698033 - RNA, 21 nt, Human
cugggcagcugccuccccucc

SEQ ID NO: 2698034 - RNA, 22 nt, Human
cugggcagcugccuccccuccu

SEQ ID NO: 2698035 - RNA, 16 nt, Human
cugugagaugcuagaa

SEQ ID NO: 2698036 - RNA, 23 nt, Human
cugucagcuccccucggagaaga

SEQ ID NO: 2698037 - RNA, 21 nt, Human
cugucagcuccccucggagaa

SEQ ID NO: 2698038 - RNA, 21 nt, Human
cuggaaaucaggguuaguauu

SEQ ID NO: 2698039 - RNA, 15 nt, Human
caaauccuugaagau

SEQ ID NO: 2698040 - RNA, 23 nt, Human
caacacgagcaggcuacugucag

SEQ ID NO: 2698041 - RNA, 22 nt, Human
caaagcacugacuucuaaguaa

SEQ ID NO: 2698042 - RNA, 20 nt, Human
caaagcacugacuucuaagu

SEQ ID NO: 2698043 - RNA, 20 nt, Human
caaaaaaaaaaaaaaauuag

SEQ ID NO: 2698044 - RNA, 15 nt, Human
caaaaggcagaagca

SEQ ID NO: 2698045 - RNA, 24 nt, Human
caaacccaguguuuuaggagcaug

SEQ ID NO: 2698046 - RNA, 13 nt, Human
caaacccaguguu

SEQ ID NO: 2698047 - RNA, 14 nt, Human
auuugcucauggaa

SEQ ID NO: 2698048 - RNA, 17 nt, Human
auuugcucauggaauug

SEQ ID NO: 2698049 - RNA, 19 nt, Human
auuuuauagcuacuaauuu

SEQ ID NO: 2698050 - RNA, 17 nt, Human
auuuuauagcuacuaau

SEQ ID NO: 2698051 - RNA, 14 nt, Human
auuaugaauuacau

SEQ ID NO: 2698052 - RNA, 17 nt, Human
auuaugaauuacauuug

SEQ ID NO: 2698053 - RNA, 16 nt, Human
auuagggagagaagau

SEQ ID NO: 2698054 - RNA, 19 nt, Human
auucacaagacccaaaagg

SEQ ID NO: 2698055 - RNA, 18 nt, Human
auuaugaauuacauuugu

SEQ ID NO: 2698056 - RNA, 22 nt, Human
auucauagcagcuuauucacaa

SEQ ID NO: 2698057 - RNA, 19 nt, Human
auucauagcagcuuauuca

SEQ ID NO: 2698058 - RNA, 23 nt, Human
auuguaauaggcguaacuaauuu

SEQ ID NO: 2698059 - RNA, 14 nt, Human
auuguaaaauggug

SEQ ID NO: 2698060 - RNA, 17 nt, Human
cacagccucuuagaugc

SEQ ID NO: 2698061 - RNA, 21 nt, Human
cacagccucuuagaugcaguu

SEQ ID NO: 2698062 - RNA, 17 nt, Human
cacacaugaaguccaag

SEQ ID NO: 2698063 - RNA, 22 nt, Human
cacacaugaaguccaagcauuu

SEQ ID NO: 2698064 - RNA, 18 nt, Human
cacaagacugcacaucaa

SEQ ID NO: 2698065 - RNA, 15 nt, Human
caaugcuguauuuua

SEQ ID NO: 2698066 - RNA, 16 nt, Human
caaugcuguauuuuaa

SEQ ID NO: 2698067 - RNA, 17 nt, Human
caaugcuguauuuuaaa

SEQ ID NO: 2698068 - RNA, 15 nt, Human
caauucuugccaaau

SEQ ID NO: 2698069 - RNA, 14 nt, Human
caaguccaagcaua

SEQ ID NO: 2698070 - RNA, 21 nt, Human
cacuagggcagggacaggaua

SEQ ID NO: 2698071 - RNA, 20 nt, Human
cacuagggcagggacaggau

SEQ ID NO: 2698072 - RNA, 21 nt, Human
cacugcagaagacaguauggc

SEQ ID NO: 2698073 - RNA, 22 nt, Human
cacuuguguuuugcaagccaga

SEQ ID NO: 2698074 - RNA, 19 nt, Human
cacuuguguuuugcaagcc

SEQ ID NO: 2698075 - RNA, 16 nt, Human
cacuugucaauaaaau

SEQ ID NO: 2698076 - RNA, 22 nt, Human
cacugguucuucuuggucucag

SEQ ID NO: 2698077 - RNA, 16 nt, Human
caugaauuaguuuuau

SEQ ID NO: 2698078 - RNA, 20 nt, Human
caucagcuugcccuguuaaa

SEQ ID NO: 2698079 - RNA, 15 nt, Human
caucagcugcugaaa

SEQ ID NO: 2698080 - RNA, 18 nt, Human
caucagcugcugaaacaa

SEQ ID NO: 2698081 - RNA, 17 nt, Human
caucagcugcugaaaca

SEQ ID NO: 2698082 - RNA, 20 nt, Human
cauagcagcuuauucacaag

SEQ ID NO: 2698083 - RNA, 18 nt, Human
cauagauucccugagcag

SEQ ID NO: 2698084 - RNA, 17 nt, Human
cauagauucccugagca

SEQ ID NO: 2698085 - RNA, 15 nt, Human
cauuaggauggcuag

SEQ ID NO: 2698086 - RNA, 18 nt, Human
ccaaauguucaucaauga

SEQ ID NO: 2698087 - RNA, 23 nt, Human
caggacagcccuucuuuccacag

SEQ ID NO: 2698088 - RNA, 24 nt, Human
caggacagcccuucuuuccacaga

SEQ ID NO: 2698089 - RNA, 21 nt, Human
caggaaaucaaauaugcaaag

SEQ ID NO: 2698090 - RNA, 19 nt, Human
caggaaaucaaauaugcaa

SEQ ID NO: 2698091 - RNA, 16 nt, Human
cagcuuauucacaaga

SEQ ID NO: 2698092 - RNA, 19 nt, Human
cagggaggacgcucucugg

SEQ ID NO: 2698093 - RNA, 22 nt, Human
cagggaggacgcucucuggccu

SEQ ID NO: 2698094 - RNA, 23 nt, Human
cagccugagcgacagugagacuc

SEQ ID NO: 2698095 - RNA, 19 nt, Human
cagccccgugggguuccuc

SEQ ID NO: 2698096 - RNA, 18 nt, Human
cagcaguucagagcugcc

SEQ ID NO: 2698097 - RNA, 19 nt, Human
cagcaguucagagcugccc

SEQ ID NO: 2698098 - RNA, 20 nt, Human
cagcaguucagagcugcccu

SEQ ID NO: 2698099 - RNA, 21 nt, Human
cagcaguucagagcugcccuc

SEQ ID NO: 2698100 - RNA, 22 nt, Human
cagcaguucagagcugcccucu

SEQ ID NO: 2698101 - RNA, 20 nt, Human
cagccagacuggcacaguuu

SEQ ID NO: 2698102 - RNA, 20 nt, Human
cccauauuuguacaccaaua

SEQ ID NO: 2698103 - RNA, 16 nt, Human
cccagccagcaguuca

SEQ ID NO: 2698104 - RNA, 17 nt, Human
cccagccagcaguucag

SEQ ID NO: 2698105 - RNA, 20 nt, Human
cccagccagcaguucagagc

SEQ ID NO: 2698106 - RNA, 23 nt, Human
cccauuguggucacaggaaguag

SEQ ID NO: 2698107 - RNA, 22 nt, Human
cccauuguggucacaggaagua

SEQ ID NO: 2698108 - RNA, 23 nt, Human
cccgggaggcagagguugcagug

SEQ ID NO: 2698109 - RNA, 15 nt, Human
ccagauccuggaaau

SEQ ID NO: 2698110 - RNA, 13 nt, Human
ccucugcuugcca

SEQ ID NO: 2698111 - RNA, 17 nt, Human
ccucugcuugccauccc

SEQ ID NO: 2698112 - RNA, 15 nt, Human
ccucauguccacugg

SEQ ID NO: 2698113 - RNA, 20 nt, Human
ccucauguccacugguucuu

SEQ ID NO: 2698114 - RNA, 16 nt, Human
ccguagguuauuuuca

SEQ ID NO: 2698115 - RNA, 24 nt, Human
ccguagacgugcacgcacacuguc

SEQ ID NO: 2698116 - RNA, 13 nt, Human
cccuucucuguau

SEQ ID NO: 2698117 - RNA, 17 nt, Human
cccuucuuuccacagaa

SEQ ID NO: 2698118 - RNA, 16 nt, Human
cgacagugagacucug

SEQ ID NO: 2698119 - RNA, 15 nt, Human
cgacagugagacucu

SEQ ID NO: 2698120 - RNA, 23 nt, Human
cuaagugaaauaagccagacauc

SEQ ID NO: 2698121 - RNA, 20 nt, Human
cuaagugaaauaagccagac

SEQ ID NO: 2698122 - RNA, 15 nt, Human
cuacaugagguacug

SEQ ID NO: 2698123 - RNA, 15 nt, Human
cguggugauuuagca

SEQ ID NO: 2698124 - RNA, 19 nt, Human
cuagaacucccuuucaaca

SEQ ID NO: 2698125 - RNA, 18 nt, Human
cuagaacucccuuucaac

SEQ ID NO: 2698126 - RNA, 17 nt, Human
cuagaacucccuuucaa

SEQ ID NO: 2698127 - RNA, 16 nt, Human
cuagaacucccuuuca

SEQ ID NO: 2698128 - RNA, 16 nt, Human
cuagcaugaagacaga

SEQ ID NO: 2698129 - RNA, 23 nt, Human
cuaguugaucagcuuauugucua

SEQ ID NO: 2698130 - RNA, 21 nt, Human
cuccagugagacagcucugca

SEQ ID NO: 2698131 - RNA, 14 nt, Human
cucccugcaauaaa

SEQ ID NO: 2698132 - RNA, 16 nt, Human
cucccugcaauaaaau

SEQ ID NO: 2698133 - RNA, 11 nt, Human
cucucuggccu

SEQ ID NO: 2698134 - RNA, 12 nt, Human
cucucuggccuu

SEQ ID NO: 2698135 - RNA, 15 nt, Human
cucuuagaugcaguu

SEQ ID NO: 2698136 - RNA, 20 nt, Human
cucuuagaugcaguucugaa

SEQ ID NO: 2698137 - RNA, 12 nt, Human
aacucauuucua

SEQ ID NO: 2698138 - RNA, 21 nt, Human
aacuagaguuuagcuggaaaa

SEQ ID NO: 2698139 - RNA, 23 nt, Human
aacuaucucauuuccaagcaagu

SEQ ID NO: 2698140 - RNA, 18 nt, Human
aaccuugaaaacuuuaug

SEQ ID NO: 2698141 - RNA, 16 nt, Human
gucuuucacauuuaaa

SEQ ID NO: 2698142 - RNA, 20 nt, Human
aaccugagccccaaaaggua

SEQ ID NO: 2698143 - RNA, 18 nt, Human
aaccugagccccaaaagg

SEQ ID NO: 2698144 - RNA, 16 nt, Human
aacccgggaggcagag

SEQ ID NO: 2698145 - RNA, 23 nt, Human
aacccaaauguucaucaaugaau

SEQ ID NO: 2698146 - RNA, 18 nt, Human
aacccaaguccaagcaua

SEQ ID NO: 2698147 - RNA, 21 nt, Human
aacuucagcgguuuauauaag

SEQ ID NO: 2698148 - RNA, 18 nt, Human
aacuuccagauccuggaa

SEQ ID NO: 2698149 - RNA, 17 nt, Human
gugaugggaaagcauug

SEQ ID NO: 2698150 - RNA, 17 nt, Human
aacugggacaggggaga

SEQ ID NO: 2698151 - RNA, 19 nt, Human
aacuggacugguucaaaug

SEQ ID NO: 2698152 - RNA, 19 nt, Human
aacugcacugucaagauga

SEQ ID NO: 2698153 - RNA, 12 nt, Human
aacugaaaucau

SEQ ID NO: 2698154 - RNA, 21 nt, Human
gugagaugcuagaacucccuu

SEQ ID NO: 2698155 - RNA, 20 nt, Human
aaauuuuuucucuaggaaau

SEQ ID NO: 2698156 - RNA, 12 nt, Human
aacaauaaaaga

SEQ ID NO: 2698157 - RNA, 14 nt, Human
aacaaugcuguauu

SEQ ID NO: 2698158 - RNA, 15 nt, Human
aacaaugcuguauuu

SEQ ID NO: 2698159 - RNA, 15 nt, Human
aacacaacuauauug

SEQ ID NO: 2698160 - RNA, 16 nt, Human
aacacaacuauauugu

SEQ ID NO: 2698161 - RNA, 17 nt, Human
aacaaugcuguauuuua

SEQ ID NO: 2698162 - RNA, 22 nt, Human
aacaaugcuguauuuuaaaaga

SEQ ID NO: 2698163 - RNA, 15 nt, Human
aacacagcaagggug

SEQ ID NO: 2698164 - RNA, 22 nt, Human
aacagugauuaccagggacuga

SEQ ID NO: 2698165 - RNA, 15 nt, Human
aacagugauuaccag

SEQ ID NO: 2698166 - RNA, 16 nt, Human
aacagauaaauaguuu

SEQ ID NO: 2698167 - RNA, 18 nt, Human
guauguacuucaugcugu

SEQ ID NO: 2698168 - RNA, 16 nt, Human
gucaaauugugugaaa

SEQ ID NO: 2698169 - RNA, 14 nt, Human
aaauggguuuuacu

SEQ ID NO: 2698170 - RNA, 15 nt, Human
aaauggguuuuacug

SEQ ID NO: 2698171 - RNA, 20 nt, Human
guaguguuggagaagaacug

SEQ ID NO: 2698172 - RNA, 17 nt, Human
guaguguuggagaagaa

SEQ ID NO: 2698173 - RNA, 16 nt, Human
aaauguaagggaaacu

SEQ ID NO: 2698174 - RNA, 16 nt, Human
guauauuuuauaucaa

SEQ ID NO: 2698175 - RNA, 15 nt, Human
guauaaaauaauuuu

SEQ ID NO: 2698176 - RNA, 21 nt, Human
guauaaaauaauuuuuauauu

SEQ ID NO: 2698177 - RNA, 19 nt, Human
aagggugaugggaaagcau

SEQ ID NO: 2698178 - RNA, 14 nt, Human
aagguacuucaaau

SEQ ID NO: 2698179 - RNA, 22 nt, Human
aagucuuauauauuguagauaa

SEQ ID NO: 2698180 - RNA, 16 nt, Human
aagucuuucacauuua

SEQ ID NO: 2698181 - RNA, 13 nt, Human
aaguauuagaaua

SEQ ID NO: 2698182 - RNA, 14 nt, Human
aaguaaugauaacu

SEQ ID NO: 2698183 - RNA, 19 nt, Human
aaguaaugauaacuggaaa

SEQ ID NO: 2698184 - RNA, 12 nt, Human
uaaaagaaugau

SEQ ID NO: 2698185 - RNA, 23 nt, Human
uaaaagaauauuuuaacuuccuu

SEQ ID NO: 2698186 - RNA, 16 nt, Human
uaaaagaauauuuuaa

SEQ ID NO: 2698187 - RNA, 20 nt, Human
uaaaagacagugaaagaaaa

SEQ ID NO: 2698188 - RNA, 20 nt, Human
uaaaauaauuuuuauauuug

SEQ ID NO: 2698189 - RNA, 13 nt, Human
aagauguagagga

SEQ ID NO: 2698190 - RNA, 14 nt, Human
aagaugaaaauauu

SEQ ID NO: 2698191 - RNA, 13 nt, Human
aagaugaaaauau

SEQ ID NO: 2698192 - RNA, 16 nt, Human
aagacugcacaucaaa

SEQ ID NO: 2698193 - RNA, 17 nt, Human
aagacugcauuauauuu

SEQ ID NO: 2698194 - RNA, 23 nt, Human
aagaggaaugaaguacucauaca

SEQ ID NO: 2698195 - RNA, 20 nt, Human
guuauuauauuuacaaaugg

SEQ ID NO: 2698196 - RNA, 13 nt, Human
aagcuccagguag

SEQ ID NO: 2698197 - RNA, 14 nt, Human
aagcuccagguaga

SEQ ID NO: 2698198 - RNA, 20 nt, Human
aagcucacagaccuuugaac

SEQ ID NO: 2698199 - RNA, 16 nt, Human
aagcauuuagauguau

SEQ ID NO: 2698200 - RNA, 13 nt, Human
aagcauuguaaau

SEQ ID NO: 2698201 - RNA, 23 nt, Human
aauacaucccuuaccugggaaag

SEQ ID NO: 2698202 - RNA, 23 nt, Human
aauaccacaggaaccacaagacu

SEQ ID NO: 2698203 - RNA, 18 nt, Human
aauaccaugccauuuaaa

SEQ ID NO: 2698204 - RNA, 19 nt, Human
aauagucaaauugugugaa

SEQ ID NO: 2698205 - RNA, 21 nt, Human
uaacuuccuuggacucauuuu

SEQ ID NO: 2698206 - RNA, 13 nt, Human
uaagaagugaaaa

SEQ ID NO: 2698207 - RNA, 20 nt, Human
aauccucaguuuuugugaaa

SEQ ID NO: 2698208 - RNA, 20 nt, Human
uaaguaaugauaacuggaaa

SEQ ID NO: 2698209 - RNA, 19 nt, Human
uaaguaaaaccacagcagu

SEQ ID NO: 2698210 - RNA, 18 nt, Human
uaaguaaaaccacagcag

SEQ ID NO: 2698211 - RNA, 17 nt, Human
uaaguaaaaccacagca

SEQ ID NO: 2698212 - RNA, 16 nt, Human
uaaguaaaaccacagc

SEQ ID NO: 2698213 - RNA, 15 nt, Human
uaaguaaaaccacag

SEQ ID NO: 2698214 - RNA, 13 nt, Human
uaaguaaaaccac

SEQ ID NO: 2698215 - RNA, 18 nt, Human
uaagguuaccuuuguucc

SEQ ID NO: 2698216 - RNA, 14 nt, Human
uaagcaaaauguga

SEQ ID NO: 2698217 - RNA, 21 nt, Human
uaagcaaaaugugauauguac

SEQ ID NO: 2698218 - RNA, 15 nt, Human
uaagcaaaaugugau

SEQ ID NO: 2698219 - RNA, 16 nt, Human
aaucagccuaguugau

SEQ ID NO: 2698220 - RNA, 15 nt, Human
aauauuuauuuuaau

SEQ ID NO: 2698221 - RNA, 21 nt, Human
uacaaaaaaaaaaaaaaauua

SEQ ID NO: 2698222 - RNA, 22 nt, Human
aaugcuguauuuuaaaagaaug

SEQ ID NO: 2698223 - RNA, 20 nt, Human
aaugcuguauuuuaaaagaa

SEQ ID NO: 2698224 - RNA, 21 nt, Human
aaugcuguauuuuaaaagaau

SEQ ID NO: 2698225 - RNA, 20 nt, Human
aauguaagggaaacugccag

SEQ ID NO: 2698226 - RNA, 17 nt, Human
uacagagacagaaagca

SEQ ID NO: 2698227 - RNA, 22 nt, Human
uaauuccguagguuauuuucag

SEQ ID NO: 2698228 - RNA, 18 nt, Human
uaauuuuuauauuugaaa

SEQ ID NO: 2698229 - RNA, 19 nt, Human
uaauuuuuauauuugaaau

SEQ ID NO: 2698230 - RNA, 21 nt, Human
uaauuuuuauauuugaaauau

SEQ ID NO: 2698231 - RNA, 16 nt, Human
aaugauuucauucaau

SEQ ID NO: 2698232 - RNA, 22 nt, Human
aaugagagacacacugaagaag

SEQ ID NO: 2698233 - RNA, 23 nt, Human
aaugauuaugaauuacauuugua

SEQ ID NO: 2698234 - RNA, 20 nt, Human
aauguucaucaaugaaugaa

SEQ ID NO: 2698235 - RNA, 16 nt, Human
aauguucaucaaugaa

SEQ ID NO: 2698236 - RNA, 13 nt, Human
aauguucaucaau

SEQ ID NO: 2698237 - RNA, 16 nt, Human
uaccaugccauuuaaa

SEQ ID NO: 2698238 - RNA, 19 nt, Human
uaccagggacugaggggag

SEQ ID NO: 2698239 - RNA, 14 nt, Human
aauuacauuuguau

SEQ ID NO: 2698240 - RNA, 13 nt, Human
aauuacauuugua

SEQ ID NO: 2698241 - RNA, 17 nt, Human
acacucaaaucaagaaa

SEQ ID NO: 2698242 - RNA, 18 nt, Human
acacucaaaucaagaaac

SEQ ID NO: 2698243 - RNA, 13 nt, Human
acacucaaaucaa

SEQ ID NO: 2698244 - RNA, 16 nt, Human
uauaggugcuacaaaa

SEQ ID NO: 2698245 - RNA, 12 nt, Human
uauaggaauuga

SEQ ID NO: 2698246 - RNA, 19 nt, Human
acagaaagcagaacaguga

SEQ ID NO: 2698247 - RNA, 14 nt, Human
acagaccuuugaac

SEQ ID NO: 2698248 - RNA, 20 nt, Human
uaucacaaaucuuaacuuga

SEQ ID NO: 2698249 - RNA, 16 nt, Human
uaucacaaaucuuaac

SEQ ID NO: 2698250 - RNA, 14 nt, Human
uaucacaaaucuua

SEQ ID NO: 2698251 - RNA, 14 nt, Human
acagcuguaugauu

SEQ ID NO: 2698252 - RNA, 19 nt, Human
acagcuguaugauucccag

SEQ ID NO: 2698253 - RNA, 20 nt, Human
acagcuguaugauucccagc

SEQ ID NO: 2698254 - RNA, 23 nt, Human
acagcuguaugauucccagccag

SEQ ID NO: 2698255 - RNA, 19 nt, Human
acagcccuucuuuccacag

SEQ ID NO: 2698256 - RNA, 18 nt, Human
acagcaagggugauggga

SEQ ID NO: 2698257 - RNA, 15 nt, Human
uagaaacacaacuau

SEQ ID NO: 2698258 - RNA, 16 nt, Human
uagaacucccuuucaa

SEQ ID NO: 2698259 - RNA, 18 nt, Human
uagaacucccuuucaaca

SEQ ID NO: 2698260 - RNA, 17 nt, Human
uagaacucccuuucaac

SEQ ID NO: 2698261 - RNA, 13 nt, Human
uagacacacauga

SEQ ID NO: 2698262 - RNA, 13 nt, Human
acaaaaacacagc

SEQ ID NO: 2698263 - RNA, 15 nt, Human
acaaaaacacagcaa

SEQ ID NO: 2698264 - RNA, 14 nt, Human
acaaaaacacagca

SEQ ID NO: 2698265 - RNA, 14 nt, Human
uagaggguguguaa

SEQ ID NO: 2698266 - RNA, 13 nt, Human
uaggauguugaaa

SEQ ID NO: 2698267 - RNA, 13 nt, Human
acacaacuauauu

SEQ ID NO: 2698268 - RNA, 18 nt, Human
acuauucaaacagucuca

SEQ ID NO: 2698269 - RNA, 16 nt, Human
acuauucaaacagucu

SEQ ID NO: 2698270 - RNA, 14 nt, Human
acuauucaaacagu

SEQ ID NO: 2698271 - RNA, 13 nt, Human
acuauucaaacag

SEQ ID NO: 2698272 - RNA, 14 nt, Human
uccccuccucugcu

SEQ ID NO: 2698273 - RNA, 15 nt, Human
uccccuccucugcuu

SEQ ID NO: 2698274 - RNA, 18 nt, Human
uccccuccucugcuugcc

SEQ ID NO: 2698275 - RNA, 24 nt, Human
uccccuccucugcuugccaucccu

SEQ ID NO: 2698276 - RNA, 20 nt, Human
acuagaguuuagcuggaaaa

SEQ ID NO: 2698277 - RNA, 21 nt, Human
acuccaaacugacucuuaaga

SEQ ID NO: 2698278 - RNA, 19 nt, Human
ucccuccaccucccugcaa

SEQ ID NO: 2698279 - RNA, 15 nt, Human
ucccuccaccucccu

SEQ ID NO: 2698280 - RNA, 17 nt, Human
ucccuccaccucccugc

SEQ ID NO: 2698281 - RNA, 14 nt, Human
ucccuccaccuccc

SEQ ID NO: 2698282 - RNA, 14 nt, Human
acuccagaaaguga

SEQ ID NO: 2698283 - RNA, 18 nt, Human
acuccagaaagugacaag

SEQ ID NO: 2698284 - RNA, 21 nt, Human
uccugaaaacccuugccaugu

SEQ ID NO: 2698285 - RNA, 22 nt, Human
uccugaaaacccuugccaugug

SEQ ID NO: 2698286 - RNA, 17 nt, Human
uccucuccccaugaugu

SEQ ID NO: 2698287 - RNA, 16 nt, Human
ucauaauaaguugcau

SEQ ID NO: 2698288 - RNA, 17 nt, Human
accugagccccaaaagg

SEQ ID NO: 2698289 - RNA, 12 nt, Human
accugagcccca

SEQ ID NO: 2698290 - RNA, 17 nt, Human
acgcucucuggccuucg

SEQ ID NO: 2698291 - RNA, 16 nt, Human
acgcucucuggccuuc

SEQ ID NO: 2698292 - RNA, 15 nt, Human
acgcucucuggccuu

SEQ ID NO: 2698293 - RNA, 14 nt, Human
uccagugagacagc

SEQ ID NO: 2698294 - RNA, 22 nt, Human
uccaugaagauguagaggagaa

SEQ ID NO: 2698295 - RNA, 23 nt, Human
ucaauauuucagauaaucacaau

SEQ ID NO: 2698296 - RNA, 13 nt, Human
ucaauuuaaaaaa

SEQ ID NO: 2698297 - RNA, 12 nt, Human
ucaauuuaaaaa

SEQ ID NO: 2698298 - RNA, 16 nt, Human
ucacagaccuuugaac

SEQ ID NO: 2698299 - RNA, 23 nt, Human
ucacagccagacuggcacaguuu

SEQ ID NO: 2698300 - RNA, 17 nt, Human
ucacagccagacuggca

SEQ ID NO: 2698301 - RNA, 22 nt, Human
ucacagcuuauuuccucauuuu

SEQ ID NO: 2698302 - RNA, 16 nt, Human
accacaagacugcaca

SEQ ID NO: 2698303 - RNA, 19 nt, Human
accaacacgagcaggcuac

SEQ ID NO: 2698304 - RNA, 14 nt, Human
accaacacgagcag

SEQ ID NO: 2698305 - RNA, 18 nt, Human
uauuuuaaaagaaugauu

SEQ ID NO: 2698306 - RNA, 14 nt, Human
uauuuuaaaagaau

SEQ ID NO: 2698307 - RNA, 19 nt, Human
uauuuuaauaauguuucaa

SEQ ID NO: 2698308 - RNA, 22 nt, Human
uauuuuaauaauguuucaaaca

SEQ ID NO: 2698309 - RNA, 21 nt, Human
ucaaacagucucaggaaauca

SEQ ID NO: 2698310 - RNA, 20 nt, Human
ucaaacagucucaggaaauc

SEQ ID NO: 2698311 - RNA, 13 nt, Human
ucaaacagucuca

SEQ ID NO: 2698312 - RNA, 13 nt, Human
ucaguagucagac

SEQ ID NO: 2698313 - RNA, 18 nt, Human
ucagagcugcccucuccu

SEQ ID NO: 2698314 - RNA, 17 nt, Human
ucagagcugcccucucc

SEQ ID NO: 2698315 - RNA, 15 nt, Human
ucagagcugcccucu

SEQ ID NO: 2698316 - RNA, 16 nt, Human
ucagagcugcccucuc

SEQ ID NO: 2698317 - RNA, 13 nt, Human
ucagagcugcccu

SEQ ID NO: 2698318 - RNA, 14 nt, Human
ucagagcugcccuc

SEQ ID NO: 2698319 - RNA, 13 nt, Human
ucagcccucagaa

SEQ ID NO: 2698320 - RNA, 12 nt, Human
ucagcccucaga

SEQ ID NO: 2698321 - RNA, 20 nt, Human
acccaaauguucaucaauga

SEQ ID NO: 2698322 - RNA, 16 nt, Human
acccaaauguucauca

SEQ ID NO: 2698323 - RNA, 13 nt, Human
acuguggguagac

SEQ ID NO: 2698324 - RNA, 17 nt, Human
ucuaccaaaaaucucaa

SEQ ID NO: 2698325 - RNA, 23 nt, Human
acugucagcuccccucggagaag

SEQ ID NO: 2698326 - RNA, 22 nt, Human
acugucagcuccccucggagaa

SEQ ID NO: 2698327 - RNA, 22 nt, Human
acugaagaagcaccaaucauga

SEQ ID NO: 2698328 - RNA, 21 nt, Human
acuugaacccgggaggcagag

SEQ ID NO: 2698329 - RNA, 23 nt, Human
acuugaacccgggaggcagaggu

SEQ ID NO: 2698330 - RNA, 17 nt, Human
ucucaaaacugcacugu

SEQ ID NO: 2698331 - RNA, 21 nt, Human
acuucuaaguaaaaccacagc

SEQ ID NO: 2698332 - RNA, 13 nt, Human
acuucuaaguaaa

SEQ ID NO: 2698333 - RNA, 19 nt, Human
acuucuaaguaaaaccaca

SEQ ID NO: 2698334 - RNA, 18 nt, Human
acuucuaaguaaaaccac

SEQ ID NO: 2698335 - RNA, 12 nt, Human
ucuagcaugaag

SEQ ID NO: 2698336 - RNA, 13 nt, Human
ucuauaauuuaaa

SEQ ID NO: 2698337 - RNA, 20 nt, Human
acuuccagauccuggaaauc

SEQ ID NO: 2698338 - RNA, 18 nt, Human
agaaagcagaacagugau

SEQ ID NO: 2698339 - RNA, 17 nt, Human
agaaagcagaacaguga

SEQ ID NO: 2698340 - RNA, 20 nt, Human
agaaagcagaacagugauua

SEQ ID NO: 2698341 - RNA, 16 nt, Human
agaaagacuauucaaa

SEQ ID NO: 2698342 - RNA, 16 nt, Human
agaaacacaacuauau

SEQ ID NO: 2698343 - RNA, 16 nt, Human
agaaaacaaggaugaa

SEQ ID NO: 2698344 - RNA, 23 nt, Human
agaaacuuaagguuaccuuuguu

SEQ ID NO: 2698345 - RNA, 19 nt, Human
agaagcaacccaaauguuc

SEQ ID NO: 2698346 - RNA, 19 nt, Human
agaagcaccaaucaugaau

SEQ ID NO: 2698347 - RNA, 20 nt, Human
ucugcccauccugccccuga

SEQ ID NO: 2698348 - RNA, 16 nt, Human
agaacucccuuucaac

SEQ ID NO: 2698349 - RNA, 15 nt, Human
agaacucccuuucaa

SEQ ID NO: 2698350 - RNA, 17 nt, Human
agaacucccuuucaaca

SEQ ID NO: 2698351 - RNA, 13 nt, Human
agaaguugauaug

SEQ ID NO: 2698352 - RNA, 10 nt, Human
ucuggccuuc

SEQ ID NO: 2698353 - RNA, 15 nt, Human
ugaauacuuuauaaa

SEQ ID NO: 2698354 - RNA, 23 nt, Human
agcaacgcaggcccccaggugcc

SEQ ID NO: 2698355 - RNA, 15 nt, Human
agauucccugagcag

SEQ ID NO: 2698356 - RNA, 15 nt, Human
ugacuucuaaguaaa

SEQ ID NO: 2698357 - RNA, 23 nt, Human
ugacuucuaaguaaaaccacagc

SEQ ID NO: 2698358 - RNA, 22 nt, Human
ugacuucuaaguaaaaccacag

SEQ ID NO: 2698359 - RNA, 24 nt, Human
ugacuucuaaguaaaaccacagca

SEQ ID NO: 2698360 - RNA, 16 nt, Human
agaugcaguucugaag

SEQ ID NO: 2698361 - RNA, 16 nt, Human
ugacacuuaaaaaugg

SEQ ID NO: 2698362 - RNA, 17 nt, Human
ugacacuuaaaaauggu

SEQ ID NO: 2698363 - RNA, 14 nt, Human
agacuauucaaaca

SEQ ID NO: 2698364 - RNA, 12 nt, Human
agacuauucaaa

SEQ ID NO: 2698365 - RNA, 15 nt, Human
agacuauucaaacag

SEQ ID NO: 2698366 - RNA, 15 nt, Human
ucuucacaacagauu

SEQ ID NO: 2698367 - RNA, 14 nt, Human
agaaucacuugaac

SEQ ID NO: 2698368 - RNA, 21 nt, Human
agacauagaauuaacacauga

SEQ ID NO: 2698369 - RNA, 14 nt, Human
agacauagaauuaa

SEQ ID NO: 2698370 - RNA, 18 nt, Human
agacaucaacagauaaau

SEQ ID NO: 2698371 - RNA, 17 nt, Human
agacaucaacagauaaa

SEQ ID NO: 2698372 - RNA, 21 nt, Human
agagcaguuugguuucuagca

SEQ ID NO: 2698373 - RNA, 23 nt, Human
agagcaguuugguuucuagcaug

SEQ ID NO: 2698374 - RNA, 20 nt, Human
ugaaaagcuccauuuuuagu

SEQ ID NO: 2698375 - RNA, 22 nt, Human
ugaaaaaguucugcagauaaac

SEQ ID NO: 2698376 - RNA, 22 nt, Human
ugaaacugagaugugaacacau

SEQ ID NO: 2698377 - RNA, 19 nt, Human
ugaaacucguuaauuugua

SEQ ID NO: 2698378 - RNA, 12 nt, Human
ugauaugggucu

SEQ ID NO: 2698379 - RNA, 20 nt, Human
agcaugucgucaaagcugaa

SEQ ID NO: 2698380 - RNA, 17 nt, Human
agcaugucgucaaagcu

SEQ ID NO: 2698381 - RNA, 18 nt, Human
agcauuguaaaugugcuu

SEQ ID NO: 2698382 - RNA, 17 nt, Human
agcauuguaaaugugcu

SEQ ID NO: 2698383 - RNA, 22 nt, Human
ugaguaacugauuuguaacaag

SEQ ID NO: 2698384 - RNA, 23 nt, Human
agcauaaauguugacaugggaca

SEQ ID NO: 2698385 - RNA, 18 nt, Human
ugagugucuuaauuaaaa

SEQ ID NO: 2698386 - RNA, 17 nt, Human
ugaugaagaaguugaua

SEQ ID NO: 2698387 - RNA, 14 nt, Human
ugauuaccagggac

SEQ ID NO: 2698388 - RNA, 12 nt, Human
ugauuaaaccaa

SEQ ID NO: 2698389 - RNA, 17 nt, Human
ugaugaucuuuaaaaua

SEQ ID NO: 2698390 - RNA, 14 nt, Human
ugaugaucuuuaaa

SEQ ID NO: 2698391 - RNA, 14 nt, Human
agccagacuggcac

SEQ ID NO: 2698392 - RNA, 19 nt, Human
agccagacuggcacaguuu

SEQ ID NO: 2698393 - RNA, 22 nt, Human
agccugaaagaggaaugaagua

SEQ ID NO: 2698394 - RNA, 15 nt, Human
agccucauguccacu

SEQ ID NO: 2698395 - RNA, 20 nt, Human
agccucauguccacugguuc

SEQ ID NO: 2698396 - RNA, 18 nt, Human
agcccauggcacucuaug

SEQ ID NO: 2698397 - RNA, 18 nt, Human
agccccgugggguuccuc

SEQ ID NO: 2698398 - RNA, 18 nt, Human
agcuacuugggaggcuga

SEQ ID NO: 2698399 - RNA, 17 nt, Human
agcuacuugggaggcug

SEQ ID NO: 2698400 - RNA, 20 nt, Human
agccuuggggcugaugcagu

SEQ ID NO: 2698401 - RNA, 14 nt, Human
uggagcucguggaa

SEQ ID NO: 2698402 - RNA, 13 nt, Human
uggagaagaacug

SEQ ID NO: 2698403 - RNA, 14 nt, Human
uggagaagaacuga

SEQ ID NO: 2698404 - RNA, 13 nt, Human
uggaaaggcagcu

SEQ ID NO: 2698405 - RNA, 19 nt, Human
uggcacaguuuucugagaa

SEQ ID NO: 2698406 - RNA, 18 nt, Human
uggcacaguuuucugaga

SEQ ID NO: 2698407 - RNA, 19 nt, Human
agcuguucacagccagacu

SEQ ID NO: 2698408 - RNA, 16 nt, Human
agcuguucacagccag

SEQ ID NO: 2698409 - RNA, 22 nt, Human
agcugcccucuccugggcagcu

SEQ ID NO: 2698410 - RNA, 15 nt, Human
agcugccuccccucc

SEQ ID NO: 2698411 - RNA, 16 nt, Human
agcugccuccccuccu

SEQ ID NO: 2698412 - RNA, 19 nt, Human
ugcuacaaaaacacagcaa

SEQ ID NO: 2698413 - RNA, 18 nt, Human
ugcuacaaaaacacagca

SEQ ID NO: 2698414 - RNA, 17 nt, Human
ugcuacaaaaacacagc

SEQ ID NO: 2698415 - RNA, 16 nt, Human
ugcuacaaaaacacag

SEQ ID NO: 2698416 - RNA, 15 nt, Human
ugcuacaaaaacaca

SEQ ID NO: 2698417 - RNA, 20 nt, Human
ugcuacaaaaacacagcaag

SEQ ID NO: 2698418 - RNA, 17 nt, Human
agcuugaaacugagaug

SEQ ID NO: 2698419 - RNA, 13 nt, Human
ugcuguauuuuaa

SEQ ID NO: 2698420 - RNA, 21 nt, Human
ugcuguauuuuaaaagaauga

SEQ ID NO: 2698421 - RNA, 22 nt, Human
ugcuguauuuuaaaagaaugau

SEQ ID NO: 2698422 - RNA, 17 nt, Human
aggacacugauaugggu

SEQ ID NO: 2698423 - RNA, 13 nt, Human
aggaaauauuuau

SEQ ID NO: 2698424 - RNA, 23 nt, Human
aggaaaucaaauaugcaaagcac

SEQ ID NO: 2698425 - RNA, 12 nt, Human
aggaaauauuua

SEQ ID NO: 2698426 - RNA, 14 nt, Human
ugcucauggaauug

SEQ ID NO: 2698427 - RNA, 11 nt, Human
ugcucauggaa

SEQ ID NO: 2698428 - RNA, 19 nt, Human
aguagauaggccaugggca

SEQ ID NO: 2698429 - RNA, 15 nt, Human
aguaaaaccacagca

SEQ ID NO: 2698430 - RNA, 18 nt, Human
uguagaggagaaacugga

SEQ ID NO: 2698431 - RNA, 21 nt, Human
ugucaauaaaauccauacauu

SEQ ID NO: 2698432 - RNA, 20 nt, Human
ugucaaucagccuaguugau

SEQ ID NO: 2698433 - RNA, 22 nt, Human
aguauuucuaugaaauauuaug

SEQ ID NO: 2698434 - RNA, 13 nt, Human
aguauuucuauga

SEQ ID NO: 2698435 - RNA, 15 nt, Human
aguauuucuaugaaa

SEQ ID NO: 2698436 - RNA, 23 nt, Human
ugucauuugcuggagcucugccc

SEQ ID NO: 2698437 - RNA, 16 nt, Human
agucaggaaagagaac

SEQ ID NO: 2698438 - RNA, 15 nt, Human
agucaggaaagagaa

SEQ ID NO: 2698439 - RNA, 23 nt, Human
agucagacuggauaguccgucuc

SEQ ID NO: 2698440 - RNA, 17 nt, Human
agggcagggacaggaua

SEQ ID NO: 2698441 - RNA, 20 nt, Human
ugguaaggggaauugaggac

SEQ ID NO: 2698442 - RNA, 17 nt, Human
aggguuaugauuaagua

SEQ ID NO: 2698443 - RNA, 23 nt, Human
agguacuucaaauccuugaagau

SEQ ID NO: 2698444 - RNA, 21 nt, Human
agugccuguaaucacagcuac

SEQ ID NO: 2698445 - RNA, 22 nt, Human
agugcaaauugucacaggacag

SEQ ID NO: 2698446 - RNA, 18 nt, Human
agugcaaauugucacagg

SEQ ID NO: 2698447 - RNA, 21 nt, Human
agugcaaauugucacaggaca

SEQ ID NO: 2698448 - RNA, 23 nt, Human
aguguuggagaagaacugaaauc

SEQ ID NO: 2698449 - RNA, 17 nt, Human
aguguuggagaagaacu

SEQ ID NO: 2698450 - RNA, 18 nt, Human
aguguuggagaagaacug

SEQ ID NO: 2698451 - RNA, 14 nt, Human
aguguuggagaaga

SEQ ID NO: 2698452 - RNA, 16 nt, Human
aguguuggagaagaac

SEQ ID NO: 2698453 - RNA, 19 nt, Human
aguucggugagcuacaaau

SEQ ID NO: 2698454 - RNA, 23 nt, Human
aguuuucugagaaagacuauuca

SEQ ID NO: 2698455 - RNA, 18 nt, Human
aguuuucugagaaagacu

SEQ ID NO: 2698456 - RNA, 19 nt, Human
aguuuucugagaaagacua

SEQ ID NO: 2698457 - RNA, 15 nt, Human
auaaaauaauuuuua

SEQ ID NO: 2698458 - RNA, 22 nt, Human
auaaaauaauuuuuauauuuga

SEQ ID NO: 2698459 - RNA, 12 nt, Human
auaaaauaauuu

SEQ ID NO: 2698460 - RNA, 13 nt, Human
uguuucaaacaua

SEQ ID NO: 2698461 - RNA, 14 nt, Human
aguuuaaauuguaa

SEQ ID NO: 2698462 - RNA, 18 nt, Human
auaauccuaaacauauga

SEQ ID NO: 2698463 - RNA, 14 nt, Human
uuagggagagaaga

SEQ ID NO: 2698464 - RNA, 22 nt, Human
auaacgauaaaagacagugaaa

SEQ ID NO: 2698465 - RNA, 13 nt, Human
auaaauaaaaaua

SEQ ID NO: 2698466 - RNA, 14 nt, Human
auaaauaaaaauaa

SEQ ID NO: 2698467 - RNA, 15 nt, Human
auaaauaguuuauga

SEQ ID NO: 2698468 - RNA, 13 nt, Human
uuugcucauggaa

SEQ ID NO: 2698469 - RNA, 15 nt, Human
auggcuauaggugcu

SEQ ID NO: 2698470 - RNA, 11 nt, Human
uuugcucaugg

SEQ ID NO: 2698471 - RNA, 12 nt, Human
uuugcucaugga

SEQ ID NO: 2698472 - RNA, 14 nt, Human
uuuuaaaagaauga

SEQ ID NO: 2698473 - RNA, 15 nt, Human
uuuuaaaagaaugau

SEQ ID NO: 2698474 - RNA, 13 nt, Human
uuuuaaaaaagaa

SEQ ID NO: 2698475 - RNA, 21 nt, Human
auguuucaaacauauauaaca

SEQ ID NO: 2698476 - RNA, 18 nt, Human
auguuucaaacauauaua

SEQ ID NO: 2698477 - RNA, 16 nt, Human
auuaaaagaauauuuu

SEQ ID NO: 2698478 - RNA, 15 nt, Human
auguugacaugggac

SEQ ID NO: 2698479 - RNA, 19 nt, Human
auguucaucaaugaaugaa

SEQ ID NO: 2698480 - RNA, 19 nt, Human
uuuuauggcacuaguauuu

SEQ ID NO: 2698481 - RNA, 23 nt, Human
uuuuauggaggcuuugcauagau

SEQ ID NO: 2698482 - RNA, 14 nt, Human
uuuuauaauuuugu

SEQ ID NO: 2698483 - RNA, 17 nt, Human
auuauauuuacaaaugg

SEQ ID NO: 2698484 - RNA, 23 nt, Human
auuaucucaaaacugcacuguca

SEQ ID NO: 2698485 - RNA, 18 nt, Human
auuaucucaaaacugcac

SEQ ID NO: 2698486 - RNA, 20 nt, Human
auuauuaccuuacagaaguu

SEQ ID NO: 2698487 - RNA, 16 nt, Human
auuauauuuacaaaug

SEQ ID NO: 2698488 - RNA, 13 nt, Human
auuaaguaaugau

SEQ ID NO: 2698489 - RNA, 15 nt, Human
auuaaguaaugauaa

SEQ ID NO: 2698490 - RNA, 23 nt, Human
uuuuuuaaaaaagaaacauuugg

SEQ ID NO: 2698491 - RNA, 15 nt, Human
auuacauuuguauaa

SEQ ID NO: 2698492 - RNA, 16 nt, Human
auuacauuuguauaaa

SEQ ID NO: 2698493 - RNA, 13 nt, Human
auuacauuuguau

SEQ ID NO: 2698494 - RNA, 15 nt, Human
auucaaacagucuca

SEQ ID NO: 2698495 - RNA, 14 nt, Human
auucaaacagucuc

SEQ ID NO: 2698496 - RNA, 20 nt, Human
auuccacuuauaggaauuga

SEQ ID NO: 2698497 - RNA, 16 nt, Human
auuuacaaaugggaaa

SEQ ID NO: 2698498 - RNA, 19 nt, Human
auuuaaagcuuauuaaaac

SEQ ID NO: 2698499 - RNA, 14 nt, Human
auuguauuacaaau

SEQ ID NO: 2698500 - RNA, 13 nt, Human
auugugccccugc

SEQ ID NO: 2698501 - RNA, 20 nt, Human
auugacacuuaaaaaugguu

SEQ ID NO: 2698502 - RNA, 21 nt, Human
auugacccacaagaaaugaaa

SEQ ID NO: 2698503 - RNA, 14 nt, Human
auuuuaauaauguu

SEQ ID NO: 2698504 - RNA, 15 nt, Human
auuuuaauaauguuu

SEQ ID NO: 2698505 - RNA, 16 nt, Human
auuuuaauaauguuuc

SEQ ID NO: 2698506 - RNA, 21 nt, Human
auuuguauaaaauaauuuuua

SEQ ID NO: 2698507 - RNA, 15 nt, Human
auuuguaucacaaau

SEQ ID NO: 2698508 - RNA, 22 nt, Human
auuuauuacuguaagaaaauau

SEQ ID NO: 2698509 - RNA, 23 nt, Human
auuugguaaggggaauugaggac

SEQ ID NO: 2698510 - RNA, 18 nt, Human
auuuguaguguuggagaa

SEQ ID NO: 2698511 - RNA, 14 nt, Human
auauauaacaaugc

SEQ ID NO: 2698512 - RNA, 17 nt, Human
auauaacaaugcuguau

SEQ ID NO: 2698513 - RNA, 20 nt, Human
auaguuguaccgcaauguga

SEQ ID NO: 2698514 - RNA, 23 nt, Human
uucacaagacccaaaaggcagaa

SEQ ID NO: 2698515 - RNA, 22 nt, Human
uucacaagacccaaaaggcaga

SEQ ID NO: 2698516 - RNA, 17 nt, Human
auaggcguaacuaauuu

SEQ ID NO: 2698517 - RNA, 22 nt, Human
auaggaauugacccacaagaaa

SEQ ID NO: 2698518 - RNA, 14 nt, Human
uucaaacauauaua

SEQ ID NO: 2698519 - RNA, 18 nt, Human
uucaaacagucucaggaa

SEQ ID NO: 2698520 - RNA, 18 nt, Human
uucccaacuccagaaagu

SEQ ID NO: 2698521 - RNA, 12 nt, Human
uucccaaauuuc

SEQ ID NO: 2698522 - RNA, 20 nt, Human
aucaaauaugcaaagcacug

SEQ ID NO: 2698523 - RNA, 17 nt, Human
uucuaaguaaaaccaca

SEQ ID NO: 2698524 - RNA, 20 nt, Human
uucuaaguaaaaccacagca

SEQ ID NO: 2698525 - RNA, 19 nt, Human
uucuaaguaaaaccacagc

SEQ ID NO: 2698526 - RNA, 21 nt, Human
uucuaaguaaaaccacagcag

SEQ ID NO: 2698527 - RNA, 14 nt, Human
uucuauaauuuaaa

SEQ ID NO: 2698528 - RNA, 13 nt, Human
uucuauaauuuaa

SEQ ID NO: 2698529 - RNA, 20 nt, Human
aucauuucugcaucagcugc

SEQ ID NO: 2698530 - RNA, 14 nt, Human
auccauacauuugu

SEQ ID NO: 2698531 - RNA, 19 nt, Human
uugaaauauugacuuuuua

SEQ ID NO: 2698532 - RNA, 23 nt, Human
uugugugaaagguacuucaaauc

SEQ ID NO: 2698533 - RNA, 23 nt, Human
augagagacacacugaagaagca

SEQ ID NO: 2698534 - RNA, 20 nt, Human
augagagacacacugaagaa

SEQ ID NO: 2698535 - RNA, 21 nt, Human
augagagacacacugaagaag

SEQ ID NO: 2698536 - RNA, 22 nt, Human
augauuaugaauuacauuugua

SEQ ID NO: 2698537 - RNA, 12 nt, Human
augauucccagc

SEQ ID NO: 2698538 - RNA, 15 nt, Human
augcaaagcacugac

SEQ ID NO: 2698539 - RNA, 14 nt, Human
uuguuuucauuauc

SEQ ID NO: 2698540 - RNA, 17 nt, Human
augccacuaaauugaca

SEQ ID NO: 2698541 - RNA, 15 nt, Human
augccacuaaauuga

SEQ ID NO: 2698542 - RNA, 18 nt, Human
augcaguucugaagaaga

SEQ ID NO: 2698543 - RNA, 19 nt, Human
augcaguucugaagaagau

SEQ ID NO: 2698544 - RNA, 15 nt, Human
augcaguucugaaga

SEQ ID NO: 2698545 - RNA, 17 nt, Human
augcaguucugaagaag

SEQ ID NO: 2698546 - RNA, 20 nt, Human
auggcuaguaucaaaagaaa

SEQ ID NO: 2698547 - RNA, 22 nt, Human
augcugucuacacuaagagaga

SEQ ID NO: 2698548 - RNA, 19 nt, Human
augcuagaacucccuuuca

SEQ ID NO: 2698549 - RNA, 16 nt, Human
augcuagaacucccuu

SEQ ID NO: 2698550 - RNA, 15 nt, Human
augcuagaacucccu

SEQ ID NO: 2698551 - RNA, 13 nt, Human
uuuauauaagcuu

SEQ ID NO: 2698552 - RNA, 20 nt, Human
uuuagcuggaaaaguauguu

SEQ ID NO: 2698553 - RNA, 22 nt, Human
uuuagcuggaaaaguauguuag

SEQ ID NO: 2698554 - RNA, 13 nt, Human
uugcccuguuaaa

SEQ ID NO: 2698555 - RNA, 13 nt, Human
aucucaauauuuc

SEQ ID NO: 2698556 - RNA, 21 nt, Human
aucucauuuccaagcaaguau

SEQ ID NO: 2698557 - RNA, 23 nt, Human
aucucauuuccaagcaaguauua

SEQ ID NO: 2698558 - RNA, 19 nt, Human
uugauggugguauguuuuc

SEQ ID NO: 2698559 - RNA, 18 nt, Human
uugauggugguauguuuu

SEQ ID NO: 2698560 - RNA, 13 nt, Human
aucuuuuucuaac

SEQ ID NO: 2698561 - RNA, 15 nt, Human
augaaagcagggacu

SEQ ID NO: 2698562 - RNA, 18 nt, Human
augaaauauuauguuaaa

SEQ ID NO: 2698563 - RNA, 13 nt, Human
augaaauauuaug

SEQ ID NO: 2698564 - RNA, 17 nt, Human
augaaauauuauguuaa

SEQ ID NO: 2698565 - RNA, 13 nt, Human
augaaugaauggc

SEQ ID NO: 2698566 - RNA, 18 nt, Human
augaagauguagaggaga

SEQ ID NO: 2698567 - RNA, 16 nt, Human
uuguauaaaauaauuu

SEQ ID NO: 2698568 - RNA, 15 nt, Human
uuguauaaaauaauu

SEQ ID NO: 2698569 - RNA, 16 nt, Human
uuguaucacaaaucuu

SEQ ID NO: 2698570 - RNA, 17 nt, Human
uuguauaaaauaauuuu

SEQ ID NO: 2698571 - RNA, 13 nt, Human
augagagacacac

SEQ ID NO: 2698572 - RNA, 14 nt, Human
augagagacacacu

SEQ ID NO: 2698573 - RNA, 17 nt, Human
augagagacacacugaa

SEQ ID NO: 2698574 - RNA, 19 nt, Human
augagagacacacugaaga

SEQ ID NO: 2698575 - RNA, 22 nt, Human
caauuuuucuuauuucauuucu

SEQ ID NO: 2698576 - RNA, 21 nt, Human
caauaucuuuuuuuuaauaaa

SEQ ID NO: 2698577 - RNA, 21 nt, Human
cacaagaaaugaaagcaggga

SEQ ID NO: 2698578 - RNA, 20 nt, Human
cacaagaaaugaaagcaggg

SEQ ID NO: 2698579 - RNA, 18 nt, Human
cacaagaaaugaaagcag

SEQ ID NO: 2698580 - RNA, 18 nt, Human
cacagccagacuggcaca

SEQ ID NO: 2698581 - RNA, 17 nt, Human
cacagccagacuggcac

SEQ ID NO: 2698582 - RNA, 19 nt, Human
cacagcaguugaaaagacu

SEQ ID NO: 2698583 - RNA, 21 nt, Human
cacagcaguugaaaagacucc

SEQ ID NO: 2698584 - RNA, 13 nt, Human
cacacugaagaag

SEQ ID NO: 2698585 - RNA, 23 nt, Human
caagggugaugggaaagcauugu

SEQ ID NO: 2698586 - RNA, 21 nt, Human
caagggugaugggaaagcauu

SEQ ID NO: 2698587 - RNA, 17 nt, Human
caauagucaaauugugu

SEQ ID NO: 2698588 - RNA, 19 nt, Human
caauagucaaauuguguga

SEQ ID NO: 2698589 - RNA, 18 nt, Human
caaggaaaaaauaacaau

SEQ ID NO: 2698590 - RNA, 20 nt, Human
caaggaaaaaauaacaauga

SEQ ID NO: 2698591 - RNA, 13 nt, Human
caaauaugcaaag

SEQ ID NO: 2698592 - RNA, 12 nt, Human
caaauaugcaaa

SEQ ID NO: 2698593 - RNA, 18 nt, Human
caaauguucaucaaugaa

SEQ ID NO: 2698594 - RNA, 14 nt, Human
caaauguucaucaa

SEQ ID NO: 2698595 - RNA, 19 nt, Human
caagaaaugaaagcaggga

SEQ ID NO: 2698596 - RNA, 17 nt, Human
caagaaaugaaagcagg

SEQ ID NO: 2698597 - RNA, 15 nt, Human
caagaaaugaaagca

SEQ ID NO: 2698598 - RNA, 17 nt, Human
caaacugacucuuaaga

SEQ ID NO: 2698599 - RNA, 21 nt, Human
caaacugacucuuaagaagac

SEQ ID NO: 2698600 - RNA, 16 nt, Human
caaacugacucuuaag

SEQ ID NO: 2698601 - RNA, 18 nt, Human
caaaacugcacugucaag

SEQ ID NO: 2698602 - RNA, 17 nt, Human
caaaacugcacugucaa

SEQ ID NO: 2698603 - RNA, 14 nt, Human
caaaacugcacugu

SEQ ID NO: 2698604 - RNA, 14 nt, Human
cagugucaaugcag

SEQ ID NO: 2698605 - RNA, 16 nt, Human
caguguuuuaggagca

SEQ ID NO: 2698606 - RNA, 20 nt, Human
caguguuuuaggagcaugag

SEQ ID NO: 2698607 - RNA, 21 nt, Human
caguuaccucugccucagaaa

SEQ ID NO: 2698608 - RNA, 12 nt, Human
caguucugaaga

SEQ ID NO: 2698609 - RNA, 13 nt, Human
caguucugaagaa

SEQ ID NO: 2698610 - RNA, 14 nt, Human
caguucugaagaag

SEQ ID NO: 2698611 - RNA, 22 nt, Human
caguucugaagaagaugguacc

SEQ ID NO: 2698612 - RNA, 15 nt, Human
caguucugaagaaga

SEQ ID NO: 2698613 - RNA, 16 nt, Human
caguucugaagaagau

SEQ ID NO: 2698614 - RNA, 22 nt, Human
caguucggugagcuacaaaugc

SEQ ID NO: 2698615 - RNA, 17 nt, Human
cauaccaacacgagcag

SEQ ID NO: 2698616 - RNA, 18 nt, Human
caguugaaaagacuccaa

SEQ ID NO: 2698617 - RNA, 14 nt, Human
caguugaaaagacu

SEQ ID NO: 2698618 - RNA, 23 nt, Human
caguugaaaagacuccaaagaaa

SEQ ID NO: 2698619 - RNA, 22 nt, Human
caguugaaaagacuccaaagaa

SEQ ID NO: 2698620 - RNA, 21 nt, Human
caguugaaaagacuccaaaga

SEQ ID NO: 2698621 - RNA, 20 nt, Human
caguuuucugagaaagacua

SEQ ID NO: 2698622 - RNA, 19 nt, Human
caguuuucugagaaagacu

SEQ ID NO: 2698623 - RNA, 15 nt, Human
caguuuucugagaaa

SEQ ID NO: 2698624 - RNA, 14 nt, Human
caguuuucugagaa

SEQ ID NO: 2698625 - RNA, 22 nt, Human
caucuagugagcagucaggaaa

SEQ ID NO: 2698626 - RNA, 14 nt, Human
caucuagugagcag

SEQ ID NO: 2698627 - RNA, 14 nt, Human
caucccucccucca

SEQ ID NO: 2698628 - RNA, 12 nt, Human
caucccucccuc

SEQ ID NO: 2698629 - RNA, 13 nt, Human
caucccucccucc

SEQ ID NO: 2698630 - RNA, 18 nt, Human
caucaaugaaugaaugaa

SEQ ID NO: 2698631 - RNA, 22 nt, Human
caucaagucuuucacauuuaaa

SEQ ID NO: 2698632 - RNA, 20 nt, Human
cauauauaacaaugcuguau

SEQ ID NO: 2698633 - RNA, 23 nt, Human
caugcugucuacacuaagagaga

SEQ ID NO: 2698634 - RNA, 17 nt, Human
caugggacagggaggac

SEQ ID NO: 2698635 - RNA, 21 nt, Human
ccaacacgagcaggcuacugu

SEQ ID NO: 2698636 - RNA, 14 nt, Human
ccaacacgagcagg

SEQ ID NO: 2698637 - RNA, 22 nt, Human
ccacaagaaaugaaagcaggga

SEQ ID NO: 2698638 - RNA, 16 nt, Human
ccacaagaaaugaaag

SEQ ID NO: 2698639 - RNA, 20 nt, Human
ccaauauucauagcagcuua

SEQ ID NO: 2698640 - RNA, 19 nt, Human
ccaaggcugauuaaaccaa

SEQ ID NO: 2698641 - RNA, 18 nt, Human
ccaaggcuagaaccaccu

SEQ ID NO: 2698642 - RNA, 19 nt, Human
cauuuaaagcuuauuaaaa

SEQ ID NO: 2698643 - RNA, 12 nt, Human
cauuuccaagca

SEQ ID NO: 2698644 - RNA, 23 nt, Human
cauuucugcaucagcugcugaaa

SEQ ID NO: 2698645 - RNA, 17 nt, Human
ccaaagaaauguaaggg

SEQ ID NO: 2698646 - RNA, 16 nt, Human
cauuugcucauggaau

SEQ ID NO: 2698647 - RNA, 15 nt, Human
cauuugcucauggaa

SEQ ID NO: 2698648 - RNA, 14 nt, Human
cauuugcucaugga

SEQ ID NO: 2698649 - RNA, 16 nt, Human
cccaguguuuuaggag

SEQ ID NO: 2698650 - RNA, 17 nt, Human
cccaguguuuuaggagc

SEQ ID NO: 2698651 - RNA, 23 nt, Human
ccauggcacucuauguucuaaga

SEQ ID NO: 2698652 - RNA, 15 nt, Human
ccauccugaggcucc

SEQ ID NO: 2698653 - RNA, 16 nt, Human
ccauccugaggcucca

SEQ ID NO: 2698654 - RNA, 13 nt, Human
ccuaaacauauga

SEQ ID NO: 2698655 - RNA, 20 nt, Human
ccucagaugcacaugagcug

SEQ ID NO: 2698656 - RNA, 12 nt, Human
ccuccccuccuc

SEQ ID NO: 2698657 - RNA, 13 nt, Human
ccuccccuccucu

SEQ ID NO: 2698658 - RNA, 13 nt, Human
ccuccauccugag

SEQ ID NO: 2698659 - RNA, 12 nt, Human
ccuccauccuga

SEQ ID NO: 2698660 - RNA, 20 nt, Human
cccucccuccaccucccugc

SEQ ID NO: 2698661 - RNA, 13 nt, Human
cccucccuccacc

SEQ ID NO: 2698662 - RNA, 12 nt, Human
cccucccuccac

SEQ ID NO: 2698663 - RNA, 14 nt, Human
ccccaggugccagu

SEQ ID NO: 2698664 - RNA, 14 nt, Human
cccugcaauaaaau

SEQ ID NO: 2698665 - RNA, 15 nt, Human
cccugcaauaaaaug

SEQ ID NO: 2698666 - RNA, 23 nt, Human
cuaguaucaaaagaaagaaaauc

SEQ ID NO: 2698667 - RNA, 17 nt, Human
cuaguaucaaaagaaag

SEQ ID NO: 2698668 - RNA, 15 nt, Human
cuaguaucaaaagaa

SEQ ID NO: 2698669 - RNA, 22 nt, Human
cuaguauuucuaugaaauauua

SEQ ID NO: 2698670 - RNA, 19 nt, Human
cuaguauuucuaugaaaua

SEQ ID NO: 2698671 - RNA, 20 nt, Human
cuaguauuucuaugaaauau

SEQ ID NO: 2698672 - RNA, 22 nt, Human
cuaggaaauauuuauuuuaaua

SEQ ID NO: 2698673 - RNA, 19 nt, Human
cuauauuguuugcuaagca

SEQ ID NO: 2698674 - RNA, 20 nt, Human
cuauauuuuuuguuaaauga

SEQ ID NO: 2698675 - RNA, 13 nt, Human
cuaugaaauauua

SEQ ID NO: 2698676 - RNA, 18 nt, Human
cuaugaaauauuauguua

SEQ ID NO: 2698677 - RNA, 22 nt, Human
cuauauuuuuuguuaaaugauu

SEQ ID NO: 2698678 - RNA, 13 nt, Human
cucacauuuauau

SEQ ID NO: 2698679 - RNA, 17 nt, Human
cucaccccuugccauaa

SEQ ID NO: 2698680 - RNA, 18 nt, Human
cuacuugggaggcugaga

SEQ ID NO: 2698681 - RNA, 15 nt, Human
cuacuugggaggcug

SEQ ID NO: 2698682 - RNA, 19 nt, Human
cuacuugggaggcugagau

SEQ ID NO: 2698683 - RNA, 14 nt, Human
cuaagcaaaaugug

SEQ ID NO: 2698684 - RNA, 18 nt, Human
cuaagcaaaaugugauau

SEQ ID NO: 2698685 - RNA, 15 nt, Human
cuaagcaaaauguga

SEQ ID NO: 2698686 - RNA, 16 nt, Human
cuacacuccagugaga

SEQ ID NO: 2698687 - RNA, 17 nt, Human
cuacacuccagugagac

SEQ ID NO: 2698688 - RNA, 23 nt, Human
cuaaauugacacuuaaaaauggu

SEQ ID NO: 2698689 - RNA, 18 nt, Human
cgugcacgcacacugucu

SEQ ID NO: 2698690 - RNA, 18 nt, Human
cgcucucuggccuucggc

SEQ ID NO: 2698691 - RNA, 15 nt, Human
cgcucucuggccuuc

SEQ ID NO: 2698692 - RNA, 14 nt, Human
cgcucucuggccuu

SEQ ID NO: 2698693 - RNA, 12 nt, Human
cggccuccaucc

SEQ ID NO: 2698694 - RNA, 21 nt, Human
cggguuuuauuguuuaaaauc

SEQ ID NO: 2698695 - RNA, 22 nt, Human
cggucggguuuuauuguuuaaa

SEQ ID NO: 2698696 - RNA, 17 nt, Human
cggugagcuacaaaugc

SEQ ID NO: 2698697 - RNA, 20 nt, Human
cucuccugggcagcugccuc

SEQ ID NO: 2698698 - RNA, 15 nt, Human
cucuccugggcagcu

SEQ ID NO: 2698699 - RNA, 16 nt, Human
cucuccugggcagcug

SEQ ID NO: 2698700 - RNA, 18 nt, Human
cucuccugggcagcugcc

SEQ ID NO: 2698701 - RNA, 19 nt, Human
cucuccugggcagcugccu

SEQ ID NO: 2698702 - RNA, 12 nt, Human
cucuccugggca

SEQ ID NO: 2698703 - RNA, 15 nt, Human
cucuaggaaauauuu

SEQ ID NO: 2698704 - RNA, 17 nt, Human
cucuaggaaauauuuau

SEQ ID NO: 2698705 - RNA, 15 nt, Human
cucccuccaccuccc

SEQ ID NO: 2698706 - RNA, 17 nt, Human
cucccuccaccucccug

SEQ ID NO: 2698707 - RNA, 18 nt, Human
cuccauccugaggcucca

SEQ ID NO: 2698708 - RNA, 16 nt, Human
cuccauccugaggcuc

SEQ ID NO: 2698709 - RNA, 14 nt, Human
cuccauccugaggc

SEQ ID NO: 2698710 - RNA, 20 nt, Human
cugagcgacagugagacucu

SEQ ID NO: 2698711 - RNA, 16 nt, Human
cugagcgacagugaga

SEQ ID NO: 2698712 - RNA, 23 nt, Human
cugagaaagacuauucaaacagu

SEQ ID NO: 2698713 - RNA, 22 nt, Human
cugagaaagacuauucaaacag

SEQ ID NO: 2698714 - RNA, 15 nt, Human
cugacuucuaaguaa

SEQ ID NO: 2698715 - RNA, 13 nt, Human
cugacuucuaagu

SEQ ID NO: 2698716 - RNA, 16 nt, Human
cugacuucuaaguaaa

SEQ ID NO: 2698717 - RNA, 17 nt, Human
cugacucuuaagaagac

SEQ ID NO: 2698718 - RNA, 19 nt, Human
cucuggccuucggccucca

SEQ ID NO: 2698719 - RNA, 12 nt, Human
cucuggccuucg

SEQ ID NO: 2698720 - RNA, 12 nt, Human
cucugcuugcca

SEQ ID NO: 2698721 - RNA, 14 nt, Human
cucugcuugccauc

SEQ ID NO: 2698722 - RNA, 17 nt, Human
cucugcuugccaucccu

SEQ ID NO: 2698723 - RNA, 20 nt, Human
cucugcuugccaucccuccc

SEQ ID NO: 2698724 - RNA, 22 nt, Human
cucuucuuuaaagggauggcaa

SEQ ID NO: 2698725 - RNA, 17 nt, Human
cugaacaucacagcuua

SEQ ID NO: 2698726 - RNA, 23 nt, Human
cugaagaagcaccaaucaugaau

SEQ ID NO: 2698727 - RNA, 12 nt, Human
cugcccucuccu

SEQ ID NO: 2698728 - RNA, 13 nt, Human
cugcccucuccug

SEQ ID NO: 2698729 - RNA, 14 nt, Human
cugcccucuccugg

SEQ ID NO: 2698730 - RNA, 15 nt, Human
cugcccucuccuggg

SEQ ID NO: 2698731 - RNA, 18 nt, Human
cugcuugccaucccuccc

SEQ ID NO: 2698732 - RNA, 19 nt, Human
cugcuugccaucccucccu

SEQ ID NO: 2698733 - RNA, 20 nt, Human
cugcuugccaucccucccuc

SEQ ID NO: 2698734 - RNA, 22 nt, Human
cugcuugccaucccucccucca

SEQ ID NO: 2698735 - RNA, 16 nt, Human
cugcuugccaucccuc

SEQ ID NO: 2698736 - RNA, 15 nt, Human
cugcuugccaucccu

SEQ ID NO: 2698737 - RNA, 12 nt, Human
cugcacugucaa

SEQ ID NO: 2698738 - RNA, 15 nt, Human
cugccagcaacgcag

SEQ ID NO: 2698739 - RNA, 20 nt, Human
cugggaaagggauuuucagc

SEQ ID NO: 2698740 - RNA, 15 nt, Human
cuggccuucggccuc

SEQ ID NO: 2698741 - RNA, 21 nt, Human
cuggccuucggccuccauccu

SEQ ID NO: 2698742 - RNA, 18 nt, Human
cuggccuucggccuccau

SEQ ID NO: 2698743 - RNA, 17 nt, Human
cuggccuucggccucca

SEQ ID NO: 2698744 - RNA, 16 nt, Human
cuggccuucggccucc

SEQ ID NO: 2698745 - RNA, 22 nt, Human
cuguaauaaacucauuucuagc

SEQ ID NO: 2698746 - RNA, 20 nt, Human
cugucuccucucucuguaau

SEQ ID NO: 2698747 - RNA, 17 nt, Human
cugucuccucucucugu

SEQ ID NO: 2698748 - RNA, 18 nt, Human
cugucucuacuaaaaaua

SEQ ID NO: 2698749 - RNA, 13 nt, Human
cuguauuuuaaaa

SEQ ID NO: 2698750 - RNA, 16 nt, Human
cuguauuuuaaaagaa

SEQ ID NO: 2698751 - RNA, 15 nt, Human
cuguaugauucccag

SEQ ID NO: 2698752 - RNA, 16 nt, Human
gaacucccuuucaaca

SEQ ID NO: 2698753 - RNA, 14 nt, Human
gaaccacaagacug

SEQ ID NO: 2698754 - RNA, 15 nt, Human
gaaccacaagacugc

SEQ ID NO: 2698755 - RNA, 22 nt, Human
gaacuuguaaaggaauuuaaaa

SEQ ID NO: 2698756 - RNA, 20 nt, Human
gaagagcuguucacagccag

SEQ ID NO: 2698757 - RNA, 15 nt, Human
gaagagcuguucaca

SEQ ID NO: 2698758 - RNA, 13 nt, Human
gaagagcuguuca

SEQ ID NO: 2698759 - RNA, 23 nt, Human
gaagagcuguucacagccagacu

SEQ ID NO: 2698760 - RNA, 23 nt, Human
gaaguccaagcauuuagauguau

SEQ ID NO: 2698761 - RNA, 14 nt, Human
gaaggaugcugucu

SEQ ID NO: 2698762 - RNA, 15 nt, Human
gaaauauuuauuuua

SEQ ID NO: 2698763 - RNA, 16 nt, Human
gaaauauuuauuuuaa

SEQ ID NO: 2698764 - RNA, 13 nt, Human
gaaauauuuauuu

SEQ ID NO: 2698765 - RNA, 22 nt, Human
gaaauguaagggaaacugccag

SEQ ID NO: 2698766 - RNA, 24 nt, Human
gaacaguuaccucugccucagaaa

SEQ ID NO: 2698767 - RNA, 19 nt, Human
gaaagacuauucaaacagu

SEQ ID NO: 2698768 - RNA, 23 nt, Human
gaaagacuauucaaacagucuca

SEQ ID NO: 2698769 - RNA, 22 nt, Human
gaaagacuauucaaacagucuc

SEQ ID NO: 2698770 - RNA, 14 nt, Human
gaaagcagaacagu

SEQ ID NO: 2698771 - RNA, 13 nt, Human
gaaagcagaacag

SEQ ID NO: 2698772 - RNA, 15 nt, Human
gaaacugccagcaac

SEQ ID NO: 2698773 - RNA, 13 nt, Human
gaaacugccagca

SEQ ID NO: 2698774 - RNA, 16 nt, Human
gaaacugacacaugcu

SEQ ID NO: 2698775 - RNA, 21 nt, Human
gaaagcuugcccuggugccuc

SEQ ID NO: 2698776 - RNA, 17 nt, Human
cuugccaaauauaaaua

SEQ ID NO: 2698777 - RNA, 18 nt, Human
cuuguaaaggaauuuaaa

SEQ ID NO: 2698778 - RNA, 21 nt, Human
cuugcaugguuuagaaagcuu

SEQ ID NO: 2698779 - RNA, 23 nt, Human
cuugcaucaauuuuucuuauuuc

SEQ ID NO: 2698780 - RNA, 16 nt, Human
cuugagugcucaguag

SEQ ID NO: 2698781 - RNA, 20 nt, Human
cuugaacccgggaggcagag

SEQ ID NO: 2698782 - RNA, 19 nt, Human
cuugaacccgggaggcaga

SEQ ID NO: 2698783 - RNA, 14 nt, Human
cuugaacccgggag

SEQ ID NO: 2698784 - RNA, 19 nt, Human
cuucuuuccacagaagcuc

SEQ ID NO: 2698785 - RNA, 13 nt, Human
cuucuuuccacag

SEQ ID NO: 2698786 - RNA, 23 nt, Human
gaccugauuucugagcauuuaau

SEQ ID NO: 2698787 - RNA, 17 nt, Human
gacaugggacauuugcu

SEQ ID NO: 2698788 - RNA, 22 nt, Human
gacaugggacauuugcucaugg

SEQ ID NO: 2698789 - RNA, 18 nt, Human
gagcugcccucuccuggg

SEQ ID NO: 2698790 - RNA, 19 nt, Human
gagcugcccucuccugggc

SEQ ID NO: 2698791 - RNA, 21 nt, Human
gagcugcccucuccugggcag

SEQ ID NO: 2698792 - RNA, 23 nt, Human
gagcugcccucuccugggcagcu

SEQ ID NO: 2698793 - RNA, 16 nt, Human
gagcucgugggacagu

SEQ ID NO: 2698794 - RNA, 19 nt, Human
gagagacacacugaagaag

SEQ ID NO: 2698795 - RNA, 17 nt, Human
gagauacagaauuuuau

SEQ ID NO: 2698796 - RNA, 19 nt, Human
gagagugaacaaauuuaca

SEQ ID NO: 2698797 - RNA, 15 nt, Human
gagagugaacaaauu

SEQ ID NO: 2698798 - RNA, 13 nt, Human
gagacagcucugc

SEQ ID NO: 2698799 - RNA, 18 nt, Human
gagacagcucugcauacu

SEQ ID NO: 2698800 - RNA, 15 nt, Human
gagacagcucugcau

SEQ ID NO: 2698801 - RNA, 18 nt, Human
gagacacacugaagaagc

SEQ ID NO: 2698802 - RNA, 22 nt, Human
gagaagagcuguucacagccag

SEQ ID NO: 2698803 - RNA, 15 nt, Human
gagaagagcuguuca

SEQ ID NO: 2698804 - RNA, 13 nt, Human
gagaagaacugaa

SEQ ID NO: 2698805 - RNA, 14 nt, Human
gagaagaacugaaa

SEQ ID NO: 2698806 - RNA, 16 nt, Human
gagaagaacugaaauc

SEQ ID NO: 2698807 - RNA, 18 nt, Human
gagaaagacuauucaaac

SEQ ID NO: 2698808 - RNA, 17 nt, Human
gagaaagacuauucaaa

SEQ ID NO: 2698809 - RNA, 15 nt, Human
gagaaagacuauuca

SEQ ID NO: 2698810 - RNA, 13 nt, Human
gagaaagacuauu

SEQ ID NO: 2698811 - RNA, 13 nt, Human
gauccuggaaauc

SEQ ID NO: 2698812 - RNA, 14 nt, Human
gaugaaaauauuug

SEQ ID NO: 2698813 - RNA, 21 nt, Human
gauggcuaguaucaaaagaaa

SEQ ID NO: 2698814 - RNA, 23 nt, Human
gauagauaggucagugcaaauac

SEQ ID NO: 2698815 - RNA, 22 nt, Human
gauaaauaguuuaugauuccac

SEQ ID NO: 2698816 - RNA, 14 nt, Human
gcaagggugauggg

SEQ ID NO: 2698817 - RNA, 10 nt, Human
gcaagccaga

SEQ ID NO: 2698818 - RNA, 23 nt, Human
gcaaagcacugacuucuaaguaa

SEQ ID NO: 2698819 - RNA, 11 nt, Human
gauuuucagcc

SEQ ID NO: 2698820 - RNA, 15 nt, Human
gauuuucagcccuca

SEQ ID NO: 2698821 - RNA, 19 nt, Human
gauuuucagcccucagaau

SEQ ID NO: 2698822 - RNA, 15 nt, Human
gauuuuccugaaaac

SEQ ID NO: 2698823 - RNA, 16 nt, Human
gcaguucagagcugcc

SEQ ID NO: 2698824 - RNA, 15 nt, Human
gcaguucugaagaag

SEQ ID NO: 2698825 - RNA, 17 nt, Human
gcaguucagagcugccc

SEQ ID NO: 2698826 - RNA, 18 nt, Human
gcaguucagagcugcccu

SEQ ID NO: 2698827 - RNA, 17 nt, Human
gcaguucugaagaagau

SEQ ID NO: 2698828 - RNA, 13 nt, Human
gcauagaaguaaa

SEQ ID NO: 2698829 - RNA, 17 nt, Human
gcauagguuuaauaauu

SEQ ID NO: 2698830 - RNA, 13 nt, Human
gcauuauauuuau

SEQ ID NO: 2698831 - RNA, 12 nt, Human
gcaucagcugcu

SEQ ID NO: 2698832 - RNA, 20 nt, Human
gcagccccgugggguuccuc

SEQ ID NO: 2698833 - RNA, 18 nt, Human
gcagauaaacaguaguga

SEQ ID NO: 2698834 - RNA, 12 nt, Human
gcgacagugaga

SEQ ID NO: 2698835 - RNA, 19 nt, Human
gcuagaacucccuuucaac

SEQ ID NO: 2698836 - RNA, 13 nt, Human
gcuauaggugcua

SEQ ID NO: 2698837 - RNA, 23 nt, Human
gccguggugauuuagcaggaagc

SEQ ID NO: 2698838 - RNA, 22 nt, Human
gccgugugugugcguccugucg

SEQ ID NO: 2698839 - RNA, 20 nt, Human
gccgggcgugguggugagug

SEQ ID NO: 2698840 - RNA, 17 nt, Human
gccuccccuccucugcu

SEQ ID NO: 2698841 - RNA, 19 nt, Human
gccuccccuccucugcuug

SEQ ID NO: 2698842 - RNA, 23 nt, Human
gccuccccuccucugcuugccau

SEQ ID NO: 2698843 - RNA, 20 nt, Human
gccuccccuccucugcuugc

SEQ ID NO: 2698844 - RNA, 22 nt, Human
gccuccccuccucugcuugcca

SEQ ID NO: 2698845 - RNA, 19 nt, Human
gccaugggcacugugggua

SEQ ID NO: 2698846 - RNA, 18 nt, Human
gccaucccucccuccacc

SEQ ID NO: 2698847 - RNA, 23 nt, Human
gccaucccucccuccaccucccu

SEQ ID NO: 2698848 - RNA, 20 nt, Human
uuuuaauaauguuucaaaca

SEQ ID NO: 2698849 - RNA, 21 nt, Human
uuuuaaaagaaugauuaugaa

SEQ ID NO: 2698850 - RNA, 13 nt, Human
uuuguauaaaaua

SEQ ID NO: 2698851 - RNA, 14 nt, Human
uuuguauaaaauaa

SEQ ID NO: 2698852 - RNA, 16 nt, Human
uuuguauaaaauaauu

SEQ ID NO: 2698853 - RNA, 13 nt, Human
uuugguuucuagc

SEQ ID NO: 2698854 - RNA, 15 nt, Human
uuucugagaaagacu

SEQ ID NO: 2698855 - RNA, 13 nt, Human
uuucugagaaaga

SEQ ID NO: 2698856 - RNA, 18 nt, Human
uuuccucauuuuuauaau

SEQ ID NO: 2698857 - RNA, 22 nt, Human
uuuccucaaaacuucagacaua

SEQ ID NO: 2698858 - RNA, 18 nt, Human
uuugaaucaucaagucuu

SEQ ID NO: 2698859 - RNA, 17 nt, Human
uuucuuauuucauuucu

SEQ ID NO: 2698860 - RNA, 19 nt, Human
uuuuucucuaggaaauauu

SEQ ID NO: 2698861 - RNA, 14 nt, Human
uuuuccugaaaacc

SEQ ID NO: 2698862 - RNA, 18 nt, Human
uuuuggucuggagggaag

SEQ ID NO: 2698863 - RNA, 18 nt, Human
uuuuuaaaaaagaaacau

SEQ ID NO: 2698864 - RNA, 22 nt, Human
gucagcuccccucggagaagag

SEQ ID NO: 2698865 - RNA, 21 nt, Human
gucagcuccccucggagaaga

SEQ ID NO: 2698866 - RNA, 23 nt, Human
gucagcuccccucggagaagagc

SEQ ID NO: 2698867 - RNA, 23 nt, Human
gucaauaaaauccauacauuugu

SEQ ID NO: 2698868 - RNA, 22 nt, Human
gucaauaaaauccauacauuug

SEQ ID NO: 2698869 - RNA, 15 nt, Human
gucaaugcagccccc

SEQ ID NO: 2698870 - RNA, 18 nt, Human
guauuuuaaaagaaugau

SEQ ID NO: 2698871 - RNA, 13 nt, Human
guauuuuaaucac

SEQ ID NO: 2698872 - RNA, 20 nt, Human
guauuuuaaaagaaugauua

SEQ ID NO: 2698873 - RNA, 19 nt, Human
gucagcuccccucggagaa

SEQ ID NO: 2698874 - RNA, 14 nt, Human
guaguguuggagaa

SEQ ID NO: 2698875 - RNA, 15 nt, Human
guaguguuggagaag

SEQ ID NO: 2698876 - RNA, 18 nt, Human
gcuauaggugcuacaaaa

SEQ ID NO: 2698877 - RNA, 17 nt, Human
guauguuagugcaaauu

SEQ ID NO: 2698878 - RNA, 23 nt, Human
gucugugagaugcuagaacuccc

SEQ ID NO: 2698879 - RNA, 22 nt, Human
gucugugagaugcuagaacucc

SEQ ID NO: 2698880 - RNA, 21 nt, Human
gucugugagaugcuagaacuc

SEQ ID NO: 2698881 - RNA, 17 nt, Human
gucugugagaugcuaga

SEQ ID NO: 2698882 - RNA, 16 nt, Human
gucugugagaugcuag

SEQ ID NO: 2698883 - RNA, 15 nt, Human
gucugugagaugcua

SEQ ID NO: 2698884 - RNA, 18 nt, Human
gucgucaaagcugaaaug

SEQ ID NO: 2698885 - RNA, 16 nt, Human
gucggagcccugucuc

SEQ ID NO: 2698886 - RNA, 12 nt, Human
gucggagcccug

SEQ ID NO: 2698887 - RNA, 23 nt, Human
gucggguuuuauuguuuaaaauc

SEQ ID NO: 2698888 - RNA, 13 nt, Human
gucugacuguuuc

SEQ ID NO: 2698889 - RNA, 13 nt, Human
gugcguccugucg

SEQ ID NO: 2698890 - RNA, 21 nt, Human
gugaacaaauuuacagagaca

SEQ ID NO: 2698891 - RNA, 13 nt, Human
gugaacacaucag

SEQ ID NO: 2698892 - RNA, 16 nt, Human
gugacaagcucacaga

SEQ ID NO: 2698893 - RNA, 14 nt, Human
guucugaagaagau

SEQ ID NO: 2698894 - RNA, 15 nt, Human
guucugaagaagaug

SEQ ID NO: 2698895 - RNA, 12 nt, Human
guucugaagaag

SEQ ID NO: 2698896 - RNA, 13 nt, Human
guucugaagaaga

SEQ ID NO: 2698897 - RNA, 23 nt, Human
guugaaaagacuccaaagaaaug

SEQ ID NO: 2698898 - RNA, 22 nt, Human
guugaaaagacuccaaagaaau

SEQ ID NO: 2698899 - RNA, 17 nt, Human
guugaaaagacuccaaa

SEQ ID NO: 2698900 - RNA, 21 nt, Human
guugauggugguauguuuuca

SEQ ID NO: 2698901 - RNA, 20 nt, Human
guugauggugguauguuuuc

SEQ ID NO: 2698902 - RNA, 23 nt, Human
guuaccucugccucagaaaacaa

SEQ ID NO: 2698903 - RNA, 13 nt, Human
guucagagcugcc

SEQ ID NO: 2698904 - RNA, 14 nt, Human
guucagagcugccc

SEQ ID NO: 2698905 - RNA, 23 nt, Human
guucagagcugcccucuccuggg

SEQ ID NO: 2698906 - RNA, 20 nt, Human
guucagagcugcccucuccu

SEQ ID NO: 2698907 - RNA, 22 nt, Human
guucagagcugcccucuccugg

SEQ ID NO: 2698908 - RNA, 15 nt, Human
guucagagcugcccu

SEQ ID NO: 2698909 - RNA, 16 nt, Human
guucagagcugcccuc

SEQ ID NO: 2698910 - RNA, 17 nt, Human
guucagagcugcccucu

SEQ ID NO: 2698911 - RNA, 19 nt, Human
guucagagcugcccucucc

SEQ ID NO: 2698912 - RNA, 16 nt, Human
guucaucaaugaauga

SEQ ID NO: 2698913 - RNA, 16 nt, Human
guuaaaagaugaaaau

SEQ ID NO: 2698914 - RNA, 14 nt, Human
guuaaaagaugaaa

SEQ ID NO: 2698915 - RNA, 20 nt, Human
guuaaaagaugaaaauauuu

SEQ ID NO: 2698916 - RNA, 16 nt, Human
gugugcguccugucgg

SEQ ID NO: 2698917 - RNA, 14 nt, Human
gugugcguccuguc

SEQ ID NO: 2698918 - RNA, 21 nt, Human
guguaaguagauaggccaugg

SEQ ID NO: 2698919 - RNA, 20 nt, Human
gugcuacaaaaacacagcaa

SEQ ID NO: 2698920 - RNA, 15 nt, Human
gugcuacaaaaacac

SEQ ID NO: 2698921 - RNA, 20 nt, Human
guuuagcuggaaaaguaugu

SEQ ID NO: 2698922 - RNA, 21 nt, Human
guuuagcuggaaaaguauguu

SEQ ID NO: 2698923 - RNA, 20 nt, Human
guuuauauaagcuuguauuc

SEQ ID NO: 2698924 - RNA, 13 nt, Human
uaaaaccacagca

SEQ ID NO: 2698925 - RNA, 13 nt, Human
uaaaaucauuucu

SEQ ID NO: 2698926 - RNA, 10 nt, Human
uaaaaucauu

SEQ ID NO: 2698927 - RNA, 15 nt, Human
uaaaauccauacauu

SEQ ID NO: 2698928 - RNA, 17 nt, Human
uaaaauccauacauuug

SEQ ID NO: 2698929 - RNA, 22 nt, Human
uaaaaucauuucugcaucagcu

SEQ ID NO: 2698930 - RNA, 18 nt, Human
uaaaaucauuucugcauc

SEQ ID NO: 2698931 - RNA, 22 nt, Human
uaaaacaagcacuaaacaaaga

SEQ ID NO: 2698932 - RNA, 18 nt, Human
uaaaaaugguuuaaaugg

SEQ ID NO: 2698933 - RNA, 15 nt, Human
uaaaaaugguuuaaa

SEQ ID NO: 2698934 - RNA, 19 nt, Human
uaaaaaugguuuaaauggu

SEQ ID NO: 2698935 - RNA, 14 nt, Human
uaaaguguuugaaa

SEQ ID NO: 2698936 - RNA, 23 nt, Human
uaaugauaacuggaaacuucagc

SEQ ID NO: 2698937 - RNA, 17 nt, Human
uaaugauaacuggaaac

SEQ ID NO: 2698938 - RNA, 22 nt, Human
uaaugauaacuggaaacuucag

SEQ ID NO: 2698939 - RNA, 22 nt, Human
uaauguuucaaacauauauaac

SEQ ID NO: 2698940 - RNA, 14 nt, Human
uaauaauguuucaa

SEQ ID NO: 2698941 - RNA, 13 nt, Human
uaagugaaauaag

SEQ ID NO: 2698942 - RNA, 16 nt, Human
uaaaugugccuucauu

SEQ ID NO: 2698943 - RNA, 16 nt, Human
uaaaugugcuuuuaaa

SEQ ID NO: 2698944 - RNA, 20 nt, Human
uaaauugacacuuaaaaaug

SEQ ID NO: 2698945 - RNA, 20 nt, Human
uaaauggcuuccuggcaaua

SEQ ID NO: 2698946 - RNA, 15 nt, Human
uaacuggaaacuuca

SEQ ID NO: 2698947 - RNA, 13 nt, Human
uaagagagaauga

SEQ ID NO: 2698948 - RNA, 14 nt, Human
uaagagagaaugag

SEQ ID NO: 2698949 - RNA, 23 nt, Human
uaagagagaaugagagacacacu

SEQ ID NO: 2698950 - RNA, 21 nt, Human
uaagaaaauaucacuugucaa

SEQ ID NO: 2698951 - RNA, 17 nt, Human
uaaccaggggccaugaa

SEQ ID NO: 2698952 - RNA, 14 nt, Human
uauaugcuucuguu

SEQ ID NO: 2698953 - RNA, 16 nt, Human
uauaugcuucuguuuu

SEQ ID NO: 2698954 - RNA, 20 nt, Human
uauauuugaaauauugacuu

SEQ ID NO: 2698955 - RNA, 21 nt, Human
uauauuuuuuguuaaaugauu

SEQ ID NO: 2698956 - RNA, 14 nt, Human
uaucaaaagaaaga

SEQ ID NO: 2698957 - RNA, 17 nt, Human
uauauaacaaugcugua

SEQ ID NO: 2698958 - RNA, 19 nt, Human
uauauaacaaugcuguauu

SEQ ID NO: 2698959 - RNA, 17 nt, Human
uaguauuguccaggucu

SEQ ID NO: 2698960 - RNA, 18 nt, Human
uaggugcuacaaaaacac

SEQ ID NO: 2698961 - RNA, 23 nt, Human
uaggugcuacaaaaacacagcaa

SEQ ID NO: 2698962 - RNA, 22 nt, Human
uaggugcuacaaaaacacagca

SEQ ID NO: 2698963 - RNA, 20 nt, Human
uaggugcuacaaaaacacag

SEQ ID NO: 2698964 - RNA, 14 nt, Human
uagauaggccaugg

SEQ ID NO: 2698965 - RNA, 16 nt, Human
uagcaugaagacagag

SEQ ID NO: 2698966 - RNA, 18 nt, Human
uagaauuaacacaugauc

SEQ ID NO: 2698967 - RNA, 16 nt, Human
uagaauuaacacauga

SEQ ID NO: 2698968 - RNA, 15 nt, Human
uagaauuaacacaug

SEQ ID NO: 2698969 - RNA, 23 nt, Human
uagaauaccacaggaaccacaag

SEQ ID NO: 2698970 - RNA, 13 nt, Human
uaauuuugugaag

SEQ ID NO: 2698971 - RNA, 16 nt, Human
uaauuuuuauauuuga

SEQ ID NO: 2698972 - RNA, 17 nt, Human
uaauuuuuauauuugaa

SEQ ID NO: 2698973 - RNA, 18 nt, Human
uaauuuugugaagcaaaa

SEQ ID NO: 2698974 - RNA, 12 nt, Human
uaauuuuuauau

SEQ ID NO: 2698975 - RNA, 16 nt, Human
uacacacucaaaucaa

SEQ ID NO: 2698976 - RNA, 17 nt, Human
uacacacucaaaucaag

SEQ ID NO: 2698977 - RNA, 14 nt, Human
uacacuccagugag

SEQ ID NO: 2698978 - RNA, 23 nt, Human
uacaguucggugagcuacaaaug

SEQ ID NO: 2698979 - RNA, 23 nt, Human
uacugucagcuccccucggagaa

SEQ ID NO: 2698980 - RNA, 22 nt, Human
uaccuaacgaaguauccuucag

SEQ ID NO: 2698981 - RNA, 22 nt, Human
uaccaaaaaucucaauauuuca

SEQ ID NO: 2698982 - RNA, 16 nt, Human
uaccuaucaucuuaag

SEQ ID NO: 2698983 - RNA, 14 nt, Human
ugaauuacauuugu

SEQ ID NO: 2698984 - RNA, 13 nt, Human
ugaauuacauuug

SEQ ID NO: 2698985 - RNA, 14 nt, Human
ugaauuaaguuuuu

SEQ ID NO: 2698986 - RNA, 18 nt, Human
ugaccacugcagaagaca

SEQ ID NO: 2698987 - RNA, 17 nt, Human
ugaccacugcagaagac

SEQ ID NO: 2698988 - RNA, 16 nt, Human
ugaccacugcagaaga

SEQ ID NO: 2698989 - RNA, 15 nt, Human
ugaaugaauggcuaa

SEQ ID NO: 2698990 - RNA, 14 nt, Human
ugacucuuaagaag

SEQ ID NO: 2698991 - RNA, 15 nt, Human
ugacucuuaagaaga

SEQ ID NO: 2698992 - RNA, 16 nt, Human
ugacucuuaagaagac

SEQ ID NO: 2698993 - RNA, 13 nt, Human
ugacucuuaagaa

SEQ ID NO: 2698994 - RNA, 15 nt, Human
ugagaaagacuauuc

SEQ ID NO: 2698995 - RNA, 20 nt, Human
ugagcaggauuuuaaucuuu

SEQ ID NO: 2698996 - RNA, 15 nt, Human
ugagcaggauuuuaa

SEQ ID NO: 2698997 - RNA, 14 nt, Human
ucugucucagucca

SEQ ID NO: 2698998 - RNA, 17 nt, Human
ucuuuccacagaagcuc

SEQ ID NO: 2698999 - RNA, 14 nt, Human
ucuuauaauuuaaa

SEQ ID NO: 2699000 - RNA, 13 nt, Human
ucuuauaauuuaa

SEQ ID NO: 2699001 - RNA, 22 nt, Human
ucuuaggguuaugauuaaguaa

SEQ ID NO: 2699002 - RNA, 19 nt, Human
ucuugccaaauauaaauaa

SEQ ID NO: 2699003 - RNA, 16 nt, Human
ucuucuuggucucagu

SEQ ID NO: 2699004 - RNA, 16 nt, Human
ucagcugcugaaacaa

SEQ ID NO: 2699005 - RNA, 21 nt, Human
ucagcuccccucggagaagag

SEQ ID NO: 2699006 - RNA, 22 nt, Human
ucagcuccccucggagaagagc

SEQ ID NO: 2699007 - RNA, 18 nt, Human
ucaguccaugaagaugua

SEQ ID NO: 2699008 - RNA, 21 nt, Human
ucauggaauuggagcucgugg

SEQ ID NO: 2699009 - RNA, 19 nt, Human
ucauggaauuggagcucgu

SEQ ID NO: 2699010 - RNA, 12 nt, Human
uccauacauuug

SEQ ID NO: 2699011 - RNA, 15 nt, Human
ucuacuaaaaauaca

SEQ ID NO: 2699012 - RNA, 19 nt, Human
ucuacuaaaaauacaaaaa

SEQ ID NO: 2699013 - RNA, 12 nt, Human
ucuacuaaaaau

SEQ ID NO: 2699014 - RNA, 14 nt, Human
ucggagcccugucu

SEQ ID NO: 2699015 - RNA, 15 nt, Human
ucggagcccugucuc

SEQ ID NO: 2699016 - RNA, 16 nt, Human
ucggccuccauccuga

SEQ ID NO: 2699017 - RNA, 15 nt, Human
ucggccuccauccug

SEQ ID NO: 2699018 - RNA, 17 nt, Human
uccuugcaucaauuuuu

SEQ ID NO: 2699019 - RNA, 15 nt, Human
uccugaggcuccacu

SEQ ID NO: 2699020 - RNA, 21 nt, Human
uccugaggcuccacuuggucu

SEQ ID NO: 2699021 - RNA, 17 nt, Human
uccugaggcuccacuug

SEQ ID NO: 2699022 - RNA, 16 nt, Human
uccugaggcuccacuu

SEQ ID NO: 2699023 - RNA, 14 nt, Human
uccucugcuugcca

SEQ ID NO: 2699024 - RNA, 15 nt, Human
uccucugcuugccau

SEQ ID NO: 2699025 - RNA, 16 nt, Human
uccucugcuugccauc

SEQ ID NO: 2699026 - RNA, 17 nt, Human
uccucugcuugccaucc

SEQ ID NO: 2699027 - RNA, 18 nt, Human
ugccuguaaucacagcua

SEQ ID NO: 2699028 - RNA, 15 nt, Human
ugccuucucaacucc

SEQ ID NO: 2699029 - RNA, 16 nt, Human
ugcucaguagucagac

SEQ ID NO: 2699030 - RNA, 15 nt, Human
ugcuaagcauuccaa

SEQ ID NO: 2699031 - RNA, 19 nt, Human
ugcuaagcauuccaacuau

SEQ ID NO: 2699032 - RNA, 17 nt, Human
ugcugaaacaacaaaua

SEQ ID NO: 2699033 - RNA, 19 nt, Human
ugcacgcacacugucugcc

SEQ ID NO: 2699034 - RNA, 19 nt, Human
ugcagugagccgagauugu

SEQ ID NO: 2699035 - RNA, 15 nt, Human
ugcaguucugaagaa

SEQ ID NO: 2699036 - RNA, 16 nt, Human
ugcaguucugaagaag

SEQ ID NO: 2699037 - RNA, 17 nt, Human
ugcaguucugaagaaga

SEQ ID NO: 2699038 - RNA, 18 nt, Human
ugcaguucugaagaagau

SEQ ID NO: 2699039 - RNA, 14 nt, Human
ugcaguucugaaga

SEQ ID NO: 2699040 - RNA, 19 nt, Human
ugcaguucugaagaagaug

SEQ ID NO: 2699041 - RNA, 22 nt, Human
ugcaguucugaagaagauggua

SEQ ID NO: 2699042 - RNA, 14 nt, Human
ugccaucccucccu

SEQ ID NO: 2699043 - RNA, 11 nt, Human
ugccaucccuc

SEQ ID NO: 2699044 - RNA, 12 nt, Human
ugccaucccucc

SEQ ID NO: 2699045 - RNA, 20 nt, Human
ugccacuaaauugacacuua

SEQ ID NO: 2699046 - RNA, 18 nt, Human
ugccaaauauaaauaaaa

SEQ ID NO: 2699047 - RNA, 17 nt, Human
ugccaaauauaaauaaa

SEQ ID NO: 2699048 - RNA, 22 nt, Human
ugccaaauauaaauaaaaauaa

SEQ ID NO: 2699049 - RNA, 19 nt, Human
ugccaaauauaaauaaaaa

SEQ ID NO: 2699050 - RNA, 14 nt, Human
ugggaguacaaaag

SEQ ID NO: 2699051 - RNA, 21 nt, Human
uggcuugaguuuaaauuguaa

SEQ ID NO: 2699052 - RNA, 16 nt, Human
uggcuuccuggcaaua

SEQ ID NO: 2699053 - RNA, 21 nt, Human
ugguauguuuucaggcuagau

SEQ ID NO: 2699054 - RNA, 11 nt, Human
uggagggaagc

SEQ ID NO: 2699055 - RNA, 21 nt, Human
uggaacauaaaauacaauguu

SEQ ID NO: 2699056 - RNA, 20 nt, Human
uggaacauaaaauacaaugu

SEQ ID NO: 2699057 - RNA, 23 nt, Human
uggaaacuucagcgguuuauaua

SEQ ID NO: 2699058 - RNA, 22 nt, Human
uggaauaauccuaaacauauga

SEQ ID NO: 2699059 - RNA, 19 nt, Human
ugugcuaguaauuggaaag

SEQ ID NO: 2699060 - RNA, 15 nt, Human
uguaugauucccagc

SEQ ID NO: 2699061 - RNA, 22 nt, Human
uguaguguuggagaagaacuga

SEQ ID NO: 2699062 - RNA, 16 nt, Human
uguaccgcaaugugac

SEQ ID NO: 2699063 - RNA, 20 nt, Human
uguaauaaacucauuucuag

SEQ ID NO: 2699064 - RNA, 18 nt, Human
uuaaaauacacacucaaa

SEQ ID NO: 2699065 - RNA, 22 nt, Human
uuaaaaaaaaaccugagcccca

SEQ ID NO: 2699066 - RNA, 20 nt, Human
uuacauuuguauaaaauaau

SEQ ID NO: 2699067 - RNA, 20 nt, Human
uguugacaugggacauuugc

SEQ ID NO: 2699068 - RNA, 16 nt, Human
uguuggagaagaacug

SEQ ID NO: 2699069 - RNA, 17 nt, Human
uguuggagaagaacuga

SEQ ID NO: 2699070 - RNA, 14 nt, Human
uguuggagaagaac

SEQ ID NO: 2699071 - RNA, 19 nt, Human
uguuggagaagaacugaaa

SEQ ID NO: 2699072 - RNA, 20 nt, Human
uguuggagaagaacugaaau

SEQ ID NO: 2699073 - RNA, 18 nt, Human
uguuuaaaaucauuucug

SEQ ID NO: 2699074 - RNA, 17 nt, Human
uguuuaaaaucauuucu

SEQ ID NO: 2699075 - RNA, 13 nt, Human
uguguuuugcaag

SEQ ID NO: 2699076 - RNA, 19 nt, Human
uguguuuugcaagccagau

SEQ ID NO: 2699077 - RNA, 20 nt, Human
ugugugaaagguacuucaaa

SEQ ID NO: 2699078 - RNA, 21 nt, Human
ugugugaaagguacuucaaau

SEQ ID NO: 2699079 - RNA, 22 nt, Human
ugugugaaagguacuucaaauc

SEQ ID NO: 2699080 - RNA, 21 nt, Human
uguuaaaagaugaaaauauuu

SEQ ID NO: 2699081 - RNA, 13 nt, Human
aaaaacacagcaa

SEQ ID NO: 2699082 - RNA, 18 nt, Human
aaaaacacagcaagggug

SEQ ID NO: 2699083 - RNA, 12 nt, Human
aaaaacacagca

SEQ ID NO: 2699084 - RNA, 17 nt, Human
acucuauguucuaagaa

SEQ ID NO: 2699085 - RNA, 20 nt, Human
acuaguauuucuaugaaaua

SEQ ID NO: 2699086 - RNA, 21 nt, Human
acuauucaaacagucucagga

SEQ ID NO: 2699087 - RNA, 22 nt, Human
acgcaggcccccaggugccagu

SEQ ID NO: 2699088 - RNA, 19 nt, Human
acgcaggcccccaggugcc

SEQ ID NO: 2699089 - RNA, 13 nt, Human
acuaagagagaau

SEQ ID NO: 2699090 - RNA, 14 nt, Human
agaaaauaacaaua

SEQ ID NO: 2699091 - RNA, 16 nt, Human
agaaaaucaggcuggc

SEQ ID NO: 2699092 - RNA, 22 nt, Human
acuuuauuuucuauaauuuaaa

SEQ ID NO: 2699093 - RNA, 22 nt, Human
acuguaagaaaauaucacuugu

SEQ ID NO: 2699094 - RNA, 19 nt, Human
acuguaagaaaauaucacu

SEQ ID NO: 2699095 - RNA, 13 nt, Human
acuguaagaaaau

SEQ ID NO: 2699096 - RNA, 18 nt, Human
acucugucucaguccaug

SEQ ID NO: 2699097 - RNA, 20 nt, Human
acucugucucaguccaugaa

SEQ ID NO: 2699098 - RNA, 13 nt, Human
acugccagcaacg

SEQ ID NO: 2699099 - RNA, 12 nt, Human
acuucagacaua

SEQ ID NO: 2699100 - RNA, 21 nt, Human
acuucugucuucacaacagau

SEQ ID NO: 2699101 - RNA, 22 nt, Human
acuucugucuucacaacagauu

SEQ ID NO: 2699102 - RNA, 21 nt, Human
acuuggucugugagaugcuag

SEQ ID NO: 2699103 - RNA, 22 nt, Human
acccaguguuuuaggagcauga

SEQ ID NO: 2699104 - RNA, 19 nt, Human
acccaguguuuuaggagca

SEQ ID NO: 2699105 - RNA, 21 nt, Human
acccacaagaaaugaaagcag

SEQ ID NO: 2699106 - RNA, 17 nt, Human
acccacaagaaaugaaa

SEQ ID NO: 2699107 - RNA, 21 nt, Human
acagcaguugaaaagacucca

SEQ ID NO: 2699108 - RNA, 23 nt, Human
acagcaguugaaaagacuccaaa

SEQ ID NO: 2699109 - RNA, 22 nt, Human
acagcaguugaaaagacuccaa

SEQ ID NO: 2699110 - RNA, 21 nt, Human
acacgagcaggcuacugucag

SEQ ID NO: 2699111 - RNA, 19 nt, Human
acacgagcaggcuacuguc

SEQ ID NO: 2699112 - RNA, 14 nt, Human
acacgagcaggcua

SEQ ID NO: 2699113 - RNA, 13 nt, Human
aauuuugugaagc

SEQ ID NO: 2699114 - RNA, 14 nt, Human
aaaggcagaagcaa

SEQ ID NO: 2699115 - RNA, 15 nt, Human
aaauauuuauuuuaa

SEQ ID NO: 2699116 - RNA, 13 nt, Human
aaauauuuauuuu

SEQ ID NO: 2699117 - RNA, 20 nt, Human
aaauauuuauuuuaauaaug

SEQ ID NO: 2699118 - RNA, 14 nt, Human
aaaucaaauaugca

SEQ ID NO: 2699119 - RNA, 12 nt, Human
aaaucaaauaug

SEQ ID NO: 2699120 - RNA, 15 nt, Human
aaaucaaauaugcaa

SEQ ID NO: 2699121 - RNA, 15 nt, Human
aaagaaauguaaggg

SEQ ID NO: 2699122 - RNA, 23 nt, Human
aaacugagaugugaacacaucag

SEQ ID NO: 2699123 - RNA, 21 nt, Human
aaacugagaugugaacacauc

SEQ ID NO: 2699124 - RNA, 16 nt, Human
aaaaucucaauauuuc

SEQ ID NO: 2699125 - RNA, 21 nt, Human
aaaaucuacacuccagugaga

SEQ ID NO: 2699126 - RNA, 18 nt, Human
aaaaguucugcagauaaa

SEQ ID NO: 2699127 - RNA, 16 nt, Human
aaaaagaaacauuugg

SEQ ID NO: 2699128 - RNA, 21 nt, Human
aacuuuaugcuaagugaaaua

SEQ ID NO: 2699129 - RNA, 20 nt, Human
aacuuuaugcuaagugaaau

SEQ ID NO: 2699130 - RNA, 20 nt, Human
aacugagaugugaacacauc

SEQ ID NO: 2699131 - RNA, 19 nt, Human
aacugacucuuaagaagac

SEQ ID NO: 2699132 - RNA, 20 nt, Human
aacugacucuuaagaagacu

SEQ ID NO: 2699133 - RNA, 15 nt, Human
aacugacucuuaaga

SEQ ID NO: 2699134 - RNA, 18 nt, Human
aacugacucuuaagaaga

SEQ ID NO: 2699135 - RNA, 17 nt, Human
aaccuagggugauauua

SEQ ID NO: 2699136 - RNA, 22 nt, Human
aaccacuggaaaguuuaugguu

SEQ ID NO: 2699137 - RNA, 16 nt, Human
aacacaucagcuugcc

SEQ ID NO: 2699138 - RNA, 18 nt, Human
aacaaauuuacagagaca

SEQ ID NO: 2699139 - RNA, 22 nt, Human
aaauguuguucucuucuuuaaa

SEQ ID NO: 2699140 - RNA, 17 nt, Human
aaaucuuauaauuuaaa

SEQ ID NO: 2699141 - RNA, 19 nt, Human
aaauugacacuuaaaaaug

SEQ ID NO: 2699142 - RNA, 17 nt, Human
aagggaaacugccagca

SEQ ID NO: 2699143 - RNA, 16 nt, Human
aagggaaacugccagc

SEQ ID NO: 2699144 - RNA, 23 nt, Human
aagggaaacugccagcaacgcag

SEQ ID NO: 2699145 - RNA, 21 nt, Human
aaguagggacuucugucuuca

SEQ ID NO: 2699146 - RNA, 17 nt, Human
aaguccaagcauaccaa

SEQ ID NO: 2699147 - RNA, 18 nt, Human
aaguccaagcauuuagau

SEQ ID NO: 2699148 - RNA, 20 nt, Human
aaggcagcucuaaaugucaa

SEQ ID NO: 2699149 - RNA, 15 nt, Human
aaugauuaugaauua

SEQ ID NO: 2699150 - RNA, 21 nt, Human
aaugauuaugaauuacauuug

SEQ ID NO: 2699151 - RNA, 23 nt, Human
aauguuucaaacauauauaacaa

SEQ ID NO: 2699152 - RNA, 16 nt, Human
agcaguugaaaagacu

SEQ ID NO: 2699153 - RNA, 13 nt, Human
agcaguugaaaag

SEQ ID NO: 2699154 - RNA, 23 nt, Human
agcaguucagagcugcccucucc

SEQ ID NO: 2699155 - RNA, 20 nt, Human
agcaguucagagcugcccuc

SEQ ID NO: 2699156 - RNA, 15 nt, Human
agcaugaagacagag

SEQ ID NO: 2699157 - RNA, 16 nt, Human
agcacugacuucuaag

SEQ ID NO: 2699158 - RNA, 21 nt, Human
agacgugcacgcacacugucu

SEQ ID NO: 2699159 - RNA, 22 nt, Human
agacgugcacgcacacugucug

SEQ ID NO: 2699160 - RNA, 21 nt, Human
agacugcauuauauuuauuac

SEQ ID NO: 2699161 - RNA, 17 nt, Human
agagaacuuccagaucc

SEQ ID NO: 2699162 - RNA, 23 nt, Human
aggaugguucccuugaugaagaa

SEQ ID NO: 2699163 - RNA, 22 nt, Human
agcuccccucggagaagagcug

SEQ ID NO: 2699164 - RNA, 18 nt, Human
aggugcuacaaaaacaca

SEQ ID NO: 2699165 - RNA, 22 nt, Human
aggugcuacaaaaacacagcaa

SEQ ID NO: 2699166 - RNA, 21 nt, Human
aggugcuacaaaaacacagca

SEQ ID NO: 2699167 - RNA, 20 nt, Human
aggugcuacaaaaacacagc

SEQ ID NO: 2699168 - RNA, 19 nt, Human
aggugcuacaaaaacacag

SEQ ID NO: 2699169 - RNA, 20 nt, Human
agguaaaagcaucacaugaa

SEQ ID NO: 2699170 - RNA, 24 nt, Human
aggugcuacaaaaacacagcaagg

SEQ ID NO: 2699171 - RNA, 23 nt, Human
aggugcuacaaaaacacagcaag

SEQ ID NO: 2699172 - RNA, 17 nt, Human
aggcuacugucagcucc

SEQ ID NO: 2699173 - RNA, 21 nt, Human
aggcuagaaccaccugccuau

SEQ ID NO: 2699174 - RNA, 17 nt, Human
aggcuagauguauguac

SEQ ID NO: 2699175 - RNA, 15 nt, Human
aggcuagauguaugu

SEQ ID NO: 2699176 - RNA, 16 nt, Human
aggcuagauguaugua

SEQ ID NO: 2699177 - RNA, 14 nt, Human
auagucaaauugug

SEQ ID NO: 2699178 - RNA, 15 nt, Human
auagguuuaauaauu

SEQ ID NO: 2699179 - RNA, 14 nt, Human
auaggugcuacaaa

SEQ ID NO: 2699180 - RNA, 23 nt, Human
auaggugcuacaaaaacacagca

SEQ ID NO: 2699181 - RNA, 21 nt, Human
auaggugcuacaaaaacacag

SEQ ID NO: 2699182 - RNA, 15 nt, Human
auaggugcuacaaaa

SEQ ID NO: 2699183 - RNA, 18 nt, Human
auagcagcuuauucacaa

SEQ ID NO: 2699184 - RNA, 20 nt, Human
auaugcuucuguuuuauaau

SEQ ID NO: 2699185 - RNA, 22 nt, Human
auaugcuucuguuuuauaauuu

SEQ ID NO: 2699186 - RNA, 16 nt, Human
auauuauguuaaaacu

SEQ ID NO: 2699187 - RNA, 22 nt, Human
auauuuauuacuguaagaaaau

SEQ ID NO: 2699188 - RNA, 13 nt, Human
auauuuauuuuaa

SEQ ID NO: 2699189 - RNA, 18 nt, Human
auaaaggauuaaugucaa

SEQ ID NO: 2699190 - RNA, 20 nt, Human
auacacacucaaaucaagaa

SEQ ID NO: 2699191 - RNA, 18 nt, Human
auacacacucaaaucaag

SEQ ID NO: 2699192 - RNA, 17 nt, Human
auacacacucaaaucaa

SEQ ID NO: 2699193 - RNA, 23 nt, Human
auaauguuucaaacauauauaac

SEQ ID NO: 2699194 - RNA, 15 nt, Human
auaaugucccuucac

SEQ ID NO: 2699195 - RNA, 15 nt, Human
agugucuuaauuaaa

SEQ ID NO: 2699196 - RNA, 18 nt, Human
agugucuuaauuaaaaga

SEQ ID NO: 2699197 - RNA, 17 nt, Human
agugucuuaauuaaaag

SEQ ID NO: 2699198 - RNA, 21 nt, Human
agugucuuaauuaaaagaaua

SEQ ID NO: 2699199 - RNA, 23 nt, Human
aguugaaaaucuuauaauuuaaa

SEQ ID NO: 2699200 - RNA, 22 nt, Human
aguugaaaagacuccaaagaaa

SEQ ID NO: 2699201 - RNA, 21 nt, Human
aguugaaaagacuccaaagaa

SEQ ID NO: 2699202 - RNA, 22 nt, Human
aguugaaaaucuuauaauuuaa

SEQ ID NO: 2699203 - RNA, 23 nt, Human
agucaaauugugugaaagguacu

SEQ ID NO: 2699204 - RNA, 19 nt, Human
agucaaauugugugaaagg

SEQ ID NO: 2699205 - RNA, 12 nt, Human
aguccuguaaug

SEQ ID NO: 2699206 - RNA, 19 nt, Human
auguaagggaaacugccag

SEQ ID NO: 2699207 - RNA, 16 nt, Human
auguaagggaaacugc

SEQ ID NO: 2699208 - RNA, 14 nt, Human
auguaagggaaacu

SEQ ID NO: 2699209 - RNA, 17 nt, Human
auguucuaagaagugaa

SEQ ID NO: 2699210 - RNA, 18 nt, Human
augugggcagugauguca

SEQ ID NO: 2699211 - RNA, 23 nt, Human
aucagcugcugaaacaacaaaua

SEQ ID NO: 2699212 - RNA, 22 nt, Human
aucagcugcugaaacaacaaau

SEQ ID NO: 2699213 - RNA, 17 nt, Human
auauuuauuuuaauaau

SEQ ID NO: 2699214 - RNA, 14 nt, Human
auauuuauuuuaau

SEQ ID NO: 2699215 - RNA, 15 nt, Human
auauuuauuuuaaua

SEQ ID NO: 2699216 - RNA, 21 nt, Human
aucagcugcugaaacaacaaa

SEQ ID NO: 2699217 - RNA, 15 nt, Human
gccucuuagaugcag

SEQ ID NO: 2699218 - RNA, 12 nt, Human
gccuccauccug

SEQ ID NO: 2699219 - RNA, 20 nt, Human
gccuucggccuccauccuga

SEQ ID NO: 2699220 - RNA, 21 nt, Human
gccuucggccuccauccugag

SEQ ID NO: 2699221 - RNA, 18 nt, Human
gcuagaacucccuuucaa

SEQ ID NO: 2699222 - RNA, 16 nt, Human
gcuagaacucccuuuc

SEQ ID NO: 2699223 - RNA, 15 nt, Human
gcuagaacucccuuu

SEQ ID NO: 2699224 - RNA, 14 nt, Human
gcuagaacucccuu

SEQ ID NO: 2699225 - RNA, 13 nt, Human
gcuagaacucccu

SEQ ID NO: 2699226 - RNA, 12 nt, Human
gcuagaacuccc

SEQ ID NO: 2699227 - RNA, 21 nt, Human
gcuccccucggagaagagcug

SEQ ID NO: 2699228 - RNA, 19 nt, Human
gcuccacuuggucugugag

SEQ ID NO: 2699229 - RNA, 18 nt, Human
gcuccacuuggucuguga

SEQ ID NO: 2699230 - RNA, 15 nt, Human
gcuccacuuggucug

SEQ ID NO: 2699231 - RNA, 19 nt, Human
gcuccaccuugcagcucuc

SEQ ID NO: 2699232 - RNA, 22 nt, Human
ggacucauuuuaaaaaauggaa

SEQ ID NO: 2699233 - RNA, 13 nt, Human
ggagaaacuggaa

SEQ ID NO: 2699234 - RNA, 15 nt, Human
ggccuccauccugag

SEQ ID NO: 2699235 - RNA, 14 nt, Human
ggccuccauccuga

SEQ ID NO: 2699236 - RNA, 21 nt, Human
ggcacaguuuucugagaaaga

SEQ ID NO: 2699237 - RNA, 14 nt, Human
ggcuccacuugguc

SEQ ID NO: 2699238 - RNA, 20 nt, Human
gggacagucaccucauggaa

SEQ ID NO: 2699239 - RNA, 21 nt, Human
gggacagucaccucauggaau

SEQ ID NO: 2699240 - RNA, 22 nt, Human
gggacagucaccucauggaauu

SEQ ID NO: 2699241 - RNA, 20 nt, Human
gggaacccaaguccaagcau

SEQ ID NO: 2699242 - RNA, 14 nt, Human
aaaaauaacaauga

SEQ ID NO: 2699243 - RNA, 15 nt, Human
aaaacuucagacaua

SEQ ID NO: 2699244 - RNA, 17 nt, Human
aaaaaugguuuaaaugg

SEQ ID NO: 2699245 - RNA, 23 nt, Human
guagacgugcacgcacacugucu

SEQ ID NO: 2699246 - RNA, 20 nt, Human
guagacgugcacgcacacug

SEQ ID NO: 2699247 - RNA, 15 nt, Human
guacuucaugcuguc

SEQ ID NO: 2699248 - RNA, 21 nt, Human
guacuucaaauccuugaagau

SEQ ID NO: 2699249 - RNA, 22 nt, Human
guacuucaaauccuugaagauu

SEQ ID NO: 2699250 - RNA, 23 nt, Human
aaaucauuucugcaucagcugcu

SEQ ID NO: 2699251 - RNA, 22 nt, Human
aaaucauuucugcaucagcugc

SEQ ID NO: 2699252 - RNA, 21 nt, Human
aaaucauuucugcaucagcug

SEQ ID NO: 2699253 - RNA, 19 nt, Human
aaaucauuucugcaucagc

SEQ ID NO: 2699254 - RNA, 11 nt, Human
aaaucauuucu

SEQ ID NO: 2699255 - RNA, 12 nt, Human
aaaucauuucug

SEQ ID NO: 2699256 - RNA, 17 nt, Human
aaauauuauguuaaaac

SEQ ID NO: 2699257 - RNA, 15 nt, Human
aaauccauacauuug

SEQ ID NO: 2699258 - RNA, 18 nt, Human
aaauccauacauuugugu

SEQ ID NO: 2699259 - RNA, 20 nt, Human
guaauaggcguaacuaauuu

SEQ ID NO: 2699260 - RNA, 23 nt, Human
guacacugccuucucaacuccaa

SEQ ID NO: 2699261 - RNA, 21 nt, Human
aaauaauuuuuauauuugaaa

SEQ ID NO: 2699262 - RNA, 15 nt, Human
aaauacacacucaaa

SEQ ID NO: 2699263 - RNA, 22 nt, Human
aaauaauuuuuauauuugaaau

SEQ ID NO: 2699264 - RNA, 23 nt, Human
aaauaauuuuuauauuugaaaua

SEQ ID NO: 2699265 - RNA, 19 nt, Human
aaauacacacucaaaucaa

SEQ ID NO: 2699266 - RNA, 18 nt, Human
aaaguauguuagugcaaa

SEQ ID NO: 2699267 - RNA, 20 nt, Human
aaagguauuuuaaucaccaa

SEQ ID NO: 2699268 - RNA, 23 nt, Human
aaaguucugcagauaaacaguag

SEQ ID NO: 2699269 - RNA, 15 nt, Human
aaagaggaaugaagu

SEQ ID NO: 2699270 - RNA, 15 nt, Human
aaagaggcagcuuga

SEQ ID NO: 2699271 - RNA, 14 nt, Human
aaagacuccaaaga

SEQ ID NO: 2699272 - RNA, 21 nt, Human
aaagacuccaaagaaauguaa

SEQ ID NO: 2699273 - RNA, 15 nt, Human
aaagacuccaaagaa

SEQ ID NO: 2699274 - RNA, 21 nt, Human
aaagacuauucaaacagucuc

SEQ ID NO: 2699275 - RNA, 17 nt, Human
aaagacuauucaaacag

SEQ ID NO: 2699276 - RNA, 19 nt, Human
aaagacuauucaaacaguc

SEQ ID NO: 2699277 - RNA, 18 nt, Human
aaagacuauucaaacagu

SEQ ID NO: 2699278 - RNA, 13 nt, Human
aaagacagugaaa

SEQ ID NO: 2699279 - RNA, 23 nt, Human
aaacuucagcgguuuauauaagc

SEQ ID NO: 2699280 - RNA, 19 nt, Human
aaacuucagacauagaauu

SEQ ID NO: 2699281 - RNA, 20 nt, Human
aaagggauggcaagaugugg

SEQ ID NO: 2699282 - RNA, 14 nt, Human
aaagguacuucaaa

SEQ ID NO: 2699283 - RNA, 21 nt, Human
aaagcacugacuucuaaguaa

SEQ ID NO: 2699284 - RNA, 17 nt, Human
aaagcacugacuucuaa

SEQ ID NO: 2699285 - RNA, 15 nt, Human
aaacucguuaauuug

SEQ ID NO: 2699286 - RNA, 12 nt, Human
aaaccacagcag

SEQ ID NO: 2699287 - RNA, 14 nt, Human
aaacaguagugaua

SEQ ID NO: 2699288 - RNA, 15 nt, Human
aaacagucucaggaa

SEQ ID NO: 2699289 - RNA, 19 nt, Human
ggggaauugaggacacuga

SEQ ID NO: 2699290 - RNA, 14 nt, Human
aaacacagcaaggg

SEQ ID NO: 2699291 - RNA, 12 nt, Human
aaacacagcaag

SEQ ID NO: 2699292 - RNA, 11 nt, Human
aaacacagcaa

SEQ ID NO: 2699293 - RNA, 16 nt, Human
gacuauucaaacaguc

SEQ ID NO: 2699294 - RNA, 15 nt, Human
gacuauucaaacagu

SEQ ID NO: 2699295 - RNA, 20 nt, Human
gacaguauggcagcuuuccu

SEQ ID NO: 2699296 - RNA, 21 nt, Human
gacagcccuucuuuccacaga

SEQ ID NO: 2699297 - RNA, 20 nt, Human
gacagaaagcagaacaguga

SEQ ID NO: 2699298 - RNA, 14 nt, Human
gacagaaagcagaa

SEQ ID NO: 2699299 - RNA, 15 nt, Human
gagcgacagugagac

SEQ ID NO: 2699300 - RNA, 13 nt, Human
gagcgacagugag

SEQ ID NO: 2699301 - RNA, 22 nt, Human
gcaguugaaaagacuccaaaga

SEQ ID NO: 2699302 - RNA, 15 nt, Human
gcagcuuauucacaa

SEQ ID NO: 2699303 - RNA, 16 nt, Human
gcauuguaaaugugcu

SEQ ID NO: 2699304 - RNA, 18 nt, Human
gcaauagucaaauugugu

SEQ ID NO: 2699305 - RNA, 16 nt, Human
gcaauaaaauggguuu

SEQ ID NO: 2699306 - RNA, 21 nt, Human
gaugcugucuucguacuggga

SEQ ID NO: 2699307 - RNA, 12 nt, Human
gaaagggauuuu

SEQ ID NO: 2699308 - RNA, 20 nt, Human
gaaagggauuuucagcccuc

SEQ ID NO: 2699309 - RNA, 18 nt, Human
gaaagaaaaucaggcugg

SEQ ID NO: 2699310 - RNA, 14 nt, Human
gaaaagacuccaaa

SEQ ID NO: 2699311 - RNA, 17 nt, Human
gaaaagacuccaaagaa

SEQ ID NO: 2699312 - RNA, 16 nt, Human
gaaaagacuccaaaga

SEQ ID NO: 2699313 - RNA, 21 nt, Human
gaaaacuuuaugcuaagugaa

SEQ ID NO: 2699314 - RNA, 17 nt, Human
gaacccgggaggcagag

SEQ ID NO: 2699315 - RNA, 17 nt, Human
gaacccaaguccaagca

SEQ ID NO: 2699316 - RNA, 16 nt, Human
gaacccaaguccaagc

SEQ ID NO: 2699317 - RNA, 19 nt, Human
cuuggucugugagaugcua

SEQ ID NO: 2699318 - RNA, 16 nt, Human
cuuggucugugagaug

SEQ ID NO: 2699319 - RNA, 17 nt, Human
cuucuaaguaaaaccac

SEQ ID NO: 2699320 - RNA, 13 nt, Human
cuucuaaguaaaa

SEQ ID NO: 2699321 - RNA, 21 nt, Human
cuucuaaguaaaaccacagca

SEQ ID NO: 2699322 - RNA, 20 nt, Human
cuucucacauuuauauuuuu

SEQ ID NO: 2699323 - RNA, 13 nt, Human
cuucucacauuua

SEQ ID NO: 2699324 - RNA, 18 nt, Human
cuggauaguccgucucug

SEQ ID NO: 2699325 - RNA, 19 nt, Human
cuggauaguccgucucugc

SEQ ID NO: 2699326 - RNA, 21 nt, Human
cuuaaaaaugguuuaaauggu

SEQ ID NO: 2699327 - RNA, 13 nt, Human
cuguuauaaucuu

SEQ ID NO: 2699328 - RNA, 19 nt, Human
cuguuauaaucuuucacag

SEQ ID NO: 2699329 - RNA, 17 nt, Human
cugucggagcccugucu

SEQ ID NO: 2699330 - RNA, 23 nt, Human
cugucggagcccugucuccucuc

SEQ ID NO: 2699331 - RNA, 17 nt, Human
cugaaagaggaaugaag

SEQ ID NO: 2699332 - RNA, 13 nt, Human
cugaaagaggaau

SEQ ID NO: 2699333 - RNA, 21 nt, Human
cugacacaugcugaacaucac

SEQ ID NO: 2699334 - RNA, 17 nt, Human
cucucuggccuucggcc

SEQ ID NO: 2699335 - RNA, 22 nt, Human
cucucuggccuucggccuccau

SEQ ID NO: 2699336 - RNA, 19 nt, Human
cucucuggccuucggccuc

SEQ ID NO: 2699337 - RNA, 24 nt, Human
cggagaagagcuguucacagccag

SEQ ID NO: 2699338 - RNA, 23 nt, Human
cggagaagagcuguucacagcca

SEQ ID NO: 2699339 - RNA, 15 nt, Human
cgguuuauauaagcu

SEQ ID NO: 2699340 - RNA, 14 nt, Human
cuaacuggacuggu

SEQ ID NO: 2699341 - RNA, 19 nt, Human
cucagaaaacaaggaugaa

SEQ ID NO: 2699342 - RNA, 23 nt, Human
cucagaaaacaaggaugaauuaa

SEQ ID NO: 2699343 - RNA, 13 nt, Human
cucaaaacugcac

SEQ ID NO: 2699344 - RNA, 14 nt, Human
ccucggagaagagc

SEQ ID NO: 2699345 - RNA, 12 nt, Human
ccucggagaaga

SEQ ID NO: 2699346 - RNA, 16 nt, Human
ccucccuucucuucac

SEQ ID NO: 2699347 - RNA, 17 nt, Human
ccugucucuacuaaaaa

SEQ ID NO: 2699348 - RNA, 13 nt, Human
cccaacuccagaa

SEQ ID NO: 2699349 - RNA, 13 nt, Human
ccaucccucccuc

SEQ ID NO: 2699350 - RNA, 14 nt, Human
ccaucccucccucc

SEQ ID NO: 2699351 - RNA, 15 nt, Human
ccaucccucccucca

SEQ ID NO: 2699352 - RNA, 13 nt, Human
cccuccucugcuu

SEQ ID NO: 2699353 - RNA, 22 nt, Human
cccuccucugcuugccaucccu

SEQ ID NO: 2699354 - RNA, 13 nt, Human
ccccugcacucca

SEQ ID NO: 2699355 - RNA, 24 nt, Human
cccagccagcaguucagagcugcc

SEQ ID NO: 2699356 - RNA, 23 nt, Human
caggaaaucaaauaugcaaagca

SEQ ID NO: 2699357 - RNA, 22 nt, Human
caggaaaucaaauaugcaaagc

SEQ ID NO: 2699358 - RNA, 16 nt, Human
cagcuccccucggaga

SEQ ID NO: 2699359 - RNA, 18 nt, Human
cagcuccccucggagaag

SEQ ID NO: 2699360 - RNA, 17 nt, Human
cagcuccccucggagaa

SEQ ID NO: 2699361 - RNA, 20 nt, Human
cagcuccccucggagaagag

SEQ ID NO: 2699362 - RNA, 23 nt, Human
cagcugccuccccuccucugcuu

SEQ ID NO: 2699363 - RNA, 24 nt, Human
cagcugccuccccuccucugcuug

SEQ ID NO: 2699364 - RNA, 21 nt, Human
cagcugccuccccuccucugc

SEQ ID NO: 2699365 - RNA, 22 nt, Human
cagcugccuccccuccucugcu

SEQ ID NO: 2699366 - RNA, 15 nt, Human
cagcccuucuuucca

SEQ ID NO: 2699367 - RNA, 19 nt, Human
cagcccuucuuuccacaga

SEQ ID NO: 2699368 - RNA, 20 nt, Human
cagcccuucuuuccacagaa

SEQ ID NO: 2699369 - RNA, 18 nt, Human
cagccugagcgacaguga

SEQ ID NO: 2699370 - RNA, 22 nt, Human
cagccugagcgacagugagacu

SEQ ID NO: 2699371 - RNA, 19 nt, Human
cagccugagcgacagugag

SEQ ID NO: 2699372 - RNA, 22 nt, Human
cagcaguugaaaagacuccaaa

SEQ ID NO: 2699373 - RNA, 17 nt, Human
cagcaguugaaaagacu

SEQ ID NO: 2699374 - RNA, 21 nt, Human
cagcaguugaaaagacuccaa

SEQ ID NO: 2699375 - RNA, 20 nt, Human
cagcaguugaaaagacucca

SEQ ID NO: 2699376 - RNA, 22 nt, Human
cagccagcaguucagagcugcc

SEQ ID NO: 2699377 - RNA, 15 nt, Human
cagccagcaguucag

SEQ ID NO: 2699378 - RNA, 21 nt, Human
cagccagcaguucagagcugc

SEQ ID NO: 2699379 - RNA, 14 nt, Human
cagccagcaguuca

SEQ ID NO: 2699380 - RNA, 22 nt, Human
cagcacagccucuuagaugcag

SEQ ID NO: 2699381 - RNA, 17 nt, Human
cagagcugcccucuccu

SEQ ID NO: 2699382 - RNA, 13 nt, Human
cagagcugcccuc

SEQ ID NO: 2699383 - RNA, 15 nt, Human
cagagcugcccucuc

SEQ ID NO: 2699384 - RNA, 15 nt, Human
cagucaccucaugga

SEQ ID NO: 2699385 - RNA, 15 nt, Human
cagucucaggaaauc

SEQ ID NO: 2699386 - RNA, 18 nt, Human
cagggaggacgcucucug

SEQ ID NO: 2699387 - RNA, 17 nt, Human
cagggaggacgcucucu

SEQ ID NO: 2699388 - RNA, 12 nt, Human
cauuaucucaaa

SEQ ID NO: 2699389 - RNA, 13 nt, Human
cauuaucucaaaa

SEQ ID NO: 2699390 - RNA, 16 nt, Human
ccacagaagcuccagg

SEQ ID NO: 2699391 - RNA, 18 nt, Human
ccaccagucugacuguuu

SEQ ID NO: 2699392 - RNA, 18 nt, Human
ccacagaagcuccaggua

SEQ ID NO: 2699393 - RNA, 16 nt, Human
auuuaauaaaugugcc

SEQ ID NO: 2699394 - RNA, 14 nt, Human
auuucuaugaaaua

SEQ ID NO: 2699395 - RNA, 20 nt, Human
auuucauaccuaucaucuua

SEQ ID NO: 2699396 - RNA, 15 nt, Human
auuguuuaaaaucau

SEQ ID NO: 2699397 - RNA, 19 nt, Human
auuaugaauuacauuugua

SEQ ID NO: 2699398 - RNA, 20 nt, Human
auuaugaauuacauuuguau

SEQ ID NO: 2699399 - RNA, 22 nt, Human
auuaugaauuacauuuguauaa

SEQ ID NO: 2699400 - RNA, 21 nt, Human
caaaucuuaacuugaaggagu

SEQ ID NO: 2699401 - RNA, 19 nt, Human
caagacccaaaaggcagaa

SEQ ID NO: 2699402 - RNA, 21 nt, Human
auuuuauaucaauuuaaaaaa

SEQ ID NO: 2699403 - RNA, 15 nt, Human
auuuuuauauuugaa

SEQ ID NO: 2699404 - RNA, 21 nt, Human
caaaaggauaaugaauacuuu

SEQ ID NO: 2699405 - RNA, 15 nt, Human
caaacagucucagga

SEQ ID NO: 2699406 - RNA, 17 nt, Human
caaacagucucaggaaa

SEQ ID NO: 2699407 - RNA, 16 nt, Human
caaacagucucaggaa

SEQ ID NO: 2699408 - RNA, 15 nt, Human
caauaaaauggguuu

SEQ ID NO: 2699409 - RNA, 20 nt, Human
caauaaaauccauacauuug

SEQ ID NO: 2699410 - RNA, 23 nt, Human
caauaaaauccauacauuugugu

SEQ ID NO: 2699411 - RNA, 15 nt, Human
cacuuaaaaaugguu

SEQ ID NO: 2699412 - RNA, 17 nt, Human
cacuuguguuuugcaag

SEQ ID NO: 2699413 - RNA, 18 nt, Human
cagaacagugauuaccag

SEQ ID NO: 2699414 - RNA, 11 nt, Human
cagaacaguga

SEQ ID NO: 2699415 - RNA, 17 nt, Human
cagaacagugauuacca

SEQ ID NO: 2699416 - RNA, 12 nt, Human
cagaacagugau

SEQ ID NO: 2699417 - RNA, 13 nt, Human
cacuccagccuga

SEQ ID NO: 2699418 - RNA, 12 nt, Human
cacuccagccug

SEQ ID NO: 2699419 - RNA, 23 nt, Human
cacuccagccugagcgacaguga

SEQ ID NO: 2699420 - RNA, 14 nt, Human
aauacacacucaaa

SEQ ID NO: 2699421 - RNA, 15 nt, Human
uaacaaugcuguauu

SEQ ID NO: 2699422 - RNA, 17 nt, Human
uaacaaugcuguauuuu

SEQ ID NO: 2699423 - RNA, 13 nt, Human
uaacaaugcugua

SEQ ID NO: 2699424 - RNA, 17 nt, Human
uaaaugauuucauucaa

SEQ ID NO: 2699425 - RNA, 15 nt, Human
uaaauguugacaugg

SEQ ID NO: 2699426 - RNA, 12 nt, Human
aauaaaaauaau

SEQ ID NO: 2699427 - RNA, 22 nt, Human
aauaaaauccauacauuugugu

SEQ ID NO: 2699428 - RNA, 15 nt, Human
aauaacgauaaaaga

SEQ ID NO: 2699429 - RNA, 15 nt, Human
aauaacaauaaaaga

SEQ ID NO: 2699430 - RNA, 21 nt, Human
aauaaaugugccuucauuuuu

SEQ ID NO: 2699431 - RNA, 12 nt, Human
aauaaaugugcc

SEQ ID NO: 2699432 - RNA, 19 nt, Human
uaaaccaaggcuagaacca

SEQ ID NO: 2699433 - RNA, 12 nt, Human
uaaacucauuuc

SEQ ID NO: 2699434 - RNA, 17 nt, Human
uaaacucauuucuagca

SEQ ID NO: 2699435 - RNA, 19 nt, Human
aaggaaaaaauaacaauga

SEQ ID NO: 2699436 - RNA, 16 nt, Human
aaggaaaaaauaacaa

SEQ ID NO: 2699437 - RNA, 13 nt, Human
aaggauaaugaau

SEQ ID NO: 2699438 - RNA, 23 nt, Human
guuuuuuuuuaaaaaagaaacau

SEQ ID NO: 2699439 - RNA, 23 nt, Human
aaguauguuagugcaaauuguca

SEQ ID NO: 2699440 - RNA, 21 nt, Human
aaguauguuagugcaaauugu

SEQ ID NO: 2699441 - RNA, 22 nt, Human
guuuucugagaaagacuauuca

SEQ ID NO: 2699442 - RNA, 17 nt, Human
guuuucugagaaagacu

SEQ ID NO: 2699443 - RNA, 16 nt, Human
guuuucugagaaagac

SEQ ID NO: 2699444 - RNA, 21 nt, Human
aagggugaugggaaagcauug

SEQ ID NO: 2699445 - RNA, 16 nt, Human
aaguaaaaccacagca

SEQ ID NO: 2699446 - RNA, 15 nt, Human
aaguaaaaccacagc

SEQ ID NO: 2699447 - RNA, 14 nt, Human
aaguaaaaccacag

SEQ ID NO: 2699448 - RNA, 18 nt, Human
aaguaaaaccacagcagu

SEQ ID NO: 2699449 - RNA, 17 nt, Human
aaguaaaaccacagcag

SEQ ID NO: 2699450 - RNA, 21 nt, Human
guuucuagcaugaagacagag

SEQ ID NO: 2699451 - RNA, 15 nt, Human
guuuuauaauuuugu

SEQ ID NO: 2699452 - RNA, 22 nt, Human
guuuuauaauuuugugaagcaa

SEQ ID NO: 2699453 - RNA, 15 nt, Human
guuuucugagaaaga

SEQ ID NO: 2699454 - RNA, 13 nt, Human
aagaauauuuuaa

SEQ ID NO: 2699455 - RNA, 13 nt, Human
aagacccaaaagg

SEQ ID NO: 2699456 - RNA, 13 nt, Human
aagaaaauaucac

SEQ ID NO: 2699457 - RNA, 22 nt, Human
aagaagcaccaaucaugaauua

SEQ ID NO: 2699458 - RNA, 19 nt, Human
aagcaaaauuuuuucucua

SEQ ID NO: 2699459 - RNA, 22 nt, Human
aagauguagaggagaaacugga

SEQ ID NO: 2699460 - RNA, 13 nt, Human
aagcaaaauguga

SEQ ID NO: 2699461 - RNA, 19 nt, Human
aagauguagaggagaaacu

SEQ ID NO: 2699462 - RNA, 16 nt, Human
aagcaaguauuagaau

SEQ ID NO: 2699463 - RNA, 13 nt, Human
aagacuauucaaa

SEQ ID NO: 2699464 - RNA, 14 nt, Human
aagacuauucaaac

SEQ ID NO: 2699465 - RNA, 14 nt, Human
aagacuccaaagaa

SEQ ID NO: 2699466 - RNA, 17 nt, Human
aagacuccaaagaaaug

SEQ ID NO: 2699467 - RNA, 16 nt, Human
aagacuccaaagaaau

SEQ ID NO: 2699468 - RNA, 18 nt, Human
aagagcuguucacagcca

SEQ ID NO: 2699469 - RNA, 14 nt, Human
guggguagacacac

SEQ ID NO: 2699470 - RNA, 19 nt, Human
aacagucucaggaaaucaa

SEQ ID NO: 2699471 - RNA, 17 nt, Human
aacagucucaggaaauc

SEQ ID NO: 2699472 - RNA, 19 nt, Human
aacagauuauuaccuuaca

SEQ ID NO: 2699473 - RNA, 16 nt, Human
aacauauauaacaaug

SEQ ID NO: 2699474 - RNA, 23 nt, Human
gucucaguccaugaagauguaga

SEQ ID NO: 2699475 - RNA, 13 nt, Human
gucuucacaacag

SEQ ID NO: 2699476 - RNA, 13 nt, Human
aacugaaaucaua

SEQ ID NO: 2699477 - RNA, 20 nt, Human
aacugaaaucauacuucuua

SEQ ID NO: 2699478 - RNA, 13 nt, Human
aacuauauuguuu

SEQ ID NO: 2699479 - RNA, 20 nt, Human
aacuaucucauuuccaagca

SEQ ID NO: 2699480 - RNA, 15 nt, Human
aaugaaugaaugaau

SEQ ID NO: 2699481 - RNA, 13 nt, Human
uaaucuuucacag

SEQ ID NO: 2699482 - RNA, 19 nt, Human
uaacaaugcuguauuuuaa

SEQ ID NO: 2699483 - RNA, 18 nt, Human
uacaaaaacacagcaagg

SEQ ID NO: 2699484 - RNA, 17 nt, Human
uacaaaaacacagcaag

SEQ ID NO: 2699485 - RNA, 16 nt, Human
aaugguuuaaaugguc

SEQ ID NO: 2699486 - RNA, 18 nt, Human
aauguugacaugggacau

SEQ ID NO: 2699487 - RNA, 19 nt, Human
aauugacccacaagaaaug

SEQ ID NO: 2699488 - RNA, 16 nt, Human
aauugacccacaagaa

SEQ ID NO: 2699489 - RNA, 13 nt, Human
aauugacccacaa

SEQ ID NO: 2699490 - RNA, 21 nt, Human
aauucuugccaaauauaaaua

SEQ ID NO: 2699491 - RNA, 13 nt, Human
uacuguaagaaaa

SEQ ID NO: 2699492 - RNA, 23 nt, Human
aauugugugaaagguacuucaaa

SEQ ID NO: 2699493 - RNA, 20 nt, Human
aauuucucccagucauuuaa

SEQ ID NO: 2699494 - RNA, 14 nt, Human
uacuucaaauccuu

SEQ ID NO: 2699495 - RNA, 19 nt, Human
uacuucaaauccuugaaga

SEQ ID NO: 2699496 - RNA, 19 nt, Human
aauuuuuucucuaggaaau

SEQ ID NO: 2699497 - RNA, 16 nt, Human
acaaaaacacagcaag

SEQ ID NO: 2699498 - RNA, 19 nt, Human
aauuuuuauauuugaaaua

SEQ ID NO: 2699499 - RNA, 21 nt, Human
uacuucaaauccuugaagauu

SEQ ID NO: 2699500 - RNA, 15 nt, Human
uagaacucccuuuca

SEQ ID NO: 2699501 - RNA, 22 nt, Human
acaagaaaugaaagcagggacu

SEQ ID NO: 2699502 - RNA, 18 nt, Human
acaagcacuaaacaaaga

SEQ ID NO: 2699503 - RNA, 18 nt, Human
uagcaugucgucaaagcu

SEQ ID NO: 2699504 - RNA, 21 nt, Human
uagcaugucgucaaagcugaa

SEQ ID NO: 2699505 - RNA, 17 nt, Human
uagaugcaguucugaag

SEQ ID NO: 2699506 - RNA, 19 nt, Human
uagaugcaguucugaagaa

SEQ ID NO: 2699507 - RNA, 16 nt, Human
uagaugcaguucugaa

SEQ ID NO: 2699508 - RNA, 14 nt, Human
uauuuauuuuaaua

SEQ ID NO: 2699509 - RNA, 16 nt, Human
uauuuauuuuaauaau

SEQ ID NO: 2699510 - RNA, 18 nt, Human
uauuuauuuuaauaaugu

SEQ ID NO: 2699511 - RNA, 17 nt, Human
uauugucuagugaaacu

SEQ ID NO: 2699512 - RNA, 23 nt, Human
acaguucggugagcuacaaaugc

SEQ ID NO: 2699513 - RNA, 22 nt, Human
acaguucggugagcuacaaaug

SEQ ID NO: 2699514 - RNA, 19 nt, Human
acaguucggugagcuacaa

SEQ ID NO: 2699515 - RNA, 23 nt, Human
uauucauagcagcuuauucacaa

SEQ ID NO: 2699516 - RNA, 15 nt, Human
uauuagaauaccaca

SEQ ID NO: 2699517 - RNA, 12 nt, Human
uauuaaaacuca

SEQ ID NO: 2699518 - RNA, 16 nt, Human
acagucucaggaaauc

SEQ ID NO: 2699519 - RNA, 15 nt, Human
acagucucaggaaau

SEQ ID NO: 2699520 - RNA, 14 nt, Human
acagucucaggaaa

SEQ ID NO: 2699521 - RNA, 13 nt, Human
acagucucaggaa

SEQ ID NO: 2699522 - RNA, 20 nt, Human
acagugaaagaaaauaacaa

SEQ ID NO: 2699523 - RNA, 17 nt, Human
acagucucaggaaauca

SEQ ID NO: 2699524 - RNA, 21 nt, Human
acaguuaccucugccucagaa

SEQ ID NO: 2699525 - RNA, 18 nt, Human
acagugagacucugucuc

SEQ ID NO: 2699526 - RNA, 14 nt, Human
acagugagacucug

SEQ ID NO: 2699527 - RNA, 21 nt, Human
acaguauggcagcuuuccuca

SEQ ID NO: 2699528 - RNA, 15 nt, Human
uauauuuacaaaugg

SEQ ID NO: 2699529 - RNA, 14 nt, Human
uauauuuacaaaug

SEQ ID NO: 2699530 - RNA, 17 nt, Human
uauggcuauaggugcua

SEQ ID NO: 2699531 - RNA, 16 nt, Human
uauggcuauaggugcu

SEQ ID NO: 2699532 - RNA, 13 nt, Human
uauaggaauugac

SEQ ID NO: 2699533 - RNA, 19 nt, Human
uauaggaauugacccacaa

SEQ ID NO: 2699534 - RNA, 14 nt, Human
uauaggaauugacc

SEQ ID NO: 2699535 - RNA, 23 nt, Human
uauaggugcuacaaaaacacagc

SEQ ID NO: 2699536 - RNA, 20 nt, Human
uauaggugcuacaaaaacac

SEQ ID NO: 2699537 - RNA, 21 nt, Human
uauaggugcuacaaaaacaca

SEQ ID NO: 2699538 - RNA, 18 nt, Human
uauaacaaugcuguauuu

SEQ ID NO: 2699539 - RNA, 14 nt, Human
uauaauuuugugaa

SEQ ID NO: 2699540 - RNA, 15 nt, Human
uaguuuuauaugcuu

SEQ ID NO: 2699541 - RNA, 16 nt, Human
uaguuuuauaugcuuc

SEQ ID NO: 2699542 - RNA, 22 nt, Human
uagugagcagucaggaaagaga

SEQ ID NO: 2699543 - RNA, 22 nt, Human
acacaucagcuugcccuguuaa

SEQ ID NO: 2699544 - RNA, 21 nt, Human
uauaaaauaauuuuuauauuu

SEQ ID NO: 2699545 - RNA, 22 nt, Human
uauaaaauaauuuuuauauuug

SEQ ID NO: 2699546 - RNA, 20 nt, Human
acucauuuuaaaaaauggaa

SEQ ID NO: 2699547 - RNA, 20 nt, Human
uccucaaaacuucagacaua

SEQ ID NO: 2699548 - RNA, 12 nt, Human
uccccuccucug

SEQ ID NO: 2699549 - RNA, 13 nt, Human
acuaaaaauacaa

SEQ ID NO: 2699550 - RNA, 13 nt, Human
uccuucagccuga

SEQ ID NO: 2699551 - RNA, 22 nt, Human
acuggcacaguuuucugagaaa

SEQ ID NO: 2699552 - RNA, 21 nt, Human
acuggcacaguuuucugagaa

SEQ ID NO: 2699553 - RNA, 22 nt, Human
acugccuucucaacuccaaacu

SEQ ID NO: 2699554 - RNA, 18 nt, Human
uccugggcagcugccucc

SEQ ID NO: 2699555 - RNA, 19 nt, Human
uccugggcagcugccuccc

SEQ ID NO: 2699556 - RNA, 22 nt, Human
uccugggcagcugccuccccuc

SEQ ID NO: 2699557 - RNA, 23 nt, Human
uccugggcagcugccuccccucc

SEQ ID NO: 2699558 - RNA, 15 nt, Human
uccugggcagcugcc

SEQ ID NO: 2699559 - RNA, 16 nt, Human
uccugggcagcugccu

SEQ ID NO: 2699560 - RNA, 17 nt, Human
uccugggcagcugccuc

SEQ ID NO: 2699561 - RNA, 22 nt, Human
acugaggggaggggagcauggg

SEQ ID NO: 2699562 - RNA, 17 nt, Human
acugaggggaggggagc

SEQ ID NO: 2699563 - RNA, 20 nt, Human
uccagccugagcgacaguga

SEQ ID NO: 2699564 - RNA, 21 nt, Human
uccagccugagcgacagugag

SEQ ID NO: 2699565 - RNA, 22 nt, Human
ucaugaauuaguuuuauaugcu

SEQ ID NO: 2699566 - RNA, 18 nt, Human
ucagaugcacaugagcug

SEQ ID NO: 2699567 - RNA, 15 nt, Human
acccaaaaggcagaa

SEQ ID NO: 2699568 - RNA, 13 nt, Human
acccaaaaggcag

SEQ ID NO: 2699569 - RNA, 18 nt, Human
acccaaaaggcagaagca

SEQ ID NO: 2699570 - RNA, 21 nt, Human
acccaaauguucaucaaugaa

SEQ ID NO: 2699571 - RNA, 12 nt, Human
uauuucauuucu

SEQ ID NO: 2699572 - RNA, 11 nt, Human
accacagcagu

SEQ ID NO: 2699573 - RNA, 13 nt, Human
accacugcagaag

SEQ ID NO: 2699574 - RNA, 19 nt, Human
accacugcagaagacagua

SEQ ID NO: 2699575 - RNA, 14 nt, Human
accacugcagaaga

SEQ ID NO: 2699576 - RNA, 19 nt, Human
accacuuguguuuugcaag

SEQ ID NO: 2699577 - RNA, 23 nt, Human
accacuuguguuuugcaagccag

SEQ ID NO: 2699578 - RNA, 16 nt, Human
agcaccaaucaugaau

SEQ ID NO: 2699579 - RNA, 22 nt, Human
agcacagccucuuagaugcagu

SEQ ID NO: 2699580 - RNA, 14 nt, Human
agcaacgcaggccc

SEQ ID NO: 2699581 - RNA, 14 nt, Human
agcagaacagugau

SEQ ID NO: 2699582 - RNA, 20 nt, Human
ugagcgacagugagacucug

SEQ ID NO: 2699583 - RNA, 16 nt, Human
ugagcgacagugagac

SEQ ID NO: 2699584 - RNA, 14 nt, Human
ugagcgacagugag

SEQ ID NO: 2699585 - RNA, 13 nt, Human
ugagcgacaguga

SEQ ID NO: 2699586 - RNA, 22 nt, Human
ugagguacugagagugaacaaa

SEQ ID NO: 2699587 - RNA, 17 nt, Human
ugagguacugagaguga

SEQ ID NO: 2699588 - RNA, 15 nt, Human
ugaggacacugauau

SEQ ID NO: 2699589 - RNA, 14 nt, Human
ugagcuacaaaugc

SEQ ID NO: 2699590 - RNA, 13 nt, Human
ugagcuacaaaug

SEQ ID NO: 2699591 - RNA, 16 nt, Human
ugagcuacaaaugcau

SEQ ID NO: 2699592 - RNA, 22 nt, Human
agagugaacaaauuuacagaga

SEQ ID NO: 2699593 - RNA, 14 nt, Human
agagugaacaaauu

SEQ ID NO: 2699594 - RNA, 17 nt, Human
ugaagauguagaggaga

SEQ ID NO: 2699595 - RNA, 18 nt, Human
ugaagauguagaggagaa

SEQ ID NO: 2699596 - RNA, 14 nt, Human
ugaagaagauggua

SEQ ID NO: 2699597 - RNA, 20 nt, Human
ugaagaagcaccaaucauga

SEQ ID NO: 2699598 - RNA, 22 nt, Human
agaugcuagaacucccuuucaa

SEQ ID NO: 2699599 - RNA, 23 nt, Human
agaugcuagaacucccuuucaac

SEQ ID NO: 2699600 - RNA, 19 nt, Human
agaugaugaugaucuuuaa

SEQ ID NO: 2699601 - RNA, 15 nt, Human
ugacuguuuccauca

SEQ ID NO: 2699602 - RNA, 16 nt, Human
agauugugccccugca

SEQ ID NO: 2699603 - RNA, 16 nt, Human
agauuuaccacuugug

SEQ ID NO: 2699604 - RNA, 13 nt, Human
ucucuggccuucg

SEQ ID NO: 2699605 - RNA, 17 nt, Human
ucucuggccuucggccu

SEQ ID NO: 2699606 - RNA, 16 nt, Human
ucucuggccuucggcc

SEQ ID NO: 2699607 - RNA, 12 nt, Human
ucucuucuuuaa

SEQ ID NO: 2699608 - RNA, 13 nt, Human
ucucuucuuuaaa

SEQ ID NO: 2699609 - RNA, 14 nt, Human
agaaagaaaaucag

SEQ ID NO: 2699610 - RNA, 15 nt, Human
agaaacuggaacucu

SEQ ID NO: 2699611 - RNA, 13 nt, Human
agaaacuggaacu

SEQ ID NO: 2699612 - RNA, 15 nt, Human
agaaacauuugguaa

SEQ ID NO: 2699613 - RNA, 19 nt, Human
agaaaacaaggaugaauua

SEQ ID NO: 2699614 - RNA, 22 nt, Human
acuuuuuauggcacuaguauuu

SEQ ID NO: 2699615 - RNA, 15 nt, Human
ucuccucucucugua

SEQ ID NO: 2699616 - RNA, 15 nt, Human
ucucccagucauuua

SEQ ID NO: 2699617 - RNA, 12 nt, Human
ucugcuugccau

SEQ ID NO: 2699618 - RNA, 14 nt, Human
ucugcuugccaucc

SEQ ID NO: 2699619 - RNA, 14 nt, Human
agaagcuccaggua

SEQ ID NO: 2699620 - RNA, 11 nt, Human
ucugcuugcca

SEQ ID NO: 2699621 - RNA, 21 nt, Human
agaagaacugaaaucauacuu

SEQ ID NO: 2699622 - RNA, 14 nt, Human
agaacucccuuuca

SEQ ID NO: 2699623 - RNA, 22 nt, Human
ucugagaaagacuauucaaaca

SEQ ID NO: 2699624 - RNA, 21 nt, Human
ucugagaaagacuauucaaac

SEQ ID NO: 2699625 - RNA, 23 nt, Human
ucugagaaagacuauucaaacag

SEQ ID NO: 2699626 - RNA, 20 nt, Human
ucugagaaagacuauucaaa

SEQ ID NO: 2699627 - RNA, 19 nt, Human
ucugagaaagacuauucaa

SEQ ID NO: 2699628 - RNA, 15 nt, Human
ucugagaaagacuau

SEQ ID NO: 2699629 - RNA, 14 nt, Human
ucugagaaagacua

SEQ ID NO: 2699630 - RNA, 21 nt, Human
ucugacuguuuccaucaaggg

SEQ ID NO: 2699631 - RNA, 23 nt, Human
agaaagacuauucaaacagucuc

SEQ ID NO: 2699632 - RNA, 20 nt, Human
agaaagacuauucaaacagu

SEQ ID NO: 2699633 - RNA, 18 nt, Human
agaaagacuauucaaaca

SEQ ID NO: 2699634 - RNA, 19 nt, Human
agaaagacuauucaaacag

SEQ ID NO: 2699635 - RNA, 21 nt, Human
agacuauucaaacagucucag

SEQ ID NO: 2699636 - RNA, 20 nt, Human
agacuauucaaacagucuca

SEQ ID NO: 2699637 - RNA, 18 nt, Human
agacuauucaaacagucu

SEQ ID NO: 2699638 - RNA, 12 nt, Human
agacuccaaaga

SEQ ID NO: 2699639 - RNA, 14 nt, Human
agacuccaaagaaa

SEQ ID NO: 2699640 - RNA, 13 nt, Human
agacuccaaagaa

SEQ ID NO: 2699641 - RNA, 16 nt, Human
agacuauucaaacagu

SEQ ID NO: 2699642 - RNA, 19 nt, Human
agacuccaaagaaauguaa

SEQ ID NO: 2699643 - RNA, 16 nt, Human
agacuccaaagaaaug

SEQ ID NO: 2699644 - RNA, 21 nt, Human
ucuuuaaagggauggcaagau

SEQ ID NO: 2699645 - RNA, 17 nt, Human
ucuuuaaaauacacacu

SEQ ID NO: 2699646 - RNA, 18 nt, Human
agagacacacugaagaag

SEQ ID NO: 2699647 - RNA, 20 nt, Human
agagacacacugaagaagca

SEQ ID NO: 2699648 - RNA, 15 nt, Human
agagaaugagagaca

SEQ ID NO: 2699649 - RNA, 17 nt, Human
agagacacacugaagaa

SEQ ID NO: 2699650 - RNA, 15 nt, Human
agacuggcacaguuu

SEQ ID NO: 2699651 - RNA, 14 nt, Human
agacuggcacaguu

SEQ ID NO: 2699652 - RNA, 18 nt, Human
agacuggcacaguuuucu

SEQ ID NO: 2699653 - RNA, 21 nt, Human
agacuggauaguccgucucug

SEQ ID NO: 2699654 - RNA, 14 nt, Human
ucuuaauuaaaaga

SEQ ID NO: 2699655 - RNA, 21 nt, Human
ucuuaauuaaaagaauauuuu

SEQ ID NO: 2699656 - RNA, 18 nt, Human
ucuuaauuaaaagaauau

SEQ ID NO: 2699657 - RNA, 18 nt, Human
ucuguuuuauaauuuugu

SEQ ID NO: 2699658 - RNA, 19 nt, Human
agcuauggugucauaggcu

SEQ ID NO: 2699659 - RNA, 19 nt, Human
agcuacuaauuuuaaaaug

SEQ ID NO: 2699660 - RNA, 18 nt, Human
agcccuucuuuccacaga

SEQ ID NO: 2699661 - RNA, 19 nt, Human
agcccuucuuuccacagaa

SEQ ID NO: 2699662 - RNA, 17 nt, Human
agcccuucuuuccacag

SEQ ID NO: 2699663 - RNA, 18 nt, Human
agccugagcgacagugag

SEQ ID NO: 2699664 - RNA, 14 nt, Human
ugcagugagccgag

SEQ ID NO: 2699665 - RNA, 13 nt, Human
agcuggaaaagua

SEQ ID NO: 2699666 - RNA, 17 nt, Human
agcugccuccccuccuc

SEQ ID NO: 2699667 - RNA, 18 nt, Human
agcugccuccccuccucu

SEQ ID NO: 2699668 - RNA, 19 nt, Human
agcugccuccccuccucug

SEQ ID NO: 2699669 - RNA, 20 nt, Human
agcugccuccccuccucugc

SEQ ID NO: 2699670 - RNA, 21 nt, Human
agcugccuccccuccucugcu

SEQ ID NO: 2699671 - RNA, 22 nt, Human
agcugccuccccuccucugcuu

SEQ ID NO: 2699672 - RNA, 23 nt, Human
agcugccuccccuccucugcuug

SEQ ID NO: 2699673 - RNA, 16 nt, Human
ugcuaguaauuggaaa

SEQ ID NO: 2699674 - RNA, 14 nt, Human
ugcuaguaauugga

SEQ ID NO: 2699675 - RNA, 13 nt, Human
aggaaagagaacu

SEQ ID NO: 2699676 - RNA, 19 nt, Human
aggaaagagaacuuccaga

SEQ ID NO: 2699677 - RNA, 15 nt, Human
agcuuauuaaaacuc

SEQ ID NO: 2699678 - RNA, 20 nt, Human
agcuuauuaaaacucauuuu

SEQ ID NO: 2699679 - RNA, 21 nt, Human
agcuuauugucuagugaaacu

SEQ ID NO: 2699680 - RNA, 19 nt, Human
aggaauugacccacaagaa

SEQ ID NO: 2699681 - RNA, 19 nt, Human
aggaaaucaaauaugcaaa

SEQ ID NO: 2699682 - RNA, 14 nt, Human
aggaaauauuuauu

SEQ ID NO: 2699683 - RNA, 18 nt, Human
aggaaauauuuauuuuaa

SEQ ID NO: 2699684 - RNA, 20 nt, Human
aggcagcucuaaaugucaau

SEQ ID NO: 2699685 - RNA, 16 nt, Human
uggagaagaacugaaa

SEQ ID NO: 2699686 - RNA, 22 nt, Human
aggcuccacuuggucugugaga

SEQ ID NO: 2699687 - RNA, 21 nt, Human
aggcuccacuuggucugugag

SEQ ID NO: 2699688 - RNA, 17 nt, Human
aggcuccacuuggucug

SEQ ID NO: 2699689 - RNA, 11 nt, Human
aggcuccacuu

SEQ ID NO: 2699690 - RNA, 19 nt, Human
uggcuauaggugcuacaaa

SEQ ID NO: 2699691 - RNA, 15 nt, Human
uggcuauaggugcua

SEQ ID NO: 2699692 - RNA, 18 nt, Human
uggcuaagcaaaauguga

SEQ ID NO: 2699693 - RNA, 23 nt, Human
uggcuauaggugcuacaaaaaca

SEQ ID NO: 2699694 - RNA, 18 nt, Human
ugggaaacaaaaggauaa

SEQ ID NO: 2699695 - RNA, 21 nt, Human
ugggaaagcauuguaaaugug

SEQ ID NO: 2699696 - RNA, 18 nt, Human
ugggaaagcauuguaaau

SEQ ID NO: 2699697 - RNA, 17 nt, Human
ugggaaagcauuguaaa

SEQ ID NO: 2699698 - RNA, 16 nt, Human
ugggaaagcauuguaa

SEQ ID NO: 2699699 - RNA, 14 nt, Human
ugggaaagcauugu

SEQ ID NO: 2699700 - RNA, 15 nt, Human
agggaaacugccagc

SEQ ID NO: 2699701 - RNA, 14 nt, Human
agggaaacugccag

SEQ ID NO: 2699702 - RNA, 23 nt, Human
agggaaacugccagcaacgcagg

SEQ ID NO: 2699703 - RNA, 21 nt, Human
agggaaacugccagcaacgca

SEQ ID NO: 2699704 - RNA, 19 nt, Human
agggaaacugccagcaacg

SEQ ID NO: 2699705 - RNA, 16 nt, Human
agggaaacugccagca

SEQ ID NO: 2699706 - RNA, 20 nt, Human
ugggaacccaaguccaagca

SEQ ID NO: 2699707 - RNA, 22 nt, Human
agggcuguuauaaucuuucaca

SEQ ID NO: 2699708 - RNA, 23 nt, Human
agggacuucugucuucacaacag

SEQ ID NO: 2699709 - RNA, 14 nt, Human
agggagagaagaua

SEQ ID NO: 2699710 - RNA, 13 nt, Human
agggagagaagau

SEQ ID NO: 2699711 - RNA, 19 nt, Human
ugggaggcugagaugggag

SEQ ID NO: 2699712 - RNA, 20 nt, Human
uguccagccccguagacgug

SEQ ID NO: 2699713 - RNA, 14 nt, Human
agucaggaaagaga

SEQ ID NO: 2699714 - RNA, 13 nt, Human
agucucaggaaau

SEQ ID NO: 2699715 - RNA, 16 nt, Human
agucucaggaaaucaa

SEQ ID NO: 2699716 - RNA, 16 nt, Human
aggugcuacaaaaaca

SEQ ID NO: 2699717 - RNA, 14 nt, Human
agguugcagugagc

SEQ ID NO: 2699718 - RNA, 19 nt, Human
uguaagggaaacugccagc

SEQ ID NO: 2699719 - RNA, 18 nt, Human
uguaagggaaacugccag

SEQ ID NO: 2699720 - RNA, 13 nt, Human
uguaagggaaacu

SEQ ID NO: 2699721 - RNA, 17 nt, Human
uguaguguuggagaaga

SEQ ID NO: 2699722 - RNA, 18 nt, Human
uguaguguuggagaagaa

SEQ ID NO: 2699723 - RNA, 16 nt, Human
uguaguguuggagaag

SEQ ID NO: 2699724 - RNA, 20 nt, Human
aguaaaaccacagcaguuga

SEQ ID NO: 2699725 - RNA, 19 nt, Human
aguaaaaccacagcaguug

SEQ ID NO: 2699726 - RNA, 17 nt, Human
aguaaaaccacagcagu

SEQ ID NO: 2699727 - RNA, 16 nt, Human
aguaaaaccacagcag

SEQ ID NO: 2699728 - RNA, 12 nt, Human
aguaauuggaaa

SEQ ID NO: 2699729 - RNA, 13 nt, Human
aguaauuggaaag

SEQ ID NO: 2699730 - RNA, 13 nt, Human
aguaaugauaacu

SEQ ID NO: 2699731 - RNA, 15 nt, Human
uguucuaagaaguga

SEQ ID NO: 2699732 - RNA, 22 nt, Human
uguugcccacagcuguaugauu

SEQ ID NO: 2699733 - RNA, 16 nt, Human
agucuuucacauuuaa

SEQ ID NO: 2699734 - RNA, 18 nt, Human
agucuuucacauuuaaau

SEQ ID NO: 2699735 - RNA, 21 nt, Human
agugaacaaauuuacagagac

SEQ ID NO: 2699736 - RNA, 23 nt, Human
agugaacaaauuuacagagacag

SEQ ID NO: 2699737 - RNA, 22 nt, Human
agugaacaaauuuacagagaca

SEQ ID NO: 2699738 - RNA, 14 nt, Human
agugcaaauuguca

SEQ ID NO: 2699739 - RNA, 17 nt, Human
auacuauggaauuucuc

SEQ ID NO: 2699740 - RNA, 19 nt, Human
uuauauuugaaauauugac

SEQ ID NO: 2699741 - RNA, 14 nt, Human
uuaugaauuacauu

SEQ ID NO: 2699742 - RNA, 16 nt, Human
uuaugaauuacauuug

SEQ ID NO: 2699743 - RNA, 17 nt, Human
uuaugaauuacauuugu

SEQ ID NO: 2699744 - RNA, 21 nt, Human
uuaugaauuacauuuguauaa

SEQ ID NO: 2699745 - RNA, 19 nt, Human
uuaugauuaaguaaugaua

SEQ ID NO: 2699746 - RNA, 13 nt, Human
auagaaguaaaaa

SEQ ID NO: 2699747 - RNA, 17 nt, Human
auagaauuaacacauga

SEQ ID NO: 2699748 - RNA, 18 nt, Human
auagauaggucagugcaa

SEQ ID NO: 2699749 - RNA, 16 nt, Human
auacucauuaggaugg

SEQ ID NO: 2699750 - RNA, 19 nt, Human
uuauguuaaaacugggaca

SEQ ID NO: 2699751 - RNA, 14 nt, Human
uuauuauauuuaca

SEQ ID NO: 2699752 - RNA, 15 nt, Human
uuauuauauuuacaa

SEQ ID NO: 2699753 - RNA, 16 nt, Human
aguuuuauaugcuucu

SEQ ID NO: 2699754 - RNA, 20 nt, Human
aguuuaaauuguaauaggcg

SEQ ID NO: 2699755 - RNA, 17 nt, Human
aguuuaaauuguaauag

SEQ ID NO: 2699756 - RNA, 15 nt, Human
aguuuagcuggaaaa

SEQ ID NO: 2699757 - RNA, 19 nt, Human
uuaaaaaagaaacauuugg

SEQ ID NO: 2699758 - RNA, 16 nt, Human
uuaaaaaauggaacau

SEQ ID NO: 2699759 - RNA, 14 nt, Human
uuaaaaucauuucu

SEQ ID NO: 2699760 - RNA, 22 nt, Human
uuaaaaucauuucugcaucagc

SEQ ID NO: 2699761 - RNA, 14 nt, Human
uuaggguuaugauu

SEQ ID NO: 2699762 - RNA, 16 nt, Human
uuaggguuaugauuaa

SEQ ID NO: 2699763 - RNA, 15 nt, Human
uuagggagagaagau

SEQ ID NO: 2699764 - RNA, 14 nt, Human
auaaucuuucacag

SEQ ID NO: 2699765 - RNA, 14 nt, Human
auaagccagacauc

SEQ ID NO: 2699766 - RNA, 23 nt, Human
augaauggcuaagcaaaauguga

SEQ ID NO: 2699767 - RNA, 15 nt, Human
augaauuaaguuuuu

SEQ ID NO: 2699768 - RNA, 15 nt, Human
augaauuacauuugu

SEQ ID NO: 2699769 - RNA, 16 nt, Human
augaauuacauuugua

SEQ ID NO: 2699770 - RNA, 14 nt, Human
aucuuauaauuuaa

SEQ ID NO: 2699771 - RNA, 18 nt, Human
aucuacacuccagugaga

SEQ ID NO: 2699772 - RNA, 19 nt, Human
aucuacacuccagugagac

SEQ ID NO: 2699773 - RNA, 17 nt, Human
uugaagggaaauuucag

SEQ ID NO: 2699774 - RNA, 14 nt, Human
aucucauuuccaag

SEQ ID NO: 2699775 - RNA, 22 nt, Human
uugcaagccagauuuuccugaa

SEQ ID NO: 2699776 - RNA, 13 nt, Human
uugcaucaauuuu

SEQ ID NO: 2699777 - RNA, 18 nt, Human
uugaacccgggaggcaga

SEQ ID NO: 2699778 - RNA, 17 nt, Human
uugaaauuguauuacaa

SEQ ID NO: 2699779 - RNA, 19 nt, Human
uugaacccgggaggcagag

SEQ ID NO: 2699780 - RNA, 12 nt, Human
uucucuaggaaa

SEQ ID NO: 2699781 - RNA, 19 nt, Human
uuccguagguuauuuucag

SEQ ID NO: 2699782 - RNA, 14 nt, Human
aucaacagauaaau

SEQ ID NO: 2699783 - RNA, 18 nt, Human
auauuuuuuguuaaauga

SEQ ID NO: 2699784 - RNA, 20 nt, Human
auauuuuuuguuaaaugauu

SEQ ID NO: 2699785 - RNA, 22 nt, Human
aucacuugucaauaaaauccau

SEQ ID NO: 2699786 - RNA, 17 nt, Human
aucaggguuaguauugu

SEQ ID NO: 2699787 - RNA, 19 nt, Human
uucuagcaugaagacagag

SEQ ID NO: 2699788 - RNA, 16 nt, Human
uucuaaguaaaaccac

SEQ ID NO: 2699789 - RNA, 15 nt, Human
uucuaaguaaaacca

SEQ ID NO: 2699790 - RNA, 13 nt, Human
uucuaagaaguga

SEQ ID NO: 2699791 - RNA, 23 nt, Human
uucuaagaagugaaaaucuacac

SEQ ID NO: 2699792 - RNA, 15 nt, Human
uucggccuccauccu

SEQ ID NO: 2699793 - RNA, 14 nt, Human
uucggccuccaucc

SEQ ID NO: 2699794 - RNA, 19 nt, Human
uuuguaguguuggagaaga

SEQ ID NO: 2699795 - RNA, 21 nt, Human
uuuguaguguuggagaagaac

SEQ ID NO: 2699796 - RNA, 17 nt, Human
uuugugaagcaaaauuu

SEQ ID NO: 2699797 - RNA, 17 nt, Human
auguccacugguucuuc

SEQ ID NO: 2699798 - RNA, 16 nt, Human
auguccacugguucuu

SEQ ID NO: 2699799 - RNA, 19 nt, Human
auguagaggagaaacugga

SEQ ID NO: 2699800 - RNA, 17 nt, Human
auguagaggagaaacug

SEQ ID NO: 2699801 - RNA, 13 nt, Human
auguagaggagaa

SEQ ID NO: 2699802 - RNA, 12 nt, Human
auguagaggaga

SEQ ID NO: 2699803 - RNA, 16 nt, Human
auguacuucaugcugu

SEQ ID NO: 2699804 - RNA, 14 nt, Human
uuugcaagccagau

SEQ ID NO: 2699805 - RNA, 21 nt, Human
augguucccuugaugaagaag

SEQ ID NO: 2699806 - RNA, 17 nt, Human
uuucucccagucauuua

SEQ ID NO: 2699807 - RNA, 18 nt, Human
uuucucccagucauuuaa

SEQ ID NO: 2699808 - RNA, 15 nt, Human
uuugaaauauugacu

SEQ ID NO: 2699809 - RNA, 18 nt, Human
uuuaaauauaugcuaagu

SEQ ID NO: 2699810 - RNA, 13 nt, Human
augcaguucugaa

SEQ ID NO: 2699811 - RNA, 21 nt, Human
augccauuuaaagcuuauuaa

SEQ ID NO: 2699812 - RNA, 17 nt, Human
augccauuuaaagcuua

SEQ ID NO: 2699813 - RNA, 18 nt, Human
augauuaaguaaugauaa

SEQ ID NO: 2699814 - RNA, 14 nt, Human
augauuaaguaaug

SEQ ID NO: 2699815 - RNA, 15 nt, Human
augauaacuggaaac

SEQ ID NO: 2699816 - RNA, 14 nt, Human
auggcacuaguauu

SEQ ID NO: 2699817 - RNA, 16 nt, Human
auggcacuaguauuuc

SEQ ID NO: 2699818 - RNA, 19 nt, Human
auggcuaagcaaaauguga

SEQ ID NO: 2699819 - RNA, 16 nt, Human
uuucaaacauauauaa

SEQ ID NO: 2699820 - RNA, 22 nt, Human
augcuagaacucccuuucaaca

SEQ ID NO: 2699821 - RNA, 21 nt, Human
augcuagaacucccuuucaac

SEQ ID NO: 2699822 - RNA, 20 nt, Human
augcuagaacucccuuucaa

SEQ ID NO: 2699823 - RNA, 19 nt, Human
auuggacaguaaaauccac

SEQ ID NO: 2699824 - RNA, 19 nt, Human
auuggagcucgugggacag

SEQ ID NO: 2699825 - RNA, 13 nt, Human
auugacuuuuuau

SEQ ID NO: 2699826 - RNA, 13 nt, Human
auugucuagugaa

SEQ ID NO: 2699827 - RNA, 14 nt, Human
auuuauuuuaauaa

SEQ ID NO: 2699828 - RNA, 19 nt, Human
auuuguaguguuggagaag

SEQ ID NO: 2699829 - RNA, 22 nt, Human
auuuguaguguuggagaagaac

SEQ ID NO: 2699830 - RNA, 14 nt, Human
auuuguauaaaaua

SEQ ID NO: 2699831 - RNA, 23 nt, Human
auuuuaaaagaaugauuaugaau

SEQ ID NO: 2699832 - RNA, 16 nt, Human
auuuuaaaagaaugau

SEQ ID NO: 2699833 - RNA, 12 nt, Human
auuuuaauaaug

SEQ ID NO: 2699834 - RNA, 15 nt, Human
auuuucuauaauuua

SEQ ID NO: 2699835 - RNA, 14 nt, Human
auuuucuauaauuu

SEQ ID NO: 2699836 - RNA, 14 nt, Human
auuuuccugaaaac

SEQ ID NO: 2699837 - RNA, 15 nt, Human
auuuuucuuauuuca

SEQ ID NO: 2699838 - RNA, 20 nt, Human
auuuuucuuauuucauuucu

SEQ ID NO: 2699839 - RNA, 19 nt, Human
auuuuucuuauuucauuuc

SEQ ID NO: 2699840 - RNA, 22 nt, Human
auuuuugugauuuugugauuga

SEQ ID NO: 2699841 - RNA, 21 nt, Human
auuuuuguuuucauuaucuca

SEQ ID NO: 2699842 - RNA, 20 nt, Human
auuuuuucucuaggaaauau

SEQ ID NO: 2699843 - RNA, 23 nt, Human
auuuuuucucuaggaaauauuua

SEQ ID NO: 2699844 - RNA, 18 nt, Human
auuuuuuguuaaaugauu

SEQ ID NO: 2699845 - RNA, 17 nt, Human
auugacacuuaaaaaug

SEQ ID NO: 2699846 - RNA, 15 nt, Human
auugacacuuaaaaa

SEQ ID NO: 2699847 - RNA, 19 nt, Human
auugacacuuaaaaauggu

SEQ ID NO: 2699848 - RNA, 15 nt, Human
auuauauuuacaaau

SEQ ID NO: 2699849 - RNA, 20 nt, Human
auucaaacagucucaggaaa

SEQ ID NO: 2699850 - RNA, 19 nt, Human
auucaaacagucucaggaa

SEQ ID NO: 2699851 - RNA, 18 nt, Human
auucaaacagucucagga

SEQ ID NO: 2699852 - RNA, 16 nt, Human
auucaaacagucucag

SEQ ID NO: 2699853 - RNA, 21 nt, Human
auuauguuaaaacugggacag

SEQ ID NO: 2699854 - RNA, 15 nt, Human
auuauauuuauuacu

SEQ ID NO: 2699855 - RNA, 18 nt, Human
auuauauuuauuacugua

SEQ ID NO: 2699856 - RNA, 22 nt, Human
caaugaaugaaugaauggcuaa

SEQ ID NO: 2699857 - RNA, 11 nt, Human
cacaacagauu

SEQ ID NO: 2699858 - RNA, 19 nt, Human
cacacucaaaucaagaaac

SEQ ID NO: 2699859 - RNA, 14 nt, Human
cacacugaagaagc

SEQ ID NO: 2699860 - RNA, 13 nt, Human
cacaacuauauug

SEQ ID NO: 2699861 - RNA, 22 nt, Human
cacagcaguugaaaagacucca

SEQ ID NO: 2699862 - RNA, 15 nt, Human
cacaggaaguagagg

SEQ ID NO: 2699863 - RNA, 20 nt, Human
cacaggaaccacaagacugc

SEQ ID NO: 2699864 - RNA, 19 nt, Human
cacaggaaccacaagacug

SEQ ID NO: 2699865 - RNA, 14 nt, Human
cacaguuuucugag

SEQ ID NO: 2699866 - RNA, 15 nt, Human
cacaguuuucugaga

SEQ ID NO: 2699867 - RNA, 17 nt, Human
caaauaugcaaagcacu

SEQ ID NO: 2699868 - RNA, 16 nt, Human
caaauaugcaaagcac

SEQ ID NO: 2699869 - RNA, 18 nt, Human
caaauaugcaaagcacug

SEQ ID NO: 2699870 - RNA, 20 nt, Human
caaauguucaucaaugaaug

SEQ ID NO: 2699871 - RNA, 21 nt, Human
caaauguucaucaaugaauga

SEQ ID NO: 2699872 - RNA, 14 nt, Human
caaauaugcaaagc

SEQ ID NO: 2699873 - RNA, 14 nt, Human
caaauuuacagaga

SEQ ID NO: 2699874 - RNA, 15 nt, Human
caaauuuacagagac

SEQ ID NO: 2699875 - RNA, 17 nt, Human
caagcacuaaacaaaga

SEQ ID NO: 2699876 - RNA, 19 nt, Human
ccaccucccugcaauaaaa

SEQ ID NO: 2699877 - RNA, 21 nt, Human
ccaccucccugcaauaaaaug

SEQ ID NO: 2699878 - RNA, 15 nt, Human
ccaccucccugcaau

SEQ ID NO: 2699879 - RNA, 14 nt, Human
ccagacaucaacag

SEQ ID NO: 2699880 - RNA, 15 nt, Human
ccacugguucuucuu

SEQ ID NO: 2699881 - RNA, 19 nt, Human
ccagccugagcgacaguga

SEQ ID NO: 2699882 - RNA, 20 nt, Human
ccagguagaggguguguaag

SEQ ID NO: 2699883 - RNA, 18 nt, Human
ccauccugaggcuccacu

SEQ ID NO: 2699884 - RNA, 20 nt, Human
ccauccugaggcuccacuug

SEQ ID NO: 2699885 - RNA, 13 nt, Human
ccaggugccaguu

SEQ ID NO: 2699886 - RNA, 12 nt, Human
ccaggugccagu

SEQ ID NO: 2699887 - RNA, 23 nt, Human
cccucuccugggcagcugccucc

SEQ ID NO: 2699888 - RNA, 20 nt, Human
cccucuccugggcagcugcc

SEQ ID NO: 2699889 - RNA, 21 nt, Human
cccucuccugggcagcugccu

SEQ ID NO: 2699890 - RNA, 22 nt, Human
cccucuccugggcagcugccuc

SEQ ID NO: 2699891 - RNA, 15 nt, Human
ccuaacgaaguaucc

SEQ ID NO: 2699892 - RNA, 15 nt, Human
ccccucggagaagag

SEQ ID NO: 2699893 - RNA, 13 nt, Human
ccccuccucugcu

SEQ ID NO: 2699894 - RNA, 14 nt, Human
ccccuccucugcuu

SEQ ID NO: 2699895 - RNA, 17 nt, Human
ccccuccucugcuugcc

SEQ ID NO: 2699896 - RNA, 17 nt, Human
cucauuuccaagcaagu

SEQ ID NO: 2699897 - RNA, 13 nt, Human
cucauuuccaagc

SEQ ID NO: 2699898 - RNA, 14 nt, Human
cucauuuccaagca

SEQ ID NO: 2699899 - RNA, 12 nt, Human
cucauuuccaag

SEQ ID NO: 2699900 - RNA, 23 nt, Human
cucauuuuuauaaugucccuuca

SEQ ID NO: 2699901 - RNA, 14 nt, Human
cuccccucggagaa

SEQ ID NO: 2699902 - RNA, 22 nt, Human
cucaggaaaucaaauaugcaaa

SEQ ID NO: 2699903 - RNA, 21 nt, Human
cucagaugcacaugagcuggc

SEQ ID NO: 2699904 - RNA, 13 nt, Human
cuauaauuuaaau

SEQ ID NO: 2699905 - RNA, 12 nt, Human
cuauaauuuaaa

SEQ ID NO: 2699906 - RNA, 19 nt, Human
cuaugaaauauuauguuaa

SEQ ID NO: 2699907 - RNA, 18 nt, Human
cuagaguuuagcuggaaa

SEQ ID NO: 2699908 - RNA, 19 nt, Human
cuagaguuuagcuggaaaa

SEQ ID NO: 2699909 - RNA, 15 nt, Human
cuauaggugcuacaa

SEQ ID NO: 2699910 - RNA, 14 nt, Human
cuaggaaauauuua

SEQ ID NO: 2699911 - RNA, 15 nt, Human
cuaggaaauauuuau

SEQ ID NO: 2699912 - RNA, 19 nt, Human
cuaggaaauauuuauuuua

SEQ ID NO: 2699913 - RNA, 20 nt, Human
cuaggaaauauuuauuuuaa

SEQ ID NO: 2699914 - RNA, 19 nt, Human
cuaaguaaaaccacagcag

SEQ ID NO: 2699915 - RNA, 18 nt, Human
cuaaguaaaaccacagca

SEQ ID NO: 2699916 - RNA, 14 nt, Human
cuaaguaaaaccac

SEQ ID NO: 2699917 - RNA, 21 nt, Human
cuaagcuucacuguaaaauaa

SEQ ID NO: 2699918 - RNA, 23 nt, Human
cuacacgagauacagaauuuuau

SEQ ID NO: 2699919 - RNA, 14 nt, Human
cuacacuaagagag

SEQ ID NO: 2699920 - RNA, 20 nt, Human
cgggaggcagagguugcagu

SEQ ID NO: 2699921 - RNA, 14 nt, Human
cuaagagagaauga

SEQ ID NO: 2699922 - RNA, 15 nt, Human
cuaagagagaaugag

SEQ ID NO: 2699923 - RNA, 19 nt, Human
cuaaauugacacuuaaaaa

SEQ ID NO: 2699924 - RNA, 17 nt, Human
ccuucggccuccauccu

SEQ ID NO: 2699925 - RNA, 16 nt, Human
ccuucggccuccaucc

SEQ ID NO: 2699926 - RNA, 18 nt, Human
ccuucggccuccauccug

SEQ ID NO: 2699927 - RNA, 15 nt, Human
ccuuggacucauuuu

SEQ ID NO: 2699928 - RNA, 13 nt, Human
ccugggcagcugc

SEQ ID NO: 2699929 - RNA, 14 nt, Human
ccugggcagcugcc

SEQ ID NO: 2699930 - RNA, 17 nt, Human
ccugccccugagcccau

SEQ ID NO: 2699931 - RNA, 13 nt, Human
ccugaaagaggaa

SEQ ID NO: 2699932 - RNA, 14 nt, Human
ccugaggcuccacu

SEQ ID NO: 2699933 - RNA, 13 nt, Human
ccugaggcuccac

SEQ ID NO: 2699934 - RNA, 16 nt, Human
gaaacacaacuauauu

SEQ ID NO: 2699935 - RNA, 11 nt, Human
gaaacauuugg

SEQ ID NO: 2699936 - RNA, 23 nt, Human
gaaacucguuaauuuguaguguu

SEQ ID NO: 2699937 - RNA, 14 nt, Human
gaaacccugucucu

SEQ ID NO: 2699938 - RNA, 17 nt, Human
gaaagagaacuuccaga

SEQ ID NO: 2699939 - RNA, 21 nt, Human
gaaagaggaaugaaguacuca

SEQ ID NO: 2699940 - RNA, 20 nt, Human
gaaagaggcagcuugaaacu

SEQ ID NO: 2699941 - RNA, 17 nt, Human
gaaagcagaacagugau

SEQ ID NO: 2699942 - RNA, 22 nt, Human
gaaagcagaacagugauuacca

SEQ ID NO: 2699943 - RNA, 14 nt, Human
gaaagcagggacuu

SEQ ID NO: 2699944 - RNA, 18 nt, Human
gaaaaucuuauaauuuaa

SEQ ID NO: 2699945 - RNA, 22 nt, Human
gaaaaucuacacuccagugaga

SEQ ID NO: 2699946 - RNA, 18 nt, Human
gaaaauauuuguaucaca

SEQ ID NO: 2699947 - RNA, 19 nt, Human
cuugaguuuaaauuguaau

SEQ ID NO: 2699948 - RNA, 23 nt, Human
cuugucaauaaaauccauacauu

SEQ ID NO: 2699949 - RNA, 14 nt, Human
cuuauuucauuucu

SEQ ID NO: 2699950 - RNA, 15 nt, Human
cuuauuuccucauuu

SEQ ID NO: 2699951 - RNA, 15 nt, Human
cuuauuucauuucuu

SEQ ID NO: 2699952 - RNA, 20 nt, Human
cuuagaugcaguucugaaga

SEQ ID NO: 2699953 - RNA, 22 nt, Human
cuuagaugcaguucugaagaag

SEQ ID NO: 2699954 - RNA, 18 nt, Human
cuucugucuucacaacag

SEQ ID NO: 2699955 - RNA, 22 nt, Human
cuucugucuucacaacagauua

SEQ ID NO: 2699956 - RNA, 21 nt, Human
cuucugucuucacaacagauu

SEQ ID NO: 2699957 - RNA, 20 nt, Human
cugcccucuccugggcagcu

SEQ ID NO: 2699958 - RNA, 21 nt, Human
cugcccucuccugggcagcug

SEQ ID NO: 2699959 - RNA, 16 nt, Human
cugcccucuccugggc

SEQ ID NO: 2699960 - RNA, 18 nt, Human
cugcccucuccugggcag

SEQ ID NO: 2699961 - RNA, 19 nt, Human
cugcccucuccugggcagc

SEQ ID NO: 2699962 - RNA, 13 nt, Human
cugccuccccucc

SEQ ID NO: 2699963 - RNA, 18 nt, Human
cugcugaaacaacaaaua

SEQ ID NO: 2699964 - RNA, 20 nt, Human
cuggcacaguuuucugagaa

SEQ ID NO: 2699965 - RNA, 22 nt, Human
cuggcacaguuuucugagaaag

SEQ ID NO: 2699966 - RNA, 21 nt, Human
cuggcacaguuuucugagaaa

SEQ ID NO: 2699967 - RNA, 22 nt, Human
cuggccuucggccuccauccug

SEQ ID NO: 2699968 - RNA, 23 nt, Human
cuggccuucggccuccauccuga

SEQ ID NO: 2699969 - RNA, 16 nt, Human
cuggagcucugcccau

SEQ ID NO: 2699970 - RNA, 13 nt, Human
cuggagcucugcc

SEQ ID NO: 2699971 - RNA, 12 nt, Human
cuggagcucugc

SEQ ID NO: 2699972 - RNA, 20 nt, Human
cuguauuuuaaaagaaugau

SEQ ID NO: 2699973 - RNA, 19 nt, Human
cuguauuuuaaaagaauga

SEQ ID NO: 2699974 - RNA, 22 nt, Human
cuguauuuuaaaagaaugauua

SEQ ID NO: 2699975 - RNA, 20 nt, Human
cugucuacacuaagagagaa

SEQ ID NO: 2699976 - RNA, 23 nt, Human
cuguaaucacagcuacuugggag

SEQ ID NO: 2699977 - RNA, 22 nt, Human
cugggggggauuguaaaauggu

SEQ ID NO: 2699978 - RNA, 20 nt, Human
cuguuaaaagaugaaaauau

SEQ ID NO: 2699979 - RNA, 23 nt, Human
cuguuaaaagaugaaaauauuug

SEQ ID NO: 2699980 - RNA, 21 nt, Human
cuguuaaaagaugaaaauauu

SEQ ID NO: 2699981 - RNA, 21 nt, Human
gaauugacccacaagaaauga

SEQ ID NO: 2699982 - RNA, 16 nt, Human
gaauugacccacaaga

SEQ ID NO: 2699983 - RNA, 16 nt, Human
gaauuggagcucgugg

SEQ ID NO: 2699984 - RNA, 15 nt, Human
gacaagcucacagac

SEQ ID NO: 2699985 - RNA, 16 nt, Human
gacaaggaaaaaauaa

SEQ ID NO: 2699986 - RNA, 22 nt, Human
gacccacaagaaaugaaagcag

SEQ ID NO: 2699987 - RNA, 15 nt, Human
gacccacaagaaaug

SEQ ID NO: 2699988 - RNA, 16 nt, Human
gacccaaaaggcagaa

SEQ ID NO: 2699989 - RNA, 21 nt, Human
gaccacugcagaagacaguau

SEQ ID NO: 2699990 - RNA, 16 nt, Human
gacaugggacauuugc

SEQ ID NO: 2699991 - RNA, 18 nt, Human
gacagggaggacgcucuc

SEQ ID NO: 2699992 - RNA, 17 nt, Human
gacagggaggacgcucu

SEQ ID NO: 2699993 - RNA, 20 nt, Human
gacauagaauuaacacauga

SEQ ID NO: 2699994 - RNA, 19 nt, Human
gacagagccccacccucag

SEQ ID NO: 2699995 - RNA, 16 nt, Human
gacuggauaguccguc

SEQ ID NO: 2699996 - RNA, 14 nt, Human
gacugcauuauauu

SEQ ID NO: 2699997 - RNA, 16 nt, Human
gacugcauuauauuua

SEQ ID NO: 2699998 - RNA, 15 nt, Human
gacuccaaagaaaug

SEQ ID NO: 2699999 - RNA, 12 nt, Human
gacuccaaagaa

SEQ ID NO: 2700000 - RNA, 11 nt, Human
gacuccaaaga

SEQ ID NO: 2700001 - RNA, 21 nt, Human
gacucauuuuaaaaaauggaa

SEQ ID NO: 2700002 - RNA, 18 nt, Human
gacuccaaagaaauguaa

SEQ ID NO: 2700003 - RNA, 16 nt, Human
gacuccaaagaaaugu

SEQ ID NO: 2700004 - RNA, 24 nt, Human
gacuucuaaguaaaaccacagcag

SEQ ID NO: 2700005 - RNA, 23 nt, Human
gacuucuaaguaaaaccacagca

SEQ ID NO: 2700006 - RNA, 19 nt, Human
gacuucuaaguaaaaccac

SEQ ID NO: 2700007 - RNA, 23 nt, Human
gacuucugucuucacaacagauu

SEQ ID NO: 2700008 - RNA, 20 nt, Human
gacuucugucuucacaacag

SEQ ID NO: 2700009 - RNA, 18 nt, Human
gacuucuaaguaaaacca

SEQ ID NO: 2700010 - RNA, 17 nt, Human
gacuucuaaguaaaacc

SEQ ID NO: 2700011 - RNA, 16 nt, Human
gacuucuaaguaaaac

SEQ ID NO: 2700012 - RNA, 13 nt, Human
gagaagagcuguu

SEQ ID NO: 2700013 - RNA, 17 nt, Human
gagaaugagagacacac

SEQ ID NO: 2700014 - RNA, 22 nt, Human
gagaacuuccagauccuggaaa

SEQ ID NO: 2700015 - RNA, 23 nt, Human
gagaacuuccagauccuggaaau

SEQ ID NO: 2700016 - RNA, 21 nt, Human
gagaaccuagggugauauuaa

SEQ ID NO: 2700017 - RNA, 22 nt, Human
gagaaccuagggugauauuaac

SEQ ID NO: 2700018 - RNA, 20 nt, Human
gagaaugagagacacacuga

SEQ ID NO: 2700019 - RNA, 21 nt, Human
gagaaugagagacacacugaa

SEQ ID NO: 2700020 - RNA, 20 nt, Human
gagacagcucugcauacuca

SEQ ID NO: 2700021 - RNA, 12 nt, Human
gagcccugucuc

SEQ ID NO: 2700022 - RNA, 22 nt, Human
gauaaauggcuuccuggcaaua

SEQ ID NO: 2700023 - RNA, 15 nt, Human
gcacugacuucuaag

SEQ ID NO: 2700024 - RNA, 18 nt, Human
gcacugacuucuaaguaa

SEQ ID NO: 2700025 - RNA, 13 nt, Human
gcacacugucugc

SEQ ID NO: 2700026 - RNA, 18 nt, Human
gaugcuagaacucccuuu

SEQ ID NO: 2700027 - RNA, 22 nt, Human
gaugcuagaacucccuuucaac

SEQ ID NO: 2700028 - RNA, 20 nt, Human
gaugcuagaacucccuuuca

SEQ ID NO: 2700029 - RNA, 16 nt, Human
gcaaauugucacagga

SEQ ID NO: 2700030 - RNA, 15 nt, Human
ggauuguaaaauggu

SEQ ID NO: 2700031 - RNA, 14 nt, Human
ggcauggcugggaa

SEQ ID NO: 2700032 - RNA, 14 nt, Human
ggacgcucucuggc

SEQ ID NO: 2700033 - RNA, 13 nt, Human
ggacgcucucugg

SEQ ID NO: 2700034 - RNA, 19 nt, Human
ggagaaucacuugaacccg

SEQ ID NO: 2700035 - RNA, 15 nt, Human
ggagaaucacuugaa

SEQ ID NO: 2700036 - RNA, 23 nt, Human
ggaauuucucccagucauuuaau

SEQ ID NO: 2700037 - RNA, 16 nt, Human
ggaauuggagcucgug

SEQ ID NO: 2700038 - RNA, 22 nt, Human
ggaauuggagcucgugggacag

SEQ ID NO: 2700039 - RNA, 20 nt, Human
ggaagugacgguuuaauggg

SEQ ID NO: 2700040 - RNA, 23 nt, Human
ggaaagggauuuucagcccucag

SEQ ID NO: 2700041 - RNA, 17 nt, Human
ggaaaucaaauaugcaa

SEQ ID NO: 2700042 - RNA, 20 nt, Human
gcugucuacacuaagagaga

SEQ ID NO: 2700043 - RNA, 17 nt, Human
gccuaagugcagccccg

SEQ ID NO: 2700044 - RNA, 22 nt, Human
gccuauauuuuuuguuaaauga

SEQ ID NO: 2700045 - RNA, 12 nt, Human
gcccucuccugg

SEQ ID NO: 2700046 - RNA, 13 nt, Human
gcccucuccuggg

SEQ ID NO: 2700047 - RNA, 14 nt, Human
gcccucuccugggc

SEQ ID NO: 2700048 - RNA, 22 nt, Human
gcccucuccugggcagcugccu

SEQ ID NO: 2700049 - RNA, 23 nt, Human
gcccucuccugggcagcugccuc

SEQ ID NO: 2700050 - RNA, 14 nt, Human
gcuaagcauuccaa

SEQ ID NO: 2700051 - RNA, 17 nt, Human
gcuaagcaaaaugugau

SEQ ID NO: 2700052 - RNA, 11 nt, Human
gcucucuggcc

SEQ ID NO: 2700053 - RNA, 13 nt, Human
gcucucuggccuu

SEQ ID NO: 2700054 - RNA, 12 nt, Human
gcucucuggccu

SEQ ID NO: 2700055 - RNA, 20 nt, Human
gcucucuggccuucggccuc

SEQ ID NO: 2700056 - RNA, 19 nt, Human
gcucucuggccuucggccu

SEQ ID NO: 2700057 - RNA, 15 nt, Human
gcucucuggccuucg

SEQ ID NO: 2700058 - RNA, 14 nt, Human
gcucucuggccuuc

SEQ ID NO: 2700059 - RNA, 19 nt, Human
guaaugauaacuggaaacu

SEQ ID NO: 2700060 - RNA, 15 nt, Human
guaauuggaaaggca

SEQ ID NO: 2700061 - RNA, 15 nt, Human
guaccgcaaugugac

SEQ ID NO: 2700062 - RNA, 15 nt, Human
guagaggagaaacug

SEQ ID NO: 2700063 - RNA, 23 nt, Human
guacuuuauuuucuauaauuuaa

SEQ ID NO: 2700064 - RNA, 18 nt, Human
guaagggaaacugccagc

SEQ ID NO: 2700065 - RNA, 17 nt, Human
guaagggaaacugccag

SEQ ID NO: 2700066 - RNA, 18 nt, Human
guaaaaccacagcaguug

SEQ ID NO: 2700067 - RNA, 16 nt, Human
guaaaaccacagcagu

SEQ ID NO: 2700068 - RNA, 15 nt, Human
guaaaaccacagcag

SEQ ID NO: 2700069 - RNA, 14 nt, Human
guaaaaccacagca

SEQ ID NO: 2700070 - RNA, 23 nt, Human
guaaaaccacagcaguugaaaag

SEQ ID NO: 2700071 - RNA, 15 nt, Human
gguagacacacauga

SEQ ID NO: 2700072 - RNA, 22 nt, Human
gguagacacacaugaaguccaa

SEQ ID NO: 2700073 - RNA, 22 nt, Human
gguacuucaaauccuugaagau

SEQ ID NO: 2700074 - RNA, 21 nt, Human
ggguagccacuggacugacga

SEQ ID NO: 2700075 - RNA, 19 nt, Human
ggugcuacaaaaacacagc

SEQ ID NO: 2700076 - RNA, 22 nt, Human
guauuucuaugaaauauuaugu

SEQ ID NO: 2700077 - RNA, 17 nt, Human
guauuucuaugaaauau

SEQ ID NO: 2700078 - RNA, 16 nt, Human
guauuuuaaaagaaug

SEQ ID NO: 2700079 - RNA, 17 nt, Human
guauuuuaaaagaauga

SEQ ID NO: 2700080 - RNA, 14 nt, Human
gucaccucauggaa

SEQ ID NO: 2700081 - RNA, 15 nt, Human
gucaauaaaauccau

SEQ ID NO: 2700082 - RNA, 21 nt, Human
gucaauaaaauccauacauuu

SEQ ID NO: 2700083 - RNA, 20 nt, Human
gucccagccagcaguucaga

SEQ ID NO: 2700084 - RNA, 23 nt, Human
gucuacacuaagagagaaugaga

SEQ ID NO: 2700085 - RNA, 17 nt, Human
gucuacacuaagagaga

SEQ ID NO: 2700086 - RNA, 18 nt, Human
guccugucggagcccugu

SEQ ID NO: 2700087 - RNA, 20 nt, Human
guccugucggagcccugucu

SEQ ID NO: 2700088 - RNA, 21 nt, Human
guccugucggagcccugucuc

SEQ ID NO: 2700089 - RNA, 18 nt, Human
gugcaaauugucacagga

SEQ ID NO: 2700090 - RNA, 20 nt, Human
gugaaacucguuaauuugua

SEQ ID NO: 2700091 - RNA, 19 nt, Human
gugaaagaaaauaacaaua

SEQ ID NO: 2700092 - RNA, 16 nt, Human
gugagcagucaggaaa

SEQ ID NO: 2700093 - RNA, 14 nt, Human
gugagcuacaaaug

SEQ ID NO: 2700094 - RNA, 17 nt, Human
ucaaacauauauaacaa

SEQ ID NO: 2700095 - RNA, 22 nt, Human
ucaaacagucucaggaaaucaa

SEQ ID NO: 2700096 - RNA, 16 nt, Human
ucaaauccuugaagau

SEQ ID NO: 2700097 - RNA, 15 nt, Human
ucaaauccuugaaga

SEQ ID NO: 2700098 - RNA, 19 nt, Human
ucaaauaugcaaagcacug

SEQ ID NO: 2700099 - RNA, 18 nt, Human
ucaaauaugcaaagcacu

SEQ ID NO: 2700100 - RNA, 17 nt, Human
ucaaauaugcaaagcac

SEQ ID NO: 2700101 - RNA, 16 nt, Human
ucaaauaugcaaagca

SEQ ID NO: 2700102 - RNA, 22 nt, Human
ucaacuccaaacugacucuuaa

SEQ ID NO: 2700103 - RNA, 12 nt, Human
ucacauuuaaau

SEQ ID NO: 2700104 - RNA, 22 nt, Human
ucacaagacccaaaaggcagaa

SEQ ID NO: 2700105 - RNA, 14 nt, Human
ucaauaaaauccau

SEQ ID NO: 2700106 - RNA, 17 nt, Human
uauuguuuaaaaucauu

SEQ ID NO: 2700107 - RNA, 16 nt, Human
uauuguuuaaaaucau

SEQ ID NO: 2700108 - RNA, 15 nt, Human
uauuguuuaaaauca

SEQ ID NO: 2700109 - RNA, 14 nt, Human
uauuuauuacugua

SEQ ID NO: 2700110 - RNA, 13 nt, Human
uauuucuaugaaa

SEQ ID NO: 2700111 - RNA, 13 nt, Human
uauuuauuacugu

SEQ ID NO: 2700112 - RNA, 14 nt, Human
uauuucuaugaaau

SEQ ID NO: 2700113 - RNA, 15 nt, Human
uauuucuaugaaaua

SEQ ID NO: 2700114 - RNA, 20 nt, Human
uauuguuuaaaaucauuucu

SEQ ID NO: 2700115 - RNA, 16 nt, Human
uauuauguuaaaacug

SEQ ID NO: 2700116 - RNA, 17 nt, Human
uauuauauuuacaaaug

SEQ ID NO: 2700117 - RNA, 19 nt, Human
uauguuagugcaaauuguc

SEQ ID NO: 2700118 - RNA, 12 nt, Human
uauguuaaaacu

SEQ ID NO: 2700119 - RNA, 19 nt, Human
uauggaggcuuugcauaga

SEQ ID NO: 2700120 - RNA, 17 nt, Human
uauguucuaagaaguga

SEQ ID NO: 2700121 - RNA, 14 nt, Human
uauccuucagccug

SEQ ID NO: 2700122 - RNA, 15 nt, Human
uauccuucagccuga

SEQ ID NO: 2700123 - RNA, 23 nt, Human
uaugaauuacauuuguauaaaau

SEQ ID NO: 2700124 - RNA, 17 nt, Human
uaugaauuacauuugua

SEQ ID NO: 2700125 - RNA, 12 nt, Human
uaugcaaagcac

SEQ ID NO: 2700126 - RNA, 14 nt, Human
uaugcaaagcacug

SEQ ID NO: 2700127 - RNA, 13 nt, Human
uaugcaaagcacu

SEQ ID NO: 2700128 - RNA, 15 nt, Human
uaugcaaagcacuga

SEQ ID NO: 2700129 - RNA, 16 nt, Human
uaugauucccagccag

SEQ ID NO: 2700130 - RNA, 15 nt, Human
uaugcuucuguuuua

SEQ ID NO: 2700131 - RNA, 16 nt, Human
uaugcuucuguuuuau

SEQ ID NO: 2700132 - RNA, 13 nt, Human
uauaugcuucugu

SEQ ID NO: 2700133 - RNA, 13 nt, Human
uauauaacaaugc

SEQ ID NO: 2700134 - RNA, 13 nt, Human
uaguaucaaaaga

SEQ ID NO: 2700135 - RNA, 18 nt, Human
uaguauuucuaugaaaua

SEQ ID NO: 2700136 - RNA, 19 nt, Human
uaguauuucuaugaaauau

SEQ ID NO: 2700137 - RNA, 16 nt, Human
uaguauuucuaugaaa

SEQ ID NO: 2700138 - RNA, 13 nt, Human
uagucaaauugug

SEQ ID NO: 2700139 - RNA, 14 nt, Human
uagucaaauugugu

SEQ ID NO: 2700140 - RNA, 14 nt, Human
uagugcaaauuguc

SEQ ID NO: 2700141 - RNA, 15 nt, Human
uagugcaaauuguca

SEQ ID NO: 2700142 - RNA, 12 nt, Human
uaggaauugacc

SEQ ID NO: 2700143 - RNA, 18 nt, Human
uaggccaugggacaggga

SEQ ID NO: 2700144 - RNA, 16 nt, Human
uaggccaugggacagg

SEQ ID NO: 2700145 - RNA, 16 nt, Human
uaggucagugcaaaua

SEQ ID NO: 2700146 - RNA, 17 nt, Human
uccaaagaaauguaagg

SEQ ID NO: 2700147 - RNA, 14 nt, Human
uccaaagaaaugua

SEQ ID NO: 2700148 - RNA, 16 nt, Human
ucauuaggauggcuag

SEQ ID NO: 2700149 - RNA, 12 nt, Human
ucauagcagcuu

SEQ ID NO: 2700150 - RNA, 11 nt, Human
ucauagcagcu

SEQ ID NO: 2700151 - RNA, 17 nt, Human
ucaucaaugaaugaaug

SEQ ID NO: 2700152 - RNA, 17 nt, Human
uccacuuggucugugag

SEQ ID NO: 2700153 - RNA, 21 nt, Human
uccacuuggucugugagaugc

SEQ ID NO: 2700154 - RNA, 23 nt, Human
uccacuuggucugugagaugcua

SEQ ID NO: 2700155 - RNA, 20 nt, Human
uccaugggccauaugaaaag

SEQ ID NO: 2700156 - RNA, 15 nt, Human
uccauacauuugugu

SEQ ID NO: 2700157 - RNA, 19 nt, Human
uccagguagagggugugua

SEQ ID NO: 2700158 - RNA, 22 nt, Human
uccucauuuuuauaaugucccu

SEQ ID NO: 2700159 - RNA, 23 nt, Human
uccuagugaaagaggcagcuuga

SEQ ID NO: 2700160 - RNA, 14 nt, Human
uccuagugaaagag

SEQ ID NO: 2700161 - RNA, 20 nt, Human
ucccuucacaaacccagugu

SEQ ID NO: 2700162 - RNA, 20 nt, Human
uccugaggcuccacuugguc

SEQ ID NO: 2700163 - RNA, 19 nt, Human
uccugaggcuccacuuggu

SEQ ID NO: 2700164 - RNA, 18 nt, Human
uccugccccugagcccau

SEQ ID NO: 2700165 - RNA, 17 nt, Human
uccugccccugagccca

SEQ ID NO: 2700166 - RNA, 18 nt, Human
ucuaugaaauauuauguu

SEQ ID NO: 2700167 - RNA, 17 nt, Human
ucuacacuaagagagaa

SEQ ID NO: 2700168 - RNA, 12 nt, Human
ucggagaagagc

SEQ ID NO: 2700169 - RNA, 16 nt, Human
ucggagaagagcuguu

SEQ ID NO: 2700170 - RNA, 14 nt, Human
ucggagaagagcug

SEQ ID NO: 2700171 - RNA, 23 nt, Human
ucucaguccaugaagauguagag

SEQ ID NO: 2700172 - RNA, 12 nt, Human
ugacaagcucac

SEQ ID NO: 2700173 - RNA, 15 nt, Human
ugacaagcucacaga

SEQ ID NO: 2700174 - RNA, 20 nt, Human
ugacaagcucacagaccuuu

SEQ ID NO: 2700175 - RNA, 20 nt, Human
ugaccacugcagaagacagu

SEQ ID NO: 2700176 - RNA, 16 nt, Human
ugacaugggacauuug

SEQ ID NO: 2700177 - RNA, 17 nt, Human
ugacaugggacauuugc

SEQ ID NO: 2700178 - RNA, 18 nt, Human
ugacaugggacauuugcu

SEQ ID NO: 2700179 - RNA, 11 nt, Human
ugaaguccaag

SEQ ID NO: 2700180 - RNA, 13 nt, Human
ugaaguccaagca

SEQ ID NO: 2700181 - RNA, 15 nt, Human
ugaauuacauuugua

SEQ ID NO: 2700182 - RNA, 16 nt, Human
ugaauuacauuuguau

SEQ ID NO: 2700183 - RNA, 18 nt, Human
ugaauuacauuuguauaa

SEQ ID NO: 2700184 - RNA, 20 nt, Human
ugaaugaauggcuaagcaaa

SEQ ID NO: 2700185 - RNA, 15 nt, Human
ugaaagguacuucaa

SEQ ID NO: 2700186 - RNA, 16 nt, Human
ugaaagguacuucaaa

SEQ ID NO: 2700187 - RNA, 18 nt, Human
ugaaagaggcagcuugaa

SEQ ID NO: 2700188 - RNA, 22 nt, Human
ugaaacaacaaauaggaauugu

SEQ ID NO: 2700189 - RNA, 19 nt, Human
ugaaauggacuuuuguaca

SEQ ID NO: 2700190 - RNA, 16 nt, Human
ugaaauauugacuuuu

SEQ ID NO: 2700191 - RNA, 17 nt, Human
ucuuucacauuuaaaua

SEQ ID NO: 2700192 - RNA, 19 nt, Human
ucuuuccacagaagcucca

SEQ ID NO: 2700193 - RNA, 12 nt, Human
ucuuugccaagu

SEQ ID NO: 2700194 - RNA, 16 nt, Human
ugauuaccagggacug

SEQ ID NO: 2700195 - RNA, 22 nt, Human
ugauguuuagaaacacaacuau

SEQ ID NO: 2700196 - RNA, 13 nt, Human
ugauuauauguca

SEQ ID NO: 2700197 - RNA, 17 nt, Human
ugauuaugaauuacauu

SEQ ID NO: 2700198 - RNA, 19 nt, Human
ugauuaugaauuacauuug

SEQ ID NO: 2700199 - RNA, 21 nt, Human
ugauuaugaauuacauuugua

SEQ ID NO: 2700200 - RNA, 22 nt, Human
ugauuaugaauuacauuuguau

SEQ ID NO: 2700201 - RNA, 15 nt, Human
ugauggugguauguu

SEQ ID NO: 2700202 - RNA, 20 nt, Human
ugaugcuacaggauuugaaa

SEQ ID NO: 2700203 - RNA, 23 nt, Human
ugaugcuacaggauuugaaauug

SEQ ID NO: 2700204 - RNA, 17 nt, Human
ugaucuuuaaaauacac

SEQ ID NO: 2700205 - RNA, 14 nt, Human
ugaucuuuaaaaua

SEQ ID NO: 2700206 - RNA, 24 nt, Human
ugaucagcuuauugucuagugaaa

SEQ ID NO: 2700207 - RNA, 17 nt, Human
ugaucagcuuauugucu

SEQ ID NO: 2700208 - RNA, 16 nt, Human
ugagagugaacaaauu

SEQ ID NO: 2700209 - RNA, 13 nt, Human
ugagccccaaaag

SEQ ID NO: 2700210 - RNA, 16 nt, Human
ugauaacuggaaacuu

SEQ ID NO: 2700211 - RNA, 20 nt, Human
ugaggcuccacuuggucugu

SEQ ID NO: 2700212 - RNA, 18 nt, Human
ugaggcuccacuuggucu

SEQ ID NO: 2700213 - RNA, 17 nt, Human
ugcuagaacucccuuuc

SEQ ID NO: 2700214 - RNA, 15 nt, Human
ugcuagaacucccuu

SEQ ID NO: 2700215 - RNA, 14 nt, Human
ugcuagaacucccu

SEQ ID NO: 2700216 - RNA, 13 nt, Human
ugcuagaacuccc

SEQ ID NO: 2700217 - RNA, 20 nt, Human
ugcugggggggauuguaaaa

SEQ ID NO: 2700218 - RNA, 22 nt, Human
ugcaucaauuuuucuuauuuca

SEQ ID NO: 2700219 - RNA, 12 nt, Human
ugcaguucugaa

SEQ ID NO: 2700220 - RNA, 13 nt, Human
ugcaucagcugcu

SEQ ID NO: 2700221 - RNA, 16 nt, Human
ugccacuaaauugaca

SEQ ID NO: 2700222 - RNA, 15 nt, Human
uggcacuaguauuuc

SEQ ID NO: 2700223 - RNA, 20 nt, Human
uggcaauagucaaauugugu

SEQ ID NO: 2700224 - RNA, 13 nt, Human
ugguauguuuuca

SEQ ID NO: 2700225 - RNA, 17 nt, Human
uggucacaggaaguaga

SEQ ID NO: 2700226 - RNA, 22 nt, Human
uggucacaggaaguagaggagg

SEQ ID NO: 2700227 - RNA, 16 nt, Human
uggucccagccagcag

SEQ ID NO: 2700228 - RNA, 16 nt, Human
uggugauuuagcagga

SEQ ID NO: 2700229 - RNA, 22 nt, Human
uggugauuuagcaggaagcugu

SEQ ID NO: 2700230 - RNA, 17 nt, Human
ugggcagcugccucccc

SEQ ID NO: 2700231 - RNA, 19 nt, Human
ugggcagcugccuccccuc

SEQ ID NO: 2700232 - RNA, 13 nt, Human
ugggcagcugccu

SEQ ID NO: 2700233 - RNA, 14 nt, Human
ugggcagcugccuc

SEQ ID NO: 2700234 - RNA, 15 nt, Human
ugggcagcugccucc

SEQ ID NO: 2700235 - RNA, 19 nt, Human
uuaaaauacacacucaaau

SEQ ID NO: 2700236 - RNA, 18 nt, Human
uuaaaagaugaaaauauu

SEQ ID NO: 2700237 - RNA, 15 nt, Human
uuaaaagaugaaaau

SEQ ID NO: 2700238 - RNA, 22 nt, Human
uuaaaagaauauuuuaacuucc

SEQ ID NO: 2700239 - RNA, 21 nt, Human
uuaaaagaauauuuuaacuuc

SEQ ID NO: 2700240 - RNA, 19 nt, Human
uguuucaaacauauauaac

SEQ ID NO: 2700241 - RNA, 21 nt, Human
uguuucaaacauauauaacaa

SEQ ID NO: 2700242 - RNA, 22 nt, Human
uguuucaaacauauauaacaau

SEQ ID NO: 2700243 - RNA, 18 nt, Human
uuaggauguugaaaaagu

SEQ ID NO: 2700244 - RNA, 20 nt, Human
uuagaugcaguucugaagaa

SEQ ID NO: 2700245 - RNA, 21 nt, Human
uuagaugcaguucugaagaag

SEQ ID NO: 2700246 - RNA, 12 nt, Human
uuagcuggaaaa

SEQ ID NO: 2700247 - RNA, 13 nt, Human
uuagcuggaaaag

SEQ ID NO: 2700248 - RNA, 19 nt, Human
uuagaaacacaacuauauu

SEQ ID NO: 2700249 - RNA, 17 nt, Human
uuacuaguuucccuugc

SEQ ID NO: 2700250 - RNA, 17 nt, Human
uucccuugaugaagaag

SEQ ID NO: 2700251 - RNA, 20 nt, Human
uuccuuggacucauuuuaaa

SEQ ID NO: 2700252 - RNA, 17 nt, Human
uuccuuggacucauuuu

SEQ ID NO: 2700253 - RNA, 19 nt, Human
uuccagauccuggaaauca

SEQ ID NO: 2700254 - RNA, 17 nt, Human
uucaaauccuugaagau

SEQ ID NO: 2700255 - RNA, 17 nt, Human
uuauuuuaauaauguuu

SEQ ID NO: 2700256 - RNA, 15 nt, Human
uuauugucuagugaa

SEQ ID NO: 2700257 - RNA, 15 nt, Human
uuauuuuaauaaugu

SEQ ID NO: 2700258 - RNA, 16 nt, Human
uuauuuuaauaauguu

SEQ ID NO: 2700259 - RNA, 13 nt, Human
uucagagcugccc

SEQ ID NO: 2700260 - RNA, 14 nt, Human
uucagagcugcccu

SEQ ID NO: 2700261 - RNA, 20 nt, Human
uucagacauagaauuaacac

SEQ ID NO: 2700262 - RNA, 16 nt, Human
uucagacauagaauua

SEQ ID NO: 2700263 - RNA, 17 nt, Human
uuauuacuguaagaaaa

SEQ ID NO: 2700264 - RNA, 18 nt, Human
uuauuacuguaagaaaau

SEQ ID NO: 2700265 - RNA, 16 nt, Human
uuauuacuguaagaaa

SEQ ID NO: 2700266 - RNA, 17 nt, Human
uuauggcuauaggugcu

SEQ ID NO: 2700267 - RNA, 21 nt, Human
uuauggcacuaguauuucuau

SEQ ID NO: 2700268 - RNA, 13 nt, Human
uuuaauaaaccau

SEQ ID NO: 2700269 - RNA, 14 nt, Human
uuuaauaauguuuc

SEQ ID NO: 2700270 - RNA, 15 nt, Human
uuuaauaauguuuca

SEQ ID NO: 2700271 - RNA, 19 nt, Human
uuuaauaauguuucaaaca

SEQ ID NO: 2700272 - RNA, 13 nt, Human
uuuacagagacag

SEQ ID NO: 2700273 - RNA, 19 nt, Human
uuuaaaauacacacucaaa

SEQ ID NO: 2700274 - RNA, 16 nt, Human
uuuaaaaucauuucug

SEQ ID NO: 2700275 - RNA, 14 nt, Human
uuuaaaagaaugau

SEQ ID NO: 2700276 - RNA, 17 nt, Human
uuuaaaagaaugauuau

SEQ ID NO: 2700277 - RNA, 12 nt, Human
uuuaaaaugucu

SEQ ID NO: 2700278 - RNA, 17 nt, Human
uuguuuaaaaucauuuc

SEQ ID NO: 2700279 - RNA, 18 nt, Human
uuguuuaaaaucauuucu

SEQ ID NO: 2700280 - RNA, 21 nt, Human
uuugaaauuguauuacaaauc

SEQ ID NO: 2700281 - RNA, 18 nt, Human
uuugguaaggggaauuga

SEQ ID NO: 2700282 - RNA, 12 nt, Human
uuucucuaggaa

SEQ ID NO: 2700283 - RNA, 21 nt, Human
uugaaaaucuuauaauuuaaa

SEQ ID NO: 2700284 - RNA, 18 nt, Human
uucuuuccacagaagcuc

SEQ ID NO: 2700285 - RNA, 19 nt, Human
uucuuaggguuaugauuaa

SEQ ID NO: 2700286 - RNA, 24 nt, Human
uucuaaguaaaaccacagcaguug

SEQ ID NO: 2700287 - RNA, 23 nt, Human
uugcagcucuccccuucucugua

SEQ ID NO: 2700288 - RNA, 22 nt, Human
uugccaucccucccuccaccuc

SEQ ID NO: 2700289 - RNA, 23 nt, Human
uugccaucccucccuccaccucc

SEQ ID NO: 2700290 - RNA, 14 nt, Human
uugccaucccuccc

SEQ ID NO: 2700291 - RNA, 16 nt, Human
uugccaucccucccuc

SEQ ID NO: 2700292 - RNA, 17 nt, Human
uugccaucccucccucc

SEQ ID NO: 2700293 - RNA, 18 nt, Human
uugccaucccucccucca

SEQ ID NO: 2700294 - RNA, 13 nt, Human
uugccaucccucc

SEQ ID NO: 2700295 - RNA, 20 nt, Human
uugauaugccuuuucccaac

SEQ ID NO: 2700296 - RNA, 13 nt, Human
uuguaaaauggug

SEQ ID NO: 2700297 - RNA, 12 nt, Human
uuguaaaauggu

SEQ ID NO: 2700298 - RNA, 15 nt, Human
uuggucugugagaug

SEQ ID NO: 2700299 - RNA, 20 nt, Human
uugguaaggggaauugagga

SEQ ID NO: 2700300 - RNA, 20 nt, Human
uuguaaaauggugugaccac

SEQ ID NO: 2700301 - RNA, 16 nt, Human
uuguaccgcaauguga

SEQ ID NO: 2700302 - RNA, 18 nt, Human
uugcuaagcauuccaacu

SEQ ID NO: 2700303 - RNA, 16 nt, Human
uugcuaagcauuccaa

SEQ ID NO: 2700304 - RNA, 22 nt, Human
cucuuagaugcaguucugaaga

SEQ ID NO: 2700305 - RNA, 21 nt, Human
cucuuagaugcaguucugaag

SEQ ID NO: 2700306 - RNA, 16 nt, Human
cucuccccuucucugu

SEQ ID NO: 2700307 - RNA, 15 nt, Human
cugaaacaacaaaua

SEQ ID NO: 2700308 - RNA, 14 nt, Human
cucguuaauuugua

SEQ ID NO: 2700309 - RNA, 21 nt, Human
cuccucugcuugccaucccuc

SEQ ID NO: 2700310 - RNA, 22 nt, Human
cuccucugcuugccaucccucc

SEQ ID NO: 2700311 - RNA, 15 nt, Human
cuccucugcuugcca

SEQ ID NO: 2700312 - RNA, 16 nt, Human
cuccucugcuugccau

SEQ ID NO: 2700313 - RNA, 17 nt, Human
cuccucugcuugccauc

SEQ ID NO: 2700314 - RNA, 20 nt, Human
cuccucugcuugccaucccu

SEQ ID NO: 2700315 - RNA, 22 nt, Human
cuccugggcagcugccuccccu

SEQ ID NO: 2700316 - RNA, 18 nt, Human
cuccugggcagcugccuc

SEQ ID NO: 2700317 - RNA, 19 nt, Human
cuccugggcagcugccucc

SEQ ID NO: 2700318 - RNA, 14 nt, Human
cuccugggcagcug

SEQ ID NO: 2700319 - RNA, 15 nt, Human
cuccugggcagcugc

SEQ ID NO: 2700320 - RNA, 16 nt, Human
cuccugggcagcugcc

SEQ ID NO: 2700321 - RNA, 17 nt, Human
cuccugggcagcugccu

SEQ ID NO: 2700322 - RNA, 12 nt, Human
cuccugggcagc

SEQ ID NO: 2700323 - RNA, 12 nt, Human
cuccucugcuug

SEQ ID NO: 2700324 - RNA, 14 nt, Human
cuccucugcuugcc

SEQ ID NO: 2700325 - RNA, 23 nt, Human
cuccacuuggucugugagaugcu

SEQ ID NO: 2700326 - RNA, 19 nt, Human
cuccccaugauguuuagaa

SEQ ID NO: 2700327 - RNA, 18 nt, Human
cucaguagucagacugga

SEQ ID NO: 2700328 - RNA, 15 nt, Human
cuccacuuggucugu

SEQ ID NO: 2700329 - RNA, 13 nt, Human
cuccacuuggucu

SEQ ID NO: 2700330 - RNA, 22 nt, Human
cuccacuuggucugugagaugc

SEQ ID NO: 2700331 - RNA, 21 nt, Human
cuccacuuggucugugagaug

SEQ ID NO: 2700332 - RNA, 17 nt, Human
cuccacuuggucuguga

SEQ ID NO: 2700333 - RNA, 16 nt, Human
cuccacuuggucugug

SEQ ID NO: 2700334 - RNA, 22 nt, Human
cguggugauuuagcaggaagcu

SEQ ID NO: 2700335 - RNA, 18 nt, Human
cgcaggcccccaggugcc

SEQ ID NO: 2700336 - RNA, 17 nt, Human
cucaaaacugcacuguc

SEQ ID NO: 2700337 - RNA, 23 nt, Human
cucaaaauaccaugccauuuaaa

SEQ ID NO: 2700338 - RNA, 15 nt, Human
cuacaaaaacacagc

SEQ ID NO: 2700339 - RNA, 18 nt, Human
cuacaaaaacacagcaag

SEQ ID NO: 2700340 - RNA, 17 nt, Human
cuacaaaaacacagcaa

SEQ ID NO: 2700341 - RNA, 16 nt, Human
cuacaaaaacacagca

SEQ ID NO: 2700342 - RNA, 18 nt, Human
cuacauacuauggaauuu

SEQ ID NO: 2700343 - RNA, 18 nt, Human
cuacaugagguacugaga

SEQ ID NO: 2700344 - RNA, 20 nt, Human
cuacaugagguacugagagu

SEQ ID NO: 2700345 - RNA, 20 nt, Human
cuaaguaaaaccacagcagu

SEQ ID NO: 2700346 - RNA, 20 nt, Human
cgugugugugcguccugucg

SEQ ID NO: 2700347 - RNA, 23 nt, Human
cuaaguaaaaccacagcaguuga

SEQ ID NO: 2700348 - RNA, 22 nt, Human
cuaaguaaaaccacagcaguug

SEQ ID NO: 2700349 - RNA, 13 nt, Human
cuagaacucccuu

SEQ ID NO: 2700350 - RNA, 12 nt, Human
cuagaacucccu

SEQ ID NO: 2700351 - RNA, 22 nt, Human
ccugucggagcccugucuccuc

SEQ ID NO: 2700352 - RNA, 16 nt, Human
ccugucggagcccugu

SEQ ID NO: 2700353 - RNA, 17 nt, Human
ccugucggagcccuguc

SEQ ID NO: 2700354 - RNA, 21 nt, Human
ccugucggagcccugucuccu

SEQ ID NO: 2700355 - RNA, 15 nt, Human
ccuguaaucacagcu

SEQ ID NO: 2700356 - RNA, 23 nt, Human
ccucauggaauuggagcucgugg

SEQ ID NO: 2700357 - RNA, 21 nt, Human
ccucauuuuuauaaugucccu

SEQ ID NO: 2700358 - RNA, 19 nt, Human
cccugucuccucucucugu

SEQ ID NO: 2700359 - RNA, 22 nt, Human
ccauuuaaagcuuauuaaaacu

SEQ ID NO: 2700360 - RNA, 13 nt, Human
ccauacauuugug

SEQ ID NO: 2700361 - RNA, 14 nt, Human
ccauacauuugugu

SEQ ID NO: 2700362 - RNA, 18 nt, Human
ccccugcacuccagccug

SEQ ID NO: 2700363 - RNA, 17 nt, Human
ccaaauguucaucaaug

SEQ ID NO: 2700364 - RNA, 19 nt, Human
cauuuguauaaaauaauuu

SEQ ID NO: 2700365 - RNA, 20 nt, Human
cauuuguauaaaauaauuuu

SEQ ID NO: 2700366 - RNA, 17 nt, Human
cauuuguauaaaauaau

SEQ ID NO: 2700367 - RNA, 12 nt, Human
ccacagcaguug

SEQ ID NO: 2700368 - RNA, 18 nt, Human
ccacagcaguugaaaaga

SEQ ID NO: 2700369 - RNA, 17 nt, Human
ccacagcaguugaaaag

SEQ ID NO: 2700370 - RNA, 23 nt, Human
ccacagcaguugaaaagacucca

SEQ ID NO: 2700371 - RNA, 14 nt, Human
caugauguuuagaa

SEQ ID NO: 2700372 - RNA, 22 nt, Human
cagcuccccucggagaagagcu

SEQ ID NO: 2700373 - RNA, 21 nt, Human
cagcuccccucggagaagagc

SEQ ID NO: 2700374 - RNA, 12 nt, Human
cagauccuggaa

SEQ ID NO: 2700375 - RNA, 16 nt, Human
cagagguugcagugag

SEQ ID NO: 2700376 - RNA, 17 nt, Human
cagagguugcagugagc

SEQ ID NO: 2700377 - RNA, 13 nt, Human
cagcaguucagag

SEQ ID NO: 2700378 - RNA, 20 nt, Human
cagucugacuguuuccauca

SEQ ID NO: 2700379 - RNA, 19 nt, Human
cagucaccucauggaauug

SEQ ID NO: 2700380 - RNA, 15 nt, Human
cagucacauuccaag

SEQ ID NO: 2700381 - RNA, 16 nt, Human
cagucaccucauggaa

SEQ ID NO: 2700382 - RNA, 19 nt, Human
caggugccaguuauggcua

SEQ ID NO: 2700383 - RNA, 20 nt, Human
auuucuaugaaauauuaugu

SEQ ID NO: 2700384 - RNA, 15 nt, Human
auuucuaugaaauau

SEQ ID NO: 2700385 - RNA, 18 nt, Human
auuucuaugaaauauuau

SEQ ID NO: 2700386 - RNA, 19 nt, Human
auuguuuaaaaucauuucu

SEQ ID NO: 2700387 - RNA, 13 nt, Human
auuguaaaauggu

SEQ ID NO: 2700388 - RNA, 17 nt, Human
auuguaaaugugcuuuu

SEQ ID NO: 2700389 - RNA, 15 nt, Human
auuguaaaugugcuu

SEQ ID NO: 2700390 - RNA, 14 nt, Human
auuguaaaugugcu

SEQ ID NO: 2700391 - RNA, 18 nt, Human
auucacaagacccaaaag

SEQ ID NO: 2700392 - RNA, 18 nt, Human
auugacuuuuuauggcac

SEQ ID NO: 2700393 - RNA, 17 nt, Human
auucuugccaaauauaa

SEQ ID NO: 2700394 - RNA, 15 nt, Human
caacacgagcaggcu

SEQ ID NO: 2700395 - RNA, 21 nt, Human
caacuaucucauuuccaagca

SEQ ID NO: 2700396 - RNA, 19 nt, Human
caacccaaauguucaucaa

SEQ ID NO: 2700397 - RNA, 20 nt, Human
cacuuggucugugagaugcu

SEQ ID NO: 2700398 - RNA, 17 nt, Human
cacuuggucugugagau

SEQ ID NO: 2700399 - RNA, 23 nt, Human
caccucaaaauaccaugccauuu

SEQ ID NO: 2700400 - RNA, 21 nt, Human
caccuacaugagguacugaga

SEQ ID NO: 2700401 - RNA, 13 nt, Human
caccuugcagcuc

SEQ ID NO: 2700402 - RNA, 15 nt, Human
caccuugcagcucuc

SEQ ID NO: 2700403 - RNA, 22 nt, Human
caccuugcagcucuccccuucu

SEQ ID NO: 2700404 - RNA, 14 nt, Human
caaguauuagaaua

SEQ ID NO: 2700405 - RNA, 20 nt, Human
caaguauuagaauaccacag

SEQ ID NO: 2700406 - RNA, 12 nt, Human
caauauuucaga

SEQ ID NO: 2700407 - RNA, 20 nt, Human
caauauuucagauaaucaca

SEQ ID NO: 2700408 - RNA, 21 nt, Human
caauauuucagauaaucacaa

SEQ ID NO: 2700409 - RNA, 14 nt, Human
caaugcuguauuuu

SEQ ID NO: 2700410 - RNA, 23 nt, Human
caaugcuguauuuuaaaagaaug

SEQ ID NO: 2700411 - RNA, 12 nt, Human
caauuuaaaaaa

SEQ ID NO: 2700412 - RNA, 16 nt, Human
cacaagacugcacauc

SEQ ID NO: 2700413 - RNA, 18 nt, Human
gaaaagacuccaaagaaa

SEQ ID NO: 2700414 - RNA, 20 nt, Human
gaaaagacuccaaagaaaug

SEQ ID NO: 2700415 - RNA, 21 nt, Human
gaaaagacuccaaagaaaugu

SEQ ID NO: 2700416 - RNA, 23 nt, Human
gaaacuucagcgguuuauauaag

SEQ ID NO: 2700417 - RNA, 16 nt, Human
gaaaucaaauaugcaa

SEQ ID NO: 2700418 - RNA, 21 nt, Human
gaaaucaaauaugcaaagcac

SEQ ID NO: 2700419 - RNA, 17 nt, Human
gaaaucaaauaugcaaa

SEQ ID NO: 2700420 - RNA, 17 nt, Human
gaaaugaaagcagggac

SEQ ID NO: 2700421 - RNA, 23 nt, Human
gaaaucaaauaugcaaagcacug

SEQ ID NO: 2700422 - RNA, 18 nt, Human
gaaaugaaagcagggacu

SEQ ID NO: 2700423 - RNA, 18 nt, Human
gaacaaauuuacagagac

SEQ ID NO: 2700424 - RNA, 17 nt, Human
gaacaaauuuacagaga

SEQ ID NO: 2700425 - RNA, 23 nt, Human
gaacaaauuuacagagacagaaa

SEQ ID NO: 2700426 - RNA, 22 nt, Human
cuucucuguauuccuagaaacu

SEQ ID NO: 2700427 - RNA, 23 nt, Human
cuuggucucagugucaaugcagc

SEQ ID NO: 2700428 - RNA, 23 nt, Human
cuggaaaaguauguuagugcaaa

SEQ ID NO: 2700429 - RNA, 21 nt, Human
cugccuccccuccucugcuug

SEQ ID NO: 2700430 - RNA, 19 nt, Human
cugccuccccuccucugcu

SEQ ID NO: 2700431 - RNA, 20 nt, Human
cugccuccccuccucugcuu

SEQ ID NO: 2700432 - RNA, 17 nt, Human
cugccuccccuccucug

SEQ ID NO: 2700433 - RNA, 18 nt, Human
cugccuccccuccucugc

SEQ ID NO: 2700434 - RNA, 14 nt, Human
cugccuccccuccu

SEQ ID NO: 2700435 - RNA, 23 nt, Human
cugugagaugcuagaacucccuu

SEQ ID NO: 2700436 - RNA, 21 nt, Human
cugugagaugcuagaacuccc

SEQ ID NO: 2700437 - RNA, 19 nt, Human
cuguucacagccagacugg

SEQ ID NO: 2700438 - RNA, 12 nt, Human
cuguucacagcc

SEQ ID NO: 2700439 - RNA, 22 nt, Human
cuguucacagccagacuggcac

SEQ ID NO: 2700440 - RNA, 12 nt, Human
cuuaaaaauggu

SEQ ID NO: 2700441 - RNA, 20 nt, Human
cuuaaaaaugguuuaaaugg

SEQ ID NO: 2700442 - RNA, 13 nt, Human
cuuaaaaaugguu

SEQ ID NO: 2700443 - RNA, 20 nt, Human
cuguaagaaaauaucacuug

SEQ ID NO: 2700444 - RNA, 14 nt, Human
gacgcucucuggcc

SEQ ID NO: 2700445 - RNA, 12 nt, Human
gacagcucugca

SEQ ID NO: 2700446 - RNA, 18 nt, Human
gacagucaccucauggaa

SEQ ID NO: 2700447 - RNA, 14 nt, Human
gaaugaauggcuaa

SEQ ID NO: 2700448 - RNA, 20 nt, Human
gaaugaauggcuaagcaaaa

SEQ ID NO: 2700449 - RNA, 15 nt, Human
gaaugaauggcuaag

SEQ ID NO: 2700450 - RNA, 14 nt, Human
gaaugauuaugaau

SEQ ID NO: 2700451 - RNA, 22 nt, Human
gaaugauuaugaauuacauuug

SEQ ID NO: 2700452 - RNA, 15 nt, Human
gaauuaacacaugau

SEQ ID NO: 2700453 - RNA, 14 nt, Human
gaauuaacacauga

SEQ ID NO: 2700454 - RNA, 13 nt, Human
gaauuacauuugu

SEQ ID NO: 2700455 - RNA, 15 nt, Human
gaauuacauuuguau

SEQ ID NO: 2700456 - RNA, 18 nt, Human
gaauuacauuuguauaaa

SEQ ID NO: 2700457 - RNA, 20 nt, Human
gaauuacauuuguauaaaau

SEQ ID NO: 2700458 - RNA, 22 nt, Human
gacuuuuuauggcacuaguauu

SEQ ID NO: 2700459 - RNA, 20 nt, Human
gagaugcuagaacucccuuu

SEQ ID NO: 2700460 - RNA, 16 nt, Human
gagaugcuagaacucc

SEQ ID NO: 2700461 - RNA, 21 nt, Human
gagauugugccccugcacucc

SEQ ID NO: 2700462 - RNA, 18 nt, Human
gaggcugagaugggagaa

SEQ ID NO: 2700463 - RNA, 17 nt, Human
gaggcuccacuuggucu

SEQ ID NO: 2700464 - RNA, 12 nt, Human
gaggcuccacuu

SEQ ID NO: 2700465 - RNA, 15 nt, Human
gaggcuccacuuggu

SEQ ID NO: 2700466 - RNA, 14 nt, Human
gaggagaaacugga

SEQ ID NO: 2700467 - RNA, 12 nt, Human
gaggagaaacug

SEQ ID NO: 2700468 - RNA, 20 nt, Human
gaggacgcucucuggccuuc

SEQ ID NO: 2700469 - RNA, 21 nt, Human
gaggacgcucucuggccuucg

SEQ ID NO: 2700470 - RNA, 16 nt, Human
gagccccacccucaga

SEQ ID NO: 2700471 - RNA, 17 nt, Human
gagccccacccucagau

SEQ ID NO: 2700472 - RNA, 14 nt, Human
gagcagucaggaaa

SEQ ID NO: 2700473 - RNA, 20 nt, Human
gagcuguucacagccagacu

SEQ ID NO: 2700474 - RNA, 17 nt, Human
gagcuguucacagccag

SEQ ID NO: 2700475 - RNA, 22 nt, Human
gagcuguucacagccagacugg

SEQ ID NO: 2700476 - RNA, 13 nt, Human
gcagugaugucac

SEQ ID NO: 2700477 - RNA, 22 nt, Human
gcaguuguugcccacagcugua

SEQ ID NO: 2700478 - RNA, 20 nt, Human
gcaucuagcaugucgucaaa

SEQ ID NO: 2700479 - RNA, 15 nt, Human
gcagcucuccccuuc

SEQ ID NO: 2700480 - RNA, 22 nt, Human
gcagaacagugauuaccaggga

SEQ ID NO: 2700481 - RNA, 18 nt, Human
gcagaacagugauuacca

SEQ ID NO: 2700482 - RNA, 13 nt, Human
gcagaacagugau

SEQ ID NO: 2700483 - RNA, 12 nt, Human
gcagaacaguga

SEQ ID NO: 2700484 - RNA, 14 nt, Human
gcugccuccccucc

SEQ ID NO: 2700485 - RNA, 13 nt, Human
gcugcugaaacaa

SEQ ID NO: 2700486 - RNA, 21 nt, Human
gcuguauuuuaaaagaaugau

SEQ ID NO: 2700487 - RNA, 20 nt, Human
gcuguauuuuaaaagaauga

SEQ ID NO: 2700488 - RNA, 18 nt, Human
gcuguauuuuaaaagaau

SEQ ID NO: 2700489 - RNA, 19 nt, Human
ggaaaucaggguuaguauu

SEQ ID NO: 2700490 - RNA, 17 nt, Human
ggacagucaccucaugg

SEQ ID NO: 2700491 - RNA, 18 nt, Human
ggacagucaccucaugga

SEQ ID NO: 2700492 - RNA, 21 nt, Human
ggacagucaccucauggaauu

SEQ ID NO: 2700493 - RNA, 16 nt, Human
ggaaaaaauaacaaug

SEQ ID NO: 2700494 - RNA, 13 nt, Human
ggaaacugccagc

SEQ ID NO: 2700495 - RNA, 12 nt, Human
gcauuuagaugu

SEQ ID NO: 2700496 - RNA, 19 nt, Human
gcauuuaggccaugggaca

SEQ ID NO: 2700497 - RNA, 13 nt, Human
gcauuuagaugua

SEQ ID NO: 2700498 - RNA, 11 nt, Human
gccccaaaagg

SEQ ID NO: 2700499 - RNA, 14 nt, Human
gccuccauccugag

SEQ ID NO: 2700500 - RNA, 13 nt, Human
gccuccauccuga

SEQ ID NO: 2700501 - RNA, 22 nt, Human
gccucauguccacugguucuuc

SEQ ID NO: 2700502 - RNA, 23 nt, Human
gccuucggccuccauccugaggc

SEQ ID NO: 2700503 - RNA, 13 nt, Human
aaaaauacaaaaa

SEQ ID NO: 2700504 - RNA, 20 nt, Human
ggcuaagcuucacuguaaaa

SEQ ID NO: 2700505 - RNA, 16 nt, Human
ggccuucggccuccau

SEQ ID NO: 2700506 - RNA, 18 nt, Human
ggccuucggccuccaucc

SEQ ID NO: 2700507 - RNA, 19 nt, Human
gguuuuauuguuuaaaauc

SEQ ID NO: 2700508 - RNA, 17 nt, Human
aaaguauguuagugcaa

SEQ ID NO: 2700509 - RNA, 13 nt, Human
aaagcuuauuaaa

SEQ ID NO: 2700510 - RNA, 20 nt, Human
aaagggcuguuauaaucuuu

SEQ ID NO: 2700511 - RNA, 22 nt, Human
aaagggcuguuauaaucuuuca

SEQ ID NO: 2700512 - RNA, 16 nt, Human
aaagcagaacagugau

SEQ ID NO: 2700513 - RNA, 19 nt, Human
aaacuuuaugcuaagugaa

SEQ ID NO: 2700514 - RNA, 12 nt, Human
aaacuuuaugcu

SEQ ID NO: 2700515 - RNA, 13 nt, Human
guaauaaacucau

SEQ ID NO: 2700516 - RNA, 22 nt, Human
aaauaucacuugucaauaaaau

SEQ ID NO: 2700517 - RNA, 18 nt, Human
aaauauaugcuaagucuu

SEQ ID NO: 2700518 - RNA, 21 nt, Human
aaauaccaugccauuuaaagc

SEQ ID NO: 2700519 - RNA, 17 nt, Human
aaauaugcaaagcacug

SEQ ID NO: 2700520 - RNA, 16 nt, Human
aaauaugcaaagcacu

SEQ ID NO: 2700521 - RNA, 15 nt, Human
aaauaugcaaagcac

SEQ ID NO: 2700522 - RNA, 13 nt, Human
aaauaugcaaagc

SEQ ID NO: 2700523 - RNA, 20 nt, Human
ggguuuuauuguuuaaaauc

SEQ ID NO: 2700524 - RNA, 14 nt, Human
ggucagugcaaaua

SEQ ID NO: 2700525 - RNA, 14 nt, Human
aaaauacacacuca

SEQ ID NO: 2700526 - RNA, 16 nt, Human
aaaauaauuuuuauau

SEQ ID NO: 2700527 - RNA, 17 nt, Human
aaaauaauuuuuauauu

SEQ ID NO: 2700528 - RNA, 11 nt, Human
aaaauaauuuu

SEQ ID NO: 2700529 - RNA, 17 nt, Human
aaaaucucaauauuuca

SEQ ID NO: 2700530 - RNA, 16 nt, Human
aaaauggguuuuacug

SEQ ID NO: 2700531 - RNA, 18 nt, Human
aaaaugguuuaaaugguc

SEQ ID NO: 2700532 - RNA, 16 nt, Human
aaaaugguuuaaaugg

SEQ ID NO: 2700533 - RNA, 17 nt, Human
aagggcuguuauaaucu

SEQ ID NO: 2700534 - RNA, 17 nt, Human
aaggggaauugaggaca

SEQ ID NO: 2700535 - RNA, 15 nt, Human
aagggcuguuauaau

SEQ ID NO: 2700536 - RNA, 14 nt, Human
guuuaugauuccac

SEQ ID NO: 2700537 - RNA, 18 nt, Human
aaguauguuagugcaaau

SEQ ID NO: 2700538 - RNA, 19 nt, Human
aaguauguuagugcaaauu

SEQ ID NO: 2700539 - RNA, 9 nt, Human
uaaaauggu

SEQ ID NO: 2700540 - RNA, 22 nt, Human
uaaaauaauuuuuauauuugaa

SEQ ID NO: 2700541 - RNA, 21 nt, Human
uaaaauacacacucaaaucaa

SEQ ID NO: 2700542 - RNA, 13 nt, Human
uaaaagaauauuu

SEQ ID NO: 2700543 - RNA, 21 nt, Human
uaaaaaaaaaccugagcccca

SEQ ID NO: 2700544 - RNA, 15 nt, Human
uaaaaccacagcagu

SEQ ID NO: 2700545 - RNA, 14 nt, Human
uaaaaccacagcag

SEQ ID NO: 2700546 - RNA, 16 nt, Human
aagcacuaaacaaaga

SEQ ID NO: 2700547 - RNA, 17 nt, Human
aagcacugacuucuaag

SEQ ID NO: 2700548 - RNA, 16 nt, Human
aagcacugacuucuaa

SEQ ID NO: 2700549 - RNA, 19 nt, Human
aagcauuguaaaugugcuu

SEQ ID NO: 2700550 - RNA, 20 nt, Human
aagcacugacuucuaaguaa

SEQ ID NO: 2700551 - RNA, 19 nt, Human
aagcacugacuucuaagua

SEQ ID NO: 2700552 - RNA, 18 nt, Human
aagcauuguaaaugugcu

SEQ ID NO: 2700553 - RNA, 17 nt, Human
aagcaacccaaauguuc

SEQ ID NO: 2700554 - RNA, 22 nt, Human
gugucuuaauuaaaagaauauu

SEQ ID NO: 2700555 - RNA, 15 nt, Human
aagauagcagggcau

SEQ ID NO: 2700556 - RNA, 19 nt, Human
guuauuauauuuacaaaug

SEQ ID NO: 2700557 - RNA, 17 nt, Human
guuauuauauuuacaaa

SEQ ID NO: 2700558 - RNA, 21 nt, Human
aagccuuggggcugaugcagu

SEQ ID NO: 2700559 - RNA, 18 nt, Human
guucccuugaugaagaag

SEQ ID NO: 2700560 - RNA, 18 nt, Human
aagcuuauuaaaacucau

SEQ ID NO: 2700561 - RNA, 15 nt, Human
aaaugugcuuuuaaa

SEQ ID NO: 2700562 - RNA, 18 nt, Human
aaaugugccuucauuuuu

SEQ ID NO: 2700563 - RNA, 17 nt, Human
aaauuguauuacaaauc

SEQ ID NO: 2700564 - RNA, 17 nt, Human
aaauuccaagugauuga

SEQ ID NO: 2700565 - RNA, 14 nt, Human
gucaggaaagagaa

SEQ ID NO: 2700566 - RNA, 13 nt, Human
gucaggaaagaga

SEQ ID NO: 2700567 - RNA, 20 nt, Human
gucacaggaaguagaggagg

SEQ ID NO: 2700568 - RNA, 15 nt, Human
gucacaggaaguaga

SEQ ID NO: 2700569 - RNA, 13 nt, Human
gucacaggaagua

SEQ ID NO: 2700570 - RNA, 21 nt, Human
gucaauuuuguuauguauauu

SEQ ID NO: 2700571 - RNA, 13 nt, Human
aacagucucagga

SEQ ID NO: 2700572 - RNA, 14 nt, Human
aacauaaaauacaa

SEQ ID NO: 2700573 - RNA, 14 nt, Human
aacagucucaggaa

SEQ ID NO: 2700574 - RNA, 12 nt, Human
aacauauauaac

SEQ ID NO: 2700575 - RNA, 18 nt, Human
aacacagcaagggugaug

SEQ ID NO: 2700576 - RNA, 20 nt, Human
aacacagcaagggugauggg

SEQ ID NO: 2700577 - RNA, 17 nt, Human
aacacaacuauauuguu

SEQ ID NO: 2700578 - RNA, 23 nt, Human
guccaugaagauguagaggagaa

SEQ ID NO: 2700579 - RNA, 22 nt, Human
guccaugaagauguagaggaga

SEQ ID NO: 2700580 - RNA, 13 nt, Human
aacuucagacaua

SEQ ID NO: 2700581 - RNA, 18 nt, Human
aacuucagcgguuuauau

SEQ ID NO: 2700582 - RNA, 22 nt, Human
aacuuccuuggacucauuuuaa

SEQ ID NO: 2700583 - RNA, 23 nt, Human
aacuuccuuggacucauuuuaaa

SEQ ID NO: 2700584 - RNA, 16 nt, Human
gugauuaccagggacu

SEQ ID NO: 2700585 - RNA, 11 nt, Human
gugauuaccag

SEQ ID NO: 2700586 - RNA, 17 nt, Human
gugauuaccagggacug

SEQ ID NO: 2700587 - RNA, 18 nt, Human
gugcacgcacacugucug

SEQ ID NO: 2700588 - RNA, 22 nt, Human
gugcuacaaaaacacagcaagg

SEQ ID NO: 2700589 - RNA, 21 nt, Human
gugcuacaaaaacacagcaag

SEQ ID NO: 2700590 - RNA, 16 nt, Human
aagaaagaaaaucagg

SEQ ID NO: 2700591 - RNA, 13 nt, Human
aagaaagaaaauc

SEQ ID NO: 2700592 - RNA, 14 nt, Human
aagaaagaaaauca

SEQ ID NO: 2700593 - RNA, 11 nt, Human
aagaaacauuu

SEQ ID NO: 2700594 - RNA, 19 nt, Human
gucuuauauauuguagaua

SEQ ID NO: 2700595 - RNA, 14 nt, Human
gucuuaauuaaaag

SEQ ID NO: 2700596 - RNA, 21 nt, Human
aacucauuuuuguuuucauua

SEQ ID NO: 2700597 - RNA, 24 nt, Human
aacucauuuuuguuuucauuaucu

SEQ ID NO: 2700598 - RNA, 15 nt, Human
uagggagagaagaua

SEQ ID NO: 2700599 - RNA, 14 nt, Human
uagggagagaagau

SEQ ID NO: 2700600 - RNA, 18 nt, Human
uaggaaauauuuauuuua

SEQ ID NO: 2700601 - RNA, 19 nt, Human
uaggaaauauuuauuuuaa

SEQ ID NO: 2700602 - RNA, 12 nt, Human
uaggagcaugag

SEQ ID NO: 2700603 - RNA, 23 nt, Human
acaauacaucccuuaccugggaa

SEQ ID NO: 2700604 - RNA, 13 nt, Human
acaagacugcaca

SEQ ID NO: 2700605 - RNA, 14 nt, Human
acaagacugcacau

SEQ ID NO: 2700606 - RNA, 18 nt, Human
acaaaaggauaaugaaua

SEQ ID NO: 2700607 - RNA, 19 nt, Human
uagaggagaaacuggaacu

SEQ ID NO: 2700608 - RNA, 22 nt, Human
uagaggagaaacuggaacucuc

SEQ ID NO: 2700609 - RNA, 15 nt, Human
uagaugcaguucuga

SEQ ID NO: 2700610 - RNA, 20 nt, Human
acaagacccaaaaggcagaa

SEQ ID NO: 2700611 - RNA, 19 nt, Human
acaaauuuacagagacaga

SEQ ID NO: 2700612 - RNA, 18 nt, Human
acaaauuuacagagacag

SEQ ID NO: 2700613 - RNA, 22 nt, Human
uagugaaacucguuaauuugua

SEQ ID NO: 2700614 - RNA, 23 nt, Human
uaguguuggagaagaacugaaau

SEQ ID NO: 2700615 - RNA, 15 nt, Human
acacacucaaaucaa

SEQ ID NO: 2700616 - RNA, 18 nt, Human
acaaugcuguauuuuaaa

SEQ ID NO: 2700617 - RNA, 22 nt, Human
acaaugcuguauuuuaaaagaa

SEQ ID NO: 2700618 - RNA, 19 nt, Human
acacucaaaucaagaaacu

SEQ ID NO: 2700619 - RNA, 14 nt, Human
acacuaagagagaa

SEQ ID NO: 2700620 - RNA, 13 nt, Human
acacuaagagaga

SEQ ID NO: 2700621 - RNA, 18 nt, Human
acacaugauccugcaauu

SEQ ID NO: 2700622 - RNA, 15 nt, Human
acacaugaaguccaa

SEQ ID NO: 2700623 - RNA, 15 nt, Human
acacaucagcuugcc

SEQ ID NO: 2700624 - RNA, 17 nt, Human
uaucucaaaacugcacu

SEQ ID NO: 2700625 - RNA, 15 nt, Human
uauauuguuugcuaa

SEQ ID NO: 2700626 - RNA, 19 nt, Human
uauaauuuugugaagcaaa

SEQ ID NO: 2700627 - RNA, 16 nt, Human
acagccucuuagaugc

SEQ ID NO: 2700628 - RNA, 19 nt, Human
uaugccccauucaacaucu

SEQ ID NO: 2700629 - RNA, 15 nt, Human
uaugccccauucaac

SEQ ID NO: 2700630 - RNA, 21 nt, Human
uaugauuaaguaaugauaacu

SEQ ID NO: 2700631 - RNA, 16 nt, Human
uaugauuaaguaauga

SEQ ID NO: 2700632 - RNA, 20 nt, Human
uaugauuaaguaaugauaac

SEQ ID NO: 2700633 - RNA, 21 nt, Human
acagggaggacgcucucuggc

SEQ ID NO: 2700634 - RNA, 20 nt, Human
acagggaggacgcucucugg

SEQ ID NO: 2700635 - RNA, 17 nt, Human
acagucaccucauggaa

SEQ ID NO: 2700636 - RNA, 18 nt, Human
acagucaccucauggaau

SEQ ID NO: 2700637 - RNA, 16 nt, Human
acagucaccucaugga

SEQ ID NO: 2700638 - RNA, 14 nt, Human
uauuacuguaagaa

SEQ ID NO: 2700639 - RNA, 15 nt, Human
uauucaaacagucuc

SEQ ID NO: 2700640 - RNA, 23 nt, Human
uauucaaacagucucaggaaauc

SEQ ID NO: 2700641 - RNA, 17 nt, Human
acaggaaguagaggagg

SEQ ID NO: 2700642 - RNA, 22 nt, Human
acaggaaccacaagacugcaca

SEQ ID NO: 2700643 - RNA, 21 nt, Human
uauguuuucaggcuagaugua

SEQ ID NO: 2700644 - RNA, 16 nt, Human
uauuaaaacucauuuu

SEQ ID NO: 2700645 - RNA, 22 nt, Human
aauugacccacaagaaaugaaa

SEQ ID NO: 2700646 - RNA, 21 nt, Human
aauugacccacaagaaaugaa

SEQ ID NO: 2700647 - RNA, 14 nt, Human
uacuguaagaaaau

SEQ ID NO: 2700648 - RNA, 22 nt, Human
aauuccacuuauaggaauugac

SEQ ID NO: 2700649 - RNA, 18 nt, Human
aauuccaagugauugaaa

SEQ ID NO: 2700650 - RNA, 16 nt, Human
aaugcuguauuuuaaa

SEQ ID NO: 2700651 - RNA, 14 nt, Human
uacacuaagagaga

SEQ ID NO: 2700652 - RNA, 18 nt, Human
uacacuaagagagaauga

SEQ ID NO: 2700653 - RNA, 20 nt, Human
uacaucccuuaccugggaaa

SEQ ID NO: 2700654 - RNA, 18 nt, Human
uaccaccagucugacugu

SEQ ID NO: 2700655 - RNA, 23 nt, Human
aaucgcuccaccuugcagcucuc

SEQ ID NO: 2700656 - RNA, 19 nt, Human
aaucuuauaauuuaaaaua

SEQ ID NO: 2700657 - RNA, 19 nt, Human
aaucuacacuccagugaga

SEQ ID NO: 2700658 - RNA, 19 nt, Human
uaaguaaugauaacuggaa

SEQ ID NO: 2700659 - RNA, 16 nt, Human
uaagcuuguauuccuu

SEQ ID NO: 2700660 - RNA, 12 nt, Human
uaauaaacucau

SEQ ID NO: 2700661 - RNA, 12 nt, Human
aaucaugaauua

SEQ ID NO: 2700662 - RNA, 15 nt, Human
aaucaugaauuaguu

SEQ ID NO: 2700663 - RNA, 22 nt, Human
aaugaauggcuaagcaaaaugu

SEQ ID NO: 2700664 - RNA, 18 nt, Human
aauauuuauuuuaauaau

SEQ ID NO: 2700665 - RNA, 19 nt, Human
aauauuuauuuuaauaaug

SEQ ID NO: 2700666 - RNA, 21 nt, Human
aauaugccccauucaacaucu

SEQ ID NO: 2700667 - RNA, 24 nt, Human
aauaugccccauucaacaucuagu

SEQ ID NO: 2700668 - RNA, 22 nt, Human
aaucaggguuaguauuguccag

SEQ ID NO: 2700669 - RNA, 16 nt, Human
aaucaggguuaguauu

SEQ ID NO: 2700670 - RNA, 21 nt, Human
aaucaggguuaguauugucca

SEQ ID NO: 2700671 - RNA, 20 nt, Human
aauaucacuugucaauaaaa

SEQ ID NO: 2700672 - RNA, 22 nt, Human
aauaucacuugucaauaaaauc

SEQ ID NO: 2700673 - RNA, 16 nt, Human
aauagucaaauugugu

SEQ ID NO: 2700674 - RNA, 18 nt, Human
uaagaagugaaaaucuac

SEQ ID NO: 2700675 - RNA, 20 nt, Human
uaacgauaaaagacagugaa

SEQ ID NO: 2700676 - RNA, 14 nt, Human
accagucugacugu

SEQ ID NO: 2700677 - RNA, 23 nt, Human
ucacuugaacccgggaggcagag

SEQ ID NO: 2700678 - RNA, 12 nt, Human
ucaccucaugga

SEQ ID NO: 2700679 - RNA, 13 nt, Human
ucaccucauggaa

SEQ ID NO: 2700680 - RNA, 14 nt, Human
ucaccucauggaau

SEQ ID NO: 2700681 - RNA, 21 nt, Human
ucacaacagauuauuaccuua

SEQ ID NO: 2700682 - RNA, 16 nt, Human
ucaauucuugccaaau

SEQ ID NO: 2700683 - RNA, 22 nt, Human
ucaauaucuuuuuuuuaauaaa

SEQ ID NO: 2700684 - RNA, 23 nt, Human
ucaaugaaugaaugaauggcuaa

SEQ ID NO: 2700685 - RNA, 15 nt, Human
ucaauauuucagaua

SEQ ID NO: 2700686 - RNA, 19 nt, Human
ucaauauuucagauaauca

SEQ ID NO: 2700687 - RNA, 23 nt, Human
accaaaaaucucaauauuucaga

SEQ ID NO: 2700688 - RNA, 18 nt, Human
ucaaauugugugaaaggu

SEQ ID NO: 2700689 - RNA, 15 nt, Human
ucaaauugugugaaa

SEQ ID NO: 2700690 - RNA, 23 nt, Human
acaugagguacugagagugaaca

SEQ ID NO: 2700691 - RNA, 16 nt, Human
acaugaaguccaagca

SEQ ID NO: 2700692 - RNA, 20 nt, Human
acaugagguacugagaguga

SEQ ID NO: 2700693 - RNA, 16 nt, Human
acaugagguacugaga

SEQ ID NO: 2700694 - RNA, 21 nt, Human
acaugggacauuugcucaugg

SEQ ID NO: 2700695 - RNA, 15 nt, Human
acaugggacauuugc

SEQ ID NO: 2700696 - RNA, 20 nt, Human
acaugggacauuugcucaug

SEQ ID NO: 2700697 - RNA, 11 nt, Human
acaugggacau

SEQ ID NO: 2700698 - RNA, 14 nt, Human
acaugggacauuug

SEQ ID NO: 2700699 - RNA, 17 nt, Human
ucaguuuuugugaaaag

SEQ ID NO: 2700700 - RNA, 15 nt, Human
ucaguuuuugugaaa

SEQ ID NO: 2700701 - RNA, 16 nt, Human
accuagggugauauua

SEQ ID NO: 2700702 - RNA, 17 nt, Human
acccgggaggcagaggu

SEQ ID NO: 2700703 - RNA, 15 nt, Human
acccgggaggcagag

SEQ ID NO: 2700704 - RNA, 14 nt, Human
ucagcccucagaau

SEQ ID NO: 2700705 - RNA, 19 nt, Human
acuccagugagacagcucu

SEQ ID NO: 2700706 - RNA, 21 nt, Human
acucuuaagaagacugcauua

SEQ ID NO: 2700707 - RNA, 16 nt, Human
uccuggaaaucagggu

SEQ ID NO: 2700708 - RNA, 17 nt, Human
acugagaugugaacaca

SEQ ID NO: 2700709 - RNA, 22 nt, Human
acugagaugugaacacaucagc

SEQ ID NO: 2700710 - RNA, 18 nt, Human
acugagagugaacaaauu

SEQ ID NO: 2700711 - RNA, 22 nt, Human
acugacuucuaaguaaaaccac

SEQ ID NO: 2700712 - RNA, 16 nt, Human
acugacuucuaaguaa

SEQ ID NO: 2700713 - RNA, 15 nt, Human
acugacuucuaagua

SEQ ID NO: 2700714 - RNA, 13 nt, Human
acugacuucuaag

SEQ ID NO: 2700715 - RNA, 17 nt, Human
acugacucuuaagaaga

SEQ ID NO: 2700716 - RNA, 18 nt, Human
acugacucuuaagaagac

SEQ ID NO: 2700717 - RNA, 20 nt, Human
acugacucuuaagaagacug

SEQ ID NO: 2700718 - RNA, 13 nt, Human
acugacucuuaag

SEQ ID NO: 2700719 - RNA, 14 nt, Human
acugacucuuaaga

SEQ ID NO: 2700720 - RNA, 15 nt, Human
acugacucuuaagaa

SEQ ID NO: 2700721 - RNA, 16 nt, Human
acugacucuuaagaag

SEQ ID NO: 2700722 - RNA, 12 nt, Human
acugaagaagca

SEQ ID NO: 2700723 - RNA, 19 nt, Human
accuugaaaacuuuaugcu

SEQ ID NO: 2700724 - RNA, 22 nt, Human
uccacugguucuucuuggucuc

SEQ ID NO: 2700725 - RNA, 20 nt, Human
accuuuuggucuggagggaa

SEQ ID NO: 2700726 - RNA, 14 nt, Human
acgcucucuggccu

SEQ ID NO: 2700727 - RNA, 11 nt, Human
acgcucucugg

SEQ ID NO: 2700728 - RNA, 18 nt, Human
uccagugagacagcucug

SEQ ID NO: 2700729 - RNA, 15 nt, Human
uccauccugaggcuc

SEQ ID NO: 2700730 - RNA, 12 nt, Human
uccauccugagg

SEQ ID NO: 2700731 - RNA, 11 nt, Human
uccauccugag

SEQ ID NO: 2700732 - RNA, 15 nt, Human
acuaauuuuaaaaug

SEQ ID NO: 2700733 - RNA, 16 nt, Human
acuaucucauuuccaa

SEQ ID NO: 2700734 - RNA, 17 nt, Human
acuaucucauuuccaag

SEQ ID NO: 2700735 - RNA, 15 nt, Human
acuaucucauuucca

SEQ ID NO: 2700736 - RNA, 22 nt, Human
acuauauuguuugcuaagcauu

SEQ ID NO: 2700737 - RNA, 17 nt, Human
acuauauuguuugcuaa

SEQ ID NO: 2700738 - RNA, 23 nt, Human
ucucaggaaaucaaauaugcaaa

SEQ ID NO: 2700739 - RNA, 21 nt, Human
ucucaggaaaucaaauaugca

SEQ ID NO: 2700740 - RNA, 14 nt, Human
ucucaggaaaucaa

SEQ ID NO: 2700741 - RNA, 15 nt, Human
ucucauuuccaagca

SEQ ID NO: 2700742 - RNA, 15 nt, Human
acuugucaauaaaau

SEQ ID NO: 2700743 - RNA, 16 nt, Human
ucuaggaaauauuuau

SEQ ID NO: 2700744 - RNA, 17 nt, Human
ucuaggaaauauuuauu

SEQ ID NO: 2700745 - RNA, 12 nt, Human
uccugggcagcu

SEQ ID NO: 2700746 - RNA, 13 nt, Human
uccugggcagcug

SEQ ID NO: 2700747 - RNA, 14 nt, Human
uccugggcagcugc

SEQ ID NO: 2700748 - RNA, 20 nt, Human
ucuaaguaaaaccacagcag

SEQ ID NO: 2700749 - RNA, 19 nt, Human
ucuaaguaaaaccacagca

SEQ ID NO: 2700750 - RNA, 15 nt, Human
ucuaaguaaaaccac

SEQ ID NO: 2700751 - RNA, 14 nt, Human
ucuaaguaaaacca

SEQ ID NO: 2700752 - RNA, 23 nt, Human
agaauuaacacaugauccugcaa

SEQ ID NO: 2700753 - RNA, 15 nt, Human
agaauuaacacauga

SEQ ID NO: 2700754 - RNA, 22 nt, Human
ucugugagaugcuagaacuccc

SEQ ID NO: 2700755 - RNA, 17 nt, Human
ucugugagaugcuagaa

SEQ ID NO: 2700756 - RNA, 23 nt, Human
ucugugagaugcuagaacucccu

SEQ ID NO: 2700757 - RNA, 14 nt, Human
ucugugagaugcua

SEQ ID NO: 2700758 - RNA, 24 nt, Human
agacagagccccacccucagaugc

SEQ ID NO: 2700759 - RNA, 22 nt, Human
agacagagccccacccucagau

SEQ ID NO: 2700760 - RNA, 12 nt, Human
agacacacauga

SEQ ID NO: 2700761 - RNA, 15 nt, Human
agacacacaugaagu

SEQ ID NO: 2700762 - RNA, 15 nt, Human
ucugcagauaaacag

SEQ ID NO: 2700763 - RNA, 18 nt, Human
ucugcagauaaacaguag

SEQ ID NO: 2700764 - RNA, 13 nt, Human
agaagaacugaaa

SEQ ID NO: 2700765 - RNA, 14 nt, Human
agaagaacugaaau

SEQ ID NO: 2700766 - RNA, 18 nt, Human
agaagaugguaccaccag

SEQ ID NO: 2700767 - RNA, 16 nt, Human
ucugcuugccaucccu

SEQ ID NO: 2700768 - RNA, 17 nt, Human
ucugcuugccaucccuc

SEQ ID NO: 2700769 - RNA, 20 nt, Human
ucugcuugccaucccucccu

SEQ ID NO: 2700770 - RNA, 23 nt, Human
ucugcuugccaucccucccucca

SEQ ID NO: 2700771 - RNA, 13 nt, Human
agauccuggaaau

SEQ ID NO: 2700772 - RNA, 14 nt, Human
agauccuggaaauc

SEQ ID NO: 2700773 - RNA, 21 nt, Human
agaugcuagaacucccuuuca

SEQ ID NO: 2700774 - RNA, 21 nt, Human
agaugcaguucugaagaagau

SEQ ID NO: 2700775 - RNA, 19 nt, Human
agaugcuagaacucccuuu

SEQ ID NO: 2700776 - RNA, 13 nt, Human
agaugcacaugag

SEQ ID NO: 2700777 - RNA, 20 nt, Human
agaugcaguucugaagaaga

SEQ ID NO: 2700778 - RNA, 16 nt, Human
agaugcacaugagcug

SEQ ID NO: 2700779 - RNA, 15 nt, Human
ugacacuuaaaaaug

SEQ ID NO: 2700780 - RNA, 22 nt, Human
agauguauguacuucaugcugu

SEQ ID NO: 2700781 - RNA, 17 nt, Human
agaugugaacacaucag

SEQ ID NO: 2700782 - RNA, 22 nt, Human
agaugugaacacaucagcuugc

SEQ ID NO: 2700783 - RNA, 21 nt, Human
agauugugccccugcacucca

SEQ ID NO: 2700784 - RNA, 16 nt, Human
agcaagggugauggga

SEQ ID NO: 2700785 - RNA, 22 nt, Human
agcaagggugaugggaaagcau

SEQ ID NO: 2700786 - RNA, 20 nt, Human
agcaagggugaugggaaagc

SEQ ID NO: 2700787 - RNA, 16 nt, Human
agauuuuccugaaaac

SEQ ID NO: 2700788 - RNA, 15 nt, Human
agauuuuccugaaaa

SEQ ID NO: 2700789 - RNA, 14 nt, Human
agauuuuccugaaa

SEQ ID NO: 2700790 - RNA, 20 nt, Human
ugagacucugucucagucca

SEQ ID NO: 2700791 - RNA, 12 nt, Human
ugagacagcucu

SEQ ID NO: 2700792 - RNA, 16 nt, Human
ugagagacacacugaa

SEQ ID NO: 2700793 - RNA, 17 nt, Human
ugagagacacacugaag

SEQ ID NO: 2700794 - RNA, 19 nt, Human
ugagagacacacugaagaa

SEQ ID NO: 2700795 - RNA, 20 nt, Human
ugagagacacacugaagaag

SEQ ID NO: 2700796 - RNA, 21 nt, Human
ugagagacacacugaagaagc

SEQ ID NO: 2700797 - RNA, 22 nt, Human
ugagagacacacugaagaagca

SEQ ID NO: 2700798 - RNA, 21 nt, Human
ugagagcaguuugguuucuag

SEQ ID NO: 2700799 - RNA, 23 nt, Human
ugagagcaguuugguuucuagca

SEQ ID NO: 2700800 - RNA, 13 nt, Human
ugagaugugaaca

SEQ ID NO: 2700801 - RNA, 19 nt, Human
ugagaugugaacacaucag

SEQ ID NO: 2700802 - RNA, 18 nt, Human
ugagaugugaacacauca

SEQ ID NO: 2700803 - RNA, 24 nt, Human
ugagaugugaacacaucagcuugc

SEQ ID NO: 2700804 - RNA, 13 nt, Human
ugaaagaaaauaa

SEQ ID NO: 2700805 - RNA, 22 nt, Human
ugaaaauauuuguaucacaaau

SEQ ID NO: 2700806 - RNA, 21 nt, Human
ugaaaauauuuguaucacaaa

SEQ ID NO: 2700807 - RNA, 20 nt, Human
ugaaaaucuuauaauuuaaa

SEQ ID NO: 2700808 - RNA, 17 nt, Human
ugaaaauauuuguauca

SEQ ID NO: 2700809 - RNA, 18 nt, Human
ugaaagaggaaugaagua

SEQ ID NO: 2700810 - RNA, 17 nt, Human
ugaaagaggaaugaagu

SEQ ID NO: 2700811 - RNA, 16 nt, Human
agagacacacugaaga

SEQ ID NO: 2700812 - RNA, 15 nt, Human
agagacagaaagcag

SEQ ID NO: 2700813 - RNA, 14 nt, Human
agagacagaaagca

SEQ ID NO: 2700814 - RNA, 22 nt, Human
agacuccaaagaaauguaaggg

SEQ ID NO: 2700815 - RNA, 21 nt, Human
agacuggcacaguuuucugag

SEQ ID NO: 2700816 - RNA, 20 nt, Human
agacuggcacaguuuucuga

SEQ ID NO: 2700817 - RNA, 23 nt, Human
agacuggcacaguuuucugagaa

SEQ ID NO: 2700818 - RNA, 18 nt, Human
agagcuguucacagccag

SEQ ID NO: 2700819 - RNA, 17 nt, Human
ugaagauuuaccacuug

SEQ ID NO: 2700820 - RNA, 20 nt, Human
ugaagauuuaccacuugugu

SEQ ID NO: 2700821 - RNA, 17 nt, Human
ugaaguacucauacaug

SEQ ID NO: 2700822 - RNA, 22 nt, Human
ugaagaagcaccaaucaugaau

SEQ ID NO: 2700823 - RNA, 18 nt, Human
ugaacccgggaggcagag

SEQ ID NO: 2700824 - RNA, 22 nt, Human
ugaacccauauuuguacaccaa

SEQ ID NO: 2700825 - RNA, 13 nt, Human
ugaacaaauuuac

SEQ ID NO: 2700826 - RNA, 16 nt, Human
agagcugcccucuccu

SEQ ID NO: 2700827 - RNA, 17 nt, Human
agagcugcccucuccug

SEQ ID NO: 2700828 - RNA, 18 nt, Human
agagcugcccucuccugg

SEQ ID NO: 2700829 - RNA, 19 nt, Human
agagcugcccucuccuggg

SEQ ID NO: 2700830 - RNA, 20 nt, Human
agagcugcccucuccugggc

SEQ ID NO: 2700831 - RNA, 14 nt, Human
ugaaauaagccaga

SEQ ID NO: 2700832 - RNA, 17 nt, Human
uguaagaaaauaucacu

SEQ ID NO: 2700833 - RNA, 18 nt, Human
uguaagaaaauaucacuu

SEQ ID NO: 2700834 - RNA, 15 nt, Human
ugguuucuagcauga

SEQ ID NO: 2700835 - RNA, 23 nt, Human
uggugugaccacugcagaagaca

SEQ ID NO: 2700836 - RNA, 22 nt, Human
agggugaugggaaagcauugua

SEQ ID NO: 2700837 - RNA, 21 nt, Human
agggugaugggaaagcauugu

SEQ ID NO: 2700838 - RNA, 16 nt, Human
aggggaauugaggaca

SEQ ID NO: 2700839 - RNA, 22 nt, Human
ugguccaugggccauaugaaaa

SEQ ID NO: 2700840 - RNA, 22 nt, Human
uggucugugagaugcuagaacu

SEQ ID NO: 2700841 - RNA, 20 nt, Human
aggguuuauguuuaggaugu

SEQ ID NO: 2700842 - RNA, 15 nt, Human
aggucagugcaaaua

SEQ ID NO: 2700843 - RNA, 22 nt, Human
ugugagaugcuagaacucccuu

SEQ ID NO: 2700844 - RNA, 14 nt, Human
ugugaagcaaaauu

SEQ ID NO: 2700845 - RNA, 17 nt, Human
agugaaagaaaauaaca

SEQ ID NO: 2700846 - RNA, 16 nt, Human
agugaaagaggcagcu

SEQ ID NO: 2700847 - RNA, 14 nt, Human
agugagacagcucu

SEQ ID NO: 2700848 - RNA, 22 nt, Human
agugaaagaggcagcuugaaac

SEQ ID NO: 2700849 - RNA, 20 nt, Human
agugaaacucguuaauuugu

SEQ ID NO: 2700850 - RNA, 21 nt, Human
agugagcagucaggaaagaga

SEQ ID NO: 2700851 - RNA, 16 nt, Human
agugagccgagauugu

SEQ ID NO: 2700852 - RNA, 14 nt, Human
ugucuucacaacag

SEQ ID NO: 2700853 - RNA, 17 nt, Human
ugucucuacuaaaaaua

SEQ ID NO: 2700854 - RNA, 15 nt, Human
ugucuccucucucug

SEQ ID NO: 2700855 - RNA, 14 nt, Human
ugucuuaauuaaaa

SEQ ID NO: 2700856 - RNA, 21 nt, Human
aguauuagaauaccacaggaa

SEQ ID NO: 2700857 - RNA, 18 nt, Human
aguauguuagugcaaauu

SEQ ID NO: 2700858 - RNA, 21 nt, Human
aguauguuagugcaaauuguc

SEQ ID NO: 2700859 - RNA, 20 nt, Human
agucacauuccaagccucau

SEQ ID NO: 2700860 - RNA, 15 nt, Human
aguauuguccagguc

SEQ ID NO: 2700861 - RNA, 16 nt, Human
aguauuguccaggucu

SEQ ID NO: 2700862 - RNA, 23 nt, Human
ugucagcuccccucggagaagag

SEQ ID NO: 2700863 - RNA, 21 nt, Human
ugucagcuccccucggagaag

SEQ ID NO: 2700864 - RNA, 20 nt, Human
ugucagcuccccucggagaa

SEQ ID NO: 2700865 - RNA, 23 nt, Human
uuagaugcaguucugaagaagau

SEQ ID NO: 2700866 - RNA, 22 nt, Human
uuagaugcaguucugaagaaga

SEQ ID NO: 2700867 - RNA, 18 nt, Human
uuagcaggaagcugugag

SEQ ID NO: 2700868 - RNA, 14 nt, Human
auaaugaauacuuu

SEQ ID NO: 2700869 - RNA, 21 nt, Human
auaaucuuucacaggggacag

SEQ ID NO: 2700870 - RNA, 12 nt, Human
auaacuggaaac

SEQ ID NO: 2700871 - RNA, 19 nt, Human
auaaaugugccuucauuuu

SEQ ID NO: 2700872 - RNA, 17 nt, Human
aguuuucugagaaagac

SEQ ID NO: 2700873 - RNA, 14 nt, Human
aguuuucugagaaa

SEQ ID NO: 2700874 - RNA, 13 nt, Human
aguuuucugagaa

SEQ ID NO: 2700875 - RNA, 12 nt, Human
aguuuucugaga

SEQ ID NO: 2700876 - RNA, 15 nt, Human
auaaacucauuucua

SEQ ID NO: 2700877 - RNA, 21 nt, Human
uuagccguggugauuuagcag

SEQ ID NO: 2700878 - RNA, 18 nt, Human
uuauauaagcuuguauuc

SEQ ID NO: 2700879 - RNA, 14 nt, Human
auaauuuuuauauu

SEQ ID NO: 2700880 - RNA, 16 nt, Human
auaauuuuuauauuug

SEQ ID NO: 2700881 - RNA, 19 nt, Human
auaauuuuuauauuugaaa

SEQ ID NO: 2700882 - RNA, 13 nt, Human
auaauuuugugaa

SEQ ID NO: 2700883 - RNA, 14 nt, Human
auaauuuugugaag

SEQ ID NO: 2700884 - RNA, 15 nt, Human
auaauuuugugaagc

SEQ ID NO: 2700885 - RNA, 20 nt, Human
auaauuuugugaagcaaaau

SEQ ID NO: 2700886 - RNA, 22 nt, Human
auacaaaaaaaaaaaaaaauua

SEQ ID NO: 2700887 - RNA, 21 nt, Human
auaauuuuuauauuugaaaua

SEQ ID NO: 2700888 - RNA, 22 nt, Human
auaauuuuuauauuugaaauau

SEQ ID NO: 2700889 - RNA, 22 nt, Human
auaccacaggaaccacaagacu

SEQ ID NO: 2700890 - RNA, 20 nt, Human
auacaucccuuaccugggaa

SEQ ID NO: 2700891 - RNA, 21 nt, Human
auacaguucggugagcuacaa

SEQ ID NO: 2700892 - RNA, 20 nt, Human
aguucggugagcuacaaaug

SEQ ID NO: 2700893 - RNA, 14 nt, Human
aguucagagcugcc

SEQ ID NO: 2700894 - RNA, 15 nt, Human
aguucagagcugccc

SEQ ID NO: 2700895 - RNA, 16 nt, Human
aguucagagcugcccu

SEQ ID NO: 2700896 - RNA, 17 nt, Human
aguucagagcugcccuc

SEQ ID NO: 2700897 - RNA, 18 nt, Human
aguucagagcugcccucu

SEQ ID NO: 2700898 - RNA, 19 nt, Human
aguucagagcugcccucuc

SEQ ID NO: 2700899 - RNA, 19 nt, Human
aguuauggcuauaggugcu

SEQ ID NO: 2700900 - RNA, 20 nt, Human
aguuauuauauuuacaaaug

SEQ ID NO: 2700901 - RNA, 15 nt, Human
uuaaaaaagaaacau

SEQ ID NO: 2700902 - RNA, 18 nt, Human
uuaaaaaagaaacauuug

SEQ ID NO: 2700903 - RNA, 22 nt, Human
aguugcauagguuuaauaauuu

SEQ ID NO: 2700904 - RNA, 20 nt, Human
uuaaaaaugguuuaaauggu

SEQ ID NO: 2700905 - RNA, 16 nt, Human
aguuugguuucuagca

SEQ ID NO: 2700906 - RNA, 15 nt, Human
aguucugaagaagau

SEQ ID NO: 2700907 - RNA, 13 nt, Human
aguucugaagaag

SEQ ID NO: 2700908 - RNA, 14 nt, Human
aguucugaagaaga

SEQ ID NO: 2700909 - RNA, 21 nt, Human
aguugauaugccuuuucccaa

SEQ ID NO: 2700910 - RNA, 14 nt, Human
uguuuuaggagcau

SEQ ID NO: 2700911 - RNA, 13 nt, Human
uguuuuauaauuu

SEQ ID NO: 2700912 - RNA, 20 nt, Human
uguuuuauaauuuugugaag

SEQ ID NO: 2700913 - RNA, 15 nt, Human
uguuugcuaagcauu

SEQ ID NO: 2700914 - RNA, 19 nt, Human
uguuugcuaagcauuccaa

SEQ ID NO: 2700915 - RNA, 18 nt, Human
ugccucagaaaacaagga

SEQ ID NO: 2700916 - RNA, 16 nt, Human
ugccuccccuccucug

SEQ ID NO: 2700917 - RNA, 12 nt, Human
ugccuccccucc

SEQ ID NO: 2700918 - RNA, 13 nt, Human
ugccuccccuccu

SEQ ID NO: 2700919 - RNA, 14 nt, Human
ugccuccccuccuc

SEQ ID NO: 2700920 - RNA, 15 nt, Human
ugccuccccuccucu

SEQ ID NO: 2700921 - RNA, 11 nt, Human
ugccuccccuc

SEQ ID NO: 2700922 - RNA, 15 nt, Human
ugccucaccccuugc

SEQ ID NO: 2700923 - RNA, 19 nt, Human
ugcccuguuaaaagaugaa

SEQ ID NO: 2700924 - RNA, 21 nt, Human
agcugcccucuccugggcagc

SEQ ID NO: 2700925 - RNA, 19 nt, Human
agcugcccucuccugggca

SEQ ID NO: 2700926 - RNA, 20 nt, Human
agcugcccucuccugggcag

SEQ ID NO: 2700927 - RNA, 17 nt, Human
agcugcccucuccuggg

SEQ ID NO: 2700928 - RNA, 18 nt, Human
agcugcccucuccugggc

SEQ ID NO: 2700929 - RNA, 23 nt, Human
agcucugcccauccugccccuga

SEQ ID NO: 2700930 - RNA, 22 nt, Human
ugcccucuccugggcagcugcc

SEQ ID NO: 2700931 - RNA, 23 nt, Human
ugcccucuccugggcagcugccu

SEQ ID NO: 2700932 - RNA, 16 nt, Human
ugcccucuccugggca

SEQ ID NO: 2700933 - RNA, 17 nt, Human
ugcccucuccugggcag

SEQ ID NO: 2700934 - RNA, 18 nt, Human
ugcccucuccugggcagc

SEQ ID NO: 2700935 - RNA, 20 nt, Human
ugcccucuccugggcagcug

SEQ ID NO: 2700936 - RNA, 13 nt, Human
ugcccucuccugg

SEQ ID NO: 2700937 - RNA, 14 nt, Human
ugcccucuccuggg

SEQ ID NO: 2700938 - RNA, 15 nt, Human
ugcccucuccugggc

SEQ ID NO: 2700939 - RNA, 12 nt, Human
ugcccucuccug

SEQ ID NO: 2700940 - RNA, 22 nt, Human
ugccauuuaaagcuuauuaaaa

SEQ ID NO: 2700941 - RNA, 16 nt, Human
ugccccauucaacauc

SEQ ID NO: 2700942 - RNA, 22 nt, Human
ugcagcucuccccuucucugua

SEQ ID NO: 2700943 - RNA, 20 nt, Human
ugcagcucuccccuucucug

SEQ ID NO: 2700944 - RNA, 11 nt, Human
agcccugucuc

SEQ ID NO: 2700945 - RNA, 18 nt, Human
agcccugucuccucucuc

SEQ ID NO: 2700946 - RNA, 14 nt, Human
ugcagaagacagua

SEQ ID NO: 2700947 - RNA, 15 nt, Human
ugcagaagacaguau

SEQ ID NO: 2700948 - RNA, 17 nt, Human
ugauuuagcaggaagcu

SEQ ID NO: 2700949 - RNA, 20 nt, Human
ugauuuagcaggaagcugug

SEQ ID NO: 2700950 - RNA, 19 nt, Human
ugaugggaaagcauuguaa

SEQ ID NO: 2700951 - RNA, 14 nt, Human
ugaugggaaagcau

SEQ ID NO: 2700952 - RNA, 11 nt, Human
ugaugaagaag

SEQ ID NO: 2700953 - RNA, 12 nt, Human
ugaugaagaagu

SEQ ID NO: 2700954 - RNA, 23 nt, Human
ugauuaaguaaugauaacuggaa

SEQ ID NO: 2700955 - RNA, 18 nt, Human
ugauuaaguaaugauaac

SEQ ID NO: 2700956 - RNA, 15 nt, Human
agccagcaguucaga

SEQ ID NO: 2700957 - RNA, 17 nt, Human
agccagcaguucagagc

SEQ ID NO: 2700958 - RNA, 19 nt, Human
agccagcaguucagagcug

SEQ ID NO: 2700959 - RNA, 22 nt, Human
agccagcaguucagagcugccc

SEQ ID NO: 2700960 - RNA, 20 nt, Human
agccagcaguucagagcugc

SEQ ID NO: 2700961 - RNA, 21 nt, Human
agccagcaguucagagcugcc

SEQ ID NO: 2700962 - RNA, 18 nt, Human
uggaauuggagcucgugg

SEQ ID NO: 2700963 - RNA, 22 nt, Human
uggaauuucucccagucauuua

SEQ ID NO: 2700964 - RNA, 16 nt, Human
ugcuugccaucccucc

SEQ ID NO: 2700965 - RNA, 15 nt, Human
ugcuugccaucccuc

SEQ ID NO: 2700966 - RNA, 11 nt, Human
aggagaaacug

SEQ ID NO: 2700967 - RNA, 14 nt, Human
aggacacugauaug

SEQ ID NO: 2700968 - RNA, 23 nt, Human
aggacagcccuucuuuccacaga

SEQ ID NO: 2700969 - RNA, 14 nt, Human
ugcuggagcucugc

SEQ ID NO: 2700970 - RNA, 13 nt, Human
ugcuggagcucug

SEQ ID NO: 2700971 - RNA, 23 nt, Human
ugcuguauuuuaaaagaaugauu

SEQ ID NO: 2700972 - RNA, 11 nt, Human
aggaauuuaaa

SEQ ID NO: 2700973 - RNA, 23 nt, Human
aggaauugacccacaagaaauga

SEQ ID NO: 2700974 - RNA, 18 nt, Human
aggaagcugugagagcag

SEQ ID NO: 2700975 - RNA, 20 nt, Human
ugggaaagggauuuucagcc

SEQ ID NO: 2700976 - RNA, 18 nt, Human
uggacgagaaaacaauaa

SEQ ID NO: 2700977 - RNA, 20 nt, Human
uggcacaguuuucugagaaa

SEQ ID NO: 2700978 - RNA, 22 nt, Human
uggcacaguuuucugagaaaga

SEQ ID NO: 2700979 - RNA, 18 nt, Human
auccugaggcuccacuug

SEQ ID NO: 2700980 - RNA, 16 nt, Human
auccugaggcuccacu

SEQ ID NO: 2700981 - RNA, 13 nt, Human
auccugaggcucc

SEQ ID NO: 2700982 - RNA, 11 nt, Human
auccugaggcu

SEQ ID NO: 2700983 - RNA, 13 nt, Human
auccugccccuga

SEQ ID NO: 2700984 - RNA, 22 nt, Human
auccugaggcuccacuuggucu

SEQ ID NO: 2700985 - RNA, 16 nt, Human
auccugcaauuccacu

SEQ ID NO: 2700986 - RNA, 21 nt, Human
uugaaggaugcugucuucgua

SEQ ID NO: 2700987 - RNA, 14 nt, Human
uugaaggaugcugu

SEQ ID NO: 2700988 - RNA, 16 nt, Human
uugaaggaugcugucu

SEQ ID NO: 2700989 - RNA, 17 nt, Human
uugacacuuaaaaaugg

SEQ ID NO: 2700990 - RNA, 19 nt, Human
uugacacuuaaaaaugguu

SEQ ID NO: 2700991 - RNA, 16 nt, Human
aucccucccuccaccu

SEQ ID NO: 2700992 - RNA, 17 nt, Human
aucccucccuccaccuc

SEQ ID NO: 2700993 - RNA, 18 nt, Human
aucccucccuccaccucc

SEQ ID NO: 2700994 - RNA, 20 nt, Human
aucccucccuccaccucccu

SEQ ID NO: 2700995 - RNA, 21 nt, Human
aucccucccuccaccucccug

SEQ ID NO: 2700996 - RNA, 16 nt, Human
uucuguuuuauaauuu

SEQ ID NO: 2700997 - RNA, 17 nt, Human
uucuguuuuauaauuuu

SEQ ID NO: 2700998 - RNA, 23 nt, Human
aucacuugaacccgggaggcaga

SEQ ID NO: 2700999 - RNA, 19 nt, Human
aucaauuuuucuuauuuca

SEQ ID NO: 2701000 - RNA, 14 nt, Human
aucaauuuuucuua

SEQ ID NO: 2701001 - RNA, 13 nt, Human
aucaauuuaaaaa

SEQ ID NO: 2701002 - RNA, 21 nt, Human
aucaaggguacacugccuucu

SEQ ID NO: 2701003 - RNA, 18 nt, Human
aucaaauaugcaaagcac

SEQ ID NO: 2701004 - RNA, 17 nt, Human
aucaaauaugcaaagca

SEQ ID NO: 2701005 - RNA, 16 nt, Human
aucaaauaugcaaagc

SEQ ID NO: 2701006 - RNA, 16 nt, Human
aucaaggguacacugc

SEQ ID NO: 2701007 - RNA, 15 nt, Human
aucaaauaugcaaag

SEQ ID NO: 2701008 - RNA, 13 nt, Human
auauuuacaaaug

SEQ ID NO: 2701009 - RNA, 14 nt, Human
auauuguuugcuaa

SEQ ID NO: 2701010 - RNA, 17 nt, Human
uucagcgguuuauauaa

SEQ ID NO: 2701011 - RNA, 15 nt, Human
uucaucaaugaauga

SEQ ID NO: 2701012 - RNA, 13 nt, Human
auauaugcuaagu

SEQ ID NO: 2701013 - RNA, 23 nt, Human
auauguaccuaacgaaguauccu

SEQ ID NO: 2701014 - RNA, 14 nt, Human
auaugcaaagcacu

SEQ ID NO: 2701015 - RNA, 13 nt, Human
auaugcaaagcac

SEQ ID NO: 2701016 - RNA, 14 nt, Human
uucauuaucucaaa

SEQ ID NO: 2701017 - RNA, 22 nt, Human
augggacauuugcucauggaau

SEQ ID NO: 2701018 - RNA, 21 nt, Human
augggacauuugcucauggaa

SEQ ID NO: 2701019 - RNA, 23 nt, Human
auggcuauaggugcuacaaaaac

SEQ ID NO: 2701020 - RNA, 21 nt, Human
auggcuauaggugcuacaaaa

SEQ ID NO: 2701021 - RNA, 19 nt, Human
auggcuauaggugcuacaa

SEQ ID NO: 2701022 - RNA, 16 nt, Human
auggcuauaggugcua

SEQ ID NO: 2701023 - RNA, 17 nt, Human
auggaauuucucccagu

SEQ ID NO: 2701024 - RNA, 14 nt, Human
uuugaaauauugac

SEQ ID NO: 2701025 - RNA, 14 nt, Human
uuucugcaucagcu

SEQ ID NO: 2701026 - RNA, 14 nt, Human
uuucuaugaaauau

SEQ ID NO: 2701027 - RNA, 20 nt, Human
uuucuaugaaauauuauguu

SEQ ID NO: 2701028 - RNA, 13 nt, Human
uuucuaugaaaua

SEQ ID NO: 2701029 - RNA, 13 nt, Human
augcuaagugaaa

SEQ ID NO: 2701030 - RNA, 24 nt, Human
uuuaaagcuuauuaaaacucauuu

SEQ ID NO: 2701031 - RNA, 16 nt, Human
uuuauuacuguaagaa

SEQ ID NO: 2701032 - RNA, 17 nt, Human
uuuauaugcuucuguuu

SEQ ID NO: 2701033 - RNA, 23 nt, Human
auggaauuggagcucgugggaca

SEQ ID NO: 2701034 - RNA, 14 nt, Human
augcuguauuuuaa

SEQ ID NO: 2701035 - RNA, 23 nt, Human
augcugucuacacuaagagagaa

SEQ ID NO: 2701036 - RNA, 19 nt, Human
uuuauuacuguaagaaaau

SEQ ID NO: 2701037 - RNA, 16 nt, Human
uuuauuuuaauaaugu

SEQ ID NO: 2701038 - RNA, 16 nt, Human
auggaacauaaaauac

SEQ ID NO: 2701039 - RNA, 14 nt, Human
augauaacuggaaa

SEQ ID NO: 2701040 - RNA, 18 nt, Human
uugugaagcaaaauuuuu

SEQ ID NO: 2701041 - RNA, 20 nt, Human
uuuaaaaaagaaacauuugg

SEQ ID NO: 2701042 - RNA, 18 nt, Human
augaauuacauuuguaua

SEQ ID NO: 2701043 - RNA, 19 nt, Human
augaauuacauuuguauaa

SEQ ID NO: 2701044 - RNA, 17 nt, Human
augaauuacauuuguau

SEQ ID NO: 2701045 - RNA, 19 nt, Human
uuguauaaaauaauuuuua

SEQ ID NO: 2701046 - RNA, 13 nt, Human
uuguauaaaauaa

SEQ ID NO: 2701047 - RNA, 23 nt, Human
uuguaguguuggagaagaacuga

SEQ ID NO: 2701048 - RNA, 22 nt, Human
augaauuacauuuguauaaaau

SEQ ID NO: 2701049 - RNA, 21 nt, Human
augaauuaguuuuauaugcuu

SEQ ID NO: 2701050 - RNA, 23 nt, Human
augaauuaguuuuauaugcuucu

SEQ ID NO: 2701051 - RNA, 12 nt, Human
uugcucauggaa

SEQ ID NO: 2701052 - RNA, 11 nt, Human
uugcucaugga

SEQ ID NO: 2701053 - RNA, 21 nt, Human
augaaauauuauguuaaaacu

SEQ ID NO: 2701054 - RNA, 20 nt, Human
augaaauauuauguuaaaac

SEQ ID NO: 2701055 - RNA, 13 nt, Human
auuuagauguaua

SEQ ID NO: 2701056 - RNA, 17 nt, Human
auuuauuuuaauaaugu

SEQ ID NO: 2701057 - RNA, 12 nt, Human
auuucauuucuu

SEQ ID NO: 2701058 - RNA, 19 nt, Human
auuuauuuuaauaauguuu

SEQ ID NO: 2701059 - RNA, 20 nt, Human
auuuauuuuaauaauguuuc

SEQ ID NO: 2701060 - RNA, 14 nt, Human
auuugaaauauuga

SEQ ID NO: 2701061 - RNA, 18 nt, Human
auugacccacaagaaaug

SEQ ID NO: 2701062 - RNA, 15 nt, Human
auuguauuacaaauc

SEQ ID NO: 2701063 - RNA, 17 nt, Human
auuuuaaaagaaugauu

SEQ ID NO: 2701064 - RNA, 19 nt, Human
auuuguauaaaauaauuuu

SEQ ID NO: 2701065 - RNA, 15 nt, Human
auuuguauaaaauaa

SEQ ID NO: 2701066 - RNA, 18 nt, Human
auuuguauaaaauaauuu

SEQ ID NO: 2701067 - RNA, 18 nt, Human
auuuuaaaagaaugauua

SEQ ID NO: 2701068 - RNA, 22 nt, Human
auuuuaaaagaaugauuaugaa

SEQ ID NO: 2701069 - RNA, 22 nt, Human
auuuucaguuauuauauuuaca

SEQ ID NO: 2701070 - RNA, 14 nt, Human
uuuucucuaggaaa

SEQ ID NO: 2701071 - RNA, 18 nt, Human
uuuucugagaaagacuau

SEQ ID NO: 2701072 - RNA, 15 nt, Human
uuuucugagaaagac

SEQ ID NO: 2701073 - RNA, 17 nt, Human
auguuuucaggcuagau

SEQ ID NO: 2701074 - RNA, 21 nt, Human
auguuuucaggcuagauguau

SEQ ID NO: 2701075 - RNA, 15 nt, Human
auguuuucaggcuag

SEQ ID NO: 2701076 - RNA, 15 nt, Human
auuaaaagaauauuu

SEQ ID NO: 2701077 - RNA, 18 nt, Human
auguucaucaaugaauga

SEQ ID NO: 2701078 - RNA, 19 nt, Human
augugcuaguaauuggaaa

SEQ ID NO: 2701079 - RNA, 16 nt, Human
uuuuaauaauguuuca

SEQ ID NO: 2701080 - RNA, 12 nt, Human
uuuuaauaaugu

SEQ ID NO: 2701081 - RNA, 13 nt, Human
uuuuaauaauguu

SEQ ID NO: 2701082 - RNA, 14 nt, Human
uuuuaauaauguuu

SEQ ID NO: 2701083 - RNA, 19 nt, Human
uuuuuauauuugaaauauu

SEQ ID NO: 2701084 - RNA, 17 nt, Human
uuuuuauauuugaaaua

SEQ ID NO: 2701085 - RNA, 12 nt, Human
auuaccagggac

SEQ ID NO: 2701086 - RNA, 18 nt, Human
auuacauuuguauaaaau

SEQ ID NO: 2701087 - RNA, 20 nt, Human
auuacauuuguauaaaauaa

SEQ ID NO: 2701088 - RNA, 17 nt, Human
auuacauuuguauaaaa

SEQ ID NO: 2701089 - RNA, 19 nt, Human
uuuuugugaaaagcuccau

SEQ ID NO: 2701090 - RNA, 21 nt, Human
auuaaguaaugauaacuggaa

SEQ ID NO: 2701091 - RNA, 23 nt, Human
auuaaguaaugauaacuggaaac

SEQ ID NO: 2701092 - RNA, 14 nt, Human
aaaacaaggaugaa

SEQ ID NO: 2701093 - RNA, 18 nt, Human
aaaacacagcaaggguga

SEQ ID NO: 2701094 - RNA, 13 nt, Human
aaaacacagcaag

SEQ ID NO: 2701095 - RNA, 12 nt, Human
aaaacacagcaa

SEQ ID NO: 2701096 - RNA, 17 nt, Human
aaaacaaggaugaauua

SEQ ID NO: 2701097 - RNA, 16 nt, Human
aagauuuaccacuugu

SEQ ID NO: 2701098 - RNA, 13 nt, Human
aagccagauuuuc

SEQ ID NO: 2701099 - RNA, 21 nt, Human
aauaauccuaaacauaugaau

SEQ ID NO: 2701100 - RNA, 14 nt, Human
aauaaaauggguuu

SEQ ID NO: 2701101 - RNA, 19 nt, Human
aauaaaauggguuuuacug

SEQ ID NO: 2701102 - RNA, 20 nt, Human
aaugauaacuggaaacuuca

SEQ ID NO: 2701103 - RNA, 17 nt, Human
aaugauaacuggaaacu

SEQ ID NO: 2701104 - RNA, 13 nt, Human
aauccauacauuu

SEQ ID NO: 2701105 - RNA, 14 nt, Human
aauccauacauuug

SEQ ID NO: 2701106 - RNA, 15 nt, Human
aaucaagaaacuuaa

SEQ ID NO: 2701107 - RNA, 13 nt, Human
aaucacaauacau

SEQ ID NO: 2701108 - RNA, 16 nt, Human
aauauuauguuaaaac

SEQ ID NO: 2701109 - RNA, 14 nt, Human
aauuaguuuuauau

SEQ ID NO: 2701110 - RNA, 17 nt, Human
aauuaguuuuauaugcu

SEQ ID NO: 2701111 - RNA, 20 nt, Human
aauuaguuuuauaugcuucu

SEQ ID NO: 2701112 - RNA, 19 nt, Human
aaaucaaauaugcaaagca

SEQ ID NO: 2701113 - RNA, 18 nt, Human
aaaucaaauaugcaaagc

SEQ ID NO: 2701114 - RNA, 16 nt, Human
aaaucaaauaugcaaa

SEQ ID NO: 2701115 - RNA, 18 nt, Human
aaauggcuuccuggcaau

SEQ ID NO: 2701116 - RNA, 12 nt, Human
aaauaacaauga

SEQ ID NO: 2701117 - RNA, 16 nt, Human
aaagaugaaaauauuu

SEQ ID NO: 2701118 - RNA, 13 nt, Human
aaagaugaaaaua

SEQ ID NO: 2701119 - RNA, 17 nt, Human
aaagaugaaaauauuug

SEQ ID NO: 2701120 - RNA, 19 nt, Human
aaacugccagcaacgcagg

SEQ ID NO: 2701121 - RNA, 17 nt, Human
aaacugacucuuaagaa

SEQ ID NO: 2701122 - RNA, 15 nt, Human
aaacugccagcaacg

SEQ ID NO: 2701123 - RNA, 14 nt, Human
aaacugccagcaac

SEQ ID NO: 2701124 - RNA, 16 nt, Human
aaacugacucuuaaga

SEQ ID NO: 2701125 - RNA, 14 nt, Human
aagaaauguaaggg

SEQ ID NO: 2701126 - RNA, 13 nt, Human
aagaaauguaagg

SEQ ID NO: 2701127 - RNA, 23 nt, Human
aacugacacaugcugaacaucac

SEQ ID NO: 2701128 - RNA, 15 nt, Human
aacacgagcaggcua

SEQ ID NO: 2701129 - RNA, 13 nt, Human
acaacuauauugu

SEQ ID NO: 2701130 - RNA, 20 nt, Human
acagcucugcauacucauua

SEQ ID NO: 2701131 - RNA, 15 nt, Human
acagccagacuggca

SEQ ID NO: 2701132 - RNA, 13 nt, Human
acagccagacugg

SEQ ID NO: 2701133 - RNA, 16 nt, Human
acagccagacuggcac

SEQ ID NO: 2701134 - RNA, 18 nt, Human
acagcaguugaaaagacu

SEQ ID NO: 2701135 - RNA, 15 nt, Human
acagcaguugaaaag

SEQ ID NO: 2701136 - RNA, 13 nt, Human
acauguuacaaca

SEQ ID NO: 2701137 - RNA, 18 nt, Human
acauuugcucauggaauu

SEQ ID NO: 2701138 - RNA, 16 nt, Human
acauuugcucauggaa

SEQ ID NO: 2701139 - RNA, 14 nt, Human
acauuuguauaaaa

SEQ ID NO: 2701140 - RNA, 15 nt, Human
acccacaagaaauga

SEQ ID NO: 2701141 - RNA, 16 nt, Human
acccaaguccaagcau

SEQ ID NO: 2701142 - RNA, 18 nt, Human
acuuguaaaggaauuuaa

SEQ ID NO: 2701143 - RNA, 15 nt, Human
acuuggucugugaga

SEQ ID NO: 2701144 - RNA, 14 nt, Human
acuuggucugugag

SEQ ID NO: 2701145 - RNA, 20 nt, Human
acuuguaaaggaauuuaaaa

SEQ ID NO: 2701146 - RNA, 19 nt, Human
acuuguaaaggaauuuaaa

SEQ ID NO: 2701147 - RNA, 12 nt, Human
acuggaacucuc

SEQ ID NO: 2701148 - RNA, 14 nt, Human
acucaaaucaagaa

SEQ ID NO: 2701149 - RNA, 14 nt, Human
acuagcuauggugu

SEQ ID NO: 2701150 - RNA, 13 nt, Human
acucccuuucaac

SEQ ID NO: 2701151 - RNA, 12 nt, Human
acucccuuucaa

SEQ ID NO: 2701152 - RNA, 16 nt, Human
acgugcacgcacacug

SEQ ID NO: 2701153 - RNA, 15 nt, Human
acuaagagagaauga

SEQ ID NO: 2701154 - RNA, 16 nt, Human
acuaagagagaaugag

SEQ ID NO: 2701155 - RNA, 14 nt, Human
auaauuacuauguc

SEQ ID NO: 2701156 - RNA, 18 nt, Human
auaucacuugucaauaaa

SEQ ID NO: 2701157 - RNA, 15 nt, Human
auaucaauuuaaaaa

SEQ ID NO: 2701158 - RNA, 23 nt, Human
auaugcuucuguuuuauaauuuu

SEQ ID NO: 2701159 - RNA, 23 nt, Human
auauuucagauaaucacaauaca

SEQ ID NO: 2701160 - RNA, 18 nt, Human
auauuuauuuuaauaaug

SEQ ID NO: 2701161 - RNA, 14 nt, Human
auauuuauuacugu

SEQ ID NO: 2701162 - RNA, 19 nt, Human
auauuuauuacuguaagaa

SEQ ID NO: 2701163 - RNA, 19 nt, Human
aguuguaccgcaaugugac

SEQ ID NO: 2701164 - RNA, 18 nt, Human
aguuguaccgcaauguga

SEQ ID NO: 2701165 - RNA, 15 nt, Human
agugauuaccaggga

SEQ ID NO: 2701166 - RNA, 18 nt, Human
agugauuaccagggacug

SEQ ID NO: 2701167 - RNA, 13 nt, Human
agucaaauugugu

SEQ ID NO: 2701168 - RNA, 15 nt, Human
agucaaauuguguga

SEQ ID NO: 2701169 - RNA, 17 nt, Human
agucaaauugugugaaa

SEQ ID NO: 2701170 - RNA, 16 nt, Human
aguccaagcauuuaga

SEQ ID NO: 2701171 - RNA, 21 nt, Human
aguccaagcauuuagauguau

SEQ ID NO: 2701172 - RNA, 17 nt, Human
aucagcugcugaaacaa

SEQ ID NO: 2701173 - RNA, 22 nt, Human
aucuuauaauuuaaaauaugcu

SEQ ID NO: 2701174 - RNA, 20 nt, Human
auguaagggaaacugccagc

SEQ ID NO: 2701175 - RNA, 22 nt, Human
auguaagggaaacugccagcaa

SEQ ID NO: 2701176 - RNA, 21 nt, Human
auguaagggaaacugccagca

SEQ ID NO: 2701177 - RNA, 14 nt, Human
agcuguaugauucc

SEQ ID NO: 2701178 - RNA, 18 nt, Human
agcuucacuguaaaauaa

SEQ ID NO: 2701179 - RNA, 17 nt, Human
aggauguugaaaaaguu

SEQ ID NO: 2701180 - RNA, 14 nt, Human
aggauguugaaaaa

SEQ ID NO: 2701181 - RNA, 17 nt, Human
agacugcauuauauuua

SEQ ID NO: 2701182 - RNA, 21 nt, Human
agauaggucagugcaaauacu

SEQ ID NO: 2701183 - RNA, 21 nt, Human
agccgggcgugguggugagug

SEQ ID NO: 2701184 - RNA, 19 nt, Human
agccccacccucagaugca

SEQ ID NO: 2701185 - RNA, 21 nt, Human
agaugggagaaucacuugaac

SEQ ID NO: 2701186 - RNA, 14 nt, Human
agauguagaggaga

SEQ ID NO: 2701187 - RNA, 21 nt, Human
agcaguugaaaagacuccaaa

SEQ ID NO: 2701188 - RNA, 23 nt, Human
agcaguugaaaagacuccaaaga

SEQ ID NO: 2701189 - RNA, 16 nt, Human
agcaguucagagcugc

SEQ ID NO: 2701190 - RNA, 15 nt, Human
agcaguucagagcug

SEQ ID NO: 2701191 - RNA, 17 nt, Human
agcaguucagagcugcc

SEQ ID NO: 2701192 - RNA, 18 nt, Human
agcaguucagagcugccc

SEQ ID NO: 2701193 - RNA, 19 nt, Human
agcaguucagagcugcccu

SEQ ID NO: 2701194 - RNA, 15 nt, Human
agccagauuuuccug

SEQ ID NO: 2701195 - RNA, 19 nt, Human
agccagauuuuccugaaaa

SEQ ID NO: 2701196 - RNA, 12 nt, Human
agcaugaagaca

SEQ ID NO: 2701197 - RNA, 17 nt, Human
caaggcugauuaaacca

SEQ ID NO: 2701198 - RNA, 21 nt, Human
caagccagauuuuccugaaaa

SEQ ID NO: 2701199 - RNA, 22 nt, Human
caaugugacuuaaugccacuaa

SEQ ID NO: 2701200 - RNA, 23 nt, Human
caauacaucccuuaccugggaaa

SEQ ID NO: 2701201 - RNA, 23 nt, Human
caaaacuucagacauagaauuaa

SEQ ID NO: 2701202 - RNA, 19 nt, Human
caaaaaucucaauauuuca

SEQ ID NO: 2701203 - RNA, 13 nt, Human
auuuuccugaaaa

SEQ ID NO: 2701204 - RNA, 17 nt, Human
caaaaacacagcaaggg

SEQ ID NO: 2701205 - RNA, 15 nt, Human
caaaaacacagcaag

SEQ ID NO: 2701206 - RNA, 14 nt, Human
caaaaacacagcaa

SEQ ID NO: 2701207 - RNA, 13 nt, Human
caaaaacacagca

SEQ ID NO: 2701208 - RNA, 21 nt, Human
caaauaugcaaagcacugacu

SEQ ID NO: 2701209 - RNA, 19 nt, Human
caaauaugcaaagcacuga

SEQ ID NO: 2701210 - RNA, 15 nt, Human
caaauugugugaaag

SEQ ID NO: 2701211 - RNA, 16 nt, Human
caaaauuuuuucucua

SEQ ID NO: 2701212 - RNA, 21 nt, Human
caaaauuuuuucucuaggaaa

SEQ ID NO: 2701213 - RNA, 22 nt, Human
caaaauuuuuucucuaggaaau

SEQ ID NO: 2701214 - RNA, 19 nt, Human
cacaguuuucugagaaaga

SEQ ID NO: 2701215 - RNA, 17 nt, Human
cacaguuuucugagaaa

SEQ ID NO: 2701216 - RNA, 16 nt, Human
cacaguuuucugagaa

SEQ ID NO: 2701217 - RNA, 23 nt, Human
cacuugaacccgggaggcagagg

SEQ ID NO: 2701218 - RNA, 21 nt, Human
cacuugaacccgggaggcaga

SEQ ID NO: 2701219 - RNA, 20 nt, Human
cacuugaacccgggaggcag

SEQ ID NO: 2701220 - RNA, 15 nt, Human
cacuuggucugugag

SEQ ID NO: 2701221 - RNA, 19 nt, Human
cacuguggguagacacaca

SEQ ID NO: 2701222 - RNA, 22 nt, Human
cacuguggguagacacacauga

SEQ ID NO: 2701223 - RNA, 24 nt, Human
cacuguggguagacacacaugaag

SEQ ID NO: 2701224 - RNA, 14 nt, Human
cacugucaagauga

SEQ ID NO: 2701225 - RNA, 20 nt, Human
cacugacuucuaaguaaaac

SEQ ID NO: 2701226 - RNA, 16 nt, Human
cacugacuucuaagua

SEQ ID NO: 2701227 - RNA, 15 nt, Human
cacugacuucuaagu

SEQ ID NO: 2701228 - RNA, 14 nt, Human
cacugacuucuaag

SEQ ID NO: 2701229 - RNA, 21 nt, Human
cacugacuucuaaguaaaacc

SEQ ID NO: 2701230 - RNA, 20 nt, Human
cacugccuucucaacuccaa

SEQ ID NO: 2701231 - RNA, 22 nt, Human
cacguucuuacuaguuucccuu

SEQ ID NO: 2701232 - RNA, 13 nt, Human
cacuaaacaaaga

SEQ ID NO: 2701233 - RNA, 20 nt, Human
cacgagcaggcuacugucag

SEQ ID NO: 2701234 - RNA, 19 nt, Human
cacgagcaggcuacuguca

SEQ ID NO: 2701235 - RNA, 17 nt, Human
cacgagcaggcuacugu

SEQ ID NO: 2701236 - RNA, 22 nt, Human
cacgagcaggcuacugucagcu

SEQ ID NO: 2701237 - RNA, 15 nt, Human
cacgcacacugucug

SEQ ID NO: 2701238 - RNA, 16 nt, Human
cacucaaaucaagaaa

SEQ ID NO: 2701239 - RNA, 21 nt, Human
cacuaaauugacacuuaaaaa

SEQ ID NO: 2701240 - RNA, 17 nt, Human
cacuaagagagaaugag

SEQ ID NO: 2701241 - RNA, 14 nt, Human
cacuaguauuucua

SEQ ID NO: 2701242 - RNA, 19 nt, Human
cacuaguauuucuaugaaa

SEQ ID NO: 2701243 - RNA, 13 nt, Human
caccucccugcaa

SEQ ID NO: 2701244 - RNA, 14 nt, Human
caccucccugcaau

SEQ ID NO: 2701245 - RNA, 10 nt, Human
caccucccug

SEQ ID NO: 2701246 - RNA, 11 nt, Human
caccucaugga

SEQ ID NO: 2701247 - RNA, 12 nt, Human
caccucauggaa

SEQ ID NO: 2701248 - RNA, 14 nt, Human
caccucauggaauu

SEQ ID NO: 2701249 - RNA, 20 nt, Human
cacccucagaugcacaugag

SEQ ID NO: 2701250 - RNA, 19 nt, Human
cagacauagaauuaacaca

SEQ ID NO: 2701251 - RNA, 17 nt, Human
cagacauagaauuaaca

SEQ ID NO: 2701252 - RNA, 20 nt, Human
cagaagcaacccaaauguuc

SEQ ID NO: 2701253 - RNA, 19 nt, Human
cagaagcaacccaaauguu

SEQ ID NO: 2701254 - RNA, 21 nt, Human
cagaaucgcuccaccuugcag

SEQ ID NO: 2701255 - RNA, 23 nt, Human
cagaaucgcuccaccuugcagcu

SEQ ID NO: 2701256 - RNA, 19 nt, Human
cagaaagcagaacagugau

SEQ ID NO: 2701257 - RNA, 23 nt, Human
cagaacagugauuaccagggacu

SEQ ID NO: 2701258 - RNA, 18 nt, Human
cagaaagcagaacaguga

SEQ ID NO: 2701259 - RNA, 20 nt, Human
cagagccccacccucagaug

SEQ ID NO: 2701260 - RNA, 14 nt, Human
cagauaaucacaau

SEQ ID NO: 2701261 - RNA, 23 nt, Human
cagauaaauaguuuaugauucca

SEQ ID NO: 2701262 - RNA, 14 nt, Human
cagauaaacaguag

SEQ ID NO: 2701263 - RNA, 14 nt, Human
cagauccuggaaau

SEQ ID NO: 2701264 - RNA, 13 nt, Human
cagauccuggaaa

SEQ ID NO: 2701265 - RNA, 17 nt, Human
cagaugcacaugagcug

SEQ ID NO: 2701266 - RNA, 15 nt, Human
caggaaguagaggag

SEQ ID NO: 2701267 - RNA, 16 nt, Human
caggaaguagaggagg

SEQ ID NO: 2701268 - RNA, 22 nt, Human
caggaagcugugagagcaguuu

SEQ ID NO: 2701269 - RNA, 13 nt, Human
caggaagcuguga

SEQ ID NO: 2701270 - RNA, 14 nt, Human
caggaagcugugag

SEQ ID NO: 2701271 - RNA, 18 nt, Human
cagcuugaaacugagaug

SEQ ID NO: 2701272 - RNA, 23 nt, Human
cagcuuuccucaaaacuucagac

SEQ ID NO: 2701273 - RNA, 18 nt, Human
caggaaccacaagacugc

SEQ ID NO: 2701274 - RNA, 18 nt, Human
cagcuguaugauucccag

SEQ ID NO: 2701275 - RNA, 21 nt, Human
cagcugcugaaacaacaaaua

SEQ ID NO: 2701276 - RNA, 20 nt, Human
cagcugcugaaacaacaaau

SEQ ID NO: 2701277 - RNA, 20 nt, Human
cagcucugcauacucauuag

SEQ ID NO: 2701278 - RNA, 16 nt, Human
cagcucuccccuucuc

SEQ ID NO: 2701279 - RNA, 13 nt, Human
cagcccucagaau

SEQ ID NO: 2701280 - RNA, 16 nt, Human
cagccuaguugaucag

SEQ ID NO: 2701281 - RNA, 19 nt, Human
cagcuacuugggaggcuga

SEQ ID NO: 2701282 - RNA, 23 nt, Human
cagcaacgcaggcccccaggugc

SEQ ID NO: 2701283 - RNA, 14 nt, Human
cagauuuuccugaa

SEQ ID NO: 2701284 - RNA, 15 nt, Human
cagauuuuccugaaa

SEQ ID NO: 2701285 - RNA, 23 nt, Human
cagcaagggugaugggaaagcau

SEQ ID NO: 2701286 - RNA, 22 nt, Human
cagcaagggugaugggaaagca

SEQ ID NO: 2701287 - RNA, 19 nt, Human
cagcaagggugaugggaaa

SEQ ID NO: 2701288 - RNA, 13 nt, Human
caggcuagaugua

SEQ ID NO: 2701289 - RNA, 19 nt, Human
caggcuagauguauguacu

SEQ ID NO: 2701290 - RNA, 14 nt, Human
caggcuacugucag

SEQ ID NO: 2701291 - RNA, 11 nt, Human
caggggacagg

SEQ ID NO: 2701292 - RNA, 16 nt, Human
caggggacaggauggu

SEQ ID NO: 2701293 - RNA, 17 nt, Human
cagggcauggcugggaa

SEQ ID NO: 2701294 - RNA, 18 nt, Human
cagggacaggauaagagg

SEQ ID NO: 2701295 - RNA, 19 nt, Human
caggcccccaggugccagu

SEQ ID NO: 2701296 - RNA, 14 nt, Human
caggcccccaggug

SEQ ID NO: 2701297 - RNA, 20 nt, Human
caggcccccaggugccaguu

SEQ ID NO: 2701298 - RNA, 16 nt, Human
caggauuuuaaucuuu

SEQ ID NO: 2701299 - RNA, 21 nt, Human
caggaugguucccuugaugaa

SEQ ID NO: 2701300 - RNA, 23 nt, Human
caggaugguucccuugaugaaga

SEQ ID NO: 2701301 - RNA, 17 nt, Human
cagugauuaccagggac

SEQ ID NO: 2701302 - RNA, 18 nt, Human
cagugauuaccagggacu

SEQ ID NO: 2701303 - RNA, 20 nt, Human
cagugaaagaaaauaacaau

SEQ ID NO: 2701304 - RNA, 16 nt, Human
cagugaaagaaaauaa

SEQ ID NO: 2701305 - RNA, 15 nt, Human
cagugagacagcucu

SEQ ID NO: 2701306 - RNA, 12 nt, Human
caguauggcagc

SEQ ID NO: 2701307 - RNA, 12 nt, Human
caguagugauag

SEQ ID NO: 2701308 - RNA, 22 nt, Human
cagucaggaaagagaacuucca

SEQ ID NO: 2701309 - RNA, 15 nt, Human
cagucaggaaagaga

SEQ ID NO: 2701310 - RNA, 18 nt, Human
cagucaggaaagagaacu

SEQ ID NO: 2701311 - RNA, 13 nt, Human
caguccaugaaga

SEQ ID NO: 2701312 - RNA, 22 nt, Human
cauuccaacuaucucauuucca

SEQ ID NO: 2701313 - RNA, 13 nt, Human
cauucuggaauaa

SEQ ID NO: 2701314 - RNA, 21 nt, Human
cauuguaaaugugcuuuuaaa

SEQ ID NO: 2701315 - RNA, 20 nt, Human
caugugcuaguaauuggaaa

SEQ ID NO: 2701316 - RNA, 20 nt, Human
cauggaauuggagcucgugg

SEQ ID NO: 2701317 - RNA, 23 nt, Human
caugggacagggaggacgcucuc

SEQ ID NO: 2701318 - RNA, 20 nt, Human
caucccucccuccaccuccc

SEQ ID NO: 2701319 - RNA, 18 nt, Human
caucccuuaccugggaaa

SEQ ID NO: 2701320 - RNA, 22 nt, Human
caucccucccuccaccucccug

SEQ ID NO: 2701321 - RNA, 23 nt, Human
caucccucccuccaccucccugc

SEQ ID NO: 2701322 - RNA, 13 nt, Human
cauauauaacaau

SEQ ID NO: 2701323 - RNA, 15 nt, Human
cauauauaacaaugc

SEQ ID NO: 2701324 - RNA, 18 nt, Human
caugaagauguagaggag

SEQ ID NO: 2701325 - RNA, 19 nt, Human
caugaagauguagaggaga

SEQ ID NO: 2701326 - RNA, 16 nt, Human
caugagguacugagag

SEQ ID NO: 2701327 - RNA, 19 nt, Human
caugagguacugagaguga

SEQ ID NO: 2701328 - RNA, 14 nt, Human
ccaccucccugcaa

SEQ ID NO: 2701329 - RNA, 13 nt, Human
ccagcaguucaga

SEQ ID NO: 2701330 - RNA, 18 nt, Human
ccagcaguucagagcugc

SEQ ID NO: 2701331 - RNA, 19 nt, Human
ccagcaguucagagcugcc

SEQ ID NO: 2701332 - RNA, 20 nt, Human
ccagcaguucagagcugccc

SEQ ID NO: 2701333 - RNA, 21 nt, Human
ccagcaguucagagcugcccu

SEQ ID NO: 2701334 - RNA, 22 nt, Human
ccagcaguucagagcugcccuc

SEQ ID NO: 2701335 - RNA, 23 nt, Human
ccagcaguucagagcugcccucu

SEQ ID NO: 2701336 - RNA, 22 nt, Human
ccagccagcaguucagagcugc

SEQ ID NO: 2701337 - RNA, 19 nt, Human
ccaugggacagggaggacg

SEQ ID NO: 2701338 - RNA, 16 nt, Human
ccaugggacagggagg

SEQ ID NO: 2701339 - RNA, 21 nt, Human
ccaguuauggcuauaggugcu

SEQ ID NO: 2701340 - RNA, 14 nt, Human
ccaguuauggcuau

SEQ ID NO: 2701341 - RNA, 19 nt, Human
ccaguguuuuaggagcaug

SEQ ID NO: 2701342 - RNA, 19 nt, Human
ccuuggggcugaugcaguu

SEQ ID NO: 2701343 - RNA, 14 nt, Human
ccuugaugaagaag

SEQ ID NO: 2701344 - RNA, 20 nt, Human
ccuugaaaacuuuaugcuaa

SEQ ID NO: 2701345 - RNA, 20 nt, Human
ccuucggccuccauccugag

SEQ ID NO: 2701346 - RNA, 19 nt, Human
ccuucggccuccauccuga

SEQ ID NO: 2701347 - RNA, 14 nt, Human
ccuucggccuccau

SEQ ID NO: 2701348 - RNA, 21 nt, Human
ccuguuaaaagaugaaaauau

SEQ ID NO: 2701349 - RNA, 20 nt, Human
ccuguuaaaagaugaaaaua

SEQ ID NO: 2701350 - RNA, 18 nt, Human
cgagcaggcuacugucag

SEQ ID NO: 2701351 - RNA, 16 nt, Human
ccugcaauaaaauggg

SEQ ID NO: 2701352 - RNA, 11 nt, Human
ccugagcccca

SEQ ID NO: 2701353 - RNA, 23 nt, Human
ccuggaaaucaggguuaguauug

SEQ ID NO: 2701354 - RNA, 22 nt, Human
ccugggcagcugccuccccucc

SEQ ID NO: 2701355 - RNA, 15 nt, Human
cccgugggguuccuc

SEQ ID NO: 2701356 - RNA, 11 nt, Human
cccucuccugg

SEQ ID NO: 2701357 - RNA, 12 nt, Human
cccucuccuggg

SEQ ID NO: 2701358 - RNA, 13 nt, Human
cccucuccugggc

SEQ ID NO: 2701359 - RNA, 14 nt, Human
cccucuccugggca

SEQ ID NO: 2701360 - RNA, 15 nt, Human
cccucuccugggcag

SEQ ID NO: 2701361 - RNA, 19 nt, Human
cccuccaccucccugcaau

SEQ ID NO: 2701362 - RNA, 15 nt, Human
cccuccaccucccug

SEQ ID NO: 2701363 - RNA, 17 nt, Human
cccuccaccucccugca

SEQ ID NO: 2701364 - RNA, 14 nt, Human
cccuccaccucccu

SEQ ID NO: 2701365 - RNA, 12 nt, Human
cccuccaccucc

SEQ ID NO: 2701366 - RNA, 20 nt, Human
cccacaagaaaugaaagcag

SEQ ID NO: 2701367 - RNA, 13 nt, Human
cccacaagaaaug

SEQ ID NO: 2701368 - RNA, 16 nt, Human
ccgggcguggugguga

SEQ ID NO: 2701369 - RNA, 13 nt, Human
ccuccaccucccu

SEQ ID NO: 2701370 - RNA, 14 nt, Human
ccuccaccucccug

SEQ ID NO: 2701371 - RNA, 15 nt, Human
ccuccaccucccugc

SEQ ID NO: 2701372 - RNA, 17 nt, Human
ccuccaccucccugcaa

SEQ ID NO: 2701373 - RNA, 22 nt, Human
ccuccaccucccugcaauaaaa

SEQ ID NO: 2701374 - RNA, 14 nt, Human
ccuccauccugagg

SEQ ID NO: 2701375 - RNA, 16 nt, Human
ccuccucugcuugcca

SEQ ID NO: 2701376 - RNA, 13 nt, Human
ccuccucugcuug

SEQ ID NO: 2701377 - RNA, 18 nt, Human
ccuccucugcuugccauc

SEQ ID NO: 2701378 - RNA, 20 nt, Human
ccucccuccaccucccugca

SEQ ID NO: 2701379 - RNA, 17 nt, Human
ccucccuccaccucccu

SEQ ID NO: 2701380 - RNA, 20 nt, Human
cuucggccuccauccugagg

SEQ ID NO: 2701381 - RNA, 20 nt, Human
cuuccuuggacucauuuuaa

SEQ ID NO: 2701382 - RNA, 15 nt, Human
cuucagccugaaaga

SEQ ID NO: 2701383 - RNA, 16 nt, Human
cuucagcgguuuauau

SEQ ID NO: 2701384 - RNA, 17 nt, Human
cuucaaauccuugaaga

SEQ ID NO: 2701385 - RNA, 14 nt, Human
cuucacaacagauu

SEQ ID NO: 2701386 - RNA, 12 nt, Human
cuucacaacaga

SEQ ID NO: 2701387 - RNA, 15 nt, Human
cuguuuuauaauuuu

SEQ ID NO: 2701388 - RNA, 14 nt, Human
cuguuuuauaauuu

SEQ ID NO: 2701389 - RNA, 17 nt, Human
cuuaauuaaaagaauau

SEQ ID NO: 2701390 - RNA, 16 nt, Human
cuuaauuaaaagaaua

SEQ ID NO: 2701391 - RNA, 20 nt, Human
cuuaauuaaaagaauauuuu

SEQ ID NO: 2701392 - RNA, 19 nt, Human
cuuaauuaaaagaauauuu

SEQ ID NO: 2701393 - RNA, 21 nt, Human
cuuaagaagacugcauuauau

SEQ ID NO: 2701394 - RNA, 23 nt, Human
cuuaagaagacugcauuauauuu

SEQ ID NO: 2701395 - RNA, 16 nt, Human
cuguuaaaagaugaaa

SEQ ID NO: 2701396 - RNA, 15 nt, Human
cuguuaaaagaugaa

SEQ ID NO: 2701397 - RNA, 19 nt, Human
cuguuaaaagaugaaaaua

SEQ ID NO: 2701398 - RNA, 18 nt, Human
cugucuucacaacagauu

SEQ ID NO: 2701399 - RNA, 21 nt, Human
gaacuagaguuuagcuggaaa

SEQ ID NO: 2701400 - RNA, 22 nt, Human
gaacuagaguuuagcuggaaaa

SEQ ID NO: 2701401 - RNA, 14 nt, Human
gaacucccuuucaa

SEQ ID NO: 2701402 - RNA, 15 nt, Human
gaacucccuuucaac

SEQ ID NO: 2701403 - RNA, 22 nt, Human
gaacuuccagauccuggaaauc

SEQ ID NO: 2701404 - RNA, 21 nt, Human
gaacuuguaaaggaauuuaaa

SEQ ID NO: 2701405 - RNA, 21 nt, Human
gaagaagcaccaaucaugaau

SEQ ID NO: 2701406 - RNA, 13 nt, Human
gaaauauuauguu

SEQ ID NO: 2701407 - RNA, 16 nt, Human
gaaauauuauguuaaa

SEQ ID NO: 2701408 - RNA, 21 nt, Human
gaagccuuggggcugaugcag

SEQ ID NO: 2701409 - RNA, 17 nt, Human
gaagacugcauuauauu

SEQ ID NO: 2701410 - RNA, 14 nt, Human
gaauacuuuauaaa

SEQ ID NO: 2701411 - RNA, 20 nt, Human
gaauaauccuaaacauauga

SEQ ID NO: 2701412 - RNA, 20 nt, Human
gaaaaucuuauaauuuaaaa

SEQ ID NO: 2701413 - RNA, 19 nt, Human
gaaaauaacgauaaaagac

SEQ ID NO: 2701414 - RNA, 19 nt, Human
gaaaaucuuauaauuuaaa

SEQ ID NO: 2701415 - RNA, 12 nt, Human
gaaaauaucacu

SEQ ID NO: 2701416 - RNA, 22 nt, Human
gaaaacaauaacgauaaaagac

SEQ ID NO: 2701417 - RNA, 18 nt, Human
cuuuaaagggauggcaag

SEQ ID NO: 2701418 - RNA, 21 nt, Human
cuuuauuuucuauaauuuaaa

SEQ ID NO: 2701419 - RNA, 13 nt, Human
cuuuccacagaag

SEQ ID NO: 2701420 - RNA, 19 nt, Human
cuuguaaaggaauuuaaaa

SEQ ID NO: 2701421 - RNA, 22 nt, Human
cuugccaucccucccuccaccu

SEQ ID NO: 2701422 - RNA, 21 nt, Human
cuugccaucccucccuccacc

SEQ ID NO: 2701423 - RNA, 20 nt, Human
cuccccuccucugcuugcca

SEQ ID NO: 2701424 - RNA, 13 nt, Human
cuccauccugagg

SEQ ID NO: 2701425 - RNA, 11 nt, Human
cuccccuccuc

SEQ ID NO: 2701426 - RNA, 13 nt, Human
cuccccuccucug

SEQ ID NO: 2701427 - RNA, 11 nt, Human
cuccauccuga

SEQ ID NO: 2701428 - RNA, 12 nt, Human
cuccauccugag

SEQ ID NO: 2701429 - RNA, 17 nt, Human
cuccaccuugcagcucu

SEQ ID NO: 2701430 - RNA, 21 nt, Human
cuccaaacugacucuuaagaa

SEQ ID NO: 2701431 - RNA, 12 nt, Human
cuccaaagaaau

SEQ ID NO: 2701432 - RNA, 13 nt, Human
cuccaaagaaaug

SEQ ID NO: 2701433 - RNA, 14 nt, Human
cucauuucuagcag

SEQ ID NO: 2701434 - RNA, 21 nt, Human
cucauuuccaagcaaguauua

SEQ ID NO: 2701435 - RNA, 18 nt, Human
cuauauuguuugcuaagc

SEQ ID NO: 2701436 - RNA, 20 nt, Human
cuauaggugcuacaaaaaca

SEQ ID NO: 2701437 - RNA, 22 nt, Human
cuauaggugcuacaaaaacaca

SEQ ID NO: 2701438 - RNA, 21 nt, Human
cuauaggugcuacaaaaacac

SEQ ID NO: 2701439 - RNA, 16 nt, Human
cuauucaaacagucuc

SEQ ID NO: 2701440 - RNA, 18 nt, Human
cuauucaaacagucucag

SEQ ID NO: 2701441 - RNA, 23 nt, Human
cuauucaaacagucucaggaaau

SEQ ID NO: 2701442 - RNA, 21 nt, Human
cuagugagcagucaggaaaga

SEQ ID NO: 2701443 - RNA, 19 nt, Human
cuagugaaagaggcagcuu

SEQ ID NO: 2701444 - RNA, 18 nt, Human
cuagugaaagaggcagcu

SEQ ID NO: 2701445 - RNA, 20 nt, Human
cuagugaaacucguuaauuu

SEQ ID NO: 2701446 - RNA, 16 nt, Human
cuaguaauuggaaagg

SEQ ID NO: 2701447 - RNA, 15 nt, Human
cugcaauaaaauggg

SEQ ID NO: 2701448 - RNA, 22 nt, Human
cugcaauaaaauggguuuuacu

SEQ ID NO: 2701449 - RNA, 15 nt, Human
cugaggcuccacuug

SEQ ID NO: 2701450 - RNA, 21 nt, Human
cugaggcuccacuuggucugu

SEQ ID NO: 2701451 - RNA, 20 nt, Human
cugcaucagcugcugaaaca

SEQ ID NO: 2701452 - RNA, 14 nt, Human
cugaagaagauggu

SEQ ID NO: 2701453 - RNA, 23 nt, Human
cugacgacuugagugcucaguag

SEQ ID NO: 2701454 - RNA, 18 nt, Human
cugagaaagacuauucaa

SEQ ID NO: 2701455 - RNA, 15 nt, Human
cugagaaagacuauu

SEQ ID NO: 2701456 - RNA, 13 nt, Human
cugagaaagacua

SEQ ID NO: 2701457 - RNA, 12 nt, Human
cugagaaagacu

SEQ ID NO: 2701458 - RNA, 21 nt, Human
cugagaugugaacacaucagc

SEQ ID NO: 2701459 - RNA, 20 nt, Human
cugagaaagacuauucaaac

SEQ ID NO: 2701460 - RNA, 19 nt, Human
cugagaaagacuauucaaa

SEQ ID NO: 2701461 - RNA, 20 nt, Human
cugagaugugaacacaucag

SEQ ID NO: 2701462 - RNA, 16 nt, Human
cugagaugugaacaca

SEQ ID NO: 2701463 - RNA, 16 nt, Human
cugagcaggauuuuaa

SEQ ID NO: 2701464 - RNA, 21 nt, Human
cucuggccuucggccuccauc

SEQ ID NO: 2701465 - RNA, 22 nt, Human
cucuggccuucggccuccaucc

SEQ ID NO: 2701466 - RNA, 19 nt, Human
cucuuaagaagacugcauu

SEQ ID NO: 2701467 - RNA, 14 nt, Human
gagcugcccucucc

SEQ ID NO: 2701468 - RNA, 17 nt, Human
gagcugcccucuccugg

SEQ ID NO: 2701469 - RNA, 15 nt, Human
gagcugcccucuccu

SEQ ID NO: 2701470 - RNA, 16 nt, Human
gagcugcccucuccug

SEQ ID NO: 2701471 - RNA, 14 nt, Human
gagcuacaaaugca

SEQ ID NO: 2701472 - RNA, 13 nt, Human
gagcuacaaaugc

SEQ ID NO: 2701473 - RNA, 12 nt, Human
gagcuacaaaug

SEQ ID NO: 2701474 - RNA, 21 nt, Human
gagcaggcuacugucagcucc

SEQ ID NO: 2701475 - RNA, 19 nt, Human
gaggcagagguugcaguga

SEQ ID NO: 2701476 - RNA, 14 nt, Human
gaucuuuaaaauac

SEQ ID NO: 2701477 - RNA, 16 nt, Human
gaugggaaagcauugu

SEQ ID NO: 2701478 - RNA, 18 nt, Human
gaugcaguucugaagaag

SEQ ID NO: 2701479 - RNA, 19 nt, Human
gauguugaaaaaguucugc

SEQ ID NO: 2701480 - RNA, 13 nt, Human
gauugugccccug

SEQ ID NO: 2701481 - RNA, 21 nt, Human
gaguugaaaaucuuauaauuu

SEQ ID NO: 2701482 - RNA, 23 nt, Human
gagugaacaaauuuacagagaca

SEQ ID NO: 2701483 - RNA, 22 nt, Human
gagugaacaaauuuacagagac

SEQ ID NO: 2701484 - RNA, 19 nt, Human
gagugaacaaauuuacaga

SEQ ID NO: 2701485 - RNA, 19 nt, Human
gagugucuuaauuaaaaga

SEQ ID NO: 2701486 - RNA, 13 nt, Human
gauagcagggcau

SEQ ID NO: 2701487 - RNA, 22 nt, Human
gccaugggacagggaggacgcu

SEQ ID NO: 2701488 - RNA, 23 nt, Human
gccaugggacagggaggacgcuc

SEQ ID NO: 2701489 - RNA, 18 nt, Human
gccagacuggcacaguuu

SEQ ID NO: 2701490 - RNA, 15 nt, Human
gccagacuggcacag

SEQ ID NO: 2701491 - RNA, 19 nt, Human
gccagacuggcacaguuuu

SEQ ID NO: 2701492 - RNA, 16 nt, Human
gcaggaagcugugaga

SEQ ID NO: 2701493 - RNA, 23 nt, Human
gcagagguugcagugagccgaga

SEQ ID NO: 2701494 - RNA, 18 nt, Human
gcagagguugcagugagc

SEQ ID NO: 2701495 - RNA, 15 nt, Human
gcacagccucuuaga

SEQ ID NO: 2701496 - RNA, 18 nt, Human
gcacagccucuuagaugc

SEQ ID NO: 2701497 - RNA, 19 nt, Human
gcacuguggguagacacac

SEQ ID NO: 2701498 - RNA, 15 nt, Human
gcacgcacacugucu

SEQ ID NO: 2701499 - RNA, 16 nt, Human
gcacgcacacugucug

SEQ ID NO: 2701500 - RNA, 23 nt, Human
gcaucagcugcugaaacaacaaa

SEQ ID NO: 2701501 - RNA, 22 nt, Human
gcaucagcugcugaaacaacaa

SEQ ID NO: 2701502 - RNA, 15 nt, Human
gcaguugaaaagacu

SEQ ID NO: 2701503 - RNA, 19 nt, Human
gcaguugaaaagacuccaa

SEQ ID NO: 2701504 - RNA, 16 nt, Human
gcaguugaaaagacuc

SEQ ID NO: 2701505 - RNA, 21 nt, Human
gcaguugaaaagacuccaaag

SEQ ID NO: 2701506 - RNA, 19 nt, Human
gcaguucagagcugcccuc

SEQ ID NO: 2701507 - RNA, 20 nt, Human
gcaguucagagcugcccucu

SEQ ID NO: 2701508 - RNA, 22 nt, Human
gcaguucagagcugcccucucc

SEQ ID NO: 2701509 - RNA, 23 nt, Human
gcaguucagagcugcccucuccu

SEQ ID NO: 2701510 - RNA, 19 nt, Human
gcuucuguuuuauaauuuu

SEQ ID NO: 2701511 - RNA, 23 nt, Human
gcuggucccagccagcaguucag

SEQ ID NO: 2701512 - RNA, 12 nt, Human
gcugcccucucc

SEQ ID NO: 2701513 - RNA, 21 nt, Human
gcugauuaaaccaaggcuaga

SEQ ID NO: 2701514 - RNA, 13 nt, Human
gcugcccucuccu

SEQ ID NO: 2701515 - RNA, 14 nt, Human
gcugcccucuccug

SEQ ID NO: 2701516 - RNA, 15 nt, Human
gcugcccucuccugg

SEQ ID NO: 2701517 - RNA, 16 nt, Human
gcugcccucuccuggg

SEQ ID NO: 2701518 - RNA, 17 nt, Human
gcugcccucuccugggc

SEQ ID NO: 2701519 - RNA, 18 nt, Human
gcugcccucuccugggca

SEQ ID NO: 2701520 - RNA, 20 nt, Human
gcugcccucuccugggcagc

SEQ ID NO: 2701521 - RNA, 22 nt, Human
gcugcccucuccugggcagcug

SEQ ID NO: 2701522 - RNA, 23 nt, Human
gcugcccucuccugggcagcugc

SEQ ID NO: 2701523 - RNA, 23 nt, Human
gcuggaaaaguauguuagugcaa

SEQ ID NO: 2701524 - RNA, 21 nt, Human
gcuggaaaaguauguuagugc

SEQ ID NO: 2701525 - RNA, 20 nt, Human
gcuccauuuuuagugaaaua

SEQ ID NO: 2701526 - RNA, 19 nt, Human
gcuauaggugcuacaaaaa

SEQ ID NO: 2701527 - RNA, 21 nt, Human
gcuauaggugcuacaaaaaca

SEQ ID NO: 2701528 - RNA, 13 nt, Human
gcuagauguaugu

SEQ ID NO: 2701529 - RNA, 14 nt, Human
gcuagauguaugua

SEQ ID NO: 2701530 - RNA, 16 nt, Human
gcuagauguauguacu

SEQ ID NO: 2701531 - RNA, 20 nt, Human
gccugagcgacagugagacu

SEQ ID NO: 2701532 - RNA, 17 nt, Human
gccugagcgacagugag

SEQ ID NO: 2701533 - RNA, 18 nt, Human
gccuuggggcugaugcag

SEQ ID NO: 2701534 - RNA, 16 nt, Human
ggcuccacuuggucug

SEQ ID NO: 2701535 - RNA, 23 nt, Human
ggcuauaggugcuacaaaaacac

SEQ ID NO: 2701536 - RNA, 20 nt, Human
ggcuaguaucaaaagaaaga

SEQ ID NO: 2701537 - RNA, 14 nt, Human
gggaauugaggaca

SEQ ID NO: 2701538 - RNA, 21 nt, Human
gggacugaggggaggggagca

SEQ ID NO: 2701539 - RNA, 20 nt, Human
gggaggacgcucucuggccu

SEQ ID NO: 2701540 - RNA, 17 nt, Human
gggaggacgcucucugg

SEQ ID NO: 2701541 - RNA, 19 nt, Human
ggauugaaggaugcugucu

SEQ ID NO: 2701542 - RNA, 21 nt, Human
ggcagagguugcagugagccg

SEQ ID NO: 2701543 - RNA, 17 nt, Human
ggauuagggagagaaga

SEQ ID NO: 2701544 - RNA, 11 nt, Human
ggcagcugccu

SEQ ID NO: 2701545 - RNA, 12 nt, Human
ggcagcugccuc

SEQ ID NO: 2701546 - RNA, 13 nt, Human
ggcagcugccucc

SEQ ID NO: 2701547 - RNA, 16 nt, Human
ggcagcugccuccccu

SEQ ID NO: 2701548 - RNA, 16 nt, Human
ggacauuugcucaugg

SEQ ID NO: 2701549 - RNA, 17 nt, Human
ggacauuugcucaugga

SEQ ID NO: 2701550 - RNA, 20 nt, Human
ggacauuugcucauggaauu

SEQ ID NO: 2701551 - RNA, 15 nt, Human
ggagaagagcuguuc

SEQ ID NO: 2701552 - RNA, 11 nt, Human
ggagaagaacu

SEQ ID NO: 2701553 - RNA, 14 nt, Human
ggagaagaacugaa

SEQ ID NO: 2701554 - RNA, 23 nt, Human
ggagaagagcuguucacagccag

SEQ ID NO: 2701555 - RNA, 19 nt, Human
ggacgcucucuggccuucg

SEQ ID NO: 2701556 - RNA, 16 nt, Human
ggacgcucucuggccu

SEQ ID NO: 2701557 - RNA, 15 nt, Human
ggacgcucucuggcc

SEQ ID NO: 2701558 - RNA, 19 nt, Human
ggaggggagcaugggaagu

SEQ ID NO: 2701559 - RNA, 16 nt, Human
ggaggacgcucucugg

SEQ ID NO: 2701560 - RNA, 18 nt, Human
ggagcccugucuccucuc

SEQ ID NO: 2701561 - RNA, 23 nt, Human
ggagcccugucuccucucucugu

SEQ ID NO: 2701562 - RNA, 19 nt, Human
ucagagcugcccucuccug

SEQ ID NO: 2701563 - RNA, 20 nt, Human
ucagagcugcccucuccugg

SEQ ID NO: 2701564 - RNA, 21 nt, Human
ucagagcugcccucuccuggg

SEQ ID NO: 2701565 - RNA, 22 nt, Human
ucagagcugcccucuccugggc

SEQ ID NO: 2701566 - RNA, 23 nt, Human
ucagagcugcccucuccugggca

SEQ ID NO: 2701567 - RNA, 17 nt, Human
ucagcuccccucggaga

SEQ ID NO: 2701568 - RNA, 18 nt, Human
ucagcuccccucggagaa

SEQ ID NO: 2701569 - RNA, 13 nt, Human
ucaggcuagaugu

SEQ ID NO: 2701570 - RNA, 17 nt, Human
ucaggcuagauguaugu

SEQ ID NO: 2701571 - RNA, 19 nt, Human
uccacagaagcuccaggua

SEQ ID NO: 2701572 - RNA, 13 nt, Human
uccaccucccugc

SEQ ID NO: 2701573 - RNA, 14 nt, Human
uccaccucccugca

SEQ ID NO: 2701574 - RNA, 15 nt, Human
uccaccucccugcaa

SEQ ID NO: 2701575 - RNA, 16 nt, Human
uccaccucccugcaau

SEQ ID NO: 2701576 - RNA, 17 nt, Human
uccaccucccugcaaua

SEQ ID NO: 2701577 - RNA, 14 nt, Human
uccacuuggucugu

SEQ ID NO: 2701578 - RNA, 16 nt, Human
uccacuuggucuguga

SEQ ID NO: 2701579 - RNA, 15 nt, Human
uccacuuggucugug

SEQ ID NO: 2701580 - RNA, 18 nt, Human
ucauaccuaucaucuuaa

SEQ ID NO: 2701581 - RNA, 13 nt, Human
ucauuaucucaaa

SEQ ID NO: 2701582 - RNA, 20 nt, Human
ucauuaucucaaaacugcac

SEQ ID NO: 2701583 - RNA, 19 nt, Human
ucauuaucucaaaacugca

SEQ ID NO: 2701584 - RNA, 13 nt, Human
ucauuuccaagca

SEQ ID NO: 2701585 - RNA, 16 nt, Human
ucauuuccaagcaagu

SEQ ID NO: 2701586 - RNA, 13 nt, Human
uauguacuucaug

SEQ ID NO: 2701587 - RNA, 17 nt, Human
uauguacuucaugcugu

SEQ ID NO: 2701588 - RNA, 16 nt, Human
uauuauucccauucua

SEQ ID NO: 2701589 - RNA, 14 nt, Human
ucaaauugugugaa

SEQ ID NO: 2701590 - RNA, 20 nt, Human
ucaaaucaagaaacuuaagg

SEQ ID NO: 2701591 - RNA, 14 nt, Human
ucaaauaugcaaag

SEQ ID NO: 2701592 - RNA, 21 nt, Human
ucaauaaaauccauacauuug

SEQ ID NO: 2701593 - RNA, 13 nt, Human
ucaaugcagcccc

SEQ ID NO: 2701594 - RNA, 13 nt, Human
ucacaagacccaa

SEQ ID NO: 2701595 - RNA, 18 nt, Human
ucacaagacccaaaaggc

SEQ ID NO: 2701596 - RNA, 17 nt, Human
ucacaagacccaaaagg

SEQ ID NO: 2701597 - RNA, 16 nt, Human
ucacagucacauucca

SEQ ID NO: 2701598 - RNA, 14 nt, Human
ucaccaaggcugau

SEQ ID NO: 2701599 - RNA, 16 nt, Human
uccuuggacucauuuu

SEQ ID NO: 2701600 - RNA, 22 nt, Human
uccugucggagcccugucuccu

SEQ ID NO: 2701601 - RNA, 19 nt, Human
uccugucggagcccugucu

SEQ ID NO: 2701602 - RNA, 20 nt, Human
uccugccuaagugcagcccc

SEQ ID NO: 2701603 - RNA, 17 nt, Human
uccuggcaauagucaaa

SEQ ID NO: 2701604 - RNA, 13 nt, Human
ucguuaauuugua

SEQ ID NO: 2701605 - RNA, 17 nt, Human
ucggccuccauccugag

SEQ ID NO: 2701606 - RNA, 18 nt, Human
ucggccuccauccugagg

SEQ ID NO: 2701607 - RNA, 21 nt, Human
ucguggaacaguuaccucugc

SEQ ID NO: 2701608 - RNA, 22 nt, Human
ucgugggacagucaccucaugg

SEQ ID NO: 2701609 - RNA, 13 nt, Human
ucuaugaaauauu

SEQ ID NO: 2701610 - RNA, 14 nt, Human
ucuaugaaauauua

SEQ ID NO: 2701611 - RNA, 17 nt, Human
ucuaugaaauauuaugu

SEQ ID NO: 2701612 - RNA, 15 nt, Human
ucucaacuccaaacu

SEQ ID NO: 2701613 - RNA, 19 nt, Human
ucuagugagcagucaggaa

SEQ ID NO: 2701614 - RNA, 22 nt, Human
ucuagugagcagucaggaaaga

SEQ ID NO: 2701615 - RNA, 20 nt, Human
uccucugcuugccaucccuc

SEQ ID NO: 2701616 - RNA, 19 nt, Human
uccucugcuugccaucccu

SEQ ID NO: 2701617 - RNA, 21 nt, Human
uccucugcuugccaucccucc

SEQ ID NO: 2701618 - RNA, 22 nt, Human
uccucugcuugccaucccuccc

SEQ ID NO: 2701619 - RNA, 15 nt, Human
ucccuugaugaagaa

SEQ ID NO: 2701620 - RNA, 16 nt, Human
ucccuugaugaagaag

SEQ ID NO: 2701621 - RNA, 16 nt, Human
ucccugcaauaaaaug

SEQ ID NO: 2701622 - RNA, 18 nt, Human
ucucuguaauaaacucau

SEQ ID NO: 2701623 - RNA, 22 nt, Human
ucucuguaauaaacucauuucu

SEQ ID NO: 2701624 - RNA, 14 nt, Human
ucugcaucagcugc

SEQ ID NO: 2701625 - RNA, 21 nt, Human
ucugcaucagcugcugaaaca

SEQ ID NO: 2701626 - RNA, 19 nt, Human
ucugcaucagcugcugaaa

SEQ ID NO: 2701627 - RNA, 15 nt, Human
ucugucuucacaaca

SEQ ID NO: 2701628 - RNA, 18 nt, Human
ucuuaagaagacugcauu

SEQ ID NO: 2701629 - RNA, 12 nt, Human
ucuuaagaagac

SEQ ID NO: 2701630 - RNA, 18 nt, Human
ucuggccuucggccucca

SEQ ID NO: 2701631 - RNA, 17 nt, Human
ucuggccuucggccucc

SEQ ID NO: 2701632 - RNA, 12 nt, Human
uguaaaauggug

SEQ ID NO: 2701633 - RNA, 11 nt, Human
uguaaaauggu

SEQ ID NO: 2701634 - RNA, 16 nt, Human
ugguucccuugaugaa

SEQ ID NO: 2701635 - RNA, 17 nt, Human
ugguucccuugaugaag

SEQ ID NO: 2701636 - RNA, 20 nt, Human
ugguucccuugaugaagaag

SEQ ID NO: 2701637 - RNA, 14 nt, Human
uggguagacacaca

SEQ ID NO: 2701638 - RNA, 22 nt, Human
ugucuacacuaagagagaauga

SEQ ID NO: 2701639 - RNA, 17 nt, Human
ugucuacacuaagagag

SEQ ID NO: 2701640 - RNA, 12 nt, Human
ugucuuaauuaa

SEQ ID NO: 2701641 - RNA, 19 nt, Human
uguaguguuggagaagaac

SEQ ID NO: 2701642 - RNA, 20 nt, Human
uguaguguuggagaagaacu

SEQ ID NO: 2701643 - RNA, 21 nt, Human
uguaguguuggagaagaacug

SEQ ID NO: 2701644 - RNA, 13 nt, Human
uguauaaaauaau

SEQ ID NO: 2701645 - RNA, 14 nt, Human
uguauaaaauaauu

SEQ ID NO: 2701646 - RNA, 18 nt, Human
uguauuuuaaaagaauga

SEQ ID NO: 2701647 - RNA, 19 nt, Human
uguauuuuaaaagaaugau

SEQ ID NO: 2701648 - RNA, 17 nt, Human
ugcuucuguuuuauaau

SEQ ID NO: 2701649 - RNA, 22 nt, Human
uggaaaaguauguuagugcaaa

SEQ ID NO: 2701650 - RNA, 22 nt, Human
ugcuucuguuuuauaauuuugu

SEQ ID NO: 2701651 - RNA, 23 nt, Human
uggccuucggccuccauccugag

SEQ ID NO: 2701652 - RNA, 20 nt, Human
uggccuucggccuccauccu

SEQ ID NO: 2701653 - RNA, 22 nt, Human
uggccuucggccuccauccuga

SEQ ID NO: 2701654 - RNA, 14 nt, Human
ugggacagggagga

SEQ ID NO: 2701655 - RNA, 12 nt, Human
ugggcagcugcc

SEQ ID NO: 2701656 - RNA, 20 nt, Human
ugggcagcugccuccccucc

SEQ ID NO: 2701657 - RNA, 22 nt, Human
ugggcagcugccuccccuccuc

SEQ ID NO: 2701658 - RNA, 23 nt, Human
ugggcagcugccuccccuccucu

SEQ ID NO: 2701659 - RNA, 12 nt, Human
ugacucuuaaga

SEQ ID NO: 2701660 - RNA, 17 nt, Human
ugagaaagacuauucaa

SEQ ID NO: 2701661 - RNA, 16 nt, Human
ugagaaagacuauuca

SEQ ID NO: 2701662 - RNA, 20 nt, Human
ugagaaagacuauucaaaca

SEQ ID NO: 2701663 - RNA, 18 nt, Human
ugagaaagacuauucaaa

SEQ ID NO: 2701664 - RNA, 16 nt, Human
ugagacagcucugcau

SEQ ID NO: 2701665 - RNA, 14 nt, Human
ugagacagcucugc

SEQ ID NO: 2701666 - RNA, 20 nt, Human
ugagaugcuagaacucccuu

SEQ ID NO: 2701667 - RNA, 16 nt, Human
ugagaugcuagaacuc

SEQ ID NO: 2701668 - RNA, 14 nt, Human
ugagaugcuagaac

SEQ ID NO: 2701669 - RNA, 20 nt, Human
ugagcagucaggaaagagaa

SEQ ID NO: 2701670 - RNA, 17 nt, Human
ugagcagucaggaaaga

SEQ ID NO: 2701671 - RNA, 15 nt, Human
ugagcagucaggaaa

SEQ ID NO: 2701672 - RNA, 24 nt, Human
ugauaguuguaccgcaaugugacu

SEQ ID NO: 2701673 - RNA, 21 nt, Human
ugcauuauauuuauuacugua

SEQ ID NO: 2701674 - RNA, 19 nt, Human
ugcagauaaacaguaguga

SEQ ID NO: 2701675 - RNA, 17 nt, Human
ugcaugguuuagaaagc

SEQ ID NO: 2701676 - RNA, 16 nt, Human
ugcacgcacacugucu

SEQ ID NO: 2701677 - RNA, 17 nt, Human
ugcacgcacacugucug

SEQ ID NO: 2701678 - RNA, 16 nt, Human
ugcacugucaagauga

SEQ ID NO: 2701679 - RNA, 13 nt, Human
uuuucuuauuuca

SEQ ID NO: 2701680 - RNA, 13 nt, Human
uuuuauauuugaa

SEQ ID NO: 2701681 - RNA, 18 nt, Human
uuuuauauuugaaauauu

SEQ ID NO: 2701682 - RNA, 21 nt, Human
uuuuaaaguaacccuacaaaa

SEQ ID NO: 2701683 - RNA, 21 nt, Human
uuuuauaauuuugugaagcaa

SEQ ID NO: 2701684 - RNA, 23 nt, Human
uuuuauaauuuugugaagcaaaa

SEQ ID NO: 2701685 - RNA, 15 nt, Human
uuuccacagaagcuc

SEQ ID NO: 2701686 - RNA, 17 nt, Human
uuuguauaaaauaauuu

SEQ ID NO: 2701687 - RNA, 18 nt, Human
uuuguauaaaauaauuuu

SEQ ID NO: 2701688 - RNA, 19 nt, Human
uuuguauaaaauaauuuuu

SEQ ID NO: 2701689 - RNA, 19 nt, Human
uuuaacucuauaauguguu

SEQ ID NO: 2701690 - RNA, 13 nt, Human
uuuaauaauguuu

SEQ ID NO: 2701691 - RNA, 13 nt, Human
uuuaccacuugug

SEQ ID NO: 2701692 - RNA, 17 nt, Human
uuuauggcacuaguauu

SEQ ID NO: 2701693 - RNA, 22 nt, Human
uuuauaauuuugugaagcaaaa

SEQ ID NO: 2701694 - RNA, 22 nt, Human
uuuauuguuuaaaaucauuucu

SEQ ID NO: 2701695 - RNA, 14 nt, Human
uuguuuaaaaucau

SEQ ID NO: 2701696 - RNA, 18 nt, Human
uuguguuuugcaagccag

SEQ ID NO: 2701697 - RNA, 12 nt, Human
uugugccccugc

SEQ ID NO: 2701698 - RNA, 15 nt, Human
uugucuagugaaacu

SEQ ID NO: 2701699 - RNA, 16 nt, Human
uuggucugugagaugc

SEQ ID NO: 2701700 - RNA, 18 nt, Human
uuauggcuauaggugcua

SEQ ID NO: 2701701 - RNA, 22 nt, Human
uuaugauuaaguaaugauaacu

SEQ ID NO: 2701702 - RNA, 11 nt, Human
uuaucucaaaa

SEQ ID NO: 2701703 - RNA, 16 nt, Human
uuauauuuacaaaugg

SEQ ID NO: 2701704 - RNA, 20 nt, Human
uuauauuuauuacuguaaga

SEQ ID NO: 2701705 - RNA, 12 nt, Human
uuauauuugaaa

SEQ ID NO: 2701706 - RNA, 13 nt, Human
uuauauuugaaau

SEQ ID NO: 2701707 - RNA, 15 nt, Human
uuauauuugaaauau

SEQ ID NO: 2701708 - RNA, 11 nt, Human
uuauaaucuuu

SEQ ID NO: 2701709 - RNA, 14 nt, Human
uuauaauuuuguga

SEQ ID NO: 2701710 - RNA, 15 nt, Human
uuauaauuuugugaa

SEQ ID NO: 2701711 - RNA, 12 nt, Human
uuauaauuuaaa

SEQ ID NO: 2701712 - RNA, 16 nt, Human
uuauaauuuugugaag

SEQ ID NO: 2701713 - RNA, 17 nt, Human
uuauaauuuugugaagc

SEQ ID NO: 2701714 - RNA, 18 nt, Human
uuauaauuuugugaagca

SEQ ID NO: 2701715 - RNA, 15 nt, Human
uucagagcugcccuc

SEQ ID NO: 2701716 - RNA, 17 nt, Human
uucagagcugcccucuc

SEQ ID NO: 2701717 - RNA, 18 nt, Human
uucagagcugcccucucc

SEQ ID NO: 2701718 - RNA, 19 nt, Human
uucagagcugcccucuccu

SEQ ID NO: 2701719 - RNA, 20 nt, Human
uucagagcugcccucuccug

SEQ ID NO: 2701720 - RNA, 20 nt, Human
uucagauaaucacaauacau

SEQ ID NO: 2701721 - RNA, 20 nt, Human
uuauuuuaauaauguuucaa

SEQ ID NO: 2701722 - RNA, 19 nt, Human
uuauuuuaauaauguuuca

SEQ ID NO: 2701723 - RNA, 18 nt, Human
uuccagauccuggaaauc

SEQ ID NO: 2701724 - RNA, 23 nt, Human
uucaguuauuauauuuacaaaug

SEQ ID NO: 2701725 - RNA, 18 nt, Human
uucggugagcuacaaaug

SEQ ID NO: 2701726 - RNA, 15 nt, Human
uucuacauacuaugg

SEQ ID NO: 2701727 - RNA, 21 nt, Human
uucugagaaagacuauucaaa

SEQ ID NO: 2701728 - RNA, 16 nt, Human
uucugagaaagacuau

SEQ ID NO: 2701729 - RNA, 21 nt, Human
uucuaugaaauauuauguuaa

SEQ ID NO: 2701730 - RNA, 14 nt, Human
uucuaugaaauauu

SEQ ID NO: 2701731 - RNA, 17 nt, Human
uugacccacaagaaaug

SEQ ID NO: 2701732 - RNA, 14 nt, Human
uugacccacaagaa

SEQ ID NO: 2701733 - RNA, 23 nt, Human
uugaugaagaaguugauaugccu

SEQ ID NO: 2701734 - RNA, 13 nt, Human
uugaugaagaagu

SEQ ID NO: 2701735 - RNA, 14 nt, Human
uugaugaagaaguu

SEQ ID NO: 2701736 - RNA, 17 nt, Human
uucugucuucacaacag

SEQ ID NO: 2701737 - RNA, 15 nt, Human
gcuagaacucccuuu

SEQ ID NO: 2701738 - RNA, 21 nt, Human parainfluenza virus 2
ccaagaaagauuuaacaggca

SEQ ID NO: 2701739 - RNA, 14 nt, Human parainfluenza virus 2
ccacucacacacuc

SEQ ID NO: 2701740 - RNA, 11 nt, Human parainfluenza virus 2
gucaacugauu

SEQ ID NO: 2701741 - RNA, 18 nt, Human parainfluenza virus 2
ugauuauaagaacucaug

SEQ ID NO: 2701742 - RNA, 15 nt, Human parainfluenza virus 2
cacagaaucacagcu

SEQ ID NO: 2701743 - RNA, 17 nt, Human parainfluenza virus 2
uaaaaaugaaaugacua

SEQ ID NO: 2701744 - RNA, 13 nt, Human parainfluenza virus 2
auacacauccaca

SEQ ID NO: 2701745 - RNA, 15 nt, Human parainfluenza virus 2
caacaccaagaaaca

SEQ ID NO: 2701746 - RNA, 23 nt, Human parainfluenza virus 2
cacucagagauacagcugccacu

SEQ ID NO: 2701747 - RNA, 17 nt, Human parainfluenza virus 2
ucucaucauuuacuguu

SEQ ID NO: 2701748 - RNA, 19 nt, Human parainfluenza virus 2
aaaggcucucuaucuuaug

SEQ ID NO: 2701749 - RNA, 13 nt, Human parainfluenza virus 2
gcauccaaucaag

SEQ ID NO: 2701750 - RNA, 16 nt, Human parainfluenza virus 2
acucaugauaguuuua

SEQ ID NO: 2701751 - RNA, 17 nt, Human parainfluenza virus 2
gaggagaucagaaagag

SEQ ID NO: 2701752 - RNA, 20 nt, Human parainfluenza virus 2
gucacacaagagacacucaa

SEQ ID NO: 2701753 - RNA, 15 nt, Human parainfluenza virus 2
agauaccaaugaaua

SEQ ID NO: 2701754 - RNA, 11 nt, Human parainfluenza virus 2
auguuaucaua

SEQ ID NO: 2701755 - RNA, 16 nt, Human parainfluenza virus 2
caaacuagacucacau

SEQ ID NO: 2701756 - RNA, 14 nt, Human parainfluenza virus 2
cucaaccaaaagac

SEQ ID NO: 2701757 - RNA, 17 nt, Human parainfluenza virus 2
acacacucauccagaca

SEQ ID NO: 2701758 - RNA, 15 nt, Human parainfluenza virus 2
caacaccucacauca

SEQ ID NO: 2701759 - RNA, 16 nt, Human parainfluenza virus 2
uccacaucacucagag

SEQ ID NO: 2701760 - RNA, 17 nt, Human parainfluenza virus 2
cauccacaucacucaga

SEQ ID NO: 2701761 - RNA, 17 nt, Human parainfluenza virus 2
cuugcaacuucugcaac

SEQ ID NO: 2701762 - RNA, 13 nt, Human parainfluenza virus 2
auccagacaaauc

SEQ ID NO: 2701763 - RNA, 13 nt, Human parainfluenza virus 2
agaaggcuggaca

SEQ ID NO: 2701764 - RNA, 19 nt, Human parainfluenza virus 2
uugucaacaccaagaaaca

SEQ ID NO: 2701765 - RNA, 20 nt, Human parainfluenza virus 2
cagauaccaagacugaguuc

SEQ ID NO: 2701766 - RNA, 17 nt, Human parainfluenza virus 2
ucaacaccaagaaacaa

SEQ ID NO: 2701767 - RNA, 15 nt, Human parainfluenza virus 2
ccagauauacacauc

SEQ ID NO: 2701768 - RNA, 15 nt, Human parainfluenza virus 2
ucaacaccaagaaac

SEQ ID NO: 2701769 - RNA, 12 nt, Human parainfluenza virus 2
gaaggcuggaca

SEQ ID NO: 2701770 - RNA, 17 nt, Human parainfluenza virus 2
acucaacaugcauccaa

SEQ ID NO: 2701771 - RNA, 15 nt, Human parainfluenza virus 2
caauuuuagucaacu

SEQ ID NO: 2701772 - RNA, 16 nt, Human parainfluenza virus 2
aguauaauaguuuaaa

SEQ ID NO: 2701773 - RNA, 13 nt, Human parainfluenza virus 2
uucugcuguuuuu

SEQ ID NO: 2701774 - RNA, 15 nt, Human parainfluenza virus 2
acuuagguucaauuu

SEQ ID NO: 2701775 - RNA, 19 nt, Human parainfluenza virus 2
ugcagcuugcaaaugacug

SEQ ID NO: 2701776 - RNA, 21 nt, Human parainfluenza virus 2
cgaaagccugaauccaagaaa

SEQ ID NO: 2701777 - RNA, 20 nt, Human parainfluenza virus 2
cucaaggcgaguguugcaac

SEQ ID NO: 2701778 - RNA, 15 nt, Human parainfluenza virus 2
aguuuuauuuaagaa

SEQ ID NO: 2701779 - RNA, 20 nt, Human parainfluenza virus 2
guccgaacugaucaaucuaa

SEQ ID NO: 2701780 - RNA, 18 nt, Human parainfluenza virus 2
ccaaucaagauccagacu

SEQ ID NO: 2701781 - RNA, 19 nt, Human parainfluenza virus 2
caaggcgaguguugcaacu

SEQ ID NO: 2701782 - RNA, 21 nt, Human parainfluenza virus 2
cacagccgaaccaugcucaac

SEQ ID NO: 2701783 - RNA, 13 nt, Human parainfluenza virus 2
ucacaucaauaga

SEQ ID NO: 2701784 - RNA, 14 nt, Human parainfluenza virus 2
uauaucucuuagaa

SEQ ID NO: 2701785 - RNA, 17 nt, Human parainfluenza virus 2
ucacacaagagacacuc

SEQ ID NO: 2701786 - RNA, 20 nt, Human parainfluenza virus 2
uacaccaacuaaugucccug

SEQ ID NO: 2701787 - RNA, 15 nt, Human parainfluenza virus 2
agaaccaacuuccaa

SEQ ID NO: 2701788 - RNA, 21 nt, Human parainfluenza virus 2
aauuuucucaucauuuacugu

SEQ ID NO: 2701789 - RNA, 17 nt, Human parainfluenza virus 2
uuaaaaaugaaaugacu

SEQ ID NO: 2701790 - RNA, 20 nt, Human parainfluenza virus 2
cacucucaucaacaaaaagg

SEQ ID NO: 2701791 - RNA, 13 nt, Human parainfluenza virus 2
guuaaauuuaagu

SEQ ID NO: 2701792 - RNA, 18 nt, Human parainfluenza virus 2
aucaaucuuaaaaaugaa

SEQ ID NO: 2701793 - RNA, 18 nt, Human parainfluenza virus 2
aaucaaacuagacucaca

SEQ ID NO: 2701794 - RNA, 13 nt, Human parainfluenza virus 2
acacucauccaga

SEQ ID NO: 2701795 - RNA, 20 nt, Human parainfluenza virus 2
augcagcuugcaaaugacug

SEQ ID NO: 2701796 - RNA, 12 nt, Human parainfluenza virus 2
ccaagaaacaac

SEQ ID NO: 2701797 - RNA, 17 nt, Human parainfluenza virus 2
uggcuguauuagaaugu

SEQ ID NO: 2701798 - RNA, 15 nt, Human parainfluenza virus 2
aucaagauccagacu

SEQ ID NO: 2701799 - RNA, 20 nt, Human parainfluenza virus 2
aacaaugauuauaagaacuc

SEQ ID NO: 2701800 - RNA, 18 nt, Human parainfluenza virus 2
auacagcugccacucaca

SEQ ID NO: 2701801 - RNA, 17 nt, Human parainfluenza virus 2
accacagaaucacagcu

SEQ ID NO: 2701802 - RNA, 16 nt, Human parainfluenza virus 2
cuagucacuauacaau

SEQ ID NO: 2701803 - RNA, 13 nt, Human parainfluenza virus 2
ucauacaaccaga

SEQ ID NO: 2701804 - RNA, 23 nt, Human parainfluenza virus 2
caacuaguggaggcuucacagcc

SEQ ID NO: 2701805 - RNA, 20 nt, Human parainfluenza virus 2
uaugauaacaacaauuaaaa

SEQ ID NO: 2701806 - RNA, 22 nt, Human parainfluenza virus 2
caugauaguuuuauuuaagaaa

SEQ ID NO: 2701807 - RNA, 12 nt, Human parainfluenza virus 2
acucaacaugca

SEQ ID NO: 2701808 - RNA, 17 nt, Human parainfluenza virus 2
gaacucaugauaguuuu

SEQ ID NO: 2701809 - RNA, 13 nt, Human parainfluenza virus 2
aggcuucacagcc

SEQ ID NO: 2701810 - RNA, 19 nt, Human parainfluenza virus 2
caaugucauacaaccagau

SEQ ID NO: 2701811 - RNA, 23 nt, Human parainfluenza virus 2
ccacucacacacucauccagaca

SEQ ID NO: 2701812 - RNA, 13 nt, Human parainfluenza virus 2
uuauuuaagaaaa

SEQ ID NO: 2701813 - RNA, 13 nt, Human parainfluenza virus 2
uguuauagauucu

SEQ ID NO: 2701814 - RNA, 18 nt, Human parainfluenza virus 2
gaacucaugauaguuuua

SEQ ID NO: 2701815 - RNA, 13 nt, Human parainfluenza virus 2
caacaccaagaaa

SEQ ID NO: 2701816 - RNA, 22 nt, Human parainfluenza virus 2
aagaacucaugauaguuuuauu

SEQ ID NO: 2701817 - RNA, 23 nt, Human parainfluenza virus 2
ccagacuccauccauccaaaaac

SEQ ID NO: 2701818 - RNA, 16 nt, Human parainfluenza virus 2
ugauuauuaugugaua

SEQ ID NO: 2701819 - RNA, 11 nt, Human parainfluenza virus 2
aggcuggacau

SEQ ID NO: 2701820 - RNA, 17 nt, Human parainfluenza virus 2
ucaaacuagacucacau

SEQ ID NO: 2701821 - RNA, 17 nt, Human parainfluenza virus 2
uauacguuuuggcugua

SEQ ID NO: 2701822 - RNA, 13 nt, Human parainfluenza virus 2
ccauaugaagcaa

SEQ ID NO: 2701823 - RNA, 18 nt, Human parainfluenza virus 2
cuccauccauccaaaaac

SEQ ID NO: 2701824 - RNA, 16 nt, Human parainfluenza virus 2
ccacaauugucaacac

SEQ ID NO: 2701825 - RNA, 19 nt, Human parainfluenza virus 2
uuaacaggcauaaaacuaa

SEQ ID NO: 2701826 - RNA, 14 nt, Human parainfluenza virus 2
acucaugauaguuu

SEQ ID NO: 2701827 - RNA, 13 nt, Human parainfluenza virus 2
uuuggcuguauua

SEQ ID NO: 2701828 - RNA, 21 nt, Human parainfluenza virus 2
ucaugauaguuuuauuuaaga

SEQ ID NO: 2701829 - RNA, 21 nt, Human parainfluenza virus 2
ucaacaugcauccaaucaaga

SEQ ID NO: 2701830 - RNA, 15 nt, Human parainfluenza virus 2
caugauaaauuuaau

SEQ ID NO: 2701831 - RNA, 22 nt, Human parainfluenza virus 2
uugaaugaagacuccagauuca

SEQ ID NO: 2701832 - RNA, 19 nt, Human parainfluenza virus 2
aaaaauuaacauuaagccu

SEQ ID NO: 2701833 - RNA, 19 nt, Human parainfluenza virus 2
augauaguuuuauuuaaga

SEQ ID NO: 2701834 - RNA, 18 nt, Human parainfluenza virus 2
auuauaagaacucaugau

SEQ ID NO: 2701835 - RNA, 17 nt, Human parainfluenza virus 2
agccugaauccaagaaa

SEQ ID NO: 2701836 - RNA, 14 nt, Human parainfluenza virus 2
auacgcucugcaau

SEQ ID NO: 2701837 - RNA, 15 nt, Human parainfluenza virus 2
aguacaauuuaagaa

SEQ ID NO: 2701838 - RNA, 21 nt, Human parainfluenza virus 2
acuaguggaggcuucacagcc

SEQ ID NO: 2701839 - RNA, 12 nt, Human parainfluenza virus 2
ccaaacaacacc

SEQ ID NO: 2701840 - RNA, 19 nt, Human parainfluenza virus 2
acaaugauuauaagaacuc

SEQ ID NO: 2701841 - RNA, 19 nt, Human parainfluenza virus 2
cuaagauucaggcagcaac

SEQ ID NO: 2701842 - RNA, 20 nt, Human parainfluenza virus 2
ggcuucacagccgaacaggu

SEQ ID NO: 2701843 - RNA, 17 nt, Human parainfluenza virus 2
cauccauccaaaaacac

SEQ ID NO: 2701844 - RNA, 14 nt, Human parainfluenza virus 2
aaaugaaaugacua

SEQ ID NO: 2701845 - RNA, 16 nt, Human parainfluenza virus 2
uagaaccacaaucaag

SEQ ID NO: 2701846 - RNA, 14 nt, Human parainfluenza virus 2
caacuucugcaacu

SEQ ID NO: 2701847 - RNA, 21 nt, Human parainfluenza virus 2
gcuguuuuucccauaugaagc

SEQ ID NO: 2701848 - RNA, 21 nt, Human parainfluenza virus 2
gccgaaccaugcucaaccaaa

SEQ ID NO: 2701849 - RNA, 15 nt, Human parainfluenza virus 2
cagccgaaccaugcu

SEQ ID NO: 2701850 - RNA, 12 nt, Human parainfluenza virus 2
auaaucaacaau

SEQ ID NO: 2701851 - RNA, 19 nt, Human parainfluenza virus 2
caggcagcaaccacagaau

SEQ ID NO: 2701852 - RNA, 12 nt, Human parainfluenza virus 2
uucugcuguuuu

SEQ ID NO: 2701853 - RNA, 15 nt, Human parainfluenza virus 2
cacauccacaucacu

SEQ ID NO: 2701854 - RNA, 23 nt, Human parainfluenza virus 2
uagaccuacacucucaucaacaa

SEQ ID NO: 2701855 - RNA, 15 nt, Human parainfluenza virus 2
ggcagcaaccacaga

SEQ ID NO: 2701856 - RNA, 11 nt, Human parainfluenza virus 2
ucacucagaga

SEQ ID NO: 2701857 - RNA, 14 nt, Human parainfluenza virus 2
gaaacaaccacagc

SEQ ID NO: 2701858 - RNA, 20 nt, Human parainfluenza virus 2
auauaaaaugaggugcaguc

SEQ ID NO: 2701859 - RNA, 18 nt, Human parainfluenza virus 2
auuuucucaucauuuacu

SEQ ID NO: 2701860 - RNA, 14 nt, Human parainfluenza virus 2
augcagcuugcaaa

SEQ ID NO: 2701861 - RNA, 18 nt, Human parainfluenza virus 2
cagcaucugagaauagaa

SEQ ID NO: 2701862 - RNA, 22 nt, Human parainfluenza virus 2
acaccaagaaacaaccacagcc

SEQ ID NO: 2701863 - RNA, 15 nt, Human parainfluenza virus 2
ugcucaaccaaaaga

SEQ ID NO: 2701864 - RNA, 13 nt, Human parainfluenza virus 2
acauuaagccucc

SEQ ID NO: 2701865 - RNA, 14 nt, Human parainfluenza virus 2
auuagaauguuaua

SEQ ID NO: 2701866 - RNA, 21 nt, Human parainfluenza virus 2
acuaagauucaggcagcaacc

SEQ ID NO: 2701867 - RNA, 17 nt, Human parainfluenza virus 2
aggcgaguguugcaacu

SEQ ID NO: 2701868 - RNA, 17 nt, Human parainfluenza virus 2
caagaaacaaccacagc

SEQ ID NO: 2701869 - RNA, 19 nt, Human parainfluenza virus 2
ccacagaaucacagcuuaa

SEQ ID NO: 2701870 - RNA, 15 nt, Human parainfluenza virus 2
ugcauccaaucaaga

SEQ ID NO: 2701871 - RNA, 18 nt, Human parainfluenza virus 2
cacaauugucaacaccaa

SEQ ID NO: 2701872 - RNA, 14 nt, Human parainfluenza virus 2
ucaauaauaauuga

SEQ ID NO: 2701873 - RNA, 18 nt, Human parainfluenza virus 2
aagaacucaugauaguuu

SEQ ID NO: 2701874 - RNA, 17 nt, Human parainfluenza virus 2
cagccgaaccaugcuca

SEQ ID NO: 2701875 - RNA, 19 nt, Human parainfluenza virus 2
uauugaaugaagacuccag

SEQ ID NO: 2701876 - RNA, 15 nt, Human parainfluenza virus 2
auuauaagaacucau

SEQ ID NO: 2701877 - RNA, 15 nt, Human parainfluenza virus 2
caaucaagucauacu

SEQ ID NO: 2701878 - RNA, 19 nt, Human parainfluenza virus 2
caaugauuauaagaacuca

SEQ ID NO: 2701879 - RNA, 13 nt, Human parainfluenza virus 2
gacucacaucauu

SEQ ID NO: 2701880 - RNA, 20 nt, Human parainfluenza virus 2
uaagauucaggcagcaacca

SEQ ID NO: 2701881 - RNA, 16 nt, Human parainfluenza virus 2
agaaggcuggacauga

SEQ ID NO: 2701882 - RNA, 19 nt, Human parainfluenza virus 2
gauacagcugccacucaca

SEQ ID NO: 2701883 - RNA, 21 nt, Human parainfluenza virus 2
ccacagccgaaccaugcucaa

SEQ ID NO: 2701884 - RNA, 13 nt, Human parainfluenza virus 2
uccauccauccaa

SEQ ID NO: 2701885 - RNA, 18 nt, Human parainfluenza virus 2
ucaacaccgacuuagguu

SEQ ID NO: 2701886 - RNA, 20 nt, Human parainfluenza virus 2
uacuacuagucacuauacaa

SEQ ID NO: 2701887 - RNA, 16 nt, Human parainfluenza virus 2
auuauaagaacucaug

SEQ ID NO: 2701888 - RNA, 17 nt, Human parainfluenza virus 2
uauaagaacucaugaua

SEQ ID NO: 2701889 - RNA, 13 nt, Human parainfluenza virus 2
agcguaguacaau

SEQ ID NO: 2701890 - RNA, 19 nt, Human parainfluenza virus 2
ugcagucacacaagagaca

SEQ ID NO: 2701891 - RNA, 15 nt, Human parainfluenza virus 2
uugacccuuaagaac

SEQ ID NO: 2701892 - RNA, 13 nt, Human parainfluenza virus 2
agacucacaucau

SEQ ID NO: 2701893 - RNA, 15 nt, Human parainfluenza virus 2
agauacagcugccac

SEQ ID NO: 2701894 - RNA, 15 nt, Human parainfluenza virus 2
agagauacagcugcc

SEQ ID NO: 2701895 - RNA, 17 nt, Human parainfluenza virus 2
cugaauccaagaaagau

SEQ ID NO: 2701896 - RNA, 10 nt, Human parainfluenza virus 2
cacucagaga

SEQ ID NO: 2701897 - RNA, 17 nt, Human parainfluenza virus 2
ccacaauugucaacacc

SEQ ID NO: 2701898 - RNA, 17 nt, Human parainfluenza virus 2
ccaaaagacccaaacaa

SEQ ID NO: 2701899 - RNA, 15 nt, Human parainfluenza virus 2
uacacaauguuccag

SEQ ID NO: 2701900 - RNA, 17 nt, Human parainfluenza virus 2
ucacacacucauccaga

SEQ ID NO: 2701901 - RNA, 14 nt, Human parainfluenza virus 2
gcugccacucacac

SEQ ID NO: 2701902 - RNA, 17 nt, Human parainfluenza virus 2
cugcaauauaaaaugag

SEQ ID NO: 2701903 - RNA, 13 nt, Human parainfluenza virus 2
cagacuccaucca

SEQ ID NO: 2701904 - RNA, 17 nt, Human parainfluenza virus 2
aaagaguuuacacaaug

SEQ ID NO: 2701905 - RNA, 20 nt, Human parainfluenza virus 2
ccaaaagacccaaacaacac

SEQ ID NO: 2701906 - RNA, 17 nt, Human parainfluenza virus 2
caacaccaagaaacaac

SEQ ID NO: 2701907 - RNA, 12 nt, Human parainfluenza virus 2
cauaugaagcaa

SEQ ID NO: 2701908 - RNA, 13 nt, Human parainfluenza virus 2
caugauaguuuua

SEQ ID NO: 2701909 - RNA, 18 nt, Human parainfluenza virus 2
guuauacguuuuggcugu

SEQ ID NO: 2701910 - RNA, 19 nt, Human parainfluenza virus 2
cguaguacaauuuaagaaa

SEQ ID NO: 2701911 - RNA, 21 nt, Human parainfluenza virus 2
ccuucagacuguagaagggaa

SEQ ID NO: 2701912 - RNA, 19 nt, Human parainfluenza virus 2
cacucagagauacagcugc

SEQ ID NO: 2701913 - RNA, 14 nt, Human parainfluenza virus 2
acaagagacacuca

SEQ ID NO: 2701914 - RNA, 14 nt, Human parainfluenza virus 2
agaaggcuggacau

SEQ ID NO: 2701915 - RNA, 21 nt, Human parainfluenza virus 2
caugcauccaaucaagaucca

SEQ ID NO: 2701916 - RNA, 13 nt, Human parainfluenza virus 2
uacagcugccacu

SEQ ID NO: 2701917 - RNA, 17 nt, Human parainfluenza virus 2
cagucacacaagagaca

SEQ ID NO: 2701918 - RNA, 10 nt, Human parainfluenza virus 2
agaacucaug

SEQ ID NO: 2701919 - RNA, 20 nt, Human parainfluenza virus 2
gcuggacaugauaaauuuaa

SEQ ID NO: 2701920 - RNA, 13 nt, Human parainfluenza virus 2
acaucaauagaag

SEQ ID NO: 2701921 - RNA, 14 nt, Human parainfluenza virus 2
gcagcaaccacaga

SEQ ID NO: 2701922 - RNA, 22 nt, Human parainfluenza virus 2
auuuacuguuguaauucaaucu

SEQ ID NO: 2701923 - RNA, 18 nt, Human parainfluenza virus 2
uaucuuaugcaauaguua

SEQ ID NO: 2701924 - RNA, 23 nt, Human parainfluenza virus 2
aacaccaagaaacaaccacagcc

SEQ ID NO: 2701925 - RNA, 11 nt, Human parainfluenza virus 2
aucacucagag

SEQ ID NO: 2701926 - RNA, 13 nt, Human parainfluenza virus 2
guccgaacugauc

SEQ ID NO: 2701927 - RNA, 15 nt, Human parainfluenza virus 2
gucaacaccaagaaa

SEQ ID NO: 2701928 - RNA, 19 nt, Human parainfluenza virus 2
auaguuuuauuuaagaaaa

SEQ ID NO: 2701929 - RNA, 11 nt, Human parainfluenza virus 2
cucaacaugca

SEQ ID NO: 2701930 - RNA, 18 nt, Human parainfluenza virus 2
aagguaugauaacaacaa

SEQ ID NO: 2701931 - RNA, 16 nt, Human parainfluenza virus 2
cguaguacaauuuaag

SEQ ID NO: 2701932 - RNA, 13 nt, Human parainfluenza virus 2
uuaacgaaauuaa

SEQ ID NO: 2701933 - RNA, 14 nt, Human parainfluenza virus 2
ccguuaaauuuaag

SEQ ID NO: 2701934 - RNA, 18 nt, Human parainfluenza virus 2
ccaagaaacaaccacagc

SEQ ID NO: 2701935 - RNA, 11 nt, Human parainfluenza virus 2
uccacaucacu

SEQ ID NO: 2701936 - RNA, 23 nt, Human parainfluenza virus 2
auucaggcagcaaccacagaauc

SEQ ID NO: 2701937 - RNA, 14 nt, Human parainfluenza virus 2
uaacgaaauuaaac

SEQ ID NO: 2701938 - RNA, 21 nt, Human parainfluenza virus 2
uacuguuguaauucaaucuua

SEQ ID NO: 2701939 - RNA, 23 nt, Human parainfluenza virus 2
auaauaguuuaaaaauuaacauu

SEQ ID NO: 2701940 - RNA, 17 nt, Human parainfluenza virus 2
cagcugccacucacaca

SEQ ID NO: 2701941 - RNA, 15 nt, Human parainfluenza virus 2
gagaucagaaagagu

SEQ ID NO: 2701942 - RNA, 17 nt, Human parainfluenza virus 2
caaaagacccaaacaac

SEQ ID NO: 2701943 - RNA, 19 nt, Human parainfluenza virus 2
auucuugcaacuucugcaa

SEQ ID NO: 2701944 - RNA, 21 nt, Human parainfluenza virus 2
caccaagaaacaaccacagcc

SEQ ID NO: 2701945 - RNA, 12 nt, Human parainfluenza virus 2
caucauuuacug

SEQ ID NO: 2701946 - RNA, 17 nt, Human parainfluenza virus 2
auuauaagaacucauga

SEQ ID NO: 2701947 - RNA, 21 nt, Human parainfluenza virus 2
cacucacacacucauccagac

SEQ ID NO: 2701948 - RNA, 21 nt, Human parainfluenza virus 2
acaaugauuauaagaacucau

SEQ ID NO: 2701949 - RNA, 18 nt, Human parainfluenza virus 2
auagaaggcuggacauga

SEQ ID NO: 2701950 - RNA, 16 nt, Human parainfluenza virus 2
gauuauaagaacucau

SEQ ID NO: 2701951 - RNA, 22 nt, Human parainfluenza virus 2
uugaugcagcuugcaaaugacu

SEQ ID NO: 2701952 - RNA, 16 nt, Human parainfluenza virus 2
gcuuaacgaaauuaaa

SEQ ID NO: 2701953 - RNA, 21 nt, Human parainfluenza virus 2
uccaaucaagauccagacucc

SEQ ID NO: 2701954 - RNA, 21 nt, Human parainfluenza virus 2
caaccaaaagacccaaacaac

SEQ ID NO: 2701955 - RNA, 20 nt, Human parainfluenza virus 2
caagagacacucaacaugca

SEQ ID NO: 2701956 - RNA, 21 nt, Human parainfluenza virus 2
gaaagccugaauccaagaaag

SEQ ID NO: 2701957 - RNA, 12 nt, Human parainfluenza virus 2
acaccaagaaac

SEQ ID NO: 2701958 - RNA, 17 nt, Human parainfluenza virus 2
agacuccauccauccaa

SEQ ID NO: 2701959 - RNA, 19 nt, Human parainfluenza virus 2
agauaaaauucuugcaacu

SEQ ID NO: 2701960 - RNA, 15 nt, Human parainfluenza virus 2
cggaaacaauucucu

SEQ ID NO: 2701961 - RNA, 14 nt, Human parainfluenza virus 2
uguuguaauucaau

SEQ ID NO: 2701962 - RNA, 21 nt, Human
cugacacaugcugaacaucac

SEQ ID NO: 2701963 - RNA, 13 nt, Human
cugaaagaggaau

SEQ ID NO: 2701964 - RNA, 17 nt, Human
cugaaagaggaaugaag

SEQ ID NO: 2701965 - RNA, 19 nt, Human
cucucuggccuucggccuc

SEQ ID NO: 2701966 - RNA, 22 nt, Human
cucucuggccuucggccuccau

SEQ ID NO: 2701967 - RNA, 17 nt, Human
cucucuggccuucggcc

SEQ ID NO: 2701968 - RNA, 13 nt, Human
cucaaaacugcac

SEQ ID NO: 2701969 - RNA, 23 nt, Human
cucagaaaacaaggaugaauuaa

SEQ ID NO: 2701970 - RNA, 19 nt, Human
cucagaaaacaaggaugaa

SEQ ID NO: 2701971 - RNA, 14 nt, Human
cuaacuggacuggu

SEQ ID NO: 2701972 - RNA, 15 nt, Human
cgguuuauauaagcu

SEQ ID NO: 2701973 - RNA, 23 nt, Human
cggagaagagcuguucacagcca

SEQ ID NO: 2701974 - RNA, 24 nt, Human
cggagaagagcuguucacagccag

SEQ ID NO: 2701975 - RNA, 24 nt, Human
cccagccagcaguucagagcugcc

SEQ ID NO: 2701976 - RNA, 13 nt, Human
ccccugcacucca

SEQ ID NO: 2701977 - RNA, 22 nt, Human
cccuccucugcuugccaucccu

SEQ ID NO: 2701978 - RNA, 13 nt, Human
cccuccucugcuu

SEQ ID NO: 2701979 - RNA, 15 nt, Human
ccaucccucccucca

SEQ ID NO: 2701980 - RNA, 14 nt, Human
ccaucccucccucc

SEQ ID NO: 2701981 - RNA, 13 nt, Human
ccaucccucccuc

SEQ ID NO: 2701982 - RNA, 13 nt, Human
cccaacuccagaa

SEQ ID NO: 2701983 - RNA, 17 nt, Human
ccugucucuacuaaaaa

SEQ ID NO: 2701984 - RNA, 16 nt, Human
ccucccuucucuucac

SEQ ID NO: 2701985 - RNA, 12 nt, Human
ccucggagaaga

SEQ ID NO: 2701986 - RNA, 14 nt, Human
ccucggagaagagc

SEQ ID NO: 2701987 - RNA, 23 nt, Human
cacuccagccugagcgacaguga

SEQ ID NO: 2701988 - RNA, 12 nt, Human
cacuccagccug

SEQ ID NO: 2701989 - RNA, 13 nt, Human
cacuccagccuga

SEQ ID NO: 2701990 - RNA, 12 nt, Human
cagaacagugau

SEQ ID NO: 2701991 - RNA, 17 nt, Human
cagaacagugauuacca

SEQ ID NO: 2701992 - RNA, 11 nt, Human
cagaacaguga

SEQ ID NO: 2701993 - RNA, 18 nt, Human
cagaacagugauuaccag

SEQ ID NO: 2701994 - RNA, 17 nt, Human
cacuuguguuuugcaag

SEQ ID NO: 2701995 - RNA, 15 nt, Human
cacuuaaaaaugguu

SEQ ID NO: 2701996 - RNA, 23 nt, Human
caauaaaauccauacauuugugu

SEQ ID NO: 2701997 - RNA, 20 nt, Human
caauaaaauccauacauuug

SEQ ID NO: 2701998 - RNA, 15 nt, Human
caauaaaauggguuu

SEQ ID NO: 2701999 - RNA, 16 nt, Human
caaacagucucaggaa

SEQ ID NO: 2702000 - RNA, 17 nt, Human
caaacagucucaggaaa

SEQ ID NO: 2702001 - RNA, 15 nt, Human
caaacagucucagga

SEQ ID NO: 2702002 - RNA, 21 nt, Human
caaaaggauaaugaauacuuu

SEQ ID NO: 2702003 - RNA, 24 nt, Human
caaacccaguguuuuaggagcaug

SEQ ID NO: 2702004 - RNA, 15 nt, Human
auuuuuauauuugaa

SEQ ID NO: 2702005 - RNA, 21 nt, Human
auuuuauaucaauuuaaaaaa

SEQ ID NO: 2702006 - RNA, 19 nt, Human
caagacccaaaaggcagaa

SEQ ID NO: 2702007 - RNA, 21 nt, Human
caaaucuuaacuugaaggagu

SEQ ID NO: 2702008 - RNA, 22 nt, Human
auuaugaauuacauuuguauaa

SEQ ID NO: 2702009 - RNA, 20 nt, Human
auuaugaauuacauuuguau

SEQ ID NO: 2702010 - RNA, 19 nt, Human
auuaugaauuacauuugua

SEQ ID NO: 2702011 - RNA, 15 nt, Human
auuguuuaaaaucau

SEQ ID NO: 2702012 - RNA, 20 nt, Human
auuucauaccuaucaucuua

SEQ ID NO: 2702013 - RNA, 14 nt, Human
auuucuaugaaaua

SEQ ID NO: 2702014 - RNA, 16 nt, Human
auuuaauaaaugugcc

SEQ ID NO: 2702015 - RNA, 18 nt, Human
ccacagaagcuccaggua

SEQ ID NO: 2702016 - RNA, 18 nt, Human
ccaccagucugacuguuu

SEQ ID NO: 2702017 - RNA, 16 nt, Human
ccacagaagcuccagg

SEQ ID NO: 2702018 - RNA, 13 nt, Human
cauuaucucaaaa

SEQ ID NO: 2702019 - RNA, 12 nt, Human
cauuaucucaaa

SEQ ID NO: 2702020 - RNA, 17 nt, Human
cagggaggacgcucucu

SEQ ID NO: 2702021 - RNA, 18 nt, Human
cagggaggacgcucucug

SEQ ID NO: 2702022 - RNA, 15 nt, Human
cagucucaggaaauc

SEQ ID NO: 2702023 - RNA, 15 nt, Human
cagucaccucaugga

SEQ ID NO: 2702024 - RNA, 15 nt, Human
cagagcugcccucuc

SEQ ID NO: 2702025 - RNA, 13 nt, Human
cagagcugcccuc

SEQ ID NO: 2702026 - RNA, 17 nt, Human
cagagcugcccucuccu

SEQ ID NO: 2702027 - RNA, 22 nt, Human
cagcacagccucuuagaugcag

SEQ ID NO: 2702028 - RNA, 14 nt, Human
cagccagcaguuca

SEQ ID NO: 2702029 - RNA, 21 nt, Human
cagccagcaguucagagcugc

SEQ ID NO: 2702030 - RNA, 15 nt, Human
cagccagcaguucag

SEQ ID NO: 2702031 - RNA, 22 nt, Human
cagccagcaguucagagcugcc

SEQ ID NO: 2702032 - RNA, 20 nt, Human
cagcaguugaaaagacucca

SEQ ID NO: 2702033 - RNA, 21 nt, Human
cagcaguugaaaagacuccaa

SEQ ID NO: 2702034 - RNA, 17 nt, Human
cagcaguugaaaagacu

SEQ ID NO: 2702035 - RNA, 22 nt, Human
cagcaguugaaaagacuccaaa

SEQ ID NO: 2702036 - RNA, 19 nt, Human
cagccugagcgacagugag

SEQ ID NO: 2702037 - RNA, 22 nt, Human
cagccugagcgacagugagacu

SEQ ID NO: 2702038 - RNA, 18 nt, Human
cagccugagcgacaguga

SEQ ID NO: 2702039 - RNA, 20 nt, Human
cagcccuucuuuccacagaa

SEQ ID NO: 2702040 - RNA, 19 nt, Human
cagcccuucuuuccacaga

SEQ ID NO: 2702041 - RNA, 15 nt, Human
cagcccuucuuucca

SEQ ID NO: 2702042 - RNA, 22 nt, Human
cagcugccuccccuccucugcu

SEQ ID NO: 2702043 - RNA, 21 nt, Human
cagcugccuccccuccucugc

SEQ ID NO: 2702044 - RNA, 24 nt, Human
cagcugccuccccuccucugcuug

SEQ ID NO: 2702045 - RNA, 23 nt, Human
cagcugccuccccuccucugcuu

SEQ ID NO: 2702046 - RNA, 17 nt, Human
cagcuccccucggagaa

SEQ ID NO: 2702047 - RNA, 18 nt, Human
cagcuccccucggagaag

SEQ ID NO: 2702048 - RNA, 16 nt, Human
cagcuccccucggaga

SEQ ID NO: 2702049 - RNA, 22 nt, Human
caggaaaucaaauaugcaaagc

SEQ ID NO: 2702050 - RNA, 23 nt, Human
caggaaaucaaauaugcaaagca

SEQ ID NO: 2702051 - RNA, 12 nt, Human
gccuccauccug

SEQ ID NO: 2702052 - RNA, 15 nt, Human
gccucuuagaugcag

SEQ ID NO: 2702053 - RNA, 21 nt, Human
gccuucggccuccauccugag

SEQ ID NO: 2702054 - RNA, 20 nt, Human
gccuucggccuccauccuga

SEQ ID NO: 2702055 - RNA, 19 nt, Human
gcuccaccuugcagcucuc

SEQ ID NO: 2702056 - RNA, 15 nt, Human
gcuccacuuggucug

SEQ ID NO: 2702057 - RNA, 18 nt, Human
gcuccacuuggucuguga

SEQ ID NO: 2702058 - RNA, 19 nt, Human
gcuccacuuggucugugag

SEQ ID NO: 2702059 - RNA, 21 nt, Human
gcuccccucggagaagagcug

SEQ ID NO: 2702060 - RNA, 12 nt, Human
gcuagaacuccc

SEQ ID NO: 2702061 - RNA, 13 nt, Human
gcuagaacucccu

SEQ ID NO: 2702062 - RNA, 14 nt, Human
gcuagaacucccuu

SEQ ID NO: 2702063 - RNA, 15 nt, Human
gcuagaacucccuuu

SEQ ID NO: 2702064 - RNA, 16 nt, Human
gcuagaacucccuuuc

SEQ ID NO: 2702065 - RNA, 18 nt, Human
gcuagaacucccuuucaa

SEQ ID NO: 2702066 - RNA, 13 nt, Human
ggagaaacuggaa

SEQ ID NO: 2702067 - RNA, 22 nt, Human
ggacucauuuuaaaaaauggaa

SEQ ID NO: 2702068 - RNA, 21 nt, Human
ggcacaguuuucugagaaaga

SEQ ID NO: 2702069 - RNA, 14 nt, Human
ggccuccauccuga

SEQ ID NO: 2702070 - RNA, 15 nt, Human
ggccuccauccugag

SEQ ID NO: 2702071 - RNA, 13 nt, Human
ggccuccauccug

SEQ ID NO: 2702072 - RNA, 17 nt, Human
aaaaaugguuuaaaugg

SEQ ID NO: 2702073 - RNA, 15 nt, Human
aaaacuucagacaua

SEQ ID NO: 2702074 - RNA, 14 nt, Human
aaaaauaacaauga

SEQ ID NO: 2702075 - RNA, 20 nt, Human
gggaacccaaguccaagcau

SEQ ID NO: 2702076 - RNA, 22 nt, Human
gggacagucaccucauggaauu

SEQ ID NO: 2702077 - RNA, 21 nt, Human
gggacagucaccucauggaau

SEQ ID NO: 2702078 - RNA, 20 nt, Human
gggacagucaccucauggaa

SEQ ID NO: 2702079 - RNA, 14 nt, Human
ggcuccacuugguc

SEQ ID NO: 2702080 - RNA, 11 nt, Human
aaacacagcaa

SEQ ID NO: 2702081 - RNA, 12 nt, Human
aaacacagcaag

SEQ ID NO: 2702082 - RNA, 14 nt, Human
aaacacagcaaggg

SEQ ID NO: 2702083 - RNA, 19 nt, Human
ggggaauugaggacacuga

SEQ ID NO: 2702084 - RNA, 15 nt, Human
aaacagucucaggaa

SEQ ID NO: 2702085 - RNA, 14 nt, Human
aaacaguagugaua

SEQ ID NO: 2702086 - RNA, 12 nt, Human
aaaccacagcag

SEQ ID NO: 2702087 - RNA, 15 nt, Human
aaacucguuaauuug

SEQ ID NO: 2702088 - RNA, 17 nt, Human
aaagcacugacuucuaa

SEQ ID NO: 2702089 - RNA, 21 nt, Human
aaagcacugacuucuaaguaa

SEQ ID NO: 2702090 - RNA, 14 nt, Human
aaagguacuucaaa

SEQ ID NO: 2702091 - RNA, 20 nt, Human
aaagggauggcaagaugugg

SEQ ID NO: 2702092 - RNA, 19 nt, Human
aaacuucagacauagaauu

SEQ ID NO: 2702093 - RNA, 23 nt, Human
aaacuucagcgguuuauauaagc

SEQ ID NO: 2702094 - RNA, 13 nt, Human
aaagacagugaaa

SEQ ID NO: 2702095 - RNA, 18 nt, Human
aaagacuauucaaacagu

SEQ ID NO: 2702096 - RNA, 19 nt, Human
aaagacuauucaaacaguc

SEQ ID NO: 2702097 - RNA, 17 nt, Human
aaagacuauucaaacag

SEQ ID NO: 2702098 - RNA, 21 nt, Human
aaagacuauucaaacagucuc

SEQ ID NO: 2702099 - RNA, 15 nt, Human
aaagacuccaaagaa

SEQ ID NO: 2702100 - RNA, 21 nt, Human
aaagacuccaaagaaauguaa

SEQ ID NO: 2702101 - RNA, 14 nt, Human
aaagacuccaaaga

SEQ ID NO: 2702102 - RNA, 15 nt, Human
aaagaggcagcuuga

SEQ ID NO: 2702103 - RNA, 15 nt, Human
aaagaggaaugaagu

SEQ ID NO: 2702104 - RNA, 23 nt, Human
aaaguucugcagauaaacaguag

SEQ ID NO: 2702105 - RNA, 20 nt, Human
aaagguauuuuaaucaccaa

SEQ ID NO: 2702106 - RNA, 18 nt, Human
aaaguauguuagugcaaa

SEQ ID NO: 2702107 - RNA, 19 nt, Human
aaauacacacucaaaucaa

SEQ ID NO: 2702108 - RNA, 23 nt, Human
aaauaauuuuuauauuugaaaua

SEQ ID NO: 2702109 - RNA, 22 nt, Human
aaauaauuuuuauauuugaaau

SEQ ID NO: 2702110 - RNA, 15 nt, Human
aaauacacacucaaa

SEQ ID NO: 2702111 - RNA, 21 nt, Human
aaauaauuuuuauauuugaaa

SEQ ID NO: 2702112 - RNA, 23 nt, Human
guacacugccuucucaacuccaa

SEQ ID NO: 2702113 - RNA, 20 nt, Human
guaauaggcguaacuaauuu

SEQ ID NO: 2702114 - RNA, 18 nt, Human
aaauccauacauuugugu

SEQ ID NO: 2702115 - RNA, 15 nt, Human
aaauccauacauuug

SEQ ID NO: 2702116 - RNA, 17 nt, Human
aaauauuauguuaaaac

SEQ ID NO: 2702117 - RNA, 12 nt, Human
aaaucauuucug

SEQ ID NO: 2702118 - RNA, 11 nt, Human
aaaucauuucu

SEQ ID NO: 2702119 - RNA, 19 nt, Human
aaaucauuucugcaucagc

SEQ ID NO: 2702120 - RNA, 21 nt, Human
aaaucauuucugcaucagcug

SEQ ID NO: 2702121 - RNA, 22 nt, Human
aaaucauuucugcaucagcugc

SEQ ID NO: 2702122 - RNA, 23 nt, Human
aaaucauuucugcaucagcugcu

SEQ ID NO: 2702123 - RNA, 22 nt, Human
guacuucaaauccuugaagauu

SEQ ID NO: 2702124 - RNA, 21 nt, Human
guacuucaaauccuugaagau

SEQ ID NO: 2702125 - RNA, 15 nt, Human
guacuucaugcuguc

SEQ ID NO: 2702126 - RNA, 20 nt, Human
guagacgugcacgcacacug

SEQ ID NO: 2702127 - RNA, 23 nt, Human
guagacgugcacgcacacugucu

SEQ ID NO: 2702128 - RNA, 14 nt, Human
gacagaaagcagaa

SEQ ID NO: 2702129 - RNA, 20 nt, Human
gacagaaagcagaacaguga

SEQ ID NO: 2702130 - RNA, 21 nt, Human
gacagcccuucuuuccacaga

SEQ ID NO: 2702131 - RNA, 15 nt, Human
gacuauucaaacagu

SEQ ID NO: 2702132 - RNA, 16 nt, Human
gacuauucaaacaguc

SEQ ID NO: 2702133 - RNA, 13 nt, Human
gagcgacagugag

SEQ ID NO: 2702134 - RNA, 15 nt, Human
gagcgacagugagac

SEQ ID NO: 2702135 - RNA, 22 nt, Human
gcaguugaaaagacuccaaaga

SEQ ID NO: 2702136 - RNA, 15 nt, Human
gcagcuuauucacaa

SEQ ID NO: 2702137 - RNA, 16 nt, Human
gcauuguaaaugugcu

SEQ ID NO: 2702138 - RNA, 16 nt, Human
gcaauaaaauggguuu

SEQ ID NO: 2702139 - RNA, 18 nt, Human
gcaauagucaaauugugu

SEQ ID NO: 2702140 - RNA, 21 nt, Human
gaugcugucuucguacuggga

SEQ ID NO: 2702141 - RNA, 18 nt, Human
gaaagaaaaucaggcugg

SEQ ID NO: 2702142 - RNA, 20 nt, Human
gaaagggauuuucagcccuc

SEQ ID NO: 2702143 - RNA, 12 nt, Human
gaaagggauuuu

SEQ ID NO: 2702144 - RNA, 21 nt, Human
gaaaacuuuaugcuaagugaa

SEQ ID NO: 2702145 - RNA, 16 nt, Human
gaaaagacuccaaaga

SEQ ID NO: 2702146 - RNA, 17 nt, Human
gaaaagacuccaaagaa

SEQ ID NO: 2702147 - RNA, 14 nt, Human
gaaaagacuccaaa

SEQ ID NO: 2702148 - RNA, 16 nt, Human
gaacccaaguccaagc

SEQ ID NO: 2702149 - RNA, 17 nt, Human
gaacccaaguccaagca

SEQ ID NO: 2702150 - RNA, 17 nt, Human
gaacccgggaggcagag

SEQ ID NO: 2702151 - RNA, 16 nt, Human
cuuggucugugagaug

SEQ ID NO: 2702152 - RNA, 19 nt, Human
cuuggucugugagaugcua

SEQ ID NO: 2702153 - RNA, 13 nt, Human
cuucucacauuua

SEQ ID NO: 2702154 - RNA, 20 nt, Human
cuucucacauuuauauuuuu

SEQ ID NO: 2702155 - RNA, 21 nt, Human
cuucuaaguaaaaccacagca

SEQ ID NO: 2702156 - RNA, 13 nt, Human
cuucuaaguaaaa

SEQ ID NO: 2702157 - RNA, 17 nt, Human
cuucuaaguaaaaccac

SEQ ID NO: 2702158 - RNA, 19 nt, Human
cuggauaguccgucucugc

SEQ ID NO: 2702159 - RNA, 18 nt, Human
cuggauaguccgucucug

SEQ ID NO: 2702160 - RNA, 23 nt, Human
cugucggagcccugucuccucuc

SEQ ID NO: 2702161 - RNA, 17 nt, Human
cugucggagcccugucu

SEQ ID NO: 2702162 - RNA, 19 nt, Human
cuguuauaaucuuucacag

SEQ ID NO: 2702163 - RNA, 13 nt, Human
cuguuauaaucuu

SEQ ID NO: 2702164 - RNA, 21 nt, Human
cuuaaaaaugguuuaaauggu

SEQ ID NO: 2702165 - RNA, 18 nt, Human
auuauauuuauuacugua

SEQ ID NO: 2702166 - RNA, 15 nt, Human
auuauauuuauuacu

SEQ ID NO: 2702167 - RNA, 21 nt, Human
auuauguuaaaacugggacag

SEQ ID NO: 2702168 - RNA, 16 nt, Human
auucaaacagucucag

SEQ ID NO: 2702169 - RNA, 18 nt, Human
auucaaacagucucagga

SEQ ID NO: 2702170 - RNA, 19 nt, Human
auucaaacagucucaggaa

SEQ ID NO: 2702171 - RNA, 20 nt, Human
auucaaacagucucaggaaa

SEQ ID NO: 2702172 - RNA, 15 nt, Human
auuauauuuacaaau

SEQ ID NO: 2702173 - RNA, 19 nt, Human
auugacacuuaaaaauggu

SEQ ID NO: 2702174 - RNA, 15 nt, Human
auugacacuuaaaaa

SEQ ID NO: 2702175 - RNA, 17 nt, Human
auugacacuuaaaaaug

SEQ ID NO: 2702176 - RNA, 18 nt, Human
auuuuuuguuaaaugauu

SEQ ID NO: 2702177 - RNA, 23 nt, Human
auuuuuucucuaggaaauauuua

SEQ ID NO: 2702178 - RNA, 20 nt, Human
auuuuuucucuaggaaauau

SEQ ID NO: 2702179 - RNA, 21 nt, Human
auuuuuguuuucauuaucuca

SEQ ID NO: 2702180 - RNA, 22 nt, Human
auuuuugugauuuugugauuga

SEQ ID NO: 2702181 - RNA, 19 nt, Human
auuuuucuuauuucauuuc

SEQ ID NO: 2702182 - RNA, 20 nt, Human
auuuuucuuauuucauuucu

SEQ ID NO: 2702183 - RNA, 15 nt, Human
auuuuucuuauuuca

SEQ ID NO: 2702184 - RNA, 14 nt, Human
auuuuccugaaaac

SEQ ID NO: 2702185 - RNA, 14 nt, Human
auuuucuauaauuu

SEQ ID NO: 2702186 - RNA, 15 nt, Human
auuuucuauaauuua

SEQ ID NO: 2702187 - RNA, 12 nt, Human
auuuuaauaaug

SEQ ID NO: 2702188 - RNA, 16 nt, Human
auuuuaaaagaaugau

SEQ ID NO: 2702189 - RNA, 23 nt, Human
auuuuaaaagaaugauuaugaau

SEQ ID NO: 2702190 - RNA, 14 nt, Human
auuuguauaaaaua

SEQ ID NO: 2702191 - RNA, 22 nt, Human
auuuguaguguuggagaagaac

SEQ ID NO: 2702192 - RNA, 19 nt, Human
auuuguaguguuggagaag

SEQ ID NO: 2702193 - RNA, 14 nt, Human
auuuauuuuaauaa

SEQ ID NO: 2702194 - RNA, 13 nt, Human
auugucuagugaa

SEQ ID NO: 2702195 - RNA, 13 nt, Human
auugacuuuuuau

SEQ ID NO: 2702196 - RNA, 19 nt, Human
auuggagcucgugggacag

SEQ ID NO: 2702197 - RNA, 19 nt, Human
auuggacaguaaaauccac

SEQ ID NO: 2702198 - RNA, 20 nt, Human
augcuagaacucccuuucaa

SEQ ID NO: 2702199 - RNA, 21 nt, Human
augcuagaacucccuuucaac

SEQ ID NO: 2702200 - RNA, 22 nt, Human
augcuagaacucccuuucaaca

SEQ ID NO: 2702201 - RNA, 16 nt, Human
uuucaaacauauauaa

SEQ ID NO: 2702202 - RNA, 19 nt, Human
auggcuaagcaaaauguga

SEQ ID NO: 2702203 - RNA, 16 nt, Human
auggcacuaguauuuc

SEQ ID NO: 2702204 - RNA, 14 nt, Human
auggcacuaguauu

SEQ ID NO: 2702205 - RNA, 15 nt, Human
augauaacuggaaac

SEQ ID NO: 2702206 - RNA, 14 nt, Human
augauuaaguaaug

SEQ ID NO: 2702207 - RNA, 18 nt, Human
augauuaaguaaugauaa

SEQ ID NO: 2702208 - RNA, 17 nt, Human
augccauuuaaagcuua

SEQ ID NO: 2702209 - RNA, 21 nt, Human
augccauuuaaagcuuauuaa

SEQ ID NO: 2702210 - RNA, 13 nt, Human
augcaguucugaa

SEQ ID NO: 2702211 - RNA, 18 nt, Human
uuuaaauauaugcuaagu

SEQ ID NO: 2702212 - RNA, 15 nt, Human
uuugaaauauugacu

SEQ ID NO: 2702213 - RNA, 18 nt, Human
uuucucccagucauuuaa

SEQ ID NO: 2702214 - RNA, 17 nt, Human
uuucucccagucauuua

SEQ ID NO: 2702215 - RNA, 21 nt, Human
augguucccuugaugaagaag

SEQ ID NO: 2702216 - RNA, 14 nt, Human
uuugcaagccagau

SEQ ID NO: 2702217 - RNA, 16 nt, Human
auguacuucaugcugu

SEQ ID NO: 2702218 - RNA, 12 nt, Human
auguagaggaga

SEQ ID NO: 2702219 - RNA, 13 nt, Human
auguagaggagaa

SEQ ID NO: 2702220 - RNA, 17 nt, Human
auguagaggagaaacug

SEQ ID NO: 2702221 - RNA, 19 nt, Human
auguagaggagaaacugga

SEQ ID NO: 2702222 - RNA, 16 nt, Human
auguccacugguucuu

SEQ ID NO: 2702223 - RNA, 17 nt, Human
auguccacugguucuuc

SEQ ID NO: 2702224 - RNA, 17 nt, Human
uuugugaagcaaaauuu

SEQ ID NO: 2702225 - RNA, 21 nt, Human
uuuguaguguuggagaagaac

SEQ ID NO: 2702226 - RNA, 19 nt, Human
uuuguaguguuggagaaga

SEQ ID NO: 2702227 - RNA, 14 nt, Human
uucggccuccaucc

SEQ ID NO: 2702228 - RNA, 15 nt, Human
uucggccuccauccu

SEQ ID NO: 2702229 - RNA, 23 nt, Human
uucuaagaagugaaaaucuacac

SEQ ID NO: 2702230 - RNA, 13 nt, Human
uucuaagaaguga

SEQ ID NO: 2702231 - RNA, 15 nt, Human
uucuaaguaaaacca

SEQ ID NO: 2702232 - RNA, 16 nt, Human
uucuaaguaaaaccac

SEQ ID NO: 2702233 - RNA, 19 nt, Human
uucuagcaugaagacagag

SEQ ID NO: 2702234 - RNA, 17 nt, Human
aucaggguuaguauugu

SEQ ID NO: 2702235 - RNA, 22 nt, Human
aucacuugucaauaaaauccau

SEQ ID NO: 2702236 - RNA, 20 nt, Human
auauuuuuuguuaaaugauu

SEQ ID NO: 2702237 - RNA, 18 nt, Human
auauuuuuuguuaaauga

SEQ ID NO: 2702238 - RNA, 14 nt, Human
aucaacagauaaau

SEQ ID NO: 2702239 - RNA, 19 nt, Human
uuccguagguuauuuucag

SEQ ID NO: 2702240 - RNA, 12 nt, Human
uucucuaggaaa

SEQ ID NO: 2702241 - RNA, 19 nt, Human
uugaacccgggaggcagag

SEQ ID NO: 2702242 - RNA, 17 nt, Human
uugaaauuguauuacaa

SEQ ID NO: 2702243 - RNA, 18 nt, Human
uugaacccgggaggcaga

SEQ ID NO: 2702244 - RNA, 13 nt, Human
uugcaucaauuuu

SEQ ID NO: 2702245 - RNA, 22 nt, Human
uugcaagccagauuuuccugaa

SEQ ID NO: 2702246 - RNA, 14 nt, Human
aucucauuuccaag

SEQ ID NO: 2702247 - RNA, 17 nt, Human
uugaagggaaauuucag

SEQ ID NO: 2702248 - RNA, 19 nt, Human
aucuacacuccagugagac

SEQ ID NO: 2702249 - RNA, 18 nt, Human
aucuacacuccagugaga

SEQ ID NO: 2702250 - RNA, 14 nt, Human
aucuuauaauuuaa

SEQ ID NO: 2702251 - RNA, 16 nt, Human
augaauuacauuugua

SEQ ID NO: 2702252 - RNA, 15 nt, Human
augaauuacauuugu

SEQ ID NO: 2702253 - RNA, 15 nt, Human
augaauuaaguuuuu

SEQ ID NO: 2702254 - RNA, 23 nt, Human
augaauggcuaagcaaaauguga

SEQ ID NO: 2702255 - RNA, 14 nt, Human
auaagccagacauc

SEQ ID NO: 2702256 - RNA, 14 nt, Human
auaaucuuucacag

SEQ ID NO: 2702257 - RNA, 15 nt, Human
uuagggagagaagau

SEQ ID NO: 2702258 - RNA, 14 nt, Human
uuagggagagaaga

SEQ ID NO: 2702259 - RNA, 16 nt, Human
uuaggguuaugauuaa

SEQ ID NO: 2702260 - RNA, 14 nt, Human
uuaggguuaugauu

SEQ ID NO: 2702261 - RNA, 22 nt, Human
uuaaaaucauuucugcaucagc

SEQ ID NO: 2702262 - RNA, 14 nt, Human
uuaaaaucauuucu

SEQ ID NO: 2702263 - RNA, 16 nt, Human
uuaaaaaauggaacau

SEQ ID NO: 2702264 - RNA, 19 nt, Human
uuaaaaaagaaacauuugg

SEQ ID NO: 2702265 - RNA, 15 nt, Human
aguuuagcuggaaaa

SEQ ID NO: 2702266 - RNA, 17 nt, Human
aguuuaaauuguaauag

SEQ ID NO: 2702267 - RNA, 20 nt, Human
aguuuaaauuguaauaggcg

SEQ ID NO: 2702268 - RNA, 16 nt, Human
aguuuuauaugcuucu

SEQ ID NO: 2702269 - RNA, 15 nt, Human
uuauuauauuuacaa

SEQ ID NO: 2702270 - RNA, 14 nt, Human
uuauuauauuuaca

SEQ ID NO: 2702271 - RNA, 19 nt, Human
uuauguuaaaacugggaca

SEQ ID NO: 2702272 - RNA, 16 nt, Human
auacucauuaggaugg

SEQ ID NO: 2702273 - RNA, 18 nt, Human
auagauaggucagugcaa

SEQ ID NO: 2702274 - RNA, 17 nt, Human
auagaauuaacacauga

SEQ ID NO: 2702275 - RNA, 13 nt, Human
auagaaguaaaaa

SEQ ID NO: 2702276 - RNA, 19 nt, Human
uuaugauuaaguaaugaua

SEQ ID NO: 2702277 - RNA, 21 nt, Human
uuaugaauuacauuuguauaa

SEQ ID NO: 2702278 - RNA, 17 nt, Human
uuaugaauuacauuugu

SEQ ID NO: 2702279 - RNA, 16 nt, Human
uuaugaauuacauuug

SEQ ID NO: 2702280 - RNA, 14 nt, Human
uuaugaauuacauu

SEQ ID NO: 2702281 - RNA, 19 nt, Human
uuauauuugaaauauugac

SEQ ID NO: 2702282 - RNA, 15 nt, Human
uuauauuugaaauau

SEQ ID NO: 2702283 - RNA, 17 nt, Human
auacuauggaauuucuc

SEQ ID NO: 2702284 - RNA, 14 nt, Human
agugcaaauuguca

SEQ ID NO: 2702285 - RNA, 22 nt, Human
agugaacaaauuuacagagaca

SEQ ID NO: 2702286 - RNA, 23 nt, Human
agugaacaaauuuacagagacag

SEQ ID NO: 2702287 - RNA, 21 nt, Human
agugaacaaauuuacagagac

SEQ ID NO: 2702288 - RNA, 16 nt, Human
agucuuucacauuuaa

SEQ ID NO: 2702289 - RNA, 22 nt, Human
uguugcccacagcuguaugauu

SEQ ID NO: 2702290 - RNA, 15 nt, Human
uguucuaagaaguga

SEQ ID NO: 2702291 - RNA, 23 nt, Human
aguguuggagaagaacugaaauc

SEQ ID NO: 2702292 - RNA, 13 nt, Human
aguaauuggaaag

SEQ ID NO: 2702293 - RNA, 12 nt, Human
aguaauuggaaa

SEQ ID NO: 2702294 - RNA, 16 nt, Human
aguaaaaccacagcag

SEQ ID NO: 2702295 - RNA, 17 nt, Human
aguaaaaccacagcagu

SEQ ID NO: 2702296 - RNA, 19 nt, Human
aguaaaaccacagcaguug

SEQ ID NO: 2702297 - RNA, 20 nt, Human
aguaaaaccacagcaguuga

SEQ ID NO: 2702298 - RNA, 16 nt, Human
uguaguguuggagaag

SEQ ID NO: 2702299 - RNA, 18 nt, Human
uguaguguuggagaagaa

SEQ ID NO: 2702300 - RNA, 17 nt, Human
uguaguguuggagaaga

SEQ ID NO: 2702301 - RNA, 13 nt, Human
uguaagggaaacu

SEQ ID NO: 2702302 - RNA, 18 nt, Human
uguaagggaaacugccag

SEQ ID NO: 2702303 - RNA, 19 nt, Human
uguaagggaaacugccagc

SEQ ID NO: 2702304 - RNA, 14 nt, Human
agguugcagugagc

SEQ ID NO: 2702305 - RNA, 16 nt, Human
aggugcuacaaaaaca

SEQ ID NO: 2702306 - RNA, 16 nt, Human
agucucaggaaaucaa

SEQ ID NO: 2702307 - RNA, 13 nt, Human
agucucaggaaau

SEQ ID NO: 2702308 - RNA, 14 nt, Human
agucaggaaagaga

SEQ ID NO: 2702309 - RNA, 20 nt, Human
uguccagccccguagacgug

SEQ ID NO: 2702310 - RNA, 19 nt, Human
ugggaggcugagaugggag

SEQ ID NO: 2702311 - RNA, 13 nt, Human
agggagagaagau

SEQ ID NO: 2702312 - RNA, 14 nt, Human
agggagagaagaua

SEQ ID NO: 2702313 - RNA, 23 nt, Human
agggacuucugucuucacaacag

SEQ ID NO: 2702314 - RNA, 22 nt, Human
agggcuguuauaaucuuucaca

SEQ ID NO: 2702315 - RNA, 20 nt, Human
ugggaacccaaguccaagca

SEQ ID NO: 2702316 - RNA, 16 nt, Human
agggaaacugccagca

SEQ ID NO: 2702317 - RNA, 19 nt, Human
agggaaacugccagcaacg

SEQ ID NO: 2702318 - RNA, 21 nt, Human
agggaaacugccagcaacgca

SEQ ID NO: 2702319 - RNA, 23 nt, Human
agggaaacugccagcaacgcagg

SEQ ID NO: 2702320 - RNA, 14 nt, Human
agggaaacugccag

SEQ ID NO: 2702321 - RNA, 15 nt, Human
agggaaacugccagc

SEQ ID NO: 2702322 - RNA, 14 nt, Human
ugggaaagcauugu

SEQ ID NO: 2702323 - RNA, 16 nt, Human
ugggaaagcauuguaa

SEQ ID NO: 2702324 - RNA, 17 nt, Human
ugggaaagcauuguaaa

SEQ ID NO: 2702325 - RNA, 18 nt, Human
ugggaaagcauuguaaau

SEQ ID NO: 2702326 - RNA, 18 nt, Human
ugggaaacaaaaggauaa

SEQ ID NO: 2702327 - RNA, 23 nt, Human
uggcuauaggugcuacaaaaaca

SEQ ID NO: 2702328 - RNA, 18 nt, Human
uggcuaagcaaaauguga

SEQ ID NO: 2702329 - RNA, 15 nt, Human
uggcuauaggugcua

SEQ ID NO: 2702330 - RNA, 19 nt, Human
uggcuauaggugcuacaaa

SEQ ID NO: 2702331 - RNA, 11 nt, Human
aggcuccacuu

SEQ ID NO: 2702332 - RNA, 17 nt, Human
aggcuccacuuggucug

SEQ ID NO: 2702333 - RNA, 21 nt, Human
aggcuccacuuggucugugag

SEQ ID NO: 2702334 - RNA, 22 nt, Human
aggcuccacuuggucugugaga

SEQ ID NO: 2702335 - RNA, 16 nt, Human
uggagaagaacugaaa

SEQ ID NO: 2702336 - RNA, 20 nt, Human
aggcagcucuaaaugucaau

SEQ ID NO: 2702337 - RNA, 18 nt, Human
aggaaauauuuauuuuaa

SEQ ID NO: 2702338 - RNA, 14 nt, Human
aggaaauauuuauu

SEQ ID NO: 2702339 - RNA, 19 nt, Human
aggaaaucaaauaugcaaa

SEQ ID NO: 2702340 - RNA, 19 nt, Human
aggaauugacccacaagaa

SEQ ID NO: 2702341 - RNA, 21 nt, Human
agcuuauugucuagugaaacu

SEQ ID NO: 2702342 - RNA, 20 nt, Human
agcuuauuaaaacucauuuu

SEQ ID NO: 2702343 - RNA, 15 nt, Human
agcuuauuaaaacuc

SEQ ID NO: 2702344 - RNA, 19 nt, Human
aggaaagagaacuuccaga

SEQ ID NO: 2702345 - RNA, 13 nt, Human
aggaaagagaacu

SEQ ID NO: 2702346 - RNA, 14 nt, Human
ugcuaguaauugga

SEQ ID NO: 2702347 - RNA, 16 nt, Human
ugcuaguaauuggaaa

SEQ ID NO: 2702348 - RNA, 23 nt, Human
agcugccuccccuccucugcuug

SEQ ID NO: 2702349 - RNA, 22 nt, Human
agcugccuccccuccucugcuu

SEQ ID NO: 2702350 - RNA, 21 nt, Human
agcugccuccccuccucugcu

SEQ ID NO: 2702351 - RNA, 20 nt, Human
agcugccuccccuccucugc

SEQ ID NO: 2702352 - RNA, 19 nt, Human
agcugccuccccuccucug

SEQ ID NO: 2702353 - RNA, 18 nt, Human
agcugccuccccuccucu

SEQ ID NO: 2702354 - RNA, 17 nt, Human
agcugccuccccuccuc

SEQ ID NO: 2702355 - RNA, 13 nt, Human
agcuggaaaagua

SEQ ID NO: 2702356 - RNA, 14 nt, Human
ugcagugagccgag

SEQ ID NO: 2702357 - RNA, 18 nt, Human
agccugagcgacagugag

SEQ ID NO: 2702358 - RNA, 17 nt, Human
agcccuucuuuccacag

SEQ ID NO: 2702359 - RNA, 19 nt, Human
agcccuucuuuccacagaa

SEQ ID NO: 2702360 - RNA, 18 nt, Human
agcccuucuuuccacaga

SEQ ID NO: 2702361 - RNA, 19 nt, Human
agcuacuaauuuuaaaaug

SEQ ID NO: 2702362 - RNA, 19 nt, Human
agcuauggugucauaggcu

SEQ ID NO: 2702363 - RNA, 18 nt, Human
ucuguuuuauaauuuugu

SEQ ID NO: 2702364 - RNA, 18 nt, Human
ucuuaauuaaaagaauau

SEQ ID NO: 2702365 - RNA, 21 nt, Human
ucuuaauuaaaagaauauuuu

SEQ ID NO: 2702366 - RNA, 14 nt, Human
ucuuaauuaaaaga

SEQ ID NO: 2702367 - RNA, 21 nt, Human
agacuggauaguccgucucug

SEQ ID NO: 2702368 - RNA, 18 nt, Human
agacuggcacaguuuucu

SEQ ID NO: 2702369 - RNA, 14 nt, Human
agacuggcacaguu

SEQ ID NO: 2702370 - RNA, 15 nt, Human
agacuggcacaguuu

SEQ ID NO: 2702371 - RNA, 17 nt, Human
agagacacacugaagaa

SEQ ID NO: 2702372 - RNA, 15 nt, Human
agagaaugagagaca

SEQ ID NO: 2702373 - RNA, 20 nt, Human
agagacacacugaagaagca

SEQ ID NO: 2702374 - RNA, 18 nt, Human
agagacacacugaagaag

SEQ ID NO: 2702375 - RNA, 17 nt, Human
ucuuuaaaauacacacu

SEQ ID NO: 2702376 - RNA, 21 nt, Human
ucuuuaaagggauggcaagau

SEQ ID NO: 2702377 - RNA, 16 nt, Human
agacuccaaagaaaug

SEQ ID NO: 2702378 - RNA, 19 nt, Human
agacuccaaagaaauguaa

SEQ ID NO: 2702379 - RNA, 16 nt, Human
agacuauucaaacagu

SEQ ID NO: 2702380 - RNA, 13 nt, Human
agacuccaaagaa

SEQ ID NO: 2702381 - RNA, 14 nt, Human
agacuccaaagaaa

SEQ ID NO: 2702382 - RNA, 12 nt, Human
agacuccaaaga

SEQ ID NO: 2702383 - RNA, 18 nt, Human
agacuauucaaacagucu

SEQ ID NO: 2702384 - RNA, 20 nt, Human
agacuauucaaacagucuca

SEQ ID NO: 2702385 - RNA, 21 nt, Human
agacuauucaaacagucucag

SEQ ID NO: 2702386 - RNA, 19 nt, Human
agaaagacuauucaaacag

SEQ ID NO: 2702387 - RNA, 18 nt, Human
agaaagacuauucaaaca

SEQ ID NO: 2702388 - RNA, 20 nt, Human
agaaagacuauucaaacagu

SEQ ID NO: 2702389 - RNA, 23 nt, Human
agaaagacuauucaaacagucuc

SEQ ID NO: 2702390 - RNA, 21 nt, Human
ucugacuguuuccaucaaggg

SEQ ID NO: 2702391 - RNA, 14 nt, Human
ucugagaaagacua

SEQ ID NO: 2702392 - RNA, 15 nt, Human
ucugagaaagacuau

SEQ ID NO: 2702393 - RNA, 19 nt, Human
ucugagaaagacuauucaa

SEQ ID NO: 2702394 - RNA, 20 nt, Human
ucugagaaagacuauucaaa

SEQ ID NO: 2702395 - RNA, 23 nt, Human
ucugagaaagacuauucaaacag

SEQ ID NO: 2702396 - RNA, 21 nt, Human
ucugagaaagacuauucaaac

SEQ ID NO: 2702397 - RNA, 22 nt, Human
ucugagaaagacuauucaaaca

SEQ ID NO: 2702398 - RNA, 14 nt, Human
agaacucccuuuca

SEQ ID NO: 2702399 - RNA, 21 nt, Human
agaagaacugaaaucauacuu

SEQ ID NO: 2702400 - RNA, 11 nt, Human
ucugcuugcca

SEQ ID NO: 2702401 - RNA, 14 nt, Human
ucugcuugccaucc

SEQ ID NO: 2702402 - RNA, 12 nt, Human
ucugcuugccau

SEQ ID NO: 2702403 - RNA, 15 nt, Human
ucucccagucauuua

SEQ ID NO: 2702404 - RNA, 15 nt, Human
ucuccucucucugua

SEQ ID NO: 2702405 - RNA, 22 nt, Human
acuuuuuauggcacuaguauuu

SEQ ID NO: 2702406 - RNA, 19 nt, Human
agaaaacaaggaugaauua

SEQ ID NO: 2702407 - RNA, 15 nt, Human
agaaacauuugguaa

SEQ ID NO: 2702408 - RNA, 13 nt, Human
agaaacuggaacu

SEQ ID NO: 2702409 - RNA, 15 nt, Human
agaaacuggaacucu

SEQ ID NO: 2702410 - RNA, 14 nt, Human
agaaagaaaaucag

SEQ ID NO: 2702411 - RNA, 13 nt, Human
ucucuucuuuaaa

SEQ ID NO: 2702412 - RNA, 12 nt, Human
ucucuucuuuaa

SEQ ID NO: 2702413 - RNA, 16 nt, Human
ucucuggccuucggcc

SEQ ID NO: 2702414 - RNA, 17 nt, Human
ucucuggccuucggccu

SEQ ID NO: 2702415 - RNA, 13 nt, Human
ucucuggccuucg

SEQ ID NO: 2702416 - RNA, 16 nt, Human
agauuuaccacuugug

SEQ ID NO: 2702417 - RNA, 16 nt, Human
agauugugccccugca

SEQ ID NO: 2702418 - RNA, 15 nt, Human
ugacuguuuccauca

SEQ ID NO: 2702419 - RNA, 19 nt, Human
agaugaugaugaucuuuaa

SEQ ID NO: 2702420 - RNA, 23 nt, Human
agaugcuagaacucccuuucaac

SEQ ID NO: 2702421 - RNA, 22 nt, Human
agaugcuagaacucccuuucaa

SEQ ID NO: 2702422 - RNA, 20 nt, Human
ugaagaagcaccaaucauga

SEQ ID NO: 2702423 - RNA, 14 nt, Human
ugaagaagauggua

SEQ ID NO: 2702424 - RNA, 18 nt, Human
ugaagauguagaggagaa

SEQ ID NO: 2702425 - RNA, 17 nt, Human
ugaagauguagaggaga

SEQ ID NO: 2702426 - RNA, 14 nt, Human
agagugaacaaauu

SEQ ID NO: 2702427 - RNA, 22 nt, Human
agagugaacaaauuuacagaga

SEQ ID NO: 2702428 - RNA, 16 nt, Human
ugagcuacaaaugcau

SEQ ID NO: 2702429 - RNA, 13 nt, Human
ugagcuacaaaug

SEQ ID NO: 2702430 - RNA, 14 nt, Human
ugagcuacaaaugc

SEQ ID NO: 2702431 - RNA, 15 nt, Human
ugaggacacugauau

SEQ ID NO: 2702432 - RNA, 17 nt, Human
ugagguacugagaguga

SEQ ID NO: 2702433 - RNA, 22 nt, Human
ugagguacugagagugaacaaa

SEQ ID NO: 2702434 - RNA, 13 nt, Human
ugagcgacaguga

SEQ ID NO: 2702435 - RNA, 14 nt, Human
ugagcgacagugag

SEQ ID NO: 2702436 - RNA, 16 nt, Human
ugagcgacagugagac

SEQ ID NO: 2702437 - RNA, 20 nt, Human
ugagcgacagugagacucug

SEQ ID NO: 2702438 - RNA, 14 nt, Human
agcagaacagugau

SEQ ID NO: 2702439 - RNA, 14 nt, Human
agcaacgcaggccc

SEQ ID NO: 2702440 - RNA, 22 nt, Human
agcacagccucuuagaugcagu

SEQ ID NO: 2702441 - RNA, 16 nt, Human
agcaccaaucaugaau

SEQ ID NO: 2702442 - RNA, 23 nt, Human
accacuuguguuuugcaagccag

SEQ ID NO: 2702443 - RNA, 19 nt, Human
accacuuguguuuugcaag

SEQ ID NO: 2702444 - RNA, 14 nt, Human
accacugcagaaga

SEQ ID NO: 2702445 - RNA, 19 nt, Human
accacugcagaagacagua

SEQ ID NO: 2702446 - RNA, 13 nt, Human
accacugcagaag

SEQ ID NO: 2702447 - RNA, 11 nt, Human
accacagcagu

SEQ ID NO: 2702448 - RNA, 12 nt, Human
uauuucauuucu

SEQ ID NO: 2702449 - RNA, 21 nt, Human
acccaaauguucaucaaugaa

SEQ ID NO: 2702450 - RNA, 18 nt, Human
acccaaaaggcagaagca

SEQ ID NO: 2702451 - RNA, 13 nt, Human
acccaaaaggcag

SEQ ID NO: 2702452 - RNA, 15 nt, Human
acccaaaaggcagaa

SEQ ID NO: 2702453 - RNA, 18 nt, Human
ucagaugcacaugagcug

SEQ ID NO: 2702454 - RNA, 22 nt, Human
ucaugaauuaguuuuauaugcu

SEQ ID NO: 2702455 - RNA, 21 nt, Human
uccagccugagcgacagugag

SEQ ID NO: 2702456 - RNA, 20 nt, Human
uccagccugagcgacaguga

SEQ ID NO: 2702457 - RNA, 17 nt, Human
acugaggggaggggagc

SEQ ID NO: 2702458 - RNA, 22 nt, Human
acugaggggaggggagcauggg

SEQ ID NO: 2702459 - RNA, 17 nt, Human
uccugggcagcugccuc

SEQ ID NO: 2702460 - RNA, 16 nt, Human
uccugggcagcugccu

SEQ ID NO: 2702461 - RNA, 15 nt, Human
uccugggcagcugcc

SEQ ID NO: 2702462 - RNA, 14 nt, Human
uccugggcagcugc

SEQ ID NO: 2702463 - RNA, 23 nt, Human
uccugggcagcugccuccccucc

SEQ ID NO: 2702464 - RNA, 22 nt, Human
uccugggcagcugccuccccuc

SEQ ID NO: 2702465 - RNA, 19 nt, Human
uccugggcagcugccuccc

SEQ ID NO: 2702466 - RNA, 18 nt, Human
uccugggcagcugccucc

SEQ ID NO: 2702467 - RNA, 22 nt, Human
acugccuucucaacuccaaacu

SEQ ID NO: 2702468 - RNA, 20 nt, Human
acugccuucucaacuccaaa

SEQ ID NO: 2702469 - RNA, 21 nt, Human
acuggcacaguuuucugagaa

SEQ ID NO: 2702470 - RNA, 22 nt, Human
acuggcacaguuuucugagaaa

SEQ ID NO: 2702471 - RNA, 13 nt, Human
uccuucagccuga

SEQ ID NO: 2702472 - RNA, 13 nt, Human
acuaaaaauacaa

SEQ ID NO: 2702473 - RNA, 12 nt, Human
uccccuccucug

SEQ ID NO: 2702474 - RNA, 20 nt, Human
uccucaaaacuucagacaua

SEQ ID NO: 2702475 - RNA, 20 nt, Human
acucauuuuaaaaaauggaa

SEQ ID NO: 2702476 - RNA, 22 nt, Human
uauaaaauaauuuuuauauuug

SEQ ID NO: 2702477 - RNA, 21 nt, Human
uauaaaauaauuuuuauauuu

SEQ ID NO: 2702478 - RNA, 22 nt, Human
acacaucagcuugcccuguuaa

SEQ ID NO: 2702479 - RNA, 22 nt, Human
uagugagcagucaggaaagaga

SEQ ID NO: 2702480 - RNA, 16 nt, Human
uaguuuuauaugcuuc

SEQ ID NO: 2702481 - RNA, 15 nt, Human
uaguuuuauaugcuu

SEQ ID NO: 2702482 - RNA, 14 nt, Human
uauaauuuugugaa

SEQ ID NO: 2702483 - RNA, 18 nt, Human
uauaacaaugcuguauuu

SEQ ID NO: 2702484 - RNA, 21 nt, Human
uauaggugcuacaaaaacaca

SEQ ID NO: 2702485 - RNA, 20 nt, Human
uauaggugcuacaaaaacac

SEQ ID NO: 2702486 - RNA, 23 nt, Human
uauaggugcuacaaaaacacagc

SEQ ID NO: 2702487 - RNA, 14 nt, Human
uauaggaauugacc

SEQ ID NO: 2702488 - RNA, 19 nt, Human
uauaggaauugacccacaa

SEQ ID NO: 2702489 - RNA, 13 nt, Human
uauaggaauugac

SEQ ID NO: 2702490 - RNA, 16 nt, Human
uauggcuauaggugcu

SEQ ID NO: 2702491 - RNA, 17 nt, Human
uauggcuauaggugcua

SEQ ID NO: 2702492 - RNA, 14 nt, Human
uauauuuacaaaug

SEQ ID NO: 2702493 - RNA, 15 nt, Human
uauauuuacaaaugg

SEQ ID NO: 2702494 - RNA, 21 nt, Human
acaguauggcagcuuuccuca

SEQ ID NO: 2702495 - RNA, 14 nt, Human
acagugagacucug

SEQ ID NO: 2702496 - RNA, 18 nt, Human
acagugagacucugucuc

SEQ ID NO: 2702497 - RNA, 21 nt, Human
acaguuaccucugccucagaa

SEQ ID NO: 2702498 - RNA, 17 nt, Human
acagucucaggaaauca

SEQ ID NO: 2702499 - RNA, 20 nt, Human
acagugaaagaaaauaacaa

SEQ ID NO: 2702500 - RNA, 13 nt, Human
acagucucaggaa

SEQ ID NO: 2702501 - RNA, 14 nt, Human
acagucucaggaaa

SEQ ID NO: 2702502 - RNA, 15 nt, Human
acagucucaggaaau

SEQ ID NO: 2702503 - RNA, 16 nt, Human
acagucucaggaaauc

SEQ ID NO: 2702504 - RNA, 12 nt, Human
uauuaaaacuca

SEQ ID NO: 2702505 - RNA, 15 nt, Human
uauuagaauaccaca

SEQ ID NO: 2702506 - RNA, 23 nt, Human
uauucauagcagcuuauucacaa

SEQ ID NO: 2702507 - RNA, 19 nt, Human
acaguucggugagcuacaa

SEQ ID NO: 2702508 - RNA, 22 nt, Human
acaguucggugagcuacaaaug

SEQ ID NO: 2702509 - RNA, 23 nt, Human
acaguucggugagcuacaaaugc

SEQ ID NO: 2702510 - RNA, 17 nt, Human
uauugucuagugaaacu

SEQ ID NO: 2702511 - RNA, 18 nt, Human
uauuuauuuuaauaaugu

SEQ ID NO: 2702512 - RNA, 16 nt, Human
uauuuauuuuaauaau

SEQ ID NO: 2702513 - RNA, 14 nt, Human
uauuuauuuuaaua

SEQ ID NO: 2702514 - RNA, 16 nt, Human
uagaugcaguucugaa

SEQ ID NO: 2702515 - RNA, 19 nt, Human
uagaugcaguucugaagaa

SEQ ID NO: 2702516 - RNA, 17 nt, Human
uagaugcaguucugaag

SEQ ID NO: 2702517 - RNA, 21 nt, Human
uagcaugucgucaaagcugaa

SEQ ID NO: 2702518 - RNA, 18 nt, Human
uagcaugucgucaaagcu

SEQ ID NO: 2702519 - RNA, 18 nt, Human
acaagcacuaaacaaaga

SEQ ID NO: 2702520 - RNA, 22 nt, Human
acaagaaaugaaagcagggacu

SEQ ID NO: 2702521 - RNA, 15 nt, Human
uagaacucccuuuca

SEQ ID NO: 2702522 - RNA, 21 nt, Human
uacuucaaauccuugaagauu

SEQ ID NO: 2702523 - RNA, 18 nt, Human
uagaacucccuuucaaca

SEQ ID NO: 2702524 - RNA, 19 nt, Human
aauuuuuauauuugaaaua

SEQ ID NO: 2702525 - RNA, 16 nt, Human
acaaaaacacagcaag

SEQ ID NO: 2702526 - RNA, 19 nt, Human
aauuuuuucucuaggaaau

SEQ ID NO: 2702527 - RNA, 19 nt, Human
uacuucaaauccuugaaga

SEQ ID NO: 2702528 - RNA, 14 nt, Human
uacuucaaauccuu

SEQ ID NO: 2702529 - RNA, 20 nt, Human
aauuucucccagucauuuaa

SEQ ID NO: 2702530 - RNA, 23 nt, Human
aauugugugaaagguacuucaaa

SEQ ID NO: 2702531 - RNA, 13 nt, Human
uacuguaagaaaa

SEQ ID NO: 2702532 - RNA, 21 nt, Human
aauucuugccaaauauaaaua

SEQ ID NO: 2702533 - RNA, 13 nt, Human
aauugacccacaa

SEQ ID NO: 2702534 - RNA, 16 nt, Human
aauugacccacaagaa

SEQ ID NO: 2702535 - RNA, 19 nt, Human
aauugacccacaagaaaug

SEQ ID NO: 2702536 - RNA, 18 nt, Human
aauguugacaugggacau

SEQ ID NO: 2702537 - RNA, 16 nt, Human
aaugguuuaaaugguc

SEQ ID NO: 2702538 - RNA, 17 nt, Human
uacaaaaacacagcaag

SEQ ID NO: 2702539 - RNA, 18 nt, Human
uacaaaaacacagcaagg

SEQ ID NO: 2702540 - RNA, 15 nt, Human
aaugaaugaaugaau

SEQ ID NO: 2702541 - RNA, 20 nt, Human
aacuaucucauuuccaagca

SEQ ID NO: 2702542 - RNA, 13 nt, Human
aacuauauuguuu

SEQ ID NO: 2702543 - RNA, 20 nt, Human
aacugaaaucauacuucuua

SEQ ID NO: 2702544 - RNA, 13 nt, Human
aacugaaaucaua

SEQ ID NO: 2702545 - RNA, 13 nt, Human
gucuucacaacag

SEQ ID NO: 2702546 - RNA, 23 nt, Human
gucucaguccaugaagauguaga

SEQ ID NO: 2702547 - RNA, 16 nt, Human
aacauauauaacaaug

SEQ ID NO: 2702548 - RNA, 19 nt, Human
aacagauuauuaccuuaca

SEQ ID NO: 2702549 - RNA, 17 nt, Human
aacagucucaggaaauc

SEQ ID NO: 2702550 - RNA, 19 nt, Human
aacagucucaggaaaucaa

SEQ ID NO: 2702551 - RNA, 14 nt, Human
guggguagacacac

SEQ ID NO: 2702552 - RNA, 18 nt, Human
aagagcuguucacagcca

SEQ ID NO: 2702553 - RNA, 16 nt, Human
aagacuccaaagaaau

SEQ ID NO: 2702554 - RNA, 17 nt, Human
aagacuccaaagaaaug

SEQ ID NO: 2702555 - RNA, 14 nt, Human
aagacuccaaagaa

SEQ ID NO: 2702556 - RNA, 14 nt, Human
aagacuauucaaac

SEQ ID NO: 2702557 - RNA, 13 nt, Human
aagacuauucaaa

SEQ ID NO: 2702558 - RNA, 16 nt, Human
aagcaaguauuagaau

SEQ ID NO: 2702559 - RNA, 19 nt, Human
aagauguagaggagaaacu

SEQ ID NO: 2702560 - RNA, 13 nt, Human
aagcaaaauguga

SEQ ID NO: 2702561 - RNA, 22 nt, Human
aagauguagaggagaaacugga

SEQ ID NO: 2702562 - RNA, 19 nt, Human
aagcaaaauuuuuucucua

SEQ ID NO: 2702563 - RNA, 22 nt, Human
aagaagcaccaaucaugaauua

SEQ ID NO: 2702564 - RNA, 13 nt, Human
aagaaaauaucac

SEQ ID NO: 2702565 - RNA, 13 nt, Human
aagacccaaaagg

SEQ ID NO: 2702566 - RNA, 13 nt, Human
aagaauauuuuaa

SEQ ID NO: 2702567 - RNA, 15 nt, Human
guuuucugagaaaga

SEQ ID NO: 2702568 - RNA, 22 nt, Human
guuuuauaauuuugugaagcaa

SEQ ID NO: 2702569 - RNA, 15 nt, Human
guuuuauaauuuugu

SEQ ID NO: 2702570 - RNA, 21 nt, Human
guuucuagcaugaagacagag

SEQ ID NO: 2702571 - RNA, 17 nt, Human
aaguaaaaccacagcag

SEQ ID NO: 2702572 - RNA, 18 nt, Human
aaguaaaaccacagcagu

SEQ ID NO: 2702573 - RNA, 14 nt, Human
aaguaaaaccacag

SEQ ID NO: 2702574 - RNA, 15 nt, Human
aaguaaaaccacagc

SEQ ID NO: 2702575 - RNA, 16 nt, Human
aaguaaaaccacagca

SEQ ID NO: 2702576 - RNA, 21 nt, Human
aagggugaugggaaagcauug

SEQ ID NO: 2702577 - RNA, 16 nt, Human
guuuucugagaaagac

SEQ ID NO: 2702578 - RNA, 17 nt, Human
guuuucugagaaagacu

SEQ ID NO: 2702579 - RNA, 22 nt, Human
guuuucugagaaagacuauuca

SEQ ID NO: 2702580 - RNA, 21 nt, Human
aaguauguuagugcaaauugu

SEQ ID NO: 2702581 - RNA, 23 nt, Human
aaguauguuagugcaaauuguca

SEQ ID NO: 2702582 - RNA, 23 nt, Human
guuuuuuuuuaaaaaagaaacau

SEQ ID NO: 2702583 - RNA, 13 nt, Human
aaggauaaugaau

SEQ ID NO: 2702584 - RNA, 16 nt, Human
aaggaaaaaauaacaa

SEQ ID NO: 2702585 - RNA, 19 nt, Human
aaggaaaaaauaacaauga

SEQ ID NO: 2702586 - RNA, 17 nt, Human
uaaacucauuucuagca

SEQ ID NO: 2702587 - RNA, 12 nt, Human
uaaacucauuuc

SEQ ID NO: 2702588 - RNA, 19 nt, Human
uaaaccaaggcuagaacca

SEQ ID NO: 2702589 - RNA, 12 nt, Human
aauaaaugugcc

SEQ ID NO: 2702590 - RNA, 21 nt, Human
aauaaaugugccuucauuuuu

SEQ ID NO: 2702591 - RNA, 15 nt, Human
aauaacaauaaaaga

SEQ ID NO: 2702592 - RNA, 15 nt, Human
aauaacgauaaaaga

SEQ ID NO: 2702593 - RNA, 22 nt, Human
aauaaaauccauacauuugugu

SEQ ID NO: 2702594 - RNA, 12 nt, Human
aauaaaaauaau

SEQ ID NO: 2702595 - RNA, 15 nt, Human
uaaauguugacaugg

SEQ ID NO: 2702596 - RNA, 17 nt, Human
uaaaugauuucauucaa

SEQ ID NO: 2702597 - RNA, 13 nt, Human
uaacaaugcugua

SEQ ID NO: 2702598 - RNA, 17 nt, Human
uaacaaugcuguauuuu

SEQ ID NO: 2702599 - RNA, 15 nt, Human
uaacaaugcuguauu

SEQ ID NO: 2702600 - RNA, 14 nt, Human
aauacacacucaaa

SEQ ID NO: 2702601 - RNA, 12 nt, Human
aaaaacacagca

SEQ ID NO: 2702602 - RNA, 18 nt, Human
aaaaacacagcaagggug

SEQ ID NO: 2702603 - RNA, 13 nt, Human
aaaaacacagcaa

SEQ ID NO: 2702604 - RNA, 21 nt, Human
aucagcugcugaaacaacaaa

SEQ ID NO: 2702605 - RNA, 15 nt, Human
auauuuauuuuaaua

SEQ ID NO: 2702606 - RNA, 14 nt, Human
auauuuauuuuaau

SEQ ID NO: 2702607 - RNA, 17 nt, Human
auauuuauuuuaauaau

SEQ ID NO: 2702608 - RNA, 22 nt, Human
aucagcugcugaaacaacaaau

SEQ ID NO: 2702609 - RNA, 23 nt, Human
aucagcugcugaaacaacaaaua

SEQ ID NO: 2702610 - RNA, 18 nt, Human
augugggcagugauguca

SEQ ID NO: 2702611 - RNA, 17 nt, Human
auguucuaagaagugaa

SEQ ID NO: 2702612 - RNA, 14 nt, Human
auguaagggaaacu

SEQ ID NO: 2702613 - RNA, 16 nt, Human
auguaagggaaacugc

SEQ ID NO: 2702614 - RNA, 19 nt, Human
auguaagggaaacugccag

SEQ ID NO: 2702615 - RNA, 12 nt, Human
aguccuguaaug

SEQ ID NO: 2702616 - RNA, 19 nt, Human
agucaaauugugugaaagg

SEQ ID NO: 2702617 - RNA, 23 nt, Human
agucaaauugugugaaagguacu

SEQ ID NO: 2702618 - RNA, 22 nt, Human
aguugaaaaucuuauaauuuaa

SEQ ID NO: 2702619 - RNA, 21 nt, Human
aguugaaaagacuccaaagaa

SEQ ID NO: 2702620 - RNA, 22 nt, Human
aguugaaaagacuccaaagaaa

SEQ ID NO: 2702621 - RNA, 23 nt, Human
aguugaaaaucuuauaauuuaaa

SEQ ID NO: 2702622 - RNA, 21 nt, Human
agugucuuaauuaaaagaaua

SEQ ID NO: 2702623 - RNA, 17 nt, Human
agugucuuaauuaaaag

SEQ ID NO: 2702624 - RNA, 18 nt, Human
agugucuuaauuaaaaga

SEQ ID NO: 2702625 - RNA, 15 nt, Human
agugucuuaauuaaa

SEQ ID NO: 2702626 - RNA, 15 nt, Human
auaaugucccuucac

SEQ ID NO: 2702627 - RNA, 23 nt, Human
auaauguuucaaacauauauaac

SEQ ID NO: 2702628 - RNA, 17 nt, Human
auacacacucaaaucaa

SEQ ID NO: 2702629 - RNA, 18 nt, Human
auacacacucaaaucaag

SEQ ID NO: 2702630 - RNA, 20 nt, Human
auacacacucaaaucaagaa

SEQ ID NO: 2702631 - RNA, 18 nt, Human
auaaaggauuaaugucaa

SEQ ID NO: 2702632 - RNA, 13 nt, Human
auauuuauuuuaa

SEQ ID NO: 2702633 - RNA, 22 nt, Human
auauuuauuacuguaagaaaau

SEQ ID NO: 2702634 - RNA, 16 nt, Human
auauuauguuaaaacu

SEQ ID NO: 2702635 - RNA, 22 nt, Human
auaugcuucuguuuuauaauuu

SEQ ID NO: 2702636 - RNA, 20 nt, Human
auaugcuucuguuuuauaau

SEQ ID NO: 2702637 - RNA, 18 nt, Human
auagcagcuuauucacaa

SEQ ID NO: 2702638 - RNA, 15 nt, Human
auaggugcuacaaaa

SEQ ID NO: 2702639 - RNA, 21 nt, Human
auaggugcuacaaaaacacag

SEQ ID NO: 2702640 - RNA, 23 nt, Human
auaggugcuacaaaaacacagca

SEQ ID NO: 2702641 - RNA, 14 nt, Human
auaggugcuacaaa

SEQ ID NO: 2702642 - RNA, 15 nt, Human
auagguuuaauaauu

SEQ ID NO: 2702643 - RNA, 14 nt, Human
auagucaaauugug

SEQ ID NO: 2702644 - RNA, 16 nt, Human
aggcuagauguaugua

SEQ ID NO: 2702645 - RNA, 15 nt, Human
aggcuagauguaugu

SEQ ID NO: 2702646 - RNA, 17 nt, Human
aggcuagauguauguac

SEQ ID NO: 2702647 - RNA, 21 nt, Human
aggcuagaaccaccugccuau

SEQ ID NO: 2702648 - RNA, 17 nt, Human
aggcuacugucagcucc

SEQ ID NO: 2702649 - RNA, 23 nt, Human
aggugcuacaaaaacacagcaag

SEQ ID NO: 2702650 - RNA, 24 nt, Human
aggugcuacaaaaacacagcaagg

SEQ ID NO: 2702651 - RNA, 20 nt, Human
agguaaaagcaucacaugaa

SEQ ID NO: 2702652 - RNA, 19 nt, Human
aggugcuacaaaaacacag

SEQ ID NO: 2702653 - RNA, 20 nt, Human
aggugcuacaaaaacacagc

SEQ ID NO: 2702654 - RNA, 21 nt, Human
aggugcuacaaaaacacagca

SEQ ID NO: 2702655 - RNA, 22 nt, Human
aggugcuacaaaaacacagcaa

SEQ ID NO: 2702656 - RNA, 18 nt, Human
aggugcuacaaaaacaca

SEQ ID NO: 2702657 - RNA, 22 nt, Human
agcuccccucggagaagagcug

SEQ ID NO: 2702658 - RNA, 23 nt, Human
aggaugguucccuugaugaagaa

SEQ ID NO: 2702659 - RNA, 17 nt, Human
agagaacuuccagaucc

SEQ ID NO: 2702660 - RNA, 21 nt, Human
agacugcauuauauuuauuac

SEQ ID NO: 2702661 - RNA, 22 nt, Human
agacgugcacgcacacugucug

SEQ ID NO: 2702662 - RNA, 21 nt, Human
agacgugcacgcacacugucu

SEQ ID NO: 2702663 - RNA, 16 nt, Human
agcacugacuucuaag

SEQ ID NO: 2702664 - RNA, 15 nt, Human
agcaugaagacagag

SEQ ID NO: 2702665 - RNA, 20 nt, Human
agcaguucagagcugcccuc

SEQ ID NO: 2702666 - RNA, 23 nt, Human
agcaguucagagcugcccucucc

SEQ ID NO: 2702667 - RNA, 13 nt, Human
agcaguugaaaag

SEQ ID NO: 2702668 - RNA, 16 nt, Human
agcaguugaaaagacu

SEQ ID NO: 2702669 - RNA, 23 nt, Human
aauguuucaaacauauauaacaa

SEQ ID NO: 2702670 - RNA, 21 nt, Human
aaugauuaugaauuacauuug

SEQ ID NO: 2702671 - RNA, 15 nt, Human
aaugauuaugaauua

SEQ ID NO: 2702672 - RNA, 20 nt, Human
aaggcagcucuaaaugucaa

SEQ ID NO: 2702673 - RNA, 18 nt, Human
aaguccaagcauuuagau

SEQ ID NO: 2702674 - RNA, 17 nt, Human
aaguccaagcauaccaa

SEQ ID NO: 2702675 - RNA, 21 nt, Human
aaguagggacuucugucuuca

SEQ ID NO: 2702676 - RNA, 23 nt, Human
aagggaaacugccagcaacgcag

SEQ ID NO: 2702677 - RNA, 16 nt, Human
aagggaaacugccagc

SEQ ID NO: 2702678 - RNA, 17 nt, Human
aagggaaacugccagca

SEQ ID NO: 2702679 - RNA, 19 nt, Human
aaauugacacuuaaaaaug

SEQ ID NO: 2702680 - RNA, 17 nt, Human
aaaucuuauaauuuaaa

SEQ ID NO: 2702681 - RNA, 22 nt, Human
aaauguuguucucuucuuuaaa

SEQ ID NO: 2702682 - RNA, 18 nt, Human
aacaaauuuacagagaca

SEQ ID NO: 2702683 - RNA, 16 nt, Human
aacacaucagcuugcc

SEQ ID NO: 2702684 - RNA, 22 nt, Human
aaccacuggaaaguuuaugguu

SEQ ID NO: 2702685 - RNA, 17 nt, Human
aaccuagggugauauua

SEQ ID NO: 2702686 - RNA, 18 nt, Human
aacugacucuuaagaaga

SEQ ID NO: 2702687 - RNA, 15 nt, Human
aacugacucuuaaga

SEQ ID NO: 2702688 - RNA, 20 nt, Human
aacugacucuuaagaagacu

SEQ ID NO: 2702689 - RNA, 19 nt, Human
aacugacucuuaagaagac

SEQ ID NO: 2702690 - RNA, 20 nt, Human
aacugagaugugaacacauc

SEQ ID NO: 2702691 - RNA, 20 nt, Human
aacuuuaugcuaagugaaau

SEQ ID NO: 2702692 - RNA, 21 nt, Human
aacuuuaugcuaagugaaaua

SEQ ID NO: 2702693 - RNA, 16 nt, Human
aaaaagaaacauuugg

SEQ ID NO: 2702694 - RNA, 18 nt, Human
aaaaguucugcagauaaa

SEQ ID NO: 2702695 - RNA, 21 nt, Human
aaaaucuacacuccagugaga

SEQ ID NO: 2702696 - RNA, 16 nt, Human
aaaaucucaauauuuc

SEQ ID NO: 2702697 - RNA, 21 nt, Human
aaacugagaugugaacacauc

SEQ ID NO: 2702698 - RNA, 23 nt, Human
aaacugagaugugaacacaucag

SEQ ID NO: 2702699 - RNA, 15 nt, Human
aaagaaauguaaggg

SEQ ID NO: 2702700 - RNA, 15 nt, Human
aaaucaaauaugcaa

SEQ ID NO: 2702701 - RNA, 12 nt, Human
aaaucaaauaug

SEQ ID NO: 2702702 - RNA, 14 nt, Human
aaaucaaauaugca

SEQ ID NO: 2702703 - RNA, 20 nt, Human
aaauauuuauuuuaauaaug

SEQ ID NO: 2702704 - RNA, 13 nt, Human
aaauauuuauuuu

SEQ ID NO: 2702705 - RNA, 15 nt, Human
aaauauuuauuuuaa

SEQ ID NO: 2702706 - RNA, 14 nt, Human
aaaggcagaagcaa

SEQ ID NO: 2702707 - RNA, 14 nt, Human
acacgagcaggcua

SEQ ID NO: 2702708 - RNA, 19 nt, Human
acacgagcaggcuacuguc

SEQ ID NO: 2702709 - RNA, 21 nt, Human
acacgagcaggcuacugucag

SEQ ID NO: 2702710 - RNA, 22 nt, Human
acagcaguugaaaagacuccaa

SEQ ID NO: 2702711 - RNA, 23 nt, Human
acagcaguugaaaagacuccaaa

SEQ ID NO: 2702712 - RNA, 21 nt, Human
acagcaguugaaaagacucca

SEQ ID NO: 2702713 - RNA, 17 nt, Human
acccacaagaaaugaaa

SEQ ID NO: 2702714 - RNA, 21 nt, Human
acccacaagaaaugaaagcag

SEQ ID NO: 2702715 - RNA, 19 nt, Human
acccaguguuuuaggagca

SEQ ID NO: 2702716 - RNA, 22 nt, Human
acccaguguuuuaggagcauga

SEQ ID NO: 2702717 - RNA, 21 nt, Human
acuuggucugugagaugcuag

SEQ ID NO: 2702718 - RNA, 22 nt, Human
acuucugucuucacaacagauu

SEQ ID NO: 2702719 - RNA, 21 nt, Human
acuucugucuucacaacagau

SEQ ID NO: 2702720 - RNA, 12 nt, Human
acuucagacaua

SEQ ID NO: 2702721 - RNA, 13 nt, Human
acugccagcaacg

SEQ ID NO: 2702722 - RNA, 20 nt, Human
acucugucucaguccaugaa

SEQ ID NO: 2702723 - RNA, 18 nt, Human
acucugucucaguccaug

SEQ ID NO: 2702724 - RNA, 13 nt, Human
acuguaagaaaau

SEQ ID NO: 2702725 - RNA, 19 nt, Human
acuguaagaaaauaucacu

SEQ ID NO: 2702726 - RNA, 22 nt, Human
acuguaagaaaauaucacuugu

SEQ ID NO: 2702727 - RNA, 22 nt, Human
acuuuauuuucuauaauuuaaa

SEQ ID NO: 2702728 - RNA, 16 nt, Human
agaaaaucaggcuggc

SEQ ID NO: 2702729 - RNA, 14 nt, Human
agaaaauaacaaua

SEQ ID NO: 2702730 - RNA, 13 nt, Human
acuaagagagaau

SEQ ID NO: 2702731 - RNA, 19 nt, Human
acgcaggcccccaggugcc

SEQ ID NO: 2702732 - RNA, 22 nt, Human
acgcaggcccccaggugccagu

SEQ ID NO: 2702733 - RNA, 21 nt, Human
acuauucaaacagucucagga

SEQ ID NO: 2702734 - RNA, 20 nt, Human
acuaguauuucuaugaaaua

SEQ ID NO: 2702735 - RNA, 17 nt, Human
acucuauguucuaagaa

SEQ ID NO: 2702736 - RNA, 17 nt, Human
caagcacuaaacaaaga

SEQ ID NO: 2702737 - RNA, 15 nt, Human
caaauuuacagagac

SEQ ID NO: 2702738 - RNA, 14 nt, Human
caaauuuacagaga

SEQ ID NO: 2702739 - RNA, 14 nt, Human
caaauaugcaaagc

SEQ ID NO: 2702740 - RNA, 21 nt, Human
caaauguucaucaaugaauga

SEQ ID NO: 2702741 - RNA, 20 nt, Human
caaauguucaucaaugaaug

SEQ ID NO: 2702742 - RNA, 18 nt, Human
caaauaugcaaagcacug

SEQ ID NO: 2702743 - RNA, 16 nt, Human
caaauaugcaaagcac

SEQ ID NO: 2702744 - RNA, 17 nt, Human
caaauaugcaaagcacu

SEQ ID NO: 2702745 - RNA, 15 nt, Human
cacaguuuucugaga

SEQ ID NO: 2702746 - RNA, 14 nt, Human
cacaguuuucugag

SEQ ID NO: 2702747 - RNA, 19 nt, Human
cacaggaaccacaagacug

SEQ ID NO: 2702748 - RNA, 20 nt, Human
cacaggaaccacaagacugc

SEQ ID NO: 2702749 - RNA, 15 nt, Human
cacaggaaguagagg

SEQ ID NO: 2702750 - RNA, 22 nt, Human
cacagcaguugaaaagacucca

SEQ ID NO: 2702751 - RNA, 13 nt, Human
cacaacuauauug

SEQ ID NO: 2702752 - RNA, 14 nt, Human
cacacugaagaagc

SEQ ID NO: 2702753 - RNA, 19 nt, Human
cacacucaaaucaagaaac

SEQ ID NO: 2702754 - RNA, 11 nt, Human
cacaacagauu

SEQ ID NO: 2702755 - RNA, 22 nt, Human
caaugaaugaaugaauggcuaa

SEQ ID NO: 2702756 - RNA, 16 nt, Human
uugcuaagcauuccaa

SEQ ID NO: 2702757 - RNA, 18 nt, Human
uugcuaagcauuccaacu

SEQ ID NO: 2702758 - RNA, 16 nt, Human
uuguaccgcaauguga

SEQ ID NO: 2702759 - RNA, 20 nt, Human
uuguaaaauggugugaccac

SEQ ID NO: 2702760 - RNA, 20 nt, Human
uugguaaggggaauugagga

SEQ ID NO: 2702761 - RNA, 15 nt, Human
uuggucugugagaug

SEQ ID NO: 2702762 - RNA, 12 nt, Human
uuguaaaauggu

SEQ ID NO: 2702763 - RNA, 13 nt, Human
uuguaaaauggug

SEQ ID NO: 2702764 - RNA, 20 nt, Human
uugauaugccuuuucccaac

SEQ ID NO: 2702765 - RNA, 13 nt, Human
uugccaucccucc

SEQ ID NO: 2702766 - RNA, 18 nt, Human
uugccaucccucccucca

SEQ ID NO: 2702767 - RNA, 17 nt, Human
uugccaucccucccucc

SEQ ID NO: 2702768 - RNA, 16 nt, Human
uugccaucccucccuc

SEQ ID NO: 2702769 - RNA, 14 nt, Human
uugccaucccuccc

SEQ ID NO: 2702770 - RNA, 23 nt, Human
uugccaucccucccuccaccucc

SEQ ID NO: 2702771 - RNA, 22 nt, Human
uugccaucccucccuccaccuc

SEQ ID NO: 2702772 - RNA, 23 nt, Human
uugcagcucuccccuucucugua

SEQ ID NO: 2702773 - RNA, 24 nt, Human
uucuaaguaaaaccacagcaguug

SEQ ID NO: 2702774 - RNA, 19 nt, Human
uucuuaggguuaugauuaa

SEQ ID NO: 2702775 - RNA, 18 nt, Human
uucuuuccacagaagcuc

SEQ ID NO: 2702776 - RNA, 21 nt, Human
uugaaaaucuuauaauuuaaa

SEQ ID NO: 2702777 - RNA, 12 nt, Human
uuucucuaggaa

SEQ ID NO: 2702778 - RNA, 18 nt, Human
uuugguaaggggaauuga

SEQ ID NO: 2702779 - RNA, 21 nt, Human
uuugaaauuguauuacaaauc

SEQ ID NO: 2702780 - RNA, 18 nt, Human
uuguuuaaaaucauuucu

SEQ ID NO: 2702781 - RNA, 17 nt, Human
uuguuuaaaaucauuuc

SEQ ID NO: 2702782 - RNA, 12 nt, Human
uuuaaaaugucu

SEQ ID NO: 2702783 - RNA, 17 nt, Human
uuuaaaagaaugauuau

SEQ ID NO: 2702784 - RNA, 14 nt, Human
uuuaaaagaaugau

SEQ ID NO: 2702785 - RNA, 16 nt, Human
uuuaaaaucauuucug

SEQ ID NO: 2702786 - RNA, 19 nt, Human
uuuaaaauacacacucaaa

SEQ ID NO: 2702787 - RNA, 13 nt, Human
uuuacagagacag

SEQ ID NO: 2702788 - RNA, 19 nt, Human
uuuaauaauguuucaaaca

SEQ ID NO: 2702789 - RNA, 15 nt, Human
uuuaauaauguuuca

SEQ ID NO: 2702790 - RNA, 14 nt, Human
uuuaauaauguuuc

SEQ ID NO: 2702791 - RNA, 13 nt, Human
uuuaauaaaccau

SEQ ID NO: 2702792 - RNA, 21 nt, Human
uuauggcacuaguauuucuau

SEQ ID NO: 2702793 - RNA, 17 nt, Human
uuauggcuauaggugcu

SEQ ID NO: 2702794 - RNA, 16 nt, Human
uuauuacuguaagaaa

SEQ ID NO: 2702795 - RNA, 18 nt, Human
uuauuacuguaagaaaau

SEQ ID NO: 2702796 - RNA, 17 nt, Human
uuauuacuguaagaaaa

SEQ ID NO: 2702797 - RNA, 16 nt, Human
uucagacauagaauua

SEQ ID NO: 2702798 - RNA, 20 nt, Human
uucagacauagaauuaacac

SEQ ID NO: 2702799 - RNA, 14 nt, Human
uucagagcugcccu

SEQ ID NO: 2702800 - RNA, 13 nt, Human
uucagagcugccc

SEQ ID NO: 2702801 - RNA, 16 nt, Human
uuauuuuaauaauguu

SEQ ID NO: 2702802 - RNA, 15 nt, Human
uuauuuuaauaaugu

SEQ ID NO: 2702803 - RNA, 15 nt, Human
uuauugucuagugaa

SEQ ID NO: 2702804 - RNA, 17 nt, Human
uucaaauccuugaagau

SEQ ID NO: 2702805 - RNA, 19 nt, Human
uuccagauccuggaaauca

SEQ ID NO: 2702806 - RNA, 17 nt, Human
uuccuuggacucauuuu

SEQ ID NO: 2702807 - RNA, 20 nt, Human
uuccuuggacucauuuuaaa

SEQ ID NO: 2702808 - RNA, 17 nt, Human
uucccuugaugaagaag

SEQ ID NO: 2702809 - RNA, 17 nt, Human
uuacuaguuucccuugc

SEQ ID NO: 2702810 - RNA, 19 nt, Human
uuagaaacacaacuauauu

SEQ ID NO: 2702811 - RNA, 13 nt, Human
uuagcuggaaaag

SEQ ID NO: 2702812 - RNA, 12 nt, Human
uuagcuggaaaa

SEQ ID NO: 2702813 - RNA, 21 nt, Human
uuagaugcaguucugaagaag

SEQ ID NO: 2702814 - RNA, 20 nt, Human
uuagaugcaguucugaagaa

SEQ ID NO: 2702815 - RNA, 18 nt, Human
uuaggauguugaaaaagu

SEQ ID NO: 2702816 - RNA, 22 nt, Human
uguuucaaacauauauaacaau

SEQ ID NO: 2702817 - RNA, 21 nt, Human
uguuucaaacauauauaacaa

SEQ ID NO: 2702818 - RNA, 19 nt, Human
uguuucaaacauauauaac

SEQ ID NO: 2702819 - RNA, 21 nt, Human
uuaaaagaauauuuuaacuuc

SEQ ID NO: 2702820 - RNA, 22 nt, Human
uuaaaagaauauuuuaacuucc

SEQ ID NO: 2702821 - RNA, 15 nt, Human
uuaaaagaugaaaau

SEQ ID NO: 2702822 - RNA, 18 nt, Human
uuaaaagaugaaaauauu

SEQ ID NO: 2702823 - RNA, 19 nt, Human
uuaaaauacacacucaaau

SEQ ID NO: 2702824 - RNA, 15 nt, Human
ugggcagcugccucc

SEQ ID NO: 2702825 - RNA, 14 nt, Human
ugggcagcugccuc

SEQ ID NO: 2702826 - RNA, 13 nt, Human
ugggcagcugccu

SEQ ID NO: 2702827 - RNA, 12 nt, Human
ugggcagcugcc

SEQ ID NO: 2702828 - RNA, 19 nt, Human
ugggcagcugccuccccuc

SEQ ID NO: 2702829 - RNA, 17 nt, Human
ugggcagcugccucccc

SEQ ID NO: 2702830 - RNA, 22 nt, Human
uggugauuuagcaggaagcugu

SEQ ID NO: 2702831 - RNA, 16 nt, Human
uggugauuuagcagga

SEQ ID NO: 2702832 - RNA, 16 nt, Human
uggucccagccagcag

SEQ ID NO: 2702833 - RNA, 22 nt, Human
uggucacaggaaguagaggagg

SEQ ID NO: 2702834 - RNA, 17 nt, Human
uggucacaggaaguaga

SEQ ID NO: 2702835 - RNA, 13 nt, Human
ugguauguuuuca

SEQ ID NO: 2702836 - RNA, 20 nt, Human
uggcaauagucaaauugugu

SEQ ID NO: 2702837 - RNA, 15 nt, Human
uggcacuaguauuuc

SEQ ID NO: 2702838 - RNA, 16 nt, Human
ugccacuaaauugaca

SEQ ID NO: 2702839 - RNA, 13 nt, Human
ugcaucagcugcu

SEQ ID NO: 2702840 - RNA, 12 nt, Human
ugcaguucugaa

SEQ ID NO: 2702841 - RNA, 22 nt, Human
ugcaucaauuuuucuuauuuca

SEQ ID NO: 2702842 - RNA, 20 nt, Human
ugcugggggggauuguaaaa

SEQ ID NO: 2702843 - RNA, 13 nt, Human
ugcuagaacuccc

SEQ ID NO: 2702844 - RNA, 14 nt, Human
ugcuagaacucccu

SEQ ID NO: 2702845 - RNA, 15 nt, Human
ugcuagaacucccuu

SEQ ID NO: 2702846 - RNA, 17 nt, Human
ugcuagaacucccuuuc

SEQ ID NO: 2702847 - RNA, 18 nt, Human
ugaggcuccacuuggucu

SEQ ID NO: 2702848 - RNA, 20 nt, Human
ugaggcuccacuuggucugu

SEQ ID NO: 2702849 - RNA, 16 nt, Human
ugauaacuggaaacuu

SEQ ID NO: 2702850 - RNA, 13 nt, Human
ugagccccaaaag

SEQ ID NO: 2702851 - RNA, 16 nt, Human
ugagagugaacaaauu

SEQ ID NO: 2702852 - RNA, 17 nt, Human
ugaucagcuuauugucu

SEQ ID NO: 2702853 - RNA, 24 nt, Human
ugaucagcuuauugucuagugaaa

SEQ ID NO: 2702854 - RNA, 14 nt, Human
ugaucuuuaaaaua

SEQ ID NO: 2702855 - RNA, 17 nt, Human
ugaucuuuaaaauacac

SEQ ID NO: 2702856 - RNA, 23 nt, Human
ugaugcuacaggauuugaaauug

SEQ ID NO: 2702857 - RNA, 20 nt, Human
ugaugcuacaggauuugaaa

SEQ ID NO: 2702858 - RNA, 15 nt, Human
ugauggugguauguu

SEQ ID NO: 2702859 - RNA, 22 nt, Human
ugauuaugaauuacauuuguau

SEQ ID NO: 2702860 - RNA, 21 nt, Human
ugauuaugaauuacauuugua

SEQ ID NO: 2702861 - RNA, 19 nt, Human
ugauuaugaauuacauuug

SEQ ID NO: 2702862 - RNA, 17 nt, Human
ugauuaugaauuacauu

SEQ ID NO: 2702863 - RNA, 13 nt, Human
ugauuauauguca

SEQ ID NO: 2702864 - RNA, 22 nt, Human
ugauguuuagaaacacaacuau

SEQ ID NO: 2702865 - RNA, 16 nt, Human
ugauuaccagggacug

SEQ ID NO: 2702866 - RNA, 12 nt, Human
ucuuugccaagu

SEQ ID NO: 2702867 - RNA, 19 nt, Human
ucuuuccacagaagcucca

SEQ ID NO: 2702868 - RNA, 17 nt, Human
ucuuucacauuuaaaua

SEQ ID NO: 2702869 - RNA, 16 nt, Human
ugaaauauugacuuuu

SEQ ID NO: 2702870 - RNA, 19 nt, Human
ugaaauggacuuuuguaca

SEQ ID NO: 2702871 - RNA, 22 nt, Human
ugaaacaacaaauaggaauugu

SEQ ID NO: 2702872 - RNA, 18 nt, Human
ugaaagaggcagcuugaa

SEQ ID NO: 2702873 - RNA, 16 nt, Human
ugaaagguacuucaaa

SEQ ID NO: 2702874 - RNA, 15 nt, Human
ugaaagguacuucaa

SEQ ID NO: 2702875 - RNA, 20 nt, Human
ugaaugaauggcuaagcaaa

SEQ ID NO: 2702876 - RNA, 18 nt, Human
ugaauuacauuuguauaa

SEQ ID NO: 2702877 - RNA, 16 nt, Human
ugaauuacauuuguau

SEQ ID NO: 2702878 - RNA, 15 nt, Human
ugaauuacauuugua

SEQ ID NO: 2702879 - RNA, 13 nt, Human
ugaaguccaagca

SEQ ID NO: 2702880 - RNA, 11 nt, Human
ugaaguccaag

SEQ ID NO: 2702881 - RNA, 18 nt, Human
ugacaugggacauuugcu

SEQ ID NO: 2702882 - RNA, 17 nt, Human
ugacaugggacauuugc

SEQ ID NO: 2702883 - RNA, 16 nt, Human
ugacaugggacauuug

SEQ ID NO: 2702884 - RNA, 20 nt, Human
ugaccacugcagaagacagu

SEQ ID NO: 2702885 - RNA, 20 nt, Human
ugacaagcucacagaccuuu

SEQ ID NO: 2702886 - RNA, 15 nt, Human
ugacaagcucacaga

SEQ ID NO: 2702887 - RNA, 12 nt, Human
ugacaagcucac

SEQ ID NO: 2702888 - RNA, 23 nt, Human
ucucaguccaugaagauguagag

SEQ ID NO: 2702889 - RNA, 14 nt, Human
ucggagaagagcug

SEQ ID NO: 2702890 - RNA, 16 nt, Human
ucggagaagagcuguu

SEQ ID NO: 2702891 - RNA, 12 nt, Human
ucggagaagagc

SEQ ID NO: 2702892 - RNA, 17 nt, Human
ucuacacuaagagagaa

SEQ ID NO: 2702893 - RNA, 18 nt, Human
ucuaugaaauauuauguu

SEQ ID NO: 2702894 - RNA, 17 nt, Human
uccugccccugagccca

SEQ ID NO: 2702895 - RNA, 18 nt, Human
uccugccccugagcccau

SEQ ID NO: 2702896 - RNA, 19 nt, Human
uccugaggcuccacuuggu

SEQ ID NO: 2702897 - RNA, 20 nt, Human
uccugaggcuccacuugguc

SEQ ID NO: 2702898 - RNA, 20 nt, Human
ucccuucacaaacccagugu

SEQ ID NO: 2702899 - RNA, 14 nt, Human
uccuagugaaagag

SEQ ID NO: 2702900 - RNA, 23 nt, Human
uccuagugaaagaggcagcuuga

SEQ ID NO: 2702901 - RNA, 22 nt, Human
uccucauuuuuauaaugucccu

SEQ ID NO: 2702902 - RNA, 19 nt, Human
uccagguagagggugugua

SEQ ID NO: 2702903 - RNA, 15 nt, Human
uccauacauuugugu

SEQ ID NO: 2702904 - RNA, 20 nt, Human
uccaugggccauaugaaaag

SEQ ID NO: 2702905 - RNA, 23 nt, Human
uccacuuggucugugagaugcua

SEQ ID NO: 2702906 - RNA, 21 nt, Human
uccacuuggucugugagaugc

SEQ ID NO: 2702907 - RNA, 17 nt, Human
uccacuuggucugugag

SEQ ID NO: 2702908 - RNA, 17 nt, Human
ucaucaaugaaugaaug

SEQ ID NO: 2702909 - RNA, 11 nt, Human
ucauagcagcu

SEQ ID NO: 2702910 - RNA, 12 nt, Human
ucauagcagcuu

SEQ ID NO: 2702911 - RNA, 16 nt, Human
ucauuaggauggcuag

SEQ ID NO: 2702912 - RNA, 14 nt, Human
uccaaagaaaugua

SEQ ID NO: 2702913 - RNA, 17 nt, Human
uccaaagaaauguaagg

SEQ ID NO: 2702914 - RNA, 16 nt, Human
uaggucagugcaaaua

SEQ ID NO: 2702915 - RNA, 16 nt, Human
uaggccaugggacagg

SEQ ID NO: 2702916 - RNA, 18 nt, Human
uaggccaugggacaggga

SEQ ID NO: 2702917 - RNA, 12 nt, Human
uaggaauugacc

SEQ ID NO: 2702918 - RNA, 15 nt, Human
uagugcaaauuguca

SEQ ID NO: 2702919 - RNA, 14 nt, Human
uagugcaaauuguc

SEQ ID NO: 2702920 - RNA, 14 nt, Human
uagucaaauugugu

SEQ ID NO: 2702921 - RNA, 13 nt, Human
uagucaaauugug

SEQ ID NO: 2702922 - RNA, 16 nt, Human
uaguauuucuaugaaa

SEQ ID NO: 2702923 - RNA, 19 nt, Human
uaguauuucuaugaaauau

SEQ ID NO: 2702924 - RNA, 18 nt, Human
uaguauuucuaugaaaua

SEQ ID NO: 2702925 - RNA, 13 nt, Human
uaguaucaaaaga

SEQ ID NO: 2702926 - RNA, 13 nt, Human
uauauaacaaugc

SEQ ID NO: 2702927 - RNA, 13 nt, Human
uauaugcuucugu

SEQ ID NO: 2702928 - RNA, 16 nt, Human
uaugcuucuguuuuau

SEQ ID NO: 2702929 - RNA, 15 nt, Human
uaugcuucuguuuua

SEQ ID NO: 2702930 - RNA, 16 nt, Human
uaugauucccagccag

SEQ ID NO: 2702931 - RNA, 15 nt, Human
uaugcaaagcacuga

SEQ ID NO: 2702932 - RNA, 13 nt, Human
uaugcaaagcacu

SEQ ID NO: 2702933 - RNA, 14 nt, Human
uaugcaaagcacug

SEQ ID NO: 2702934 - RNA, 12 nt, Human
uaugcaaagcac

SEQ ID NO: 2702935 - RNA, 17 nt, Human
uaugaauuacauuugua

SEQ ID NO: 2702936 - RNA, 23 nt, Human
uaugaauuacauuuguauaaaau

SEQ ID NO: 2702937 - RNA, 15 nt, Human
uauccuucagccuga

SEQ ID NO: 2702938 - RNA, 14 nt, Human
uauccuucagccug

SEQ ID NO: 2702939 - RNA, 17 nt, Human
uauguucuaagaaguga

SEQ ID NO: 2702940 - RNA, 19 nt, Human
uauggaggcuuugcauaga

SEQ ID NO: 2702941 - RNA, 12 nt, Human
uauguuaaaacu

SEQ ID NO: 2702942 - RNA, 19 nt, Human
uauguuagugcaaauuguc

SEQ ID NO: 2702943 - RNA, 17 nt, Human
uauuauauuuacaaaug

SEQ ID NO: 2702944 - RNA, 16 nt, Human
uauuauguuaaaacug

SEQ ID NO: 2702945 - RNA, 20 nt, Human
uauuguuuaaaaucauuucu

SEQ ID NO: 2702946 - RNA, 15 nt, Human
uauuucuaugaaaua

SEQ ID NO: 2702947 - RNA, 14 nt, Human
uauuucuaugaaau

SEQ ID NO: 2702948 - RNA, 13 nt, Human
uauuuauuacugu

SEQ ID NO: 2702949 - RNA, 13 nt, Human
uauuucuaugaaa

SEQ ID NO: 2702950 - RNA, 14 nt, Human
uauuuauuacugua

SEQ ID NO: 2702951 - RNA, 15 nt, Human
uauuguuuaaaauca

SEQ ID NO: 2702952 - RNA, 16 nt, Human
uauuguuuaaaaucau

SEQ ID NO: 2702953 - RNA, 17 nt, Human
uauuguuuaaaaucauu

SEQ ID NO: 2702954 - RNA, 14 nt, Human
ucaauaaaauccau

SEQ ID NO: 2702955 - RNA, 22 nt, Human
ucacaagacccaaaaggcagaa

SEQ ID NO: 2702956 - RNA, 12 nt, Human
ucacauuuaaau

SEQ ID NO: 2702957 - RNA, 22 nt, Human
ucaacuccaaacugacucuuaa

SEQ ID NO: 2702958 - RNA, 16 nt, Human
ucaaauaugcaaagca

SEQ ID NO: 2702959 - RNA, 17 nt, Human
ucaaauaugcaaagcac

SEQ ID NO: 2702960 - RNA, 18 nt, Human
ucaaauaugcaaagcacu

SEQ ID NO: 2702961 - RNA, 19 nt, Human
ucaaauaugcaaagcacug

SEQ ID NO: 2702962 - RNA, 15 nt, Human
ucaaauccuugaaga

SEQ ID NO: 2702963 - RNA, 16 nt, Human
ucaaauccuugaagau

SEQ ID NO: 2702964 - RNA, 22 nt, Human
ucaaacagucucaggaaaucaa

SEQ ID NO: 2702965 - RNA, 17 nt, Human
ucaaacauauauaacaa

SEQ ID NO: 2702966 - RNA, 14 nt, Human
gugagcuacaaaug

SEQ ID NO: 2702967 - RNA, 16 nt, Human
gugagcagucaggaaa

SEQ ID NO: 2702968 - RNA, 19 nt, Human
gugaaagaaaauaacaaua

SEQ ID NO: 2702969 - RNA, 20 nt, Human
gugaaacucguuaauuugua

SEQ ID NO: 2702970 - RNA, 18 nt, Human
gugcaaauugucacagga

SEQ ID NO: 2702971 - RNA, 21 nt, Human
guccugucggagcccugucuc

SEQ ID NO: 2702972 - RNA, 20 nt, Human
guccugucggagcccugucu

SEQ ID NO: 2702973 - RNA, 18 nt, Human
guccugucggagcccugu

SEQ ID NO: 2702974 - RNA, 17 nt, Human
gucuacacuaagagaga

SEQ ID NO: 2702975 - RNA, 23 nt, Human
gucuacacuaagagagaaugaga

SEQ ID NO: 2702976 - RNA, 20 nt, Human
gucccagccagcaguucaga

SEQ ID NO: 2702977 - RNA, 21 nt, Human
gucaauaaaauccauacauuu

SEQ ID NO: 2702978 - RNA, 15 nt, Human
gucaauaaaauccau

SEQ ID NO: 2702979 - RNA, 14 nt, Human
gucaccucauggaa

SEQ ID NO: 2702980 - RNA, 17 nt, Human
guauuuuaaaagaauga

SEQ ID NO: 2702981 - RNA, 16 nt, Human
guauuuuaaaagaaug

SEQ ID NO: 2702982 - RNA, 17 nt, Human
guauuucuaugaaauau

SEQ ID NO: 2702983 - RNA, 22 nt, Human
guauuucuaugaaauauuaugu

SEQ ID NO: 2702984 - RNA, 19 nt, Human
ggugcuacaaaaacacagc

SEQ ID NO: 2702985 - RNA, 21 nt, Human
ggguagccacuggacugacga

SEQ ID NO: 2702986 - RNA, 22 nt, Human
gguacuucaaauccuugaagau

SEQ ID NO: 2702987 - RNA, 22 nt, Human
gguagacacacaugaaguccaa

SEQ ID NO: 2702988 - RNA, 15 nt, Human
gguagacacacauga

SEQ ID NO: 2702989 - RNA, 23 nt, Human
guaaaaccacagcaguugaaaag

SEQ ID NO: 2702990 - RNA, 14 nt, Human
guaaaaccacagca

SEQ ID NO: 2702991 - RNA, 15 nt, Human
guaaaaccacagcag

SEQ ID NO: 2702992 - RNA, 16 nt, Human
guaaaaccacagcagu

SEQ ID NO: 2702993 - RNA, 18 nt, Human
guaaaaccacagcaguug

SEQ ID NO: 2702994 - RNA, 17 nt, Human
guaagggaaacugccag

SEQ ID NO: 2702995 - RNA, 18 nt, Human
guaagggaaacugccagc

SEQ ID NO: 2702996 - RNA, 23 nt, Human
guacuuuauuuucuauaauuuaa

SEQ ID NO: 2702997 - RNA, 15 nt, Human
guagaggagaaacug

SEQ ID NO: 2702998 - RNA, 15 nt, Human
guaccgcaaugugac

SEQ ID NO: 2702999 - RNA, 15 nt, Human
guaauuggaaaggca

SEQ ID NO: 2703000 - RNA, 19 nt, Human
guaaugauaacuggaaacu

SEQ ID NO: 2703001 - RNA, 14 nt, Human
gcucucuggccuuc

SEQ ID NO: 2703002 - RNA, 15 nt, Human
gcucucuggccuucg

SEQ ID NO: 2703003 - RNA, 19 nt, Human
gcucucuggccuucggccu

SEQ ID NO: 2703004 - RNA, 20 nt, Human
gcucucuggccuucggccuc

SEQ ID NO: 2703005 - RNA, 12 nt, Human
gcucucuggccu

SEQ ID NO: 2703006 - RNA, 13 nt, Human
gcucucuggccuu

SEQ ID NO: 2703007 - RNA, 11 nt, Human
gcucucuggcc

SEQ ID NO: 2703008 - RNA, 17 nt, Human
gcuaagcaaaaugugau

SEQ ID NO: 2703009 - RNA, 14 nt, Human
gcuaagcauuccaa

SEQ ID NO: 2703010 - RNA, 23 nt, Human
gcccucuccugggcagcugccuc

SEQ ID NO: 2703011 - RNA, 22 nt, Human
gcccucuccugggcagcugccu

SEQ ID NO: 2703012 - RNA, 14 nt, Human
gcccucuccugggc

SEQ ID NO: 2703013 - RNA, 13 nt, Human
gcccucuccuggg

SEQ ID NO: 2703014 - RNA, 12 nt, Human
gcccucuccugg

SEQ ID NO: 2703015 - RNA, 22 nt, Human
gccuauauuuuuuguuaaauga

SEQ ID NO: 2703016 - RNA, 17 nt, Human
gccuaagugcagccccg

SEQ ID NO: 2703017 - RNA, 20 nt, Human
gcugucuacacuaagagaga

SEQ ID NO: 2703018 - RNA, 17 nt, Human
ggaaaucaaauaugcaa

SEQ ID NO: 2703019 - RNA, 23 nt, Human
ggaaagggauuuucagcccucag

SEQ ID NO: 2703020 - RNA, 20 nt, Human
ggaagugacgguuuaauggg

SEQ ID NO: 2703021 - RNA, 22 nt, Human
ggaauuggagcucgugggacag

SEQ ID NO: 2703022 - RNA, 16 nt, Human
ggaauuggagcucgug

SEQ ID NO: 2703023 - RNA, 23 nt, Human
ggaauuucucccagucauuuaau

SEQ ID NO: 2703024 - RNA, 15 nt, Human
ggagaaucacuugaa

SEQ ID NO: 2703025 - RNA, 19 nt, Human
ggagaaucacuugaacccg

SEQ ID NO: 2703026 - RNA, 13 nt, Human
ggacgcucucugg

SEQ ID NO: 2703027 - RNA, 14 nt, Human
ggacgcucucuggc

SEQ ID NO: 2703028 - RNA, 14 nt, Human
ggcauggcugggaa

SEQ ID NO: 2703029 - RNA, 15 nt, Human
ggauuguaaaauggu

SEQ ID NO: 2703030 - RNA, 16 nt, Human
gcaaauugucacagga

SEQ ID NO: 2703031 - RNA, 20 nt, Human
gaugcuagaacucccuuuca

SEQ ID NO: 2703032 - RNA, 22 nt, Human
gaugcuagaacucccuuucaac

SEQ ID NO: 2703033 - RNA, 18 nt, Human
gaugcuagaacucccuuu

SEQ ID NO: 2703034 - RNA, 13 nt, Human
gcacacugucugc

SEQ ID NO: 2703035 - RNA, 18 nt, Human
gcacugacuucuaaguaa

SEQ ID NO: 2703036 - RNA, 15 nt, Human
gcacugacuucuaag

SEQ ID NO: 2703037 - RNA, 22 nt, Human
gauaaauggcuuccuggcaaua

SEQ ID NO: 2703038 - RNA, 12 nt, Human
gagcccugucuc

SEQ ID NO: 2703039 - RNA, 20 nt, Human
gagacagcucugcauacuca

SEQ ID NO: 2703040 - RNA, 21 nt, Human
gagaaugagagacacacugaa

SEQ ID NO: 2703041 - RNA, 20 nt, Human
gagaaugagagacacacuga

SEQ ID NO: 2703042 - RNA, 22 nt, Human
gagaaccuagggugauauuaac

SEQ ID NO: 2703043 - RNA, 21 nt, Human
gagaaccuagggugauauuaa

SEQ ID NO: 2703044 - RNA, 23 nt, Human
gagaacuuccagauccuggaaau

SEQ ID NO: 2703045 - RNA, 22 nt, Human
gagaacuuccagauccuggaaa

SEQ ID NO: 2703046 - RNA, 17 nt, Human
gagaaugagagacacac

SEQ ID NO: 2703047 - RNA, 16 nt, Human
gacuucuaaguaaaac

SEQ ID NO: 2703048 - RNA, 17 nt, Human
gacuucuaaguaaaacc

SEQ ID NO: 2703049 - RNA, 18 nt, Human
gacuucuaaguaaaacca

SEQ ID NO: 2703050 - RNA, 20 nt, Human
gacuucugucuucacaacag

SEQ ID NO: 2703051 - RNA, 23 nt, Human
gacuucugucuucacaacagauu

SEQ ID NO: 2703052 - RNA, 19 nt, Human
gacuucuaaguaaaaccac

SEQ ID NO: 2703053 - RNA, 23 nt, Human
gacuucuaaguaaaaccacagca

SEQ ID NO: 2703054 - RNA, 24 nt, Human
gacuucuaaguaaaaccacagcag

SEQ ID NO: 2703055 - RNA, 16 nt, Human
gacuccaaagaaaugu

SEQ ID NO: 2703056 - RNA, 18 nt, Human
gacuccaaagaaauguaa

SEQ ID NO: 2703057 - RNA, 21 nt, Human
gacucauuuuaaaaaauggaa

SEQ ID NO: 2703058 - RNA, 11 nt, Human
gacuccaaaga

SEQ ID NO: 2703059 - RNA, 12 nt, Human
gacuccaaagaa

SEQ ID NO: 2703060 - RNA, 15 nt, Human
gacuccaaagaaaug

SEQ ID NO: 2703061 - RNA, 16 nt, Human
gacugcauuauauuua

SEQ ID NO: 2703062 - RNA, 14 nt, Human
gacugcauuauauu

SEQ ID NO: 2703063 - RNA, 16 nt, Human
gacuggauaguccguc

SEQ ID NO: 2703064 - RNA, 19 nt, Human
gacagagccccacccucag

SEQ ID NO: 2703065 - RNA, 20 nt, Human
gacauagaauuaacacauga

SEQ ID NO: 2703066 - RNA, 17 nt, Human
gacagggaggacgcucu

SEQ ID NO: 2703067 - RNA, 18 nt, Human
gacagggaggacgcucuc

SEQ ID NO: 2703068 - RNA, 16 nt, Human
gacaugggacauuugc

SEQ ID NO: 2703069 - RNA, 21 nt, Human
gaccacugcagaagacaguau

SEQ ID NO: 2703070 - RNA, 16 nt, Human
gacccaaaaggcagaa

SEQ ID NO: 2703071 - RNA, 15 nt, Human
gacccacaagaaaug

SEQ ID NO: 2703072 - RNA, 22 nt, Human
gacccacaagaaaugaaagcag

SEQ ID NO: 2703073 - RNA, 16 nt, Human
gacaaggaaaaaauaa

SEQ ID NO: 2703074 - RNA, 15 nt, Human
gacaagcucacagac

SEQ ID NO: 2703075 - RNA, 16 nt, Human
gaauuggagcucgugg

SEQ ID NO: 2703076 - RNA, 16 nt, Human
gaauugacccacaaga

SEQ ID NO: 2703077 - RNA, 21 nt, Human
gaauugacccacaagaaauga

SEQ ID NO: 2703078 - RNA, 21 nt, Human
cuguuaaaagaugaaaauauu

SEQ ID NO: 2703079 - RNA, 23 nt, Human
cuguuaaaagaugaaaauauuug

SEQ ID NO: 2703080 - RNA, 20 nt, Human
cuguuaaaagaugaaaauau

SEQ ID NO: 2703081 - RNA, 22 nt, Human
cugggggggauuguaaaauggu

SEQ ID NO: 2703082 - RNA, 23 nt, Human
cuguaaucacagcuacuugggag

SEQ ID NO: 2703083 - RNA, 20 nt, Human
cugucuacacuaagagagaa

SEQ ID NO: 2703084 - RNA, 22 nt, Human
cuguauuuuaaaagaaugauua

SEQ ID NO: 2703085 - RNA, 19 nt, Human
cuguauuuuaaaagaauga

SEQ ID NO: 2703086 - RNA, 20 nt, Human
cuguauuuuaaaagaaugau

SEQ ID NO: 2703087 - RNA, 12 nt, Human
cuggagcucugc

SEQ ID NO: 2703088 - RNA, 13 nt, Human
cuggagcucugcc

SEQ ID NO: 2703089 - RNA, 16 nt, Human
cuggagcucugcccau

SEQ ID NO: 2703090 - RNA, 23 nt, Human
cuggccuucggccuccauccuga

SEQ ID NO: 2703091 - RNA, 22 nt, Human
cuggccuucggccuccauccug

SEQ ID NO: 2703092 - RNA, 21 nt, Human
cuggcacaguuuucugagaaa

SEQ ID NO: 2703093 - RNA, 22 nt, Human
cuggcacaguuuucugagaaag

SEQ ID NO: 2703094 - RNA, 20 nt, Human
cuggcacaguuuucugagaa

SEQ ID NO: 2703095 - RNA, 18 nt, Human
cugcugaaacaacaaaua

SEQ ID NO: 2703096 - RNA, 13 nt, Human
cugccuccccucc

SEQ ID NO: 2703097 - RNA, 19 nt, Human
cugcccucuccugggcagc

SEQ ID NO: 2703098 - RNA, 18 nt, Human
cugcccucuccugggcag

SEQ ID NO: 2703099 - RNA, 16 nt, Human
cugcccucuccugggc

SEQ ID NO: 2703100 - RNA, 21 nt, Human
cugcccucuccugggcagcug

SEQ ID NO: 2703101 - RNA, 20 nt, Human
cugcccucuccugggcagcu

SEQ ID NO: 2703102 - RNA, 21 nt, Human
cuucugucuucacaacagauu

SEQ ID NO: 2703103 - RNA, 22 nt, Human
cuucugucuucacaacagauua

SEQ ID NO: 2703104 - RNA, 18 nt, Human
cuucugucuucacaacag

SEQ ID NO: 2703105 - RNA, 22 nt, Human
cuuagaugcaguucugaagaag

SEQ ID NO: 2703106 - RNA, 20 nt, Human
cuuagaugcaguucugaaga

SEQ ID NO: 2703107 - RNA, 15 nt, Human
cuuauuucauuucuu

SEQ ID NO: 2703108 - RNA, 15 nt, Human
cuuauuuccucauuu

SEQ ID NO: 2703109 - RNA, 14 nt, Human
cuuauuucauuucu

SEQ ID NO: 2703110 - RNA, 23 nt, Human
cuugucaauaaaauccauacauu

SEQ ID NO: 2703111 - RNA, 19 nt, Human
cuugaguuuaaauuguaau

SEQ ID NO: 2703112 - RNA, 18 nt, Human
gaaaauauuuguaucaca

SEQ ID NO: 2703113 - RNA, 22 nt, Human
gaaaaucuacacuccagugaga

SEQ ID NO: 2703114 - RNA, 18 nt, Human
gaaaaucuuauaauuuaa

SEQ ID NO: 2703115 - RNA, 14 nt, Human
gaaagcagggacuu

SEQ ID NO: 2703116 - RNA, 22 nt, Human
gaaagcagaacagugauuacca

SEQ ID NO: 2703117 - RNA, 17 nt, Human
gaaagcagaacagugau

SEQ ID NO: 2703118 - RNA, 20 nt, Human
gaaagaggcagcuugaaacu

SEQ ID NO: 2703119 - RNA, 21 nt, Human
gaaagaggaaugaaguacuca

SEQ ID NO: 2703120 - RNA, 17 nt, Human
gaaagagaacuuccaga

SEQ ID NO: 2703121 - RNA, 14 nt, Human
gaaacccugucucu

SEQ ID NO: 2703122 - RNA, 23 nt, Human
gaaacucguuaauuuguaguguu

SEQ ID NO: 2703123 - RNA, 11 nt, Human
gaaacauuugg

SEQ ID NO: 2703124 - RNA, 16 nt, Human
gaaacacaacuauauu

SEQ ID NO: 2703125 - RNA, 13 nt, Human
ccugaggcuccac

SEQ ID NO: 2703126 - RNA, 14 nt, Human
ccugaggcuccacu

SEQ ID NO: 2703127 - RNA, 17 nt, Human
ccugccccugagcccau

SEQ ID NO: 2703128 - RNA, 14 nt, Human
ccugggcagcugcc

SEQ ID NO: 2703129 - RNA, 13 nt, Human
ccugggcagcugc

SEQ ID NO: 2703130 - RNA, 15 nt, Human
ccuuggacucauuuu

SEQ ID NO: 2703131 - RNA, 18 nt, Human
ccuucggccuccauccug

SEQ ID NO: 2703132 - RNA, 16 nt, Human
ccuucggccuccaucc

SEQ ID NO: 2703133 - RNA, 17 nt, Human
ccuucggccuccauccu

SEQ ID NO: 2703134 - RNA, 19 nt, Human
cuaaauugacacuuaaaaa

SEQ ID NO: 2703135 - RNA, 15 nt, Human
cuaagagagaaugag

SEQ ID NO: 2703136 - RNA, 14 nt, Human
cuaagagagaauga

SEQ ID NO: 2703137 - RNA, 20 nt, Human
cgggaggcagagguugcagu

SEQ ID NO: 2703138 - RNA, 14 nt, Human
cuacacuaagagag

SEQ ID NO: 2703139 - RNA, 23 nt, Human
cuacacgagauacagaauuuuau

SEQ ID NO: 2703140 - RNA, 21 nt, Human
cuaagcuucacuguaaaauaa

SEQ ID NO: 2703141 - RNA, 14 nt, Human
cuaaguaaaaccac

SEQ ID NO: 2703142 - RNA, 18 nt, Human
cuaaguaaaaccacagca

SEQ ID NO: 2703143 - RNA, 19 nt, Human
cuaaguaaaaccacagcag

SEQ ID NO: 2703144 - RNA, 20 nt, Human
cuaggaaauauuuauuuuaa

SEQ ID NO: 2703145 - RNA, 19 nt, Human
cuaggaaauauuuauuuua

SEQ ID NO: 2703146 - RNA, 15 nt, Human
cuaggaaauauuuau

SEQ ID NO: 2703147 - RNA, 14 nt, Human
cuaggaaauauuua

SEQ ID NO: 2703148 - RNA, 19 nt, Human
cuagaguuuagcuggaaaa

SEQ ID NO: 2703149 - RNA, 18 nt, Human
cuagaguuuagcuggaaa

SEQ ID NO: 2703150 - RNA, 19 nt, Human
cuaugaaauauuauguuaa

SEQ ID NO: 2703151 - RNA, 12 nt, Human
cuauaauuuaaa

SEQ ID NO: 2703152 - RNA, 13 nt, Human
cuauaauuuaaau

SEQ ID NO: 2703153 - RNA, 21 nt, Human
cucagaugcacaugagcuggc

SEQ ID NO: 2703154 - RNA, 22 nt, Human
cucaggaaaucaaauaugcaaa

SEQ ID NO: 2703155 - RNA, 14 nt, Human
cuccccucggagaa

SEQ ID NO: 2703156 - RNA, 23 nt, Human
cucauuuuuauaaugucccuuca

SEQ ID NO: 2703157 - RNA, 12 nt, Human
cucauuuccaag

SEQ ID NO: 2703158 - RNA, 14 nt, Human
cucauuuccaagca

SEQ ID NO: 2703159 - RNA, 13 nt, Human
cucauuuccaagc

SEQ ID NO: 2703160 - RNA, 17 nt, Human
cucauuuccaagcaagu

SEQ ID NO: 2703161 - RNA, 17 nt, Human
ccccuccucugcuugcc

SEQ ID NO: 2703162 - RNA, 14 nt, Human
ccccuccucugcuu

SEQ ID NO: 2703163 - RNA, 13 nt, Human
ccccuccucugcu

SEQ ID NO: 2703164 - RNA, 15 nt, Human
ccccucggagaagag

SEQ ID NO: 2703165 - RNA, 15 nt, Human
ccuaacgaaguaucc

SEQ ID NO: 2703166 - RNA, 22 nt, Human
cccucuccugggcagcugccuc

SEQ ID NO: 2703167 - RNA, 21 nt, Human
cccucuccugggcagcugccu

SEQ ID NO: 2703168 - RNA, 20 nt, Human
cccucuccugggcagcugcc

SEQ ID NO: 2703169 - RNA, 23 nt, Human
cccucuccugggcagcugccucc

SEQ ID NO: 2703170 - RNA, 12 nt, Human
ccaggugccagu

SEQ ID NO: 2703171 - RNA, 13 nt, Human
ccaggugccaguu

SEQ ID NO: 2703172 - RNA, 20 nt, Human
ccauccugaggcuccacuug

SEQ ID NO: 2703173 - RNA, 18 nt, Human
ccauccugaggcuccacu

SEQ ID NO: 2703174 - RNA, 20 nt, Human
ccagguagaggguguguaag

SEQ ID NO: 2703175 - RNA, 19 nt, Human
ccagccugagcgacaguga

SEQ ID NO: 2703176 - RNA, 15 nt, Human
ccacugguucuucuu

SEQ ID NO: 2703177 - RNA, 14 nt, Human
ccagacaucaacag

SEQ ID NO: 2703178 - RNA, 15 nt, Human
ccaccucccugcaau

SEQ ID NO: 2703179 - RNA, 21 nt, Human
ccaccucccugcaauaaaaug

SEQ ID NO: 2703180 - RNA, 19 nt, Human
ccaccucccugcaauaaaa

SEQ ID NO: 2703181 - RNA, 21 nt, Human
gaaaagacuccaaagaaaugu

SEQ ID NO: 2703182 - RNA, 20 nt, Human
gaaaagacuccaaagaaaug

SEQ ID NO: 2703183 - RNA, 18 nt, Human
gaaaagacuccaaagaaa

SEQ ID NO: 2703184 - RNA, 23 nt, Human
gaacaaauuuacagagacagaaa

SEQ ID NO: 2703185 - RNA, 17 nt, Human
gaacaaauuuacagaga

SEQ ID NO: 2703186 - RNA, 18 nt, Human
gaacaaauuuacagagac

SEQ ID NO: 2703187 - RNA, 18 nt, Human
gaaaugaaagcagggacu

SEQ ID NO: 2703188 - RNA, 23 nt, Human
gaaaucaaauaugcaaagcacug

SEQ ID NO: 2703189 - RNA, 17 nt, Human
gaaaugaaagcagggac

SEQ ID NO: 2703190 - RNA, 21 nt, Human
gaaaucaaauaugcaaagcac

SEQ ID NO: 2703191 - RNA, 16 nt, Human
gaaaucaaauaugcaa

SEQ ID NO: 2703192 - RNA, 23 nt, Human
gaaacuucagcgguuuauauaag

SEQ ID NO: 2703193 - RNA, 22 nt, Human
cuucucuguauuccuagaaacu

SEQ ID NO: 2703194 - RNA, 23 nt, Human
cuuggucucagugucaaugcagc

SEQ ID NO: 2703195 - RNA, 14 nt, Human
cugccuccccuccu

SEQ ID NO: 2703196 - RNA, 18 nt, Human
cugccuccccuccucugc

SEQ ID NO: 2703197 - RNA, 17 nt, Human
cugccuccccuccucug

SEQ ID NO: 2703198 - RNA, 20 nt, Human
cugccuccccuccucugcuu

SEQ ID NO: 2703199 - RNA, 19 nt, Human
cugccuccccuccucugcu

SEQ ID NO: 2703200 - RNA, 21 nt, Human
cugccuccccuccucugcuug

SEQ ID NO: 2703201 - RNA, 23 nt, Human
cuggaaaaguauguuagugcaaa

SEQ ID NO: 2703202 - RNA, 21 nt, Human
cugugagaugcuagaacuccc

SEQ ID NO: 2703203 - RNA, 23 nt, Human
cugugagaugcuagaacucccuu

SEQ ID NO: 2703204 - RNA, 22 nt, Human
cuguucacagccagacuggcac

SEQ ID NO: 2703205 - RNA, 12 nt, Human
cuguucacagcc

SEQ ID NO: 2703206 - RNA, 19 nt, Human
cuguucacagccagacugg

SEQ ID NO: 2703207 - RNA, 13 nt, Human
cuuaaaaaugguu

SEQ ID NO: 2703208 - RNA, 20 nt, Human
cuuaaaaaugguuuaaaugg

SEQ ID NO: 2703209 - RNA, 12 nt, Human
cuuaaaaauggu

SEQ ID NO: 2703210 - RNA, 20 nt, Human
cuguaagaaaauaucacuug

SEQ ID NO: 2703211 - RNA, 14 nt, Human
gacgcucucuggcc

SEQ ID NO: 2703212 - RNA, 18 nt, Human
gacagucaccucauggaa

SEQ ID NO: 2703213 - RNA, 12 nt, Human
gacagcucugca

SEQ ID NO: 2703214 - RNA, 14 nt, Human
gaaugaauggcuaa

SEQ ID NO: 2703215 - RNA, 20 nt, Human
gaauuacauuuguauaaaau

SEQ ID NO: 2703216 - RNA, 18 nt, Human
gaauuacauuuguauaaa

SEQ ID NO: 2703217 - RNA, 15 nt, Human
gaauuacauuuguau

SEQ ID NO: 2703218 - RNA, 13 nt, Human
gaauuacauuugu

SEQ ID NO: 2703219 - RNA, 14 nt, Human
gaauuaacacauga

SEQ ID NO: 2703220 - RNA, 15 nt, Human
gaauuaacacaugau

SEQ ID NO: 2703221 - RNA, 22 nt, Human
gaaugauuaugaauuacauuug

SEQ ID NO: 2703222 - RNA, 14 nt, Human
gaaugauuaugaau

SEQ ID NO: 2703223 - RNA, 15 nt, Human
gaaugaauggcuaag

SEQ ID NO: 2703224 - RNA, 20 nt, Human
gaaugaauggcuaagcaaaa

SEQ ID NO: 2703225 - RNA, 22 nt, Human
gacuuuuuauggcacuaguauu

SEQ ID NO: 2703226 - RNA, 21 nt, Human
gagauugugccccugcacucc

SEQ ID NO: 2703227 - RNA, 16 nt, Human
gagaugcuagaacucc

SEQ ID NO: 2703228 - RNA, 20 nt, Human
gagaugcuagaacucccuuu

SEQ ID NO: 2703229 - RNA, 22 nt, Human
gagcuguucacagccagacugg

SEQ ID NO: 2703230 - RNA, 17 nt, Human
gagcuguucacagccag

SEQ ID NO: 2703231 - RNA, 20 nt, Human
gagcuguucacagccagacu

SEQ ID NO: 2703232 - RNA, 14 nt, Human
gagcagucaggaaa

SEQ ID NO: 2703233 - RNA, 17 nt, Human
gagccccacccucagau

SEQ ID NO: 2703234 - RNA, 16 nt, Human
gagccccacccucaga

SEQ ID NO: 2703235 - RNA, 21 nt, Human
gaggacgcucucuggccuucg

SEQ ID NO: 2703236 - RNA, 20 nt, Human
gaggacgcucucuggccuuc

SEQ ID NO: 2703237 - RNA, 12 nt, Human
gaggagaaacug

SEQ ID NO: 2703238 - RNA, 14 nt, Human
gaggagaaacugga

SEQ ID NO: 2703239 - RNA, 15 nt, Human
gaggcuccacuuggu

SEQ ID NO: 2703240 - RNA, 12 nt, Human
gaggcuccacuu

SEQ ID NO: 2703241 - RNA, 17 nt, Human
gaggcuccacuuggucu

SEQ ID NO: 2703242 - RNA, 18 nt, Human
gaggcugagaugggagaa

SEQ ID NO: 2703243 - RNA, 20 nt, Human
gcaucuagcaugucgucaaa

SEQ ID NO: 2703244 - RNA, 22 nt, Human
gcaguuguugcccacagcugua

SEQ ID NO: 2703245 - RNA, 13 nt, Human
gcagugaugucac

SEQ ID NO: 2703246 - RNA, 12 nt, Human
gcagaacaguga

SEQ ID NO: 2703247 - RNA, 13 nt, Human
gcagaacagugau

SEQ ID NO: 2703248 - RNA, 18 nt, Human
gcagaacagugauuacca

SEQ ID NO: 2703249 - RNA, 22 nt, Human
gcagaacagugauuaccaggga

SEQ ID NO: 2703250 - RNA, 15 nt, Human
gcagcucuccccuuc

SEQ ID NO: 2703251 - RNA, 13 nt, Human
gcugcugaaacaa

SEQ ID NO: 2703252 - RNA, 18 nt, Human
gcuguauuuuaaaagaau

SEQ ID NO: 2703253 - RNA, 20 nt, Human
gcuguauuuuaaaagaauga

SEQ ID NO: 2703254 - RNA, 21 nt, Human
gcuguauuuuaaaagaaugau

SEQ ID NO: 2703255 - RNA, 14 nt, Human
gcugccuccccucc

SEQ ID NO: 2703256 - RNA, 19 nt, Human
ggaaaucaggguuaguauu

SEQ ID NO: 2703257 - RNA, 21 nt, Human
ggacagucaccucauggaauu

SEQ ID NO: 2703258 - RNA, 18 nt, Human
ggacagucaccucaugga

SEQ ID NO: 2703259 - RNA, 17 nt, Human
ggacagucaccucaugg

SEQ ID NO: 2703260 - RNA, 13 nt, Human
ggaaacugccagc

SEQ ID NO: 2703261 - RNA, 16 nt, Human
ggaaaaaauaacaaug

SEQ ID NO: 2703262 - RNA, 11 nt, Human
gccccaaaagg

SEQ ID NO: 2703263 - RNA, 13 nt, Human
gcauuuagaugua

SEQ ID NO: 2703264 - RNA, 19 nt, Human
gcauuuaggccaugggaca

SEQ ID NO: 2703265 - RNA, 12 nt, Human
gcauuuagaugu

SEQ ID NO: 2703266 - RNA, 22 nt, Human
gccucauguccacugguucuuc

SEQ ID NO: 2703267 - RNA, 13 nt, Human
gccuccauccuga

SEQ ID NO: 2703268 - RNA, 14 nt, Human
gccuccauccugag

SEQ ID NO: 2703269 - RNA, 23 nt, Human
gccuucggccuccauccugaggc

SEQ ID NO: 2703270 - RNA, 13 nt, Human
aaaaauacaaaaa

SEQ ID NO: 2703271 - RNA, 18 nt, Human
ggccuucggccuccaucc

SEQ ID NO: 2703272 - RNA, 16 nt, Human
ggccuucggccuccau

SEQ ID NO: 2703273 - RNA, 20 nt, Human
ggcuaagcuucacuguaaaa

SEQ ID NO: 2703274 - RNA, 16 nt, Human
aaaaugguuuaaaugg

SEQ ID NO: 2703275 - RNA, 18 nt, Human
aaaaugguuuaaaugguc

SEQ ID NO: 2703276 - RNA, 16 nt, Human
aaaauggguuuuacug

SEQ ID NO: 2703277 - RNA, 17 nt, Human
aaaaucucaauauuuca

SEQ ID NO: 2703278 - RNA, 11 nt, Human
aaaauaauuuu

SEQ ID NO: 2703279 - RNA, 17 nt, Human
aaaauaauuuuuauauu

SEQ ID NO: 2703280 - RNA, 16 nt, Human
aaaauaauuuuuauau

SEQ ID NO: 2703281 - RNA, 14 nt, Human
aaaauacacacuca

SEQ ID NO: 2703282 - RNA, 14 nt, Human
ggucagugcaaaua

SEQ ID NO: 2703283 - RNA, 20 nt, Human
ggguuuuauuguuuaaaauc

SEQ ID NO: 2703284 - RNA, 13 nt, Human
aaauaugcaaagc

SEQ ID NO: 2703285 - RNA, 15 nt, Human
aaauaugcaaagcac

SEQ ID NO: 2703286 - RNA, 16 nt, Human
aaauaugcaaagcacu

SEQ ID NO: 2703287 - RNA, 17 nt, Human
aaauaugcaaagcacug

SEQ ID NO: 2703288 - RNA, 21 nt, Human
aaauaccaugccauuuaaagc

SEQ ID NO: 2703289 - RNA, 18 nt, Human
aaauauaugcuaagucuu

SEQ ID NO: 2703290 - RNA, 22 nt, Human
aaauaucacuugucaauaaaau

SEQ ID NO: 2703291 - RNA, 13 nt, Human
guaauaaacucau

SEQ ID NO: 2703292 - RNA, 12 nt, Human
aaacuuuaugcu

SEQ ID NO: 2703293 - RNA, 19 nt, Human
aaacuuuaugcuaagugaa

SEQ ID NO: 2703294 - RNA, 16 nt, Human
aaagcagaacagugau

SEQ ID NO: 2703295 - RNA, 22 nt, Human
aaagggcuguuauaaucuuuca

SEQ ID NO: 2703296 - RNA, 20 nt, Human
aaagggcuguuauaaucuuu

SEQ ID NO: 2703297 - RNA, 13 nt, Human
aaagcuuauuaaa

SEQ ID NO: 2703298 - RNA, 17 nt, Human
aaaguauguuagugcaa

SEQ ID NO: 2703299 - RNA, 19 nt, Human
gguuuuauuguuuaaaauc

SEQ ID NO: 2703300 - RNA, 16 nt, Human
cacaagacugcacauc

SEQ ID NO: 2703301 - RNA, 12 nt, Human
caauuuaaaaaa

SEQ ID NO: 2703302 - RNA, 23 nt, Human
caaugcuguauuuuaaaagaaug

SEQ ID NO: 2703303 - RNA, 14 nt, Human
caaugcuguauuuu

SEQ ID NO: 2703304 - RNA, 21 nt, Human
caauauuucagauaaucacaa

SEQ ID NO: 2703305 - RNA, 20 nt, Human
caauauuucagauaaucaca

SEQ ID NO: 2703306 - RNA, 12 nt, Human
caauauuucaga

SEQ ID NO: 2703307 - RNA, 20 nt, Human
caaguauuagaauaccacag

SEQ ID NO: 2703308 - RNA, 14 nt, Human
caaguauuagaaua

SEQ ID NO: 2703309 - RNA, 22 nt, Human
caccuugcagcucuccccuucu

SEQ ID NO: 2703310 - RNA, 15 nt, Human
caccuugcagcucuc

SEQ ID NO: 2703311 - RNA, 13 nt, Human
caccuugcagcuc

SEQ ID NO: 2703312 - RNA, 21 nt, Human
caccuacaugagguacugaga

SEQ ID NO: 2703313 - RNA, 23 nt, Human
caccucaaaauaccaugccauuu

SEQ ID NO: 2703314 - RNA, 17 nt, Human
cacuuggucugugagau

SEQ ID NO: 2703315 - RNA, 20 nt, Human
cacuuggucugugagaugcu

SEQ ID NO: 2703316 - RNA, 19 nt, Human
caacccaaauguucaucaa

SEQ ID NO: 2703317 - RNA, 21 nt, Human
caacuaucucauuuccaagca

SEQ ID NO: 2703318 - RNA, 15 nt, Human
caacacgagcaggcu

SEQ ID NO: 2703319 - RNA, 15 nt, Human
caaauccuugaagau

SEQ ID NO: 2703320 - RNA, 17 nt, Human
auucuugccaaauauaa

SEQ ID NO: 2703321 - RNA, 18 nt, Human
auugacuuuuuauggcac

SEQ ID NO: 2703322 - RNA, 18 nt, Human
auucacaagacccaaaag

SEQ ID NO: 2703323 - RNA, 14 nt, Human
auuguaaaugugcu

SEQ ID NO: 2703324 - RNA, 15 nt, Human
auuguaaaugugcuu

SEQ ID NO: 2703325 - RNA, 17 nt, Human
auuguaaaugugcuuuu

SEQ ID NO: 2703326 - RNA, 19 nt, Human
auuguuuaaaaucauuucu

SEQ ID NO: 2703327 - RNA, 18 nt, Human
auuucuaugaaauauuau

SEQ ID NO: 2703328 - RNA, 15 nt, Human
auuucuaugaaauau

SEQ ID NO: 2703329 - RNA, 20 nt, Human
auuucuaugaaauauuaugu

SEQ ID NO: 2703330 - RNA, 19 nt, Human
caggugccaguuauggcua

SEQ ID NO: 2703331 - RNA, 16 nt, Human
cagucaccucauggaa

SEQ ID NO: 2703332 - RNA, 15 nt, Human
cagucacauuccaag

SEQ ID NO: 2703333 - RNA, 19 nt, Human
cagucaccucauggaauug

SEQ ID NO: 2703334 - RNA, 20 nt, Human
cagucugacuguuuccauca

SEQ ID NO: 2703335 - RNA, 13 nt, Human
cagcaguucagag

SEQ ID NO: 2703336 - RNA, 17 nt, Human
cagagguugcagugagc

SEQ ID NO: 2703337 - RNA, 16 nt, Human
cagagguugcagugag

SEQ ID NO: 2703338 - RNA, 12 nt, Human
cagauccuggaa

SEQ ID NO: 2703339 - RNA, 21 nt, Human
cagcuccccucggagaagagc

SEQ ID NO: 2703340 - RNA, 22 nt, Human
cagcuccccucggagaagagcu

SEQ ID NO: 2703341 - RNA, 20 nt, Human
cagcuccccucggagaagag

SEQ ID NO: 2703342 - RNA, 14 nt, Human
caugauguuuagaa

SEQ ID NO: 2703343 - RNA, 23 nt, Human
ccacagcaguugaaaagacucca

SEQ ID NO: 2703344 - RNA, 17 nt, Human
ccacagcaguugaaaag

SEQ ID NO: 2703345 - RNA, 18 nt, Human
ccacagcaguugaaaaga

SEQ ID NO: 2703346 - RNA, 12 nt, Human
ccacagcaguug

SEQ ID NO: 2703347 - RNA, 17 nt, Human
cauuuguauaaaauaau

SEQ ID NO: 2703348 - RNA, 20 nt, Human
cauuuguauaaaauaauuuu

SEQ ID NO: 2703349 - RNA, 19 nt, Human
cauuuguauaaaauaauuu

SEQ ID NO: 2703350 - RNA, 17 nt, Human
ccaaauguucaucaaug

SEQ ID NO: 2703351 - RNA, 18 nt, Human
ccccugcacuccagccug

SEQ ID NO: 2703352 - RNA, 14 nt, Human
ccauacauuugugu

SEQ ID NO: 2703353 - RNA, 13 nt, Human
ccauacauuugug

SEQ ID NO: 2703354 - RNA, 22 nt, Human
ccauuuaaagcuuauuaaaacu

SEQ ID NO: 2703355 - RNA, 19 nt, Human
cccugucuccucucucugu

SEQ ID NO: 2703356 - RNA, 21 nt, Human
ccucauuuuuauaaugucccu

SEQ ID NO: 2703357 - RNA, 23 nt, Human
ccucauggaauuggagcucgugg

SEQ ID NO: 2703358 - RNA, 15 nt, Human
ccuguaaucacagcu

SEQ ID NO: 2703359 - RNA, 21 nt, Human
ccugucggagcccugucuccu

SEQ ID NO: 2703360 - RNA, 17 nt, Human
ccugucggagcccuguc

SEQ ID NO: 2703361 - RNA, 16 nt, Human
ccugucggagcccugu

SEQ ID NO: 2703362 - RNA, 22 nt, Human
ccugucggagcccugucuccuc

SEQ ID NO: 2703363 - RNA, 12 nt, Human
cuagaacucccu

SEQ ID NO: 2703364 - RNA, 13 nt, Human
cuagaacucccuu

SEQ ID NO: 2703365 - RNA, 22 nt, Human
cuaaguaaaaccacagcaguug

SEQ ID NO: 2703366 - RNA, 23 nt, Human
cuaaguaaaaccacagcaguuga

SEQ ID NO: 2703367 - RNA, 20 nt, Human
cgugugugugcguccugucg

SEQ ID NO: 2703368 - RNA, 20 nt, Human
cuaaguaaaaccacagcagu

SEQ ID NO: 2703369 - RNA, 20 nt, Human
cuacaugagguacugagagu

SEQ ID NO: 2703370 - RNA, 18 nt, Human
cuacaugagguacugaga

SEQ ID NO: 2703371 - RNA, 18 nt, Human
cuacauacuauggaauuu

SEQ ID NO: 2703372 - RNA, 16 nt, Human
cuacaaaaacacagca

SEQ ID NO: 2703373 - RNA, 17 nt, Human
cuacaaaaacacagcaa

SEQ ID NO: 2703374 - RNA, 18 nt, Human
cuacaaaaacacagcaag

SEQ ID NO: 2703375 - RNA, 15 nt, Human
cuacaaaaacacagc

SEQ ID NO: 2703376 - RNA, 23 nt, Human
cucaaaauaccaugccauuuaaa

SEQ ID NO: 2703377 - RNA, 17 nt, Human
cucaaaacugcacuguc

SEQ ID NO: 2703378 - RNA, 18 nt, Human
cgcaggcccccaggugcc

SEQ ID NO: 2703379 - RNA, 22 nt, Human
cguggugauuuagcaggaagcu

SEQ ID NO: 2703380 - RNA, 16 nt, Human
cuccacuuggucugug

SEQ ID NO: 2703381 - RNA, 17 nt, Human
cuccacuuggucuguga

SEQ ID NO: 2703382 - RNA, 21 nt, Human
cuccacuuggucugugagaug

SEQ ID NO: 2703383 - RNA, 22 nt, Human
cuccacuuggucugugagaugc

SEQ ID NO: 2703384 - RNA, 13 nt, Human
cuccacuuggucu

SEQ ID NO: 2703385 - RNA, 15 nt, Human
cuccacuuggucugu

SEQ ID NO: 2703386 - RNA, 18 nt, Human
cucaguagucagacugga

SEQ ID NO: 2703387 - RNA, 19 nt, Human
cuccccaugauguuuagaa

SEQ ID NO: 2703388 - RNA, 23 nt, Human
cuccacuuggucugugagaugcu

SEQ ID NO: 2703389 - RNA, 14 nt, Human
cuccucugcuugcc

SEQ ID NO: 2703390 - RNA, 12 nt, Human
cuccucugcuug

SEQ ID NO: 2703391 - RNA, 12 nt, Human
cuccugggcagc

SEQ ID NO: 2703392 - RNA, 17 nt, Human
cuccugggcagcugccu

SEQ ID NO: 2703393 - RNA, 16 nt, Human
cuccugggcagcugcc

SEQ ID NO: 2703394 - RNA, 15 nt, Human
cuccugggcagcugc

SEQ ID NO: 2703395 - RNA, 14 nt, Human
cuccugggcagcug

SEQ ID NO: 2703396 - RNA, 19 nt, Human
cuccugggcagcugccucc

SEQ ID NO: 2703397 - RNA, 18 nt, Human
cuccugggcagcugccuc

SEQ ID NO: 2703398 - RNA, 22 nt, Human
cuccugggcagcugccuccccu

SEQ ID NO: 2703399 - RNA, 20 nt, Human
cuccucugcuugccaucccu

SEQ ID NO: 2703400 - RNA, 17 nt, Human
cuccucugcuugccauc

SEQ ID NO: 2703401 - RNA, 16 nt, Human
cuccucugcuugccau

SEQ ID NO: 2703402 - RNA, 15 nt, Human
cuccucugcuugcca

SEQ ID NO: 2703403 - RNA, 22 nt, Human
cuccucugcuugccaucccucc

SEQ ID NO: 2703404 - RNA, 21 nt, Human
cuccucugcuugccaucccuc

SEQ ID NO: 2703405 - RNA, 14 nt, Human
cucguuaauuugua

SEQ ID NO: 2703406 - RNA, 15 nt, Human
cugaaacaacaaaua

SEQ ID NO: 2703407 - RNA, 16 nt, Human
cucuccccuucucugu

SEQ ID NO: 2703408 - RNA, 21 nt, Human
cucuuagaugcaguucugaag

SEQ ID NO: 2703409 - RNA, 22 nt, Human
cucuuagaugcaguucugaaga

SEQ ID NO: 2703410 - RNA, 23 nt, Human
auuaaguaaugauaacuggaaac

SEQ ID NO: 2703411 - RNA, 21 nt, Human
auuaaguaaugauaacuggaa

SEQ ID NO: 2703412 - RNA, 19 nt, Human
uuuuugugaaaagcuccau

SEQ ID NO: 2703413 - RNA, 17 nt, Human
auuacauuuguauaaaa

SEQ ID NO: 2703414 - RNA, 18 nt, Human
auuacauuuguauaaaau

SEQ ID NO: 2703415 - RNA, 12 nt, Human
auuaccagggac

SEQ ID NO: 2703416 - RNA, 16 nt, Human
auuacauuuguauaaa

SEQ ID NO: 2703417 - RNA, 17 nt, Human
uuuuuauauuugaaaua

SEQ ID NO: 2703418 - RNA, 19 nt, Human
uuuuuauauuugaaauauu

SEQ ID NO: 2703419 - RNA, 14 nt, Human
uuuuaauaauguuu

SEQ ID NO: 2703420 - RNA, 13 nt, Human
uuuuaauaauguu

SEQ ID NO: 2703421 - RNA, 12 nt, Human
uuuuaauaaugu

SEQ ID NO: 2703422 - RNA, 16 nt, Human
uuuuaauaauguuuca

SEQ ID NO: 2703423 - RNA, 19 nt, Human
augugcuaguaauuggaaa

SEQ ID NO: 2703424 - RNA, 18 nt, Human
auguucaucaaugaauga

SEQ ID NO: 2703425 - RNA, 15 nt, Human
auuaaaagaauauuu

SEQ ID NO: 2703426 - RNA, 15 nt, Human
auguuuucaggcuag

SEQ ID NO: 2703427 - RNA, 21 nt, Human
auguuuucaggcuagauguau

SEQ ID NO: 2703428 - RNA, 17 nt, Human
auguuuucaggcuagau

SEQ ID NO: 2703429 - RNA, 15 nt, Human
uuuucugagaaagac

SEQ ID NO: 2703430 - RNA, 18 nt, Human
uuuucugagaaagacuau

SEQ ID NO: 2703431 - RNA, 14 nt, Human
uuuucucuaggaaa

SEQ ID NO: 2703432 - RNA, 22 nt, Human
auuuucaguuauuauauuuaca

SEQ ID NO: 2703433 - RNA, 22 nt, Human
auuuuaaaagaaugauuaugaa

SEQ ID NO: 2703434 - RNA, 18 nt, Human
auuuuaaaagaaugauua

SEQ ID NO: 2703435 - RNA, 18 nt, Human
auuuguauaaaauaauuu

SEQ ID NO: 2703436 - RNA, 15 nt, Human
auuuguauaaaauaa

SEQ ID NO: 2703437 - RNA, 19 nt, Human
auuuguauaaaauaauuuu

SEQ ID NO: 2703438 - RNA, 17 nt, Human
auuuuaaaagaaugauu

SEQ ID NO: 2703439 - RNA, 15 nt, Human
auuguauuacaaauc

SEQ ID NO: 2703440 - RNA, 18 nt, Human
auugacccacaagaaaug

SEQ ID NO: 2703441 - RNA, 14 nt, Human
auuugaaauauuga

SEQ ID NO: 2703442 - RNA, 20 nt, Human
auuuauuuuaauaauguuuc

SEQ ID NO: 2703443 - RNA, 19 nt, Human
auuuauuuuaauaauguuu

SEQ ID NO: 2703444 - RNA, 12 nt, Human
auuucauuucuu

SEQ ID NO: 2703445 - RNA, 17 nt, Human
auuuauuuuaauaaugu

SEQ ID NO: 2703446 - RNA, 13 nt, Human
auuuagauguaua

SEQ ID NO: 2703447 - RNA, 20 nt, Human
augaaauauuauguuaaaac

SEQ ID NO: 2703448 - RNA, 21 nt, Human
augaaauauuauguuaaaacu

SEQ ID NO: 2703449 - RNA, 11 nt, Human
uugcucaugga

SEQ ID NO: 2703450 - RNA, 12 nt, Human
uugcucauggaa

SEQ ID NO: 2703451 - RNA, 23 nt, Human
augaauuaguuuuauaugcuucu

SEQ ID NO: 2703452 - RNA, 21 nt, Human
augaauuaguuuuauaugcuu

SEQ ID NO: 2703453 - RNA, 22 nt, Human
augaauuacauuuguauaaaau

SEQ ID NO: 2703454 - RNA, 23 nt, Human
uuguaguguuggagaagaacuga

SEQ ID NO: 2703455 - RNA, 13 nt, Human
uuguauaaaauaa

SEQ ID NO: 2703456 - RNA, 19 nt, Human
uuguauaaaauaauuuuua

SEQ ID NO: 2703457 - RNA, 17 nt, Human
augaauuacauuuguau

SEQ ID NO: 2703458 - RNA, 19 nt, Human
augaauuacauuuguauaa

SEQ ID NO: 2703459 - RNA, 18 nt, Human
augaauuacauuuguaua

SEQ ID NO: 2703460 - RNA, 20 nt, Human
uuuaaaaaagaaacauuugg

SEQ ID NO: 2703461 - RNA, 18 nt, Human
uugugaagcaaaauuuuu

SEQ ID NO: 2703462 - RNA, 14 nt, Human
augauaacuggaaa

SEQ ID NO: 2703463 - RNA, 16 nt, Human
auggaacauaaaauac

SEQ ID NO: 2703464 - RNA, 16 nt, Human
uuuauuuuaauaaugu

SEQ ID NO: 2703465 - RNA, 19 nt, Human
uuuauuacuguaagaaaau

SEQ ID NO: 2703466 - RNA, 23 nt, Human
augcugucuacacuaagagagaa

SEQ ID NO: 2703467 - RNA, 14 nt, Human
augcuguauuuuaa

SEQ ID NO: 2703468 - RNA, 23 nt, Human
auggaauuggagcucgugggaca

SEQ ID NO: 2703469 - RNA, 17 nt, Human
uuuauaugcuucuguuu

SEQ ID NO: 2703470 - RNA, 16 nt, Human
uuuauuacuguaagaa

SEQ ID NO: 2703471 - RNA, 24 nt, Human
uuuaaagcuuauuaaaacucauuu

SEQ ID NO: 2703472 - RNA, 13 nt, Human
augcuaagugaaa

SEQ ID NO: 2703473 - RNA, 13 nt, Human
uuucuaugaaaua

SEQ ID NO: 2703474 - RNA, 20 nt, Human
uuucuaugaaauauuauguu

SEQ ID NO: 2703475 - RNA, 14 nt, Human
uuucuaugaaauau

SEQ ID NO: 2703476 - RNA, 14 nt, Human
uuucugcaucagcu

SEQ ID NO: 2703477 - RNA, 14 nt, Human
uuugaaauauugac

SEQ ID NO: 2703478 - RNA, 17 nt, Human
auggaauuucucccagu

SEQ ID NO: 2703479 - RNA, 16 nt, Human
auggcuauaggugcua

SEQ ID NO: 2703480 - RNA, 19 nt, Human
auggcuauaggugcuacaa

SEQ ID NO: 2703481 - RNA, 21 nt, Human
auggcuauaggugcuacaaaa

SEQ ID NO: 2703482 - RNA, 23 nt, Human
auggcuauaggugcuacaaaaac

SEQ ID NO: 2703483 - RNA, 21 nt, Human
augggacauuugcucauggaa

SEQ ID NO: 2703484 - RNA, 22 nt, Human
augggacauuugcucauggaau

SEQ ID NO: 2703485 - RNA, 14 nt, Human
uucauuaucucaaa

SEQ ID NO: 2703486 - RNA, 13 nt, Human
auaugcaaagcac

SEQ ID NO: 2703487 - RNA, 14 nt, Human
auaugcaaagcacu

SEQ ID NO: 2703488 - RNA, 23 nt, Human
auauguaccuaacgaaguauccu

SEQ ID NO: 2703489 - RNA, 13 nt, Human
auauaugcuaagu

SEQ ID NO: 2703490 - RNA, 15 nt, Human
uucaucaaugaauga

SEQ ID NO: 2703491 - RNA, 17 nt, Human
uucagcgguuuauauaa

SEQ ID NO: 2703492 - RNA, 14 nt, Human
auauuguuugcuaa

SEQ ID NO: 2703493 - RNA, 13 nt, Human
auauuuacaaaug

SEQ ID NO: 2703494 - RNA, 15 nt, Human
aucaaauaugcaaag

SEQ ID NO: 2703495 - RNA, 16 nt, Human
aucaaggguacacugc

SEQ ID NO: 2703496 - RNA, 16 nt, Human
aucaaauaugcaaagc

SEQ ID NO: 2703497 - RNA, 17 nt, Human
aucaaauaugcaaagca

SEQ ID NO: 2703498 - RNA, 18 nt, Human
aucaaauaugcaaagcac

SEQ ID NO: 2703499 - RNA, 21 nt, Human
aucaaggguacacugccuucu

SEQ ID NO: 2703500 - RNA, 13 nt, Human
aucaauuuaaaaa

SEQ ID NO: 2703501 - RNA, 14 nt, Human
aucaauuuuucuua

SEQ ID NO: 2703502 - RNA, 23 nt, Human
aucacuugaacccgggaggcaga

SEQ ID NO: 2703503 - RNA, 17 nt, Human
uucuguuuuauaauuuu

SEQ ID NO: 2703504 - RNA, 16 nt, Human
uucuguuuuauaauuu

SEQ ID NO: 2703505 - RNA, 21 nt, Human
aucccucccuccaccucccug

SEQ ID NO: 2703506 - RNA, 20 nt, Human
aucccucccuccaccucccu

SEQ ID NO: 2703507 - RNA, 18 nt, Human
aucccucccuccaccucc

SEQ ID NO: 2703508 - RNA, 17 nt, Human
aucccucccuccaccuc

SEQ ID NO: 2703509 - RNA, 16 nt, Human
aucccucccuccaccu

SEQ ID NO: 2703510 - RNA, 14 nt, Human
aucccucccuccac

SEQ ID NO: 2703511 - RNA, 19 nt, Human
uugacacuuaaaaaugguu

SEQ ID NO: 2703512 - RNA, 17 nt, Human
uugacacuuaaaaaugg

SEQ ID NO: 2703513 - RNA, 16 nt, Human
uugaaggaugcugucu

SEQ ID NO: 2703514 - RNA, 14 nt, Human
uugaaggaugcugu

SEQ ID NO: 2703515 - RNA, 21 nt, Human
uugaaggaugcugucuucgua

SEQ ID NO: 2703516 - RNA, 16 nt, Human
auccugcaauuccacu

SEQ ID NO: 2703517 - RNA, 22 nt, Human
auccugaggcuccacuuggucu

SEQ ID NO: 2703518 - RNA, 13 nt, Human
auccugccccuga

SEQ ID NO: 2703519 - RNA, 11 nt, Human
auccugaggcu

SEQ ID NO: 2703520 - RNA, 13 nt, Human
auccugaggcucc

SEQ ID NO: 2703521 - RNA, 16 nt, Human
auccugaggcuccacu

SEQ ID NO: 2703522 - RNA, 18 nt, Human
auccugaggcuccacuug

SEQ ID NO: 2703523 - RNA, 22 nt, Human
uggcacaguuuucugagaaaga

SEQ ID NO: 2703524 - RNA, 20 nt, Human
uggcacaguuuucugagaaa

SEQ ID NO: 2703525 - RNA, 18 nt, Human
uggacgagaaaacaauaa

SEQ ID NO: 2703526 - RNA, 20 nt, Human
ugggaaagggauuuucagcc

SEQ ID NO: 2703527 - RNA, 21 nt, Human
ugggaaagcauuguaaaugug

SEQ ID NO: 2703528 - RNA, 18 nt, Human
aggaagcugugagagcag

SEQ ID NO: 2703529 - RNA, 23 nt, Human
aggaauugacccacaagaaauga

SEQ ID NO: 2703530 - RNA, 11 nt, Human
aggaauuuaaa

SEQ ID NO: 2703531 - RNA, 23 nt, Human
ugcuguauuuuaaaagaaugauu

SEQ ID NO: 2703532 - RNA, 13 nt, Human
ugcuggagcucug

SEQ ID NO: 2703533 - RNA, 14 nt, Human
ugcuggagcucugc

SEQ ID NO: 2703534 - RNA, 23 nt, Human
aggacagcccuucuuuccacaga

SEQ ID NO: 2703535 - RNA, 14 nt, Human
aggacacugauaug

SEQ ID NO: 2703536 - RNA, 11 nt, Human
aggagaaacug

SEQ ID NO: 2703537 - RNA, 15 nt, Human
ugcuugccaucccuc

SEQ ID NO: 2703538 - RNA, 16 nt, Human
ugcuugccaucccucc

SEQ ID NO: 2703539 - RNA, 22 nt, Human
uggaauuucucccagucauuua

SEQ ID NO: 2703540 - RNA, 18 nt, Human
uggaauuggagcucgugg

SEQ ID NO: 2703541 - RNA, 21 nt, Human
agccagcaguucagagcugcc

SEQ ID NO: 2703542 - RNA, 20 nt, Human
agccagcaguucagagcugc

SEQ ID NO: 2703543 - RNA, 22 nt, Human
agccagcaguucagagcugccc

SEQ ID NO: 2703544 - RNA, 19 nt, Human
agccagcaguucagagcug

SEQ ID NO: 2703545 - RNA, 17 nt, Human
agccagcaguucagagc

SEQ ID NO: 2703546 - RNA, 15 nt, Human
agccagcaguucaga

SEQ ID NO: 2703547 - RNA, 18 nt, Human
ugauuaaguaaugauaac

SEQ ID NO: 2703548 - RNA, 23 nt, Human
ugauuaaguaaugauaacuggaa

SEQ ID NO: 2703549 - RNA, 12 nt, Human
ugaugaagaagu

SEQ ID NO: 2703550 - RNA, 11 nt, Human
ugaugaagaag

SEQ ID NO: 2703551 - RNA, 14 nt, Human
ugaugggaaagcau

SEQ ID NO: 2703552 - RNA, 19 nt, Human
ugaugggaaagcauuguaa

SEQ ID NO: 2703553 - RNA, 20 nt, Human
ugauuuagcaggaagcugug

SEQ ID NO: 2703554 - RNA, 17 nt, Human
ugauuuagcaggaagcu

SEQ ID NO: 2703555 - RNA, 15 nt, Human
ugcagaagacaguau

SEQ ID NO: 2703556 - RNA, 14 nt, Human
ugcagaagacagua

SEQ ID NO: 2703557 - RNA, 18 nt, Human
agcccugucuccucucuc

SEQ ID NO: 2703558 - RNA, 11 nt, Human
agcccugucuc

SEQ ID NO: 2703559 - RNA, 20 nt, Human
ugcagcucuccccuucucug

SEQ ID NO: 2703560 - RNA, 22 nt, Human
ugcagcucuccccuucucugua

SEQ ID NO: 2703561 - RNA, 16 nt, Human
ugccccauucaacauc

SEQ ID NO: 2703562 - RNA, 22 nt, Human
ugccauuuaaagcuuauuaaaa

SEQ ID NO: 2703563 - RNA, 12 nt, Human
ugcccucuccug

SEQ ID NO: 2703564 - RNA, 15 nt, Human
ugcccucuccugggc

SEQ ID NO: 2703565 - RNA, 14 nt, Human
ugcccucuccuggg

SEQ ID NO: 2703566 - RNA, 13 nt, Human
ugcccucuccugg

SEQ ID NO: 2703567 - RNA, 20 nt, Human
ugcccucuccugggcagcug

SEQ ID NO: 2703568 - RNA, 18 nt, Human
ugcccucuccugggcagc

SEQ ID NO: 2703569 - RNA, 17 nt, Human
ugcccucuccugggcag

SEQ ID NO: 2703570 - RNA, 16 nt, Human
ugcccucuccugggca

SEQ ID NO: 2703571 - RNA, 23 nt, Human
ugcccucuccugggcagcugccu

SEQ ID NO: 2703572 - RNA, 22 nt, Human
ugcccucuccugggcagcugcc

SEQ ID NO: 2703573 - RNA, 23 nt, Human
agcucugcccauccugccccuga

SEQ ID NO: 2703574 - RNA, 18 nt, Human
agcugcccucuccugggc

SEQ ID NO: 2703575 - RNA, 17 nt, Human
agcugcccucuccuggg

SEQ ID NO: 2703576 - RNA, 20 nt, Human
agcugcccucuccugggcag

SEQ ID NO: 2703577 - RNA, 19 nt, Human
agcugcccucuccugggca

SEQ ID NO: 2703578 - RNA, 21 nt, Human
agcugcccucuccugggcagc

SEQ ID NO: 2703579 - RNA, 19 nt, Human
ugcccuguuaaaagaugaa

SEQ ID NO: 2703580 - RNA, 15 nt, Human
ugccucaccccuugc

SEQ ID NO: 2703581 - RNA, 11 nt, Human
ugccuccccuc

SEQ ID NO: 2703582 - RNA, 15 nt, Human
ugccuccccuccucu

SEQ ID NO: 2703583 - RNA, 14 nt, Human
ugccuccccuccuc

SEQ ID NO: 2703584 - RNA, 13 nt, Human
ugccuccccuccu

SEQ ID NO: 2703585 - RNA, 12 nt, Human
ugccuccccucc

SEQ ID NO: 2703586 - RNA, 16 nt, Human
ugccuccccuccucug

SEQ ID NO: 2703587 - RNA, 18 nt, Human
ugccucagaaaacaagga

SEQ ID NO: 2703588 - RNA, 19 nt, Human
uguuugcuaagcauuccaa

SEQ ID NO: 2703589 - RNA, 15 nt, Human
uguuugcuaagcauu

SEQ ID NO: 2703590 - RNA, 20 nt, Human
uguuuuauaauuuugugaag

SEQ ID NO: 2703591 - RNA, 13 nt, Human
uguuuuauaauuu

SEQ ID NO: 2703592 - RNA, 14 nt, Human
uguuuuaggagcau

SEQ ID NO: 2703593 - RNA, 21 nt, Human
aguugauaugccuuuucccaa

SEQ ID NO: 2703594 - RNA, 14 nt, Human
aguucugaagaaga

SEQ ID NO: 2703595 - RNA, 13 nt, Human
aguucugaagaag

SEQ ID NO: 2703596 - RNA, 15 nt, Human
aguucugaagaagau

SEQ ID NO: 2703597 - RNA, 16 nt, Human
aguuugguuucuagca

SEQ ID NO: 2703598 - RNA, 20 nt, Human
uuaaaaaugguuuaaauggu

SEQ ID NO: 2703599 - RNA, 22 nt, Human
aguugcauagguuuaauaauuu

SEQ ID NO: 2703600 - RNA, 18 nt, Human
uuaaaaaagaaacauuug

SEQ ID NO: 2703601 - RNA, 15 nt, Human
uuaaaaaagaaacau

SEQ ID NO: 2703602 - RNA, 20 nt, Human
aguuauuauauuuacaaaug

SEQ ID NO: 2703603 - RNA, 19 nt, Human
aguuauggcuauaggugcu

SEQ ID NO: 2703604 - RNA, 19 nt, Human
aguucagagcugcccucuc

SEQ ID NO: 2703605 - RNA, 18 nt, Human
aguucagagcugcccucu

SEQ ID NO: 2703606 - RNA, 17 nt, Human
aguucagagcugcccuc

SEQ ID NO: 2703607 - RNA, 16 nt, Human
aguucagagcugcccu

SEQ ID NO: 2703608 - RNA, 15 nt, Human
aguucagagcugccc

SEQ ID NO: 2703609 - RNA, 14 nt, Human
aguucagagcugcc

SEQ ID NO: 2703610 - RNA, 20 nt, Human
aguucggugagcuacaaaug

SEQ ID NO: 2703611 - RNA, 21 nt, Human
auacaguucggugagcuacaa

SEQ ID NO: 2703612 - RNA, 20 nt, Human
auacaucccuuaccugggaa

SEQ ID NO: 2703613 - RNA, 22 nt, Human
auaccacaggaaccacaagacu

SEQ ID NO: 2703614 - RNA, 22 nt, Human
auaauuuuuauauuugaaauau

SEQ ID NO: 2703615 - RNA, 21 nt, Human
auaauuuuuauauuugaaaua

SEQ ID NO: 2703616 - RNA, 22 nt, Human
auacaaaaaaaaaaaaaaauua

SEQ ID NO: 2703617 - RNA, 20 nt, Human
auaauuuugugaagcaaaau

SEQ ID NO: 2703618 - RNA, 15 nt, Human
auaauuuugugaagc

SEQ ID NO: 2703619 - RNA, 14 nt, Human
auaauuuugugaag

SEQ ID NO: 2703620 - RNA, 13 nt, Human
auaauuuugugaa

SEQ ID NO: 2703621 - RNA, 19 nt, Human
auaauuuuuauauuugaaa

SEQ ID NO: 2703622 - RNA, 16 nt, Human
auaauuuuuauauuug

SEQ ID NO: 2703623 - RNA, 14 nt, Human
auaauuuuuauauu

SEQ ID NO: 2703624 - RNA, 18 nt, Human
uuauauaagcuuguauuc

SEQ ID NO: 2703625 - RNA, 21 nt, Human
uuagccguggugauuuagcag

SEQ ID NO: 2703626 - RNA, 15 nt, Human
auaaacucauuucua

SEQ ID NO: 2703627 - RNA, 12 nt, Human
aguuuucugaga

SEQ ID NO: 2703628 - RNA, 13 nt, Human
aguuuucugagaa

SEQ ID NO: 2703629 - RNA, 14 nt, Human
aguuuucugagaaa

SEQ ID NO: 2703630 - RNA, 17 nt, Human
aguuuucugagaaagac

SEQ ID NO: 2703631 - RNA, 19 nt, Human
auaaaugugccuucauuuu

SEQ ID NO: 2703632 - RNA, 12 nt, Human
auaacuggaaac

SEQ ID NO: 2703633 - RNA, 21 nt, Human
auaaucuuucacaggggacag

SEQ ID NO: 2703634 - RNA, 14 nt, Human
auaaugaauacuuu

SEQ ID NO: 2703635 - RNA, 18 nt, Human
uuagcaggaagcugugag

SEQ ID NO: 2703636 - RNA, 22 nt, Human
uuagaugcaguucugaagaaga

SEQ ID NO: 2703637 - RNA, 23 nt, Human
uuagaugcaguucugaagaagau

SEQ ID NO: 2703638 - RNA, 20 nt, Human
ugucagcuccccucggagaa

SEQ ID NO: 2703639 - RNA, 21 nt, Human
ugucagcuccccucggagaag

SEQ ID NO: 2703640 - RNA, 23 nt, Human
ugucagcuccccucggagaagag

SEQ ID NO: 2703641 - RNA, 16 nt, Human
aguauuguccaggucu

SEQ ID NO: 2703642 - RNA, 15 nt, Human
aguauuguccagguc

SEQ ID NO: 2703643 - RNA, 20 nt, Human
agucacauuccaagccucau

SEQ ID NO: 2703644 - RNA, 21 nt, Human
aguauguuagugcaaauuguc

SEQ ID NO: 2703645 - RNA, 18 nt, Human
aguauguuagugcaaauu

SEQ ID NO: 2703646 - RNA, 21 nt, Human
aguauuagaauaccacaggaa

SEQ ID NO: 2703647 - RNA, 14 nt, Human
ugucuuaauuaaaa

SEQ ID NO: 2703648 - RNA, 15 nt, Human
ugucuccucucucug

SEQ ID NO: 2703649 - RNA, 17 nt, Human
ugucucuacuaaaaaua

SEQ ID NO: 2703650 - RNA, 14 nt, Human
ugucuucacaacag

SEQ ID NO: 2703651 - RNA, 16 nt, Human
agugagccgagauugu

SEQ ID NO: 2703652 - RNA, 21 nt, Human
agugagcagucaggaaagaga

SEQ ID NO: 2703653 - RNA, 20 nt, Human
agugaaacucguuaauuugu

SEQ ID NO: 2703654 - RNA, 22 nt, Human
agugaaagaggcagcuugaaac

SEQ ID NO: 2703655 - RNA, 14 nt, Human
agugagacagcucu

SEQ ID NO: 2703656 - RNA, 16 nt, Human
agugaaagaggcagcu

SEQ ID NO: 2703657 - RNA, 17 nt, Human
agugaaagaaaauaaca

SEQ ID NO: 2703658 - RNA, 14 nt, Human
ugugaagcaaaauu

SEQ ID NO: 2703659 - RNA, 22 nt, Human
ugugagaugcuagaacucccuu

SEQ ID NO: 2703660 - RNA, 15 nt, Human
aggucagugcaaaua

SEQ ID NO: 2703661 - RNA, 20 nt, Human
aggguuuauguuuaggaugu

SEQ ID NO: 2703662 - RNA, 22 nt, Human
uggucugugagaugcuagaacu

SEQ ID NO: 2703663 - RNA, 22 nt, Human
ugguccaugggccauaugaaaa

SEQ ID NO: 2703664 - RNA, 16 nt, Human
aggggaauugaggaca

SEQ ID NO: 2703665 - RNA, 21 nt, Human
agggugaugggaaagcauugu

SEQ ID NO: 2703666 - RNA, 22 nt, Human
agggugaugggaaagcauugua

SEQ ID NO: 2703667 - RNA, 23 nt, Human
uggugugaccacugcagaagaca

SEQ ID NO: 2703668 - RNA, 15 nt, Human
ugguuucuagcauga

SEQ ID NO: 2703669 - RNA, 18 nt, Human
uguaagaaaauaucacuu

SEQ ID NO: 2703670 - RNA, 17 nt, Human
uguaagaaaauaucacu

SEQ ID NO: 2703671 - RNA, 14 nt, Human
ugaaauaagccaga

SEQ ID NO: 2703672 - RNA, 20 nt, Human
agagcugcccucuccugggc

SEQ ID NO: 2703673 - RNA, 19 nt, Human
agagcugcccucuccuggg

SEQ ID NO: 2703674 - RNA, 18 nt, Human
agagcugcccucuccugg

SEQ ID NO: 2703675 - RNA, 17 nt, Human
agagcugcccucuccug

SEQ ID NO: 2703676 - RNA, 16 nt, Human
agagcugcccucuccu

SEQ ID NO: 2703677 - RNA, 13 nt, Human
ugaacaaauuuac

SEQ ID NO: 2703678 - RNA, 22 nt, Human
ugaacccauauuuguacaccaa

SEQ ID NO: 2703679 - RNA, 18 nt, Human
ugaacccgggaggcagag

SEQ ID NO: 2703680 - RNA, 22 nt, Human
ugaagaagcaccaaucaugaau

SEQ ID NO: 2703681 - RNA, 17 nt, Human
ugaaguacucauacaug

SEQ ID NO: 2703682 - RNA, 20 nt, Human
ugaagauuuaccacuugugu

SEQ ID NO: 2703683 - RNA, 17 nt, Human
ugaagauuuaccacuug

SEQ ID NO: 2703684 - RNA, 18 nt, Human
agagcuguucacagccag

SEQ ID NO: 2703685 - RNA, 23 nt, Human
agacuggcacaguuuucugagaa

SEQ ID NO: 2703686 - RNA, 20 nt, Human
agacuggcacaguuuucuga

SEQ ID NO: 2703687 - RNA, 21 nt, Human
agacuggcacaguuuucugag

SEQ ID NO: 2703688 - RNA, 22 nt, Human
agacuccaaagaaauguaaggg

SEQ ID NO: 2703689 - RNA, 14 nt, Human
agagacagaaagca

SEQ ID NO: 2703690 - RNA, 16 nt, Human
agagacacacugaaga

SEQ ID NO: 2703691 - RNA, 17 nt, Human
ugaaagaggaaugaagu

SEQ ID NO: 2703692 - RNA, 18 nt, Human
ugaaagaggaaugaagua

SEQ ID NO: 2703693 - RNA, 17 nt, Human
ugaaaauauuuguauca

SEQ ID NO: 2703694 - RNA, 20 nt, Human
ugaaaaucuuauaauuuaaa

SEQ ID NO: 2703695 - RNA, 21 nt, Human
ugaaaauauuuguaucacaaa

SEQ ID NO: 2703696 - RNA, 22 nt, Human
ugaaaauauuuguaucacaaau

SEQ ID NO: 2703697 - RNA, 13 nt, Human
ugaaagaaaauaa

SEQ ID NO: 2703698 - RNA, 24 nt, Human
ugagaugugaacacaucagcuugc

SEQ ID NO: 2703699 - RNA, 18 nt, Human
ugagaugugaacacauca

SEQ ID NO: 2703700 - RNA, 19 nt, Human
ugagaugugaacacaucag

SEQ ID NO: 2703701 - RNA, 13 nt, Human
ugagaugugaaca

SEQ ID NO: 2703702 - RNA, 23 nt, Human
ugagagcaguuugguuucuagca

SEQ ID NO: 2703703 - RNA, 21 nt, Human
ugagagcaguuugguuucuag

SEQ ID NO: 2703704 - RNA, 22 nt, Human
ugagagacacacugaagaagca

SEQ ID NO: 2703705 - RNA, 21 nt, Human
ugagagacacacugaagaagc

SEQ ID NO: 2703706 - RNA, 20 nt, Human
ugagagacacacugaagaag

SEQ ID NO: 2703707 - RNA, 19 nt, Human
ugagagacacacugaagaa

SEQ ID NO: 2703708 - RNA, 17 nt, Human
ugagagacacacugaag

SEQ ID NO: 2703709 - RNA, 16 nt, Human
ugagagacacacugaa

SEQ ID NO: 2703710 - RNA, 12 nt, Human
ugagacagcucu

SEQ ID NO: 2703711 - RNA, 20 nt, Human
ugagacucugucucagucca

SEQ ID NO: 2703712 - RNA, 14 nt, Human
agauuuuccugaaa

SEQ ID NO: 2703713 - RNA, 15 nt, Human
agauuuuccugaaaa

SEQ ID NO: 2703714 - RNA, 16 nt, Human
agauuuuccugaaaac

SEQ ID NO: 2703715 - RNA, 20 nt, Human
agcaagggugaugggaaagc

SEQ ID NO: 2703716 - RNA, 22 nt, Human
agcaagggugaugggaaagcau

SEQ ID NO: 2703717 - RNA, 16 nt, Human
agcaagggugauggga

SEQ ID NO: 2703718 - RNA, 21 nt, Human
agauugugccccugcacucca

SEQ ID NO: 2703719 - RNA, 22 nt, Human
agaugugaacacaucagcuugc

SEQ ID NO: 2703720 - RNA, 17 nt, Human
agaugugaacacaucag

SEQ ID NO: 2703721 - RNA, 22 nt, Human
agauguauguacuucaugcugu

SEQ ID NO: 2703722 - RNA, 15 nt, Human
ugacacuuaaaaaug

SEQ ID NO: 2703723 - RNA, 16 nt, Human
agaugcacaugagcug

SEQ ID NO: 2703724 - RNA, 20 nt, Human
agaugcaguucugaagaaga

SEQ ID NO: 2703725 - RNA, 13 nt, Human
agaugcacaugag

SEQ ID NO: 2703726 - RNA, 19 nt, Human
agaugcuagaacucccuuu

SEQ ID NO: 2703727 - RNA, 21 nt, Human
agaugcaguucugaagaagau

SEQ ID NO: 2703728 - RNA, 21 nt, Human
agaugcuagaacucccuuuca

SEQ ID NO: 2703729 - RNA, 14 nt, Human
agauccuggaaauc

SEQ ID NO: 2703730 - RNA, 13 nt, Human
agauccuggaaau

SEQ ID NO: 2703731 - RNA, 23 nt, Human
ucugcuugccaucccucccucca

SEQ ID NO: 2703732 - RNA, 20 nt, Human
ucugcuugccaucccucccu

SEQ ID NO: 2703733 - RNA, 17 nt, Human
ucugcuugccaucccuc

SEQ ID NO: 2703734 - RNA, 16 nt, Human
ucugcuugccaucccu

SEQ ID NO: 2703735 - RNA, 18 nt, Human
agaagaugguaccaccag

SEQ ID NO: 2703736 - RNA, 14 nt, Human
agaagaacugaaau

SEQ ID NO: 2703737 - RNA, 13 nt, Human
agaagaacugaaa

SEQ ID NO: 2703738 - RNA, 18 nt, Human
ucugcagauaaacaguag

SEQ ID NO: 2703739 - RNA, 15 nt, Human
ucugcagauaaacag

SEQ ID NO: 2703740 - RNA, 15 nt, Human
agacacacaugaagu

SEQ ID NO: 2703741 - RNA, 12 nt, Human
agacacacauga

SEQ ID NO: 2703742 - RNA, 22 nt, Human
agacagagccccacccucagau

SEQ ID NO: 2703743 - RNA, 24 nt, Human
agacagagccccacccucagaugc

SEQ ID NO: 2703744 - RNA, 14 nt, Human
ucugugagaugcua

SEQ ID NO: 2703745 - RNA, 23 nt, Human
ucugugagaugcuagaacucccu

SEQ ID NO: 2703746 - RNA, 17 nt, Human
ucugugagaugcuagaa

SEQ ID NO: 2703747 - RNA, 22 nt, Human
ucugugagaugcuagaacuccc

SEQ ID NO: 2703748 - RNA, 15 nt, Human
agaauuaacacauga

SEQ ID NO: 2703749 - RNA, 23 nt, Human
agaauuaacacaugauccugcaa

SEQ ID NO: 2703750 - RNA, 14 nt, Human
ucuaaguaaaacca

SEQ ID NO: 2703751 - RNA, 15 nt, Human
ucuaaguaaaaccac

SEQ ID NO: 2703752 - RNA, 19 nt, Human
ucuaaguaaaaccacagca

SEQ ID NO: 2703753 - RNA, 20 nt, Human
ucuaaguaaaaccacagcag

SEQ ID NO: 2703754 - RNA, 13 nt, Human
uccugggcagcug

SEQ ID NO: 2703755 - RNA, 12 nt, Human
uccugggcagcu

SEQ ID NO: 2703756 - RNA, 17 nt, Human
ucuaggaaauauuuauu

SEQ ID NO: 2703757 - RNA, 16 nt, Human
ucuaggaaauauuuau

SEQ ID NO: 2703758 - RNA, 15 nt, Human
acuugucaauaaaau

SEQ ID NO: 2703759 - RNA, 15 nt, Human
ucucauuuccaagca

SEQ ID NO: 2703760 - RNA, 14 nt, Human
ucucaggaaaucaa

SEQ ID NO: 2703761 - RNA, 21 nt, Human
ucucaggaaaucaaauaugca

SEQ ID NO: 2703762 - RNA, 23 nt, Human
ucucaggaaaucaaauaugcaaa

SEQ ID NO: 2703763 - RNA, 17 nt, Human
acuauauuguuugcuaa

SEQ ID NO: 2703764 - RNA, 22 nt, Human
acuauauuguuugcuaagcauu

SEQ ID NO: 2703765 - RNA, 15 nt, Human
acuaucucauuucca

SEQ ID NO: 2703766 - RNA, 17 nt, Human
acuaucucauuuccaag

SEQ ID NO: 2703767 - RNA, 16 nt, Human
acuaucucauuuccaa

SEQ ID NO: 2703768 - RNA, 15 nt, Human
acuaauuuuaaaaug

SEQ ID NO: 2703769 - RNA, 11 nt, Human
uccauccugag

SEQ ID NO: 2703770 - RNA, 12 nt, Human
uccauccugagg

SEQ ID NO: 2703771 - RNA, 15 nt, Human
uccauccugaggcuc

SEQ ID NO: 2703772 - RNA, 18 nt, Human
uccagugagacagcucug

SEQ ID NO: 2703773 - RNA, 11 nt, Human
acgcucucugg

SEQ ID NO: 2703774 - RNA, 14 nt, Human
acgcucucuggccu

SEQ ID NO: 2703775 - RNA, 20 nt, Human
accuuuuggucuggagggaa

SEQ ID NO: 2703776 - RNA, 22 nt, Human
uccacugguucuucuuggucuc

SEQ ID NO: 2703777 - RNA, 19 nt, Human
accuugaaaacuuuaugcu

SEQ ID NO: 2703778 - RNA, 12 nt, Human
acugaagaagca

SEQ ID NO: 2703779 - RNA, 16 nt, Human
acugacucuuaagaag

SEQ ID NO: 2703780 - RNA, 15 nt, Human
acugacucuuaagaa

SEQ ID NO: 2703781 - RNA, 14 nt, Human
acugacucuuaaga

SEQ ID NO: 2703782 - RNA, 13 nt, Human
acugacucuuaag

SEQ ID NO: 2703783 - RNA, 20 nt, Human
acugacucuuaagaagacug

SEQ ID NO: 2703784 - RNA, 18 nt, Human
acugacucuuaagaagac

SEQ ID NO: 2703785 - RNA, 17 nt, Human
acugacucuuaagaaga

SEQ ID NO: 2703786 - RNA, 13 nt, Human
acugacuucuaag

SEQ ID NO: 2703787 - RNA, 15 nt, Human
acugacuucuaagua

SEQ ID NO: 2703788 - RNA, 16 nt, Human
acugacuucuaaguaa

SEQ ID NO: 2703789 - RNA, 22 nt, Human
acugacuucuaaguaaaaccac

SEQ ID NO: 2703790 - RNA, 18 nt, Human
acugagagugaacaaauu

SEQ ID NO: 2703791 - RNA, 22 nt, Human
acugagaugugaacacaucagc

SEQ ID NO: 2703792 - RNA, 17 nt, Human
acugagaugugaacaca

SEQ ID NO: 2703793 - RNA, 16 nt, Human
uccuggaaaucagggu

SEQ ID NO: 2703794 - RNA, 21 nt, Human
acucuuaagaagacugcauua

SEQ ID NO: 2703795 - RNA, 19 nt, Human
acuccagugagacagcucu

SEQ ID NO: 2703796 - RNA, 14 nt, Human
ucagcccucagaau

SEQ ID NO: 2703797 - RNA, 15 nt, Human
acccgggaggcagag

SEQ ID NO: 2703798 - RNA, 17 nt, Human
acccgggaggcagaggu

SEQ ID NO: 2703799 - RNA, 16 nt, Human
accuagggugauauua

SEQ ID NO: 2703800 - RNA, 15 nt, Human
ucaguuuuugugaaa

SEQ ID NO: 2703801 - RNA, 17 nt, Human
ucaguuuuugugaaaag

SEQ ID NO: 2703802 - RNA, 14 nt, Human
acaugggacauuug

SEQ ID NO: 2703803 - RNA, 11 nt, Human
acaugggacau

SEQ ID NO: 2703804 - RNA, 20 nt, Human
acaugggacauuugcucaug

SEQ ID NO: 2703805 - RNA, 15 nt, Human
acaugggacauuugc

SEQ ID NO: 2703806 - RNA, 21 nt, Human
acaugggacauuugcucaugg

SEQ ID NO: 2703807 - RNA, 16 nt, Human
acaugagguacugaga

SEQ ID NO: 2703808 - RNA, 20 nt, Human
acaugagguacugagaguga

SEQ ID NO: 2703809 - RNA, 16 nt, Human
acaugaaguccaagca

SEQ ID NO: 2703810 - RNA, 23 nt, Human
acaugagguacugagagugaaca

SEQ ID NO: 2703811 - RNA, 15 nt, Human
ucaaauugugugaaa

SEQ ID NO: 2703812 - RNA, 18 nt, Human
ucaaauugugugaaaggu

SEQ ID NO: 2703813 - RNA, 23 nt, Human
accaaaaaucucaauauuucaga

SEQ ID NO: 2703814 - RNA, 19 nt, Human
ucaauauuucagauaauca

SEQ ID NO: 2703815 - RNA, 15 nt, Human
ucaauauuucagaua

SEQ ID NO: 2703816 - RNA, 23 nt, Human
ucaaugaaugaaugaauggcuaa

SEQ ID NO: 2703817 - RNA, 22 nt, Human
ucaauaucuuuuuuuuaauaaa

SEQ ID NO: 2703818 - RNA, 16 nt, Human
ucaauucuugccaaau

SEQ ID NO: 2703819 - RNA, 21 nt, Human
ucacaacagauuauuaccuua

SEQ ID NO: 2703820 - RNA, 14 nt, Human
ucaccucauggaau

SEQ ID NO: 2703821 - RNA, 13 nt, Human
ucaccucauggaa

SEQ ID NO: 2703822 - RNA, 12 nt, Human
ucaccucaugga

SEQ ID NO: 2703823 - RNA, 23 nt, Human
ucacuugaacccgggaggcagag

SEQ ID NO: 2703824 - RNA, 14 nt, Human
accagucugacugu

SEQ ID NO: 2703825 - RNA, 20 nt, Human
uaacgauaaaagacagugaa

SEQ ID NO: 2703826 - RNA, 18 nt, Human
uaagaagugaaaaucuac

SEQ ID NO: 2703827 - RNA, 16 nt, Human
aauagucaaauugugu

SEQ ID NO: 2703828 - RNA, 22 nt, Human
aauaucacuugucaauaaaauc

SEQ ID NO: 2703829 - RNA, 20 nt, Human
aauaucacuugucaauaaaa

SEQ ID NO: 2703830 - RNA, 21 nt, Human
aaucaggguuaguauugucca

SEQ ID NO: 2703831 - RNA, 16 nt, Human
aaucaggguuaguauu

SEQ ID NO: 2703832 - RNA, 22 nt, Human
aaucaggguuaguauuguccag

SEQ ID NO: 2703833 - RNA, 24 nt, Human
aauaugccccauucaacaucuagu

SEQ ID NO: 2703834 - RNA, 21 nt, Human
aauaugccccauucaacaucu

SEQ ID NO: 2703835 - RNA, 19 nt, Human
aauauuuauuuuaauaaug

SEQ ID NO: 2703836 - RNA, 18 nt, Human
aauauuuauuuuaauaau

SEQ ID NO: 2703837 - RNA, 22 nt, Human
aaugaauggcuaagcaaaaugu

SEQ ID NO: 2703838 - RNA, 13 nt, Human
uaaucuuucacag

SEQ ID NO: 2703839 - RNA, 15 nt, Human
aaucaugaauuaguu

SEQ ID NO: 2703840 - RNA, 12 nt, Human
aaucaugaauua

SEQ ID NO: 2703841 - RNA, 12 nt, Human
uaauaaacucau

SEQ ID NO: 2703842 - RNA, 16 nt, Human
uaagcuuguauuccuu

SEQ ID NO: 2703843 - RNA, 19 nt, Human
uaaguaaugauaacuggaa

SEQ ID NO: 2703844 - RNA, 19 nt, Human
aaucuacacuccagugaga

SEQ ID NO: 2703845 - RNA, 19 nt, Human
aaucuuauaauuuaaaaua

SEQ ID NO: 2703846 - RNA, 23 nt, Human
aaucgcuccaccuugcagcucuc

SEQ ID NO: 2703847 - RNA, 18 nt, Human
uaccaccagucugacugu

SEQ ID NO: 2703848 - RNA, 20 nt, Human
uacaucccuuaccugggaaa

SEQ ID NO: 2703849 - RNA, 18 nt, Human
uacacuaagagagaauga

SEQ ID NO: 2703850 - RNA, 14 nt, Human
uacacuaagagaga

SEQ ID NO: 2703851 - RNA, 16 nt, Human
aaugcuguauuuuaaa

SEQ ID NO: 2703852 - RNA, 18 nt, Human
aauuccaagugauugaaa

SEQ ID NO: 2703853 - RNA, 22 nt, Human
aauuccacuuauaggaauugac

SEQ ID NO: 2703854 - RNA, 14 nt, Human
uacuguaagaaaau

SEQ ID NO: 2703855 - RNA, 21 nt, Human
aauugacccacaagaaaugaa

SEQ ID NO: 2703856 - RNA, 22 nt, Human
aauugacccacaagaaaugaaa

SEQ ID NO: 2703857 - RNA, 16 nt, Human
uauuaaaacucauuuu

SEQ ID NO: 2703858 - RNA, 21 nt, Human
uauguuuucaggcuagaugua

SEQ ID NO: 2703859 - RNA, 22 nt, Human
acaggaaccacaagacugcaca

SEQ ID NO: 2703860 - RNA, 17 nt, Human
acaggaaguagaggagg

SEQ ID NO: 2703861 - RNA, 23 nt, Human
uauucaaacagucucaggaaauc

SEQ ID NO: 2703862 - RNA, 15 nt, Human
uauucaaacagucuc

SEQ ID NO: 2703863 - RNA, 14 nt, Human
uauuacuguaagaa

SEQ ID NO: 2703864 - RNA, 16 nt, Human
acagucaccucaugga

SEQ ID NO: 2703865 - RNA, 18 nt, Human
acagucaccucauggaau

SEQ ID NO: 2703866 - RNA, 17 nt, Human
acagucaccucauggaa

SEQ ID NO: 2703867 - RNA, 20 nt, Human
acagggaggacgcucucugg

SEQ ID NO: 2703868 - RNA, 21 nt, Human
acagggaggacgcucucuggc

SEQ ID NO: 2703869 - RNA, 20 nt, Human
uaugauuaaguaaugauaac

SEQ ID NO: 2703870 - RNA, 16 nt, Human
uaugauuaaguaauga

SEQ ID NO: 2703871 - RNA, 21 nt, Human
uaugauuaaguaaugauaacu

SEQ ID NO: 2703872 - RNA, 15 nt, Human
uaugccccauucaac

SEQ ID NO: 2703873 - RNA, 19 nt, Human
uaugccccauucaacaucu

SEQ ID NO: 2703874 - RNA, 16 nt, Human
acagccucuuagaugc

SEQ ID NO: 2703875 - RNA, 19 nt, Human
uauaauuuugugaagcaaa

SEQ ID NO: 2703876 - RNA, 15 nt, Human
uauauuguuugcuaa

SEQ ID NO: 2703877 - RNA, 17 nt, Human
uaucucaaaacugcacu

SEQ ID NO: 2703878 - RNA, 15 nt, Human
acacaucagcuugcc

SEQ ID NO: 2703879 - RNA, 15 nt, Human
acacaugaaguccaa

SEQ ID NO: 2703880 - RNA, 18 nt, Human
acacaugauccugcaauu

SEQ ID NO: 2703881 - RNA, 13 nt, Human
acacuaagagaga

SEQ ID NO: 2703882 - RNA, 14 nt, Human
acacuaagagagaa

SEQ ID NO: 2703883 - RNA, 19 nt, Human
acacucaaaucaagaaacu

SEQ ID NO: 2703884 - RNA, 22 nt, Human
acaaugcuguauuuuaaaagaa

SEQ ID NO: 2703885 - RNA, 18 nt, Human
acaaugcuguauuuuaaa

SEQ ID NO: 2703886 - RNA, 15 nt, Human
acacacucaaaucaa

SEQ ID NO: 2703887 - RNA, 23 nt, Human
uaguguuggagaagaacugaaau

SEQ ID NO: 2703888 - RNA, 22 nt, Human
uagugaaacucguuaauuugua

SEQ ID NO: 2703889 - RNA, 18 nt, Human
acaaauuuacagagacag

SEQ ID NO: 2703890 - RNA, 19 nt, Human
acaaauuuacagagacaga

SEQ ID NO: 2703891 - RNA, 20 nt, Human
acaagacccaaaaggcagaa

SEQ ID NO: 2703892 - RNA, 15 nt, Human
uagaugcaguucuga

SEQ ID NO: 2703893 - RNA, 22 nt, Human
uagaggagaaacuggaacucuc

SEQ ID NO: 2703894 - RNA, 19 nt, Human
uagaggagaaacuggaacu

SEQ ID NO: 2703895 - RNA, 18 nt, Human
acaaaaggauaaugaaua

SEQ ID NO: 2703896 - RNA, 14 nt, Human
acaagacugcacau

SEQ ID NO: 2703897 - RNA, 13 nt, Human
acaagacugcaca

SEQ ID NO: 2703898 - RNA, 23 nt, Human
acaauacaucccuuaccugggaa

SEQ ID NO: 2703899 - RNA, 12 nt, Human
uaggagcaugag

SEQ ID NO: 2703900 - RNA, 19 nt, Human
uaggaaauauuuauuuuaa

SEQ ID NO: 2703901 - RNA, 18 nt, Human
uaggaaauauuuauuuua

SEQ ID NO: 2703902 - RNA, 14 nt, Human
uagggagagaagau

SEQ ID NO: 2703903 - RNA, 15 nt, Human
uagggagagaagaua

SEQ ID NO: 2703904 - RNA, 24 nt, Human
aacucauuuuuguuuucauuaucu

SEQ ID NO: 2703905 - RNA, 21 nt, Human
aacucauuuuuguuuucauua

SEQ ID NO: 2703906 - RNA, 14 nt, Human
gucuuaauuaaaag

SEQ ID NO: 2703907 - RNA, 19 nt, Human
gucuuauauauuguagaua

SEQ ID NO: 2703908 - RNA, 11 nt, Human
aagaaacauuu

SEQ ID NO: 2703909 - RNA, 14 nt, Human
aagaaagaaaauca

SEQ ID NO: 2703910 - RNA, 13 nt, Human
aagaaagaaaauc

SEQ ID NO: 2703911 - RNA, 16 nt, Human
aagaaagaaaaucagg

SEQ ID NO: 2703912 - RNA, 21 nt, Human
gugcuacaaaaacacagcaag

SEQ ID NO: 2703913 - RNA, 22 nt, Human
gugcuacaaaaacacagcaagg

SEQ ID NO: 2703914 - RNA, 18 nt, Human
gugcacgcacacugucug

SEQ ID NO: 2703915 - RNA, 17 nt, Human
gugauuaccagggacug

SEQ ID NO: 2703916 - RNA, 11 nt, Human
gugauuaccag

SEQ ID NO: 2703917 - RNA, 16 nt, Human
gugauuaccagggacu

SEQ ID NO: 2703918 - RNA, 23 nt, Human
aacuuccuuggacucauuuuaaa

SEQ ID NO: 2703919 - RNA, 22 nt, Human
aacuuccuuggacucauuuuaa

SEQ ID NO: 2703920 - RNA, 18 nt, Human
aacuucagcgguuuauau

SEQ ID NO: 2703921 - RNA, 13 nt, Human
aacuucagacaua

SEQ ID NO: 2703922 - RNA, 22 nt, Human
guccaugaagauguagaggaga

SEQ ID NO: 2703923 - RNA, 23 nt, Human
guccaugaagauguagaggagaa

SEQ ID NO: 2703924 - RNA, 17 nt, Human
aacacaacuauauuguu

SEQ ID NO: 2703925 - RNA, 20 nt, Human
aacacagcaagggugauggg

SEQ ID NO: 2703926 - RNA, 18 nt, Human
aacacagcaagggugaug

SEQ ID NO: 2703927 - RNA, 12 nt, Human
aacauauauaac

SEQ ID NO: 2703928 - RNA, 14 nt, Human
aacagucucaggaa

SEQ ID NO: 2703929 - RNA, 14 nt, Human
aacauaaaauacaa

SEQ ID NO: 2703930 - RNA, 13 nt, Human
aacagucucagga

SEQ ID NO: 2703931 - RNA, 21 nt, Human
gucaauuuuguuauguauauu

SEQ ID NO: 2703932 - RNA, 13 nt, Human
gucacaggaagua

SEQ ID NO: 2703933 - RNA, 15 nt, Human
gucacaggaaguaga

SEQ ID NO: 2703934 - RNA, 20 nt, Human
gucacaggaaguagaggagg

SEQ ID NO: 2703935 - RNA, 13 nt, Human
gucaggaaagaga

SEQ ID NO: 2703936 - RNA, 14 nt, Human
gucaggaaagagaa

SEQ ID NO: 2703937 - RNA, 17 nt, Human
aaauuccaagugauuga

SEQ ID NO: 2703938 - RNA, 17 nt, Human
aaauuguauuacaaauc

SEQ ID NO: 2703939 - RNA, 18 nt, Human
aaaugugccuucauuuuu

SEQ ID NO: 2703940 - RNA, 15 nt, Human
aaaugugcuuuuaaa

SEQ ID NO: 2703941 - RNA, 18 nt, Human
aagcuuauuaaaacucau

SEQ ID NO: 2703942 - RNA, 18 nt, Human
guucccuugaugaagaag

SEQ ID NO: 2703943 - RNA, 21 nt, Human
aagccuuggggcugaugcagu

SEQ ID NO: 2703944 - RNA, 17 nt, Human
guuauuauauuuacaaa

SEQ ID NO: 2703945 - RNA, 19 nt, Human
guuauuauauuuacaaaug

SEQ ID NO: 2703946 - RNA, 15 nt, Human
aagauagcagggcau

SEQ ID NO: 2703947 - RNA, 14 nt, Human
aagauagcagggca

SEQ ID NO: 2703948 - RNA, 22 nt, Human
gugucuuaauuaaaagaauauu

SEQ ID NO: 2703949 - RNA, 17 nt, Human
aagcaacccaaauguuc

SEQ ID NO: 2703950 - RNA, 18 nt, Human
aagcauuguaaaugugcu

SEQ ID NO: 2703951 - RNA, 19 nt, Human
aagcacugacuucuaagua

SEQ ID NO: 2703952 - RNA, 20 nt, Human
aagcacugacuucuaaguaa

SEQ ID NO: 2703953 - RNA, 19 nt, Human
aagcauuguaaaugugcuu

SEQ ID NO: 2703954 - RNA, 16 nt, Human
aagcacugacuucuaa

SEQ ID NO: 2703955 - RNA, 17 nt, Human
aagcacugacuucuaag

SEQ ID NO: 2703956 - RNA, 16 nt, Human
aagcacuaaacaaaga

SEQ ID NO: 2703957 - RNA, 14 nt, Human
uaaaaccacagcag

SEQ ID NO: 2703958 - RNA, 15 nt, Human
uaaaaccacagcagu

SEQ ID NO: 2703959 - RNA, 21 nt, Human
uaaaaaaaaaccugagcccca

SEQ ID NO: 2703960 - RNA, 13 nt, Human
uaaaagaauauuu

SEQ ID NO: 2703961 - RNA, 21 nt, Human
uaaaauacacacucaaaucaa

SEQ ID NO: 2703962 - RNA, 22 nt, Human
uaaaauaauuuuuauauuugaa

SEQ ID NO: 2703963 - RNA, 9 nt, Human
uaaaauggu

SEQ ID NO: 2703964 - RNA, 19 nt, Human
aaguauguuagugcaaauu

SEQ ID NO: 2703965 - RNA, 18 nt, Human
aaguauguuagugcaaau

SEQ ID NO: 2703966 - RNA, 14 nt, Human
guuuaugauuccac

SEQ ID NO: 2703967 - RNA, 15 nt, Human
aagggcuguuauaau

SEQ ID NO: 2703968 - RNA, 17 nt, Human
aaggggaauugaggaca

SEQ ID NO: 2703969 - RNA, 17 nt, Human
aagggcuguuauaaucu

SEQ ID NO: 2703970 - RNA, 17 nt, Human
aaaacaaggaugaauua

SEQ ID NO: 2703971 - RNA, 12 nt, Human
aaaacacagcaa

SEQ ID NO: 2703972 - RNA, 13 nt, Human
aaaacacagcaag

SEQ ID NO: 2703973 - RNA, 18 nt, Human
aaaacacagcaaggguga

SEQ ID NO: 2703974 - RNA, 14 nt, Human
aaaacaaggaugaa

SEQ ID NO: 2703975 - RNA, 12 nt, Human
agcaugaagaca

SEQ ID NO: 2703976 - RNA, 19 nt, Human
agccagauuuuccugaaaa

SEQ ID NO: 2703977 - RNA, 15 nt, Human
agccagauuuuccug

SEQ ID NO: 2703978 - RNA, 19 nt, Human
agcaguucagagcugcccu

SEQ ID NO: 2703979 - RNA, 18 nt, Human
agcaguucagagcugccc

SEQ ID NO: 2703980 - RNA, 17 nt, Human
agcaguucagagcugcc

SEQ ID NO: 2703981 - RNA, 15 nt, Human
agcaguucagagcug

SEQ ID NO: 2703982 - RNA, 16 nt, Human
agcaguucagagcugc

SEQ ID NO: 2703983 - RNA, 23 nt, Human
agcaguugaaaagacuccaaaga

SEQ ID NO: 2703984 - RNA, 21 nt, Human
agcaguugaaaagacuccaaa

SEQ ID NO: 2703985 - RNA, 14 nt, Human
agauguagaggaga

SEQ ID NO: 2703986 - RNA, 21 nt, Human
agaugggagaaucacuugaac

SEQ ID NO: 2703987 - RNA, 19 nt, Human
agccccacccucagaugca

SEQ ID NO: 2703988 - RNA, 21 nt, Human
agccgggcgugguggugagug

SEQ ID NO: 2703989 - RNA, 21 nt, Human
agauaggucagugcaaauacu

SEQ ID NO: 2703990 - RNA, 17 nt, Human
agacugcauuauauuua

SEQ ID NO: 2703991 - RNA, 14 nt, Human
aggauguugaaaaa

SEQ ID NO: 2703992 - RNA, 17 nt, Human
aggauguugaaaaaguu

SEQ ID NO: 2703993 - RNA, 18 nt, Human
agcuucacuguaaaauaa

SEQ ID NO: 2703994 - RNA, 14 nt, Human
agcuguaugauucc

SEQ ID NO: 2703995 - RNA, 21 nt, Human
auguaagggaaacugccagca

SEQ ID NO: 2703996 - RNA, 22 nt, Human
auguaagggaaacugccagcaa

SEQ ID NO: 2703997 - RNA, 20 nt, Human
auguaagggaaacugccagc

SEQ ID NO: 2703998 - RNA, 22 nt, Human
aucuuauaauuuaaaauaugcu

SEQ ID NO: 2703999 - RNA, 17 nt, Human
aucagcugcugaaacaa

SEQ ID NO: 2704000 - RNA, 21 nt, Human
aguccaagcauuuagauguau

SEQ ID NO: 2704001 - RNA, 16 nt, Human
aguccaagcauuuaga

SEQ ID NO: 2704002 - RNA, 17 nt, Human
agucaaauugugugaaa

SEQ ID NO: 2704003 - RNA, 15 nt, Human
agucaaauuguguga

SEQ ID NO: 2704004 - RNA, 13 nt, Human
agucaaauugugu

SEQ ID NO: 2704005 - RNA, 18 nt, Human
agugauuaccagggacug

SEQ ID NO: 2704006 - RNA, 15 nt, Human
agugauuaccaggga

SEQ ID NO: 2704007 - RNA, 18 nt, Human
aguuguaccgcaauguga

SEQ ID NO: 2704008 - RNA, 19 nt, Human
aguuguaccgcaaugugac

SEQ ID NO: 2704009 - RNA, 19 nt, Human
auauuuauuacuguaagaa

SEQ ID NO: 2704010 - RNA, 14 nt, Human
auauuuauuacugu

SEQ ID NO: 2704011 - RNA, 18 nt, Human
auauuuauuuuaauaaug

SEQ ID NO: 2704012 - RNA, 23 nt, Human
auauuucagauaaucacaauaca

SEQ ID NO: 2704013 - RNA, 23 nt, Human
auaugcuucuguuuuauaauuuu

SEQ ID NO: 2704014 - RNA, 15 nt, Human
auaucaauuuaaaaa

SEQ ID NO: 2704015 - RNA, 18 nt, Human
auaucacuugucaauaaa

SEQ ID NO: 2704016 - RNA, 14 nt, Human
auaauuacuauguc

SEQ ID NO: 2704017 - RNA, 16 nt, Human
acuaagagagaaugag

SEQ ID NO: 2704018 - RNA, 15 nt, Human
acuaagagagaauga

SEQ ID NO: 2704019 - RNA, 16 nt, Human
acgugcacgcacacug

SEQ ID NO: 2704020 - RNA, 12 nt, Human
acucccuuucaa

SEQ ID NO: 2704021 - RNA, 13 nt, Human
acucccuuucaac

SEQ ID NO: 2704022 - RNA, 14 nt, Human
acuagcuauggugu

SEQ ID NO: 2704023 - RNA, 14 nt, Human
acucaaaucaagaa

SEQ ID NO: 2704024 - RNA, 12 nt, Human
acuggaacucuc

SEQ ID NO: 2704025 - RNA, 19 nt, Human
acuuguaaaggaauuuaaa

SEQ ID NO: 2704026 - RNA, 20 nt, Human
acuuguaaaggaauuuaaaa

SEQ ID NO: 2704027 - RNA, 14 nt, Human
acuuggucugugag

SEQ ID NO: 2704028 - RNA, 13 nt, Human
acuuggucuguga

SEQ ID NO: 2704029 - RNA, 15 nt, Human
acuuggucugugaga

SEQ ID NO: 2704030 - RNA, 18 nt, Human
acuuguaaaggaauuuaa

SEQ ID NO: 2704031 - RNA, 16 nt, Human
acccaaguccaagcau

SEQ ID NO: 2704032 - RNA, 15 nt, Human
acccacaagaaauga

SEQ ID NO: 2704033 - RNA, 14 nt, Human
acauuuguauaaaa

SEQ ID NO: 2704034 - RNA, 16 nt, Human
acauuugcucauggaa

SEQ ID NO: 2704035 - RNA, 18 nt, Human
acauuugcucauggaauu

SEQ ID NO: 2704036 - RNA, 13 nt, Human
acauguuacaaca

SEQ ID NO: 2704037 - RNA, 15 nt, Human
acagcaguugaaaag

SEQ ID NO: 2704038 - RNA, 18 nt, Human
acagcaguugaaaagacu

SEQ ID NO: 2704039 - RNA, 16 nt, Human
acagccagacuggcac

SEQ ID NO: 2704040 - RNA, 13 nt, Human
acagccagacugg

SEQ ID NO: 2704041 - RNA, 15 nt, Human
acagccagacuggca

SEQ ID NO: 2704042 - RNA, 20 nt, Human
acagcucugcauacucauua

SEQ ID NO: 2704043 - RNA, 13 nt, Human
acaacuauauugu

SEQ ID NO: 2704044 - RNA, 15 nt, Human
aacacgagcaggcua

SEQ ID NO: 2704045 - RNA, 23 nt, Human
aacugacacaugcugaacaucac

SEQ ID NO: 2704046 - RNA, 13 nt, Human
aagaaauguaagg

SEQ ID NO: 2704047 - RNA, 14 nt, Human
aagaaauguaaggg

SEQ ID NO: 2704048 - RNA, 16 nt, Human
aaacugacucuuaaga

SEQ ID NO: 2704049 - RNA, 14 nt, Human
aaacugccagcaac

SEQ ID NO: 2704050 - RNA, 15 nt, Human
aaacugccagcaacg

SEQ ID NO: 2704051 - RNA, 17 nt, Human
aaacugacucuuaagaa

SEQ ID NO: 2704052 - RNA, 19 nt, Human
aaacugccagcaacgcagg

SEQ ID NO: 2704053 - RNA, 17 nt, Human
aaagaugaaaauauuug

SEQ ID NO: 2704054 - RNA, 13 nt, Human
aaagaugaaaaua

SEQ ID NO: 2704055 - RNA, 16 nt, Human
aaagaugaaaauauuu

SEQ ID NO: 2704056 - RNA, 12 nt, Human
aaauaacaauga

SEQ ID NO: 2704057 - RNA, 18 nt, Human
aaauggcuuccuggcaau

SEQ ID NO: 2704058 - RNA, 16 nt, Human
aaaucaaauaugcaaa

SEQ ID NO: 2704059 - RNA, 18 nt, Human
aaaucaaauaugcaaagc

SEQ ID NO: 2704060 - RNA, 19 nt, Human
aaaucaaauaugcaaagca

SEQ ID NO: 2704061 - RNA, 20 nt, Human
aauuaguuuuauaugcuucu

SEQ ID NO: 2704062 - RNA, 17 nt, Human
aauuaguuuuauaugcu

SEQ ID NO: 2704063 - RNA, 14 nt, Human
aauuaguuuuauau

SEQ ID NO: 2704064 - RNA, 16 nt, Human
aauauuauguuaaaac

SEQ ID NO: 2704065 - RNA, 13 nt, Human
aaucacaauacau

SEQ ID NO: 2704066 - RNA, 15 nt, Human
aaucaagaaacuuaa

SEQ ID NO: 2704067 - RNA, 14 nt, Human
aauccauacauuug

SEQ ID NO: 2704068 - RNA, 13 nt, Human
aauccauacauuu

SEQ ID NO: 2704069 - RNA, 17 nt, Human
aaugauaacuggaaacu

SEQ ID NO: 2704070 - RNA, 20 nt, Human
aaugauaacuggaaacuuca

SEQ ID NO: 2704071 - RNA, 19 nt, Human
aauaaaauggguuuuacug

SEQ ID NO: 2704072 - RNA, 14 nt, Human
aauaaaauggguuu

SEQ ID NO: 2704073 - RNA, 21 nt, Human
aauaauccuaaacauaugaau

SEQ ID NO: 2704074 - RNA, 13 nt, Human
aagccagauuuuc

SEQ ID NO: 2704075 - RNA, 16 nt, Human
aagauuuaccacuugu

SEQ ID NO: 2704076 - RNA, 16 nt, Human
cacaguuuucugagaa

SEQ ID NO: 2704077 - RNA, 17 nt, Human
cacaguuuucugagaaa

SEQ ID NO: 2704078 - RNA, 19 nt, Human
cacaguuuucugagaaaga

SEQ ID NO: 2704079 - RNA, 22 nt, Human
caaaauuuuuucucuaggaaau

SEQ ID NO: 2704080 - RNA, 21 nt, Human
caaaauuuuuucucuaggaaa

SEQ ID NO: 2704081 - RNA, 16 nt, Human
caaaauuuuuucucua

SEQ ID NO: 2704082 - RNA, 15 nt, Human
caaauugugugaaag

SEQ ID NO: 2704083 - RNA, 19 nt, Human
caaauaugcaaagcacuga

SEQ ID NO: 2704084 - RNA, 21 nt, Human
caaauaugcaaagcacugacu

SEQ ID NO: 2704085 - RNA, 13 nt, Human
caaaaacacagca

SEQ ID NO: 2704086 - RNA, 14 nt, Human
caaaaacacagcaa

SEQ ID NO: 2704087 - RNA, 15 nt, Human
caaaaacacagcaag

SEQ ID NO: 2704088 - RNA, 17 nt, Human
caaaaacacagcaaggg

SEQ ID NO: 2704089 - RNA, 13 nt, Human
auuuuccugaaaa

SEQ ID NO: 2704090 - RNA, 19 nt, Human
caaaaaucucaauauuuca

SEQ ID NO: 2704091 - RNA, 23 nt, Human
caaaacuucagacauagaauuaa

SEQ ID NO: 2704092 - RNA, 23 nt, Human
caauacaucccuuaccugggaaa

SEQ ID NO: 2704093 - RNA, 22 nt, Human
caaugugacuuaaugccacuaa

SEQ ID NO: 2704094 - RNA, 21 nt, Human
caagccagauuuuccugaaaa

SEQ ID NO: 2704095 - RNA, 17 nt, Human
caaggcugauuaaacca

SEQ ID NO: 2704096 - RNA, 17 nt, Human
uucugucuucacaacag

SEQ ID NO: 2704097 - RNA, 14 nt, Human
uugaugaagaaguu

SEQ ID NO: 2704098 - RNA, 13 nt, Human
uugaugaagaagu

SEQ ID NO: 2704099 - RNA, 23 nt, Human
uugaugaagaaguugauaugccu

SEQ ID NO: 2704100 - RNA, 14 nt, Human
uugacccacaagaa

SEQ ID NO: 2704101 - RNA, 17 nt, Human
uugacccacaagaaaug

SEQ ID NO: 2704102 - RNA, 14 nt, Human
uucuaugaaauauu

SEQ ID NO: 2704103 - RNA, 21 nt, Human
uucuaugaaauauuauguuaa

SEQ ID NO: 2704104 - RNA, 16 nt, Human
uucugagaaagacuau

SEQ ID NO: 2704105 - RNA, 21 nt, Human
uucugagaaagacuauucaaa

SEQ ID NO: 2704106 - RNA, 15 nt, Human
uucuacauacuaugg

SEQ ID NO: 2704107 - RNA, 18 nt, Human
uucggugagcuacaaaug

SEQ ID NO: 2704108 - RNA, 23 nt, Human
uucaguuauuauauuuacaaaug

SEQ ID NO: 2704109 - RNA, 18 nt, Human
uuccagauccuggaaauc

SEQ ID NO: 2704110 - RNA, 19 nt, Human
uuauuuuaauaauguuuca

SEQ ID NO: 2704111 - RNA, 17 nt, Human
uuauuuuaauaauguuu

SEQ ID NO: 2704112 - RNA, 20 nt, Human
uuauuuuaauaauguuucaa

SEQ ID NO: 2704113 - RNA, 20 nt, Human
uucagauaaucacaauacau

SEQ ID NO: 2704114 - RNA, 20 nt, Human
uucagagcugcccucuccug

SEQ ID NO: 2704115 - RNA, 19 nt, Human
uucagagcugcccucuccu

SEQ ID NO: 2704116 - RNA, 18 nt, Human
uucagagcugcccucucc

SEQ ID NO: 2704117 - RNA, 17 nt, Human
uucagagcugcccucuc

SEQ ID NO: 2704118 - RNA, 15 nt, Human
uucagagcugcccuc

SEQ ID NO: 2704119 - RNA, 18 nt, Human
uuauaauuuugugaagca

SEQ ID NO: 2704120 - RNA, 17 nt, Human
uuauaauuuugugaagc

SEQ ID NO: 2704121 - RNA, 16 nt, Human
uuauaauuuugugaag

SEQ ID NO: 2704122 - RNA, 12 nt, Human
uuauaauuuaaa

SEQ ID NO: 2704123 - RNA, 15 nt, Human
uuauaauuuugugaa

SEQ ID NO: 2704124 - RNA, 14 nt, Human
uuauaauuuuguga

SEQ ID NO: 2704125 - RNA, 11 nt, Human
uuauaaucuuu

SEQ ID NO: 2704126 - RNA, 13 nt, Human
uuauauuugaaau

SEQ ID NO: 2704127 - RNA, 12 nt, Human
uuauauuugaaa

SEQ ID NO: 2704128 - RNA, 20 nt, Human
uuauauuuauuacuguaaga

SEQ ID NO: 2704129 - RNA, 16 nt, Human
uuauauuuacaaaugg

SEQ ID NO: 2704130 - RNA, 11 nt, Human
uuaucucaaaa

SEQ ID NO: 2704131 - RNA, 22 nt, Human
uuaugauuaaguaaugauaacu

SEQ ID NO: 2704132 - RNA, 18 nt, Human
uuauggcuauaggugcua

SEQ ID NO: 2704133 - RNA, 16 nt, Human
uuggucugugagaugc

SEQ ID NO: 2704134 - RNA, 15 nt, Human
uugucuagugaaacu

SEQ ID NO: 2704135 - RNA, 12 nt, Human
uugugccccugc

SEQ ID NO: 2704136 - RNA, 18 nt, Human
uuguguuuugcaagccag

SEQ ID NO: 2704137 - RNA, 14 nt, Human
uuguuuaaaaucau

SEQ ID NO: 2704138 - RNA, 22 nt, Human
uuuauuguuuaaaaucauuucu

SEQ ID NO: 2704139 - RNA, 22 nt, Human
uuuauaauuuugugaagcaaaa

SEQ ID NO: 2704140 - RNA, 17 nt, Human
uuuauggcacuaguauu

SEQ ID NO: 2704141 - RNA, 13 nt, Human
uuuaccacuugug

SEQ ID NO: 2704142 - RNA, 13 nt, Human
uuuaauaauguuu

SEQ ID NO: 2704143 - RNA, 19 nt, Human
uuuaacucuauaauguguu

SEQ ID NO: 2704144 - RNA, 19 nt, Human
uuuguauaaaauaauuuuu

SEQ ID NO: 2704145 - RNA, 18 nt, Human
uuuguauaaaauaauuuu

SEQ ID NO: 2704146 - RNA, 17 nt, Human
uuuguauaaaauaauuu

SEQ ID NO: 2704147 - RNA, 15 nt, Human
uuuccacagaagcuc

SEQ ID NO: 2704148 - RNA, 23 nt, Human
uuuuauaauuuugugaagcaaaa

SEQ ID NO: 2704149 - RNA, 21 nt, Human
uuuuauaauuuugugaagcaa

SEQ ID NO: 2704150 - RNA, 21 nt, Human
uuuuaaaguaacccuacaaaa

SEQ ID NO: 2704151 - RNA, 18 nt, Human
uuuuauauuugaaauauu

SEQ ID NO: 2704152 - RNA, 13 nt, Human
uuuuauauuugaa

SEQ ID NO: 2704153 - RNA, 13 nt, Human
uuuucuuauuuca

SEQ ID NO: 2704154 - RNA, 16 nt, Human
ugcacugucaagauga

SEQ ID NO: 2704155 - RNA, 17 nt, Human
ugcacgcacacugucug

SEQ ID NO: 2704156 - RNA, 16 nt, Human
ugcacgcacacugucu

SEQ ID NO: 2704157 - RNA, 17 nt, Human
ugcaugguuuagaaagc

SEQ ID NO: 2704158 - RNA, 19 nt, Human
ugcagauaaacaguaguga

SEQ ID NO: 2704159 - RNA, 21 nt, Human
ugcauuauauuuauuacugua

SEQ ID NO: 2704160 - RNA, 24 nt, Human
ugauaguuguaccgcaaugugacu

SEQ ID NO: 2704161 - RNA, 15 nt, Human
ugagcagucaggaaa

SEQ ID NO: 2704162 - RNA, 17 nt, Human
ugagcagucaggaaaga

SEQ ID NO: 2704163 - RNA, 20 nt, Human
ugagcagucaggaaagagaa

SEQ ID NO: 2704164 - RNA, 14 nt, Human
ugagaugcuagaac

SEQ ID NO: 2704165 - RNA, 16 nt, Human
ugagaugcuagaacuc

SEQ ID NO: 2704166 - RNA, 20 nt, Human
ugagaugcuagaacucccuu

SEQ ID NO: 2704167 - RNA, 14 nt, Human
ugagacagcucugc

SEQ ID NO: 2704168 - RNA, 16 nt, Human
ugagacagcucugcau

SEQ ID NO: 2704169 - RNA, 18 nt, Human
ugagaaagacuauucaaa

SEQ ID NO: 2704170 - RNA, 20 nt, Human
ugagaaagacuauucaaaca

SEQ ID NO: 2704171 - RNA, 16 nt, Human
ugagaaagacuauuca

SEQ ID NO: 2704172 - RNA, 17 nt, Human
ugagaaagacuauucaa

SEQ ID NO: 2704173 - RNA, 12 nt, Human
ugacucuuaaga

SEQ ID NO: 2704174 - RNA, 23 nt, Human
ugggcagcugccuccccuccucu

SEQ ID NO: 2704175 - RNA, 22 nt, Human
ugggcagcugccuccccuccuc

SEQ ID NO: 2704176 - RNA, 20 nt, Human
ugggcagcugccuccccucc

SEQ ID NO: 2704177 - RNA, 14 nt, Human
ugggacagggagga

SEQ ID NO: 2704178 - RNA, 22 nt, Human
uggccuucggccuccauccuga

SEQ ID NO: 2704179 - RNA, 20 nt, Human
uggccuucggccuccauccu

SEQ ID NO: 2704180 - RNA, 23 nt, Human
uggccuucggccuccauccugag

SEQ ID NO: 2704181 - RNA, 22 nt, Human
ugcuucuguuuuauaauuuugu

SEQ ID NO: 2704182 - RNA, 22 nt, Human
uggaaaaguauguuagugcaaa

SEQ ID NO: 2704183 - RNA, 17 nt, Human
ugcuucuguuuuauaau

SEQ ID NO: 2704184 - RNA, 19 nt, Human
uguauuuuaaaagaaugau

SEQ ID NO: 2704185 - RNA, 18 nt, Human
uguauuuuaaaagaauga

SEQ ID NO: 2704186 - RNA, 14 nt, Human
uguauaaaauaauu

SEQ ID NO: 2704187 - RNA, 13 nt, Human
uguauaaaauaau

SEQ ID NO: 2704188 - RNA, 21 nt, Human
uguaguguuggagaagaacug

SEQ ID NO: 2704189 - RNA, 20 nt, Human
uguaguguuggagaagaacu

SEQ ID NO: 2704190 - RNA, 19 nt, Human
uguaguguuggagaagaac

SEQ ID NO: 2704191 - RNA, 12 nt, Human
ugucuuaauuaa

SEQ ID NO: 2704192 - RNA, 17 nt, Human
ugucuacacuaagagag

SEQ ID NO: 2704193 - RNA, 22 nt, Human
ugucuacacuaagagagaauga

SEQ ID NO: 2704194 - RNA, 14 nt, Human
uggguagacacaca

SEQ ID NO: 2704195 - RNA, 20 nt, Human
ugguucccuugaugaagaag

SEQ ID NO: 2704196 - RNA, 17 nt, Human
ugguucccuugaugaag

SEQ ID NO: 2704197 - RNA, 16 nt, Human
ugguucccuugaugaa

SEQ ID NO: 2704198 - RNA, 11 nt, Human
uguaaaauggu

SEQ ID NO: 2704199 - RNA, 12 nt, Human
uguaaaauggug

SEQ ID NO: 2704200 - RNA, 17 nt, Human
ucuggccuucggccucc

SEQ ID NO: 2704201 - RNA, 18 nt, Human
ucuggccuucggccucca

SEQ ID NO: 2704202 - RNA, 12 nt, Human
ucuuaagaagac

SEQ ID NO: 2704203 - RNA, 18 nt, Human
ucuuaagaagacugcauu

SEQ ID NO: 2704204 - RNA, 15 nt, Human
ucugucuucacaaca

SEQ ID NO: 2704205 - RNA, 19 nt, Human
ucugcaucagcugcugaaa

SEQ ID NO: 2704206 - RNA, 21 nt, Human
ucugcaucagcugcugaaaca

SEQ ID NO: 2704207 - RNA, 14 nt, Human
ucugcaucagcugc

SEQ ID NO: 2704208 - RNA, 22 nt, Human
ucucuguaauaaacucauuucu

SEQ ID NO: 2704209 - RNA, 18 nt, Human
ucucuguaauaaacucau

SEQ ID NO: 2704210 - RNA, 16 nt, Human
ucccugcaauaaaaug

SEQ ID NO: 2704211 - RNA, 16 nt, Human
ucccuugaugaagaag

SEQ ID NO: 2704212 - RNA, 15 nt, Human
ucccuugaugaagaa

SEQ ID NO: 2704213 - RNA, 22 nt, Human
uccucugcuugccaucccuccc

SEQ ID NO: 2704214 - RNA, 21 nt, Human
uccucugcuugccaucccucc

SEQ ID NO: 2704215 - RNA, 19 nt, Human
uccucugcuugccaucccu

SEQ ID NO: 2704216 - RNA, 20 nt, Human
uccucugcuugccaucccuc

SEQ ID NO: 2704217 - RNA, 22 nt, Human
ucuagugagcagucaggaaaga

SEQ ID NO: 2704218 - RNA, 19 nt, Human
ucuagugagcagucaggaa

SEQ ID NO: 2704219 - RNA, 15 nt, Human
ucucaacuccaaacu

SEQ ID NO: 2704220 - RNA, 17 nt, Human
ucuaugaaauauuaugu

SEQ ID NO: 2704221 - RNA, 14 nt, Human
ucuaugaaauauua

SEQ ID NO: 2704222 - RNA, 13 nt, Human
ucuaugaaauauu

SEQ ID NO: 2704223 - RNA, 22 nt, Human
ucgugggacagucaccucaugg

SEQ ID NO: 2704224 - RNA, 21 nt, Human
ucguggaacaguuaccucugc

SEQ ID NO: 2704225 - RNA, 18 nt, Human
ucggccuccauccugagg

SEQ ID NO: 2704226 - RNA, 17 nt, Human
ucggccuccauccugag

SEQ ID NO: 2704227 - RNA, 13 nt, Human
ucguuaauuugua

SEQ ID NO: 2704228 - RNA, 17 nt, Human
uccuggcaauagucaaa

SEQ ID NO: 2704229 - RNA, 20 nt, Human
uccugccuaagugcagcccc

SEQ ID NO: 2704230 - RNA, 19 nt, Human
uccugucggagcccugucu

SEQ ID NO: 2704231 - RNA, 22 nt, Human
uccugucggagcccugucuccu

SEQ ID NO: 2704232 - RNA, 16 nt, Human
uccuuggacucauuuu

SEQ ID NO: 2704233 - RNA, 14 nt, Human
ucaccaaggcugau

SEQ ID NO: 2704234 - RNA, 16 nt, Human
ucacagucacauucca

SEQ ID NO: 2704235 - RNA, 17 nt, Human
ucacaagacccaaaagg

SEQ ID NO: 2704236 - RNA, 18 nt, Human
ucacaagacccaaaaggc

SEQ ID NO: 2704237 - RNA, 13 nt, Human
ucacaagacccaa

SEQ ID NO: 2704238 - RNA, 13 nt, Human
ucaaugcagcccc

SEQ ID NO: 2704239 - RNA, 21 nt, Human
ucaauaaaauccauacauuug

SEQ ID NO: 2704240 - RNA, 14 nt, Human
ucaaauaugcaaag

SEQ ID NO: 2704241 - RNA, 20 nt, Human
ucaaaucaagaaacuuaagg

SEQ ID NO: 2704242 - RNA, 14 nt, Human
ucaaauugugugaa

SEQ ID NO: 2704243 - RNA, 16 nt, Human
uauuauucccauucua

SEQ ID NO: 2704244 - RNA, 17 nt, Human
uauguacuucaugcugu

SEQ ID NO: 2704245 - RNA, 13 nt, Human
uauguacuucaug

SEQ ID NO: 2704246 - RNA, 16 nt, Human
ucauuuccaagcaagu

SEQ ID NO: 2704247 - RNA, 13 nt, Human
ucauuuccaagca

SEQ ID NO: 2704248 - RNA, 19 nt, Human
ucauuaucucaaaacugca

SEQ ID NO: 2704249 - RNA, 20 nt, Human
ucauuaucucaaaacugcac

SEQ ID NO: 2704250 - RNA, 13 nt, Human
ucauuaucucaaa

SEQ ID NO: 2704251 - RNA, 18 nt, Human
ucauaccuaucaucuuaa

SEQ ID NO: 2704252 - RNA, 15 nt, Human
uccacuuggucugug

SEQ ID NO: 2704253 - RNA, 16 nt, Human
uccacuuggucuguga

SEQ ID NO: 2704254 - RNA, 14 nt, Human
uccacuuggucugu

SEQ ID NO: 2704255 - RNA, 17 nt, Human
uccaccucccugcaaua

SEQ ID NO: 2704256 - RNA, 16 nt, Human
uccaccucccugcaau

SEQ ID NO: 2704257 - RNA, 15 nt, Human
uccaccucccugcaa

SEQ ID NO: 2704258 - RNA, 14 nt, Human
uccaccucccugca

SEQ ID NO: 2704259 - RNA, 13 nt, Human
uccaccucccugc

SEQ ID NO: 2704260 - RNA, 19 nt, Human
uccacagaagcuccaggua

SEQ ID NO: 2704261 - RNA, 17 nt, Human
ucaggcuagauguaugu

SEQ ID NO: 2704262 - RNA, 13 nt, Human
ucaggcuagaugu

SEQ ID NO: 2704263 - RNA, 18 nt, Human
ucagcuccccucggagaa

SEQ ID NO: 2704264 - RNA, 17 nt, Human
ucagcuccccucggaga

SEQ ID NO: 2704265 - RNA, 23 nt, Human
ucagagcugcccucuccugggca

SEQ ID NO: 2704266 - RNA, 22 nt, Human
ucagagcugcccucuccugggc

SEQ ID NO: 2704267 - RNA, 21 nt, Human
ucagagcugcccucuccuggg

SEQ ID NO: 2704268 - RNA, 20 nt, Human
ucagagcugcccucuccugg

SEQ ID NO: 2704269 - RNA, 19 nt, Human
ucagagcugcccucuccug

SEQ ID NO: 2704270 - RNA, 18 nt, Human
ucagagcugcccucuccu

SEQ ID NO: 2704271 - RNA, 23 nt, Human
ggagcccugucuccucucucugu

SEQ ID NO: 2704272 - RNA, 18 nt, Human
ggagcccugucuccucuc

SEQ ID NO: 2704273 - RNA, 16 nt, Human
ggaggacgcucucugg

SEQ ID NO: 2704274 - RNA, 19 nt, Human
ggaggggagcaugggaagu

SEQ ID NO: 2704275 - RNA, 15 nt, Human
ggacgcucucuggcc

SEQ ID NO: 2704276 - RNA, 16 nt, Human
ggacgcucucuggccu

SEQ ID NO: 2704277 - RNA, 19 nt, Human
ggacgcucucuggccuucg

SEQ ID NO: 2704278 - RNA, 23 nt, Human
ggagaagagcuguucacagccag

SEQ ID NO: 2704279 - RNA, 14 nt, Human
ggagaagaacugaa

SEQ ID NO: 2704280 - RNA, 11 nt, Human
ggagaagaacu

SEQ ID NO: 2704281 - RNA, 15 nt, Human
ggagaagagcuguuc

SEQ ID NO: 2704282 - RNA, 20 nt, Human
ggacauuugcucauggaauu

SEQ ID NO: 2704283 - RNA, 17 nt, Human
ggacauuugcucaugga

SEQ ID NO: 2704284 - RNA, 16 nt, Human
ggacauuugcucaugg

SEQ ID NO: 2704285 - RNA, 16 nt, Human
ggcagcugccuccccu

SEQ ID NO: 2704286 - RNA, 13 nt, Human
ggcagcugccucc

SEQ ID NO: 2704287 - RNA, 12 nt, Human
ggcagcugccuc

SEQ ID NO: 2704288 - RNA, 11 nt, Human
ggcagcugccu

SEQ ID NO: 2704289 - RNA, 17 nt, Human
ggauuagggagagaaga

SEQ ID NO: 2704290 - RNA, 21 nt, Human
ggcagagguugcagugagccg

SEQ ID NO: 2704291 - RNA, 19 nt, Human
ggauugaaggaugcugucu

SEQ ID NO: 2704292 - RNA, 17 nt, Human
gggaggacgcucucugg

SEQ ID NO: 2704293 - RNA, 20 nt, Human
gggaggacgcucucuggccu

SEQ ID NO: 2704294 - RNA, 21 nt, Human
gggacugaggggaggggagca

SEQ ID NO: 2704295 - RNA, 14 nt, Human
gggaauugaggaca

SEQ ID NO: 2704296 - RNA, 20 nt, Human
ggcuaguaucaaaagaaaga

SEQ ID NO: 2704297 - RNA, 23 nt, Human
ggcuauaggugcuacaaaaacac

SEQ ID NO: 2704298 - RNA, 16 nt, Human
ggcuccacuuggucug

SEQ ID NO: 2704299 - RNA, 18 nt, Human
gccuuggggcugaugcag

SEQ ID NO: 2704300 - RNA, 17 nt, Human
gccugagcgacagugag

SEQ ID NO: 2704301 - RNA, 20 nt, Human
gccugagcgacagugagacu

SEQ ID NO: 2704302 - RNA, 16 nt, Human
gcuagauguauguacu

SEQ ID NO: 2704303 - RNA, 14 nt, Human
gcuagauguaugua

SEQ ID NO: 2704304 - RNA, 13 nt, Human
gcuagauguaugu

SEQ ID NO: 2704305 - RNA, 21 nt, Human
gcuauaggugcuacaaaaaca

SEQ ID NO: 2704306 - RNA, 19 nt, Human
gcuauaggugcuacaaaaa

SEQ ID NO: 2704307 - RNA, 20 nt, Human
gcuccauuuuuagugaaaua

SEQ ID NO: 2704308 - RNA, 21 nt, Human
gcuggaaaaguauguuagugc

SEQ ID NO: 2704309 - RNA, 23 nt, Human
gcuggaaaaguauguuagugcaa

SEQ ID NO: 2704310 - RNA, 23 nt, Human
gcugcccucuccugggcagcugc

SEQ ID NO: 2704311 - RNA, 22 nt, Human
gcugcccucuccugggcagcug

SEQ ID NO: 2704312 - RNA, 20 nt, Human
gcugcccucuccugggcagc

SEQ ID NO: 2704313 - RNA, 18 nt, Human
gcugcccucuccugggca

SEQ ID NO: 2704314 - RNA, 17 nt, Human
gcugcccucuccugggc

SEQ ID NO: 2704315 - RNA, 16 nt, Human
gcugcccucuccuggg

SEQ ID NO: 2704316 - RNA, 15 nt, Human
gcugcccucuccugg

SEQ ID NO: 2704317 - RNA, 14 nt, Human
gcugcccucuccug

SEQ ID NO: 2704318 - RNA, 13 nt, Human
gcugcccucuccu

SEQ ID NO: 2704319 - RNA, 21 nt, Human
gcugauuaaaccaaggcuaga

SEQ ID NO: 2704320 - RNA, 12 nt, Human
gcugcccucucc

SEQ ID NO: 2704321 - RNA, 23 nt, Human
gcuggucccagccagcaguucag

SEQ ID NO: 2704322 - RNA, 19 nt, Human
gcuucuguuuuauaauuuu

SEQ ID NO: 2704323 - RNA, 18 nt, Human
gcuugcccuguuaaaaga

SEQ ID NO: 2704324 - RNA, 23 nt, Human
gcaguucagagcugcccucuccu

SEQ ID NO: 2704325 - RNA, 22 nt, Human
gcaguucagagcugcccucucc

SEQ ID NO: 2704326 - RNA, 20 nt, Human
gcaguucagagcugcccucu

SEQ ID NO: 2704327 - RNA, 19 nt, Human
gcaguucagagcugcccuc

SEQ ID NO: 2704328 - RNA, 21 nt, Human
gcaguugaaaagacuccaaag

SEQ ID NO: 2704329 - RNA, 16 nt, Human
gcaguugaaaagacuc

SEQ ID NO: 2704330 - RNA, 19 nt, Human
gcaguugaaaagacuccaa

SEQ ID NO: 2704331 - RNA, 15 nt, Human
gcaguugaaaagacu

SEQ ID NO: 2704332 - RNA, 22 nt, Human
gcaucagcugcugaaacaacaa

SEQ ID NO: 2704333 - RNA, 23 nt, Human
gcaucagcugcugaaacaacaaa

SEQ ID NO: 2704334 - RNA, 16 nt, Human
gcacgcacacugucug

SEQ ID NO: 2704335 - RNA, 15 nt, Human
gcacgcacacugucu

SEQ ID NO: 2704336 - RNA, 19 nt, Human
gcacuguggguagacacac

SEQ ID NO: 2704337 - RNA, 18 nt, Human
gcacagccucuuagaugc

SEQ ID NO: 2704338 - RNA, 15 nt, Human
gcacagccucuuaga

SEQ ID NO: 2704339 - RNA, 18 nt, Human
gcagagguugcagugagc

SEQ ID NO: 2704340 - RNA, 23 nt, Human
gcagagguugcagugagccgaga

SEQ ID NO: 2704341 - RNA, 16 nt, Human
gcaggaagcugugaga

SEQ ID NO: 2704342 - RNA, 19 nt, Human
gccagacuggcacaguuuu

SEQ ID NO: 2704343 - RNA, 15 nt, Human
gccagacuggcacag

SEQ ID NO: 2704344 - RNA, 18 nt, Human
gccagacuggcacaguuu

SEQ ID NO: 2704345 - RNA, 23 nt, Human
gccaugggacagggaggacgcuc

SEQ ID NO: 2704346 - RNA, 22 nt, Human
gccaugggacagggaggacgcu

SEQ ID NO: 2704347 - RNA, 13 nt, Human
gauagcagggcau

SEQ ID NO: 2704348 - RNA, 19 nt, Human
gagugucuuaauuaaaaga

SEQ ID NO: 2704349 - RNA, 19 nt, Human
gagugaacaaauuuacaga

SEQ ID NO: 2704350 - RNA, 22 nt, Human
gagugaacaaauuuacagagac

SEQ ID NO: 2704351 - RNA, 23 nt, Human
gagugaacaaauuuacagagaca

SEQ ID NO: 2704352 - RNA, 21 nt, Human
gaguugaaaaucuuauaauuu

SEQ ID NO: 2704353 - RNA, 13 nt, Human
gauugugccccug

SEQ ID NO: 2704354 - RNA, 19 nt, Human
gauguugaaaaaguucugc

SEQ ID NO: 2704355 - RNA, 18 nt, Human
gaugcaguucugaagaag

SEQ ID NO: 2704356 - RNA, 16 nt, Human
gaugggaaagcauugu

SEQ ID NO: 2704357 - RNA, 14 nt, Human
gaucuuuaaaauac

SEQ ID NO: 2704358 - RNA, 19 nt, Human
gaggcagagguugcaguga

SEQ ID NO: 2704359 - RNA, 21 nt, Human
gagcaggcuacugucagcucc

SEQ ID NO: 2704360 - RNA, 12 nt, Human
gagcuacaaaug

SEQ ID NO: 2704361 - RNA, 13 nt, Human
gagcuacaaaugc

SEQ ID NO: 2704362 - RNA, 14 nt, Human
gagcuacaaaugca

SEQ ID NO: 2704363 - RNA, 16 nt, Human
gagcugcccucuccug

SEQ ID NO: 2704364 - RNA, 15 nt, Human
gagcugcccucuccu

SEQ ID NO: 2704365 - RNA, 17 nt, Human
gagcugcccucuccugg

SEQ ID NO: 2704366 - RNA, 14 nt, Human
gagcugcccucucc

SEQ ID NO: 2704367 - RNA, 19 nt, Human
cucuuaagaagacugcauu

SEQ ID NO: 2704368 - RNA, 22 nt, Human
cucuggccuucggccuccaucc

SEQ ID NO: 2704369 - RNA, 21 nt, Human
cucuggccuucggccuccauc

SEQ ID NO: 2704370 - RNA, 16 nt, Human
cugagcaggauuuuaa

SEQ ID NO: 2704371 - RNA, 16 nt, Human
cugagaugugaacaca

SEQ ID NO: 2704372 - RNA, 20 nt, Human
cugagaugugaacacaucag

SEQ ID NO: 2704373 - RNA, 19 nt, Human
cugagaaagacuauucaaa

SEQ ID NO: 2704374 - RNA, 20 nt, Human
cugagaaagacuauucaaac

SEQ ID NO: 2704375 - RNA, 21 nt, Human
cugagaugugaacacaucagc

SEQ ID NO: 2704376 - RNA, 12 nt, Human
cugagaaagacu

SEQ ID NO: 2704377 - RNA, 13 nt, Human
cugagaaagacua

SEQ ID NO: 2704378 - RNA, 15 nt, Human
cugagaaagacuauu

SEQ ID NO: 2704379 - RNA, 18 nt, Human
cugagaaagacuauucaa

SEQ ID NO: 2704380 - RNA, 23 nt, Human
cugacgacuugagugcucaguag

SEQ ID NO: 2704381 - RNA, 14 nt, Human
cugaagaagauggu

SEQ ID NO: 2704382 - RNA, 20 nt, Human
cugcaucagcugcugaaaca

SEQ ID NO: 2704383 - RNA, 21 nt, Human
cugaggcuccacuuggucugu

SEQ ID NO: 2704384 - RNA, 15 nt, Human
cugaggcuccacuug

SEQ ID NO: 2704385 - RNA, 22 nt, Human
cugcaauaaaauggguuuuacu

SEQ ID NO: 2704386 - RNA, 15 nt, Human
cugcaauaaaauggg

SEQ ID NO: 2704387 - RNA, 16 nt, Human
cuaguaauuggaaagg

SEQ ID NO: 2704388 - RNA, 20 nt, Human
cuagugaaacucguuaauuu

SEQ ID NO: 2704389 - RNA, 18 nt, Human
cuagugaaagaggcagcu

SEQ ID NO: 2704390 - RNA, 19 nt, Human
cuagugaaagaggcagcuu

SEQ ID NO: 2704391 - RNA, 21 nt, Human
cuagugagcagucaggaaaga

SEQ ID NO: 2704392 - RNA, 23 nt, Human
cuauucaaacagucucaggaaau

SEQ ID NO: 2704393 - RNA, 18 nt, Human
cuauucaaacagucucag

SEQ ID NO: 2704394 - RNA, 16 nt, Human
cuauucaaacagucuc

SEQ ID NO: 2704395 - RNA, 21 nt, Human
cuauaggugcuacaaaaacac

SEQ ID NO: 2704396 - RNA, 22 nt, Human
cuauaggugcuacaaaaacaca

SEQ ID NO: 2704397 - RNA, 20 nt, Human
cuauaggugcuacaaaaaca

SEQ ID NO: 2704398 - RNA, 18 nt, Human
cuauauuguuugcuaagc

SEQ ID NO: 2704399 - RNA, 15 nt, Human
cuauaggugcuacaa

SEQ ID NO: 2704400 - RNA, 21 nt, Human
cucauuuccaagcaaguauua

SEQ ID NO: 2704401 - RNA, 14 nt, Human
cucauuucuagcag

SEQ ID NO: 2704402 - RNA, 13 nt, Human
cuccaaagaaaug

SEQ ID NO: 2704403 - RNA, 12 nt, Human
cuccaaagaaau

SEQ ID NO: 2704404 - RNA, 21 nt, Human
cuccaaacugacucuuaagaa

SEQ ID NO: 2704405 - RNA, 23 nt, Human
cuccaccucccugcaauaaaaug

SEQ ID NO: 2704406 - RNA, 17 nt, Human
cuccaccuugcagcucu

SEQ ID NO: 2704407 - RNA, 12 nt, Human
cuccauccugag

SEQ ID NO: 2704408 - RNA, 11 nt, Human
cuccauccuga

SEQ ID NO: 2704409 - RNA, 13 nt, Human
cuccccuccucug

SEQ ID NO: 2704410 - RNA, 11 nt, Human
cuccccuccuc

SEQ ID NO: 2704411 - RNA, 13 nt, Human
cuccauccugagg

SEQ ID NO: 2704412 - RNA, 20 nt, Human
cuccccuccucugcuugcca

SEQ ID NO: 2704413 - RNA, 21 nt, Human
cuugccaucccucccuccacc

SEQ ID NO: 2704414 - RNA, 22 nt, Human
cuugccaucccucccuccaccu

SEQ ID NO: 2704415 - RNA, 19 nt, Human
cuuguaaaggaauuuaaaa

SEQ ID NO: 2704416 - RNA, 13 nt, Human
cuuuccacagaag

SEQ ID NO: 2704417 - RNA, 21 nt, Human
cuuuauuuucuauaauuuaaa

SEQ ID NO: 2704418 - RNA, 18 nt, Human
cuuuaaagggauggcaag

SEQ ID NO: 2704419 - RNA, 22 nt, Human
gaaaacaauaacgauaaaagac

SEQ ID NO: 2704420 - RNA, 12 nt, Human
gaaaauaucacu

SEQ ID NO: 2704421 - RNA, 19 nt, Human
gaaaaucuuauaauuuaaa

SEQ ID NO: 2704422 - RNA, 19 nt, Human
gaaaauaacgauaaaagac

SEQ ID NO: 2704423 - RNA, 20 nt, Human
gaaaaucuuauaauuuaaaa

SEQ ID NO: 2704424 - RNA, 20 nt, Human
gaauaauccuaaacauauga

SEQ ID NO: 2704425 - RNA, 14 nt, Human
gaauacuuuauaaa

SEQ ID NO: 2704426 - RNA, 17 nt, Human
gaagacugcauuauauu

SEQ ID NO: 2704427 - RNA, 21 nt, Human
gaagccuuggggcugaugcag

SEQ ID NO: 2704428 - RNA, 16 nt, Human
gaaauauuauguuaaa

SEQ ID NO: 2704429 - RNA, 13 nt, Human
gaaauauuauguu

SEQ ID NO: 2704430 - RNA, 21 nt, Human
gaagaagcaccaaucaugaau

SEQ ID NO: 2704431 - RNA, 21 nt, Human
gaacuuguaaaggaauuuaaa

SEQ ID NO: 2704432 - RNA, 22 nt, Human
gaacuuccagauccuggaaauc

SEQ ID NO: 2704433 - RNA, 14 nt, Human
gaacucccuuucaa

SEQ ID NO: 2704434 - RNA, 22 nt, Human
gaacuagaguuuagcuggaaaa

SEQ ID NO: 2704435 - RNA, 21 nt, Human
gaacuagaguuuagcuggaaa

SEQ ID NO: 2704436 - RNA, 18 nt, Human
cugucuucacaacagauu

SEQ ID NO: 2704437 - RNA, 19 nt, Human
cuguuaaaagaugaaaaua

SEQ ID NO: 2704438 - RNA, 15 nt, Human
cuguuaaaagaugaa

SEQ ID NO: 2704439 - RNA, 16 nt, Human
cuguuaaaagaugaaa

SEQ ID NO: 2704440 - RNA, 23 nt, Human
cuuaagaagacugcauuauauuu

SEQ ID NO: 2704441 - RNA, 21 nt, Human
cuuaagaagacugcauuauau

SEQ ID NO: 2704442 - RNA, 19 nt, Human
cuuaauuaaaagaauauuu

SEQ ID NO: 2704443 - RNA, 20 nt, Human
cuuaauuaaaagaauauuuu

SEQ ID NO: 2704444 - RNA, 16 nt, Human
cuuaauuaaaagaaua

SEQ ID NO: 2704445 - RNA, 17 nt, Human
cuuaauuaaaagaauau

SEQ ID NO: 2704446 - RNA, 14 nt, Human
cuguuuuauaauuu

SEQ ID NO: 2704447 - RNA, 15 nt, Human
cuguuuuauaauuuu

SEQ ID NO: 2704448 - RNA, 12 nt, Human
cuucacaacaga

SEQ ID NO: 2704449 - RNA, 14 nt, Human
cuucacaacagauu

SEQ ID NO: 2704450 - RNA, 17 nt, Human
cuucaaauccuugaaga

SEQ ID NO: 2704451 - RNA, 16 nt, Human
cuucagcgguuuauau

SEQ ID NO: 2704452 - RNA, 15 nt, Human
cuucagccugaaaga

SEQ ID NO: 2704453 - RNA, 20 nt, Human
cuuccuuggacucauuuuaa

SEQ ID NO: 2704454 - RNA, 20 nt, Human
cuucggccuccauccugagg

SEQ ID NO: 2704455 - RNA, 17 nt, Human
ccucccuccaccucccu

SEQ ID NO: 2704456 - RNA, 20 nt, Human
ccucccuccaccucccugca

SEQ ID NO: 2704457 - RNA, 18 nt, Human
ccuccucugcuugccauc

SEQ ID NO: 2704458 - RNA, 13 nt, Human
ccuccucugcuug

SEQ ID NO: 2704459 - RNA, 16 nt, Human
ccuccucugcuugcca

SEQ ID NO: 2704460 - RNA, 14 nt, Human
ccuccauccugagg

SEQ ID NO: 2704461 - RNA, 22 nt, Human
ccuccaccucccugcaauaaaa

SEQ ID NO: 2704462 - RNA, 17 nt, Human
ccuccaccucccugcaa

SEQ ID NO: 2704463 - RNA, 15 nt, Human
ccuccaccucccugc

SEQ ID NO: 2704464 - RNA, 14 nt, Human
ccuccaccucccug

SEQ ID NO: 2704465 - RNA, 13 nt, Human
ccuccaccucccu

SEQ ID NO: 2704466 - RNA, 16 nt, Human
ccgggcguggugguga

SEQ ID NO: 2704467 - RNA, 13 nt, Human
cccacaagaaaug

SEQ ID NO: 2704468 - RNA, 20 nt, Human
cccacaagaaaugaaagcag

SEQ ID NO: 2704469 - RNA, 12 nt, Human
cccuccaccucc

SEQ ID NO: 2704470 - RNA, 14 nt, Human
cccuccaccucccu

SEQ ID NO: 2704471 - RNA, 17 nt, Human
cccuccaccucccugca

SEQ ID NO: 2704472 - RNA, 15 nt, Human
cccuccaccucccug

SEQ ID NO: 2704473 - RNA, 19 nt, Human
cccuccaccucccugcaau

SEQ ID NO: 2704474 - RNA, 15 nt, Human
cccucuccugggcag

SEQ ID NO: 2704475 - RNA, 14 nt, Human
cccucuccugggca

SEQ ID NO: 2704476 - RNA, 13 nt, Human
cccucuccugggc

SEQ ID NO: 2704477 - RNA, 12 nt, Human
cccucuccuggg

SEQ ID NO: 2704478 - RNA, 11 nt, Human
cccucuccugg

SEQ ID NO: 2704479 - RNA, 15 nt, Human
cccgugggguuccuc

SEQ ID NO: 2704480 - RNA, 22 nt, Human
ccugggcagcugccuccccucc

SEQ ID NO: 2704481 - RNA, 23 nt, Human
ccuggaaaucaggguuaguauug

SEQ ID NO: 2704482 - RNA, 11 nt, Human
ccugagcccca

SEQ ID NO: 2704483 - RNA, 16 nt, Human
ccugcaauaaaauggg

SEQ ID NO: 2704484 - RNA, 18 nt, Human
cgagcaggcuacugucag

SEQ ID NO: 2704485 - RNA, 20 nt, Human
ccuguuaaaagaugaaaaua

SEQ ID NO: 2704486 - RNA, 21 nt, Human
ccuguuaaaagaugaaaauau

SEQ ID NO: 2704487 - RNA, 14 nt, Human
ccuucggccuccau

SEQ ID NO: 2704488 - RNA, 19 nt, Human
ccuucggccuccauccuga

SEQ ID NO: 2704489 - RNA, 20 nt, Human
ccuucggccuccauccugag

SEQ ID NO: 2704490 - RNA, 20 nt, Human
ccuugaaaacuuuaugcuaa

SEQ ID NO: 2704491 - RNA, 14 nt, Human
ccuugaugaagaag

SEQ ID NO: 2704492 - RNA, 19 nt, Human
ccuuggggcugaugcaguu

SEQ ID NO: 2704493 - RNA, 19 nt, Human
ccaguguuuuaggagcaug

SEQ ID NO: 2704494 - RNA, 14 nt, Human
ccaguuauggcuau

SEQ ID NO: 2704495 - RNA, 21 nt, Human
ccaguuauggcuauaggugcu

SEQ ID NO: 2704496 - RNA, 16 nt, Human
ccaugggacagggagg

SEQ ID NO: 2704497 - RNA, 19 nt, Human
ccaugggacagggaggacg

SEQ ID NO: 2704498 - RNA, 22 nt, Human
ccagccagcaguucagagcugc

SEQ ID NO: 2704499 - RNA, 23 nt, Human
ccagcaguucagagcugcccucu

SEQ ID NO: 2704500 - RNA, 22 nt, Human
ccagcaguucagagcugcccuc

SEQ ID NO: 2704501 - RNA, 21 nt, Human
ccagcaguucagagcugcccu

SEQ ID NO: 2704502 - RNA, 20 nt, Human
ccagcaguucagagcugccc

SEQ ID NO: 2704503 - RNA, 19 nt, Human
ccagcaguucagagcugcc

SEQ ID NO: 2704504 - RNA, 18 nt, Human
ccagcaguucagagcugc

SEQ ID NO: 2704505 - RNA, 13 nt, Human
ccagcaguucaga

SEQ ID NO: 2704506 - RNA, 14 nt, Human
ccaccucccugcaa

SEQ ID NO: 2704507 - RNA, 19 nt, Human
caugagguacugagaguga

SEQ ID NO: 2704508 - RNA, 16 nt, Human
caugagguacugagag

SEQ ID NO: 2704509 - RNA, 19 nt, Human
caugaagauguagaggaga

SEQ ID NO: 2704510 - RNA, 18 nt, Human
caugaagauguagaggag

SEQ ID NO: 2704511 - RNA, 15 nt, Human
cauauauaacaaugc

SEQ ID NO: 2704512 - RNA, 13 nt, Human
cauauauaacaau

SEQ ID NO: 2704513 - RNA, 23 nt, Human
caucccucccuccaccucccugc

SEQ ID NO: 2704514 - RNA, 22 nt, Human
caucccucccuccaccucccug

SEQ ID NO: 2704515 - RNA, 18 nt, Human
caucccuuaccugggaaa

SEQ ID NO: 2704516 - RNA, 20 nt, Human
caucccucccuccaccuccc

SEQ ID NO: 2704517 - RNA, 23 nt, Human
caugggacagggaggacgcucuc

SEQ ID NO: 2704518 - RNA, 20 nt, Human
cauggaauuggagcucgugg

SEQ ID NO: 2704519 - RNA, 20 nt, Human
caugugcuaguaauuggaaa

SEQ ID NO: 2704520 - RNA, 21 nt, Human
cauuguaaaugugcuuuuaaa

SEQ ID NO: 2704521 - RNA, 13 nt, Human
cauucuggaauaa

SEQ ID NO: 2704522 - RNA, 22 nt, Human
cauuccaacuaucucauuucca

SEQ ID NO: 2704523 - RNA, 13 nt, Human
caguccaugaaga

SEQ ID NO: 2704524 - RNA, 18 nt, Human
cagucaggaaagagaacu

SEQ ID NO: 2704525 - RNA, 15 nt, Human
cagucaggaaagaga

SEQ ID NO: 2704526 - RNA, 22 nt, Human
cagucaggaaagagaacuucca

SEQ ID NO: 2704527 - RNA, 12 nt, Human
caguagugauag

SEQ ID NO: 2704528 - RNA, 12 nt, Human
caguauggcagc

SEQ ID NO: 2704529 - RNA, 15 nt, Human
cagugagacagcucu

SEQ ID NO: 2704530 - RNA, 16 nt, Human
cagugaaagaaaauaa

SEQ ID NO: 2704531 - RNA, 20 nt, Human
cagugaaagaaaauaacaau

SEQ ID NO: 2704532 - RNA, 18 nt, Human
cagugauuaccagggacu

SEQ ID NO: 2704533 - RNA, 17 nt, Human
cagugauuaccagggac

SEQ ID NO: 2704534 - RNA, 23 nt, Human
caggaugguucccuugaugaaga

SEQ ID NO: 2704535 - RNA, 21 nt, Human
caggaugguucccuugaugaa

SEQ ID NO: 2704536 - RNA, 16 nt, Human
caggauuuuaaucuuu

SEQ ID NO: 2704537 - RNA, 20 nt, Human
caggcccccaggugccaguu

SEQ ID NO: 2704538 - RNA, 14 nt, Human
caggcccccaggug

SEQ ID NO: 2704539 - RNA, 19 nt, Human
caggcccccaggugccagu

SEQ ID NO: 2704540 - RNA, 18 nt, Human
cagggacaggauaagagg

SEQ ID NO: 2704541 - RNA, 17 nt, Human
cagggcauggcugggaa

SEQ ID NO: 2704542 - RNA, 16 nt, Human
caggggacaggauggu

SEQ ID NO: 2704543 - RNA, 11 nt, Human
caggggacagg

SEQ ID NO: 2704544 - RNA, 14 nt, Human
caggcuacugucag

SEQ ID NO: 2704545 - RNA, 19 nt, Human
caggcuagauguauguacu

SEQ ID NO: 2704546 - RNA, 13 nt, Human
caggcuagaugua

SEQ ID NO: 2704547 - RNA, 19 nt, Human
cagcaagggugaugggaaa

SEQ ID NO: 2704548 - RNA, 22 nt, Human
cagcaagggugaugggaaagca

SEQ ID NO: 2704549 - RNA, 23 nt, Human
cagcaagggugaugggaaagcau

SEQ ID NO: 2704550 - RNA, 15 nt, Human
cagauuuuccugaaa

SEQ ID NO: 2704551 - RNA, 14 nt, Human
cagauuuuccugaa

SEQ ID NO: 2704552 - RNA, 23 nt, Human
cagcaacgcaggcccccaggugc

SEQ ID NO: 2704553 - RNA, 19 nt, Human
cagcuacuugggaggcuga

SEQ ID NO: 2704554 - RNA, 16 nt, Human
cagccuaguugaucag

SEQ ID NO: 2704555 - RNA, 13 nt, Human
cagcccucagaau

SEQ ID NO: 2704556 - RNA, 16 nt, Human
cagcucuccccuucuc

SEQ ID NO: 2704557 - RNA, 20 nt, Human
cagcucugcauacucauuag

SEQ ID NO: 2704558 - RNA, 20 nt, Human
cagcugcugaaacaacaaau

SEQ ID NO: 2704559 - RNA, 21 nt, Human
cagcugcugaaacaacaaaua

SEQ ID NO: 2704560 - RNA, 18 nt, Human
cagcuguaugauucccag

SEQ ID NO: 2704561 - RNA, 18 nt, Human
caggaaccacaagacugc

SEQ ID NO: 2704562 - RNA, 23 nt, Human
cagcuuuccucaaaacuucagac

SEQ ID NO: 2704563 - RNA, 18 nt, Human
cagcuugaaacugagaug

SEQ ID NO: 2704564 - RNA, 14 nt, Human
caggaagcugugag

SEQ ID NO: 2704565 - RNA, 13 nt, Human
caggaagcuguga

SEQ ID NO: 2704566 - RNA, 22 nt, Human
caggaagcugugagagcaguuu

SEQ ID NO: 2704567 - RNA, 16 nt, Human
caggaaguagaggagg

SEQ ID NO: 2704568 - RNA, 15 nt, Human
caggaaguagaggag

SEQ ID NO: 2704569 - RNA, 17 nt, Human
cagaugcacaugagcug

SEQ ID NO: 2704570 - RNA, 13 nt, Human
cagauccuggaaa

SEQ ID NO: 2704571 - RNA, 14 nt, Human
cagauccuggaaau

SEQ ID NO: 2704572 - RNA, 14 nt, Human
cagauaaacaguag

SEQ ID NO: 2704573 - RNA, 23 nt, Human
cagauaaauaguuuaugauucca

SEQ ID NO: 2704574 - RNA, 14 nt, Human
cagauaaucacaau

SEQ ID NO: 2704575 - RNA, 20 nt, Human
cagagccccacccucagaug

SEQ ID NO: 2704576 - RNA, 18 nt, Human
cagaaagcagaacaguga

SEQ ID NO: 2704577 - RNA, 23 nt, Human
cagaacagugauuaccagggacu

SEQ ID NO: 2704578 - RNA, 19 nt, Human
cagaaagcagaacagugau

SEQ ID NO: 2704579 - RNA, 23 nt, Human
cagaaucgcuccaccuugcagcu

SEQ ID NO: 2704580 - RNA, 21 nt, Human
cagaaucgcuccaccuugcag

SEQ ID NO: 2704581 - RNA, 19 nt, Human
cagaagcaacccaaauguu

SEQ ID NO: 2704582 - RNA, 20 nt, Human
cagaagcaacccaaauguuc

SEQ ID NO: 2704583 - RNA, 17 nt, Human
cagacauagaauuaaca

SEQ ID NO: 2704584 - RNA, 19 nt, Human
cagacauagaauuaacaca

SEQ ID NO: 2704585 - RNA, 20 nt, Human
cacccucagaugcacaugag

SEQ ID NO: 2704586 - RNA, 14 nt, Human
caccucauggaauu

SEQ ID NO: 2704587 - RNA, 12 nt, Human
caccucauggaa

SEQ ID NO: 2704588 - RNA, 11 nt, Human
caccucaugga

SEQ ID NO: 2704589 - RNA, 10 nt, Human
caccucccug

SEQ ID NO: 2704590 - RNA, 14 nt, Human
caccucccugcaau

SEQ ID NO: 2704591 - RNA, 13 nt, Human
caccucccugcaa

SEQ ID NO: 2704592 - RNA, 19 nt, Human
cacuaguauuucuaugaaa

SEQ ID NO: 2704593 - RNA, 14 nt, Human
cacuaguauuucua

SEQ ID NO: 2704594 - RNA, 17 nt, Human
cacuaagagagaaugag

SEQ ID NO: 2704595 - RNA, 21 nt, Human
cacuaaauugacacuuaaaaa

SEQ ID NO: 2704596 - RNA, 16 nt, Human
cacucaaaucaagaaa

SEQ ID NO: 2704597 - RNA, 15 nt, Human
cacgcacacugucug

SEQ ID NO: 2704598 - RNA, 22 nt, Human
cacgagcaggcuacugucagcu

SEQ ID NO: 2704599 - RNA, 17 nt, Human
cacgagcaggcuacugu

SEQ ID NO: 2704600 - RNA, 19 nt, Human
cacgagcaggcuacuguca

SEQ ID NO: 2704601 - RNA, 20 nt, Human
cacgagcaggcuacugucag

SEQ ID NO: 2704602 - RNA, 13 nt, Human
cacuaaacaaaga

SEQ ID NO: 2704603 - RNA, 22 nt, Human
cacguucuuacuaguuucccuu

SEQ ID NO: 2704604 - RNA, 20 nt, Human
cacugccuucucaacuccaa

SEQ ID NO: 2704605 - RNA, 21 nt, Human
cacugacuucuaaguaaaacc

SEQ ID NO: 2704606 - RNA, 14 nt, Human
cacugacuucuaag

SEQ ID NO: 2704607 - RNA, 15 nt, Human
cacugacuucuaagu

SEQ ID NO: 2704608 - RNA, 16 nt, Human
cacugacuucuaagua

SEQ ID NO: 2704609 - RNA, 20 nt, Human
cacugacuucuaaguaaaac

SEQ ID NO: 2704610 - RNA, 14 nt, Human
cacugucaagauga

SEQ ID NO: 2704611 - RNA, 24 nt, Human
cacuguggguagacacacaugaag

SEQ ID NO: 2704612 - RNA, 22 nt, Human
cacuguggguagacacacauga

SEQ ID NO: 2704613 - RNA, 19 nt, Human
cacuguggguagacacaca

SEQ ID NO: 2704614 - RNA, 15 nt, Human
cacuuggucugugag

SEQ ID NO: 2704615 - RNA, 20 nt, Human
cacuugaacccgggaggcag

SEQ ID NO: 2704616 - RNA, 21 nt, Human
cacuugaacccgggaggcaga

SEQ ID NO: 2704617 - RNA, 23 nt, Human
cacuugaacccgggaggcagagg

SEQ ID NO: 2704618 - RNA, 22 nt, Human
acuugggaggcugagaugggag

SEQ ID NO: 2704619 - RNA, 12 nt, Human
acuuuaugcuaa

SEQ ID NO: 2704620 - RNA, 17 nt, Human
acuuuaugcuaagugaa

SEQ ID NO: 2704621 - RNA, 19 nt, Human
acuucagcgguuuauauaa

SEQ ID NO: 2704622 - RNA, 18 nt, Human
acuucagcgguuuauaua

SEQ ID NO: 2704623 - RNA, 17 nt, Human
acuucagcgguuuauau

SEQ ID NO: 2704624 - RNA, 20 nt, Human
acuucaaauccuugaagauu

SEQ ID NO: 2704625 - RNA, 19 nt, Human
acuucaaauccuugaagau

SEQ ID NO: 2704626 - RNA, 13 nt, Human
acuuaaaaauggu

SEQ ID NO: 2704627 - RNA, 14 nt, Human
acuuaaaaaugguu

SEQ ID NO: 2704628 - RNA, 15 nt, Human
acucugucucagucc

SEQ ID NO: 2704629 - RNA, 17 nt, Human
acucugucucaguccau

SEQ ID NO: 2704630 - RNA, 20 nt, Human
acucuuaagaagacugcauu

SEQ ID NO: 2704631 - RNA, 15 nt, Human
acucuuaagaagacu

SEQ ID NO: 2704632 - RNA, 14 nt, Human
acucuuaagaagac

SEQ ID NO: 2704633 - RNA, 18 nt, Human
accucugccucagaaaac

SEQ ID NO: 2704634 - RNA, 17 nt, Human
accucugccucagaaaa

SEQ ID NO: 2704635 - RNA, 18 nt, Human
acuaguauuucuaugaaa

SEQ ID NO: 2704636 - RNA, 19 nt, Human
acuaguauuucuaugaaau

SEQ ID NO: 2704637 - RNA, 19 nt, Human
acggacgaaccuugaaaac

SEQ ID NO: 2704638 - RNA, 19 nt, Human
accaaggcugauuaaacca

SEQ ID NO: 2704639 - RNA, 20 nt, Human
accaaggcugauuaaaccaa

SEQ ID NO: 2704640 - RNA, 20 nt, Human
acaucccuuaccugggaaag

SEQ ID NO: 2704641 - RNA, 21 nt, Human
acagugauuaccagggacuga

SEQ ID NO: 2704642 - RNA, 20 nt, Human
acagugauuaccagggacug

SEQ ID NO: 2704643 - RNA, 18 nt, Human
aauuuugugaagcaaaau

SEQ ID NO: 2704644 - RNA, 17 nt, Human
aauuuugugaagcaaaa

SEQ ID NO: 2704645 - RNA, 13 nt, Human
aauuuugugaagc

SEQ ID NO: 2704646 - RNA, 13 nt, Human
acaagaaaugaaa

SEQ ID NO: 2704647 - RNA, 15 nt, Human
acaagaaaugaaagc

SEQ ID NO: 2704648 - RNA, 16 nt, Human
acaagaaaugaaagca

SEQ ID NO: 2704649 - RNA, 21 nt, Human
acaaggaugaauuaaguuuuu

SEQ ID NO: 2704650 - RNA, 16 nt, Human
acagaagcuccaggua

SEQ ID NO: 2704651 - RNA, 19 nt, Human
aaaggcagaagcaacccaa

SEQ ID NO: 2704652 - RNA, 19 nt, Human
aaagcauuguaaaugugcu

SEQ ID NO: 2704653 - RNA, 20 nt, Human
aaagcauuguaaaugugcuu

SEQ ID NO: 2704654 - RNA, 21 nt, Human
aaacccugucucuacuaaaaa

SEQ ID NO: 2704655 - RNA, 19 nt, Human
aaacccuugccaugugcua

SEQ ID NO: 2704656 - RNA, 13 nt, Human
aaagaaacauuug

SEQ ID NO: 2704657 - RNA, 19 nt, Human
aaaauccauacauuugugu

SEQ ID NO: 2704658 - RNA, 12 nt, Human
aacacaucagcu

SEQ ID NO: 2704659 - RNA, 22 nt, Human
aaauugacacuuaaaaaugguu

SEQ ID NO: 2704660 - RNA, 20 nt, Human
aaauguucaucaaugaauga

SEQ ID NO: 2704661 - RNA, 14 nt, Human
aaaucuuaacuuga

SEQ ID NO: 2704662 - RNA, 23 nt, Human
aacugagaugugaacacaucagc

SEQ ID NO: 2704663 - RNA, 15 nt, Human
aauccaaugaaauga

SEQ ID NO: 2704664 - RNA, 16 nt, Human
aauccauacauuugug

SEQ ID NO: 2704665 - RNA, 17 nt, Human
aauccauacauuugugu

SEQ ID NO: 2704666 - RNA, 16 nt, Human
aaugauaacuggaaac

SEQ ID NO: 2704667 - RNA, 15 nt, Human
aaugauaacuggaaa

SEQ ID NO: 2704668 - RNA, 14 nt, Human
aaugauaacuggaa

SEQ ID NO: 2704669 - RNA, 22 nt, Human
aaucauuucugcaucagcugcu

SEQ ID NO: 2704670 - RNA, 15 nt, Human
aaucaaauaugcaaa

SEQ ID NO: 2704671 - RNA, 16 nt, Human
aaucaaauaugcaaag

SEQ ID NO: 2704672 - RNA, 22 nt, Human
aaucaaauaugcaaagcacuga

SEQ ID NO: 2704673 - RNA, 12 nt, Human
aauaauguuuca

SEQ ID NO: 2704674 - RNA, 19 nt, Human
aauaauguuucaaacauau

SEQ ID NO: 2704675 - RNA, 14 nt, Human
aauaauguuucaaa

SEQ ID NO: 2704676 - RNA, 10 nt, Human
aauaaaccau

SEQ ID NO: 2704677 - RNA, 22 nt, Human
aaguugauaugccuuuucccaa

SEQ ID NO: 2704678 - RNA, 17 nt, Human
aaguucugcagauaaac

SEQ ID NO: 2704679 - RNA, 15 nt, Human
aagcagggacuugaa

SEQ ID NO: 2704680 - RNA, 15 nt, Human
aagagaacuuccaga

SEQ ID NO: 2704681 - RNA, 23 nt, Human
aagacagugaaagaaaauaacaa

SEQ ID NO: 2704682 - RNA, 19 nt, Human
aagccagauuuuccugaaa

SEQ ID NO: 2704683 - RNA, 12 nt, Human
aaguagaggagg

SEQ ID NO: 2704684 - RNA, 15 nt, Human
aagggauuuucagcc

SEQ ID NO: 2704685 - RNA, 14 nt, Human
aagggauggcaaga

SEQ ID NO: 2704686 - RNA, 17 nt, Human
aagggauggcaagaugu

SEQ ID NO: 2704687 - RNA, 23 nt, Human
aagggauuuucagcccucagaau

SEQ ID NO: 2704688 - RNA, 21 nt, Human
aagggauuuucagcccucaga

SEQ ID NO: 2704689 - RNA, 24 nt, Human
agcaaaauuuuuucucuaggaaau

SEQ ID NO: 2704690 - RNA, 16 nt, Human
agauguagaggagaaa

SEQ ID NO: 2704691 - RNA, 19 nt, Human
agauguagaggagaaacug

SEQ ID NO: 2704692 - RNA, 22 nt, Human
agaagagcuguucacagccaga

SEQ ID NO: 2704693 - RNA, 21 nt, Human
agaagagcuguucacagccag

SEQ ID NO: 2704694 - RNA, 18 nt, Human
agaagacugcauuauauu

SEQ ID NO: 2704695 - RNA, 21 nt, Human
agaagugaaaaucuacacucc

SEQ ID NO: 2704696 - RNA, 17 nt, Human
agaaugauuaugaauua

SEQ ID NO: 2704697 - RNA, 22 nt, Human
agaaugagagacacacugaaga

SEQ ID NO: 2704698 - RNA, 17 nt, Human
agaaugagagacacacu

SEQ ID NO: 2704699 - RNA, 17 nt, Human
agacccaaaaggcagaa

SEQ ID NO: 2704700 - RNA, 19 nt, Human
agacccaaaaggcagaagc

SEQ ID NO: 2704701 - RNA, 20 nt, Human
agacuggauaguccgucucu

SEQ ID NO: 2704702 - RNA, 16 nt, Human
agacuggauaguccgu

SEQ ID NO: 2704703 - RNA, 18 nt, Human
agacucugucucagucca

SEQ ID NO: 2704704 - RNA, 13 nt, Human
agaggaaugaagu

SEQ ID NO: 2704705 - RNA, 21 nt, Human
aggccaugggcacugugggua

SEQ ID NO: 2704706 - RNA, 15 nt, Human
agggacugaggggag

SEQ ID NO: 2704707 - RNA, 22 nt, Human
agggauuuucagcccucagaau

SEQ ID NO: 2704708 - RNA, 17 nt, Human
agggauuuucagcccuc

SEQ ID NO: 2704709 - RNA, 15 nt, Human
agggauuagggagag

SEQ ID NO: 2704710 - RNA, 13 nt, Human
aggaaguagagga

SEQ ID NO: 2704711 - RNA, 20 nt, Human
agcuuauuuccucauuuuua

SEQ ID NO: 2704712 - RNA, 20 nt, Human
agcuccccucggagaagagc

SEQ ID NO: 2704713 - RNA, 17 nt, Human
agcuccccucggagaag

SEQ ID NO: 2704714 - RNA, 19 nt, Human
agcuccccucggagaagag

SEQ ID NO: 2704715 - RNA, 17 nt, Human
agcgacagugagacucu

SEQ ID NO: 2704716 - RNA, 18 nt, Human
augaugaucuuuaaaaua

SEQ ID NO: 2704717 - RNA, 21 nt, Human
augaugaucuuuaaaauacac

SEQ ID NO: 2704718 - RNA, 16 nt, Human
augaucuuuaaaauac

SEQ ID NO: 2704719 - RNA, 21 nt, Human
augucaaucagccuaguugau

SEQ ID NO: 2704720 - RNA, 16 nt, Human
augucaaucagccuag

SEQ ID NO: 2704721 - RNA, 15 nt, Human
augugaacacaucag

SEQ ID NO: 2704722 - RNA, 15 nt, Human
auguuccuagugaaa

SEQ ID NO: 2704723 - RNA, 16 nt, Human
auguuccuagugaaag

SEQ ID NO: 2704724 - RNA, 17 nt, Human
auguuccuagugaaaga

SEQ ID NO: 2704725 - RNA, 22 nt, Human
aucagcuugcccuguuaaaaga

SEQ ID NO: 2704726 - RNA, 13 nt, Human
aucagcuuauugu

SEQ ID NO: 2704727 - RNA, 17 nt, Human
aucaugaauuaguuuua

SEQ ID NO: 2704728 - RNA, 14 nt, Human
aucaaauaugcaaa

SEQ ID NO: 2704729 - RNA, 21 nt, Human
aucgcuccaccuugcagcucu

SEQ ID NO: 2704730 - RNA, 17 nt, Human
aucgcuccaccuugcag

SEQ ID NO: 2704731 - RNA, 19 nt, Human
auccucaguuuuugugaaa

SEQ ID NO: 2704732 - RNA, 13 nt, Human
augaaguacucau

SEQ ID NO: 2704733 - RNA, 21 nt, Human
augaaguacucauacauguua

SEQ ID NO: 2704734 - RNA, 23 nt, Human
augaaguccaagcauuuagaugu

SEQ ID NO: 2704735 - RNA, 20 nt, Human
augaaguccaagcauuuaga

SEQ ID NO: 2704736 - RNA, 19 nt, Human
aguugaaaagacuccaaag

SEQ ID NO: 2704737 - RNA, 20 nt, Human
aguugaaaagacuccaaaga

SEQ ID NO: 2704738 - RNA, 14 nt, Human
aguugaaaagacuc

SEQ ID NO: 2704739 - RNA, 18 nt, Human
aguugaaaagacuccaaa

SEQ ID NO: 2704740 - RNA, 20 nt, Human
aguucagagcugcccucucc

SEQ ID NO: 2704741 - RNA, 22 nt, Human
aguucagagcugcccucuccug

SEQ ID NO: 2704742 - RNA, 21 nt, Human
aguucagagcugcccucuccu

SEQ ID NO: 2704743 - RNA, 23 nt, Human
aguucagagcugcccucuccugg

SEQ ID NO: 2704744 - RNA, 19 nt, Human
agugucaaugcagccccca

SEQ ID NO: 2704745 - RNA, 11 nt, Human
aguccaagcau

SEQ ID NO: 2704746 - RNA, 15 nt, Human
auagcagcuuauuca

SEQ ID NO: 2704747 - RNA, 14 nt, Human
auauuauguuaaaa

SEQ ID NO: 2704748 - RNA, 13 nt, Human
auauuauguuaaa

SEQ ID NO: 2704749 - RNA, 21 nt, Human
auaacaaugcuguauuuuaaa

SEQ ID NO: 2704750 - RNA, 20 nt, Human
auaacaaugcuguauuuuaa

SEQ ID NO: 2704751 - RNA, 19 nt, Human
auaacaaugcuguauuuua

SEQ ID NO: 2704752 - RNA, 17 nt, Human
auaacaaugcuguauuu

SEQ ID NO: 2704753 - RNA, 15 nt, Human
auaacaaugcuguau

SEQ ID NO: 2704754 - RNA, 14 nt, Human
auaacaaugaaagu

SEQ ID NO: 2704755 - RNA, 18 nt, Human
auaauguuucaaacauau

SEQ ID NO: 2704756 - RNA, 21 nt, Human
auaagccagacaucaacagau

SEQ ID NO: 2704757 - RNA, 22 nt, Human
auaagccagacaucaacagaua

SEQ ID NO: 2704758 - RNA, 13 nt, Human
auaauguuucaaa

SEQ ID NO: 2704759 - RNA, 20 nt, Human
gcuccacuuggucugugaga

SEQ ID NO: 2704760 - RNA, 15 nt, Human
gcucugcccauccug

SEQ ID NO: 2704761 - RNA, 21 nt, Human
gcucugcccauccugccccug

SEQ ID NO: 2704762 - RNA, 12 nt, Human
gcugaacaucac

SEQ ID NO: 2704763 - RNA, 16 nt, Human
gcugaaacaacaaaua

SEQ ID NO: 2704764 - RNA, 12 nt, Human
gcuguauuuuaa

SEQ ID NO: 2704765 - RNA, 13 nt, Human
gcuguauuuuaaa

SEQ ID NO: 2704766 - RNA, 17 nt, Human
gcuuauuuccucauuuu

SEQ ID NO: 2704767 - RNA, 19 nt, Human
gcuuccuggcaauagucaa

SEQ ID NO: 2704768 - RNA, 15 nt, Human
gccuccauccugagg

SEQ ID NO: 2704769 - RNA, 16 nt, Human
gccuccauccugaggc

SEQ ID NO: 2704770 - RNA, 20 nt, Human
gccuccauccugaggcucca

SEQ ID NO: 2704771 - RNA, 17 nt, Human
gcuacuugggaggcuga

SEQ ID NO: 2704772 - RNA, 15 nt, Human
gcuacugucagcucc

SEQ ID NO: 2704773 - RNA, 18 nt, Human
gcuacaaaaacacagcaa

SEQ ID NO: 2704774 - RNA, 19 nt, Human
gcuacaaaaacacagcaag

SEQ ID NO: 2704775 - RNA, 17 nt, Human
gcuacaaaaacacagca

SEQ ID NO: 2704776 - RNA, 22 nt, Human
gccaugugcuaguaauuggaaa

SEQ ID NO: 2704777 - RNA, 18 nt, Human
gccccacccucagaugca

SEQ ID NO: 2704778 - RNA, 15 nt, Human
gccccacccucagau

SEQ ID NO: 2704779 - RNA, 22 nt, Human
gccaguuauggcuauaggugcu

SEQ ID NO: 2704780 - RNA, 19 nt, Human
gccagcaguucagagcugc

SEQ ID NO: 2704781 - RNA, 14 nt, Human
gccagcaguucaga

SEQ ID NO: 2704782 - RNA, 13 nt, Human
gccagcaguucag

SEQ ID NO: 2704783 - RNA, 21 nt, Human
gccagcaguucagagcugccc

SEQ ID NO: 2704784 - RNA, 20 nt, Human
gccagcaguucagagcugcc

SEQ ID NO: 2704785 - RNA, 22 nt, Human
ggauguugaaaaaguucugcag

SEQ ID NO: 2704786 - RNA, 12 nt, Human
ggauggcaagau

SEQ ID NO: 2704787 - RNA, 22 nt, Human
ggccuucggccuccauccugag

SEQ ID NO: 2704788 - RNA, 23 nt, Human
ggccuucggccuccauccugagg

SEQ ID NO: 2704789 - RNA, 14 nt, Human
aaagacuauucaaa

SEQ ID NO: 2704790 - RNA, 15 nt, Human
aaagacuauucaaac

SEQ ID NO: 2704791 - RNA, 17 nt, Human
aaagcagggacuugaac

SEQ ID NO: 2704792 - RNA, 16 nt, Human
ggugugaccacugcag

SEQ ID NO: 2704793 - RNA, 12 nt, Human
gguuucuagcau

SEQ ID NO: 2704794 - RNA, 16 nt, Human
gguuuagaaagcuugc

SEQ ID NO: 2704795 - RNA, 20 nt, Human
aaauaauuuuuauauuugaa

SEQ ID NO: 2704796 - RNA, 18 nt, Human
aaauaauuuuuauauuug

SEQ ID NO: 2704797 - RNA, 15 nt, Human
aaauaauuuuuauau

SEQ ID NO: 2704798 - RNA, 15 nt, Human
aaaaugugauaugua

SEQ ID NO: 2704799 - RNA, 22 nt, Human
aaaauuuuuucucuaggaaaua

SEQ ID NO: 2704800 - RNA, 20 nt, Human
aaacaagcacuaaacaaaga

SEQ ID NO: 2704801 - RNA, 20 nt, Human
aaacagucucaggaaaucaa

SEQ ID NO: 2704802 - RNA, 15 nt, Human
gggcgugguggugag

SEQ ID NO: 2704803 - RNA, 19 nt, Human
aaaaguauguuagugcaaa

SEQ ID NO: 2704804 - RNA, 16 nt, Human
gggauuguaaaauggu

SEQ ID NO: 2704805 - RNA, 17 nt, Human
gggauuguaaaauggug

SEQ ID NO: 2704806 - RNA, 13 nt, Human
aaaaccacagcag

SEQ ID NO: 2704807 - RNA, 14 nt, Human
aaaaccacagcagu

SEQ ID NO: 2704808 - RNA, 17 nt, Human
aaaagaugaaaauauuu

SEQ ID NO: 2704809 - RNA, 13 nt, Human
aaaacucauuuuu

SEQ ID NO: 2704810 - RNA, 22 nt, Human
aaaaauggaacauaaaauacaa

SEQ ID NO: 2704811 - RNA, 12 nt, Human
aaaaccacagca

SEQ ID NO: 2704812 - RNA, 19 nt, Human
gggacauuugcucauggaa

SEQ ID NO: 2704813 - RNA, 21 nt, Human
gggacauuugcucauggaauu

SEQ ID NO: 2704814 - RNA, 20 nt, Human
gggacauuugcucauggaau

SEQ ID NO: 2704815 - RNA, 20 nt, Human
gaaugagagacacacugaag

SEQ ID NO: 2704816 - RNA, 23 nt, Human
gaaugagagacacacugaagaag

SEQ ID NO: 2704817 - RNA, 22 nt, Human
gaaugagagacacacugaagaa

SEQ ID NO: 2704818 - RNA, 12 nt, Human
gacacacaugaa

SEQ ID NO: 2704819 - RNA, 13 nt, Human
gacacacugaaga

SEQ ID NO: 2704820 - RNA, 11 nt, Human
gaauuaguuuu

SEQ ID NO: 2704821 - RNA, 14 nt, Human
gacagugaaagaaa

SEQ ID NO: 2704822 - RNA, 17 nt, Human
gacagucaccucaugga

SEQ ID NO: 2704823 - RNA, 20 nt, Human
gacaguauggcagcuuuccu

SEQ ID NO: 2704824 - RNA, 16 nt, Human
gacacuuaaaaauggu

SEQ ID NO: 2704825 - RNA, 22 nt, Human
gacuauucaaacagucucagga

SEQ ID NO: 2704826 - RNA, 16 nt, Human
gacucuuaagaagacu

SEQ ID NO: 2704827 - RNA, 15 nt, Human
gacucuuaagaagac

SEQ ID NO: 2704828 - RNA, 17 nt, Human
gacucuuaagaagacug

SEQ ID NO: 2704829 - RNA, 14 nt, Human
gagaaucacuugaa

SEQ ID NO: 2704830 - RNA, 15 nt, Human
gagaaucacuugaac

SEQ ID NO: 2704831 - RNA, 21 nt, Human
gcacaugagcuggcgggauug

SEQ ID NO: 2704832 - RNA, 14 nt, Human
gcacaguuuucuga

SEQ ID NO: 2704833 - RNA, 17 nt, Human
gcacaguuuucugagaa

SEQ ID NO: 2704834 - RNA, 18 nt, Human
gcacaguuuucugagaaa

SEQ ID NO: 2704835 - RNA, 19 nt, Human
gcagggacuugaacccaua

SEQ ID NO: 2704836 - RNA, 22 nt, Human
gcagcugccuccccuccucugc

SEQ ID NO: 2704837 - RNA, 18 nt, Human
gcagcugccuccccuccu

SEQ ID NO: 2704838 - RNA, 17 nt, Human
gcagcugccuccccucc

SEQ ID NO: 2704839 - RNA, 16 nt, Human
gcagcugccuccccuc

SEQ ID NO: 2704840 - RNA, 15 nt, Human
gcagcugccuccccu

SEQ ID NO: 2704841 - RNA, 13 nt, Human
gcagcugccuccc

SEQ ID NO: 2704842 - RNA, 12 nt, Human
gcagcugccucc

SEQ ID NO: 2704843 - RNA, 11 nt, Human
gcagcugccuc

SEQ ID NO: 2704844 - RNA, 17 nt, Human
gauuagggagagaagau

SEQ ID NO: 2704845 - RNA, 14 nt, Human
gaugugaacacauc

SEQ ID NO: 2704846 - RNA, 16 nt, Human
gaugugaacacaucag

SEQ ID NO: 2704847 - RNA, 14 nt, Human
gauuaccagggacu

SEQ ID NO: 2704848 - RNA, 20 nt, Human
gauauguaccuaacgaagua

SEQ ID NO: 2704849 - RNA, 16 nt, Human
gaguuuagcuggaaaa

SEQ ID NO: 2704850 - RNA, 21 nt, Human
gagugcucaguagucagacug

SEQ ID NO: 2704851 - RNA, 19 nt, Human
gaaaucaaauaugcaaagc

SEQ ID NO: 2704852 - RNA, 20 nt, Human
gaaaucaaauaugcaaagca

SEQ ID NO: 2704853 - RNA, 22 nt, Human
gaaauauuuauuuuaauaaugu

SEQ ID NO: 2704854 - RNA, 18 nt, Human
gaaauauuuauuuuaaua

SEQ ID NO: 2704855 - RNA, 18 nt, Human
gaaaucaaauaugcaaag

SEQ ID NO: 2704856 - RNA, 17 nt, Human
gaaaucaaauaugcaaa

SEQ ID NO: 2704857 - RNA, 17 nt, Human
gaaauauuuauuuuaau

SEQ ID NO: 2704858 - RNA, 14 nt, Human
gaaagacuauucaa

SEQ ID NO: 2704859 - RNA, 15 nt, Human
gaaagacuauucaaa

SEQ ID NO: 2704860 - RNA, 17 nt, Human
gaaagacuauucaaaca

SEQ ID NO: 2704861 - RNA, 15 nt, Human
cuucacuguaaaaua

SEQ ID NO: 2704862 - RNA, 22 nt, Human
cuucuaaguaaaaccacagcag

SEQ ID NO: 2704863 - RNA, 23 nt, Human
cuucuaaguaaaaccacagcagu

SEQ ID NO: 2704864 - RNA, 12 nt, Human
cuugaugaagaa

SEQ ID NO: 2704865 - RNA, 13 nt, Human
cuugaugaagaag

SEQ ID NO: 2704866 - RNA, 10 nt, Human
cugggacagg

SEQ ID NO: 2704867 - RNA, 22 nt, Human
cugggcagcugccuccccuccu

SEQ ID NO: 2704868 - RNA, 21 nt, Human
cugggcagcugccuccccucc

SEQ ID NO: 2704869 - RNA, 20 nt, Human
cugggcagcugccuccccuc

SEQ ID NO: 2704870 - RNA, 19 nt, Human
cugggcagcugccuccccu

SEQ ID NO: 2704871 - RNA, 16 nt, Human
cugggcagcugccucc

SEQ ID NO: 2704872 - RNA, 21 nt, Human
cugucagcuccccucggagaa

SEQ ID NO: 2704873 - RNA, 23 nt, Human
cugucagcuccccucggagaaga

SEQ ID NO: 2704874 - RNA, 16 nt, Human
cugugagaugcuagaa

SEQ ID NO: 2704875 - RNA, 21 nt, Human
cuggaaaucaggguuaguauu

SEQ ID NO: 2704876 - RNA, 20 nt, Human
cucuuagaugcaguucugaa

SEQ ID NO: 2704877 - RNA, 15 nt, Human
cucuuagaugcaguu

SEQ ID NO: 2704878 - RNA, 12 nt, Human
cucucuggccuu

SEQ ID NO: 2704879 - RNA, 11 nt, Human
cucucuggccu

SEQ ID NO: 2704880 - RNA, 16 nt, Human
cucccugcaauaaaau

SEQ ID NO: 2704881 - RNA, 14 nt, Human
cucccugcaauaaa

SEQ ID NO: 2704882 - RNA, 21 nt, Human
cuccagugagacagcucugca

SEQ ID NO: 2704883 - RNA, 23 nt, Human
cuaguugaucagcuuauugucua

SEQ ID NO: 2704884 - RNA, 16 nt, Human
cuagcaugaagacaga

SEQ ID NO: 2704885 - RNA, 16 nt, Human
cuagaacucccuuuca

SEQ ID NO: 2704886 - RNA, 17 nt, Human
cuagaacucccuuucaa

SEQ ID NO: 2704887 - RNA, 18 nt, Human
cuagaacucccuuucaac

SEQ ID NO: 2704888 - RNA, 19 nt, Human
cuagaacucccuuucaaca

SEQ ID NO: 2704889 - RNA, 15 nt, Human
cguggugauuuagca

SEQ ID NO: 2704890 - RNA, 15 nt, Human
cuacaugagguacug

SEQ ID NO: 2704891 - RNA, 20 nt, Human
cuaagugaaauaagccagac

SEQ ID NO: 2704892 - RNA, 23 nt, Human
cuaagugaaauaagccagacauc

SEQ ID NO: 2704893 - RNA, 15 nt, Human
cgacagugagacucu

SEQ ID NO: 2704894 - RNA, 16 nt, Human
cgacagugagacucug

SEQ ID NO: 2704895 - RNA, 17 nt, Human
cccuucuuuccacagaa

SEQ ID NO: 2704896 - RNA, 13 nt, Human
cccuucucuguau

SEQ ID NO: 2704897 - RNA, 24 nt, Human
ccguagacgugcacgcacacuguc

SEQ ID NO: 2704898 - RNA, 16 nt, Human
ccguagguuauuuuca

SEQ ID NO: 2704899 - RNA, 20 nt, Human
ccucauguccacugguucuu

SEQ ID NO: 2704900 - RNA, 15 nt, Human
ccucauguccacugg

SEQ ID NO: 2704901 - RNA, 13 nt, Human
ccucugcuugcca

SEQ ID NO: 2704902 - RNA, 15 nt, Human
ccagauccuggaaau

SEQ ID NO: 2704903 - RNA, 23 nt, Human
cccgggaggcagagguugcagug

SEQ ID NO: 2704904 - RNA, 22 nt, Human
cccauuguggucacaggaagua

SEQ ID NO: 2704905 - RNA, 23 nt, Human
cccauuguggucacaggaaguag

SEQ ID NO: 2704906 - RNA, 20 nt, Human
cccagccagcaguucagagc

SEQ ID NO: 2704907 - RNA, 17 nt, Human
cccagccagcaguucag

SEQ ID NO: 2704908 - RNA, 16 nt, Human
cccagccagcaguuca

SEQ ID NO: 2704909 - RNA, 20 nt, Human
cccauauuuguacaccaaua

SEQ ID NO: 2704910 - RNA, 20 nt, Human
cagccagacuggcacaguuu

SEQ ID NO: 2704911 - RNA, 22 nt, Human
cagcaguucagagcugcccucu

SEQ ID NO: 2704912 - RNA, 21 nt, Human
cagcaguucagagcugcccuc

SEQ ID NO: 2704913 - RNA, 20 nt, Human
cagcaguucagagcugcccu

SEQ ID NO: 2704914 - RNA, 19 nt, Human
cagcaguucagagcugccc

SEQ ID NO: 2704915 - RNA, 18 nt, Human
cagcaguucagagcugcc

SEQ ID NO: 2704916 - RNA, 19 nt, Human
cagccccgugggguuccuc

SEQ ID NO: 2704917 - RNA, 23 nt, Human
cagccugagcgacagugagacuc

SEQ ID NO: 2704918 - RNA, 22 nt, Human
cagggaggacgcucucuggccu

SEQ ID NO: 2704919 - RNA, 19 nt, Human
cagggaggacgcucucugg

SEQ ID NO: 2704920 - RNA, 16 nt, Human
cagcuuauucacaaga

SEQ ID NO: 2704921 - RNA, 19 nt, Human
caggaaaucaaauaugcaa

SEQ ID NO: 2704922 - RNA, 21 nt, Human
caggaaaucaaauaugcaaag

SEQ ID NO: 2704923 - RNA, 24 nt, Human
caggacagcccuucuuuccacaga

SEQ ID NO: 2704924 - RNA, 23 nt, Human
caggacagcccuucuuuccacag

SEQ ID NO: 2704925 - RNA, 18 nt, Human
ccaaauguucaucaauga

SEQ ID NO: 2704926 - RNA, 15 nt, Human
cauuaggauggcuag

SEQ ID NO: 2704927 - RNA, 17 nt, Human
cauagauucccugagca

SEQ ID NO: 2704928 - RNA, 18 nt, Human
cauagauucccugagcag

SEQ ID NO: 2704929 - RNA, 20 nt, Human
cauagcagcuuauucacaag

SEQ ID NO: 2704930 - RNA, 17 nt, Human
caucagcugcugaaaca

SEQ ID NO: 2704931 - RNA, 18 nt, Human
caucagcugcugaaacaa

SEQ ID NO: 2704932 - RNA, 15 nt, Human
caucagcugcugaaa

SEQ ID NO: 2704933 - RNA, 13 nt, Human
caucagcugcuga

SEQ ID NO: 2704934 - RNA, 20 nt, Human
caucagcuugcccuguuaaa

SEQ ID NO: 2704935 - RNA, 16 nt, Human
caugaauuaguuuuau

SEQ ID NO: 2704936 - RNA, 22 nt, Human
cacugguucuucuuggucucag

SEQ ID NO: 2704937 - RNA, 16 nt, Human
cacuugucaauaaaau

SEQ ID NO: 2704938 - RNA, 19 nt, Human
cacuuguguuuugcaagcc

SEQ ID NO: 2704939 - RNA, 22 nt, Human
cacuuguguuuugcaagccaga

SEQ ID NO: 2704940 - RNA, 21 nt, Human
cacugcagaagacaguauggc

SEQ ID NO: 2704941 - RNA, 20 nt, Human
cacuagggcagggacaggau

SEQ ID NO: 2704942 - RNA, 21 nt, Human
cacuagggcagggacaggaua

SEQ ID NO: 2704943 - RNA, 14 nt, Human
caaguccaagcaua

SEQ ID NO: 2704944 - RNA, 15 nt, Human
caauucuugccaaau

SEQ ID NO: 2704945 - RNA, 17 nt, Human
caaugcuguauuuuaaa

SEQ ID NO: 2704946 - RNA, 16 nt, Human
caaugcuguauuuuaa

SEQ ID NO: 2704947 - RNA, 15 nt, Human
caaugcuguauuuua

SEQ ID NO: 2704948 - RNA, 18 nt, Human
cacaagacugcacaucaa

SEQ ID NO: 2704949 - RNA, 22 nt, Human
cacacaugaaguccaagcauuu

SEQ ID NO: 2704950 - RNA, 17 nt, Human
cacacaugaaguccaag

SEQ ID NO: 2704951 - RNA, 21 nt, Human
cacagccucuuagaugcaguu

SEQ ID NO: 2704952 - RNA, 17 nt, Human
cacagccucuuagaugc

SEQ ID NO: 2704953 - RNA, 14 nt, Human
auuguaaaauggug

SEQ ID NO: 2704954 - RNA, 13 nt, Human
auuguaaaauggu

SEQ ID NO: 2704955 - RNA, 23 nt, Human
auuguaauaggcguaacuaauuu

SEQ ID NO: 2704956 - RNA, 19 nt, Human
auucauagcagcuuauuca

SEQ ID NO: 2704957 - RNA, 22 nt, Human
auucauagcagcuuauucacaa

SEQ ID NO: 2704958 - RNA, 18 nt, Human
auuaugaauuacauuugu

SEQ ID NO: 2704959 - RNA, 19 nt, Human
auucacaagacccaaaagg

SEQ ID NO: 2704960 - RNA, 16 nt, Human
auuagggagagaagau

SEQ ID NO: 2704961 - RNA, 17 nt, Human
auuaugaauuacauuug

SEQ ID NO: 2704962 - RNA, 14 nt, Human
auuaugaauuacau

SEQ ID NO: 2704963 - RNA, 17 nt, Human
auuuuauagcuacuaau

SEQ ID NO: 2704964 - RNA, 19 nt, Human
auuuuauagcuacuaauuu

SEQ ID NO: 2704965 - RNA, 17 nt, Human
auuugcucauggaauug

SEQ ID NO: 2704966 - RNA, 14 nt, Human
auuugcucauggaa

SEQ ID NO: 2704967 - RNA, 13 nt, Human
caaacccaguguu

SEQ ID NO: 2704968 - RNA, 15 nt, Human
caaaaggcagaagca

SEQ ID NO: 2704969 - RNA, 20 nt, Human
caaaaaaaaaaaaaaauuag

SEQ ID NO: 2704970 - RNA, 20 nt, Human
caaagcacugacuucuaagu

SEQ ID NO: 2704971 - RNA, 22 nt, Human
caaagcacugacuucuaaguaa

SEQ ID NO: 2704972 - RNA, 23 nt, Human
caacacgagcaggcuacugucag

SEQ ID NO: 2704973 - RNA, 19 nt, Human
augagagacacacugaaga

SEQ ID NO: 2704974 - RNA, 17 nt, Human
augagagacacacugaa

SEQ ID NO: 2704975 - RNA, 14 nt, Human
augagagacacacu

SEQ ID NO: 2704976 - RNA, 13 nt, Human
augagagacacac

SEQ ID NO: 2704977 - RNA, 17 nt, Human
uuguauaaaauaauuuu

SEQ ID NO: 2704978 - RNA, 16 nt, Human
uuguaucacaaaucuu

SEQ ID NO: 2704979 - RNA, 15 nt, Human
uuguauaaaauaauu

SEQ ID NO: 2704980 - RNA, 16 nt, Human
uuguauaaaauaauuu

SEQ ID NO: 2704981 - RNA, 18 nt, Human
augaagauguagaggaga

SEQ ID NO: 2704982 - RNA, 13 nt, Human
augaaugaauggc

SEQ ID NO: 2704983 - RNA, 17 nt, Human
augaaauauuauguuaa

SEQ ID NO: 2704984 - RNA, 13 nt, Human
augaaauauuaug

SEQ ID NO: 2704985 - RNA, 18 nt, Human
augaaauauuauguuaaa

SEQ ID NO: 2704986 - RNA, 15 nt, Human
augaaagcagggacu

SEQ ID NO: 2704987 - RNA, 13 nt, Human
aucuuuuucuaac

SEQ ID NO: 2704988 - RNA, 18 nt, Human
uugauggugguauguuuu

SEQ ID NO: 2704989 - RNA, 19 nt, Human
uugauggugguauguuuuc

SEQ ID NO: 2704990 - RNA, 23 nt, Human
aucucauuuccaagcaaguauua

SEQ ID NO: 2704991 - RNA, 21 nt, Human
aucucauuuccaagcaaguau

SEQ ID NO: 2704992 - RNA, 13 nt, Human
aucucaauauuuc

SEQ ID NO: 2704993 - RNA, 13 nt, Human
uugcccuguuaaa

SEQ ID NO: 2704994 - RNA, 22 nt, Human
uuuagcuggaaaaguauguuag

SEQ ID NO: 2704995 - RNA, 20 nt, Human
uuuagcuggaaaaguauguu

SEQ ID NO: 2704996 - RNA, 13 nt, Human
uuuauauaagcuu

SEQ ID NO: 2704997 - RNA, 15 nt, Human
augcuagaacucccu

SEQ ID NO: 2704998 - RNA, 16 nt, Human
augcuagaacucccuu

SEQ ID NO: 2704999 - RNA, 19 nt, Human
augcuagaacucccuuuca

SEQ ID NO: 2705000 - RNA, 22 nt, Human
augcugucuacacuaagagaga

SEQ ID NO: 2705001 - RNA, 20 nt, Human
auggcuaguaucaaaagaaa

SEQ ID NO: 2705002 - RNA, 17 nt, Human
augcaguucugaagaag

SEQ ID NO: 2705003 - RNA, 15 nt, Human
augcaguucugaaga

SEQ ID NO: 2705004 - RNA, 19 nt, Human
augcaguucugaagaagau

SEQ ID NO: 2705005 - RNA, 18 nt, Human
augcaguucugaagaaga

SEQ ID NO: 2705006 - RNA, 15 nt, Human
augccacuaaauuga

SEQ ID NO: 2705007 - RNA, 17 nt, Human
augccacuaaauugaca

SEQ ID NO: 2705008 - RNA, 14 nt, Human
uuguuuucauuauc

SEQ ID NO: 2705009 - RNA, 15 nt, Human
augcaaagcacugac

SEQ ID NO: 2705010 - RNA, 12 nt, Human
augauucccagc

SEQ ID NO: 2705011 - RNA, 22 nt, Human
augauuaugaauuacauuugua

SEQ ID NO: 2705012 - RNA, 21 nt, Human
augagagacacacugaagaag

SEQ ID NO: 2705013 - RNA, 20 nt, Human
augagagacacacugaagaa

SEQ ID NO: 2705014 - RNA, 23 nt, Human
augagagacacacugaagaagca

SEQ ID NO: 2705015 - RNA, 23 nt, Human
uugugugaaagguacuucaaauc

SEQ ID NO: 2705016 - RNA, 19 nt, Human
uugaaauauugacuuuuua

SEQ ID NO: 2705017 - RNA, 14 nt, Human
auccauacauuugu

SEQ ID NO: 2705018 - RNA, 20 nt, Human
aucauuucugcaucagcugc

SEQ ID NO: 2705019 - RNA, 13 nt, Human
uucuauaauuuaa

SEQ ID NO: 2705020 - RNA, 14 nt, Human
uucuauaauuuaaa

SEQ ID NO: 2705021 - RNA, 21 nt, Human
uucuaaguaaaaccacagcag

SEQ ID NO: 2705022 - RNA, 19 nt, Human
uucuaaguaaaaccacagc

SEQ ID NO: 2705023 - RNA, 20 nt, Human
uucuaaguaaaaccacagca

SEQ ID NO: 2705024 - RNA, 17 nt, Human
uucuaaguaaaaccaca

SEQ ID NO: 2705025 - RNA, 20 nt, Human
aucaaauaugcaaagcacug

SEQ ID NO: 2705026 - RNA, 12 nt, Human
uucccaaauuuc

SEQ ID NO: 2705027 - RNA, 18 nt, Human
uucccaacuccagaaagu

SEQ ID NO: 2705028 - RNA, 18 nt, Human
uucaaacagucucaggaa

SEQ ID NO: 2705029 - RNA, 14 nt, Human
uucaaacauauaua

SEQ ID NO: 2705030 - RNA, 22 nt, Human
auaggaauugacccacaagaaa

SEQ ID NO: 2705031 - RNA, 17 nt, Human
auaggcguaacuaauuu

SEQ ID NO: 2705032 - RNA, 22 nt, Human
uucacaagacccaaaaggcaga

SEQ ID NO: 2705033 - RNA, 23 nt, Human
uucacaagacccaaaaggcagaa

SEQ ID NO: 2705034 - RNA, 20 nt, Human
auaguuguaccgcaauguga

SEQ ID NO: 2705035 - RNA, 17 nt, Human
auauaacaaugcuguau

SEQ ID NO: 2705036 - RNA, 14 nt, Human
auauauaacaaugc

SEQ ID NO: 2705037 - RNA, 18 nt, Human
auuuguaguguuggagaa

SEQ ID NO: 2705038 - RNA, 23 nt, Human
auuugguaaggggaauugaggac

SEQ ID NO: 2705039 - RNA, 22 nt, Human
auuuauuacuguaagaaaauau

SEQ ID NO: 2705040 - RNA, 15 nt, Human
auuuguaucacaaau

SEQ ID NO: 2705041 - RNA, 21 nt, Human
auuuguauaaaauaauuuuua

SEQ ID NO: 2705042 - RNA, 16 nt, Human
auuuuaauaauguuuc

SEQ ID NO: 2705043 - RNA, 15 nt, Human
auuuuaauaauguuu

SEQ ID NO: 2705044 - RNA, 14 nt, Human
auuuuaauaauguu

SEQ ID NO: 2705045 - RNA, 21 nt, Human
auugacccacaagaaaugaaa

SEQ ID NO: 2705046 - RNA, 20 nt, Human
auugacacuuaaaaaugguu

SEQ ID NO: 2705047 - RNA, 13 nt, Human
auugugccccugc

SEQ ID NO: 2705048 - RNA, 14 nt, Human
auuguauuacaaau

SEQ ID NO: 2705049 - RNA, 19 nt, Human
auuuaaagcuuauuaaaac

SEQ ID NO: 2705050 - RNA, 16 nt, Human
auuuacaaaugggaaa

SEQ ID NO: 2705051 - RNA, 20 nt, Human
auuccacuuauaggaauuga

SEQ ID NO: 2705052 - RNA, 14 nt, Human
auucaaacagucuc

SEQ ID NO: 2705053 - RNA, 15 nt, Human
auucaaacagucuca

SEQ ID NO: 2705054 - RNA, 13 nt, Human
auuacauuuguau

SEQ ID NO: 2705055 - RNA, 20 nt, Human
auuacauuuguauaaaauaa

SEQ ID NO: 2705056 - RNA, 15 nt, Human
auuacauuuguauaa

SEQ ID NO: 2705057 - RNA, 23 nt, Human
uuuuuuaaaaaagaaacauuugg

SEQ ID NO: 2705058 - RNA, 15 nt, Human
auuaaguaaugauaa

SEQ ID NO: 2705059 - RNA, 13 nt, Human
auuaaguaaugau

SEQ ID NO: 2705060 - RNA, 16 nt, Human
auuauauuuacaaaug

SEQ ID NO: 2705061 - RNA, 20 nt, Human
auuauuaccuuacagaaguu

SEQ ID NO: 2705062 - RNA, 18 nt, Human
auuaucucaaaacugcac

SEQ ID NO: 2705063 - RNA, 23 nt, Human
auuaucucaaaacugcacuguca

SEQ ID NO: 2705064 - RNA, 17 nt, Human
auuauauuuacaaaugg

SEQ ID NO: 2705065 - RNA, 14 nt, Human
uuuuauaauuuugu

SEQ ID NO: 2705066 - RNA, 23 nt, Human
uuuuauggaggcuuugcauagau

SEQ ID NO: 2705067 - RNA, 19 nt, Human
uuuuauggcacuaguauuu

SEQ ID NO: 2705068 - RNA, 19 nt, Human
auguucaucaaugaaugaa

SEQ ID NO: 2705069 - RNA, 15 nt, Human
auguugacaugggac

SEQ ID NO: 2705070 - RNA, 16 nt, Human
auuaaaagaauauuuu

SEQ ID NO: 2705071 - RNA, 18 nt, Human
auguuucaaacauauaua

SEQ ID NO: 2705072 - RNA, 21 nt, Human
auguuucaaacauauauaaca

SEQ ID NO: 2705073 - RNA, 13 nt, Human
uuuuaaaaaagaa

SEQ ID NO: 2705074 - RNA, 15 nt, Human
uuuuaaaagaaugau

SEQ ID NO: 2705075 - RNA, 14 nt, Human
uuuuaaaagaauga

SEQ ID NO: 2705076 - RNA, 12 nt, Human
uuugcucaugga

SEQ ID NO: 2705077 - RNA, 11 nt, Human
uuugcucaugg

SEQ ID NO: 2705078 - RNA, 15 nt, Human
auggcuauaggugcu

SEQ ID NO: 2705079 - RNA, 13 nt, Human
uuugcucauggaa

SEQ ID NO: 2705080 - RNA, 15 nt, Human
auaaauaguuuauga

SEQ ID NO: 2705081 - RNA, 14 nt, Human
auaaauaaaaauaa

SEQ ID NO: 2705082 - RNA, 13 nt, Human
auaaauaaaaaua

SEQ ID NO: 2705083 - RNA, 22 nt, Human
auaacgauaaaagacagugaaa

SEQ ID NO: 2705084 - RNA, 18 nt, Human
auaauccuaaacauauga

SEQ ID NO: 2705085 - RNA, 14 nt, Human
aguuuaaauuguaa

SEQ ID NO: 2705086 - RNA, 13 nt, Human
uguuucaaacaua

SEQ ID NO: 2705087 - RNA, 12 nt, Human
auaaaauaauuu

SEQ ID NO: 2705088 - RNA, 22 nt, Human
auaaaauaauuuuuauauuuga

SEQ ID NO: 2705089 - RNA, 19 nt, Human
aguuuucugagaaagacua

SEQ ID NO: 2705090 - RNA, 18 nt, Human
aguuuucugagaaagacu

SEQ ID NO: 2705091 - RNA, 23 nt, Human
aguuuucugagaaagacuauuca

SEQ ID NO: 2705092 - RNA, 19 nt, Human
aguucggugagcuacaaau

SEQ ID NO: 2705093 - RNA, 16 nt, Human
aguguuggagaagaac

SEQ ID NO: 2705094 - RNA, 14 nt, Human
aguguuggagaaga

SEQ ID NO: 2705095 - RNA, 18 nt, Human
aguguuggagaagaacug

SEQ ID NO: 2705096 - RNA, 17 nt, Human
aguguuggagaagaacu

SEQ ID NO: 2705097 - RNA, 21 nt, Human
agugcaaauugucacaggaca

SEQ ID NO: 2705098 - RNA, 18 nt, Human
agugcaaauugucacagg

SEQ ID NO: 2705099 - RNA, 22 nt, Human
agugcaaauugucacaggacag

SEQ ID NO: 2705100 - RNA, 21 nt, Human
agugccuguaaucacagcuac

SEQ ID NO: 2705101 - RNA, 23 nt, Human
agguacuucaaauccuugaagau

SEQ ID NO: 2705102 - RNA, 17 nt, Human
aggguuaugauuaagua

SEQ ID NO: 2705103 - RNA, 20 nt, Human
ugguaaggggaauugaggac

SEQ ID NO: 2705104 - RNA, 17 nt, Human
agggcagggacaggaua

SEQ ID NO: 2705105 - RNA, 23 nt, Human
agucagacuggauaguccgucuc

SEQ ID NO: 2705106 - RNA, 15 nt, Human
agucaggaaagagaa

SEQ ID NO: 2705107 - RNA, 16 nt, Human
agucaggaaagagaac

SEQ ID NO: 2705108 - RNA, 23 nt, Human
ugucauuugcuggagcucugccc

SEQ ID NO: 2705109 - RNA, 15 nt, Human
aguauuucuaugaaa

SEQ ID NO: 2705110 - RNA, 13 nt, Human
aguauuucuauga

SEQ ID NO: 2705111 - RNA, 22 nt, Human
aguauuucuaugaaauauuaug

SEQ ID NO: 2705112 - RNA, 20 nt, Human
ugucaaucagccuaguugau

SEQ ID NO: 2705113 - RNA, 21 nt, Human
ugucaauaaaauccauacauu

SEQ ID NO: 2705114 - RNA, 18 nt, Human
uguagaggagaaacugga

SEQ ID NO: 2705115 - RNA, 16 nt, Human
uguagaggagaaacug

SEQ ID NO: 2705116 - RNA, 15 nt, Human
aguaaaaccacagca

SEQ ID NO: 2705117 - RNA, 19 nt, Human
aguagauaggccaugggca

SEQ ID NO: 2705118 - RNA, 11 nt, Human
ugcucauggaa

SEQ ID NO: 2705119 - RNA, 14 nt, Human
ugcucauggaauug

SEQ ID NO: 2705120 - RNA, 12 nt, Human
aggaaauauuua

SEQ ID NO: 2705121 - RNA, 23 nt, Human
aggaaaucaaauaugcaaagcac

SEQ ID NO: 2705122 - RNA, 13 nt, Human
aggaaauauuuau

SEQ ID NO: 2705123 - RNA, 17 nt, Human
aggacacugauaugggu

SEQ ID NO: 2705124 - RNA, 22 nt, Human
ugcuguauuuuaaaagaaugau

SEQ ID NO: 2705125 - RNA, 21 nt, Human
ugcuguauuuuaaaagaauga

SEQ ID NO: 2705126 - RNA, 13 nt, Human
ugcuguauuuuaa

SEQ ID NO: 2705127 - RNA, 17 nt, Human
agcuugaaacugagaug

SEQ ID NO: 2705128 - RNA, 20 nt, Human
ugcuacaaaaacacagcaag

SEQ ID NO: 2705129 - RNA, 15 nt, Human
ugcuacaaaaacaca

SEQ ID NO: 2705130 - RNA, 16 nt, Human
ugcuacaaaaacacag

SEQ ID NO: 2705131 - RNA, 17 nt, Human
ugcuacaaaaacacagc

SEQ ID NO: 2705132 - RNA, 18 nt, Human
ugcuacaaaaacacagca

SEQ ID NO: 2705133 - RNA, 19 nt, Human
ugcuacaaaaacacagcaa

SEQ ID NO: 2705134 - RNA, 16 nt, Human
agcugccuccccuccu

SEQ ID NO: 2705135 - RNA, 15 nt, Human
agcugccuccccucc

SEQ ID NO: 2705136 - RNA, 22 nt, Human
agcugcccucuccugggcagcu

SEQ ID NO: 2705137 - RNA, 16 nt, Human
agcuguucacagccag

SEQ ID NO: 2705138 - RNA, 19 nt, Human
agcuguucacagccagacu

SEQ ID NO: 2705139 - RNA, 18 nt, Human
uggcacaguuuucugaga

SEQ ID NO: 2705140 - RNA, 19 nt, Human
uggcacaguuuucugagaa

SEQ ID NO: 2705141 - RNA, 13 nt, Human
uggaaaggcagcu

SEQ ID NO: 2705142 - RNA, 14 nt, Human
uggagaagaacuga

SEQ ID NO: 2705143 - RNA, 13 nt, Human
uggagaagaacug

SEQ ID NO: 2705144 - RNA, 14 nt, Human
uggagcucguggaa

SEQ ID NO: 2705145 - RNA, 20 nt, Human
agccuuggggcugaugcagu

SEQ ID NO: 2705146 - RNA, 17 nt, Human
agcuacuugggaggcug

SEQ ID NO: 2705147 - RNA, 18 nt, Human
agcuacuugggaggcuga

SEQ ID NO: 2705148 - RNA, 18 nt, Human
agccccgugggguuccuc

SEQ ID NO: 2705149 - RNA, 18 nt, Human
agcccauggcacucuaug

SEQ ID NO: 2705150 - RNA, 20 nt, Human
agccucauguccacugguuc

SEQ ID NO: 2705151 - RNA, 15 nt, Human
agccucauguccacu

SEQ ID NO: 2705152 - RNA, 22 nt, Human
agccugaaagaggaaugaagua

SEQ ID NO: 2705153 - RNA, 19 nt, Human
agccagacuggcacaguuu

SEQ ID NO: 2705154 - RNA, 14 nt, Human
agccagacuggcac

SEQ ID NO: 2705155 - RNA, 14 nt, Human
ugaugaucuuuaaa

SEQ ID NO: 2705156 - RNA, 17 nt, Human
ugaugaucuuuaaaaua

SEQ ID NO: 2705157 - RNA, 12 nt, Human
ugauuaaaccaa

SEQ ID NO: 2705158 - RNA, 14 nt, Human
ugauuaccagggac

SEQ ID NO: 2705159 - RNA, 17 nt, Human
ugaugaagaaguugaua

SEQ ID NO: 2705160 - RNA, 18 nt, Human
ugagugucuuaauuaaaa

SEQ ID NO: 2705161 - RNA, 23 nt, Human
agcauaaauguugacaugggaca

SEQ ID NO: 2705162 - RNA, 22 nt, Human
ugaguaacugauuuguaacaag

SEQ ID NO: 2705163 - RNA, 17 nt, Human
agcauuguaaaugugcu

SEQ ID NO: 2705164 - RNA, 18 nt, Human
agcauuguaaaugugcuu

SEQ ID NO: 2705165 - RNA, 17 nt, Human
agcaugucgucaaagcu

SEQ ID NO: 2705166 - RNA, 20 nt, Human
agcaugucgucaaagcugaa

SEQ ID NO: 2705167 - RNA, 12 nt, Human
ugauaugggucu

SEQ ID NO: 2705168 - RNA, 19 nt, Human
ugaaacucguuaauuugua

SEQ ID NO: 2705169 - RNA, 22 nt, Human
ugaaacugagaugugaacacau

SEQ ID NO: 2705170 - RNA, 22 nt, Human
ugaaaaaguucugcagauaaac

SEQ ID NO: 2705171 - RNA, 20 nt, Human
ugaaaagcuccauuuuuagu

SEQ ID NO: 2705172 - RNA, 23 nt, Human
agagcaguuugguuucuagcaug

SEQ ID NO: 2705173 - RNA, 21 nt, Human
agagcaguuugguuucuagca

SEQ ID NO: 2705174 - RNA, 17 nt, Human
agacaucaacagauaaa

SEQ ID NO: 2705175 - RNA, 18 nt, Human
agacaucaacagauaaau

SEQ ID NO: 2705176 - RNA, 14 nt, Human
agacauagaauuaa

SEQ ID NO: 2705177 - RNA, 21 nt, Human
agacauagaauuaacacauga

SEQ ID NO: 2705178 - RNA, 14 nt, Human
agaaucacuugaac

SEQ ID NO: 2705179 - RNA, 15 nt, Human
ucuucacaacagauu

SEQ ID NO: 2705180 - RNA, 15 nt, Human
agacuauucaaacag

SEQ ID NO: 2705181 - RNA, 12 nt, Human
agacuauucaaa

SEQ ID NO: 2705182 - RNA, 14 nt, Human
agacuauucaaaca

SEQ ID NO: 2705183 - RNA, 17 nt, Human
ugacacuuaaaaauggu

SEQ ID NO: 2705184 - RNA, 16 nt, Human
ugacacuuaaaaaugg

SEQ ID NO: 2705185 - RNA, 16 nt, Human
agaugcaguucugaag

SEQ ID NO: 2705186 - RNA, 24 nt, Human
ugacuucuaaguaaaaccacagca

SEQ ID NO: 2705187 - RNA, 22 nt, Human
ugacuucuaaguaaaaccacag

SEQ ID NO: 2705188 - RNA, 23 nt, Human
ugacuucuaaguaaaaccacagc

SEQ ID NO: 2705189 - RNA, 15 nt, Human
ugacuucuaaguaaa

SEQ ID NO: 2705190 - RNA, 15 nt, Human
agauucccugagcag

SEQ ID NO: 2705191 - RNA, 23 nt, Human
agcaacgcaggcccccaggugcc

SEQ ID NO: 2705192 - RNA, 15 nt, Human
ugaauacuuuauaaa

SEQ ID NO: 2705193 - RNA, 10 nt, Human
ucuggccuuc

SEQ ID NO: 2705194 - RNA, 14 nt, Human
agaagcuccaggua

SEQ ID NO: 2705195 - RNA, 13 nt, Human
agaaguugauaug

SEQ ID NO: 2705196 - RNA, 17 nt, Human
agaacucccuuucaaca

SEQ ID NO: 2705197 - RNA, 15 nt, Human
agaacucccuuucaa

SEQ ID NO: 2705198 - RNA, 16 nt, Human
agaacucccuuucaac

SEQ ID NO: 2705199 - RNA, 20 nt, Human
ucugcccauccugccccuga

SEQ ID NO: 2705200 - RNA, 19 nt, Human
agaagcaccaaucaugaau

SEQ ID NO: 2705201 - RNA, 19 nt, Human
agaagcaacccaaauguuc

SEQ ID NO: 2705202 - RNA, 23 nt, Human
agaaacuuaagguuaccuuuguu

SEQ ID NO: 2705203 - RNA, 16 nt, Human
agaaaacaaggaugaa

SEQ ID NO: 2705204 - RNA, 16 nt, Human
agaaacacaacuauau

SEQ ID NO: 2705205 - RNA, 16 nt, Human
agaaagacuauucaaa

SEQ ID NO: 2705206 - RNA, 20 nt, Human
agaaagcagaacagugauua

SEQ ID NO: 2705207 - RNA, 17 nt, Human
agaaagcagaacaguga

SEQ ID NO: 2705208 - RNA, 18 nt, Human
agaaagcagaacagugau

SEQ ID NO: 2705209 - RNA, 20 nt, Human
acuuccagauccuggaaauc

SEQ ID NO: 2705210 - RNA, 13 nt, Human
ucuauaauuuaaa

SEQ ID NO: 2705211 - RNA, 12 nt, Human
ucuagcaugaag

SEQ ID NO: 2705212 - RNA, 18 nt, Human
acuucuaaguaaaaccac

SEQ ID NO: 2705213 - RNA, 19 nt, Human
acuucuaaguaaaaccaca

SEQ ID NO: 2705214 - RNA, 13 nt, Human
acuucuaaguaaa

SEQ ID NO: 2705215 - RNA, 21 nt, Human
acuucuaaguaaaaccacagc

SEQ ID NO: 2705216 - RNA, 17 nt, Human
ucucaaaacugcacugu

SEQ ID NO: 2705217 - RNA, 23 nt, Human
acuugaacccgggaggcagaggu

SEQ ID NO: 2705218 - RNA, 21 nt, Human
acuugaacccgggaggcagag

SEQ ID NO: 2705219 - RNA, 22 nt, Human
acugaagaagcaccaaucauga

SEQ ID NO: 2705220 - RNA, 22 nt, Human
acugucagcuccccucggagaa

SEQ ID NO: 2705221 - RNA, 23 nt, Human
acugucagcuccccucggagaag

SEQ ID NO: 2705222 - RNA, 17 nt, Human
ucuaccaaaaaucucaa

SEQ ID NO: 2705223 - RNA, 13 nt, Human
acuguggguagac

SEQ ID NO: 2705224 - RNA, 16 nt, Human
acccaaauguucauca

SEQ ID NO: 2705225 - RNA, 20 nt, Human
acccaaauguucaucaauga

SEQ ID NO: 2705226 - RNA, 12 nt, Human
ucagcccucaga

SEQ ID NO: 2705227 - RNA, 13 nt, Human
ucagcccucagaa

SEQ ID NO: 2705228 - RNA, 14 nt, Human
ucagagcugcccuc

SEQ ID NO: 2705229 - RNA, 13 nt, Human
ucagagcugcccu

SEQ ID NO: 2705230 - RNA, 16 nt, Human
ucagagcugcccucuc

SEQ ID NO: 2705231 - RNA, 15 nt, Human
ucagagcugcccucu

SEQ ID NO: 2705232 - RNA, 17 nt, Human
ucagagcugcccucucc

SEQ ID NO: 2705233 - RNA, 13 nt, Human
ucaguagucagac

SEQ ID NO: 2705234 - RNA, 13 nt, Human
ucaaacagucuca

SEQ ID NO: 2705235 - RNA, 20 nt, Human
ucaaacagucucaggaaauc

SEQ ID NO: 2705236 - RNA, 21 nt, Human
ucaaacagucucaggaaauca

SEQ ID NO: 2705237 - RNA, 22 nt, Human
uauuuuaauaauguuucaaaca

SEQ ID NO: 2705238 - RNA, 19 nt, Human
uauuuuaauaauguuucaa

SEQ ID NO: 2705239 - RNA, 14 nt, Human
uauuuuaaaagaau

SEQ ID NO: 2705240 - RNA, 18 nt, Human
uauuuuaaaagaaugauu

SEQ ID NO: 2705241 - RNA, 14 nt, Human
accaacacgagcag

SEQ ID NO: 2705242 - RNA, 19 nt, Human
accaacacgagcaggcuac

SEQ ID NO: 2705243 - RNA, 16 nt, Human
accacaagacugcaca

SEQ ID NO: 2705244 - RNA, 22 nt, Human
ucacagcuuauuuccucauuuu

SEQ ID NO: 2705245 - RNA, 17 nt, Human
ucacagccagacuggca

SEQ ID NO: 2705246 - RNA, 23 nt, Human
ucacagccagacuggcacaguuu

SEQ ID NO: 2705247 - RNA, 16 nt, Human
ucacagaccuuugaac

SEQ ID NO: 2705248 - RNA, 12 nt, Human
ucaauuuaaaaa

SEQ ID NO: 2705249 - RNA, 13 nt, Human
ucaauuuaaaaaa

SEQ ID NO: 2705250 - RNA, 23 nt, Human
ucaauauuucagauaaucacaau

SEQ ID NO: 2705251 - RNA, 22 nt, Human
uccaugaagauguagaggagaa

SEQ ID NO: 2705252 - RNA, 14 nt, Human
uccagugagacagc

SEQ ID NO: 2705253 - RNA, 15 nt, Human
acgcucucuggccuu

SEQ ID NO: 2705254 - RNA, 16 nt, Human
acgcucucuggccuuc

SEQ ID NO: 2705255 - RNA, 17 nt, Human
acgcucucuggccuucg

SEQ ID NO: 2705256 - RNA, 12 nt, Human
accugagcccca

SEQ ID NO: 2705257 - RNA, 17 nt, Human
accugagccccaaaagg

SEQ ID NO: 2705258 - RNA, 16 nt, Human
ucauaauaaguugcau

SEQ ID NO: 2705259 - RNA, 17 nt, Human
uccucuccccaugaugu

SEQ ID NO: 2705260 - RNA, 22 nt, Human
uccugaaaacccuugccaugug

SEQ ID NO: 2705261 - RNA, 21 nt, Human
uccugaaaacccuugccaugu

SEQ ID NO: 2705262 - RNA, 18 nt, Human
acuccagaaagugacaag

SEQ ID NO: 2705263 - RNA, 14 nt, Human
acuccagaaaguga

SEQ ID NO: 2705264 - RNA, 14 nt, Human
ucccuccaccuccc

SEQ ID NO: 2705265 - RNA, 17 nt, Human
ucccuccaccucccugc

SEQ ID NO: 2705266 - RNA, 15 nt, Human
ucccuccaccucccu

SEQ ID NO: 2705267 - RNA, 19 nt, Human
ucccuccaccucccugcaa

SEQ ID NO: 2705268 - RNA, 21 nt, Human
acuccaaacugacucuuaaga

SEQ ID NO: 2705269 - RNA, 20 nt, Human
acuagaguuuagcuggaaaa

SEQ ID NO: 2705270 - RNA, 24 nt, Human
uccccuccucugcuugccaucccu

SEQ ID NO: 2705271 - RNA, 18 nt, Human
uccccuccucugcuugcc

SEQ ID NO: 2705272 - RNA, 15 nt, Human
uccccuccucugcuu

SEQ ID NO: 2705273 - RNA, 14 nt, Human
uccccuccucugcu

SEQ ID NO: 2705274 - RNA, 13 nt, Human
acuauucaaacag

SEQ ID NO: 2705275 - RNA, 14 nt, Human
acuauucaaacagu

SEQ ID NO: 2705276 - RNA, 16 nt, Human
acuauucaaacagucu

SEQ ID NO: 2705277 - RNA, 18 nt, Human
acuauucaaacagucuca

SEQ ID NO: 2705278 - RNA, 13 nt, Human
acacaacuauauu

SEQ ID NO: 2705279 - RNA, 13 nt, Human
uaggauguugaaa

SEQ ID NO: 2705280 - RNA, 14 nt, Human
uagaggguguguaa

SEQ ID NO: 2705281 - RNA, 14 nt, Human
acaaaaacacagca

SEQ ID NO: 2705282 - RNA, 15 nt, Human
acaaaaacacagcaa

SEQ ID NO: 2705283 - RNA, 13 nt, Human
acaaaaacacagc

SEQ ID NO: 2705284 - RNA, 13 nt, Human
uagacacacauga

SEQ ID NO: 2705285 - RNA, 17 nt, Human
uagaacucccuuucaac

SEQ ID NO: 2705286 - RNA, 16 nt, Human
uagaacucccuuucaa

SEQ ID NO: 2705287 - RNA, 15 nt, Human
uagaaacacaacuau

SEQ ID NO: 2705288 - RNA, 18 nt, Human
acagcaagggugauggga

SEQ ID NO: 2705289 - RNA, 19 nt, Human
acagcccuucuuuccacag

SEQ ID NO: 2705290 - RNA, 23 nt, Human
acagcuguaugauucccagccag

SEQ ID NO: 2705291 - RNA, 20 nt, Human
acagcuguaugauucccagc

SEQ ID NO: 2705292 - RNA, 19 nt, Human
acagcuguaugauucccag

SEQ ID NO: 2705293 - RNA, 14 nt, Human
acagcuguaugauu

SEQ ID NO: 2705294 - RNA, 14 nt, Human
uaucacaaaucuua

SEQ ID NO: 2705295 - RNA, 16 nt, Human
uaucacaaaucuuaac

SEQ ID NO: 2705296 - RNA, 20 nt, Human
uaucacaaaucuuaacuuga

SEQ ID NO: 2705297 - RNA, 14 nt, Human
acagaccuuugaac

SEQ ID NO: 2705298 - RNA, 19 nt, Human
acagaaagcagaacaguga

SEQ ID NO: 2705299 - RNA, 12 nt, Human
uauaggaauuga

SEQ ID NO: 2705300 - RNA, 16 nt, Human
uauaggugcuacaaaa

SEQ ID NO: 2705301 - RNA, 13 nt, Human
acacucaaaucaa

SEQ ID NO: 2705302 - RNA, 18 nt, Human
acacucaaaucaagaaac

SEQ ID NO: 2705303 - RNA, 17 nt, Human
acacucaaaucaagaaa

SEQ ID NO: 2705304 - RNA, 13 nt, Human
aauuacauuugua

SEQ ID NO: 2705305 - RNA, 14 nt, Human
aauuacauuuguau

SEQ ID NO: 2705306 - RNA, 19 nt, Human
uaccagggacugaggggag

SEQ ID NO: 2705307 - RNA, 16 nt, Human
uaccaugccauuuaaa

SEQ ID NO: 2705308 - RNA, 13 nt, Human
aauguucaucaau

SEQ ID NO: 2705309 - RNA, 16 nt, Human
aauguucaucaaugaa

SEQ ID NO: 2705310 - RNA, 20 nt, Human
aauguucaucaaugaaugaa

SEQ ID NO: 2705311 - RNA, 23 nt, Human
aaugauuaugaauuacauuugua

SEQ ID NO: 2705312 - RNA, 22 nt, Human
aaugagagacacacugaagaag

SEQ ID NO: 2705313 - RNA, 16 nt, Human
aaugauuucauucaau

SEQ ID NO: 2705314 - RNA, 21 nt, Human
uaauuuuuauauuugaaauau

SEQ ID NO: 2705315 - RNA, 19 nt, Human
uaauuuuuauauuugaaau

SEQ ID NO: 2705316 - RNA, 18 nt, Human
uaauuuuuauauuugaaa

SEQ ID NO: 2705317 - RNA, 22 nt, Human
uaauuccguagguuauuuucag

SEQ ID NO: 2705318 - RNA, 17 nt, Human
uacagagacagaaagca

SEQ ID NO: 2705319 - RNA, 20 nt, Human
aauguaagggaaacugccag

SEQ ID NO: 2705320 - RNA, 21 nt, Human
aaugcuguauuuuaaaagaau

SEQ ID NO: 2705321 - RNA, 20 nt, Human
aaugcuguauuuuaaaagaa

SEQ ID NO: 2705322 - RNA, 22 nt, Human
aaugcuguauuuuaaaagaaug

SEQ ID NO: 2705323 - RNA, 21 nt, Human
uacaaaaaaaaaaaaaaauua

SEQ ID NO: 2705324 - RNA, 15 nt, Human
aauauuuauuuuaau

SEQ ID NO: 2705325 - RNA, 16 nt, Human
aaucagccuaguugau

SEQ ID NO: 2705326 - RNA, 15 nt, Human
uaagcaaaaugugau

SEQ ID NO: 2705327 - RNA, 21 nt, Human
uaagcaaaaugugauauguac

SEQ ID NO: 2705328 - RNA, 14 nt, Human
uaagcaaaauguga

SEQ ID NO: 2705329 - RNA, 18 nt, Human
uaagguuaccuuuguucc

SEQ ID NO: 2705330 - RNA, 13 nt, Human
uaaguaaaaccac

SEQ ID NO: 2705331 - RNA, 15 nt, Human
uaaguaaaaccacag

SEQ ID NO: 2705332 - RNA, 16 nt, Human
uaaguaaaaccacagc

SEQ ID NO: 2705333 - RNA, 17 nt, Human
uaaguaaaaccacagca

SEQ ID NO: 2705334 - RNA, 18 nt, Human
uaaguaaaaccacagcag

SEQ ID NO: 2705335 - RNA, 19 nt, Human
uaaguaaaaccacagcagu

SEQ ID NO: 2705336 - RNA, 20 nt, Human
uaaguaaugauaacuggaaa

SEQ ID NO: 2705337 - RNA, 20 nt, Human
aauccucaguuuuugugaaa

SEQ ID NO: 2705338 - RNA, 13 nt, Human
uaagaagugaaaa

SEQ ID NO: 2705339 - RNA, 21 nt, Human
uaacuuccuuggacucauuuu

SEQ ID NO: 2705340 - RNA, 19 nt, Human
aauagucaaauugugugaa

SEQ ID NO: 2705341 - RNA, 18 nt, Human
aauaccaugccauuuaaa

SEQ ID NO: 2705342 - RNA, 23 nt, Human
aauaccacaggaaccacaagacu

SEQ ID NO: 2705343 - RNA, 23 nt, Human
aauacaucccuuaccugggaaag

SEQ ID NO: 2705344 - RNA, 16 nt, Human
uaaaugugcuuuuaaa

SEQ ID NO: 2705345 - RNA, 13 nt, Human
aagcauuguaaau

SEQ ID NO: 2705346 - RNA, 16 nt, Human
aagcauuuagauguau

SEQ ID NO: 2705347 - RNA, 20 nt, Human
aagcucacagaccuuugaac

SEQ ID NO: 2705348 - RNA, 14 nt, Human
aagcuccagguaga

SEQ ID NO: 2705349 - RNA, 13 nt, Human
aagcuccagguag

SEQ ID NO: 2705350 - RNA, 20 nt, Human
guuauuauauuuacaaaugg

SEQ ID NO: 2705351 - RNA, 23 nt, Human
aagaggaaugaaguacucauaca

SEQ ID NO: 2705352 - RNA, 17 nt, Human
aagacugcauuauauuu

SEQ ID NO: 2705353 - RNA, 16 nt, Human
aagacugcacaucaaa

SEQ ID NO: 2705354 - RNA, 13 nt, Human
aagaugaaaauau

SEQ ID NO: 2705355 - RNA, 14 nt, Human
aagaugaaaauauu

SEQ ID NO: 2705356 - RNA, 13 nt, Human
aagauguagagga

SEQ ID NO: 2705357 - RNA, 20 nt, Human
uaaaauaauuuuuauauuug

SEQ ID NO: 2705358 - RNA, 20 nt, Human
uaaaagacagugaaagaaaa

SEQ ID NO: 2705359 - RNA, 16 nt, Human
uaaaagaauauuuuaa

SEQ ID NO: 2705360 - RNA, 23 nt, Human
uaaaagaauauuuuaacuuccuu

SEQ ID NO: 2705361 - RNA, 12 nt, Human
uaaaagaaugau

SEQ ID NO: 2705362 - RNA, 19 nt, Human
aaguaaugauaacuggaaa

SEQ ID NO: 2705363 - RNA, 14 nt, Human
aaguaaugauaacu

SEQ ID NO: 2705364 - RNA, 13 nt, Human
aaguauuagaaua

SEQ ID NO: 2705365 - RNA, 16 nt, Human
aagucuuucacauuua

SEQ ID NO: 2705366 - RNA, 22 nt, Human
aagucuuauauauuguagauaa

SEQ ID NO: 2705367 - RNA, 14 nt, Human
aagguacuucaaau

SEQ ID NO: 2705368 - RNA, 19 nt, Human
aagggugaugggaaagcau

SEQ ID NO: 2705369 - RNA, 13 nt, Human
aagguacuucaaa

SEQ ID NO: 2705370 - RNA, 21 nt, Human
guauaaaauaauuuuuauauu

SEQ ID NO: 2705371 - RNA, 15 nt, Human
guauaaaauaauuuu

SEQ ID NO: 2705372 - RNA, 16 nt, Human
guauauuuuauaucaa

SEQ ID NO: 2705373 - RNA, 16 nt, Human
aaauguaagggaaacu

SEQ ID NO: 2705374 - RNA, 17 nt, Human
guaguguuggagaagaa

SEQ ID NO: 2705375 - RNA, 20 nt, Human
guaguguuggagaagaacug

SEQ ID NO: 2705376 - RNA, 15 nt, Human
aaauggguuuuacug

SEQ ID NO: 2705377 - RNA, 14 nt, Human
aaauggguuuuacu

SEQ ID NO: 2705378 - RNA, 16 nt, Human
gucaaauugugugaaa

SEQ ID NO: 2705379 - RNA, 18 nt, Human
guauguacuucaugcugu

SEQ ID NO: 2705380 - RNA, 16 nt, Human
aacagauaaauaguuu

SEQ ID NO: 2705381 - RNA, 15 nt, Human
aacagugauuaccag

SEQ ID NO: 2705382 - RNA, 22 nt, Human
aacagugauuaccagggacuga

SEQ ID NO: 2705383 - RNA, 15 nt, Human
aacacagcaagggug

SEQ ID NO: 2705384 - RNA, 22 nt, Human
aacaaugcuguauuuuaaaaga

SEQ ID NO: 2705385 - RNA, 17 nt, Human
aacaaugcuguauuuua

SEQ ID NO: 2705386 - RNA, 16 nt, Human
aacacaacuauauugu

SEQ ID NO: 2705387 - RNA, 15 nt, Human
aacacaacuauauug

SEQ ID NO: 2705388 - RNA, 15 nt, Human
aacaaugcuguauuu

SEQ ID NO: 2705389 - RNA, 14 nt, Human
aacaaugcuguauu

SEQ ID NO: 2705390 - RNA, 12 nt, Human
aacaauaaaaga

SEQ ID NO: 2705391 - RNA, 20 nt, Human
aaauuuuuucucuaggaaau

SEQ ID NO: 2705392 - RNA, 21 nt, Human
gugagaugcuagaacucccuu

SEQ ID NO: 2705393 - RNA, 12 nt, Human
aacugaaaucau

SEQ ID NO: 2705394 - RNA, 19 nt, Human
aacugcacugucaagauga

SEQ ID NO: 2705395 - RNA, 19 nt, Human
aacuggacugguucaaaug

SEQ ID NO: 2705396 - RNA, 17 nt, Human
aacugggacaggggaga

SEQ ID NO: 2705397 - RNA, 17 nt, Human
gugaugggaaagcauug

SEQ ID NO: 2705398 - RNA, 18 nt, Human
aacuuccagauccuggaa

SEQ ID NO: 2705399 - RNA, 21 nt, Human
aacuucagcgguuuauauaag

SEQ ID NO: 2705400 - RNA, 18 nt, Human
aacccaaguccaagcaua

SEQ ID NO: 2705401 - RNA, 23 nt, Human
aacccaaauguucaucaaugaau

SEQ ID NO: 2705402 - RNA, 16 nt, Human
aacccgggaggcagag

SEQ ID NO: 2705403 - RNA, 18 nt, Human
aaccugagccccaaaagg

SEQ ID NO: 2705404 - RNA, 20 nt, Human
aaccugagccccaaaaggua

SEQ ID NO: 2705405 - RNA, 16 nt, Human
gucuuucacauuuaaa

SEQ ID NO: 2705406 - RNA, 18 nt, Human
aaccuugaaaacuuuaug

SEQ ID NO: 2705407 - RNA, 23 nt, Human
aacuaucucauuuccaagcaagu

SEQ ID NO: 2705408 - RNA, 21 nt, Human
aacuagaguuuagcuggaaaa

SEQ ID NO: 2705409 - RNA, 12 nt, Human
aacucauuucua

SEQ ID NO: 2705410 - RNA, 14 nt, Human
caaaacugcacugu

SEQ ID NO: 2705411 - RNA, 17 nt, Human
caaaacugcacugucaa

SEQ ID NO: 2705412 - RNA, 18 nt, Human
caaaacugcacugucaag

SEQ ID NO: 2705413 - RNA, 16 nt, Human
caaacugacucuuaag

SEQ ID NO: 2705414 - RNA, 21 nt, Human
caaacugacucuuaagaagac

SEQ ID NO: 2705415 - RNA, 17 nt, Human
caaacugacucuuaaga

SEQ ID NO: 2705416 - RNA, 15 nt, Human
caagaaaugaaagca

SEQ ID NO: 2705417 - RNA, 17 nt, Human
caagaaaugaaagcagg

SEQ ID NO: 2705418 - RNA, 19 nt, Human
caagaaaugaaagcaggga

SEQ ID NO: 2705419 - RNA, 14 nt, Human
caaauguucaucaa

SEQ ID NO: 2705420 - RNA, 18 nt, Human
caaauguucaucaaugaa

SEQ ID NO: 2705421 - RNA, 12 nt, Human
caaauaugcaaa

SEQ ID NO: 2705422 - RNA, 13 nt, Human
caaauaugcaaag

SEQ ID NO: 2705423 - RNA, 20 nt, Human
caaggaaaaaauaacaauga

SEQ ID NO: 2705424 - RNA, 18 nt, Human
caaggaaaaaauaacaau

SEQ ID NO: 2705425 - RNA, 19 nt, Human
caauagucaaauuguguga

SEQ ID NO: 2705426 - RNA, 17 nt, Human
caauagucaaauugugu

SEQ ID NO: 2705427 - RNA, 21 nt, Human
caagggugaugggaaagcauu

SEQ ID NO: 2705428 - RNA, 23 nt, Human
caagggugaugggaaagcauugu

SEQ ID NO: 2705429 - RNA, 13 nt, Human
cacacugaagaag

SEQ ID NO: 2705430 - RNA, 21 nt, Human
cacagcaguugaaaagacucc

SEQ ID NO: 2705431 - RNA, 19 nt, Human
cacagcaguugaaaagacu

SEQ ID NO: 2705432 - RNA, 17 nt, Human
cacagccagacuggcac

SEQ ID NO: 2705433 - RNA, 18 nt, Human
cacagccagacuggcaca

SEQ ID NO: 2705434 - RNA, 18 nt, Human
cacaagaaaugaaagcag

SEQ ID NO: 2705435 - RNA, 20 nt, Human
cacaagaaaugaaagcaggg

SEQ ID NO: 2705436 - RNA, 21 nt, Human
cacaagaaaugaaagcaggga

SEQ ID NO: 2705437 - RNA, 21 nt, Human
caauaucuuuuuuuuaauaaa

SEQ ID NO: 2705438 - RNA, 22 nt, Human
caauuuuucuuauuucauuucu

SEQ ID NO: 2705439 - RNA, 21 nt, Human
uguuaaaagaugaaaauauuu

SEQ ID NO: 2705440 - RNA, 22 nt, Human
ugugugaaagguacuucaaauc

SEQ ID NO: 2705441 - RNA, 21 nt, Human
ugugugaaagguacuucaaau

SEQ ID NO: 2705442 - RNA, 20 nt, Human
ugugugaaagguacuucaaa

SEQ ID NO: 2705443 - RNA, 19 nt, Human
uguguuuugcaagccagau

SEQ ID NO: 2705444 - RNA, 13 nt, Human
uguguuuugcaag

SEQ ID NO: 2705445 - RNA, 17 nt, Human
uguuuaaaaucauuucu

SEQ ID NO: 2705446 - RNA, 18 nt, Human
uguuuaaaaucauuucug

SEQ ID NO: 2705447 - RNA, 14 nt, Human
uguuuaaaaucauu

SEQ ID NO: 2705448 - RNA, 20 nt, Human
uguuggagaagaacugaaau

SEQ ID NO: 2705449 - RNA, 19 nt, Human
uguuggagaagaacugaaa

SEQ ID NO: 2705450 - RNA, 14 nt, Human
uguuggagaagaac

SEQ ID NO: 2705451 - RNA, 17 nt, Human
uguuggagaagaacuga

SEQ ID NO: 2705452 - RNA, 16 nt, Human
uguuggagaagaacug

SEQ ID NO: 2705453 - RNA, 20 nt, Human
uguugacaugggacauuugc

SEQ ID NO: 2705454 - RNA, 20 nt, Human
uuacauuuguauaaaauaau

SEQ ID NO: 2705455 - RNA, 22 nt, Human
uuaaaaaaaaaccugagcccca

SEQ ID NO: 2705456 - RNA, 18 nt, Human
uuaaaauacacacucaaa

SEQ ID NO: 2705457 - RNA, 20 nt, Human
uguaauaaacucauuucuag

SEQ ID NO: 2705458 - RNA, 16 nt, Human
uguaccgcaaugugac

SEQ ID NO: 2705459 - RNA, 15 nt, Human
uguaccgcaauguga

SEQ ID NO: 2705460 - RNA, 22 nt, Human
uguaguguuggagaagaacuga

SEQ ID NO: 2705461 - RNA, 15 nt, Human
uguaugauucccagc

SEQ ID NO: 2705462 - RNA, 19 nt, Human
ugugcuaguaauuggaaag

SEQ ID NO: 2705463 - RNA, 22 nt, Human
uggaauaauccuaaacauauga

SEQ ID NO: 2705464 - RNA, 23 nt, Human
uggaaacuucagcgguuuauaua

SEQ ID NO: 2705465 - RNA, 20 nt, Human
uggaacauaaaauacaaugu

SEQ ID NO: 2705466 - RNA, 21 nt, Human
uggaacauaaaauacaauguu

SEQ ID NO: 2705467 - RNA, 11 nt, Human
uggagggaagc

SEQ ID NO: 2705468 - RNA, 21 nt, Human
ugguauguuuucaggcuagau

SEQ ID NO: 2705469 - RNA, 16 nt, Human
uggcuuccuggcaaua

SEQ ID NO: 2705470 - RNA, 21 nt, Human
uggcuugaguuuaaauuguaa

SEQ ID NO: 2705471 - RNA, 14 nt, Human
ugggaguacaaaag

SEQ ID NO: 2705472 - RNA, 19 nt, Human
ugccaaauauaaauaaaaa

SEQ ID NO: 2705473 - RNA, 22 nt, Human
ugccaaauauaaauaaaaauaa

SEQ ID NO: 2705474 - RNA, 17 nt, Human
ugccaaauauaaauaaa

SEQ ID NO: 2705475 - RNA, 18 nt, Human
ugccaaauauaaauaaaa

SEQ ID NO: 2705476 - RNA, 20 nt, Human
ugccacuaaauugacacuua

SEQ ID NO: 2705477 - RNA, 12 nt, Human
ugccaucccucc

SEQ ID NO: 2705478 - RNA, 11 nt, Human
ugccaucccuc

SEQ ID NO: 2705479 - RNA, 14 nt, Human
ugccaucccucccu

SEQ ID NO: 2705480 - RNA, 22 nt, Human
ugcaguucugaagaagauggua

SEQ ID NO: 2705481 - RNA, 19 nt, Human
ugcaguucugaagaagaug

SEQ ID NO: 2705482 - RNA, 14 nt, Human
ugcaguucugaaga

SEQ ID NO: 2705483 - RNA, 18 nt, Human
ugcaguucugaagaagau

SEQ ID NO: 2705484 - RNA, 17 nt, Human
ugcaguucugaagaaga

SEQ ID NO: 2705485 - RNA, 16 nt, Human
ugcaguucugaagaag

SEQ ID NO: 2705486 - RNA, 15 nt, Human
ugcaguucugaagaa

SEQ ID NO: 2705487 - RNA, 19 nt, Human
ugcagugagccgagauugu

SEQ ID NO: 2705488 - RNA, 19 nt, Human
ugcacgcacacugucugcc

SEQ ID NO: 2705489 - RNA, 17 nt, Human
ugcugaaacaacaaaua

SEQ ID NO: 2705490 - RNA, 19 nt, Human
ugcuaagcauuccaacuau

SEQ ID NO: 2705491 - RNA, 15 nt, Human
ugcuaagcauuccaa

SEQ ID NO: 2705492 - RNA, 16 nt, Human
ugcucaguagucagac

SEQ ID NO: 2705493 - RNA, 15 nt, Human
ugccuucucaacucc

SEQ ID NO: 2705494 - RNA, 18 nt, Human
ugccuguaaucacagcua

SEQ ID NO: 2705495 - RNA, 17 nt, Human
uccucugcuugccaucc

SEQ ID NO: 2705496 - RNA, 16 nt, Human
uccucugcuugccauc

SEQ ID NO: 2705497 - RNA, 15 nt, Human
uccucugcuugccau

SEQ ID NO: 2705498 - RNA, 14 nt, Human
uccucugcuugcca

SEQ ID NO: 2705499 - RNA, 16 nt, Human
uccugaggcuccacuu

SEQ ID NO: 2705500 - RNA, 17 nt, Human
uccugaggcuccacuug

SEQ ID NO: 2705501 - RNA, 21 nt, Human
uccugaggcuccacuuggucu

SEQ ID NO: 2705502 - RNA, 15 nt, Human
uccugaggcuccacu

SEQ ID NO: 2705503 - RNA, 17 nt, Human
uccuugcaucaauuuuu

SEQ ID NO: 2705504 - RNA, 15 nt, Human
ucggccuccauccug

SEQ ID NO: 2705505 - RNA, 16 nt, Human
ucggccuccauccuga

SEQ ID NO: 2705506 - RNA, 15 nt, Human
ucggagcccugucuc

SEQ ID NO: 2705507 - RNA, 14 nt, Human
ucggagcccugucu

SEQ ID NO: 2705508 - RNA, 12 nt, Human
ucuacuaaaaau

SEQ ID NO: 2705509 - RNA, 19 nt, Human
ucuacuaaaaauacaaaaa

SEQ ID NO: 2705510 - RNA, 15 nt, Human
ucuacuaaaaauaca

SEQ ID NO: 2705511 - RNA, 12 nt, Human
uccauacauuug

SEQ ID NO: 2705512 - RNA, 19 nt, Human
ucauggaauuggagcucgu

SEQ ID NO: 2705513 - RNA, 21 nt, Human
ucauggaauuggagcucgugg

SEQ ID NO: 2705514 - RNA, 18 nt, Human
ucaguccaugaagaugua

SEQ ID NO: 2705515 - RNA, 22 nt, Human
ucagcuccccucggagaagagc

SEQ ID NO: 2705516 - RNA, 21 nt, Human
ucagcuccccucggagaagag

SEQ ID NO: 2705517 - RNA, 16 nt, Human
ucagcugcugaaacaa

SEQ ID NO: 2705518 - RNA, 16 nt, Human
ucuucuuggucucagu

SEQ ID NO: 2705519 - RNA, 19 nt, Human
ucuugccaaauauaaauaa

SEQ ID NO: 2705520 - RNA, 22 nt, Human
ucuuaggguuaugauuaaguaa

SEQ ID NO: 2705521 - RNA, 13 nt, Human
ucuuauaauuuaa

SEQ ID NO: 2705522 - RNA, 14 nt, Human
ucuuauaauuuaaa

SEQ ID NO: 2705523 - RNA, 17 nt, Human
ucuuuccacagaagcuc

SEQ ID NO: 2705524 - RNA, 14 nt, Human
ucugucucagucca

SEQ ID NO: 2705525 - RNA, 15 nt, Human
ugagcaggauuuuaa

SEQ ID NO: 2705526 - RNA, 20 nt, Human
ugagcaggauuuuaaucuuu

SEQ ID NO: 2705527 - RNA, 15 nt, Human
ugagaaagacuauuc

SEQ ID NO: 2705528 - RNA, 13 nt, Human
ugacucuuaagaa

SEQ ID NO: 2705529 - RNA, 16 nt, Human
ugacucuuaagaagac

SEQ ID NO: 2705530 - RNA, 15 nt, Human
ugacucuuaagaaga

SEQ ID NO: 2705531 - RNA, 14 nt, Human
ugacucuuaagaag

SEQ ID NO: 2705532 - RNA, 15 nt, Human
ugaaugaauggcuaa

SEQ ID NO: 2705533 - RNA, 16 nt, Human
ugaccacugcagaaga

SEQ ID NO: 2705534 - RNA, 17 nt, Human
ugaccacugcagaagac

SEQ ID NO: 2705535 - RNA, 18 nt, Human
ugaccacugcagaagaca

SEQ ID NO: 2705536 - RNA, 14 nt, Human
ugaauuaaguuuuu

SEQ ID NO: 2705537 - RNA, 13 nt, Human
ugaauuacauuug

SEQ ID NO: 2705538 - RNA, 14 nt, Human
ugaauuacauuugu

SEQ ID NO: 2705539 - RNA, 16 nt, Human
uaccuaucaucuuaag

SEQ ID NO: 2705540 - RNA, 22 nt, Human
uaccaaaaaucucaauauuuca

SEQ ID NO: 2705541 - RNA, 22 nt, Human
uaccuaacgaaguauccuucag

SEQ ID NO: 2705542 - RNA, 23 nt, Human
uaccuuuguucccaaauuucaua

SEQ ID NO: 2705543 - RNA, 23 nt, Human
uacugucagcuccccucggagaa

SEQ ID NO: 2705544 - RNA, 23 nt, Human
uacaguucggugagcuacaaaug

SEQ ID NO: 2705545 - RNA, 14 nt, Human
uacacuccagugag

SEQ ID NO: 2705546 - RNA, 17 nt, Human
uacacacucaaaucaag

SEQ ID NO: 2705547 - RNA, 16 nt, Human
uacacacucaaaucaa

SEQ ID NO: 2705548 - RNA, 12 nt, Human
uaauuuuuauau

SEQ ID NO: 2705549 - RNA, 18 nt, Human
uaauuuugugaagcaaaa

SEQ ID NO: 2705550 - RNA, 17 nt, Human
uaauuuuuauauuugaa

SEQ ID NO: 2705551 - RNA, 16 nt, Human
uaauuuuuauauuuga

SEQ ID NO: 2705552 - RNA, 13 nt, Human
uaauuuugugaag

SEQ ID NO: 2705553 - RNA, 23 nt, Human
uagaauaccacaggaaccacaag

SEQ ID NO: 2705554 - RNA, 15 nt, Human
uagaauuaacacaug

SEQ ID NO: 2705555 - RNA, 16 nt, Human
uagaauuaacacauga

SEQ ID NO: 2705556 - RNA, 18 nt, Human
uagaauuaacacaugauc

SEQ ID NO: 2705557 - RNA, 16 nt, Human
uagcaugaagacagag

SEQ ID NO: 2705558 - RNA, 14 nt, Human
uagauaggccaugg

SEQ ID NO: 2705559 - RNA, 20 nt, Human
uaggugcuacaaaaacacag

SEQ ID NO: 2705560 - RNA, 22 nt, Human
uaggugcuacaaaaacacagca

SEQ ID NO: 2705561 - RNA, 23 nt, Human
uaggugcuacaaaaacacagcaa

SEQ ID NO: 2705562 - RNA, 18 nt, Human
uaggugcuacaaaaacac

SEQ ID NO: 2705563 - RNA, 17 nt, Human
uaguauuguccaggucu

SEQ ID NO: 2705564 - RNA, 19 nt, Human
uauauaacaaugcuguauu

SEQ ID NO: 2705565 - RNA, 17 nt, Human
uauauaacaaugcugua

SEQ ID NO: 2705566 - RNA, 14 nt, Human
uaucaaaagaaaga

SEQ ID NO: 2705567 - RNA, 21 nt, Human
uauauuuuuuguuaaaugauu

SEQ ID NO: 2705568 - RNA, 20 nt, Human
uauauuugaaauauugacuu

SEQ ID NO: 2705569 - RNA, 16 nt, Human
uauaugcuucuguuuu

SEQ ID NO: 2705570 - RNA, 14 nt, Human
uauaugcuucuguu

SEQ ID NO: 2705571 - RNA, 17 nt, Human
uaaccaggggccaugaa

SEQ ID NO: 2705572 - RNA, 21 nt, Human
uaagaaaauaucacuugucaa

SEQ ID NO: 2705573 - RNA, 23 nt, Human
uaagagagaaugagagacacacu

SEQ ID NO: 2705574 - RNA, 14 nt, Human
uaagagagaaugag

SEQ ID NO: 2705575 - RNA, 13 nt, Human
uaagagagaauga

SEQ ID NO: 2705576 - RNA, 15 nt, Human
uaacuggaaacuuca

SEQ ID NO: 2705577 - RNA, 20 nt, Human
uaaauggcuuccuggcaaua

SEQ ID NO: 2705578 - RNA, 20 nt, Human
uaaauugacacuuaaaaaug

SEQ ID NO: 2705579 - RNA, 16 nt, Human
uaaaugugccuucauu

SEQ ID NO: 2705580 - RNA, 13 nt, Human
uaagugaaauaag

SEQ ID NO: 2705581 - RNA, 14 nt, Human
uaauaauguuucaa

SEQ ID NO: 2705582 - RNA, 22 nt, Human
uaauguuucaaacauauauaac

SEQ ID NO: 2705583 - RNA, 22 nt, Human
uaaugauaacuggaaacuucag

SEQ ID NO: 2705584 - RNA, 17 nt, Human
uaaugauaacuggaaac

SEQ ID NO: 2705585 - RNA, 23 nt, Human
uaaugauaacuggaaacuucagc

SEQ ID NO: 2705586 - RNA, 14 nt, Human
uaaaguguuugaaa

SEQ ID NO: 2705587 - RNA, 19 nt, Human
uaaaaaugguuuaaauggu

SEQ ID NO: 2705588 - RNA, 15 nt, Human
uaaaaaugguuuaaa

SEQ ID NO: 2705589 - RNA, 18 nt, Human
uaaaaaugguuuaaaugg

SEQ ID NO: 2705590 - RNA, 22 nt, Human
uaaaacaagcacuaaacaaaga

SEQ ID NO: 2705591 - RNA, 18 nt, Human
uaaaaucauuucugcauc

SEQ ID NO: 2705592 - RNA, 22 nt, Human
uaaaaucauuucugcaucagcu

SEQ ID NO: 2705593 - RNA, 17 nt, Human
uaaaauccauacauuug

SEQ ID NO: 2705594 - RNA, 15 nt, Human
uaaaauccauacauu

SEQ ID NO: 2705595 - RNA, 10 nt, Human
uaaaaucauu

SEQ ID NO: 2705596 - RNA, 13 nt, Human
uaaaaucauuucu

SEQ ID NO: 2705597 - RNA, 13 nt, Human
uaaaaccacagca

SEQ ID NO: 2705598 - RNA, 20 nt, Human
guuuauauaagcuuguauuc

SEQ ID NO: 2705599 - RNA, 21 nt, Human
guuuagcuggaaaaguauguu

SEQ ID NO: 2705600 - RNA, 20 nt, Human
guuuagcuggaaaaguaugu

SEQ ID NO: 2705601 - RNA, 15 nt, Human
gugcuacaaaaacac

SEQ ID NO: 2705602 - RNA, 20 nt, Human
gugcuacaaaaacacagcaa

SEQ ID NO: 2705603 - RNA, 21 nt, Human
guguaaguagauaggccaugg

SEQ ID NO: 2705604 - RNA, 14 nt, Human
gugugcguccuguc

SEQ ID NO: 2705605 - RNA, 16 nt, Human
gugugcguccugucgg

SEQ ID NO: 2705606 - RNA, 20 nt, Human
guuaaaagaugaaaauauuu

SEQ ID NO: 2705607 - RNA, 14 nt, Human
guuaaaagaugaaa

SEQ ID NO: 2705608 - RNA, 16 nt, Human
guuaaaagaugaaaau

SEQ ID NO: 2705609 - RNA, 16 nt, Human
guucaucaaugaauga

SEQ ID NO: 2705610 - RNA, 19 nt, Human
guucagagcugcccucucc

SEQ ID NO: 2705611 - RNA, 17 nt, Human
guucagagcugcccucu

SEQ ID NO: 2705612 - RNA, 16 nt, Human
guucagagcugcccuc

SEQ ID NO: 2705613 - RNA, 15 nt, Human
guucagagcugcccu

SEQ ID NO: 2705614 - RNA, 22 nt, Human
guucagagcugcccucuccugg

SEQ ID NO: 2705615 - RNA, 20 nt, Human
guucagagcugcccucuccu

SEQ ID NO: 2705616 - RNA, 23 nt, Human
guucagagcugcccucuccuggg

SEQ ID NO: 2705617 - RNA, 14 nt, Human
guucagagcugccc

SEQ ID NO: 2705618 - RNA, 13 nt, Human
guucagagcugcc

SEQ ID NO: 2705619 - RNA, 23 nt, Human
guuaccucugccucagaaaacaa

SEQ ID NO: 2705620 - RNA, 20 nt, Human
guugauggugguauguuuuc

SEQ ID NO: 2705621 - RNA, 21 nt, Human
guugauggugguauguuuuca

SEQ ID NO: 2705622 - RNA, 17 nt, Human
guugaaaagacuccaaa

SEQ ID NO: 2705623 - RNA, 22 nt, Human
guugaaaagacuccaaagaaau

SEQ ID NO: 2705624 - RNA, 23 nt, Human
guugaaaagacuccaaagaaaug

SEQ ID NO: 2705625 - RNA, 13 nt, Human
guucugaagaaga

SEQ ID NO: 2705626 - RNA, 12 nt, Human
guucugaagaag

SEQ ID NO: 2705627 - RNA, 15 nt, Human
guucugaagaagaug

SEQ ID NO: 2705628 - RNA, 14 nt, Human
guucugaagaagau

SEQ ID NO: 2705629 - RNA, 16 nt, Human
gugacaagcucacaga

SEQ ID NO: 2705630 - RNA, 13 nt, Human
gugaacacaucag

SEQ ID NO: 2705631 - RNA, 21 nt, Human
gugaacaaauuuacagagaca

SEQ ID NO: 2705632 - RNA, 13 nt, Human
gugcguccugucg

SEQ ID NO: 2705633 - RNA, 13 nt, Human
gucugacuguuuc

SEQ ID NO: 2705634 - RNA, 23 nt, Human
gucggguuuuauuguuuaaaauc

SEQ ID NO: 2705635 - RNA, 12 nt, Human
gucggagcccug

SEQ ID NO: 2705636 - RNA, 16 nt, Human
gucggagcccugucuc

SEQ ID NO: 2705637 - RNA, 18 nt, Human
gucgucaaagcugaaaug

SEQ ID NO: 2705638 - RNA, 15 nt, Human
gucugugagaugcua

SEQ ID NO: 2705639 - RNA, 16 nt, Human
gucugugagaugcuag

SEQ ID NO: 2705640 - RNA, 17 nt, Human
gucugugagaugcuaga

SEQ ID NO: 2705641 - RNA, 21 nt, Human
gucugugagaugcuagaacuc

SEQ ID NO: 2705642 - RNA, 22 nt, Human
gucugugagaugcuagaacucc

SEQ ID NO: 2705643 - RNA, 23 nt, Human
gucugugagaugcuagaacuccc

SEQ ID NO: 2705644 - RNA, 17 nt, Human
guauguuagugcaaauu

SEQ ID NO: 2705645 - RNA, 18 nt, Human
gcuauaggugcuacaaaa

SEQ ID NO: 2705646 - RNA, 15 nt, Human
guaguguuggagaag

SEQ ID NO: 2705647 - RNA, 14 nt, Human
guaguguuggagaa

SEQ ID NO: 2705648 - RNA, 19 nt, Human
gucagcuccccucggagaa

SEQ ID NO: 2705649 - RNA, 20 nt, Human
guauuuuaaaagaaugauua

SEQ ID NO: 2705650 - RNA, 13 nt, Human
guauuuuaaucac

SEQ ID NO: 2705651 - RNA, 18 nt, Human
guauuuuaaaagaaugau

SEQ ID NO: 2705652 - RNA, 15 nt, Human
gucaaugcagccccc

SEQ ID NO: 2705653 - RNA, 22 nt, Human
gucaauaaaauccauacauuug

SEQ ID NO: 2705654 - RNA, 23 nt, Human
gucaauaaaauccauacauuugu

SEQ ID NO: 2705655 - RNA, 23 nt, Human
gucagcuccccucggagaagagc

SEQ ID NO: 2705656 - RNA, 21 nt, Human
gucagcuccccucggagaaga

SEQ ID NO: 2705657 - RNA, 22 nt, Human
gucagcuccccucggagaagag

SEQ ID NO: 2705658 - RNA, 18 nt, Human
uuuuuaaaaaagaaacau

SEQ ID NO: 2705659 - RNA, 18 nt, Human
uuuuggucuggagggaag

SEQ ID NO: 2705660 - RNA, 14 nt, Human
uuuuccugaaaacc

SEQ ID NO: 2705661 - RNA, 19 nt, Human
uuuuucucuaggaaauauu

SEQ ID NO: 2705662 - RNA, 17 nt, Human
uuucuuauuucauuucu

SEQ ID NO: 2705663 - RNA, 18 nt, Human
uuugaaucaucaagucuu

SEQ ID NO: 2705664 - RNA, 22 nt, Human
uuuccucaaaacuucagacaua

SEQ ID NO: 2705665 - RNA, 18 nt, Human
uuuccucauuuuuauaau

SEQ ID NO: 2705666 - RNA, 13 nt, Human
uuucugagaaaga

SEQ ID NO: 2705667 - RNA, 13 nt, Human
uuugguuucuagc

SEQ ID NO: 2705668 - RNA, 16 nt, Human
uuuguauaaaauaauu

SEQ ID NO: 2705669 - RNA, 14 nt, Human
uuuguauaaaauaa

SEQ ID NO: 2705670 - RNA, 13 nt, Human
uuuguauaaaaua

SEQ ID NO: 2705671 - RNA, 21 nt, Human
uuuuaaaagaaugauuaugaa

SEQ ID NO: 2705672 - RNA, 20 nt, Human
uuuuaauaauguuucaaaca

SEQ ID NO: 2705673 - RNA, 23 nt, Human
gccaucccucccuccaccucccu

SEQ ID NO: 2705674 - RNA, 18 nt, Human
gccaucccucccuccacc

SEQ ID NO: 2705675 - RNA, 19 nt, Human
gccaugggcacugugggua

SEQ ID NO: 2705676 - RNA, 22 nt, Human
gccuccccuccucugcuugcca

SEQ ID NO: 2705677 - RNA, 20 nt, Human
gccuccccuccucugcuugc

SEQ ID NO: 2705678 - RNA, 23 nt, Human
gccuccccuccucugcuugccau

SEQ ID NO: 2705679 - RNA, 19 nt, Human
gccuccccuccucugcuug

SEQ ID NO: 2705680 - RNA, 17 nt, Human
gccuccccuccucugcu

SEQ ID NO: 2705681 - RNA, 20 nt, Human
gccgggcgugguggugagug

SEQ ID NO: 2705682 - RNA, 22 nt, Human
gccgugugugugcguccugucg

SEQ ID NO: 2705683 - RNA, 23 nt, Human
gccguggugauuuagcaggaagc

SEQ ID NO: 2705684 - RNA, 13 nt, Human
gcuauaggugcua

SEQ ID NO: 2705685 - RNA, 19 nt, Human
gcuagaacucccuuucaac

SEQ ID NO: 2705686 - RNA, 12 nt, Human
gcgacagugaga

SEQ ID NO: 2705687 - RNA, 18 nt, Human
gcagauaaacaguaguga

SEQ ID NO: 2705688 - RNA, 20 nt, Human
gcagccccgugggguuccuc

SEQ ID NO: 2705689 - RNA, 12 nt, Human
gcaucagcugcu

SEQ ID NO: 2705690 - RNA, 13 nt, Human
gcauuauauuuau

SEQ ID NO: 2705691 - RNA, 17 nt, Human
gcauagguuuaauaauu

SEQ ID NO: 2705692 - RNA, 13 nt, Human
gcauagaaguaaa

SEQ ID NO: 2705693 - RNA, 17 nt, Human
gcaguucugaagaagau

SEQ ID NO: 2705694 - RNA, 14 nt, Human
gcaguucugaagaa

SEQ ID NO: 2705695 - RNA, 18 nt, Human
gcaguucagagcugcccu

SEQ ID NO: 2705696 - RNA, 17 nt, Human
gcaguucagagcugccc

SEQ ID NO: 2705697 - RNA, 15 nt, Human
gcaguucugaagaag

SEQ ID NO: 2705698 - RNA, 16 nt, Human
gcaguucagagcugcc

SEQ ID NO: 2705699 - RNA, 15 nt, Human
gauuuuccugaaaac

SEQ ID NO: 2705700 - RNA, 19 nt, Human
gauuuucagcccucagaau

SEQ ID NO: 2705701 - RNA, 15 nt, Human
gauuuucagcccuca

SEQ ID NO: 2705702 - RNA, 11 nt, Human
gauuuucagcc

SEQ ID NO: 2705703 - RNA, 23 nt, Human
gcaaagcacugacuucuaaguaa

SEQ ID NO: 2705704 - RNA, 10 nt, Human
gcaagccaga

SEQ ID NO: 2705705 - RNA, 14 nt, Human
gcaagggugauggg

SEQ ID NO: 2705706 - RNA, 22 nt, Human
gauaaauaguuuaugauuccac

SEQ ID NO: 2705707 - RNA, 23 nt, Human
gauagauaggucagugcaaauac

SEQ ID NO: 2705708 - RNA, 21 nt, Human
gauggcuaguaucaaaagaaa

SEQ ID NO: 2705709 - RNA, 14 nt, Human
gaugaaaauauuug

SEQ ID NO: 2705710 - RNA, 13 nt, Human
gauccuggaaauc

SEQ ID NO: 2705711 - RNA, 13 nt, Human
gagaaagacuauu

SEQ ID NO: 2705712 - RNA, 15 nt, Human
gagaaagacuauuca

SEQ ID NO: 2705713 - RNA, 17 nt, Human
gagaaagacuauucaaa

SEQ ID NO: 2705714 - RNA, 18 nt, Human
gagaaagacuauucaaac

SEQ ID NO: 2705715 - RNA, 16 nt, Human
gagaagaacugaaauc

SEQ ID NO: 2705716 - RNA, 14 nt, Human
gagaagaacugaaa

SEQ ID NO: 2705717 - RNA, 13 nt, Human
gagaagaacugaa

SEQ ID NO: 2705718 - RNA, 15 nt, Human
gagaagagcuguuca

SEQ ID NO: 2705719 - RNA, 22 nt, Human
gagaagagcuguucacagccag

SEQ ID NO: 2705720 - RNA, 13 nt, Human
gagaagagcuguu

SEQ ID NO: 2705721 - RNA, 18 nt, Human
gagacacacugaagaagc

SEQ ID NO: 2705722 - RNA, 15 nt, Human
gagacagcucugcau

SEQ ID NO: 2705723 - RNA, 18 nt, Human
gagacagcucugcauacu

SEQ ID NO: 2705724 - RNA, 13 nt, Human
gagacagcucugc

SEQ ID NO: 2705725 - RNA, 15 nt, Human
gagagugaacaaauu

SEQ ID NO: 2705726 - RNA, 19 nt, Human
gagagugaacaaauuuaca

SEQ ID NO: 2705727 - RNA, 17 nt, Human
gagauacagaauuuuau

SEQ ID NO: 2705728 - RNA, 19 nt, Human
gagagacacacugaagaag

SEQ ID NO: 2705729 - RNA, 16 nt, Human
gagcucgugggacagu

SEQ ID NO: 2705730 - RNA, 23 nt, Human
gagcugcccucuccugggcagcu

SEQ ID NO: 2705731 - RNA, 21 nt, Human
gagcugcccucuccugggcag

SEQ ID NO: 2705732 - RNA, 19 nt, Human
gagcugcccucuccugggc

SEQ ID NO: 2705733 - RNA, 18 nt, Human
gagcugcccucuccuggg

SEQ ID NO: 2705734 - RNA, 22 nt, Human
gacaugggacauuugcucaugg

SEQ ID NO: 2705735 - RNA, 17 nt, Human
gacaugggacauuugcu

SEQ ID NO: 2705736 - RNA, 23 nt, Human
gaccugauuucugagcauuuaau

SEQ ID NO: 2705737 - RNA, 13 nt, Human
cuucuuuccacag

SEQ ID NO: 2705738 - RNA, 19 nt, Human
cuucuuuccacagaagcuc

SEQ ID NO: 2705739 - RNA, 14 nt, Human
cuugaacccgggag

SEQ ID NO: 2705740 - RNA, 19 nt, Human
cuugaacccgggaggcaga

SEQ ID NO: 2705741 - RNA, 20 nt, Human
cuugaacccgggaggcagag

SEQ ID NO: 2705742 - RNA, 16 nt, Human
cuugagugcucaguag

SEQ ID NO: 2705743 - RNA, 23 nt, Human
cuugcaucaauuuuucuuauuuc

SEQ ID NO: 2705744 - RNA, 21 nt, Human
cuugcaugguuuagaaagcuu

SEQ ID NO: 2705745 - RNA, 18 nt, Human
cuuguaaaggaauuuaaa

SEQ ID NO: 2705746 - RNA, 17 nt, Human
cuugccaaauauaaaua

SEQ ID NO: 2705747 - RNA, 21 nt, Human
gaaagcuugcccuggugccuc

SEQ ID NO: 2705748 - RNA, 16 nt, Human
gaaacugacacaugcu

SEQ ID NO: 2705749 - RNA, 13 nt, Human
gaaacugccagca

SEQ ID NO: 2705750 - RNA, 15 nt, Human
gaaacugccagcaac

SEQ ID NO: 2705751 - RNA, 13 nt, Human
gaaagcagaacag

SEQ ID NO: 2705752 - RNA, 14 nt, Human
gaaagcagaacagu

SEQ ID NO: 2705753 - RNA, 22 nt, Human
gaaagacuauucaaacagucuc

SEQ ID NO: 2705754 - RNA, 23 nt, Human
gaaagacuauucaaacagucuca

SEQ ID NO: 2705755 - RNA, 19 nt, Human
gaaagacuauucaaacagu

SEQ ID NO: 2705756 - RNA, 24 nt, Human
gaacaguuaccucugccucagaaa

SEQ ID NO: 2705757 - RNA, 22 nt, Human
gaaauguaagggaaacugccag

SEQ ID NO: 2705758 - RNA, 13 nt, Human
gaaauauuuauuu

SEQ ID NO: 2705759 - RNA, 16 nt, Human
gaaauauuuauuuuaa

SEQ ID NO: 2705760 - RNA, 15 nt, Human
gaaauauuuauuuua

SEQ ID NO: 2705761 - RNA, 14 nt, Human
gaaggaugcugucu

SEQ ID NO: 2705762 - RNA, 23 nt, Human
gaaguccaagcauuuagauguau

SEQ ID NO: 2705763 - RNA, 23 nt, Human
gaagagcuguucacagccagacu

SEQ ID NO: 2705764 - RNA, 13 nt, Human
gaagagcuguuca

SEQ ID NO: 2705765 - RNA, 15 nt, Human
gaagagcuguucaca

SEQ ID NO: 2705766 - RNA, 20 nt, Human
gaagagcuguucacagccag

SEQ ID NO: 2705767 - RNA, 22 nt, Human
gaacuuguaaaggaauuuaaaa

SEQ ID NO: 2705768 - RNA, 15 nt, Human
gaaccacaagacugc

SEQ ID NO: 2705769 - RNA, 14 nt, Human
gaaccacaagacug

SEQ ID NO: 2705770 - RNA, 16 nt, Human
gaacucccuuucaaca

SEQ ID NO: 2705771 - RNA, 15 nt, Human
gaacucccuuucaac

SEQ ID NO: 2705772 - RNA, 15 nt, Human
cuguaugauucccag

SEQ ID NO: 2705773 - RNA, 16 nt, Human
cuguauuuuaaaagaa

SEQ ID NO: 2705774 - RNA, 13 nt, Human
cuguauuuuaaaa

SEQ ID NO: 2705775 - RNA, 18 nt, Human
cugucucuacuaaaaaua

SEQ ID NO: 2705776 - RNA, 17 nt, Human
cugucuccucucucugu

SEQ ID NO: 2705777 - RNA, 20 nt, Human
cugucuccucucucuguaau

SEQ ID NO: 2705778 - RNA, 22 nt, Human
cuguaauaaacucauuucuagc

SEQ ID NO: 2705779 - RNA, 16 nt, Human
cuggccuucggccucc

SEQ ID NO: 2705780 - RNA, 17 nt, Human
cuggccuucggccucca

SEQ ID NO: 2705781 - RNA, 18 nt, Human
cuggccuucggccuccau

SEQ ID NO: 2705782 - RNA, 21 nt, Human
cuggccuucggccuccauccu

SEQ ID NO: 2705783 - RNA, 15 nt, Human
cuggccuucggccuc

SEQ ID NO: 2705784 - RNA, 20 nt, Human
cugggaaagggauuuucagc

SEQ ID NO: 2705785 - RNA, 15 nt, Human
cugccagcaacgcag

SEQ ID NO: 2705786 - RNA, 12 nt, Human
cugcacugucaa

SEQ ID NO: 2705787 - RNA, 15 nt, Human
cugcuugccaucccu

SEQ ID NO: 2705788 - RNA, 16 nt, Human
cugcuugccaucccuc

SEQ ID NO: 2705789 - RNA, 22 nt, Human
cugcuugccaucccucccucca

SEQ ID NO: 2705790 - RNA, 20 nt, Human
cugcuugccaucccucccuc

SEQ ID NO: 2705791 - RNA, 19 nt, Human
cugcuugccaucccucccu

SEQ ID NO: 2705792 - RNA, 18 nt, Human
cugcuugccaucccuccc

SEQ ID NO: 2705793 - RNA, 15 nt, Human
cugcccucuccuggg

SEQ ID NO: 2705794 - RNA, 14 nt, Human
cugcccucuccugg

SEQ ID NO: 2705795 - RNA, 13 nt, Human
cugcccucuccug

SEQ ID NO: 2705796 - RNA, 12 nt, Human
cugcccucuccu

SEQ ID NO: 2705797 - RNA, 23 nt, Human
cugaagaagcaccaaucaugaau

SEQ ID NO: 2705798 - RNA, 17 nt, Human
cugaacaucacagcuua

SEQ ID NO: 2705799 - RNA, 22 nt, Human
cucuucuuuaaagggauggcaa

SEQ ID NO: 2705800 - RNA, 20 nt, Human
cucugcuugccaucccuccc

SEQ ID NO: 2705801 - RNA, 17 nt, Human
cucugcuugccaucccu

SEQ ID NO: 2705802 - RNA, 14 nt, Human
cucugcuugccauc

SEQ ID NO: 2705803 - RNA, 12 nt, Human
cucugcuugcca

SEQ ID NO: 2705804 - RNA, 12 nt, Human
cucuggccuucg

SEQ ID NO: 2705805 - RNA, 19 nt, Human
cucuggccuucggccucca

SEQ ID NO: 2705806 - RNA, 17 nt, Human
cugacucuuaagaagac

SEQ ID NO: 2705807 - RNA, 16 nt, Human
cugacuucuaaguaaa

SEQ ID NO: 2705808 - RNA, 13 nt, Human
cugacuucuaagu

SEQ ID NO: 2705809 - RNA, 15 nt, Human
cugacuucuaaguaa

SEQ ID NO: 2705810 - RNA, 22 nt, Human
cugagaaagacuauucaaacag

SEQ ID NO: 2705811 - RNA, 23 nt, Human
cugagaaagacuauucaaacagu

SEQ ID NO: 2705812 - RNA, 16 nt, Human
cugagcgacagugaga

SEQ ID NO: 2705813 - RNA, 20 nt, Human
cugagcgacagugagacucu

SEQ ID NO: 2705814 - RNA, 14 nt, Human
cuccauccugaggc

SEQ ID NO: 2705815 - RNA, 16 nt, Human
cuccauccugaggcuc

SEQ ID NO: 2705816 - RNA, 18 nt, Human
cuccauccugaggcucca

SEQ ID NO: 2705817 - RNA, 17 nt, Human
cucccuccaccucccug

SEQ ID NO: 2705818 - RNA, 15 nt, Human
cucccuccaccuccc

SEQ ID NO: 2705819 - RNA, 17 nt, Human
cucuaggaaauauuuau

SEQ ID NO: 2705820 - RNA, 15 nt, Human
cucuaggaaauauuu

SEQ ID NO: 2705821 - RNA, 12 nt, Human
cucuccugggca

SEQ ID NO: 2705822 - RNA, 19 nt, Human
cucuccugggcagcugccu

SEQ ID NO: 2705823 - RNA, 18 nt, Human
cucuccugggcagcugcc

SEQ ID NO: 2705824 - RNA, 16 nt, Human
cucuccugggcagcug

SEQ ID NO: 2705825 - RNA, 15 nt, Human
cucuccugggcagcu

SEQ ID NO: 2705826 - RNA, 20 nt, Human
cucuccugggcagcugccuc

SEQ ID NO: 2705827 - RNA, 17 nt, Human
cggugagcuacaaaugc

SEQ ID NO: 2705828 - RNA, 22 nt, Human
cggucggguuuuauuguuuaaa

SEQ ID NO: 2705829 - RNA, 21 nt, Human
cggguuuuauuguuuaaaauc

SEQ ID NO: 2705830 - RNA, 12 nt, Human
cggccuccaucc

SEQ ID NO: 2705831 - RNA, 14 nt, Human
cgcucucuggccuu

SEQ ID NO: 2705832 - RNA, 15 nt, Human
cgcucucuggccuuc

SEQ ID NO: 2705833 - RNA, 18 nt, Human
cgcucucuggccuucggc

SEQ ID NO: 2705834 - RNA, 18 nt, Human
cgugcacgcacacugucu

SEQ ID NO: 2705835 - RNA, 23 nt, Human
cuaaauugacacuuaaaaauggu

SEQ ID NO: 2705836 - RNA, 17 nt, Human
cuacacuccagugagac

SEQ ID NO: 2705837 - RNA, 16 nt, Human
cuacacuccagugaga

SEQ ID NO: 2705838 - RNA, 15 nt, Human
cuaagcaaaauguga

SEQ ID NO: 2705839 - RNA, 18 nt, Human
cuaagcaaaaugugauau

SEQ ID NO: 2705840 - RNA, 14 nt, Human
cuaagcaaaaugug

SEQ ID NO: 2705841 - RNA, 19 nt, Human
cuacuugggaggcugagau

SEQ ID NO: 2705842 - RNA, 15 nt, Human
cuacuugggaggcug

SEQ ID NO: 2705843 - RNA, 18 nt, Human
cuacuugggaggcugaga

SEQ ID NO: 2705844 - RNA, 17 nt, Human
cucaccccuugccauaa

SEQ ID NO: 2705845 - RNA, 13 nt, Human
cucacauuuauau

SEQ ID NO: 2705846 - RNA, 22 nt, Human
cuauauuuuuuguuaaaugauu

SEQ ID NO: 2705847 - RNA, 18 nt, Human
cuaugaaauauuauguua

SEQ ID NO: 2705848 - RNA, 13 nt, Human
cuaugaaauauua

SEQ ID NO: 2705849 - RNA, 20 nt, Human
cuauauuuuuuguuaaauga

SEQ ID NO: 2705850 - RNA, 19 nt, Human
cuauauuguuugcuaagca

SEQ ID NO: 2705851 - RNA, 22 nt, Human
cuaggaaauauuuauuuuaaua

SEQ ID NO: 2705852 - RNA, 20 nt, Human
cuaguauuucuaugaaauau

SEQ ID NO: 2705853 - RNA, 19 nt, Human
cuaguauuucuaugaaaua

SEQ ID NO: 2705854 - RNA, 22 nt, Human
cuaguauuucuaugaaauauua

SEQ ID NO: 2705855 - RNA, 15 nt, Human
cuaguaucaaaagaa

SEQ ID NO: 2705856 - RNA, 17 nt, Human
cuaguaucaaaagaaag

SEQ ID NO: 2705857 - RNA, 23 nt, Human
cuaguaucaaaagaaagaaaauc

SEQ ID NO: 2705858 - RNA, 15 nt, Human
cccugcaauaaaaug

SEQ ID NO: 2705859 - RNA, 14 nt, Human
cccugcaauaaaau

SEQ ID NO: 2705860 - RNA, 14 nt, Human
ccccaggugccagu

SEQ ID NO: 2705861 - RNA, 12 nt, Human
cccucccuccac

SEQ ID NO: 2705862 - RNA, 13 nt, Human
cccucccuccacc

SEQ ID NO: 2705863 - RNA, 20 nt, Human
cccucccuccaccucccugc

SEQ ID NO: 2705864 - RNA, 12 nt, Human
ccuccauccuga

SEQ ID NO: 2705865 - RNA, 13 nt, Human
ccuccauccugag

SEQ ID NO: 2705866 - RNA, 13 nt, Human
ccuccccuccucu

SEQ ID NO: 2705867 - RNA, 12 nt, Human
ccuccccuccuc

SEQ ID NO: 2705868 - RNA, 20 nt, Human
ccucagaugcacaugagcug

SEQ ID NO: 2705869 - RNA, 13 nt, Human
ccuaaacauauga

SEQ ID NO: 2705870 - RNA, 16 nt, Human
ccauccugaggcucca

SEQ ID NO: 2705871 - RNA, 15 nt, Human
ccauccugaggcucc

SEQ ID NO: 2705872 - RNA, 23 nt, Human
ccauggcacucuauguucuaaga

SEQ ID NO: 2705873 - RNA, 17 nt, Human
cccaguguuuuaggagc

SEQ ID NO: 2705874 - RNA, 16 nt, Human
cccaguguuuuaggag

SEQ ID NO: 2705875 - RNA, 14 nt, Human
cauuugcucaugga

SEQ ID NO: 2705876 - RNA, 15 nt, Human
cauuugcucauggaa

SEQ ID NO: 2705877 - RNA, 16 nt, Human
cauuugcucauggaau

SEQ ID NO: 2705878 - RNA, 17 nt, Human
ccaaagaaauguaaggg

SEQ ID NO: 2705879 - RNA, 23 nt, Human
cauuucugcaucagcugcugaaa

SEQ ID NO: 2705880 - RNA, 12 nt, Human
cauuuccaagca

SEQ ID NO: 2705881 - RNA, 19 nt, Human
cauuuaaagcuuauuaaaa

SEQ ID NO: 2705882 - RNA, 18 nt, Human
ccaaggcuagaaccaccu

SEQ ID NO: 2705883 - RNA, 19 nt, Human
ccaaggcugauuaaaccaa

SEQ ID NO: 2705884 - RNA, 20 nt, Human
ccaauauucauagcagcuua

SEQ ID NO: 2705885 - RNA, 16 nt, Human
ccacaagaaaugaaag

SEQ ID NO: 2705886 - RNA, 22 nt, Human
ccacaagaaaugaaagcaggga

SEQ ID NO: 2705887 - RNA, 14 nt, Human
ccaacacgagcagg

SEQ ID NO: 2705888 - RNA, 21 nt, Human
ccaacacgagcaggcuacugu

SEQ ID NO: 2705889 - RNA, 17 nt, Human
caugggacagggaggac

SEQ ID NO: 2705890 - RNA, 23 nt, Human
caugcugucuacacuaagagaga

SEQ ID NO: 2705891 - RNA, 20 nt, Human
cauauauaacaaugcuguau

SEQ ID NO: 2705892 - RNA, 22 nt, Human
caucaagucuuucacauuuaaa

SEQ ID NO: 2705893 - RNA, 18 nt, Human
caucaaugaaugaaugaa

SEQ ID NO: 2705894 - RNA, 13 nt, Human
caucccucccucc

SEQ ID NO: 2705895 - RNA, 12 nt, Human
caucccucccuc

SEQ ID NO: 2705896 - RNA, 14 nt, Human
caucccucccucca

SEQ ID NO: 2705897 - RNA, 14 nt, Human
caucuagugagcag

SEQ ID NO: 2705898 - RNA, 22 nt, Human
caucuagugagcagucaggaaa

SEQ ID NO: 2705899 - RNA, 14 nt, Human
caguuuucugagaa

SEQ ID NO: 2705900 - RNA, 15 nt, Human
caguuuucugagaaa

SEQ ID NO: 2705901 - RNA, 19 nt, Human
caguuuucugagaaagacu

SEQ ID NO: 2705902 - RNA, 20 nt, Human
caguuuucugagaaagacua

SEQ ID NO: 2705903 - RNA, 21 nt, Human
caguugaaaagacuccaaaga

SEQ ID NO: 2705904 - RNA, 22 nt, Human
caguugaaaagacuccaaagaa

SEQ ID NO: 2705905 - RNA, 23 nt, Human
caguugaaaagacuccaaagaaa

SEQ ID NO: 2705906 - RNA, 14 nt, Human
caguugaaaagacu

SEQ ID NO: 2705907 - RNA, 18 nt, Human
caguugaaaagacuccaa

SEQ ID NO: 2705908 - RNA, 17 nt, Human
cauaccaacacgagcag

SEQ ID NO: 2705909 - RNA, 22 nt, Human
caguucggugagcuacaaaugc

SEQ ID NO: 2705910 - RNA, 16 nt, Human
caguucugaagaagau

SEQ ID NO: 2705911 - RNA, 15 nt, Human
caguucugaagaaga

SEQ ID NO: 2705912 - RNA, 22 nt, Human
caguucugaagaagaugguacc

SEQ ID NO: 2705913 - RNA, 14 nt, Human
caguucugaagaag

SEQ ID NO: 2705914 - RNA, 13 nt, Human
caguucugaagaa

SEQ ID NO: 2705915 - RNA, 12 nt, Human
caguucugaaga

SEQ ID NO: 2705916 - RNA, 21 nt, Human
caguuaccucugccucagaaa

SEQ ID NO: 2705917 - RNA, 20 nt, Human
caguguuuuaggagcaugag

SEQ ID NO: 2705918 - RNA, 16 nt, Human
caguguuuuaggagca

SEQ ID NO: 2705919 - RNA, 14 nt, Human
cagugucaaugcag

SEQ ID NO: 2705920 - RNA, 15 nt, Human
aaacugcacugucaa

SEQ ID NO: 2705921 - RNA, 21 nt, Human
aaaaucauuucugcaucagcu

SEQ ID NO: 2705922 - RNA, 15 nt, Human
aaagcauuguaaaug

SEQ ID NO: 2705923 - RNA, 17 nt, Human
aaagcauuguaaaugug

SEQ ID NO: 2705924 - RNA, 11 nt, Human
aaaaucauuuc

SEQ ID NO: 2705925 - RNA, 12 nt, Human
aaaaucauuucu

SEQ ID NO: 2705926 - RNA, 10 nt, Human
aaaaucauuu

SEQ ID NO: 2705927 - RNA, 13 nt, Human
aaaagacuccaaa

SEQ ID NO: 2705928 - RNA, 11 nt, Human
aaaagaaugau

SEQ ID NO: 2705929 - RNA, 13 nt, Human
aaaagaauauuuu

SEQ ID NO: 2705930 - RNA, 20 nt, Human
aaaagacaaggaaaaaauaa

SEQ ID NO: 2705931 - RNA, 12 nt, Human
aaaagaauauuu

SEQ ID NO: 2705932 - RNA, 17 nt, Human
aaaagaaagaaaaucag

SEQ ID NO: 2705933 - RNA, 23 nt, Human
aaauguugacaugggacauuugc

SEQ ID NO: 2705934 - RNA, 22 nt, Human
aaauguugacaugggacauuug

SEQ ID NO: 2705935 - RNA, 17 nt, Human
aaauguucaucaaugaa

SEQ ID NO: 2705936 - RNA, 13 nt, Human
aaauguucaucaa

SEQ ID NO: 2705937 - RNA, 18 nt, Human
aaaucucaauauuucaga

SEQ ID NO: 2705938 - RNA, 21 nt, Human
aaauauuuauuuuaauaaugu

SEQ ID NO: 2705939 - RNA, 22 nt, Human
aagacagagccccacccucaga

SEQ ID NO: 2705940 - RNA, 15 nt, Human
aagaacugaaaucau

SEQ ID NO: 2705941 - RNA, 11 nt, Human
aagaacugaaa

SEQ ID NO: 2705942 - RNA, 13 nt, Human
aagaacugaaauc

SEQ ID NO: 2705943 - RNA, 12 nt, Human
aagaacugaaau

SEQ ID NO: 2705944 - RNA, 20 nt, Human
aacgcaggcccccaggugcc

SEQ ID NO: 2705945 - RNA, 15 nt, Human
aagaagacugcauua

SEQ ID NO: 2705946 - RNA, 20 nt, Human
aagaagacugcauuauauuu

SEQ ID NO: 2705947 - RNA, 21 nt, Human
aagacaaggaaaaaauaacaa

SEQ ID NO: 2705948 - RNA, 16 nt, Human
aaucucaauauuucag

SEQ ID NO: 2705949 - RNA, 20 nt, Human
aaugaauacuuuauaaagga

SEQ ID NO: 2705950 - RNA, 19 nt, Human
acugauaugggucuugaua

SEQ ID NO: 2705951 - RNA, 13 nt, Human
acugacacaugcu

SEQ ID NO: 2705952 - RNA, 19 nt, Human
acucguuaauuuguagugu

SEQ ID NO: 2705953 - RNA, 14 nt, Human
acucguuaauuugu

SEQ ID NO: 2705954 - RNA, 14 nt, Human
acucccuuucaaca

SEQ ID NO: 2705955 - RNA, 21 nt, Human
acuucagacauagaauuaaca

SEQ ID NO: 2705956 - RNA, 21 nt, Human
acuuaaaaaugguuuaaaugg

SEQ ID NO: 2705957 - RNA, 22 nt, Human
acuuaaaaaugguuuaaauggu

SEQ ID NO: 2705958 - RNA, 17 nt, Human
acuucaaauccuugaag

SEQ ID NO: 2705959 - RNA, 18 nt, Human
acuucaaauccuugaaga

SEQ ID NO: 2705960 - RNA, 17 nt, Human
acuguaaaauaauaacu

SEQ ID NO: 2705961 - RNA, 21 nt, Human
acccugucucuacuaaaaaua

SEQ ID NO: 2705962 - RNA, 20 nt, Human
acccucagaugcacaugagc

SEQ ID NO: 2705963 - RNA, 20 nt, Human
accucugccucagaaaacaa

SEQ ID NO: 2705964 - RNA, 14 nt, Human
acgcacacugucug

SEQ ID NO: 2705965 - RNA, 21 nt, Human
acauuuguauaaaauaauuuu

SEQ ID NO: 2705966 - RNA, 19 nt, Human
acauuuguauaaaauaauu

SEQ ID NO: 2705967 - RNA, 16 nt, Human
acauuuguauaaaaua

SEQ ID NO: 2705968 - RNA, 15 nt, Human
acauuugcucaugga

SEQ ID NO: 2705969 - RNA, 19 nt, Human
acagugauuaccagggacu

SEQ ID NO: 2705970 - RNA, 22 nt, Human
acaggaugguucccuugaugaa

SEQ ID NO: 2705971 - RNA, 24 nt, Human
acaggaugguucccuugaugaaga

SEQ ID NO: 2705972 - RNA, 15 nt, Human
acaccaauauucaua

SEQ ID NO: 2705973 - RNA, 22 nt, Human
aauuucauaccuaucaucuuaa

SEQ ID NO: 2705974 - RNA, 11 nt, Human
aauuguaauag

SEQ ID NO: 2705975 - RNA, 15 nt, Human
aauuggagcucgugg

SEQ ID NO: 2705976 - RNA, 14 nt, Human
agccagcaguucag

SEQ ID NO: 2705977 - RNA, 17 nt, Human
agcacugacuucuaagu

SEQ ID NO: 2705978 - RNA, 19 nt, Human
agcacugacuucuaaguaa

SEQ ID NO: 2705979 - RNA, 20 nt, Human
agauagauaggucagugcaa

SEQ ID NO: 2705980 - RNA, 23 nt, Human
agcaaaauuuuuucucuaggaaa

SEQ ID NO: 2705981 - RNA, 21 nt, Human
agaagacugcauuauauuuau

SEQ ID NO: 2705982 - RNA, 20 nt, Human
agaagagcuguucacagcca

SEQ ID NO: 2705983 - RNA, 13 nt, Human
agaagauagcagg

SEQ ID NO: 2705984 - RNA, 13 nt, Human
agaagagcuguuc

SEQ ID NO: 2705985 - RNA, 22 nt, Human
agaacagugauuaccagggacu

SEQ ID NO: 2705986 - RNA, 19 nt, Human
agacaaggaaaaaauaaca

SEQ ID NO: 2705987 - RNA, 18 nt, Human
aggaaaaaauaacaauga

SEQ ID NO: 2705988 - RNA, 18 nt, Human
agcuguaugauucccagc

SEQ ID NO: 2705989 - RNA, 17 nt, Human
agcuguaugauucccag

SEQ ID NO: 2705990 - RNA, 14 nt, Human
agcugcugaaacaa

SEQ ID NO: 2705991 - RNA, 15 nt, Human
agcugcugaaacaac

SEQ ID NO: 2705992 - RNA, 16 nt, Human
agcugcugaaacaaca

SEQ ID NO: 2705993 - RNA, 20 nt, Human
agcugcugaaacaacaaaua

SEQ ID NO: 2705994 - RNA, 13 nt, Human
agcgacagugaga

SEQ ID NO: 2705995 - RNA, 15 nt, Human
agcgacagugagacu

SEQ ID NO: 2705996 - RNA, 12 nt, Human
agcuacaaaugc

SEQ ID NO: 2705997 - RNA, 13 nt, Human
agcuacaaaugca

SEQ ID NO: 2705998 - RNA, 20 nt, Human
aggcagagguugcagugagc

SEQ ID NO: 2705999 - RNA, 23 nt, Human
aggccaugggcacuguggguaga

SEQ ID NO: 2706000 - RNA, 17 nt, Human
agggacaggauaagagg

SEQ ID NO: 2706001 - RNA, 20 nt, Human
agggauuagggagagaagau

SEQ ID NO: 2706002 - RNA, 20 nt, Human
augggacauuugcucaugga

SEQ ID NO: 2706003 - RNA, 15 nt, Human
augggacagggagga

SEQ ID NO: 2706004 - RNA, 14 nt, Human
augggaaagcauug

SEQ ID NO: 2706005 - RNA, 20 nt, Human
augggaaagcauuguaaaug

SEQ ID NO: 2706006 - RNA, 23 nt, Human
auggcuuccuggcaauagucaaa

SEQ ID NO: 2706007 - RNA, 14 nt, Human
aucaaaagaaagaa

SEQ ID NO: 2706008 - RNA, 12 nt, Human
auccuugaagau

SEQ ID NO: 2706009 - RNA, 21 nt, Human
aucaugaauuaguuuuauaug

SEQ ID NO: 2706010 - RNA, 13 nt, Human
agucauuuaauaa

SEQ ID NO: 2706011 - RNA, 13 nt, Human
agugauuaccagg

SEQ ID NO: 2706012 - RNA, 19 nt, Human
agugaugucacuagggcag

SEQ ID NO: 2706013 - RNA, 13 nt, Human
aguacucauacau

SEQ ID NO: 2706014 - RNA, 16 nt, Human
auaaaagacagugaaa

SEQ ID NO: 2706015 - RNA, 15 nt, Human
auaaaagacagugaa

SEQ ID NO: 2706016 - RNA, 14 nt, Human
gcccuguuaaaaga

SEQ ID NO: 2706017 - RNA, 17 nt, Human
gcccuguuaaaagauga

SEQ ID NO: 2706018 - RNA, 13 nt, Human
gcccuguuaaaag

SEQ ID NO: 2706019 - RNA, 16 nt, Human
gcccccaggugccagu

SEQ ID NO: 2706020 - RNA, 16 nt, Human
gccauaugaaaaggcu

SEQ ID NO: 2706021 - RNA, 23 nt, Human
gccagcaguucagagcugcccuc

SEQ ID NO: 2706022 - RNA, 22 nt, Human
gccagcaguucagagcugcccu

SEQ ID NO: 2706023 - RNA, 22 nt, Human
gccagacaucaacagauaaaua

SEQ ID NO: 2706024 - RNA, 19 nt, Human
gccagauuuuccugaaaac

SEQ ID NO: 2706025 - RNA, 15 nt, Human
gcuccccucggagaa

SEQ ID NO: 2706026 - RNA, 18 nt, Human
gcuccccucggagaagag

SEQ ID NO: 2706027 - RNA, 21 nt, Human
gcuaguaauuggaaaggcagc

SEQ ID NO: 2706028 - RNA, 16 nt, Human
gcuaguaucaaaagaa

SEQ ID NO: 2706029 - RNA, 17 nt, Human
gcuggagcucugcccau

SEQ ID NO: 2706030 - RNA, 14 nt, Human
gcuggagcucugcc

SEQ ID NO: 2706031 - RNA, 20 nt, Human
gcugccuccccuccucugcu

SEQ ID NO: 2706032 - RNA, 17 nt, Human
gcugccuccccuccucu

SEQ ID NO: 2706033 - RNA, 16 nt, Human
gcugccuccccuccuc

SEQ ID NO: 2706034 - RNA, 22 nt, Human
gcugccuccccuccucugcuug

SEQ ID NO: 2706035 - RNA, 21 nt, Human
gcugccuccccuccucugcuu

SEQ ID NO: 2706036 - RNA, 15 nt, Human
ggaggcugagauggg

SEQ ID NO: 2706037 - RNA, 19 nt, Human
ggaggcugagaugggagaa

SEQ ID NO: 2706038 - RNA, 12 nt, Human
ggauuuucagcc

SEQ ID NO: 2706039 - RNA, 23 nt, Human
ggaugguucccuugaugaagaag

SEQ ID NO: 2706040 - RNA, 22 nt, Human
ggaugguucccuugaugaagaa

SEQ ID NO: 2706041 - RNA, 16 nt, Human
ggccuccauccugagg

SEQ ID NO: 2706042 - RNA, 23 nt, Human
aaaauaauuuuuauauuugaaau

SEQ ID NO: 2706043 - RNA, 21 nt, Human
aaaauaauuuuuauauuugaa

SEQ ID NO: 2706044 - RNA, 20 nt, Human
aaaauaauuuuuauauuuga

SEQ ID NO: 2706045 - RNA, 21 nt, Human
gggauuuucagcccucagaau

SEQ ID NO: 2706046 - RNA, 17 nt, Human
gggauugaaggaugcug

SEQ ID NO: 2706047 - RNA, 23 nt, Human
gggcagcugccuccccuccucug

SEQ ID NO: 2706048 - RNA, 20 nt, Human
gggcagcugccuccccuccu

SEQ ID NO: 2706049 - RNA, 19 nt, Human
gggcagcugccuccccucc

SEQ ID NO: 2706050 - RNA, 14 nt, Human
gggcagcugccucc

SEQ ID NO: 2706051 - RNA, 13 nt, Human
gggcagcugccuc

SEQ ID NO: 2706052 - RNA, 12 nt, Human
gggcagcugccu

SEQ ID NO: 2706053 - RNA, 11 nt, Human
gggaggcagag

SEQ ID NO: 2706054 - RNA, 20 nt, Human
gggaggcagagguugcagug

SEQ ID NO: 2706055 - RNA, 22 nt, Human
aaaagcuccauuuuuagugaaa

SEQ ID NO: 2706056 - RNA, 21 nt, Human
aaaacuuuaugcuaagugaaa

SEQ ID NO: 2706057 - RNA, 20 nt, Human
aaagaggcagcuugaaacug

SEQ ID NO: 2706058 - RNA, 18 nt, Human
aaagagaacuuccagauc

SEQ ID NO: 2706059 - RNA, 22 nt, Human
aaagacuauucaaacagucuca

SEQ ID NO: 2706060 - RNA, 13 nt, Human
aaagacuccaaag

SEQ ID NO: 2706061 - RNA, 23 nt, Human
aaagacuauucaaacagucucag

SEQ ID NO: 2706062 - RNA, 16 nt, Human
aaagaaugauuaugaa

SEQ ID NO: 2706063 - RNA, 13 nt, Human
aaaggaauuuaaa

SEQ ID NO: 2706064 - RNA, 15 nt, Human
ggugccaguuauggc

SEQ ID NO: 2706065 - RNA, 20 nt, Human
ggugauuuagcaggaagcug

SEQ ID NO: 2706066 - RNA, 14 nt, Human
ggucugugagaugc

SEQ ID NO: 2706067 - RNA, 24 nt, Human
ggucugugagaugcuagaacuccc

SEQ ID NO: 2706068 - RNA, 16 nt, Human
aaaccacagcaguuga

SEQ ID NO: 2706069 - RNA, 15 nt, Human
aaaccacagcaguug

SEQ ID NO: 2706070 - RNA, 16 nt, Human
aaacucauuucuagca

SEQ ID NO: 2706071 - RNA, 19 nt, Human
aaaauuuuuucucuaggaa

SEQ ID NO: 2706072 - RNA, 17 nt, Human
aaacaaggaugaauuaa

SEQ ID NO: 2706073 - RNA, 14 nt, Human
aaacacaacuauau

SEQ ID NO: 2706074 - RNA, 13 nt, Human
aaacauauauaac

SEQ ID NO: 2706075 - RNA, 19 nt, Human
aaacauauauaacaaugcu

SEQ ID NO: 2706076 - RNA, 16 nt, Human
aaacauauauaacaau

SEQ ID NO: 2706077 - RNA, 21 nt, Human
aaacauauauaacaaugcugu

SEQ ID NO: 2706078 - RNA, 21 nt, Human
gacagaaagcagaacagugau

SEQ ID NO: 2706079 - RNA, 14 nt, Human
gacacacugaagaa

SEQ ID NO: 2706080 - RNA, 16 nt, Human
gacacacugaagaagc

SEQ ID NO: 2706081 - RNA, 15 nt, Human
gacacacugaagaag

SEQ ID NO: 2706082 - RNA, 21 nt, Human
gacagugagacucugucucag

SEQ ID NO: 2706083 - RNA, 17 nt, Human
gacauuugcucauggaa

SEQ ID NO: 2706084 - RNA, 16 nt, Human
gacauuugcucaugga

SEQ ID NO: 2706085 - RNA, 21 nt, Human
gacucuuaagaagacugcauu

SEQ ID NO: 2706086 - RNA, 18 nt, Human
gacucuuaagaagacugc

SEQ ID NO: 2706087 - RNA, 14 nt, Human
gacucuuaagaaga

SEQ ID NO: 2706088 - RNA, 16 nt, Human
gacgcucucuggccuu

SEQ ID NO: 2706089 - RNA, 17 nt, Human
gacgcucucuggccuuc

SEQ ID NO: 2706090 - RNA, 15 nt, Human
gacgcucucuggccu

SEQ ID NO: 2706091 - RNA, 23 nt, Human
gaagcaacccaaauguucaucaa

SEQ ID NO: 2706092 - RNA, 14 nt, Human
gaagcaaaauuuuu

SEQ ID NO: 2706093 - RNA, 13 nt, Human
gaacugaaaucau

SEQ ID NO: 2706094 - RNA, 14 nt, Human
gaacugaaaucaua

SEQ ID NO: 2706095 - RNA, 19 nt, Human
gaacccgggaggcagaggu

SEQ ID NO: 2706096 - RNA, 23 nt, Human
gcacaguuuucugagaaagacua

SEQ ID NO: 2706097 - RNA, 20 nt, Human
gcacaguuuucugagaaaga

SEQ ID NO: 2706098 - RNA, 22 nt, Human
gcacaguuuucugagaaagacu

SEQ ID NO: 2706099 - RNA, 22 nt, Human
gcaauagucaaauugugugaaa

SEQ ID NO: 2706100 - RNA, 20 nt, Human
gcaaguauuagaauaccaca

SEQ ID NO: 2706101 - RNA, 22 nt, Human
gaugguucccuugaugaagaag

SEQ ID NO: 2706102 - RNA, 17 nt, Human
gauguagaggagaaacu

SEQ ID NO: 2706103 - RNA, 18 nt, Human
gauguagaggagaaacug

SEQ ID NO: 2706104 - RNA, 16 nt, Human
gaugaucuuuaaaaua

SEQ ID NO: 2706105 - RNA, 16 nt, Human
gauuuaccacuugugu

SEQ ID NO: 2706106 - RNA, 15 nt, Human
gauuuaccacuugug

SEQ ID NO: 2706107 - RNA, 15 nt, Human
gaggacgcucucugg

SEQ ID NO: 2706108 - RNA, 23 nt, Human
gaggcuccacuuggucugugaga

SEQ ID NO: 2706109 - RNA, 19 nt, Human
gaggcuccacuuggucugu

SEQ ID NO: 2706110 - RNA, 18 nt, Human
gaggcuccacuuggucug

SEQ ID NO: 2706111 - RNA, 16 nt, Human
gaguuuaaauuguaau

SEQ ID NO: 2706112 - RNA, 11 nt, Human
cuucagacaua

SEQ ID NO: 2706113 - RNA, 23 nt, Human
cuucaugcugucuacacuaagag

SEQ ID NO: 2706114 - RNA, 20 nt, Human
cuucuguuuuauaauuuugu

SEQ ID NO: 2706115 - RNA, 15 nt, Human
cuucuguuuuauaau

SEQ ID NO: 2706116 - RNA, 20 nt, Human
cuuuaaagggauggcaagau

SEQ ID NO: 2706117 - RNA, 21 nt, Human
cuuugagugucuuaauuaaaa

SEQ ID NO: 2706118 - RNA, 20 nt, Human
cugcuuauccguuagccgug

SEQ ID NO: 2706119 - RNA, 21 nt, Human
cuggugccucaccccuugcca

SEQ ID NO: 2706120 - RNA, 12 nt, Human
cuggugccucac

SEQ ID NO: 2706121 - RNA, 15 nt, Human
cugggcagcugccuc

SEQ ID NO: 2706122 - RNA, 14 nt, Human
cugggcagcugccu

SEQ ID NO: 2706123 - RNA, 13 nt, Human
cugggcagcugcc

SEQ ID NO: 2706124 - RNA, 16 nt, Human
cugcacuccagccuga

SEQ ID NO: 2706125 - RNA, 17 nt, Human
cugcacuccagccugag

SEQ ID NO: 2706126 - RNA, 20 nt, Human
cugcacuccagccugagcga

SEQ ID NO: 2706127 - RNA, 15 nt, Human
ccaggggccaugaau

SEQ ID NO: 2706128 - RNA, 20 nt, Human
ccacuuggucugugagaugc

SEQ ID NO: 2706129 - RNA, 22 nt, Human
ccacuuggucugugagaugcua

SEQ ID NO: 2706130 - RNA, 15 nt, Human
ccacuuggucuguga

SEQ ID NO: 2706131 - RNA, 16 nt, Human
ccacuuggucugugag

SEQ ID NO: 2706132 - RNA, 17 nt, Human
ccacuuggucugugaga

SEQ ID NO: 2706133 - RNA, 19 nt, Human
ccacuuggucugugagaug

SEQ ID NO: 2706134 - RNA, 12 nt, Human
ccacuuggucug

SEQ ID NO: 2706135 - RNA, 13 nt, Human
ccauuuaaagcuu

SEQ ID NO: 2706136 - RNA, 22 nt, Human
ccauuguggucacaggaaguag

SEQ ID NO: 2706137 - RNA, 18 nt, Human
ccaugggcacugugggua

SEQ ID NO: 2706138 - RNA, 15 nt, Human
ccccauuguggucac

SEQ ID NO: 2706139 - RNA, 22 nt, Human
ccucuccugggcagcugccucc

SEQ ID NO: 2706140 - RNA, 21 nt, Human
ccucuccugggcagcugccuc

SEQ ID NO: 2706141 - RNA, 16 nt, Human
ccucuccugggcagcu

SEQ ID NO: 2706142 - RNA, 15 nt, Human
ccucuccugggcagc

SEQ ID NO: 2706143 - RNA, 14 nt, Human
ccucuccugggcag

SEQ ID NO: 2706144 - RNA, 20 nt, Human
ccucuccugggcagcugccu

SEQ ID NO: 2706145 - RNA, 19 nt, Human
ccucuccugggcagcugcc

SEQ ID NO: 2706146 - RNA, 18 nt, Human
ccucuccugggcagcugc

SEQ ID NO: 2706147 - RNA, 17 nt, Human
ccucuccugggcagcug

SEQ ID NO: 2706148 - RNA, 13 nt, Human
cccucggagaaga

SEQ ID NO: 2706149 - RNA, 14 nt, Human
cccugagcaggauu

SEQ ID NO: 2706150 - RNA, 20 nt, Human
ccuaacgaaguauccuucag

SEQ ID NO: 2706151 - RNA, 19 nt, Human
cucuauguucuaagaagug

SEQ ID NO: 2706152 - RNA, 15 nt, Human
cucuccccaugaugu

SEQ ID NO: 2706153 - RNA, 16 nt, Human
cucuccccaugauguu

SEQ ID NO: 2706154 - RNA, 14 nt, Human
cucucuggccuucg

SEQ ID NO: 2706155 - RNA, 16 nt, Human
cucucuggccuucggc

SEQ ID NO: 2706156 - RNA, 13 nt, Human
cucucuggccuuc

SEQ ID NO: 2706157 - RNA, 21 nt, Human
cucucuguaauaaacucauuu

SEQ ID NO: 2706158 - RNA, 16 nt, Human
cucucuguaauaaacu

SEQ ID NO: 2706159 - RNA, 22 nt, Human
cucccuccaccucccugcaaua

SEQ ID NO: 2706160 - RNA, 21 nt, Human
cucccuccaccucccugcaau

SEQ ID NO: 2706161 - RNA, 20 nt, Human
cucccuccaccucccugcaa

SEQ ID NO: 2706162 - RNA, 19 nt, Human
cucccuccaccucccugca

SEQ ID NO: 2706163 - RNA, 16 nt, Human
cucaguccaugaagau

SEQ ID NO: 2706164 - RNA, 23 nt, Human
cuaugucauuugcuggagcucug

SEQ ID NO: 2706165 - RNA, 18 nt, Human
cuaucucauuuccaagca

SEQ ID NO: 2706166 - RNA, 18 nt, Human
cuauguucuaagaaguga

SEQ ID NO: 2706167 - RNA, 17 nt, Human
ccuucucuucacaguca

SEQ ID NO: 2706168 - RNA, 20 nt, Human
cuaacgaaguauccuucagc

SEQ ID NO: 2706169 - RNA, 20 nt, Human
cuacaaaaacacagcaaggg

SEQ ID NO: 2706170 - RNA, 12 nt, Human
ccuuuucccaac

SEQ ID NO: 2706171 - RNA, 22 nt, Human
auugaggacacugauauggguc

SEQ ID NO: 2706172 - RNA, 16 nt, Human
auuucagcagcugcag

SEQ ID NO: 2706173 - RNA, 16 nt, Human
auuuuuauauuugaaa

SEQ ID NO: 2706174 - RNA, 19 nt, Human
auuuuuauauuugaaauau

SEQ ID NO: 2706175 - RNA, 17 nt, Human
caaacauauauaacaau

SEQ ID NO: 2706176 - RNA, 21 nt, Human
caaaagguauuuuaaucacca

SEQ ID NO: 2706177 - RNA, 19 nt, Human
auuuucuauaauuuaaaua

SEQ ID NO: 2706178 - RNA, 17 nt, Human
auuuucuauaauuuaaa

SEQ ID NO: 2706179 - RNA, 18 nt, Human
auuuucuauaauuuaaau

SEQ ID NO: 2706180 - RNA, 13 nt, Human
cacaucagcuugc

SEQ ID NO: 2706181 - RNA, 23 nt, Human
cacaucagcuugcccuguuaaaa

SEQ ID NO: 2706182 - RNA, 23 nt, Human
cacugaagaagcaccaaucauga

SEQ ID NO: 2706183 - RNA, 11 nt, Human
cacugaagaag

SEQ ID NO: 2706184 - RNA, 16 nt, Human
cacuccagugagacag

SEQ ID NO: 2706185 - RNA, 21 nt, Human
cacuccagugagacagcucug

SEQ ID NO: 2706186 - RNA, 14 nt, Human
caagcaaguauuag

SEQ ID NO: 2706187 - RNA, 12 nt, Human
caacuccagaaa

SEQ ID NO: 2706188 - RNA, 19 nt, Human
caacuaucucauuuccaag

SEQ ID NO: 2706189 - RNA, 19 nt, Human
caacuauauuguuugcuaa

SEQ ID NO: 2706190 - RNA, 17 nt, Human
caaucagccuaguugau

SEQ ID NO: 2706191 - RNA, 19 nt, Human
cagcuguaugauucccagc

SEQ ID NO: 2706192 - RNA, 20 nt, Human
cagcugccuccccuccucug

SEQ ID NO: 2706193 - RNA, 19 nt, Human
cagcugccuccccuccucu

SEQ ID NO: 2706194 - RNA, 18 nt, Human
cagcugccuccccuccuc

SEQ ID NO: 2706195 - RNA, 17 nt, Human
cagcugccuccccuccu

SEQ ID NO: 2706196 - RNA, 16 nt, Human
cagcugccuccccucc

SEQ ID NO: 2706197 - RNA, 15 nt, Human
cagcugccuccccuc

SEQ ID NO: 2706198 - RNA, 14 nt, Human
cagcugccuccccu

SEQ ID NO: 2706199 - RNA, 9 nt, Human
cagcugccu

SEQ ID NO: 2706200 - RNA, 10 nt, Human
cagcugccuc

SEQ ID NO: 2706201 - RNA, 11 nt, Human
cagcugccucc

SEQ ID NO: 2706202 - RNA, 17 nt, Human
cagcuuauucacaagac

SEQ ID NO: 2706203 - RNA, 20 nt, Human
cagcuuauugucuagugaaa

SEQ ID NO: 2706204 - RNA, 20 nt, Human
cagcuguaugauucccagcc

SEQ ID NO: 2706205 - RNA, 14 nt, Human
cagcuuauugucua

SEQ ID NO: 2706206 - RNA, 20 nt, Human
caggaaagagaacuuccaga

SEQ ID NO: 2706207 - RNA, 16 nt, Human
caggaaagagaacuuc

SEQ ID NO: 2706208 - RNA, 11 nt, Human
caggcuacugu

SEQ ID NO: 2706209 - RNA, 23 nt, Human
cagagcugcccucuccugggcag

SEQ ID NO: 2706210 - RNA, 21 nt, Human
cagagcugcccucuccugggc

SEQ ID NO: 2706211 - RNA, 20 nt, Human
cagagcugcccucuccuggg

SEQ ID NO: 2706212 - RNA, 19 nt, Human
cagagcugcccucuccugg

SEQ ID NO: 2706213 - RNA, 18 nt, Human
cagagcugcccucuccug

SEQ ID NO: 2706214 - RNA, 14 nt, Human
cagccagacuggca

SEQ ID NO: 2706215 - RNA, 15 nt, Human
cagccagacuggcac

SEQ ID NO: 2706216 - RNA, 18 nt, Human
cagccagacuggcacagu

SEQ ID NO: 2706217 - RNA, 23 nt, Human
cagccagcaguucagagcugccc

SEQ ID NO: 2706218 - RNA, 19 nt, Human
cagacuggauaguccgucu

SEQ ID NO: 2706219 - RNA, 22 nt, Human
cagacuggcacaguuuucugag

SEQ ID NO: 2706220 - RNA, 23 nt, Human
cagacuggcacaguuuucugaga

SEQ ID NO: 2706221 - RNA, 17 nt, Human
cagacuggcacaguuuu

SEQ ID NO: 2706222 - RNA, 18 nt, Human
cagacuggcacaguuuuc

SEQ ID NO: 2706223 - RNA, 22 nt, Human
caguucagagcugcccucuccu

SEQ ID NO: 2706224 - RNA, 21 nt, Human
caguucagagcugcccucucc

SEQ ID NO: 2706225 - RNA, 19 nt, Human
caguucagagcugcccucu

SEQ ID NO: 2706226 - RNA, 18 nt, Human
caguucagagcugcccuc

SEQ ID NO: 2706227 - RNA, 24 nt, Human
caguucagagcugcccucuccugg

SEQ ID NO: 2706228 - RNA, 23 nt, Human
caguucagagcugcccucuccug

SEQ ID NO: 2706229 - RNA, 22 nt, Human
caguuauuauauuuacaaaugg

SEQ ID NO: 2706230 - RNA, 17 nt, Human
caguucagagcugcccu

SEQ ID NO: 2706231 - RNA, 16 nt, Human
caguucagagcugccc

SEQ ID NO: 2706232 - RNA, 15 nt, Human
caguucagagcugcc

SEQ ID NO: 2706233 - RNA, 22 nt, Human
cagugauuaccagggacugagg

SEQ ID NO: 2706234 - RNA, 13 nt, Human
caguuauggcuau

SEQ ID NO: 2706235 - RNA, 19 nt, Human
caguuauggcuauaggugc

SEQ ID NO: 2706236 - RNA, 20 nt, Human
caguuauggcuauaggugcu

SEQ ID NO: 2706237 - RNA, 17 nt, Human
caguuauuauauuuaca

SEQ ID NO: 2706238 - RNA, 21 nt, Human
caguuauuauauuuacaaaug

SEQ ID NO: 2706239 - RNA, 16 nt, Human
cauagguuuaauaauu

SEQ ID NO: 2706240 - RNA, 19 nt, Human
cauagcagcuuauucacaa

SEQ ID NO: 2706241 - RNA, 18 nt, Human
cauccugaggcuccacuu

SEQ ID NO: 2706242 - RNA, 19 nt, Human
cauccugaggcuccacuug

SEQ ID NO: 2706243 - RNA, 19 nt, Human
cauuauauuuauuacugua

SEQ ID NO: 2706244 - RNA, 21 nt, Human
ccaacuccagaaagugacaag

SEQ ID NO: 2706245 - RNA, 14 nt, Human
ccaaaaggcagaag

SEQ ID NO: 2706246 - RNA, 16 nt, Human
cauuuguauaaaauaa

SEQ ID NO: 2706247 - RNA, 14 nt, Human
cauuuguauaaaau

SEQ ID NO: 2706248 - RNA, 22 nt, Human
auuuaccacuuguguuuugcaa

SEQ ID NO: 2706249 - RNA, 15 nt, Human
auuuaccacuugugu

SEQ ID NO: 2706250 - RNA, 16 nt, Human
auuguaguccuguaau

SEQ ID NO: 2706251 - RNA, 17 nt, Human
auuuaaaaaaaaaccug

SEQ ID NO: 2706252 - RNA, 20 nt, Human
auuuauuacuguaagaaaau

SEQ ID NO: 2706253 - RNA, 19 nt, Human
auuuauuacuguaagaaaa

SEQ ID NO: 2706254 - RNA, 21 nt, Human
auuuauuuuaauaauguuuca

SEQ ID NO: 2706255 - RNA, 20 nt, Human
auuucuugagguaaaagcau

SEQ ID NO: 2706256 - RNA, 17 nt, Human
auuggagcucgugggac

SEQ ID NO: 2706257 - RNA, 16 nt, Human
auuggagcucguggaa

SEQ ID NO: 2706258 - RNA, 17 nt, Human
auugaaggaugcugucu

SEQ ID NO: 2706259 - RNA, 24 nt, Human
auuccuagaaacugacacaugcug

SEQ ID NO: 2706260 - RNA, 16 nt, Human
uuuucucuaggaaaua

SEQ ID NO: 2706261 - RNA, 16 nt, Human
uuuucuauaauuuaaa

SEQ ID NO: 2706262 - RNA, 20 nt, Human
uuuucaggcuagauguaugu

SEQ ID NO: 2706263 - RNA, 22 nt, Human
uuuuauggcacuaguauuucua

SEQ ID NO: 2706264 - RNA, 20 nt, Human
augugcuaguaauuggaaag

SEQ ID NO: 2706265 - RNA, 21 nt, Human
augugcuaguaauuggaaagg

SEQ ID NO: 2706266 - RNA, 19 nt, Human
auguauauuuuauaucaau

SEQ ID NO: 2706267 - RNA, 23 nt, Human
augucgucaaagcugaaauggac

SEQ ID NO: 2706268 - RNA, 17 nt, Human
uuuguaguguuggagaa

SEQ ID NO: 2706269 - RNA, 19 nt, Human
uuugcuaagcauuccaacu

SEQ ID NO: 2706270 - RNA, 20 nt, Human
uuugcuggagcucugcccau

SEQ ID NO: 2706271 - RNA, 22 nt, Human
auucaaacagucucaggaaauc

SEQ ID NO: 2706272 - RNA, 20 nt, Human
auuauauggcuugaguuuaa

SEQ ID NO: 2706273 - RNA, 17 nt, Human
auuccaagugauugaaa

SEQ ID NO: 2706274 - RNA, 15 nt, Human
uuuuugaagcuguau

SEQ ID NO: 2706275 - RNA, 15 nt, Human
uuuuguuuucauuau

SEQ ID NO: 2706276 - RNA, 14 nt, Human
uuuugugaagcaaa

SEQ ID NO: 2706277 - RNA, 16 nt, Human
auuacuguaagaaaau

SEQ ID NO: 2706278 - RNA, 15 nt, Human
auuacuguaagaaaa

SEQ ID NO: 2706279 - RNA, 20 nt, Human
uugucaauaaaauccauaca

SEQ ID NO: 2706280 - RNA, 17 nt, Human
augagguacugagagug

SEQ ID NO: 2706281 - RNA, 18 nt, Human
augagguacugagaguga

SEQ ID NO: 2706282 - RNA, 15 nt, Human
augagguacugagag

SEQ ID NO: 2706283 - RNA, 13 nt, Human
augauuucauuca

SEQ ID NO: 2706284 - RNA, 18 nt, Human
uuuaaaaaaauuccaagu

SEQ ID NO: 2706285 - RNA, 12 nt, Human
augcaaagcacu

SEQ ID NO: 2706286 - RNA, 13 nt, Human
augcaaagcacug

SEQ ID NO: 2706287 - RNA, 14 nt, Human
augcaaagcacuga

SEQ ID NO: 2706288 - RNA, 21 nt, Human
uuuaaauauaugcuaagucuu

SEQ ID NO: 2706289 - RNA, 17 nt, Human
uuucaaacauauauaac

SEQ ID NO: 2706290 - RNA, 19 nt, Human
uuucaaacauauauaacaa

SEQ ID NO: 2706291 - RNA, 21 nt, Human
augcuucuguuuuauaauuuu

SEQ ID NO: 2706292 - RNA, 22 nt, Human
augcuguauuuuaaaagaauga

SEQ ID NO: 2706293 - RNA, 19 nt, Human
augcuguauuuuaaaagaa

SEQ ID NO: 2706294 - RNA, 23 nt, Human
augcuguauuuuaaaagaaugau

SEQ ID NO: 2706295 - RNA, 18 nt, Human
augcuacaggauuugaaa

SEQ ID NO: 2706296 - RNA, 22 nt, Human
augccuuuucccaacuccagaa

SEQ ID NO: 2706297 - RNA, 20 nt, Human
augccuuuucccaacuccag

SEQ ID NO: 2706298 - RNA, 14 nt, Human
augccuuuucccaa

SEQ ID NO: 2706299 - RNA, 19 nt, Human
uuuauaugcuucuguuuua

SEQ ID NO: 2706300 - RNA, 21 nt, Human
uuuauaugcuucuguuuuaua

SEQ ID NO: 2706301 - RNA, 12 nt, Human
uugacuuuuuau

SEQ ID NO: 2706302 - RNA, 13 nt, Human
uugacaugggaca

SEQ ID NO: 2706303 - RNA, 19 nt, Human
aucucaaaacugcacuguc

SEQ ID NO: 2706304 - RNA, 20 nt, Human
aucucaaaacugcacuguca

SEQ ID NO: 2706305 - RNA, 15 nt, Human
aucucaaaacugcac

SEQ ID NO: 2706306 - RNA, 15 nt, Human
uuggagaagaacuga

SEQ ID NO: 2706307 - RNA, 22 nt, Human
uuggagaagaacugaaaucaua

SEQ ID NO: 2706308 - RNA, 17 nt, Human
uuggagaagaacugaaa

SEQ ID NO: 2706309 - RNA, 12 nt, Human
aucuuuaaaaua

SEQ ID NO: 2706310 - RNA, 15 nt, Human
aucuuuaaaauacac

SEQ ID NO: 2706311 - RNA, 16 nt, Human
aucuuauaauuuaaaa

SEQ ID NO: 2706312 - RNA, 15 nt, Human
aucuuauaauuuaaa

SEQ ID NO: 2706313 - RNA, 18 nt, Human
augaacuuguaaaggaau

SEQ ID NO: 2706314 - RNA, 23 nt, Human
auaugcaaagcacugacuucuaa

SEQ ID NO: 2706315 - RNA, 16 nt, Human
auaugcaaagcacuga

SEQ ID NO: 2706316 - RNA, 15 nt, Human
auaugcaaagcacug

SEQ ID NO: 2706317 - RNA, 15 nt, Human
uucagcccucagaau

SEQ ID NO: 2706318 - RNA, 15 nt, Human
auauaacaaugcugu

SEQ ID NO: 2706319 - RNA, 12 nt, Human
auauaacaaugc

SEQ ID NO: 2706320 - RNA, 19 nt, Human
auauaagcuuguauuccuu

SEQ ID NO: 2706321 - RNA, 18 nt, Human
auauauaacaaugcugua

SEQ ID NO: 2706322 - RNA, 17 nt, Human
auauauaacaaugcugu

SEQ ID NO: 2706323 - RNA, 19 nt, Human
auauauaacaaugcuguau

SEQ ID NO: 2706324 - RNA, 18 nt, Human
auagucaaauugugugaa

SEQ ID NO: 2706325 - RNA, 17 nt, Human
auagucaaauuguguga

SEQ ID NO: 2706326 - RNA, 15 nt, Human
uucaaacauauauaa

SEQ ID NO: 2706327 - RNA, 21 nt, Human
auaggaauugacccacaagaa

SEQ ID NO: 2706328 - RNA, 14 nt, Human
auagcuacuaauuu

SEQ ID NO: 2706329 - RNA, 17 nt, Human
auagcuacuaauuuuaa

SEQ ID NO: 2706330 - RNA, 18 nt, Human
auagcuacuaauuuuaaa

SEQ ID NO: 2706331 - RNA, 17 nt, Human
uuauuguuuaaaaucau

SEQ ID NO: 2706332 - RNA, 18 nt, Human
uucucaacuccaaacuga

SEQ ID NO: 2706333 - RNA, 14 nt, Human
uucucaacuccaaa

SEQ ID NO: 2706334 - RNA, 23 nt, Human
aucccucccuccaccucccugca

SEQ ID NO: 2706335 - RNA, 13 nt, Human
aucccucccucca

SEQ ID NO: 2706336 - RNA, 11 nt, Human
aucccucccuc

SEQ ID NO: 2706337 - RNA, 16 nt, Human
uucugcaucagcugcu

SEQ ID NO: 2706338 - RNA, 23 nt, Human
uucugcaucagcugcugaaacaa

SEQ ID NO: 2706339 - RNA, 14 nt, Human
uucugaagaagaug

SEQ ID NO: 2706340 - RNA, 13 nt, Human
uucugaagaagau

SEQ ID NO: 2706341 - RNA, 12 nt, Human
uucugaagaaga

SEQ ID NO: 2706342 - RNA, 19 nt, Human
auauuugaaauauugacuu

SEQ ID NO: 2706343 - RNA, 14 nt, Human
auauuugaaauauu

SEQ ID NO: 2706344 - RNA, 23 nt, Human
auauuugaaauauugacuuuuua

SEQ ID NO: 2706345 - RNA, 12 nt, Human
auauuuuaacuu

SEQ ID NO: 2706346 - RNA, 22 nt, Human
auauuuguaucacaaaucuuaa

SEQ ID NO: 2706347 - RNA, 13 nt, Human
auauuugaaauau

SEQ ID NO: 2706348 - RNA, 19 nt, Human
aucaauuuuucuuauuuca

SEQ ID NO: 2706349 - RNA, 14 nt, Human
uguuccuagugaaa

SEQ ID NO: 2706350 - RNA, 18 nt, Human
uguuccuagugaaagagg

SEQ ID NO: 2706351 - RNA, 15 nt, Human
uguuauaaucuuuca

SEQ ID NO: 2706352 - RNA, 13 nt, Human
uguguaaguagau

SEQ ID NO: 2706353 - RNA, 20 nt, Human
uguggucacaggaaguagag

SEQ ID NO: 2706354 - RNA, 15 nt, Human
agugaaagaaaauaa

SEQ ID NO: 2706355 - RNA, 16 nt, Human
agugaacaaauuuaca

SEQ ID NO: 2706356 - RNA, 20 nt, Human
agugaacaaauuuacagaga

SEQ ID NO: 2706357 - RNA, 22 nt, Human
agucucaggaaaucaaauaugc

SEQ ID NO: 2706358 - RNA, 15 nt, Human
ugugagaugcuagaa

SEQ ID NO: 2706359 - RNA, 19 nt, Human
ugugagaugcuagaacucc

SEQ ID NO: 2706360 - RNA, 18 nt, Human
agucuuucacauuuaaau

SEQ ID NO: 2706361 - RNA, 19 nt, Human
auaaaauccauacauuugu

SEQ ID NO: 2706362 - RNA, 18 nt, Human
auaaaauccauacauuug

SEQ ID NO: 2706363 - RNA, 21 nt, Human
auaaaauaauuuuuauauuug

SEQ ID NO: 2706364 - RNA, 16 nt, Human
auaaaauaauuuuuau

SEQ ID NO: 2706365 - RNA, 15 nt, Human
auaaaauaauuuuua

SEQ ID NO: 2706366 - RNA, 18 nt, Human
uuaaguaaugauaacugg

SEQ ID NO: 2706367 - RNA, 22 nt, Human
uuaagaagacugcauuauauuu

SEQ ID NO: 2706368 - RNA, 20 nt, Human
uuaagaagacugcauuauau

SEQ ID NO: 2706369 - RNA, 15 nt, Human
uuacuguaagaaaau

SEQ ID NO: 2706370 - RNA, 12 nt, Human
uuaccugggaaa

SEQ ID NO: 2706371 - RNA, 14 nt, Human
uuaccuuacagaag

SEQ ID NO: 2706372 - RNA, 16 nt, Human
aguuuagcuggaaaag

SEQ ID NO: 2706373 - RNA, 19 nt, Human
uguuuucauuaucucaaaa

SEQ ID NO: 2706374 - RNA, 14 nt, Human
uguuuugcaagcca

SEQ ID NO: 2706375 - RNA, 16 nt, Human
aguucugaagaagaug

SEQ ID NO: 2706376 - RNA, 16 nt, Human
aguucugcagauaaac

SEQ ID NO: 2706377 - RNA, 21 nt, Human
aguucugcagauaaacaguag

SEQ ID NO: 2706378 - RNA, 18 nt, Human
aggggagcaugggaagug

SEQ ID NO: 2706379 - RNA, 21 nt, Human
agggaggacgcucucuggccu

SEQ ID NO: 2706380 - RNA, 22 nt, Human
agggaggacgcucucuggccuu

SEQ ID NO: 2706381 - RNA, 23 nt, Human
agggaggacgcucucuggccuuc

SEQ ID NO: 2706382 - RNA, 13 nt, Human
agggaaauuucag

SEQ ID NO: 2706383 - RNA, 13 nt, Human
aguaaaauccaca

SEQ ID NO: 2706384 - RNA, 20 nt, Human
aguaaugauaacuggaaacu

SEQ ID NO: 2706385 - RNA, 18 nt, Human
aguaaugauaacuggaaa

SEQ ID NO: 2706386 - RNA, 17 nt, Human
aguaaugauaacuggaa

SEQ ID NO: 2706387 - RNA, 13 nt, Human
aguaaugauaacu

SEQ ID NO: 2706388 - RNA, 16 nt, Human
aguauuucuaugaaau

SEQ ID NO: 2706389 - RNA, 17 nt, Human
aguauuucuaugaaaua

SEQ ID NO: 2706390 - RNA, 18 nt, Human
aguauuucuaugaaauau

SEQ ID NO: 2706391 - RNA, 17 nt, Human
agucaccucauggaauu

SEQ ID NO: 2706392 - RNA, 15 nt, Human
agucaccucauggaa

SEQ ID NO: 2706393 - RNA, 14 nt, Human
agucaccucaugga

SEQ ID NO: 2706394 - RNA, 18 nt, Human
aguauuagaauaccacag

SEQ ID NO: 2706395 - RNA, 13 nt, Human
aguagucagacug

SEQ ID NO: 2706396 - RNA, 13 nt, Human
uguauuacaaauc

SEQ ID NO: 2706397 - RNA, 22 nt, Human
uguauuacaaauccaaugaaau

SEQ ID NO: 2706398 - RNA, 15 nt, Human
uguaucacaaaucuu

SEQ ID NO: 2706399 - RNA, 18 nt, Human
uguaucacaaaucuuaac

SEQ ID NO: 2706400 - RNA, 15 nt, Human
uguaguguuggagaa

SEQ ID NO: 2706401 - RNA, 14 nt, Human
uguaguguuggaga

SEQ ID NO: 2706402 - RNA, 16 nt, Human
uguaaaggaauuuaaa

SEQ ID NO: 2706403 - RNA, 14 nt, Human
agcuguucacagcc

SEQ ID NO: 2706404 - RNA, 16 nt, Human
agcugcccucuccugg

SEQ ID NO: 2706405 - RNA, 15 nt, Human
agcugcccucuccug

SEQ ID NO: 2706406 - RNA, 14 nt, Human
agcugcccucuccu

SEQ ID NO: 2706407 - RNA, 13 nt, Human
agcugcccucucc

SEQ ID NO: 2706408 - RNA, 20 nt, Human
ugcccuguuaaaagaugaaa

SEQ ID NO: 2706409 - RNA, 20 nt, Human
agcuugcccuggugccucac

SEQ ID NO: 2706410 - RNA, 16 nt, Human
agcuugcccuguuaaa

SEQ ID NO: 2706411 - RNA, 18 nt, Human
agcuugcccuguuaaaag

SEQ ID NO: 2706412 - RNA, 19 nt, Human
agcuugcccuguuaaaaga

SEQ ID NO: 2706413 - RNA, 14 nt, Human
ugcuacaaaaacac

SEQ ID NO: 2706414 - RNA, 19 nt, Human
ugccuuuucccaacuccag

SEQ ID NO: 2706415 - RNA, 17 nt, Human
ugccuuuucccaacucc

SEQ ID NO: 2706416 - RNA, 20 nt, Human
aggaaaucaaauaugcaaag

SEQ ID NO: 2706417 - RNA, 21 nt, Human
aggaaaucaaauaugcaaagc

SEQ ID NO: 2706418 - RNA, 22 nt, Human
aggaaaucaaauaugcaaagca

SEQ ID NO: 2706419 - RNA, 15 nt, Human
aggcccccaggugcc

SEQ ID NO: 2706420 - RNA, 14 nt, Human
uggaguugaaaauc

SEQ ID NO: 2706421 - RNA, 15 nt, Human
aggcagcuugaaacu

SEQ ID NO: 2706422 - RNA, 20 nt, Human
aggcauuuaggccaugggac

SEQ ID NO: 2706423 - RNA, 21 nt, Human
uggagcucguggaacaguuac

SEQ ID NO: 2706424 - RNA, 17 nt, Human
uggagcucguggaacag

SEQ ID NO: 2706425 - RNA, 21 nt, Human
uggagcucgugggacagucac

SEQ ID NO: 2706426 - RNA, 17 nt, Human
ugcuuuuaaaaaaaaau

SEQ ID NO: 2706427 - RNA, 18 nt, Human
aggagaaacuggaacucu

SEQ ID NO: 2706428 - RNA, 19 nt, Human
aggagaaacuggaacucuc

SEQ ID NO: 2706429 - RNA, 17 nt, Human
aggagaaacuggaacuc

SEQ ID NO: 2706430 - RNA, 13 nt, Human
aggacgcucucug

SEQ ID NO: 2706431 - RNA, 14 nt, Human
aggacgcucucugg

SEQ ID NO: 2706432 - RNA, 16 nt, Human
aggacgcucucuggcc

SEQ ID NO: 2706433 - RNA, 17 nt, Human
aggacgcucucuggccu

SEQ ID NO: 2706434 - RNA, 19 nt, Human
aggacgcucucuggccuuc

SEQ ID NO: 2706435 - RNA, 20 nt, Human
aggacgcucucuggccuucg

SEQ ID NO: 2706436 - RNA, 15 nt, Human
ugcacuccagccuga

SEQ ID NO: 2706437 - RNA, 17 nt, Human
ugcacuccagccugagc

SEQ ID NO: 2706438 - RNA, 22 nt, Human
ugcagaagacaguauggcagcu

SEQ ID NO: 2706439 - RNA, 13 nt, Human
ugauuucauucaa

SEQ ID NO: 2706440 - RNA, 20 nt, Human
ugcaaagcacugacuucuaa

SEQ ID NO: 2706441 - RNA, 22 nt, Human
ugcaaagcacugacuucuaagu

SEQ ID NO: 2706442 - RNA, 18 nt, Human
ugcaaagcacugacuucu

SEQ ID NO: 2706443 - RNA, 21 nt, Human
ugcaagccagauuuuccugaa

SEQ ID NO: 2706444 - RNA, 15 nt, Human
ugcaagccagauuuu

SEQ ID NO: 2706445 - RNA, 21 nt, Human
ugcaauaaaauggguuuuacu

SEQ ID NO: 2706446 - RNA, 17 nt, Human
ugcaauaaaauggguuu

SEQ ID NO: 2706447 - RNA, 20 nt, Human
ugcauagauucccugagcag

SEQ ID NO: 2706448 - RNA, 13 nt, Human
ugcauacucauua

SEQ ID NO: 2706449 - RNA, 19 nt, Human
ugcauacucauuaggaugg

SEQ ID NO: 2706450 - RNA, 19 nt, Human
agccugagcgacagugaga

SEQ ID NO: 2706451 - RNA, 17 nt, Human
ugccaguuauggcuaua

SEQ ID NO: 2706452 - RNA, 13 nt, Human
ugccauaauuacu

SEQ ID NO: 2706453 - RNA, 18 nt, Human
agcagucaggaaagagaa

SEQ ID NO: 2706454 - RNA, 17 nt, Human
agcagucaggaaagaga

SEQ ID NO: 2706455 - RNA, 23 nt, Human
agcaguuugguuucuagcaugaa

SEQ ID NO: 2706456 - RNA, 22 nt, Human
agcaguuugguuucuagcauga

SEQ ID NO: 2706457 - RNA, 20 nt, Human
agcaguuugguuucuagcau

SEQ ID NO: 2706458 - RNA, 19 nt, Human
agcagucaggaaagagaac

SEQ ID NO: 2706459 - RNA, 13 nt, Human
agcauaccaacac

SEQ ID NO: 2706460 - RNA, 19 nt, Human
agcauaccaacacgagcag

SEQ ID NO: 2706461 - RNA, 22 nt, Human
agcauaccaacacgagcaggcu

SEQ ID NO: 2706462 - RNA, 19 nt, Human
agcagggcauggcugggaa

SEQ ID NO: 2706463 - RNA, 20 nt, Human
agcaggaagcugugagagca

SEQ ID NO: 2706464 - RNA, 16 nt, Human
agcaggcuacugucag

SEQ ID NO: 2706465 - RNA, 17 nt, Human
agcaggcuacugucagc

SEQ ID NO: 2706466 - RNA, 19 nt, Human
agcaggcuacugucagcuc

SEQ ID NO: 2706467 - RNA, 20 nt, Human
agcaggcuacugucagcucc

SEQ ID NO: 2706468 - RNA, 14 nt, Human
agcaggcuacuguc

SEQ ID NO: 2706469 - RNA, 15 nt, Human
ugauuaaguaaugau

SEQ ID NO: 2706470 - RNA, 16 nt, Human
ugauuaaguaaugaua

SEQ ID NO: 2706471 - RNA, 22 nt, Human
agcauuuagauguauagguuga

SEQ ID NO: 2706472 - RNA, 20 nt, Human
agcaucacaugaacuuguaa

SEQ ID NO: 2706473 - RNA, 17 nt, Human
ugaaauaagccagacau

SEQ ID NO: 2706474 - RNA, 18 nt, Human
ugaaauaagccagacauc

SEQ ID NO: 2706475 - RNA, 20 nt, Human
ugaaauaagccagacaucaa

SEQ ID NO: 2706476 - RNA, 23 nt, Human
ugaaauaagccagacaucaacag

SEQ ID NO: 2706477 - RNA, 14 nt, Human
agagcugcccucuc

SEQ ID NO: 2706478 - RNA, 13 nt, Human
agagcugcccucu

SEQ ID NO: 2706479 - RNA, 15 nt, Human
agagcugcccucucc

SEQ ID NO: 2706480 - RNA, 15 nt, Human
ugaaauuguauuaca

SEQ ID NO: 2706481 - RNA, 18 nt, Human
ugaaauauuauguuaaaa

SEQ ID NO: 2706482 - RNA, 19 nt, Human
ugaacaaauuuacagagac

SEQ ID NO: 2706483 - RNA, 20 nt, Human
ugaacaaauuuacagagaca

SEQ ID NO: 2706484 - RNA, 18 nt, Human
ugaacaaauuuacagaga

SEQ ID NO: 2706485 - RNA, 23 nt, Human
ugaacuagaguuuagcuggaaaa

SEQ ID NO: 2706486 - RNA, 22 nt, Human
agagcugcccucuccugggcag

SEQ ID NO: 2706487 - RNA, 19 nt, Human
agagcuguucacagccaga

SEQ ID NO: 2706488 - RNA, 21 nt, Human
agagcuguucacagccagacu

SEQ ID NO: 2706489 - RNA, 15 nt, Human
agagguugcagugag

SEQ ID NO: 2706490 - RNA, 17 nt, Human
ugacccacaagaaauga

SEQ ID NO: 2706491 - RNA, 17 nt, Human
agaugcaguucugaaga

SEQ ID NO: 2706492 - RNA, 19 nt, Human
agaugcaguucugaagaag

SEQ ID NO: 2706493 - RNA, 18 nt, Human
agaugcaguucugaagaa

SEQ ID NO: 2706494 - RNA, 14 nt, Human
agaugcuagaacuc

SEQ ID NO: 2706495 - RNA, 15 nt, Human
agaugcuagaacucc

SEQ ID NO: 2706496 - RNA, 17 nt, Human
agaguuuagcuggaaaa

SEQ ID NO: 2706497 - RNA, 16 nt, Human
agaguuuagcuggaaa

SEQ ID NO: 2706498 - RNA, 23 nt, Human
agacuauucaaacagucucagga

SEQ ID NO: 2706499 - RNA, 16 nt, Human
ucuuauuucauuucuu

SEQ ID NO: 2706500 - RNA, 15 nt, Human
ucuuauuucauuucu

SEQ ID NO: 2706501 - RNA, 24 nt, Human
agagacagaaagcagaacagugau

SEQ ID NO: 2706502 - RNA, 15 nt, Human
agagacagaaagcag

SEQ ID NO: 2706503 - RNA, 22 nt, Human
ucuuagaugcaguucugaagaa

SEQ ID NO: 2706504 - RNA, 23 nt, Human
ucuuagaugcaguucugaagaag

SEQ ID NO: 2706505 - RNA, 17 nt, Human
agacacacugaagaagc

SEQ ID NO: 2706506 - RNA, 16 nt, Human
agacacacugaagaag

SEQ ID NO: 2706507 - RNA, 16 nt, Human
acuuguguuuugcaag

SEQ ID NO: 2706508 - RNA, 12 nt, Human
ucucaggaaauc

SEQ ID NO: 2706509 - RNA, 23 nt, Human
acuucuaaguaaaaccacagcag

SEQ ID NO: 2706510 - RNA, 16 nt, Human
acuugucaauaaaauc

SEQ ID NO: 2706511 - RNA, 21 nt, Human
acuugaacccauauuuguaca

SEQ ID NO: 2706512 - RNA, 19 nt, Human
acuugaacccgggaggcag

SEQ ID NO: 2706513 - RNA, 20 nt, Human
acuugaacccgggaggcaga

SEQ ID NO: 2706514 - RNA, 12 nt, Human
ucucuggccuuc

SEQ ID NO: 2706515 - RNA, 23 nt, Human
ucucuggccuucggccuccaucc

SEQ ID NO: 2706516 - RNA, 21 nt, Human
ucucuggccuucggccuccau

SEQ ID NO: 2706517 - RNA, 22 nt, Human
ucucuggccuucggccuccauc

SEQ ID NO: 2706518 - RNA, 12 nt, Human
ucugaagaagau

SEQ ID NO: 2706519 - RNA, 14 nt, Human
agaaaugaaagcag

SEQ ID NO: 2706520 - RNA, 22 nt, Human
ucggguuuuauuguuuaaaauc

SEQ ID NO: 2706521 - RNA, 18 nt, Human
acuguggguagacacaca

SEQ ID NO: 2706522 - RNA, 21 nt, Human
acugucagcuccccucggaga

SEQ ID NO: 2706523 - RNA, 18 nt, Human
acugggacaggggagaac

SEQ ID NO: 2706524 - RNA, 23 nt, Human
ucuaaguaaaaccacagcaguug

SEQ ID NO: 2706525 - RNA, 16 nt, Human
ucuacauacuauggaa

SEQ ID NO: 2706526 - RNA, 21 nt, Human
ucuaaguaaaaccacagcagu

SEQ ID NO: 2706527 - RNA, 22 nt, Human
ucuaaguaaaaccacagcaguu

SEQ ID NO: 2706528 - RNA, 20 nt, Human
ucuaaagccauuguaguccu

SEQ ID NO: 2706529 - RNA, 13 nt, Human
acuggcacaguuu

SEQ ID NO: 2706530 - RNA, 19 nt, Human
acuggcacaguuuucugag

SEQ ID NO: 2706531 - RNA, 20 nt, Human
acuggcacaguuuucugaga

SEQ ID NO: 2706532 - RNA, 19 nt, Human
acugccuucucaacuccaa

SEQ ID NO: 2706533 - RNA, 13 nt, Human
acugccuucucaa

SEQ ID NO: 2706534 - RNA, 15 nt, Human
acugcauuauauuua

SEQ ID NO: 2706535 - RNA, 14 nt, Human
acugcauuauauuu

SEQ ID NO: 2706536 - RNA, 18 nt, Human
ucgcuccaccuugcagcu

SEQ ID NO: 2706537 - RNA, 21 nt, Human
uccaacuaucucauuuccaag

SEQ ID NO: 2706538 - RNA, 19 nt, Human
acgagcaggcuacugucag

SEQ ID NO: 2706539 - RNA, 20 nt, Human
acgagcaggcuacugucagc

SEQ ID NO: 2706540 - RNA, 14 nt, Human
acgagaaaacaaua

SEQ ID NO: 2706541 - RNA, 13 nt, Human
accucccugcaau

SEQ ID NO: 2706542 - RNA, 12 nt, Human
accucccugcaa

SEQ ID NO: 2706543 - RNA, 16 nt, Human
ucaugaauuaguuuua

SEQ ID NO: 2706544 - RNA, 22 nt, Human
ucaggaaaucaaauaugcaaag

SEQ ID NO: 2706545 - RNA, 23 nt, Human
ucaggaaaucaaauaugcaaagc

SEQ ID NO: 2706546 - RNA, 21 nt, Human
accuagggugauauuaaccag

SEQ ID NO: 2706547 - RNA, 21 nt, Human
ucaugaauuaguuuuauaugc

SEQ ID NO: 2706548 - RNA, 21 nt, Human
acuccaaagaaauguaaggga

SEQ ID NO: 2706549 - RNA, 15 nt, Human
acuccaaagaaaugu

SEQ ID NO: 2706550 - RNA, 18 nt, Human
acuccaaagaaauguaag

SEQ ID NO: 2706551 - RNA, 14 nt, Human
acuccaaagaaaug

SEQ ID NO: 2706552 - RNA, 11 nt, Human
ucccugagcag

SEQ ID NO: 2706553 - RNA, 16 nt, Human
ucccucccuccaccuc

SEQ ID NO: 2706554 - RNA, 15 nt, Human
ucccucccuccaccu

SEQ ID NO: 2706555 - RNA, 23 nt, Human
ucccuccaccucccugcaauaaa

SEQ ID NO: 2706556 - RNA, 21 nt, Human
ucccuccaccucccugcaaua

SEQ ID NO: 2706557 - RNA, 14 nt, Human
ucccucccuccacc

SEQ ID NO: 2706558 - RNA, 13 nt, Human
ucccucccuccac

SEQ ID NO: 2706559 - RNA, 17 nt, Human
uccccucggagaagagc

SEQ ID NO: 2706560 - RNA, 16 nt, Human
uccccucggagaagag

SEQ ID NO: 2706561 - RNA, 18 nt, Human
ucccagccagcaguucag

SEQ ID NO: 2706562 - RNA, 17 nt, Human
ucccagccagcaguuca

SEQ ID NO: 2706563 - RNA, 14 nt, Human
ucccagucauuuaa

SEQ ID NO: 2706564 - RNA, 22 nt, Human
ucccagucauuuaauaaaugug

SEQ ID NO: 2706565 - RNA, 21 nt, Human
uccaugaagauguagaggaga

SEQ ID NO: 2706566 - RNA, 13 nt, Human
uccaugaagaugu

SEQ ID NO: 2706567 - RNA, 20 nt, Human
uccauccugaggcuccacuu

SEQ ID NO: 2706568 - RNA, 21 nt, Human
uccauccugaggcuccacuug

SEQ ID NO: 2706569 - RNA, 19 nt, Human
uccauccugaggcuccacu

SEQ ID NO: 2706570 - RNA, 20 nt, Human
ucaggaaaucaaauaugcaa

SEQ ID NO: 2706571 - RNA, 21 nt, Human
ucaggaaaucaaauaugcaaa

SEQ ID NO: 2706572 - RNA, 19 nt, Human
ucaggaaagagaacuucca

SEQ ID NO: 2706573 - RNA, 13 nt, Human
ucaggaaagagaa

SEQ ID NO: 2706574 - RNA, 12 nt, Human
ucagagcugccc

SEQ ID NO: 2706575 - RNA, 23 nt, Human
accauuucuugagguaaaagcau

SEQ ID NO: 2706576 - RNA, 15 nt, Human
accaaucaugaauua

SEQ ID NO: 2706577 - RNA, 13 nt, Human
accaaucaugaau

SEQ ID NO: 2706578 - RNA, 20 nt, Human
ucaauuuuucuuauuucauu

SEQ ID NO: 2706579 - RNA, 23 nt, Human
ucaauuuuucuuauuucauuucu

SEQ ID NO: 2706580 - RNA, 15 nt, Human
ucaauucuugccaaa

SEQ ID NO: 2706581 - RNA, 18 nt, Human
accacuuguguuuugcaa

SEQ ID NO: 2706582 - RNA, 14 nt, Human
accagggacugagg

SEQ ID NO: 2706583 - RNA, 14 nt, Human
acauagaauuaaca

SEQ ID NO: 2706584 - RNA, 18 nt, Human
acauagaauuaacacaug

SEQ ID NO: 2706585 - RNA, 19 nt, Human
acauauauaacaaugcugu

SEQ ID NO: 2706586 - RNA, 13 nt, Human
acaucaacagaua

SEQ ID NO: 2706587 - RNA, 13 nt, Human
uauuucauuucuu

SEQ ID NO: 2706588 - RNA, 21 nt, Human
uaugaaauauuauguuaaaac

SEQ ID NO: 2706589 - RNA, 18 nt, Human
acaguuuucugagaaaga

SEQ ID NO: 2706590 - RNA, 19 nt, Human
acaguuuucugagaaagac

SEQ ID NO: 2706591 - RNA, 20 nt, Human
acaguuuucugagaaagacu

SEQ ID NO: 2706592 - RNA, 21 nt, Human
acaguuuucugagaaagacua

SEQ ID NO: 2706593 - RNA, 16 nt, Human
acaguuuucugagaaa

SEQ ID NO: 2706594 - RNA, 17 nt, Human
acaguuuucugagaaag

SEQ ID NO: 2706595 - RNA, 15 nt, Human
acaguuuucugagaa

SEQ ID NO: 2706596 - RNA, 22 nt, Human
ucaagaugaugaugaucuuuaa

SEQ ID NO: 2706597 - RNA, 21 nt, Human
acaugcugaacaucacagcuu

SEQ ID NO: 2706598 - RNA, 14 nt, Human
acaugcugaacauc

SEQ ID NO: 2706599 - RNA, 21 nt, Human
ucaaaauaugccccauucaac

SEQ ID NO: 2706600 - RNA, 23 nt, Human
ucaaaauaccaugccauuuaaag

SEQ ID NO: 2706601 - RNA, 21 nt, Human
ucaaaauaccaugccauuuaa

SEQ ID NO: 2706602 - RNA, 18 nt, Human
ucaaaagaaagaaaauca

SEQ ID NO: 2706603 - RNA, 14 nt, Human
ucaaagcugaaaug

SEQ ID NO: 2706604 - RNA, 19 nt, Human
acaugauccugcaauucca

SEQ ID NO: 2706605 - RNA, 15 nt, Human
uauauuuauuacugu

SEQ ID NO: 2706606 - RNA, 19 nt, Human
uauauuuauuacuguaaga

SEQ ID NO: 2706607 - RNA, 21 nt, Human
acagcccuucuuuccacagaa

SEQ ID NO: 2706608 - RNA, 20 nt, Human
acagcccuucuuuccacaga

SEQ ID NO: 2706609 - RNA, 13 nt, Human
acacuuaaaaaug

SEQ ID NO: 2706610 - RNA, 15 nt, Human
acacuuaaaaauggu

SEQ ID NO: 2706611 - RNA, 12 nt, Human
uauauuuacaaa

SEQ ID NO: 2706612 - RNA, 14 nt, Human
acacugaagaagca

SEQ ID NO: 2706613 - RNA, 12 nt, Human
acacugaagaag

SEQ ID NO: 2706614 - RNA, 14 nt, Human
acacuccagugaga

SEQ ID NO: 2706615 - RNA, 23 nt, Human
uauaaaauaauuuuuauauuuga

SEQ ID NO: 2706616 - RNA, 18 nt, Human
acacaugcugaacaucac

SEQ ID NO: 2706617 - RNA, 19 nt, Human
acacuaagagagaaugaga

SEQ ID NO: 2706618 - RNA, 18 nt, Human
acacuaagagagaaugag

SEQ ID NO: 2706619 - RNA, 17 nt, Human
acacuaagagagaauga

SEQ ID NO: 2706620 - RNA, 12 nt, Human
uaguguuggaga

SEQ ID NO: 2706621 - RNA, 17 nt, Human
uaguguuggagaagaac

SEQ ID NO: 2706622 - RNA, 16 nt, Human
uaguguuggagaagaa

SEQ ID NO: 2706623 - RNA, 14 nt, Human
acacacugaagaag

SEQ ID NO: 2706624 - RNA, 17 nt, Human
acaaugcuguauuuuaa

SEQ ID NO: 2706625 - RNA, 14 nt, Human
acaaugcuguauuu

SEQ ID NO: 2706626 - RNA, 17 nt, Human
acacaacuauauuguuu

SEQ ID NO: 2706627 - RNA, 14 nt, Human
acacaacuauauug

SEQ ID NO: 2706628 - RNA, 20 nt, Human
acacacucaaaucaagaaac

SEQ ID NO: 2706629 - RNA, 13 nt, Human
acacacugaagaa

SEQ ID NO: 2706630 - RNA, 18 nt, Human
uacuaaaaauacaaaaaa

SEQ ID NO: 2706631 - RNA, 14 nt, Human
uacuaaaaauacaa

SEQ ID NO: 2706632 - RNA, 23 nt, Human
uacugggaaagggauuuucagcc

SEQ ID NO: 2706633 - RNA, 17 nt, Human
uacugagagugaacaaa

SEQ ID NO: 2706634 - RNA, 18 nt, Human
aauugaggacacugauau

SEQ ID NO: 2706635 - RNA, 19 nt, Human
aauuucucccagucauuua

SEQ ID NO: 2706636 - RNA, 17 nt, Human
aauuuacagagacagaa

SEQ ID NO: 2706637 - RNA, 18 nt, Human
aauuuacagagacagaaa

SEQ ID NO: 2706638 - RNA, 19 nt, Human
uacuucuuaggguuaugau

SEQ ID NO: 2706639 - RNA, 16 nt, Human
uacuucaugcugucua

SEQ ID NO: 2706640 - RNA, 17 nt, Human
uagauaggccaugggca

SEQ ID NO: 2706641 - RNA, 22 nt, Human
uagauaggucagugcaaauacu

SEQ ID NO: 2706642 - RNA, 20 nt, Human
uagaugcaguucugaagaag

SEQ ID NO: 2706643 - RNA, 21 nt, Human
uagaugcaguucugaagaaga

SEQ ID NO: 2706644 - RNA, 21 nt, Human
aauuuuucuuauuucauuucu

SEQ ID NO: 2706645 - RNA, 22 nt, Human
aauuuuuucucuaggaaauauu

SEQ ID NO: 2706646 - RNA, 22 nt, Human
acaagcucacagaccuuugaac

SEQ ID NO: 2706647 - RNA, 17 nt, Human
acaaauuuacagagaca

SEQ ID NO: 2706648 - RNA, 16 nt, Human
uagcuacuaauuuuaa

SEQ ID NO: 2706649 - RNA, 18 nt, Human
aauaggcguaacuaauuu

SEQ ID NO: 2706650 - RNA, 12 nt, Human
aauaucacuugu

SEQ ID NO: 2706651 - RNA, 15 nt, Human
aauaucacuugucaa

SEQ ID NO: 2706652 - RNA, 15 nt, Human
aauaugcaaagcacu

SEQ ID NO: 2706653 - RNA, 17 nt, Human
aauaugcaaagcacuga

SEQ ID NO: 2706654 - RNA, 24 nt, Human
aauaugcaaagcacugacuucuaa

SEQ ID NO: 2706655 - RNA, 14 nt, Human
aauauuucagauaa

SEQ ID NO: 2706656 - RNA, 15 nt, Human
aauauuucagauaau

SEQ ID NO: 2706657 - RNA, 19 nt, Human
aauaucuuuuuuuuaauaa

SEQ ID NO: 2706658 - RNA, 21 nt, Human
aauaacaaugaaaguugauaa

SEQ ID NO: 2706659 - RNA, 16 nt, Human
aauaauuuuuauauuu

SEQ ID NO: 2706660 - RNA, 19 nt, Human
aauaauuuuuauauuugaa

SEQ ID NO: 2706661 - RNA, 17 nt, Human
aauaauuuuuauauuug

SEQ ID NO: 2706662 - RNA, 20 nt, Human
aauaauuuuuauauuugaaa

SEQ ID NO: 2706663 - RNA, 11 nt, Human
aaugugauaug

SEQ ID NO: 2706664 - RNA, 19 nt, Human
aauggacuuuuguacauag

SEQ ID NO: 2706665 - RNA, 19 nt, Human
uacacuaagagagaaugag

SEQ ID NO: 2706666 - RNA, 13 nt, Human
uacaaaaacacag

SEQ ID NO: 2706667 - RNA, 14 nt, Human
uacaaaaacacagc

SEQ ID NO: 2706668 - RNA, 16 nt, Human
uacaaaaacacagcaa

SEQ ID NO: 2706669 - RNA, 15 nt, Human
uacaaaaacacagca

SEQ ID NO: 2706670 - RNA, 14 nt, Human
aaucuuauaauuua

SEQ ID NO: 2706671 - RNA, 16 nt, Human
aaucuuauaauuuaaa

SEQ ID NO: 2706672 - RNA, 13 nt, Human
aauccuugaagau

SEQ ID NO: 2706673 - RNA, 15 nt, Human
aaucaucaagucuuu

SEQ ID NO: 2706674 - RNA, 17 nt, Human
aaucaugaauuaguuuu

SEQ ID NO: 2706675 - RNA, 19 nt, Human
aaucaugaauuaguuuuau

SEQ ID NO: 2706676 - RNA, 23 nt, Human
aaucaugaauuaguuuuauaugc

SEQ ID NO: 2706677 - RNA, 18 nt, Human
uaaguuuuuuuuuaaaaa

SEQ ID NO: 2706678 - RNA, 16 nt, Human
uaaugauaacuggaaa

SEQ ID NO: 2706679 - RNA, 21 nt, Human
aaugagagacacacugaagaa

SEQ ID NO: 2706680 - RNA, 18 nt, Human
aagaaugauuaugaauua

SEQ ID NO: 2706681 - RNA, 16 nt, Human
aagaaugauuaugaau

SEQ ID NO: 2706682 - RNA, 16 nt, Human
aagaagugaaaaucua

SEQ ID NO: 2706683 - RNA, 22 nt, Human
aagaagugaaaaucuacacucc

SEQ ID NO: 2706684 - RNA, 18 nt, Human
gugcuaguaauuggaaag

SEQ ID NO: 2706685 - RNA, 21 nt, Human
gugggacagucaccucaugga

SEQ ID NO: 2706686 - RNA, 19 nt, Human
aagagcuguucacagccag

SEQ ID NO: 2706687 - RNA, 21 nt, Human
gugugaccacugcagaagaca

SEQ ID NO: 2706688 - RNA, 13 nt, Human
guugacaugggac

SEQ ID NO: 2706689 - RNA, 18 nt, Human
guugacaugggacauuug

SEQ ID NO: 2706690 - RNA, 14 nt, Human
guugacaugggaca

SEQ ID NO: 2706691 - RNA, 23 nt, Human
aagcuuguauuccuuuuucucuc

SEQ ID NO: 2706692 - RNA, 23 nt, Human
guuuucugagaaagacuauucaa

SEQ ID NO: 2706693 - RNA, 21 nt, Human
guuucaaacauauauaacaau

SEQ ID NO: 2706694 - RNA, 10 nt, Human
guuuaaaauc

SEQ ID NO: 2706695 - RNA, 16 nt, Human
guuuaaaaucauuucu

SEQ ID NO: 2706696 - RNA, 18 nt, Human
guuguaccgcaaugugac

SEQ ID NO: 2706697 - RNA, 20 nt, Human
aacccauauuuguacaccaa

SEQ ID NO: 2706698 - RNA, 13 nt, Human
aacccaaauguuc

SEQ ID NO: 2706699 - RNA, 18 nt, Human
aacccaaauguucaucaa

SEQ ID NO: 2706700 - RNA, 20 nt, Human
aaccuagggugauauuaacc

SEQ ID NO: 2706701 - RNA, 12 nt, Human
aaccacagcagu

SEQ ID NO: 2706702 - RNA, 22 nt, Human
gucuuaauuaaaagaauauuuu

SEQ ID NO: 2706703 - RNA, 19 nt, Human
gucuuaauuaaaagaauau

SEQ ID NO: 2706704 - RNA, 21 nt, Human
gucuuaauuaaaagaauauuu

SEQ ID NO: 2706705 - RNA, 15 nt, Human
gugaacacaucagcu

SEQ ID NO: 2706706 - RNA, 18 nt, Human
aacucguuaauuuguagu

SEQ ID NO: 2706707 - RNA, 13 nt, Human
aacucccuuucaa

SEQ ID NO: 2706708 - RNA, 14 nt, Human
aacucccuuucaac

SEQ ID NO: 2706709 - RNA, 21 nt, Human
aacuccagaaagugacaagcu

SEQ ID NO: 2706710 - RNA, 14 nt, Human
aacuccagaaagug

SEQ ID NO: 2706711 - RNA, 24 nt, Human
guccaagcauaccaacacgagcag

SEQ ID NO: 2706712 - RNA, 21 nt, Human
guccaagcauuuagauguaua

SEQ ID NO: 2706713 - RNA, 15 nt, Human
aacaaggaugaauua

SEQ ID NO: 2706714 - RNA, 21 nt, Human
aacaagccuccuuuuaaagua

SEQ ID NO: 2706715 - RNA, 22 nt, Human
aacaguagugauaguuguaccg

SEQ ID NO: 2706716 - RNA, 18 nt, Human
aacauuugguaaggggaa

SEQ ID NO: 2706717 - RNA, 19 nt, Human
aaauggcuuccuggcaaua

SEQ ID NO: 2706718 - RNA, 14 nt, Human
aaaugcauuucuaa

SEQ ID NO: 2706719 - RNA, 21 nt, Human
aaaugaaagcagggacuugaa

SEQ ID NO: 2706720 - RNA, 22 nt, Human
aaaugaaagcagggacuugaac

SEQ ID NO: 2706721 - RNA, 14 nt, Human
aaauccuugaagau

SEQ ID NO: 2706722 - RNA, 19 nt, Human
aaaucuacacuccagugag

SEQ ID NO: 2706723 - RNA, 14 nt, Human
guaugauucccagc

SEQ ID NO: 2706724 - RNA, 22 nt, Human
aaauguaagggaaacugccagc

SEQ ID NO: 2706725 - RNA, 17 nt, Human
aaauuucagcagcugca

SEQ ID NO: 2706726 - RNA, 18 nt, Human
aaauuucagcagcugcag

SEQ ID NO: 2706727 - RNA, 21 nt, Human
cacaguuuucugagaaagacu

SEQ ID NO: 2706728 - RNA, 22 nt, Human
cacaguuuucugagaaagacua

SEQ ID NO: 2706729 - RNA, 20 nt, Human
cacaguuuucugagaaagac

SEQ ID NO: 2706730 - RNA, 16 nt, Human
cacaugaaguccaagc

SEQ ID NO: 2706731 - RNA, 20 nt, Human
cacaugaaguccaagcauuu

SEQ ID NO: 2706732 - RNA, 17 nt, Human
cacaugaaguccaagca

SEQ ID NO: 2706733 - RNA, 13 nt, Human
cacaagaaaugaa

SEQ ID NO: 2706734 - RNA, 15 nt, Human
cacaagaaaugaaag

SEQ ID NO: 2706735 - RNA, 23 nt, Human
cacaagaaaugaaagcagggacu

SEQ ID NO: 2706736 - RNA, 23 nt, Human
cacaagacccaaaaggcagaagc

SEQ ID NO: 2706737 - RNA, 16 nt, Human
caaauuuacagagaca

SEQ ID NO: 2706738 - RNA, 17 nt, Human
caaauuuacagagacag

SEQ ID NO: 2706739 - RNA, 23 nt, Human
caaauuuacagagacagaaagca

SEQ ID NO: 2706740 - RNA, 19 nt, Human
caagcauuuagauguauag

SEQ ID NO: 2706741 - RNA, 16 nt, Human
caagcauuuagaugua

SEQ ID NO: 2706742 - RNA, 21 nt, Human
caagcauaccaacacgagcag

SEQ ID NO: 2706743 - RNA, 16 nt, Human
caagcauaccaacacg

SEQ ID NO: 2706744 - RNA, 13 nt, Human
caagaaaugaaag

SEQ ID NO: 2706745 - RNA, 19 nt, Human
caagacugcacaucaaaau

SEQ ID NO: 2706746 - RNA, 14 nt, Human
caaagaaauguaag

SEQ ID NO: 2706747 - RNA, 19 nt, Human
auuuuaauaauguuucaaa

SEQ ID NO: 2706748 - RNA, 18 nt, Human
auuuuaauaauguuucaa

SEQ ID NO: 2706749 - RNA, 13 nt, Human
uuuuccugaaaac

SEQ ID NO: 2706750 - RNA, 20 nt, Human
uuuuauaugcuucuguuuua

SEQ ID NO: 2706751 - RNA, 15 nt, Human
uuuuauaugcuucug

SEQ ID NO: 2706752 - RNA, 20 nt, Human
uuuuauaucaauuuaaaaaa

SEQ ID NO: 2706753 - RNA, 10 nt, Human
uuuuauauuu

SEQ ID NO: 2706754 - RNA, 21 nt, Human
uuugcauagauucccugagca

SEQ ID NO: 2706755 - RNA, 21 nt, Human
uuuguauaaaauaauuuuuau

SEQ ID NO: 2706756 - RNA, 20 nt, Human
uuuagaaacacaacuauauu

SEQ ID NO: 2706757 - RNA, 12 nt, Human
uuuagaaacaca

SEQ ID NO: 2706758 - RNA, 22 nt, Human
uuucugagaaagacuauucaaa

SEQ ID NO: 2706759 - RNA, 15 nt, Human
uuucugagaaagacu

SEQ ID NO: 2706760 - RNA, 15 nt, Human
uuucagauaaucaca

SEQ ID NO: 2706761 - RNA, 15 nt, Human
uuucagcagcugcag

SEQ ID NO: 2706762 - RNA, 21 nt, Human
uuucagauaaucacaauacau

SEQ ID NO: 2706763 - RNA, 23 nt, Human
uucucuccucuccccaugauguu

SEQ ID NO: 2706764 - RNA, 18 nt, Human
uucccuugaugaagaagu

SEQ ID NO: 2706765 - RNA, 12 nt, Human
uuccuagugaaa

SEQ ID NO: 2706766 - RNA, 22 nt, Human
uucggccuccauccugaggcuc

SEQ ID NO: 2706767 - RNA, 18 nt, Human
uucggccuccauccugag

SEQ ID NO: 2706768 - RNA, 19 nt, Human
uucggccuccauccugagg

SEQ ID NO: 2706769 - RNA, 19 nt, Human
uuccacuuauaggaauuga

SEQ ID NO: 2706770 - RNA, 23 nt, Human
uucagagcugcccucuccugggc

SEQ ID NO: 2706771 - RNA, 22 nt, Human
uucagagcugcccucuccuggg

SEQ ID NO: 2706772 - RNA, 21 nt, Human
uucagagcugcccucuccugg

SEQ ID NO: 2706773 - RNA, 12 nt, Human
uugaugaagaag

SEQ ID NO: 2706774 - RNA, 18 nt, Human
uugcauagauucccugag

SEQ ID NO: 2706775 - RNA, 14 nt, Human
uugaggacacugau

SEQ ID NO: 2706776 - RNA, 15 nt, Human
uugaggacacugaua

SEQ ID NO: 2706777 - RNA, 23 nt, Human
uugaaacugagaugugaacacau

SEQ ID NO: 2706778 - RNA, 16 nt, Human
uugaaaagacuccaaa

SEQ ID NO: 2706779 - RNA, 18 nt, Human
uugaaaagacuccaaaga

SEQ ID NO: 2706780 - RNA, 22 nt, Human
uugaaaagacuccaaagaaaug

SEQ ID NO: 2706781 - RNA, 23 nt, Human
uugaaaagacuccaaagaaaugu

SEQ ID NO: 2706782 - RNA, 15 nt, Human
uucuuauuucauuuc

SEQ ID NO: 2706783 - RNA, 15 nt, Human
uucugagaaagacua

SEQ ID NO: 2706784 - RNA, 14 nt, Human
uucugagcauuuaa

SEQ ID NO: 2706785 - RNA, 16 nt, Human
uuguaaaggaauuuaa

SEQ ID NO: 2706786 - RNA, 11 nt, Human
uuguaaaugug

SEQ ID NO: 2706787 - RNA, 14 nt, Human
uuguaaaugugcuu

SEQ ID NO: 2706788 - RNA, 18 nt, Human
uuguaaaugugcuuuuaa

SEQ ID NO: 2706789 - RNA, 19 nt, Human
uuguaucacaaaucuuaac

SEQ ID NO: 2706790 - RNA, 14 nt, Human
uuguauuacaaauc

SEQ ID NO: 2706791 - RNA, 12 nt, Human
uugggaggcuga

SEQ ID NO: 2706792 - RNA, 22 nt, Human
ugugaccacugcagaagacagu

SEQ ID NO: 2706793 - RNA, 21 nt, Human
ugucucaguccaugaagaugu

SEQ ID NO: 2706794 - RNA, 22 nt, Human
ugucucaguccaugaagaugua

SEQ ID NO: 2706795 - RNA, 14 nt, Human
ugugcguccugucg

SEQ ID NO: 2706796 - RNA, 17 nt, Human
uguagauaauacaguuc

SEQ ID NO: 2706797 - RNA, 15 nt, Human
uguaaucacagcuac

SEQ ID NO: 2706798 - RNA, 14 nt, Human
uguaaucacagcua

SEQ ID NO: 2706799 - RNA, 16 nt, Human
uguaugauucccagcc

SEQ ID NO: 2706800 - RNA, 21 nt, Human
uguuggagaagaacugaaauc

SEQ ID NO: 2706801 - RNA, 13 nt, Human
uguuuaaaaucau

SEQ ID NO: 2706802 - RNA, 12 nt, Human
uguuauaaucuu

SEQ ID NO: 2706803 - RNA, 14 nt, Human
uguuagugcaaauu

SEQ ID NO: 2706804 - RNA, 16 nt, Human
uguucacagccagacu

SEQ ID NO: 2706805 - RNA, 19 nt, Human
ugugugcguccugucggag

SEQ ID NO: 2706806 - RNA, 21 nt, Human
uuaccacuuguguuuugcaag

SEQ ID NO: 2706807 - RNA, 20 nt, Human
uuacagagacagaaagcaga

SEQ ID NO: 2706808 - RNA, 15 nt, Human
uuacauuuguauaaa

SEQ ID NO: 2706809 - RNA, 14 nt, Human
uuacauuuguauaa

SEQ ID NO: 2706810 - RNA, 22 nt, Human
uuaaugucaauucuugccaaau

SEQ ID NO: 2706811 - RNA, 16 nt, Human
uuaauaauguuucaaa

SEQ ID NO: 2706812 - RNA, 18 nt, Human
uuaauaauguuucaaaca

SEQ ID NO: 2706813 - RNA, 20 nt, Human
uuaaagcuuauuaaaacuca

SEQ ID NO: 2706814 - RNA, 13 nt, Human
uuaaaagaaugau

SEQ ID NO: 2706815 - RNA, 19 nt, Human
uuaaaagaaugauuaugaa

SEQ ID NO: 2706816 - RNA, 14 nt, Human
uggccuucggccuc

SEQ ID NO: 2706817 - RNA, 17 nt, Human
uggccuucggccuccau

SEQ ID NO: 2706818 - RNA, 18 nt, Human
uggccuucggccuccauc

SEQ ID NO: 2706819 - RNA, 20 nt, Human
ugggacauuugcucauggaa

SEQ ID NO: 2706820 - RNA, 19 nt, Human
ugggacauuugcucaugga

SEQ ID NO: 2706821 - RNA, 21 nt, Human
ugggacagucaccucauggaa

SEQ ID NO: 2706822 - RNA, 20 nt, Human
ugggacagucaccucaugga

SEQ ID NO: 2706823 - RNA, 18 nt, Human
ugggacagucaccucaug

SEQ ID NO: 2706824 - RNA, 16 nt, Human
uggguagacacacaug

SEQ ID NO: 2706825 - RNA, 17 nt, Human
uggguagacacacauga

SEQ ID NO: 2706826 - RNA, 14 nt, Human
ugcuucuguuuuau

SEQ ID NO: 2706827 - RNA, 14 nt, Human
uggaacucucgagc

SEQ ID NO: 2706828 - RNA, 15 nt, Human
ugcauuauauuuauu

SEQ ID NO: 2706829 - RNA, 20 nt, Human
ugcauuauauuuauuacugu

SEQ ID NO: 2706830 - RNA, 14 nt, Human
ugcauuauauuuau

SEQ ID NO: 2706831 - RNA, 19 nt, Human
ugcaucagcugcugaaaca

SEQ ID NO: 2706832 - RNA, 22 nt, Human
ugcaucagcugcugaaacaaca

SEQ ID NO: 2706833 - RNA, 20 nt, Human
ugccaucccucccuccaccu

SEQ ID NO: 2706834 - RNA, 19 nt, Human
ugccaucccucccuccacc

SEQ ID NO: 2706835 - RNA, 15 nt, Human
ugccaucccucccuc

SEQ ID NO: 2706836 - RNA, 22 nt, Human
ugccaucccucccuccaccucc

SEQ ID NO: 2706837 - RNA, 21 nt, Human
ugccaucccucccuccaccuc

SEQ ID NO: 2706838 - RNA, 15 nt, Human
ugcacaucaaaauau

SEQ ID NO: 2706839 - RNA, 17 nt, Human
ugcagauaaacaguagu

SEQ ID NO: 2706840 - RNA, 16 nt, Human
ugcagauaaacaguag

SEQ ID NO: 2706841 - RNA, 20 nt, Human
ugcuagaacucccuuucaac

SEQ ID NO: 2706842 - RNA, 21 nt, Human
ugcuagaacucccuuucaaca

SEQ ID NO: 2706843 - RNA, 19 nt, Human
ugcuagaacucccuuucaa

SEQ ID NO: 2706844 - RNA, 18 nt, Human
ugcuagaacucccuuuca

SEQ ID NO: 2706845 - RNA, 17 nt, Human
ugccuucucaacuccaa

SEQ ID NO: 2706846 - RNA, 22 nt, Human
ugccuucucaacuccaaacuga

SEQ ID NO: 2706847 - RNA, 23 nt, Human
ugccuccccuccucugcuugcca

SEQ ID NO: 2706848 - RNA, 22 nt, Human
ugccuccccuccucugcuugcc

SEQ ID NO: 2706849 - RNA, 19 nt, Human
ugccuccccuccucugcuu

SEQ ID NO: 2706850 - RNA, 18 nt, Human
ugccuccccuccucugcu

SEQ ID NO: 2706851 - RNA, 24 nt, Human
ucuguaauaaacucauuucuagca

SEQ ID NO: 2706852 - RNA, 23 nt, Human
ucuguaauaaacucauuucuagc

SEQ ID NO: 2706853 - RNA, 19 nt, Human
ucuguaauaaacucauuuc

SEQ ID NO: 2706854 - RNA, 23 nt, Human
ucuggccuucggccuccauccug

SEQ ID NO: 2706855 - RNA, 22 nt, Human
ucuguuuuauaauuuugugaag

SEQ ID NO: 2706856 - RNA, 20 nt, Human
ucuguuuuauaauuuuguga

SEQ ID NO: 2706857 - RNA, 19 nt, Human
ugaaaacuuuaugcuaagu

SEQ ID NO: 2706858 - RNA, 15 nt, Human
ugaaaagacuccaaa

SEQ ID NO: 2706859 - RNA, 16 nt, Human
ugaaaagacuccaaag

SEQ ID NO: 2706860 - RNA, 17 nt, Human
ugaaaagacuccaaaga

SEQ ID NO: 2706861 - RNA, 19 nt, Human
ugaaaagacuccaaagaaa

SEQ ID NO: 2706862 - RNA, 22 nt, Human
ugaaaagacuccaaagaaaugu

SEQ ID NO: 2706863 - RNA, 18 nt, Human
ugaaacccugucucuacu

SEQ ID NO: 2706864 - RNA, 18 nt, Human
ugaaagcagggacuugaa

SEQ ID NO: 2706865 - RNA, 19 nt, Human
ugaaagcagggacuugaac

SEQ ID NO: 2706866 - RNA, 23 nt, Human
ugaaagcagggacuugaacccau

SEQ ID NO: 2706867 - RNA, 22 nt, Human
ugaaguccaagcauuuagaugu

SEQ ID NO: 2706868 - RNA, 21 nt, Human
ugaaguccaagcauuuagaug

SEQ ID NO: 2706869 - RNA, 22 nt, Human
ugaacuuguaaaggaauuuaaa

SEQ ID NO: 2706870 - RNA, 14 nt, Human
ugaacacaucagcu

SEQ ID NO: 2706871 - RNA, 17 nt, Human
ucuacacuccagugaga

SEQ ID NO: 2706872 - RNA, 21 nt, Human
ucuacacuaagagagaaugag

SEQ ID NO: 2706873 - RNA, 15 nt, Human
uccuugcaucaauuu

SEQ ID NO: 2706874 - RNA, 18 nt, Human
ucuccugggcagcugccu

SEQ ID NO: 2706875 - RNA, 17 nt, Human
ucuccugggcagcugcc

SEQ ID NO: 2706876 - RNA, 16 nt, Human
ucuccugggcagcugc

SEQ ID NO: 2706877 - RNA, 15 nt, Human
ucuccugggcagcug

SEQ ID NO: 2706878 - RNA, 13 nt, Human
ucuccugggcagc

SEQ ID NO: 2706879 - RNA, 14 nt, Human
ucuccugggcagcu

SEQ ID NO: 2706880 - RNA, 21 nt, Human
ucucagugucaaugcagcccc

SEQ ID NO: 2706881 - RNA, 20 nt, Human
ucuccugggcagcugccucc

SEQ ID NO: 2706882 - RNA, 19 nt, Human
ucuccugggcagcugccuc

SEQ ID NO: 2706883 - RNA, 21 nt, Human
ucuccugggcagcugccuccc

SEQ ID NO: 2706884 - RNA, 19 nt, Human
ucucuaggaaauauuuauu

SEQ ID NO: 2706885 - RNA, 13 nt, Human
ucucuaggaaaua

SEQ ID NO: 2706886 - RNA, 18 nt, Human
ucucuucacagucacauu

SEQ ID NO: 2706887 - RNA, 12 nt, Human
uccacuuggucu

SEQ ID NO: 2706888 - RNA, 13 nt, Human
uccacuuggucug

SEQ ID NO: 2706889 - RNA, 17 nt, Human
uccagauccuggaaauc

SEQ ID NO: 2706890 - RNA, 16 nt, Human
uccagauccuggaaau

SEQ ID NO: 2706891 - RNA, 14 nt, Human
uccagauccuggaa

SEQ ID NO: 2706892 - RNA, 20 nt, Human
uccaagcauuuagauguaua

SEQ ID NO: 2706893 - RNA, 14 nt, Human
uccaccuacaugag

SEQ ID NO: 2706894 - RNA, 12 nt, Human
uccaccucccug

SEQ ID NO: 2706895 - RNA, 23 nt, Human
uccaccucccugcaauaaaaugg

SEQ ID NO: 2706896 - RNA, 23 nt, Human
uccaaacugacucuuaagaagac

SEQ ID NO: 2706897 - RNA, 12 nt, Human
uccaaagaaaug

SEQ ID NO: 2706898 - RNA, 16 nt, Human
ucauuucugcaucagc

SEQ ID NO: 2706899 - RNA, 22 nt, Human
ucauuucugcaucagcugcuga

SEQ ID NO: 2706900 - RNA, 14 nt, Human
ucauuucuuugagu

SEQ ID NO: 2706901 - RNA, 23 nt, Human
uccaagcauaccaacacgagcag

SEQ ID NO: 2706902 - RNA, 17 nt, Human
uccaagcauuuagaugu

SEQ ID NO: 2706903 - RNA, 17 nt, Human
ucccucccuccaccucc

SEQ ID NO: 2706904 - RNA, 16 nt, Human
ucccaaauuucauacc

SEQ ID NO: 2706905 - RNA, 17 nt, Human
ucacuugucaauaaaau

SEQ ID NO: 2706906 - RNA, 22 nt, Human
ucagacauagaauuaacacaug

SEQ ID NO: 2706907 - RNA, 19 nt, Human
ucagacauagaauuaacac

SEQ ID NO: 2706908 - RNA, 14 nt, Human
ucacaggaaguaga

SEQ ID NO: 2706909 - RNA, 19 nt, Human
ucacaggaaguagaggagg

SEQ ID NO: 2706910 - RNA, 23 nt, Human
ucacaggacagcccuucuuucca

SEQ ID NO: 2706911 - RNA, 19 nt, Human
ucaacuccaaacugacucu

SEQ ID NO: 2706912 - RNA, 13 nt, Human
ucaaaacugcacu

SEQ ID NO: 2706913 - RNA, 22 nt, Human
uauuucuaugaaauauuauguu

SEQ ID NO: 2706914 - RNA, 21 nt, Human
uauuucuaugaaauauuaugu

SEQ ID NO: 2706915 - RNA, 18 nt, Human
uaaauauaugcuaagucu

SEQ ID NO: 2706916 - RNA, 17 nt, Human
uaaauaaaaauaauccu

SEQ ID NO: 2706917 - RNA, 14 nt, Human
uaaaggaauuuaaa

SEQ ID NO: 2706918 - RNA, 17 nt, Human
uaaaauggguuuuacug

SEQ ID NO: 2706919 - RNA, 18 nt, Human
uaaaauccauacauuugu

SEQ ID NO: 2706920 - RNA, 19 nt, Human
uaaaauccauacauuugug

SEQ ID NO: 2706921 - RNA, 14 nt, Human
uaaaagaugaaaau

SEQ ID NO: 2706922 - RNA, 16 nt, Human
guuuucauuaucucaa

SEQ ID NO: 2706923 - RNA, 18 nt, Human
guuuucaggcuagaugua

SEQ ID NO: 2706924 - RNA, 16 nt, Human
uaaaaaagaaacauuu

SEQ ID NO: 2706925 - RNA, 13 nt, Human
guuuagaaagcuu

SEQ ID NO: 2706926 - RNA, 17 nt, Human
guuuagaaagcuugccc

SEQ ID NO: 2706927 - RNA, 20 nt, Human
guuuaggauguugaaaaagu

SEQ ID NO: 2706928 - RNA, 20 nt, Human
uaagccagacaucaacagau

SEQ ID NO: 2706929 - RNA, 21 nt, Human
uaagccagacaucaacagaua

SEQ ID NO: 2706930 - RNA, 13 nt, Human
uaagccagacauc

SEQ ID NO: 2706931 - RNA, 18 nt, Human
uaagcauuccaacuaucu

SEQ ID NO: 2706932 - RNA, 16 nt, Human
uaagcauuccaacuau

SEQ ID NO: 2706933 - RNA, 20 nt, Human
uaagcauuccaacuaucuca

SEQ ID NO: 2706934 - RNA, 23 nt, Human
uaagagggauuagggagagaaga

SEQ ID NO: 2706935 - RNA, 23 nt, Human
uaaauugacacuuaaaaaugguu

SEQ ID NO: 2706936 - RNA, 19 nt, Human
uaacaaugcuguauuuuaa

SEQ ID NO: 2706937 - RNA, 14 nt, Human
uaauguuucaaaca

SEQ ID NO: 2706938 - RNA, 15 nt, Human
uaauguuucaaacau

SEQ ID NO: 2706939 - RNA, 20 nt, Human
uaauuaaaagaauauuuuaa

SEQ ID NO: 2706940 - RNA, 22 nt, Human
uaauuggaaaggcagcucuaaa

SEQ ID NO: 2706941 - RNA, 23 nt, Human
uaauuuguaguguuggagaagaa

SEQ ID NO: 2706942 - RNA, 20 nt, Human
uaauuuguaguguuggagaa

SEQ ID NO: 2706943 - RNA, 15 nt, Human
uaauaauguuucaaa

SEQ ID NO: 2706944 - RNA, 19 nt, Human
uaaugccacuaaauugaca

SEQ ID NO: 2706945 - RNA, 14 nt, Human
uacaggauuugaaa

SEQ ID NO: 2706946 - RNA, 13 nt, Human
uacagaauuuuau

SEQ ID NO: 2706947 - RNA, 16 nt, Human
uaccaacacgagcagg

SEQ ID NO: 2706948 - RNA, 16 nt, Human
uacauuuguauaaaau

SEQ ID NO: 2706949 - RNA, 11 nt, Human
uacauuugugu

SEQ ID NO: 2706950 - RNA, 17 nt, Human
uacauuuguauaaaaua

SEQ ID NO: 2706951 - RNA, 21 nt, Human
uacaugagguacugagaguga

SEQ ID NO: 2706952 - RNA, 22 nt, Human
uacaugagguacugagagugaa

SEQ ID NO: 2706953 - RNA, 23 nt, Human
uaccacaggaaccacaagacugc

SEQ ID NO: 2706954 - RNA, 23 nt, Human
uacugauguuccuagugaaagag

SEQ ID NO: 2706955 - RNA, 19 nt, Human
uacugagagugaacaaauu

SEQ ID NO: 2706956 - RNA, 20 nt, Human
uagcagggcauggcugggaa

SEQ ID NO: 2706957 - RNA, 16 nt, Human
uagauguauguacuuc

SEQ ID NO: 2706958 - RNA, 20 nt, Human
uagauguauguacuucaugc

SEQ ID NO: 2706959 - RNA, 18 nt, Human
uagaguuuagcuggaaaa

SEQ ID NO: 2706960 - RNA, 17 nt, Human
uagaguuuagcuggaaa

SEQ ID NO: 2706961 - RNA, 13 nt, Human
uaggccaugggac

SEQ ID NO: 2706962 - RNA, 23 nt, Human
uaggaauugacccacaagaaaug

SEQ ID NO: 2706963 - RNA, 20 nt, Human
uaggaauugacccacaagaa

SEQ ID NO: 2706964 - RNA, 21 nt, Human
uaguuguaccgcaaugugacu

SEQ ID NO: 2706965 - RNA, 18 nt, Human
uagucaaauugugugaaa

SEQ ID NO: 2706966 - RNA, 13 nt, Human
uauauuugaaaua

SEQ ID NO: 2706967 - RNA, 14 nt, Human
uauauuugaaauau

SEQ ID NO: 2706968 - RNA, 23 nt, Human
uauauuuauuacuguaagaaaau

SEQ ID NO: 2706969 - RNA, 20 nt, Human
uauauuuauuacuguaagaa

SEQ ID NO: 2706970 - RNA, 19 nt, Human
uauauuuuuuguuaaauga

SEQ ID NO: 2706971 - RNA, 21 nt, Human
ggugcuacaaaaacacagcaa

SEQ ID NO: 2706972 - RNA, 23 nt, Human
ggugcuacaaaaacacagcaagg

SEQ ID NO: 2706973 - RNA, 22 nt, Human
ggcuugaguuuaaauuguaaua

SEQ ID NO: 2706974 - RNA, 20 nt, Human
ggaaaaaauaacaaugaaag

SEQ ID NO: 2706975 - RNA, 17 nt, Human
gcuuuuaaaaaaaaaua

SEQ ID NO: 2706976 - RNA, 16 nt, Human
gcuugccaucccuccc

SEQ ID NO: 2706977 - RNA, 17 nt, Human
gcuugcccuggugccuc

SEQ ID NO: 2706978 - RNA, 19 nt, Human
gcuugcccuggugccucac

SEQ ID NO: 2706979 - RNA, 21 nt, Human
gcuugccaucccucccuccac

SEQ ID NO: 2706980 - RNA, 18 nt, Human
gcuugccaucccucccuc

SEQ ID NO: 2706981 - RNA, 15 nt, Human
gcuguucacagccag

SEQ ID NO: 2706982 - RNA, 16 nt, Human
gcuguucacagccaga

SEQ ID NO: 2706983 - RNA, 23 nt, Human
gcuguucacagccagacuggcac

SEQ ID NO: 2706984 - RNA, 18 nt, Human
ggaaauauuuauuuuaau

SEQ ID NO: 2706985 - RNA, 17 nt, Human
ggaaauauuuauuuuaa

SEQ ID NO: 2706986 - RNA, 12 nt, Human
ggaaauauuuau

SEQ ID NO: 2706987 - RNA, 15 nt, Human
ggaaauauuuauuuu

SEQ ID NO: 2706988 - RNA, 13 nt, Human
ggaaauauuuauu

SEQ ID NO: 2706989 - RNA, 16 nt, Human
ggaaaucaaauaugca

SEQ ID NO: 2706990 - RNA, 18 nt, Human
gcuagauguauguacuuc

SEQ ID NO: 2706991 - RNA, 22 nt, Human
gcuguauuuuaaaagaaugauu

SEQ ID NO: 2706992 - RNA, 19 nt, Human
ggaggacgcucucuggccu

SEQ ID NO: 2706993 - RNA, 20 nt, Human
ggaggacgcucucuggccuu

SEQ ID NO: 2706994 - RNA, 21 nt, Human
ggaggacgcucucuggccuuc

SEQ ID NO: 2706995 - RNA, 22 nt, Human
ggccaugggacagggaggacgc

SEQ ID NO: 2706996 - RNA, 21 nt, Human
ggcagcugccuccccuccucu

SEQ ID NO: 2706997 - RNA, 18 nt, Human
ggcagcugccuccccucc

SEQ ID NO: 2706998 - RNA, 22 nt, Human
ggcagcugccuccccuccucug

SEQ ID NO: 2706999 - RNA, 19 nt, Human
gcccuucuuuccacagaag

SEQ ID NO: 2707000 - RNA, 16 nt, Human
gccuccccuccucugc

SEQ ID NO: 2707001 - RNA, 14 nt, Human
gccuccccuccucu

SEQ ID NO: 2707002 - RNA, 13 nt, Human
gccuccccuccuc

SEQ ID NO: 2707003 - RNA, 12 nt, Human
gccuccccuccu

SEQ ID NO: 2707004 - RNA, 11 nt, Human
gccuccccucc

SEQ ID NO: 2707005 - RNA, 19 nt, Human
gcguccugucggagcccug

SEQ ID NO: 2707006 - RNA, 22 nt, Human
gcguccugucggagcccugucu

SEQ ID NO: 2707007 - RNA, 18 nt, Human
gccuguaaucacagcuac

SEQ ID NO: 2707008 - RNA, 19 nt, Human
gccuucggccuccauccug

SEQ ID NO: 2707009 - RNA, 18 nt, Human
gccuucggccuccauccu

SEQ ID NO: 2707010 - RNA, 22 nt, Human
gcgacagugagacucugucuca

SEQ ID NO: 2707011 - RNA, 22 nt, Human
gccacguucuuacuaguuuccc

SEQ ID NO: 2707012 - RNA, 14 nt, Human
gccaucccucccuc

SEQ ID NO: 2707013 - RNA, 13 nt, Human
gccaucccucccu

SEQ ID NO: 2707014 - RNA, 11 nt, Human
gccaucccucc

SEQ ID NO: 2707015 - RNA, 14 nt, Human
gccaugggacaggg

SEQ ID NO: 2707016 - RNA, 19 nt, Human
gccaugggacagggaggac

SEQ ID NO: 2707017 - RNA, 16 nt, Human
gccaucccucccucca

SEQ ID NO: 2707018 - RNA, 15 nt, Human
gccaucccucccucc

SEQ ID NO: 2707019 - RNA, 22 nt, Human
gccauuuaaagcuuauuaaaac

SEQ ID NO: 2707020 - RNA, 16 nt, Human
gcccacagcuguauga

SEQ ID NO: 2707021 - RNA, 17 nt, Human
gccccgugggguuccuc

SEQ ID NO: 2707022 - RNA, 19 nt, Human
gccccugcacuccagccug

SEQ ID NO: 2707023 - RNA, 16 nt, Human
gcccucuccugggcag

SEQ ID NO: 2707024 - RNA, 15 nt, Human
gcccucuccugggca

SEQ ID NO: 2707025 - RNA, 21 nt, Human
gcccucuccugggcagcugcc

SEQ ID NO: 2707026 - RNA, 19 nt, Human
gcccucuccugggcagcug

SEQ ID NO: 2707027 - RNA, 18 nt, Human
gcccucuccugggcagcu

SEQ ID NO: 2707028 - RNA, 18 nt, Human
gcauagauucccugagca

SEQ ID NO: 2707029 - RNA, 13 nt, Human
gcaguucugaaga

SEQ ID NO: 2707030 - RNA, 15 nt, Human
gcaggcuacugucag

SEQ ID NO: 2707031 - RNA, 20 nt, Human
gcacagccucuuagaugcag

SEQ ID NO: 2707032 - RNA, 15 nt, Human
gcacugucaagauga

SEQ ID NO: 2707033 - RNA, 14 nt, Human
gcagaagacaguau

SEQ ID NO: 2707034 - RNA, 14 nt, Human
gauuaaguaaugau

SEQ ID NO: 2707035 - RNA, 22 nt, Human
gauuaaguaaugauaacuggaa

SEQ ID NO: 2707036 - RNA, 16 nt, Human
gaugcuagaacucccu

SEQ ID NO: 2707037 - RNA, 12 nt, Human
gcaagauguggg

SEQ ID NO: 2707038 - RNA, 16 nt, Human
gcaagaugugggcagu

SEQ ID NO: 2707039 - RNA, 17 nt, Human
gauaggucagugcaaau

SEQ ID NO: 2707040 - RNA, 23 nt, Human
gaucagcuuauugucuagugaaa

SEQ ID NO: 2707041 - RNA, 13 nt, Human
gauaaacaguagu

SEQ ID NO: 2707042 - RNA, 14 nt, Human
gauccuggaaauca

SEQ ID NO: 2707043 - RNA, 13 nt, Human
gaucuuuaaaaua

SEQ ID NO: 2707044 - RNA, 15 nt, Human
gaacauaaaauacaa

SEQ ID NO: 2707045 - RNA, 14 nt, Human
gaacaucacagcuu

SEQ ID NO: 2707046 - RNA, 16 nt, Human
gaacagugauuaccag

SEQ ID NO: 2707047 - RNA, 20 nt, Human
gaacagugauuaccagggac

SEQ ID NO: 2707048 - RNA, 16 nt, Human
gaaauuguauuacaaa

SEQ ID NO: 2707049 - RNA, 18 nt, Human
gaaauuguauuacaaauc

SEQ ID NO: 2707050 - RNA, 19 nt, Human
gaagacugcauuauauuua

SEQ ID NO: 2707051 - RNA, 12 nt, Human
gaagaacugaaa

SEQ ID NO: 2707052 - RNA, 17 nt, Human
gaagauguagaggagaa

SEQ ID NO: 2707053 - RNA, 18 nt, Human
gaagauguagaggagaaa

SEQ ID NO: 2707054 - RNA, 16 nt, Human
gaauauuuuaacuucc

SEQ ID NO: 2707055 - RNA, 22 nt, Human
gaaguccaagcauuuagaugua

SEQ ID NO: 2707056 - RNA, 12 nt, Human
gaaguccaagca

SEQ ID NO: 2707057 - RNA, 16 nt, Human
gaaguauccuucagcc

SEQ ID NO: 2707058 - RNA, 14 nt, Human
gaaguauccuucag

SEQ ID NO: 2707059 - RNA, 21 nt, Human
gacagagccccacccucagau

SEQ ID NO: 2707060 - RNA, 14 nt, Human
gacaucaacagaua

SEQ ID NO: 2707061 - RNA, 23 nt, Human
gacaggaugguucccuugaugaa

SEQ ID NO: 2707062 - RNA, 18 nt, Human
gacccaaaaggcagaagc

SEQ ID NO: 2707063 - RNA, 19 nt, Human
gacccaaaaggcagaagca

SEQ ID NO: 2707064 - RNA, 20 nt, Human
gacccaaaaggcagaagcaa

SEQ ID NO: 2707065 - RNA, 16 nt, Human
gaccacugcagaagac

SEQ ID NO: 2707066 - RNA, 18 nt, Human
gaccacugcagaagacag

SEQ ID NO: 2707067 - RNA, 22 nt, Human
gacuggauaguccgucucugcu

SEQ ID NO: 2707068 - RNA, 18 nt, Human
gacuggcacaguuuucug

SEQ ID NO: 2707069 - RNA, 22 nt, Human
gacuggcacaguuuucugagaa

SEQ ID NO: 2707070 - RNA, 17 nt, Human
gacuggauaguccgucu

SEQ ID NO: 2707071 - RNA, 14 nt, Human
gacuggcacaguuu

SEQ ID NO: 2707072 - RNA, 16 nt, Human
gacugaggggagggga

SEQ ID NO: 2707073 - RNA, 24 nt, Human
gacugcauuauauuuauuacugua

SEQ ID NO: 2707074 - RNA, 22 nt, Human
cuugcagcucuccccuucucug

SEQ ID NO: 2707075 - RNA, 14 nt, Human
cuugcccuguuaaa

SEQ ID NO: 2707076 - RNA, 18 nt, Human
cuugcccuggugccucac

SEQ ID NO: 2707077 - RNA, 19 nt, Human
cuugccaucccucccucca

SEQ ID NO: 2707078 - RNA, 16 nt, Human
cuugccaucccucccu

SEQ ID NO: 2707079 - RNA, 15 nt, Human
cuugccaucccuccc

SEQ ID NO: 2707080 - RNA, 17 nt, Human
cuugccaucccucccuc

SEQ ID NO: 2707081 - RNA, 14 nt, Human
cuugccaucccucc

SEQ ID NO: 2707082 - RNA, 20 nt, Human
cuugcuugauuguauggugg

SEQ ID NO: 2707083 - RNA, 22 nt, Human
cuugcccuguuaaaagaugaaa

SEQ ID NO: 2707084 - RNA, 16 nt, Human
cuuggacucauuuuaa

SEQ ID NO: 2707085 - RNA, 16 nt, Human
cuuggggcugaugcag

SEQ ID NO: 2707086 - RNA, 18 nt, Human
cuuggggcugaugcaguu

SEQ ID NO: 2707087 - RNA, 17 nt, Human
cuuguacuuuauuuucu

SEQ ID NO: 2707088 - RNA, 19 nt, Human
cuuuccucaaaacuucaga

SEQ ID NO: 2707089 - RNA, 14 nt, Human
gaaaacaaggauga

SEQ ID NO: 2707090 - RNA, 14 nt, Human
gaaaaguauguuag

SEQ ID NO: 2707091 - RNA, 20 nt, Human
gaaaaguauguuagugcaaa

SEQ ID NO: 2707092 - RNA, 19 nt, Human
gaaaauaacaauaaaagac

SEQ ID NO: 2707093 - RNA, 18 nt, Human
cuuaaugccacuaaauug

SEQ ID NO: 2707094 - RNA, 19 nt, Human
cuguuuuauaauuuuguga

SEQ ID NO: 2707095 - RNA, 19 nt, Human
cuuacuaguuucccuugca

SEQ ID NO: 2707096 - RNA, 19 nt, Human
cuuagaugcaguucugaag

SEQ ID NO: 2707097 - RNA, 19 nt, Human
cuuauaggaauugacccac

SEQ ID NO: 2707098 - RNA, 14 nt, Human
cuuauaauuuaaaa

SEQ ID NO: 2707099 - RNA, 21 nt, Human
cuuaggguuaugauuaaguaa

SEQ ID NO: 2707100 - RNA, 13 nt, Human
cuuauaauuuaaa

SEQ ID NO: 2707101 - RNA, 19 nt, Human
cuuccagauccuggaaauc

SEQ ID NO: 2707102 - RNA, 18 nt, Human
cuucagcgguuuauauaa

SEQ ID NO: 2707103 - RNA, 19 nt, Human
cuuccuuggacucauuuua

SEQ ID NO: 2707104 - RNA, 18 nt, Human
cuucggccuccauccuga

SEQ ID NO: 2707105 - RNA, 19 nt, Human
cuucggccuccauccugag

SEQ ID NO: 2707106 - RNA, 17 nt, Human
cuucggccuccauccug

SEQ ID NO: 2707107 - RNA, 16 nt, Human
cucccuucucuucaca

SEQ ID NO: 2707108 - RNA, 13 nt, Human
cucccuuucaaca

SEQ ID NO: 2707109 - RNA, 12 nt, Human
cucccuuucaac

SEQ ID NO: 2707110 - RNA, 13 nt, Human
cucggagaagagc

SEQ ID NO: 2707111 - RNA, 20 nt, Human
cucggagaagagcuguucac

SEQ ID NO: 2707112 - RNA, 12 nt, Human
cucggagaagag

SEQ ID NO: 2707113 - RNA, 17 nt, Human
cucauuaggauggcuag

SEQ ID NO: 2707114 - RNA, 18 nt, Human
cucauuaggauggcuagu

SEQ ID NO: 2707115 - RNA, 21 nt, Human
cuccauccugaggcuccacuu

SEQ ID NO: 2707116 - RNA, 20 nt, Human
cuccauccugaggcuccacu

SEQ ID NO: 2707117 - RNA, 23 nt, Human
cuccauccugaggcuccacuugg

SEQ ID NO: 2707118 - RNA, 17 nt, Human
cucccagucauuuaaua

SEQ ID NO: 2707119 - RNA, 17 nt, Human
cuccaccucccugcaau

SEQ ID NO: 2707120 - RNA, 16 nt, Human
cuccaccucccugcaa

SEQ ID NO: 2707121 - RNA, 15 nt, Human
cuccaccucccugca

SEQ ID NO: 2707122 - RNA, 14 nt, Human
cuccaccucccugc

SEQ ID NO: 2707123 - RNA, 23 nt, Human
cucugcauacucauuaggauggc

SEQ ID NO: 2707124 - RNA, 21 nt, Human
cucuccugggcagcugccucc

SEQ ID NO: 2707125 - RNA, 13 nt, Human
cucuuaagaagac

SEQ ID NO: 2707126 - RNA, 13 nt, Human
cugauguuccuag

SEQ ID NO: 2707127 - RNA, 18 nt, Human
cugauguuccuagugaaa

SEQ ID NO: 2707128 - RNA, 20 nt, Human
cugauguuccuagugaaaga

SEQ ID NO: 2707129 - RNA, 21 nt, Human
cugauguuccuagugaaagag

SEQ ID NO: 2707130 - RNA, 23 nt, Human
cugcagaagacaguauggcagcu

SEQ ID NO: 2707131 - RNA, 13 nt, Human
cugcagaagacag

SEQ ID NO: 2707132 - RNA, 15 nt, Human
cugccuaagugcagc

SEQ ID NO: 2707133 - RNA, 13 nt, Human
cugcugaaacaac

SEQ ID NO: 2707134 - RNA, 23 nt, Human
cuggaauaauccuaaacauauga

SEQ ID NO: 2707135 - RNA, 16 nt, Human
cuggccaacgggguga

SEQ ID NO: 2707136 - RNA, 18 nt, Human
cuggcacaguuuucugag

SEQ ID NO: 2707137 - RNA, 19 nt, Human
cuggcacaguuuucugaga

SEQ ID NO: 2707138 - RNA, 22 nt, Human
cugggaacccaaguccaagcau

SEQ ID NO: 2707139 - RNA, 21 nt, Human
cuggucccagccagcaguuca

SEQ ID NO: 2707140 - RNA, 22 nt, Human
ccgggaggcagagguugcagug

SEQ ID NO: 2707141 - RNA, 16 nt, Human
cccuugaugaagaagu

SEQ ID NO: 2707142 - RNA, 15 nt, Human
cccuugaugaagaag

SEQ ID NO: 2707143 - RNA, 23 nt, Human
ccucuuagaugcaguucugaaga

SEQ ID NO: 2707144 - RNA, 23 nt, Human
ccugaaagaggaaugaaguacuc

SEQ ID NO: 2707145 - RNA, 18 nt, Human
ccugaaagaggaaugaag

SEQ ID NO: 2707146 - RNA, 13 nt, Human
ccugaaagaggaa

SEQ ID NO: 2707147 - RNA, 18 nt, Human
ccugaggcuccacuuggu

SEQ ID NO: 2707148 - RNA, 20 nt, Human
ccugaggcuccacuuggucu

SEQ ID NO: 2707149 - RNA, 17 nt, Human
ccugaggcuccacuugg

SEQ ID NO: 2707150 - RNA, 13 nt, Human
ccucuccugggca

SEQ ID NO: 2707151 - RNA, 12 nt, Human
ccucuccugggc

SEQ ID NO: 2707152 - RNA, 11 nt, Human
ccucuccuggg

SEQ ID NO: 2707153 - RNA, 21 nt, Human
ccucugcuugccaucccuccc

SEQ ID NO: 2707154 - RNA, 20 nt, Human
ccucugcuugccaucccucc

SEQ ID NO: 2707155 - RNA, 17 nt, Human
ccucugcuugccauccc

SEQ ID NO: 2707156 - RNA, 20 nt, Human
ccucagaaaacaaggaugaa

SEQ ID NO: 2707157 - RNA, 14 nt, Human
ccuccccuccucug

SEQ ID NO: 2707158 - RNA, 15 nt, Human
ccuccccuccucugc

SEQ ID NO: 2707159 - RNA, 11 nt, Human
ccuccucugcu

SEQ ID NO: 2707160 - RNA, 16 nt, Human
ccucccugcaauaaaa

SEQ ID NO: 2707161 - RNA, 12 nt, Human
ccucccugcaau

SEQ ID NO: 2707162 - RNA, 18 nt, Human
ccuccccuccucugcuug

SEQ ID NO: 2707163 - RNA, 17 nt, Human
ccuccccuccucugcuu

SEQ ID NO: 2707164 - RNA, 12 nt, Human
ccuucagccuga

SEQ ID NO: 2707165 - RNA, 18 nt, Human
ccugggcagcugccuccc

SEQ ID NO: 2707166 - RNA, 17 nt, Human
ccugggcagcugccucc

SEQ ID NO: 2707167 - RNA, 16 nt, Human
ccugggcagcugccuc

SEQ ID NO: 2707168 - RNA, 15 nt, Human
ccugggcagcugccu

SEQ ID NO: 2707169 - RNA, 20 nt, Human
ccugggcagcugccuccccu

SEQ ID NO: 2707170 - RNA, 11 nt, Human
cgcaaugugac

SEQ ID NO: 2707171 - RNA, 14 nt, Human
cggccuccauccug

SEQ ID NO: 2707172 - RNA, 16 nt, Human
cggccuccauccugag

SEQ ID NO: 2707173 - RNA, 17 nt, Human
cggccuccauccugagg

SEQ ID NO: 2707174 - RNA, 18 nt, Human
cauuugcucauggaauug

SEQ ID NO: 2707175 - RNA, 13 nt, Human
cauuugcucaugg

SEQ ID NO: 2707176 - RNA, 17 nt, Human
cauuuaggccaugggac

SEQ ID NO: 2707177 - RNA, 22 nt, Human
ccaagcauaccaacacgagcag

SEQ ID NO: 2707178 - RNA, 17 nt, Human
ccaagcauuuagaugua

SEQ ID NO: 2707179 - RNA, 14 nt, Human
ccaagcaaguauua

SEQ ID NO: 2707180 - RNA, 23 nt, Human
ccaaauuucauaccuaucaucuu

SEQ ID NO: 2707181 - RNA, 22 nt, Human
ccaaacugacucuuaagaagac

SEQ ID NO: 2707182 - RNA, 20 nt, Human
ccacaggaaccacaagacug

SEQ ID NO: 2707183 - RNA, 16 nt, Human
ccaauauucauagcag

SEQ ID NO: 2707184 - RNA, 13 nt, Human
ccacugcagaaga

SEQ ID NO: 2707185 - RNA, 18 nt, Human
ccacugcagaagacagua

SEQ ID NO: 2707186 - RNA, 17 nt, Human
ccaggugccaguuaugg

SEQ ID NO: 2707187 - RNA, 13 nt, Human
cccaaaaggcaga

SEQ ID NO: 2707188 - RNA, 18 nt, Human
cccaaaaggcagaagcaa

SEQ ID NO: 2707189 - RNA, 14 nt, Human
ccaugaagauguag

SEQ ID NO: 2707190 - RNA, 16 nt, Human
ccaugauguuuagaaa

SEQ ID NO: 2707191 - RNA, 18 nt, Human
ccaucaaggguacacugc

SEQ ID NO: 2707192 - RNA, 13 nt, Human
cccaggugccagu

SEQ ID NO: 2707193 - RNA, 22 nt, Human
ucuauaauuuaaauauaugcua

SEQ ID NO: 2707194 - RNA, 23 nt, Human
aucuuauaauuuaaaauaugcuc

SEQ ID NO: 2707195 - RNA, 15 nt, Human parainfluenza virus 3
auagcagauaguaaa

SEQ ID NO: 2707196 - RNA, 14 nt, Human parainfluenza virus 3
auguccagaauuau

SEQ ID NO: 2707197 - RNA, 16 nt, Human parainfluenza virus 3
acaaauaacauaucua

SEQ ID NO: 2707198 - RNA, 23 nt, Human parainfluenza virus 3
uuaacugagaaagugaaugacuu

SEQ ID NO: 2707199 - RNA, 18 nt, Human parainfluenza virus 3
agcccaaggauagacaaa

SEQ ID NO: 2707200 - RNA, 18 nt, Human parainfluenza virus 3
uagacaaaaaguaagaaa

SEQ ID NO: 2707201 - RNA, 14 nt, Human parainfluenza virus 3
aaugaaucuacaau

SEQ ID NO: 2707202 - RNA, 13 nt, Human parainfluenza virus 3
uaaagauauaucu

SEQ ID NO: 2707203 - RNA, 15 nt, Human parainfluenza virus 3
uugaauucauacuua

SEQ ID NO: 2707204 - RNA, 18 nt, Human parainfluenza virus 3
aaccaacagaaacaagug

SEQ ID NO: 2707205 - RNA, 15 nt, Human parainfluenza virus 3
ccaaaacaacaaaac

SEQ ID NO: 2707206 - RNA, 17 nt, Human parainfluenza virus 3
caaggauagacaaaaag

SEQ ID NO: 2707207 - RNA, 17 nt, Human parainfluenza virus 3
agcuggccaucagaaac

SEQ ID NO: 2707208 - RNA, 17 nt, Human parainfluenza virus 3
caagacuaauacccaaa

SEQ ID NO: 2707209 - RNA, 15 nt, Human parainfluenza virus 3
aaccauugcucuggg

SEQ ID NO: 2707210 - RNA, 12 nt, Human parainfluenza virus 3
gaucuuaaugaa

SEQ ID NO: 2707211 - RNA, 14 nt, Human parainfluenza virus 3
gucaaaugacugau

SEQ ID NO: 2707212 - RNA, 22 nt, Human parainfluenza virus 3
cucaauaaauuagauaaaagac

SEQ ID NO: 2707213 - RNA, 13 nt, Human parainfluenza virus 3
aagacaaauggaa

SEQ ID NO: 2707214 - RNA, 18 nt, Human parainfluenza virus 3
aaagggggaaaagggaaa

SEQ ID NO: 2707215 - RNA, 22 nt, Human parainfluenza virus 3
uugauauuacugauuacaguga

SEQ ID NO: 2707216 - RNA, 14 nt, Human parainfluenza virus 3
uugcaaaaaugaca

SEQ ID NO: 2707217 - RNA, 15 nt, Human parainfluenza virus 3
uuccaauuaugggag

SEQ ID NO: 2707218 - RNA, 18 nt, Human parainfluenza virus 3
ccuuuaucuuugagccca

SEQ ID NO: 2707219 - RNA, 16 nt, Human parainfluenza virus 3
aaauuccuaagucaau

SEQ ID NO: 2707220 - RNA, 22 nt, Human parainfluenza virus 3
aacauaggaucauuacaagaaa

SEQ ID NO: 2707221 - RNA, 22 nt, Human parainfluenza virus 3
ucaaaaucuaucaacacacaca

SEQ ID NO: 2707222 - RNA, 19 nt, Human parainfluenza virus 3
ggaugaaucacauagaaga

SEQ ID NO: 2707223 - RNA, 14 nt, Human parainfluenza virus 3
agaaacucaaagaa

SEQ ID NO: 2707224 - RNA, 12 nt, Human parainfluenza virus 3
auucuaaaaaug

SEQ ID NO: 2707225 - RNA, 20 nt, Human parainfluenza virus 3
aagauugauagaaaaucaaa

SEQ ID NO: 2707226 - RNA, 16 nt, Human parainfluenza virus 3
ucuuaaccuuuaucuu

SEQ ID NO: 2707227 - RNA, 23 nt, Human parainfluenza virus 3
auggcaucuuucugccaaauaga

SEQ ID NO: 2707228 - RNA, 20 nt, Human parainfluenza virus 3
agcaccgacccccaagaaga

SEQ ID NO: 2707229 - RNA, 18 nt, Human parainfluenza virus 3
gcuaaaccucaaagcaga

SEQ ID NO: 2707230 - RNA, 16 nt, Human parainfluenza virus 3
auugacaagaauauac

SEQ ID NO: 2707231 - RNA, 15 nt, Human parainfluenza virus 3
agaaacucaaagaag

SEQ ID NO: 2707232 - RNA, 14 nt, Human parainfluenza virus 3
uauauuauggacaa

SEQ ID NO: 2707233 - RNA, 23 nt, Human parainfluenza virus 3
aucaacaguugauaaauaugaua

SEQ ID NO: 2707234 - RNA, 14 nt, Human parainfluenza virus 3
cuacaauagaugaa

SEQ ID NO: 2707235 - RNA, 19 nt, Human parainfluenza virus 3
agguggagcagaugucaaa

SEQ ID NO: 2707236 - RNA, 17 nt, Human parainfluenza virus 3
gcaaaaaugaugaagaa

SEQ ID NO: 2707237 - RNA, 17 nt, Human parainfluenza virus 3
aacccaagacacaaaag

SEQ ID NO: 2707238 - RNA, 19 nt, Human parainfluenza virus 3
auuaccagagcuucauagg

SEQ ID NO: 2707239 - RNA, 16 nt, Human parainfluenza virus 3
guagaaauaaaucaga

SEQ ID NO: 2707240 - RNA, 14 nt, Human parainfluenza virus 3
cccccaacaacaac

SEQ ID NO: 2707241 - RNA, 18 nt, Human parainfluenza virus 3
aaacuucgaaacaagaua

SEQ ID NO: 2707242 - RNA, 14 nt, Human parainfluenza virus 3
auaacaacaagcuc

SEQ ID NO: 2707243 - RNA, 22 nt, Human parainfluenza virus 3
ugaguuuauggagauuacagaa

SEQ ID NO: 2707244 - RNA, 17 nt, Human parainfluenza virus 3
acauauagucaaaugac

SEQ ID NO: 2707245 - RNA, 14 nt, Human parainfluenza virus 3
acaauaaagauaua

SEQ ID NO: 2707246 - RNA, 14 nt, Human parainfluenza virus 3
auuacucagaauua

SEQ ID NO: 2707247 - RNA, 23 nt, Human parainfluenza virus 3
uccaaaauuaaagguauggacaa

SEQ ID NO: 2707248 - RNA, 19 nt, Human parainfluenza virus 3
cagcaaucucucacaaagc

SEQ ID NO: 2707249 - RNA, 14 nt, Human parainfluenza virus 3
gauacagaagagag

SEQ ID NO: 2707250 - RNA, 15 nt, Human parainfluenza virus 3
ucaaagagaacaacu

SEQ ID NO: 2707251 - RNA, 15 nt, Human parainfluenza virus 3
agcagaguucuucuc

SEQ ID NO: 2707252 - RNA, 17 nt, Human parainfluenza virus 3
aaacuuaggacaaaaga

SEQ ID NO: 2707253 - RNA, 14 nt, Human parainfluenza virus 3
augccaacaaaguu

SEQ ID NO: 2707254 - RNA, 15 nt, Human parainfluenza virus 3
aagaaucaauccgaa

SEQ ID NO: 2707255 - RNA, 13 nt, Human parainfluenza virus 3
aaaaaaagcaaaa

SEQ ID NO: 2707256 - RNA, 17 nt, Human parainfluenza virus 3
gcuaucaagaccaggaa

SEQ ID NO: 2707257 - RNA, 24 nt, Human parainfluenza virus 3
aacgcagcauuacucagaauuaac

SEQ ID NO: 2707258 - RNA, 20 nt, Human parainfluenza virus 3
ugcuaaaaacuaucaaauca

SEQ ID NO: 2707259 - RNA, 18 nt, Human parainfluenza virus 3
auucauuagugaaauuac

SEQ ID NO: 2707260 - RNA, 13 nt, Human parainfluenza virus 3
uauauaccaagca

SEQ ID NO: 2707261 - RNA, 11 nt, Human parainfluenza virus 3
ggagauuacag

SEQ ID NO: 2707262 - RNA, 19 nt, Human parainfluenza virus 3
aucaacuuauacaaaagaa

SEQ ID NO: 2707263 - RNA, 20 nt, Human parainfluenza virus 3
gaaggauacagaagagagca

SEQ ID NO: 2707264 - RNA, 22 nt, Human parainfluenza virus 3
aagcaaauaagggauaaucaaa

SEQ ID NO: 2707265 - RNA, 13 nt, Human parainfluenza virus 3
uugggaaaaucaa

SEQ ID NO: 2707266 - RNA, 15 nt, Human parainfluenza virus 3
agauacaaaaugaaa

SEQ ID NO: 2707267 - RNA, 19 nt, Human parainfluenza virus 3
caacacagcaaacacuaaa

SEQ ID NO: 2707268 - RNA, 17 nt, Human parainfluenza virus 3
gaaaaguucaaacacau

SEQ ID NO: 2707269 - RNA, 21 nt, Human parainfluenza virus 3
aaaaugaauccaaugagagag

SEQ ID NO: 2707270 - RNA, 15 nt, Human parainfluenza virus 3
auaaaucagaaaagu

SEQ ID NO: 2707271 - RNA, 18 nt, Human parainfluenza virus 3
acagaaaaucgagaaaau

SEQ ID NO: 2707272 - RNA, 16 nt, Human parainfluenza virus 3
aauaaagauauaucuu

SEQ ID NO: 2707273 - RNA, 15 nt, Human parainfluenza virus 3
cuauauauauacaag

SEQ ID NO: 2707274 - RNA, 21 nt, Human parainfluenza virus 3
acaaaaucaagcagaaugaaa

SEQ ID NO: 2707275 - RNA, 22 nt, Human parainfluenza virus 3
gaaugcuguucaauacaaacaa

SEQ ID NO: 2707276 - RNA, 23 nt, Human parainfluenza virus 3
ccuuuaucuuugagcccaaggau

SEQ ID NO: 2707277 - RNA, 16 nt, Human parainfluenza virus 3
gagcccaaggauagac

SEQ ID NO: 2707278 - RNA, 15 nt, Human parainfluenza virus 3
aucaaaccaacagaa

SEQ ID NO: 2707279 - RNA, 17 nt, Human parainfluenza virus 3
cgcaggaacaagaaaga

SEQ ID NO: 2707280 - RNA, 23 nt, Human parainfluenza virus 3
aucauguguuauccgaaauggaa

SEQ ID NO: 2707281 - RNA, 14 nt, Human parainfluenza virus 3
acaacaacaagcug

SEQ ID NO: 2707282 - RNA, 14 nt, Human parainfluenza virus 3
gaaagaaagaccaa

SEQ ID NO: 2707283 - RNA, 22 nt, Human parainfluenza virus 3
cugcagguacauaucaaaacag

SEQ ID NO: 2707284 - RNA, 15 nt, Human parainfluenza virus 3
ggaauccaaugaaaa

SEQ ID NO: 2707285 - RNA, 23 nt, Human parainfluenza virus 3
acucaaagucaaugaacagagaa

SEQ ID NO: 2707286 - RNA, 19 nt, Human parainfluenza virus 3
caggaaacuguacagagag

SEQ ID NO: 2707287 - RNA, 21 nt, Human parainfluenza virus 3
agaaacaauuaaaauuugaca

SEQ ID NO: 2707288 - RNA, 23 nt, Human parainfluenza virus 3
cuuccacuagauaggagcauaaa

SEQ ID NO: 2707289 - RNA, 23 nt, Human parainfluenza virus 3
gaucaucagauauuaagauuaua

SEQ ID NO: 2707290 - RNA, 23 nt, Human parainfluenza virus 3
aaacaaaaaguacagaacaccaa

SEQ ID NO: 2707291 - RNA, 11 nt, Human parainfluenza virus 3
cacauagaaga

SEQ ID NO: 2707292 - RNA, 13 nt, Human parainfluenza virus 3
aagcacaaaacaa

SEQ ID NO: 2707293 - RNA, 16 nt, Human parainfluenza virus 3
uccaugaucaaaacaa

SEQ ID NO: 2707294 - RNA, 15 nt, Human parainfluenza virus 3
agaaugaaacaauag

SEQ ID NO: 2707295 - RNA, 16 nt, Human parainfluenza virus 3
aaaauaaaaaucccaa

SEQ ID NO: 2707296 - RNA, 14 nt, Human parainfluenza virus 3
aagauauaucuuaa

SEQ ID NO: 2707297 - RNA, 19 nt, Human parainfluenza virus 3
gcaaucagacaauggacaa

SEQ ID NO: 2707298 - RNA, 13 nt, Human parainfluenza virus 3
ggccaaaucagau

SEQ ID NO: 2707299 - RNA, 16 nt, Human parainfluenza virus 3
cuagguugugaagcag

SEQ ID NO: 2707300 - RNA, 12 nt, Human parainfluenza virus 3
auuaacaguaaa

SEQ ID NO: 2707301 - RNA, 14 nt, Human parainfluenza virus 3
ugauuacagugaua

SEQ ID NO: 2707302 - RNA, 18 nt, Human parainfluenza virus 3
uauuagcagucauacucg

SEQ ID NO: 2707303 - RNA, 20 nt, Human parainfluenza virus 3
gagaagaacagucaaagcga

SEQ ID NO: 2707304 - RNA, 22 nt, Human parainfluenza virus 3
acucaaacauugcaaaaaugau

SEQ ID NO: 2707305 - RNA, 17 nt, Human parainfluenza virus 3
aauauauauauaccaag

SEQ ID NO: 2707306 - RNA, 17 nt, Human parainfluenza virus 3
acgaauguacaacagaa

SEQ ID NO: 2707307 - RNA, 20 nt, Human parainfluenza virus 3
uauuccucuucccagccaua

SEQ ID NO: 2707308 - RNA, 17 nt, Human parainfluenza virus 3
uugcaguuauaagcaac

SEQ ID NO: 2707309 - RNA, 16 nt, Human parainfluenza virus 3
caccgaacaaacagac

SEQ ID NO: 2707310 - RNA, 13 nt, Human parainfluenza virus 3
gcaaguuaaauca

SEQ ID NO: 2707311 - RNA, 19 nt, Human parainfluenza virus 3
acuaaacacaaugccaacu

SEQ ID NO: 2707312 - RNA, 21 nt, Human parainfluenza virus 3
aaguucauacaaugaaucaaa

SEQ ID NO: 2707313 - RNA, 21 nt, Human parainfluenza virus 3
uugagaaacucaaagaagcaa

SEQ ID NO: 2707314 - RNA, 11 nt, Human parainfluenza virus 3
caaaacaaaaa

SEQ ID NO: 2707315 - RNA, 12 nt, Human parainfluenza virus 3
cagccuuaugau

SEQ ID NO: 2707316 - RNA, 18 nt, Human parainfluenza virus 3
aguaagaaaaacauguaa

SEQ ID NO: 2707317 - RNA, 21 nt, Human parainfluenza virus 3
auuaacacagauacaaaauga

SEQ ID NO: 2707318 - RNA, 20 nt, Human parainfluenza virus 3
agaaacaagugagaaagaua

SEQ ID NO: 2707319 - RNA, 13 nt, Human parainfluenza virus 3
ugagcccaaggau

SEQ ID NO: 2707320 - RNA, 14 nt, Human parainfluenza virus 3
acacuaaacacaau

SEQ ID NO: 2707321 - RNA, 14 nt, Human parainfluenza virus 3
agcucgaaaugaga

SEQ ID NO: 2707322 - RNA, 22 nt, Human parainfluenza virus 3
aaaacauguaauauauauauac

SEQ ID NO: 2707323 - RNA, 21 nt, Human parainfluenza virus 3
aagaagaugacaaaagaauua

SEQ ID NO: 2707324 - RNA, 21 nt, Human parainfluenza virus 3
uacccaacacaauaucaauca

SEQ ID NO: 2707325 - RNA, 21 nt, Human parainfluenza virus 3
agaaaaagagauuaaacaaga

SEQ ID NO: 2707326 - RNA, 13 nt, Human parainfluenza virus 3
aaagguuagaaaa

SEQ ID NO: 2707327 - RNA, 13 nt, Human parainfluenza virus 3
agauagaacauau

SEQ ID NO: 2707328 - RNA, 15 nt, Human parainfluenza virus 3
aaugaaguguacaau

SEQ ID NO: 2707329 - RNA, 21 nt, Human parainfluenza virus 3
gaaacgacaccgaacaaacag

SEQ ID NO: 2707330 - RNA, 21 nt, Human parainfluenza virus 3
augagaagggcgaaaaaucac

SEQ ID NO: 2707331 - RNA, 12 nt, Human parainfluenza virus 3
caauacaccaag

SEQ ID NO: 2707332 - RNA, 20 nt, Human parainfluenza virus 3
aguucuucaauacaccaaga

SEQ ID NO: 2707333 - RNA, 12 nt, Human parainfluenza virus 3
ucaacacaagaa

SEQ ID NO: 2707334 - RNA, 19 nt, Human parainfluenza virus 3
cuuaggauuaaagaauaaa

SEQ ID NO: 2707335 - RNA, 19 nt, Human parainfluenza virus 3
ucagcugguauucaaaagg

SEQ ID NO: 2707336 - RNA, 15 nt, Human parainfluenza virus 3
aauagauaucacaaa

SEQ ID NO: 2707337 - RNA, 19 nt, Human parainfluenza virus 3
auuaugucaacaaagaaau

SEQ ID NO: 2707338 - RNA, 18 nt, Human parainfluenza virus 3
agaaaauggaugaaucac

SEQ ID NO: 2707339 - RNA, 14 nt, Human parainfluenza virus 3
augaagauaucaca

SEQ ID NO: 2707340 - RNA, 14 nt, Human parainfluenza virus 3
aacaguagaucaaa

SEQ ID NO: 2707341 - RNA, 14 nt, Human parainfluenza virus 3
aggauauaggaaaa

SEQ ID NO: 2707342 - RNA, 14 nt, Human parainfluenza virus 3
gaaauaaaucagaa

SEQ ID NO: 2707343 - RNA, 14 nt, Human parainfluenza virus 3
uagcaaucaaauca

SEQ ID NO: 2707344 - RNA, 21 nt, Human parainfluenza virus 3
auagugaaaagguccauaauu

SEQ ID NO: 2707345 - RNA, 14 nt, Human parainfluenza virus 3
gaaaaucaaagaga

SEQ ID NO: 2707346 - RNA, 14 nt, Human parainfluenza virus 3
uacagacagaauca

SEQ ID NO: 2707347 - RNA, 12 nt, Human parainfluenza virus 3
cuuaaaucccag

SEQ ID NO: 2707348 - RNA, 14 nt, Human parainfluenza virus 3
cuuauaaaucagau

SEQ ID NO: 2707349 - RNA, 15 nt, Human parainfluenza virus 3
auaccaagcagaguu

SEQ ID NO: 2707350 - RNA, 19 nt, Human parainfluenza virus 3
aaucaggaauccaaugaaa

SEQ ID NO: 2707351 - RNA, 19 nt, Human parainfluenza virus 3
uagacaaaaaguaagaaaa

SEQ ID NO: 2707352 - RNA, 13 nt, Human parainfluenza virus 3
agauacaaaauga

SEQ ID NO: 2707353 - RNA, 14 nt, Human parainfluenza virus 3
caaaaggaaaauau

SEQ ID NO: 2707354 - RNA, 17 nt, Human parainfluenza virus 3
auauuaacugagaaagu

SEQ ID NO: 2707355 - RNA, 12 nt, Human parainfluenza virus 3
gcaaaaaugaug

SEQ ID NO: 2707356 - RNA, 22 nt, Human parainfluenza virus 3
aaacagagauuccaaaaagcug

SEQ ID NO: 2707357 - RNA, 20 nt, Human parainfluenza virus 3
uggaggaaucuccagaagca

SEQ ID NO: 2707358 - RNA, 16 nt, Human parainfluenza virus 3
agaaauacuaaugaaa

SEQ ID NO: 2707359 - RNA, 15 nt, Human parainfluenza virus 3
agaaaagaucaagaa

SEQ ID NO: 2707360 - RNA, 19 nt, Human parainfluenza virus 3
aucauucuuugaaaauggu

SEQ ID NO: 2707361 - RNA, 17 nt, Human parainfluenza virus 3
auaaagauauaucuuaa

SEQ ID NO: 2707362 - RNA, 21 nt, Human parainfluenza virus 3
auaaucaaaaacuuaggacaa

SEQ ID NO: 2707363 - RNA, 16 nt, Human parainfluenza virus 3
agacuaagaaaaggaa

SEQ ID NO: 2707364 - RNA, 19 nt, Human parainfluenza virus 3
uugaaugauuacucaauca

SEQ ID NO: 2707365 - RNA, 21 nt, Human parainfluenza virus 3
gaucaggaaacuguacagaga

SEQ ID NO: 2707366 - RNA, 15 nt, Human parainfluenza virus 3
gagaaacucaaagaa

SEQ ID NO: 2707367 - RNA, 14 nt, Human parainfluenza virus 3
gcagaguucuucuc

SEQ ID NO: 2707368 - RNA, 17 nt, Human parainfluenza virus 3
uauguacuaacaaacaa

SEQ ID NO: 2707369 - RNA, 16 nt, Human parainfluenza virus 3
agucaaugaacagaga

SEQ ID NO: 2707370 - RNA, 17 nt, Human parainfluenza virus 3
aaauguacuaaacaaug

SEQ ID NO: 2707371 - RNA, 22 nt, Human parainfluenza virus 3
cagagaggaccugggagaagaa

SEQ ID NO: 2707372 - RNA, 12 nt, Human parainfluenza virus 3
aagauuacagaa

SEQ ID NO: 2707373 - RNA, 15 nt, Human parainfluenza virus 3
gaaauuaauaauaua

SEQ ID NO: 2707374 - RNA, 16 nt, Human parainfluenza virus 3
agccucaaaaaaugau

SEQ ID NO: 2707375 - RNA, 13 nt, Human parainfluenza virus 3
aagaaaaacaugu

SEQ ID NO: 2707376 - RNA, 18 nt, Human parainfluenza virus 3
uggaacgaaucaaagaca

SEQ ID NO: 2707377 - RNA, 19 nt, Human parainfluenza virus 3
aucuuucugccaaauagau

SEQ ID NO: 2707378 - RNA, 14 nt, Human parainfluenza virus 3
accaugaaauggag

SEQ ID NO: 2707379 - RNA, 22 nt, Human parainfluenza virus 3
aacaauggcacuguaucugaca

SEQ ID NO: 2707380 - RNA, 16 nt, Human parainfluenza virus 3
auacaaugaaucaaau

SEQ ID NO: 2707381 - RNA, 16 nt, Human parainfluenza virus 3
uuguucaaaacagaga

SEQ ID NO: 2707382 - RNA, 18 nt, Human parainfluenza virus 3
agauugauagaaaaucaa

SEQ ID NO: 2707383 - RNA, 23 nt, Human parainfluenza virus 3
cccaaaguugaugaaagaucaga

SEQ ID NO: 2707384 - RNA, 21 nt, Human parainfluenza virus 3
auggacaacgacacaaaauua

SEQ ID NO: 2707385 - RNA, 14 nt, Human parainfluenza virus 3
ucaacacacacaaa

SEQ ID NO: 2707386 - RNA, 19 nt, Human parainfluenza virus 3
auaccugguauuaacagua

SEQ ID NO: 2707387 - RNA, 17 nt, Human parainfluenza virus 3
aaguuuguggcucugga

SEQ ID NO: 2707388 - RNA, 14 nt, Human parainfluenza virus 3
uacccaacacaaua

SEQ ID NO: 2707389 - RNA, 17 nt, Human parainfluenza virus 3
uauauaccaagcagagu

SEQ ID NO: 2707390 - RNA, 22 nt, Human parainfluenza virus 3
agccucauaccaaaaauagaag

SEQ ID NO: 2707391 - RNA, 17 nt, Human parainfluenza virus 3
agaaauaaauaaugagu

SEQ ID NO: 2707392 - RNA, 13 nt, Human parainfluenza virus 3
auaaaucagauaa

SEQ ID NO: 2707393 - RNA, 14 nt, Human parainfluenza virus 3
gaacaccaaaacaa

SEQ ID NO: 2707394 - RNA, 20 nt, Human parainfluenza virus 3
aaguuggcauagcaaauuac

SEQ ID NO: 2707395 - RNA, 21 nt, Human parainfluenza virus 3
gauagacaaaaaguaagaaaa

SEQ ID NO: 2707396 - RNA, 21 nt, Human parainfluenza virus 3
cacagaucgaaccgaacagac

SEQ ID NO: 2707397 - RNA, 19 nt, Human parainfluenza virus 3
gcauccaacgaaucacgaa

SEQ ID NO: 2707398 - RNA, 18 nt, Human parainfluenza virus 3
ucaaaccaacagaaacaa

SEQ ID NO: 2707399 - RNA, 17 nt, Human parainfluenza virus 3
ucagaauuaacaaacau

SEQ ID NO: 2707400 - RNA, 17 nt, Human parainfluenza virus 3
uacuaaacaauguagau

SEQ ID NO: 2707401 - RNA, 16 nt, Human parainfluenza virus 3
gauacugcaucaaaga

SEQ ID NO: 2707402 - RNA, 14 nt, Human parainfluenza virus 3
acaauaaaauaagu

SEQ ID NO: 2707403 - RNA, 18 nt, Human parainfluenza virus 3
cgacaugcaggaaauaca

SEQ ID NO: 2707404 - RNA, 19 nt, Human parainfluenza virus 3
gaucaacuuauacaaaaga

SEQ ID NO: 2707405 - RNA, 19 nt, Human parainfluenza virus 3
ugcuaucuucuguacaaua

SEQ ID NO: 2707406 - RNA, 12 nt, Human parainfluenza virus 3
gaucaaaacaaa

SEQ ID NO: 2707407 - RNA, 23 nt, Human parainfluenza virus 3
agcaaucucucacaaagcacaaa

SEQ ID NO: 2707408 - RNA, 19 nt, Human parainfluenza virus 3
agaucuaaagaaaauggau

SEQ ID NO: 2707409 - RNA, 18 nt, Human parainfluenza virus 3
aaaaauaggcagaaugua

SEQ ID NO: 2707410 - RNA, 23 nt, Human parainfluenza virus 3
gaggaaucagucuucaugucaau

SEQ ID NO: 2707411 - RNA, 15 nt, Human parainfluenza virus 3
acuagacucacagaa

SEQ ID NO: 2707412 - RNA, 13 nt, Human parainfluenza virus 3
accauugcucugg

SEQ ID NO: 2707413 - RNA, 19 nt, Human parainfluenza virus 3
agacuaauacccaaaaaag

SEQ ID NO: 2707414 - RNA, 21 nt, Human parainfluenza virus 3
auacucgcaggaacaagaaag

SEQ ID NO: 2707415 - RNA, 16 nt, Human parainfluenza virus 3
aguacaccugauacaa

SEQ ID NO: 2707416 - RNA, 15 nt, Human parainfluenza virus 3
ucgauuuacagagag

SEQ ID NO: 2707417 - RNA, 19 nt, Human parainfluenza virus 3
gaaaaucgagaaaaugaga

SEQ ID NO: 2707418 - RNA, 12 nt, Human parainfluenza virus 3
agaguucuucuc

SEQ ID NO: 2707419 - RNA, 22 nt, Human parainfluenza virus 3
caagucaacggauaucuacaau

SEQ ID NO: 2707420 - RNA, 15 nt, Human parainfluenza virus 3
cacaaauaucacaga

SEQ ID NO: 2707421 - RNA, 21 nt, Human parainfluenza virus 3
aaaaccuuuaaauccagauga

SEQ ID NO: 2707422 - RNA, 16 nt, Human parainfluenza virus 3
gcagaguucuucucuu

SEQ ID NO: 2707423 - RNA, 21 nt, Human parainfluenza virus 3
gcaacaccagaugaugaagaa

SEQ ID NO: 2707424 - RNA, 21 nt, Human parainfluenza virus 3
guacuaaacaauguagauacu

SEQ ID NO: 2707425 - RNA, 20 nt, Human parainfluenza virus 3
aauaagggauaaucaaaaac

SEQ ID NO: 2707426 - RNA, 13 nt, Human parainfluenza virus 3
aaaacauguaaua

SEQ ID NO: 2707427 - RNA, 18 nt, Human parainfluenza virus 3
aaacaugguuuacuauca

SEQ ID NO: 2707428 - RNA, 18 nt, Human parainfluenza virus 3
aaggauagacaaaaagua

SEQ ID NO: 2707429 - RNA, 12 nt, Human parainfluenza virus 3
aaugaguuuaug

SEQ ID NO: 2707430 - RNA, 14 nt, Human parainfluenza virus 3
auaaaugagaaugu

SEQ ID NO: 2707431 - RNA, 13 nt, Human parainfluenza virus 3
cagauauuaagau

SEQ ID NO: 2707432 - RNA, 16 nt, Human parainfluenza virus 3
agauaauauauauauu

SEQ ID NO: 2707433 - RNA, 22 nt, Human parainfluenza virus 3
uuaaacucaauuccaaaauuaa

SEQ ID NO: 2707434 - RNA, 16 nt, Human parainfluenza virus 3
acagaaucaucaggaa

SEQ ID NO: 2707435 - RNA, 16 nt, Human parainfluenza virus 3
aacauuuugauccaaa

SEQ ID NO: 2707436 - RNA, 17 nt, Human parainfluenza virus 3
aaaacacuaaucccaga

SEQ ID NO: 2707437 - RNA, 13 nt, Human parainfluenza virus 3
caagaaacaacag

SEQ ID NO: 2707438 - RNA, 14 nt, Human parainfluenza virus 3
caaagaagcaauca

SEQ ID NO: 2707439 - RNA, 22 nt, Human parainfluenza virus 3
agaagggacaaaaaaagcaaaa

SEQ ID NO: 2707440 - RNA, 15 nt, Human parainfluenza virus 3
ugaucaagagaaaaa

SEQ ID NO: 2707441 - RNA, 18 nt, Human parainfluenza virus 3
auuaacgaccauaucaau

SEQ ID NO: 2707442 - RNA, 17 nt, Human parainfluenza virus 3
gacugauuccaaaggga

SEQ ID NO: 2707443 - RNA, 14 nt, Human parainfluenza virus 3
aggaucauuacaag

SEQ ID NO: 2707444 - RNA, 20 nt, Human parainfluenza virus 3
ugaaguauuuauagcagaua

SEQ ID NO: 2707445 - RNA, 13 nt, Human parainfluenza virus 3
aaaauuauaacac

SEQ ID NO: 2707446 - RNA, 15 nt, Human parainfluenza virus 3
caaacccaagacaca

SEQ ID NO: 2707447 - RNA, 13 nt, Human parainfluenza virus 3
gacacaguuuauc

SEQ ID NO: 2707448 - RNA, 16 nt, Human parainfluenza virus 3
acacagauacaaaaug

SEQ ID NO: 2707449 - RNA, 17 nt, Human parainfluenza virus 3
gcuucuucgaaauggaa

SEQ ID NO: 2707450 - RNA, 22 nt, Human parainfluenza virus 3
aaucuaucaacacacacaaaau

SEQ ID NO: 2707451 - RNA, 12 nt, Human parainfluenza virus 3
auaucaagacaa

SEQ ID NO: 2707452 - RNA, 13 nt, Human parainfluenza virus 3
auauaggaaaauc

SEQ ID NO: 2707453 - RNA, 20 nt, Human parainfluenza virus 3
ucaauccacaucaaaacuag

SEQ ID NO: 2707454 - RNA, 23 nt, Human parainfluenza virus 3
agauuuguuauccuuuaauggau

SEQ ID NO: 2707455 - RNA, 13 nt, Human parainfluenza virus 3
ucagaucuacaaa

SEQ ID NO: 2707456 - RNA, 14 nt, Human parainfluenza virus 3
gauccaacaaagaa

SEQ ID NO: 2707457 - RNA, 18 nt, Human parainfluenza virus 3
gugagaagaacagucaaa

SEQ ID NO: 2707458 - RNA, 20 nt, Human parainfluenza virus 3
ucucacaaagcacaaaacaa

SEQ ID NO: 2707459 - RNA, 14 nt, Human parainfluenza virus 3
caggaguauauacu

SEQ ID NO: 2707460 - RNA, 17 nt, Human parainfluenza virus 3
aagcuagauccaaaauu

SEQ ID NO: 2707461 - RNA, 15 nt, Human parainfluenza virus 3
uaaagauauaucuua

SEQ ID NO: 2707462 - RNA, 17 nt, Human parainfluenza virus 3
aucuauuauuuacagaa

SEQ ID NO: 2707463 - RNA, 17 nt, Human parainfluenza virus 3
ugcuaaaccucaaagca

SEQ ID NO: 2707464 - RNA, 22 nt, Human parainfluenza virus 3
aaaauuagccucaaaaaaugau

SEQ ID NO: 2707465 - RNA, 14 nt, Human parainfluenza virus 3
auucacaacaucaa

SEQ ID NO: 2707466 - RNA, 21 nt, Human parainfluenza virus 3
gacauaaauacaauaaagaua

SEQ ID NO: 2707467 - RNA, 18 nt, Human parainfluenza virus 3
cauaccaaaaauagaaga

SEQ ID NO: 2707468 - RNA, 14 nt, Human parainfluenza virus 3
caacacagcaaaca

SEQ ID NO: 2707469 - RNA, 16 nt, Human parainfluenza virus 3
uaacacagauacaaaa

SEQ ID NO: 2707470 - RNA, 16 nt, Human parainfluenza virus 3
uagaaaaucaaagaga

SEQ ID NO: 2707471 - RNA, 13 nt, Human parainfluenza virus 3
ucaaaaacaacaa

SEQ ID NO: 2707472 - RNA, 18 nt, Human parainfluenza virus 3
gauaauaccaaugaucua

SEQ ID NO: 2707473 - RNA, 16 nt, Human parainfluenza virus 3
agcagaucuaaagaaa

SEQ ID NO: 2707474 - RNA, 21 nt, Human parainfluenza virus 3
gaacaaacagacaagaaacaa

SEQ ID NO: 2707475 - RNA, 14 nt, Human parainfluenza virus 3
ugguauuaacagua

SEQ ID NO: 2707476 - RNA, 16 nt, Human parainfluenza virus 3
auucaauccacaucaa

SEQ ID NO: 2707477 - RNA, 14 nt, Human parainfluenza virus 3
aagcagaguucuuc

SEQ ID NO: 2707478 - RNA, 20 nt, Human parainfluenza virus 3
acaauagauaucaaucaaua

SEQ ID NO: 2707479 - RNA, 20 nt, Human parainfluenza virus 3
aaaacaaaaaguacagaaca

SEQ ID NO: 2707480 - RNA, 18 nt, Human parainfluenza virus 3
ugcucggaaaauggacac

SEQ ID NO: 2707481 - RNA, 12 nt, Human parainfluenza virus 3
gccauacagaug

SEQ ID NO: 2707482 - RNA, 13 nt, Human parainfluenza virus 3
gaagugagaagaa

SEQ ID NO: 2707483 - RNA, 13 nt, Human parainfluenza virus 3
agacaaauccaaa

SEQ ID NO: 2707484 - RNA, 13 nt, Human parainfluenza virus 3
gcucgaaaugaga

SEQ ID NO: 2707485 - RNA, 22 nt, Human parainfluenza virus 3
aacaacaguagaucaaaaucua

SEQ ID NO: 2707486 - RNA, 12 nt, Human parainfluenza virus 3
agacaaauggaa

SEQ ID NO: 2707487 - RNA, 13 nt, Human parainfluenza virus 3
uaagaaaaacaug

SEQ ID NO: 2707488 - RNA, 23 nt, Human parainfluenza virus 3
uccauggcuacucauaacaacaa

SEQ ID NO: 2707489 - RNA, 16 nt, Human parainfluenza virus 3
auauaccaagcagagu

SEQ ID NO: 2707490 - RNA, 15 nt, Human parainfluenza virus 3
aucagauaaauggua

SEQ ID NO: 2707491 - RNA, 22 nt, Human parainfluenza virus 3
acagacaagaaacaacaguaga

SEQ ID NO: 2707492 - RNA, 23 nt, Human parainfluenza virus 3
ccgaacaaacagacaagaaacaa

SEQ ID NO: 2707493 - RNA, 23 nt, Human parainfluenza virus 3
gugcaaguuaaaucagagauauu

SEQ ID NO: 2707494 - RNA, 19 nt, Human parainfluenza virus 3
auuaauaauauaucaaaag

SEQ ID NO: 2707495 - RNA, 22 nt, Human parainfluenza virus 3
agaagauauuguacuugauauu

SEQ ID NO: 2707496 - RNA, 12 nt, Human parainfluenza virus 3
aguuacaaaguu

SEQ ID NO: 2707497 - RNA, 21 nt, Human parainfluenza virus 3
agcccaaggauagacaaaaag

SEQ ID NO: 2707498 - RNA, 13 nt, Human parainfluenza virus 3
cucaaaaaaugau

SEQ ID NO: 2707499 - RNA, 14 nt, Human parainfluenza virus 3
auacaagaucuaca

SEQ ID NO: 2707500 - RNA, 21 nt, Human parainfluenza virus 3
cuacagauccacaucaaaagg

SEQ ID NO: 2707501 - RNA, 16 nt, Human parainfluenza virus 3
uaaagauauaucuuaa

SEQ ID NO: 2707502 - RNA, 16 nt, Human parainfluenza virus 3
acacauuuaucagaua

SEQ ID NO: 2707503 - RNA, 18 nt, Human parainfluenza virus 3
aaucugcagauguuccaa

SEQ ID NO: 2707504 - RNA, 23 nt, Human parainfluenza virus 3
ucaaaauuagccucaaaaaauga

SEQ ID NO: 2707505 - RNA, 19 nt, Human parainfluenza virus 3
aggauauaggaaaaucaua

SEQ ID NO: 2707506 - RNA, 18 nt, Human parainfluenza virus 3
ucggauugaucaagagaa

SEQ ID NO: 2707507 - RNA, 22 nt, Human parainfluenza virus 3
gacacuacuugcaaauaauaua

SEQ ID NO: 2707508 - RNA, 14 nt, Human parainfluenza virus 3
aauauaggaaaauu

SEQ ID NO: 2707509 - RNA, 15 nt, Human parainfluenza virus 3
aauaauauaggaaaa

SEQ ID NO: 2707510 - RNA, 23 nt, Human parainfluenza virus 3
cagauaguagagcugagacugug

SEQ ID NO: 2707511 - RNA, 15 nt, Human parainfluenza virus 3
agaaagucaaaucaa

SEQ ID NO: 2707512 - RNA, 21 nt, Human parainfluenza virus 3
acuggauccauaucaaaaaca

SEQ ID NO: 2707513 - RNA, 22 nt, Human parainfluenza virus 3
ucaauggacaacgacacaaaau

SEQ ID NO: 2707514 - RNA, 17 nt, Human parainfluenza virus 3
gaaucaaagacaaauac

SEQ ID NO: 2707515 - RNA, 20 nt, Human parainfluenza virus 3
acaacaagcugcauuacaca

SEQ ID NO: 2707516 - RNA, 21 nt, Human parainfluenza virus 3
gacaaaagaggucaacaccaa

SEQ ID NO: 2707517 - RNA, 20 nt, Human parainfluenza virus 3
acagcaaacacuaaacacaa

SEQ ID NO: 2707518 - RNA, 17 nt, Human parainfluenza virus 3
uagaaaaucaaagagaa

SEQ ID NO: 2707519 - RNA, 22 nt, Human parainfluenza virus 3
cauaaauacaauaaagauauau

SEQ ID NO: 2707520 - RNA, 23 nt, Human parainfluenza virus 3
caaacgaguuguauguguagcaa

SEQ ID NO: 2707521 - RNA, 12 nt, Human parainfluenza virus 3
aagauaucacaa

SEQ ID NO: 2707522 - RNA, 18 nt, Human parainfluenza virus 3
ucuuaaccuuuaucuuug

SEQ ID NO: 2707523 - RNA, 23 nt, Human parainfluenza virus 3
aaacagaaaaucgagaaaaugag

SEQ ID NO: 2707524 - RNA, 12 nt, Human parainfluenza virus 3
cucuuugcaaaa

SEQ ID NO: 2707525 - RNA, 15 nt, Human parainfluenza virus 3
guaggacaaagaaaa

SEQ ID NO: 2707526 - RNA, 22 nt, Human parainfluenza virus 3
uagaacauauagucaaaugacu

SEQ ID NO: 2707527 - RNA, 22 nt, Human parainfluenza virus 3
agaguauccaugaucaaaacaa

SEQ ID NO: 2707528 - RNA, 17 nt, Human parainfluenza virus 3
agacaauggacaaaagg

SEQ ID NO: 2707529 - RNA, 13 nt, Human parainfluenza virus 3
uaccucagccuua

SEQ ID NO: 2707530 - RNA, 18 nt, Human parainfluenza virus 3
aaccaaucaggaauccaa

SEQ ID NO: 2707531 - RNA, 15 nt, Human parainfluenza virus 3
gacacuguuaauaaa

SEQ ID NO: 2707532 - RNA, 22 nt, Human parainfluenza virus 3
caaucagggacacaaacaaagc

SEQ ID NO: 2707533 - RNA, 15 nt, Human parainfluenza virus 3
gaaauaaauaaugag

SEQ ID NO: 2707534 - RNA, 14 nt, Human parainfluenza virus 3
auaagauaauauau

SEQ ID NO: 2707535 - RNA, 21 nt, Human parainfluenza virus 3
cagaacuccguccuuaauuau

SEQ ID NO: 2707536 - RNA, 16 nt, Human parainfluenza virus 3
ccauugauaacaacac

SEQ ID NO: 2707537 - RNA, 20 nt, Human parainfluenza virus 3
auauaucuuaaccuuuaucu

SEQ ID NO: 2707538 - RNA, 13 nt, Human parainfluenza virus 3
caacgacacaaaa

SEQ ID NO: 2707539 - RNA, 22 nt, Human parainfluenza virus 3
gaugaggauuugacaauuuaua

SEQ ID NO: 2707540 - RNA, 21 nt, Human parainfluenza virus 3
caaacacuaaacacaaugcca

SEQ ID NO: 2707541 - RNA, 18 nt, Human parainfluenza virus 3
aauuuauaugaaagauaa

SEQ ID NO: 2707542 - RNA, 22 nt, Human parainfluenza virus 3
gacagaaucaucaggaacacaa

SEQ ID NO: 2707543 - RNA, 20 nt, Human parainfluenza virus 3
cuauugaucaggaaacugua

SEQ ID NO: 2707544 - RNA, 20 nt, Human parainfluenza virus 3
uuacaacagaacaaaguaga

SEQ ID NO: 2707545 - RNA, 13 nt, Human parainfluenza virus 3
cuucuuacaauuc

SEQ ID NO: 2707546 - RNA, 18 nt, Human parainfluenza virus 3
acucuuugcaaaaaugac

SEQ ID NO: 2707547 - RNA, 14 nt, Human parainfluenza virus 3
agggcagaagaaaa

SEQ ID NO: 2707548 - RNA, 16 nt, Human parainfluenza virus 3
aaaaucaagcagaaug

SEQ ID NO: 2707549 - RNA, 15 nt, Human parainfluenza virus 3
aacaacaaaaccaaa

SEQ ID NO: 2707550 - RNA, 20 nt, Human parainfluenza virus 3
uaaagaaaauggaugaauca

SEQ ID NO: 2707551 - RNA, 15 nt, Human parainfluenza virus 3
auauuacaaaggcaa

SEQ ID NO: 2707552 - RNA, 20 nt, Human parainfluenza virus 3
uucaaaucuuaaaauuauga

SEQ ID NO: 2707553 - RNA, 20 nt, Human parainfluenza virus 3
aaagugagcaguacaaugag

SEQ ID NO: 2707554 - RNA, 15 nt, Human parainfluenza virus 3
auagucaaaugacug

SEQ ID NO: 2707555 - RNA, 15 nt, Human parainfluenza virus 3
uguacuaacaaacaa

SEQ ID NO: 2707556 - RNA, 22 nt, Human parainfluenza virus 3
cacucucagcuggauauacaac

SEQ ID NO: 2707557 - RNA, 20 nt, Human parainfluenza virus 3
cuacaaugauggauaugaga

SEQ ID NO: 2707558 - RNA, 17 nt, Human parainfluenza virus 3
ggaucauuacaagaaaa

SEQ ID NO: 2707559 - RNA, 15 nt, Human parainfluenza virus 3
aacaacagaucucaa

SEQ ID NO: 2707560 - RNA, 21 nt, Human parainfluenza virus 3
agaaaagguuagaaaauauau

SEQ ID NO: 2707561 - RNA, 21 nt, Human parainfluenza virus 3
caacucccaaaguugaugaaa

SEQ ID NO: 2707562 - RNA, 21 nt, Human parainfluenza virus 3
ucaaaagauacugacaaccag

SEQ ID NO: 2707563 - RNA, 12 nt, Human parainfluenza virus 3
uuaagaaaucaa

SEQ ID NO: 2707564 - RNA, 22 nt, Human parainfluenza virus 3
aauuacucuauugcagaaucuu

SEQ ID NO: 2707565 - RNA, 16 nt, Human parainfluenza virus 3
gaaauacuaaugaaaa

SEQ ID NO: 2707566 - RNA, 16 nt, Human parainfluenza virus 3
acaagaaaaaggaaua

SEQ ID NO: 2707567 - RNA, 13 nt, Human parainfluenza virus 3
auagauaucacaa

SEQ ID NO: 2707568 - RNA, 12 nt, Human parainfluenza virus 3
cuacuugcaaau

SEQ ID NO: 2707569 - RNA, 19 nt, Human parainfluenza virus 3
ccaaugauccaacaaagaa

SEQ ID NO: 2707570 - RNA, 13 nt, Human parainfluenza virus 3
auuaaagaauaaa

SEQ ID NO: 2707571 - RNA, 18 nt, Human parainfluenza virus 3
ccugaucuauaucgacau

SEQ ID NO: 2707572 - RNA, 20 nt, Human parainfluenza virus 3
acaauggaacuaauaaucuc

SEQ ID NO: 2707573 - RNA, 23 nt, Human parainfluenza virus 3
gagaaaagacauuugaugugaua

SEQ ID NO: 2707574 - RNA, 21 nt, Human parainfluenza virus 3
auauggaugacgacucaauac

SEQ ID NO: 2707575 - RNA, 14 nt, Human parainfluenza virus 3
ggaucuuaggaaau

SEQ ID NO: 2707576 - RNA, 13 nt, Human parainfluenza virus 3
aaggauacagaag

SEQ ID NO: 2707577 - RNA, 16 nt, Human parainfluenza virus 3
auguacaacagaagca

SEQ ID NO: 2707578 - RNA, 14 nt, Human parainfluenza virus 3
caauuagaaaugau

SEQ ID NO: 2707579 - RNA, 17 nt, Human parainfluenza virus 3
acuaauaagauaauaua

SEQ ID NO: 2707580 - RNA, 15 nt, Human parainfluenza virus 3
aucaggaacacaauc

SEQ ID NO: 2707581 - RNA, 20 nt, Human parainfluenza virus 3
accagaugaugaagaagaaa

SEQ ID NO: 2707582 - RNA, 13 nt, Human parainfluenza virus 3
aagcagaaugaaa

SEQ ID NO: 2707583 - RNA, 18 nt, Human parainfluenza virus 3
ucacuagacagaaaauaa

SEQ ID NO: 2707584 - RNA, 18 nt, Human parainfluenza virus 3
auaguaggacaaagaaaa

SEQ ID NO: 2707585 - RNA, 16 nt, Human parainfluenza virus 3
ucaaagcgaaagagau

SEQ ID NO: 2707586 - RNA, 19 nt, Human parainfluenza virus 3
acacaaaaucaagcagaau

SEQ ID NO: 2707587 - RNA, 19 nt, Human parainfluenza virus 3
gcaaauaagggauaaucaa

SEQ ID NO: 2707588 - RNA, 16 nt, Human parainfluenza virus 3
caaaauauaaaaccag

SEQ ID NO: 2707589 - RNA, 19 nt, Human parainfluenza virus 3
ugaagaaguaucugaauua

SEQ ID NO: 2707590 - RNA, 16 nt, Human parainfluenza virus 3
uauaucuuaaccuuua

SEQ ID NO: 2707591 - RNA, 14 nt, Human parainfluenza virus 3
agagauugaauuac

SEQ ID NO: 2707592 - RNA, 19 nt, Human parainfluenza virus 3
ccaaauggauguauaacag

SEQ ID NO: 2707593 - RNA, 23 nt, Human parainfluenza virus 3
aucacauagaagauugauagaaa

SEQ ID NO: 2707594 - RNA, 22 nt, Human parainfluenza virus 3
auuguuuucauauaguagaaau

SEQ ID NO: 2707595 - RNA, 17 nt, Human parainfluenza virus 3
aagccgaagcaaauaag

SEQ ID NO: 2707596 - RNA, 14 nt, Human parainfluenza virus 3
gacaaaaaaagcaa

SEQ ID NO: 2707597 - RNA, 21 nt, Human parainfluenza virus 3
cagaacaccaaaacaacaaaa

SEQ ID NO: 2707598 - RNA, 17 nt, Human parainfluenza virus 3
aaucacccuccaaguca

SEQ ID NO: 2707599 - RNA, 22 nt, Human parainfluenza virus 3
gaaaauacacauuuaucagaua

SEQ ID NO: 2707600 - RNA, 19 nt, Human parainfluenza virus 3
uaggaucauuacaagaaaa

SEQ ID NO: 2707601 - RNA, 17 nt, Human parainfluenza virus 3
auaaggauaaaauggac

SEQ ID NO: 2707602 - RNA, 16 nt, Human parainfluenza virus 3
aagaacccaauagaca

SEQ ID NO: 2707603 - RNA, 16 nt, Human parainfluenza virus 3
agaaaaucaaagagaa

SEQ ID NO: 2707604 - RNA, 15 nt, Human parainfluenza virus 3
accaagcagaguucu

SEQ ID NO: 2707605 - RNA, 21 nt, Human parainfluenza virus 3
acgacaccgaacaaacagaca

SEQ ID NO: 2707606 - RNA, 14 nt, Human parainfluenza virus 3
cuuuaucuuugagc

SEQ ID NO: 2707607 - RNA, 16 nt, Human parainfluenza virus 3
cauagaagauauugua

SEQ ID NO: 2707608 - RNA, 16 nt, Human parainfluenza virus 3
ucaaaucaaaaacuag

SEQ ID NO: 2707609 - RNA, 18 nt, Human parainfluenza virus 3
aaagauauaucuuaaccu

SEQ ID NO: 2707610 - RNA, 18 nt, Human parainfluenza virus 3
uagaagugagaagaacag

SEQ ID NO: 2707611 - RNA, 19 nt, Human parainfluenza virus 3
aaaguaagaaaaacaugua

SEQ ID NO: 2707612 - RNA, 14 nt, Human parainfluenza virus 3
aaguguacaauaau

SEQ ID NO: 2707613 - RNA, 11 nt, Human parainfluenza virus 3
acaaacacaac

SEQ ID NO: 2707614 - RNA, 21 nt, Human parainfluenza virus 3
caagaaagaagggacaaaaaa

SEQ ID NO: 2707615 - RNA, 20 nt, Human parainfluenza virus 3
aauaggagaaaucaaaacaa

SEQ ID NO: 2707616 - RNA, 15 nt, Human parainfluenza virus 3
aucuuaaccuuuauc

SEQ ID NO: 2707617 - RNA, 16 nt, Human parainfluenza virus 3
uaaccuuuaucuuuga

SEQ ID NO: 2707618 - RNA, 17 nt, Human parainfluenza virus 3
auuaauaauauaucaaa

SEQ ID NO: 2707619 - RNA, 15 nt, Human parainfluenza virus 3
gacaaaaaguaagaa

SEQ ID NO: 2707620 - RNA, 20 nt, Human parainfluenza virus 3
caagaaagaagggacaaaaa

SEQ ID NO: 2707621 - RNA, 20 nt, Human parainfluenza virus 3
ucaauauacaaauaagaaaa

SEQ ID NO: 2707622 - RNA, 17 nt, Human parainfluenza virus 3
auuaacaguaaagugac

SEQ ID NO: 2707623 - RNA, 21 nt, Human parainfluenza virus 3
caccagaugaugaagaagaaa

SEQ ID NO: 2707624 - RNA, 22 nt, Human parainfluenza virus 3
aaagcgugcucggaaaauggac

SEQ ID NO: 2707625 - RNA, 23 nt, Human parainfluenza virus 3
aaaauuaacacagauacaaaaug

SEQ ID NO: 2707626 - RNA, 18 nt, Human parainfluenza virus 3
acaagacuaauacccaaa

SEQ ID NO: 2707627 - RNA, 15 nt, Human parainfluenza virus 3
cacaaaacuacagca

SEQ ID NO: 2707628 - RNA, 17 nt, Human parainfluenza virus 3
aagaggucaacaccaac

SEQ ID NO: 2707629 - RNA, 15 nt, Human parainfluenza virus 3
caccaaaacaacaaa

SEQ ID NO: 2707630 - RNA, 22 nt, Human parainfluenza virus 3
aagcaaaauaggagaaaucaaa

SEQ ID NO: 2707631 - RNA, 18 nt, Human parainfluenza virus 3
uuagaagauuaaaauuaa

SEQ ID NO: 2707632 - RNA, 18 nt, Human parainfluenza virus 3
cuuuaucuuugagcccaa

SEQ ID NO: 2707633 - RNA, 12 nt, Human parainfluenza virus 3
gcaaaauaauau

SEQ ID NO: 2707634 - RNA, 15 nt, Human parainfluenza virus 3
ccaaggauagacaaa

SEQ ID NO: 2707635 - RNA, 22 nt, Human parainfluenza virus 3
uacugacaaccagauaccaaca

SEQ ID NO: 2707636 - RNA, 18 nt, Human parainfluenza virus 3
agauaaacaaaacuauaa

SEQ ID NO: 2707637 - RNA, 12 nt, Human parainfluenza virus 3
aucaaagagaac

SEQ ID NO: 2707638 - RNA, 15 nt, Human parainfluenza virus 3
agaagggacaaaaaa

SEQ ID NO: 2707639 - RNA, 23 nt, Human parainfluenza virus 3
ugauauaaggauaaaauggacau

SEQ ID NO: 2707640 - RNA, 14 nt, Human parainfluenza virus 3
ucauacuuucaaca

SEQ ID NO: 2707641 - RNA, 14 nt, Human parainfluenza virus 3
aggaauaauugaua

SEQ ID NO: 2707642 - RNA, 20 nt, Human parainfluenza virus 3
gccucauaccaaaaauagaa

SEQ ID NO: 2707643 - RNA, 16 nt, Human parainfluenza virus 3
aaucucucacaaagca

SEQ ID NO: 2707644 - RNA, 13 nt, Human parainfluenza virus 3
acaauaauaauua

SEQ ID NO: 2707645 - RNA, 11 nt, Human parainfluenza virus 3
auccaaaauua

SEQ ID NO: 2707646 - RNA, 19 nt, Human parainfluenza virus 3
agaaaaacauguaauauau

SEQ ID NO: 2707647 - RNA, 14 nt, Human parainfluenza virus 3
agacaaaaaguaag

SEQ ID NO: 2707648 - RNA, 18 nt, Human parainfluenza virus 3
aggaaauacacuagagaa

SEQ ID NO: 2707649 - RNA, 17 nt, Human parainfluenza virus 3
ucuaucaacacacacaa

SEQ ID NO: 2707650 - RNA, 14 nt, Human parainfluenza virus 3
uauaucuuaaccuu

SEQ ID NO: 2707651 - RNA, 19 nt, Human parainfluenza virus 3
auuaacaguaaagugacug

SEQ ID NO: 2707652 - RNA, 15 nt, Human parainfluenza virus 3
cagccuuaugauaug

SEQ ID NO: 2707653 - RNA, 20 nt, Human parainfluenza virus 3
acuuauaaaucagauaaaug

SEQ ID NO: 2707654 - RNA, 18 nt, Human parainfluenza virus 3
gauaaaugguauaaucca

SEQ ID NO: 2707655 - RNA, 20 nt, Human parainfluenza virus 3
agaggucaacaccaacaacu

SEQ ID NO: 2707656 - RNA, 14 nt, Human parainfluenza virus 3
uauaccaagcagag

SEQ ID NO: 2707657 - RNA, 22 nt, Human parainfluenza virus 3
auacuuucaacauaaaugacaa

SEQ ID NO: 2707658 - RNA, 16 nt, Human parainfluenza virus 3
gcaaucucucacaaag

SEQ ID NO: 2707659 - RNA, 15 nt, Human parainfluenza virus 3
agcaacugaaagagu

SEQ ID NO: 2707660 - RNA, 13 nt, Human parainfluenza virus 3
accaaaaauagaa

SEQ ID NO: 2707661 - RNA, 17 nt, Human parainfluenza virus 3
gauagacaaaaaguaag

SEQ ID NO: 2707662 - RNA, 16 nt, Human parainfluenza virus 3
agggauugacaagaau

SEQ ID NO: 2707663 - RNA, 23 nt, Human parainfluenza virus 3
gagaauguaaucugcaacacaac

SEQ ID NO: 2707664 - RNA, 15 nt, Human parainfluenza virus 3
aauuacaauuagaaa

SEQ ID NO: 2707665 - RNA, 20 nt, Human parainfluenza virus 3
auuacaagguauagcaucau

SEQ ID NO: 2707666 - RNA, 16 nt, Human parainfluenza virus 3
auaacuuguuagaaga

SEQ ID NO: 2707667 - RNA, 18 nt, Human parainfluenza virus 3
auauuauggacaauaauc

SEQ ID NO: 2707668 - RNA, 14 nt, Human parainfluenza virus 3
gaggaaagaaagac

SEQ ID NO: 2707669 - RNA, 23 nt, Human parainfluenza virus 3
aucucaaaaacaacaaccaucaa

SEQ ID NO: 2707670 - RNA, 19 nt, Human parainfluenza virus 3
caagaucuauauauauaca

SEQ ID NO: 2707671 - RNA, 20 nt, Human parainfluenza virus 3
cugauacaagaucaauaagu

SEQ ID NO: 2707672 - RNA, 21 nt, Human parainfluenza virus 3
ucgaaccgaacagacaaacac

SEQ ID NO: 2707673 - RNA, 19 nt, Human parainfluenza virus 3
gcaaaauaggagaaaucaa

SEQ ID NO: 2707674 - RNA, 22 nt, Human parainfluenza virus 3
auuaacacagauacaaaaugaa

SEQ ID NO: 2707675 - RNA, 19 nt, Human parainfluenza virus 3
ugagaagaacagucaaagc

SEQ ID NO: 2707676 - RNA, 19 nt, Human parainfluenza virus 3
gacaaaaaguaagaaaaac

SEQ ID NO: 2707677 - RNA, 19 nt, Human parainfluenza virus 3
acaacuuauaaaucagaua

SEQ ID NO: 2707678 - RNA, 18 nt, Human parainfluenza virus 3
agaaaaucgagaaaauga

SEQ ID NO: 2707679 - RNA, 16 nt, Human parainfluenza virus 3
uuaaagaauaaauuaa

SEQ ID NO: 2707680 - RNA, 17 nt, Human parainfluenza virus 3
gaaucaauccgaacaaa

SEQ ID NO: 2707681 - RNA, 16 nt, Human parainfluenza virus 3
aaagggcagaagaaaa

SEQ ID NO: 2707682 - RNA, 14 nt, Human parainfluenza virus 3
aaauaucacagaaa

SEQ ID NO: 2707683 - RNA, 19 nt, Human parainfluenza virus 3
gaccaacagaucaagcaau

SEQ ID NO: 2707684 - RNA, 15 nt, Human parainfluenza virus 3
aaugacuuaggaaaa

SEQ ID NO: 2707685 - RNA, 16 nt, Human parainfluenza virus 3
uuaauaauaaauaaga

SEQ ID NO: 2707686 - RNA, 19 nt, Human parainfluenza virus 3
aucuaauaguagcaaucaa

SEQ ID NO: 2707687 - RNA, 18 nt, Human parainfluenza virus 3
augauaugagaagauuac

SEQ ID NO: 2707688 - RNA, 16 nt, Human parainfluenza virus 3
agaucaagaaaacuag

SEQ ID NO: 2707689 - RNA, 14 nt, Human parainfluenza virus 3
aaugacuuaggaaa

SEQ ID NO: 2707690 - RNA, 16 nt, Human parainfluenza virus 3
acugcugcaacaccag

SEQ ID NO: 2707691 - RNA, 19 nt, Human parainfluenza virus 3
acagagaggaccugggaga

SEQ ID NO: 2707692 - RNA, 14 nt, Human parainfluenza virus 3
uacaaaagaaucaa

SEQ ID NO: 2707693 - RNA, 22 nt, Human parainfluenza virus 3
agggauugacaagaauauaccu

SEQ ID NO: 2707694 - RNA, 22 nt, Human parainfluenza virus 3
acuaacucugcaauauacacau

SEQ ID NO: 2707695 - RNA, 23 nt, Human parainfluenza virus 3
gcauccauuaagccgaagcaaau

SEQ ID NO: 2707696 - RNA, 23 nt, Human parainfluenza virus 3
aaucccagguucucucauacuuu

SEQ ID NO: 2707697 - RNA, 21 nt, Human parainfluenza virus 3
gacacaaaggggcaaacagaa

SEQ ID NO: 2707698 - RNA, 15 nt, Human parainfluenza virus 3
agaaauaaauaauga

SEQ ID NO: 2707699 - RNA, 19 nt, Human parainfluenza virus 3
augaguuuauggagauuac

SEQ ID NO: 2707700 - RNA, 16 nt, Human parainfluenza virus 3
ucaaaaacaacaacca

SEQ ID NO: 2707701 - RNA, 22 nt, Human parainfluenza virus 3
aaccuuuaucuuugagcccaag

SEQ ID NO: 2707702 - RNA, 19 nt, Human parainfluenza virus 3
ggauuaguuggaggaauca

SEQ ID NO: 2707703 - RNA, 16 nt, Human parainfluenza virus 3
ccaagacacaaaagac

SEQ ID NO: 2707704 - RNA, 20 nt, Human parainfluenza virus 3
ugaaugacuuaggaaaauac

SEQ ID NO: 2707705 - RNA, 16 nt, Human parainfluenza virus 3
aaauacagacagaauc

SEQ ID NO: 2707706 - RNA, 21 nt, Human parainfluenza virus 3
aggaaaauucuuucaagagaa

SEQ ID NO: 2707707 - RNA, 13 nt, Human parainfluenza virus 3
acagacaagaaac

SEQ ID NO: 2707708 - RNA, 16 nt, Human parainfluenza virus 3
agaucacuuuuaaugu

SEQ ID NO: 2707709 - RNA, 19 nt, Human parainfluenza virus 3
ggacauguucaaugaagau

SEQ ID NO: 2707710 - RNA, 17 nt, Human parainfluenza virus 3
agaugaugaagaagaaa

SEQ ID NO: 2707711 - RNA, 17 nt, Human parainfluenza virus 3
gauugauagaaaaucaa

SEQ ID NO: 2707712 - RNA, 16 nt, Human parainfluenza virus 3
ucagggacacaaacaa

SEQ ID NO: 2707713 - RNA, 20 nt, Human parainfluenza virus 3
cugcagguacauaucaaaac

SEQ ID NO: 2707714 - RNA, 15 nt, Human parainfluenza virus 3
cugccaaauagauau

SEQ ID NO: 2707715 - RNA, 14 nt, Human parainfluenza virus 3
accacucaaaguca

SEQ ID NO: 2707716 - RNA, 17 nt, Human parainfluenza virus 3
aggaaacuguacagaga

SEQ ID NO: 2707717 - RNA, 17 nt, Human parainfluenza virus 3
uuaucuuugagcccaag

SEQ ID NO: 2707718 - RNA, 19 nt, Human parainfluenza virus 3
ucaggaaacuguacagaga

SEQ ID NO: 2707719 - RNA, 13 nt, Human parainfluenza virus 3
acuuaggaaaaua

SEQ ID NO: 2707720 - RNA, 23 nt, Human parainfluenza virus 3
auggaaagcgaugcuaaaaacua

SEQ ID NO: 2707721 - RNA, 21 nt, Human parainfluenza virus 3
gacagugacccgaguuacaaa

SEQ ID NO: 2707722 - RNA, 11 nt, Human parainfluenza virus 3
agcccaaggau

SEQ ID NO: 2707723 - RNA, 13 nt, Human parainfluenza virus 3
uaggagaaaucaa

SEQ ID NO: 2707724 - RNA, 14 nt, Human parainfluenza virus 3
auaccaacaucaga

SEQ ID NO: 2707725 - RNA, 17 nt, Human parainfluenza virus 3
gauacuauccuaauauu

SEQ ID NO: 2707726 - RNA, 18 nt, Human parainfluenza virus 3
acuuucaacauaaaugac

SEQ ID NO: 2707727 - RNA, 12 nt, Human parainfluenza virus 3
aucuaaagaaaa

SEQ ID NO: 2707728 - RNA, 17 nt, Human parainfluenza virus 3
aaacaaaaaguacagaa

SEQ ID NO: 2707729 - RNA, 18 nt, Human parainfluenza virus 3
gcagaguucuucucuugu

SEQ ID NO: 2707730 - RNA, 18 nt, Human parainfluenza virus 3
aagaucuauauauauaca

SEQ ID NO: 2707731 - RNA, 18 nt, Human parainfluenza virus 3
cgaaauggaauugauauu

SEQ ID NO: 2707732 - RNA, 17 nt, Human parainfluenza virus 3
auccaugaucaaaacaa

SEQ ID NO: 2707733 - RNA, 19 nt, Human parainfluenza virus 3
aaugagagaguauccauga

SEQ ID NO: 2707734 - RNA, 23 nt, Human parainfluenza virus 3
guucacacaacuuauaaaucaga

SEQ ID NO: 2707735 - RNA, 21 nt, Human parainfluenza virus 3
ugagcuguuuccuaacaacag

SEQ ID NO: 2707736 - RNA, 19 nt, Human parainfluenza virus 3
cauguaauauauauauacc

SEQ ID NO: 2707737 - RNA, 22 nt, Human parainfluenza virus 3
auggagacacaagggauugaca

SEQ ID NO: 2707738 - RNA, 22 nt, Human parainfluenza virus 3
agcuguuuccuaacaacagauc

SEQ ID NO: 2707739 - RNA, 13 nt, Human parainfluenza virus 3
cauacaaugaauc

SEQ ID NO: 2707740 - RNA, 16 nt, Human parainfluenza virus 3
acgugcuaucaaaauu

SEQ ID NO: 2707741 - RNA, 21 nt, Human parainfluenza virus 3
ugagaagaacagucaaagcga

SEQ ID NO: 2707742 - RNA, 19 nt, Human parainfluenza virus 3
gacaccgaacaaacagaca

SEQ ID NO: 2707743 - RNA, 15 nt, Human parainfluenza virus 3
aacuuauacaaaaga

SEQ ID NO: 2707744 - RNA, 15 nt, Human parainfluenza virus 3
acaaaauugaaagaa

SEQ ID NO: 2707745 - RNA, 15 nt, Human parainfluenza virus 3
caaaacuauaauggu

SEQ ID NO: 2707746 - RNA, 16 nt, Human parainfluenza virus 3
gaacagacaaacacaa

SEQ ID NO: 2707747 - RNA, 13 nt, Human parainfluenza virus 3
aacaaaguagaaa

SEQ ID NO: 2707748 - RNA, 16 nt, Human parainfluenza virus 3
gacauacaaaaugaga

SEQ ID NO: 2707749 - RNA, 20 nt, Human parainfluenza virus 3
uggagaaucgauuagggaau

SEQ ID NO: 2707750 - RNA, 21 nt, Human parainfluenza virus 3
aaaacuuaggauuaaagaaua

SEQ ID NO: 2707751 - RNA, 19 nt, Human parainfluenza virus 3
aaagcgugcucggaaaaug

SEQ ID NO: 2707752 - RNA, 15 nt, Human parainfluenza virus 3
acauaucaaaacagg

SEQ ID NO: 2707753 - RNA, 16 nt, Human parainfluenza virus 3
caaaagggcagaagaa

SEQ ID NO: 2707754 - RNA, 22 nt, Human parainfluenza virus 3
aaacgaguuguauguguagcaa

SEQ ID NO: 2707755 - RNA, 18 nt, Human parainfluenza virus 3
caaugagagaguauccau

SEQ ID NO: 2707756 - RNA, 18 nt, Human parainfluenza virus 3
aaacuuaggauuaaagaa

SEQ ID NO: 2707757 - RNA, 17 nt, Human parainfluenza virus 3
augaucaaaacaaaauu

SEQ ID NO: 2707758 - RNA, 14 nt, Human parainfluenza virus 3
caauaucaaucaau

SEQ ID NO: 2707759 - RNA, 16 nt, Human parainfluenza virus 3
uucaacauaaaugaca

SEQ ID NO: 2707760 - RNA, 21 nt, Human parainfluenza virus 3
accauuaccacucaaagucaa

SEQ ID NO: 2707761 - RNA, 14 nt, Human parainfluenza virus 3
auauauauauacca

SEQ ID NO: 2707762 - RNA, 18 nt, Human parainfluenza virus 3
gcuucaucaguagagauu

SEQ ID NO: 2707763 - RNA, 23 nt, Human parainfluenza virus 3
acagaaaauaaaacucaauaaau

SEQ ID NO: 2707764 - RNA, 13 nt, Human parainfluenza virus 3
caaauuacaauua

SEQ ID NO: 2707765 - RNA, 20 nt, Human parainfluenza virus 3
aagagacuggcaacacagca

SEQ ID NO: 2707766 - RNA, 17 nt, Human parainfluenza virus 3
ucaggaauccaaugaaa

SEQ ID NO: 2707767 - RNA, 13 nt, Human parainfluenza virus 3
gaaaugauaauca

SEQ ID NO: 2707768 - RNA, 14 nt, Human parainfluenza virus 3
auuuacagaaucaa

SEQ ID NO: 2707769 - RNA, 16 nt, Human parainfluenza virus 3
aaagggauaguucaaa

SEQ ID NO: 2707770 - RNA, 16 nt, Human parainfluenza virus 3
aagauuacagaaagau

SEQ ID NO: 2707771 - RNA, 13 nt, Human parainfluenza virus 3
cgaugccaacaaa

SEQ ID NO: 2707772 - RNA, 23 nt, Human parainfluenza virus 3
uauuaaaaauaaaaaucccaaaa

SEQ ID NO: 2707773 - RNA, 18 nt, Human parainfluenza virus 3
gaaacucaaagaagcaau

SEQ ID NO: 2707774 - RNA, 19 nt, Human parainfluenza virus 3
agauacugcaucaaagaua

SEQ ID NO: 2707775 - RNA, 21 nt, Human parainfluenza virus 3
aucacacgaauguacaacaga

SEQ ID NO: 2707776 - RNA, 12 nt, Human parainfluenza virus 3
auuauaccagaa

SEQ ID NO: 2707777 - RNA, 19 nt, Human parainfluenza virus 3
caaaaucuaucaacacaca

SEQ ID NO: 2707778 - RNA, 20 nt, Human parainfluenza virus 3
uaucgacaugcaggaaauac

SEQ ID NO: 2707779 - RNA, 22 nt, Human parainfluenza virus 3
agccauauguacuaacaaacaa

SEQ ID NO: 2707780 - RNA, 16 nt, Human parainfluenza virus 3
guauaauccauucaaa

SEQ ID NO: 2707781 - RNA, 18 nt, Human parainfluenza virus 3
cauuagugaaauuacaau

SEQ ID NO: 2707782 - RNA, 16 nt, Human parainfluenza virus 3
auacuguaaacagaaa

SEQ ID NO: 2707783 - RNA, 22 nt, Human parainfluenza virus 3
uaucuuaaccuuuaucuuugag

SEQ ID NO: 2707784 - RNA, 12 nt, Human parainfluenza virus 3
gagcccaaggau

SEQ ID NO: 2707785 - RNA, 14 nt, Human parainfluenza virus 3
caaaaaaagcaaaa

SEQ ID NO: 2707786 - RNA, 23 nt, Human parainfluenza virus 3
aauaucauugacacaacagaugu

SEQ ID NO: 2707787 - RNA, 17 nt, Human parainfluenza virus 3
ucaaaaacaacaaccau

SEQ ID NO: 2707788 - RNA, 15 nt, Human parainfluenza virus 3
uaauaguagcaauca

SEQ ID NO: 2707789 - RNA, 23 nt, Human parainfluenza virus 3
uaauaacuguaaacucagacuug

SEQ ID NO: 2707790 - RNA, 19 nt, Human parainfluenza virus 3
auacaccaagaagaugaca

SEQ ID NO: 2707791 - RNA, 23 nt, Human parainfluenza virus 3
ucuaucaacacacacaaaaucaa

SEQ ID NO: 2707792 - RNA, 14 nt, Human parainfluenza virus 3
ugcaaguuaaauca

SEQ ID NO: 2707793 - RNA, 18 nt, Human parainfluenza virus 3
uacagaacaccaaaacaa

SEQ ID NO: 2707794 - RNA, 16 nt, Human parainfluenza virus 3
agaaagaccaaaauga

SEQ ID NO: 2707795 - RNA, 21 nt, Human parainfluenza virus 3
caaaaugacaagccauaugua

SEQ ID NO: 2707796 - RNA, 19 nt, Human parainfluenza virus 3
aaaauuaugacugagagag

SEQ ID NO: 2707797 - RNA, 13 nt, Human parainfluenza virus 3
cagacaagaaaca

SEQ ID NO: 2707798 - RNA, 15 nt, Human parainfluenza virus 3
aaauggaaaggaaag

SEQ ID NO: 2707799 - RNA, 19 nt, Human parainfluenza virus 3
cugaucuauuaaaaauaaa

SEQ ID NO: 2707800 - RNA, 23 nt, Human parainfluenza virus 3
uaccaagcagaguucuucucuug

SEQ ID NO: 2707801 - RNA, 20 nt, Human parainfluenza virus 3
gaaagacugguuuaagaaau

SEQ ID NO: 2707802 - RNA, 19 nt, Human parainfluenza virus 3
acaccgaacaaacagacaa

SEQ ID NO: 2707803 - RNA, 18 nt, Human parainfluenza virus 3
acaaguuuuaucagagac

SEQ ID NO: 2707804 - RNA, 19 nt, Human parainfluenza virus 3
auggaacgaaucaaagaca

SEQ ID NO: 2707805 - RNA, 18 nt, Human parainfluenza virus 3
ucgaaauggaacgaauca

SEQ ID NO: 2707806 - RNA, 16 nt, Human parainfluenza virus 3
auccacaucaaaacua

SEQ ID NO: 2707807 - RNA, 17 nt, Human parainfluenza virus 3
agaucaagcaauacaag

SEQ ID NO: 2707808 - RNA, 12 nt, Human parainfluenza virus 3
gaugacaaaaga

SEQ ID NO: 2707809 - RNA, 17 nt, Human parainfluenza virus 3
agaaaaugagauugaua

SEQ ID NO: 2707810 - RNA, 20 nt, Human parainfluenza virus 3
gaucaacuuauacaaaagaa

SEQ ID NO: 2707811 - RNA, 14 nt, Human parainfluenza virus 3
auaucacaaaacua

SEQ ID NO: 2707812 - RNA, 17 nt, Human parainfluenza virus 3
agcagaugucaaagaau

SEQ ID NO: 2707813 - RNA, 21 nt, Human parainfluenza virus 3
uagcaaccucagcacaaauca

SEQ ID NO: 2707814 - RNA, 15 nt, Human parainfluenza virus 3
uaauaaauucauaga

SEQ ID NO: 2707815 - RNA, 21 nt, Human parainfluenza virus 3
ggauagacaaaaaguaagaaa

SEQ ID NO: 2707816 - RNA, 19 nt, Human parainfluenza virus 3
acacaaaggggcaaacaga

SEQ ID NO: 2707817 - RNA, 12 nt, Human parainfluenza virus 3
ugauaacaacac

SEQ ID NO: 2707818 - RNA, 19 nt, Human parainfluenza virus 3
aucagggacacaaacaaag

SEQ ID NO: 2707819 - RNA, 15 nt, Human parainfluenza virus 3
ugacaaaagaauuaa

SEQ ID NO: 2707820 - RNA, 18 nt, Human parainfluenza virus 3
acacaaaaucaagcagaa

SEQ ID NO: 2707821 - RNA, 14 nt, Human parainfluenza virus 3
gaauuaacaaacau

SEQ ID NO: 2707822 - RNA, 16 nt, Human parainfluenza virus 3
uuaccacucaaaguca

SEQ ID NO: 2707823 - RNA, 21 nt, Human parainfluenza virus 3
accaagaagaugacaaaagaa

SEQ ID NO: 2707824 - RNA, 14 nt, Human parainfluenza virus 3
aucaaaacaaaaag

SEQ ID NO: 2707825 - RNA, 18 nt, Human parainfluenza virus 3
auggcacuguaucugaca

SEQ ID NO: 2707826 - RNA, 17 nt, Human parainfluenza virus 3
gcaaucagggacacaaa

SEQ ID NO: 2707827 - RNA, 15 nt, Human parainfluenza virus 3
gcuaucaaaauuagc

SEQ ID NO: 2707828 - RNA, 15 nt, Human parainfluenza virus 3
cagaauuaacaaaca

SEQ ID NO: 2707829 - RNA, 21 nt, Human parainfluenza virus 3
cauguguuauccgaaauggaa

SEQ ID NO: 2707830 - RNA, 23 nt, Human parainfluenza virus 3
caaggauagacaaaaaguaagaa

SEQ ID NO: 2707831 - RNA, 23 nt, Human parainfluenza virus 3
aucaaaccaacagaaacaaguga

SEQ ID NO: 2707832 - RNA, 21 nt, Human parainfluenza virus 3
uacagaacaccaaaacaacaa

SEQ ID NO: 2707833 - RNA, 14 nt, Human parainfluenza virus 3
uccacaucaaaagg

SEQ ID NO: 2707834 - RNA, 18 nt, Human parainfluenza virus 3
uaggagaaaucaaaacaa

SEQ ID NO: 2707835 - RNA, 13 nt, Human parainfluenza virus 3
aaccuuuaucuuu

SEQ ID NO: 2707836 - RNA, 19 nt, Human parainfluenza virus 3
agaucgaaccgaacagaca

SEQ ID NO: 2707837 - RNA, 19 nt, Human parainfluenza virus 3
aaugacauacaaaaugaga

SEQ ID NO: 2707838 - RNA, 14 nt, Human parainfluenza virus 3
acuguaaacagaaa

SEQ ID NO: 2707839 - RNA, 22 nt, Human parainfluenza virus 3
aucacagcggcgguugcucugg

SEQ ID NO: 2707840 - RNA, 14 nt, Human parainfluenza virus 3
gaacaagaaagaag

SEQ ID NO: 2707841 - RNA, 19 nt, Human parainfluenza virus 3
caauggacaacgacacaaa

SEQ ID NO: 2707842 - RNA, 13 nt, Human parainfluenza virus 3
agaaucaauaaag

SEQ ID NO: 2707843 - RNA, 22 nt, Human parainfluenza virus 3
aucugauuuaugcuuauaccuc

SEQ ID NO: 2707844 - RNA, 16 nt, Human parainfluenza virus 3
acaauuagaaaugaua

SEQ ID NO: 2707845 - RNA, 12 nt, Human parainfluenza virus 3
uguauaacagga

SEQ ID NO: 2707846 - RNA, 13 nt, Human parainfluenza virus 3
gacacaacagaug

SEQ ID NO: 2707847 - RNA, 20 nt, Human parainfluenza virus 3
agcgugcucggaaaauggac

SEQ ID NO: 2707848 - RNA, 14 nt, Human parainfluenza virus 3
aauuaggaauaauu

SEQ ID NO: 2707849 - RNA, 13 nt, Human parainfluenza virus 3
guuaagauuacag

SEQ ID NO: 2707850 - RNA, 17 nt, Human parainfluenza virus 3
gauaaauaugauaucua

SEQ ID NO: 2707851 - RNA, 22 nt, Human parainfluenza virus 3
gcagucauacucgcaggaacaa

SEQ ID NO: 2707852 - RNA, 23 nt, Human parainfluenza virus 3
aagaaacgacaccgaacaaacag

SEQ ID NO: 2707853 - RNA, 23 nt, Human parainfluenza virus 3
aaauugaaagaagaaaagaucaa

SEQ ID NO: 2707854 - RNA, 13 nt, Human parainfluenza virus 3
cuuccaaucagaa

SEQ ID NO: 2707855 - RNA, 22 nt, Human parainfluenza virus 3
agaccuaucggaaaacgacaca

SEQ ID NO: 2707856 - RNA, 15 nt, Human parainfluenza virus 3
cagaaauacagacag

SEQ ID NO: 2707857 - RNA, 23 nt, Human parainfluenza virus 3
agauauuaaguucauacaaugaa

SEQ ID NO: 2707858 - RNA, 12 nt, Human parainfluenza virus 3
cucaaaaacaac

SEQ ID NO: 2707859 - RNA, 16 nt, Human parainfluenza virus 3
agacaaaaaguaagaa

SEQ ID NO: 2707860 - RNA, 14 nt, Human parainfluenza virus 3
auauccagaaaugu

SEQ ID NO: 2707861 - RNA, 12 nt, Human parainfluenza virus 3
cagcaaucagac

SEQ ID NO: 2707862 - RNA, 15 nt, Human parainfluenza virus 3
caaacacuaaacaca

SEQ ID NO: 2707863 - RNA, 14 nt, Human parainfluenza virus 3
auuacugauuacag

SEQ ID NO: 2707864 - RNA, 17 nt, Human parainfluenza virus 3
ggccaucagaaacagaa

SEQ ID NO: 2707865 - RNA, 19 nt, Human parainfluenza virus 3
acacagauacaaaaugaaa

SEQ ID NO: 2707866 - RNA, 12 nt, Human parainfluenza virus 3
gagauaaaucaa

SEQ ID NO: 2707867 - RNA, 21 nt, Human parainfluenza virus 3
uuaaguucauacaaugaauca

SEQ ID NO: 2707868 - RNA, 22 nt, Human parainfluenza virus 3
ggauagacaaaaaguaagaaaa

SEQ ID NO: 2707869 - RNA, 14 nt, Human parainfluenza virus 3
cccaaggauagaca

SEQ ID NO: 2707870 - RNA, 14 nt, Human parainfluenza virus 3
uagauaucaaucaa

SEQ ID NO: 2707871 - RNA, 16 nt, Human parainfluenza virus 3
aagacacaaaagacaa

SEQ ID NO: 2707872 - RNA, 18 nt, Human parainfluenza virus 3
uauccacuaaaucccaca

SEQ ID NO: 2707873 - RNA, 20 nt, Human parainfluenza virus 3
uugaacauccaauaaaugag

SEQ ID NO: 2707874 - RNA, 12 nt, Human parainfluenza virus 3
auuccaaaauua

SEQ ID NO: 2707875 - RNA, 14 nt, Human parainfluenza virus 3
aucaaaaucuauca

SEQ ID NO: 2707876 - RNA, 23 nt, Human parainfluenza virus 3
ucaagaagugccgcaacaaagaa

SEQ ID NO: 2707877 - RNA, 22 nt, Human parainfluenza virus 3
uuacaaaaagcucgaaaugaga

SEQ ID NO: 2707878 - RNA, 14 nt, Human parainfluenza virus 3
ucaacuuauacaaa

SEQ ID NO: 2707879 - RNA, 20 nt, Human parainfluenza virus 3
ggaucaacuuauacaaaaga

SEQ ID NO: 2707880 - RNA, 23 nt, Human parainfluenza virus 3
gaaaagcaguaccccacauuaga

SEQ ID NO: 2707881 - RNA, 16 nt, Human parainfluenza virus 3
gacacaaaagacaaau

SEQ ID NO: 2707882 - RNA, 19 nt, Human parainfluenza virus 3
aaaguugaugaaagaucag

SEQ ID NO: 2707883 - RNA, 18 nt, Human parainfluenza virus 3
gcaaauaagggauaauca

SEQ ID NO: 2707884 - RNA, 22 nt, Human parainfluenza virus 3
uaagggauaaucaaaaacuuag

SEQ ID NO: 2707885 - RNA, 14 nt, Human parainfluenza virus 3
aucagauaaauggu

SEQ ID NO: 2707886 - RNA, 21 nt, Human parainfluenza virus 3
agcacuccuaaauacagaugu

SEQ ID NO: 2707887 - RNA, 14 nt, Human parainfluenza virus 3
cacaaaucacagcg

SEQ ID NO: 2707888 - RNA, 21 nt, Human parainfluenza virus 3
auagauaucaaucaauauaca

SEQ ID NO: 2707889 - RNA, 23 nt, Human parainfluenza virus 3
uacucauacaauugagaaagaac

SEQ ID NO: 2707890 - RNA, 20 nt, Human parainfluenza virus 3
agaaucuugguguaauucaa

SEQ ID NO: 2707891 - RNA, 15 nt, Human parainfluenza virus 3
acgaaucaaagacaa

SEQ ID NO: 2707892 - RNA, 17 nt, Human parainfluenza virus 3
gugaaauuacaauuaga

SEQ ID NO: 2707893 - RNA, 15 nt, Human parainfluenza virus 3
acuaaugaaaaauag

SEQ ID NO: 2707894 - RNA, 15 nt, Human parainfluenza virus 3
uagcaaucaaaucag

SEQ ID NO: 2707895 - RNA, 19 nt, Human parainfluenza virus 3
acacacaaaaucaagcaga

SEQ ID NO: 2707896 - RNA, 17 nt, Human parainfluenza virus 3
accaucuaucaaccaaa

SEQ ID NO: 2707897 - RNA, 17 nt, Human parainfluenza virus 3
cauacuuucaacauaaa

SEQ ID NO: 2707898 - RNA, 13 nt, Human parainfluenza virus 3
acucaaagucaau

SEQ ID NO: 2707899 - RNA, 22 nt, Human parainfluenza virus 3
caacagcaacugaaagaguaaa

SEQ ID NO: 2707900 - RNA, 19 nt, Human parainfluenza virus 3
cuggauccauaucaaaaac

SEQ ID NO: 2707901 - RNA, 12 nt, Human parainfluenza virus 3
auaccaagcaga

SEQ ID NO: 2707902 - RNA, 13 nt, Human parainfluenza virus 3
ucaagacaaacga

SEQ ID NO: 2707903 - RNA, 20 nt, Human parainfluenza virus 3
caaucagggacacaaacaaa

SEQ ID NO: 2707904 - RNA, 16 nt, Human parainfluenza virus 3
acagauacaaaaugaa

SEQ ID NO: 2707905 - RNA, 17 nt, Human parainfluenza virus 3
auacaaauaagaaaaac

SEQ ID NO: 2707906 - RNA, 16 nt, Human parainfluenza virus 3
aucaacuuauacaaaa

SEQ ID NO: 2707907 - RNA, 13 nt, Human parainfluenza virus 3
ugacaagaauaua

SEQ ID NO: 2707908 - RNA, 15 nt, Human parainfluenza virus 3
aauaaaacucaauaa

SEQ ID NO: 2707909 - RNA, 14 nt, Human parainfluenza virus 3
gucaaucauaauua

SEQ ID NO: 2707910 - RNA, 12 nt, Human parainfluenza virus 3
aagucaaaucaa

SEQ ID NO: 2707911 - RNA, 21 nt, Human parainfluenza virus 3
aucaacugacaaaaauagaca

SEQ ID NO: 2707912 - RNA, 18 nt, Human parainfluenza virus 3
agcagaucuaaagaaaau

SEQ ID NO: 2707913 - RNA, 18 nt, Human parainfluenza virus 3
cagaacaaaguagaaaca

SEQ ID NO: 2707914 - RNA, 16 nt, Human parainfluenza virus 3
aucugcaacacaacug

SEQ ID NO: 2707915 - RNA, 18 nt, Human parainfluenza virus 3
agcaaucagggacacaaa

SEQ ID NO: 2707916 - RNA, 15 nt, Human parainfluenza virus 3
gcagaguucuucucu

SEQ ID NO: 2707917 - RNA, 14 nt, Human parainfluenza virus 3
aucgagaaaaugag

SEQ ID NO: 2707918 - RNA, 14 nt, Human parainfluenza virus 3
caaaggauauuguu

SEQ ID NO: 2707919 - RNA, 13 nt, Human parainfluenza virus 3
ugacuuaggaaaa

SEQ ID NO: 2707920 - RNA, 14 nt, Human parainfluenza virus 3
cuggacauagaagu

SEQ ID NO: 2707921 - RNA, 16 nt, Human parainfluenza virus 3
aaucaaagagaacaac

SEQ ID NO: 2707922 - RNA, 13 nt, Human parainfluenza virus 3
uacagaacaccaa

SEQ ID NO: 2707923 - RNA, 17 nt, Human parainfluenza virus 3
caaucagggacacaaac

SEQ ID NO: 2707924 - RNA, 19 nt, Human parainfluenza virus 3
agauacugacaaccagaua

SEQ ID NO: 2707925 - RNA, 17 nt, Human parainfluenza virus 3
agccucaaaaaaugaug

SEQ ID NO: 2707926 - RNA, 19 nt, Human parainfluenza virus 3
ucagcaaucagacaaugga

SEQ ID NO: 2707927 - RNA, 13 nt, Human parainfluenza virus 3
gacaccgaacaaa

SEQ ID NO: 2707928 - RNA, 18 nt, Human parainfluenza virus 3
auccaaaaugaguauaac

SEQ ID NO: 2707929 - RNA, 15 nt, Human parainfluenza virus 3
acaaauaucacagaa

SEQ ID NO: 2707930 - RNA, 17 nt, Human parainfluenza virus 3
uaagaaaucaaaagaua

SEQ ID NO: 2707931 - RNA, 14 nt, Human parainfluenza virus 3
ugacaauaggaagu

SEQ ID NO: 2707932 - RNA, 12 nt, Human parainfluenza virus 3
cugcaacaccag

SEQ ID NO: 2707933 - RNA, 13 nt, Human parainfluenza virus 3
uaggacaaaagag

SEQ ID NO: 2707934 - RNA, 15 nt, Human parainfluenza virus 3
gaaucacauagaaga

SEQ ID NO: 2707935 - RNA, 19 nt, Human parainfluenza virus 3
agaaagaccaaaaugaauc

SEQ ID NO: 2707936 - RNA, 16 nt, Human parainfluenza virus 3
ccaaugauccaacaaa

SEQ ID NO: 2707937 - RNA, 14 nt, Human parainfluenza virus 3
uuacaaccauaauu

SEQ ID NO: 2707938 - RNA, 16 nt, Human parainfluenza virus 3
cuaauaguagcaauca

SEQ ID NO: 2707939 - RNA, 17 nt, Human parainfluenza virus 3
ucagggacacaaacaaa

SEQ ID NO: 2707940 - RNA, 15 nt, Human parainfluenza virus 3
gauaagaaagucaaa

SEQ ID NO: 2707941 - RNA, 13 nt, Human parainfluenza virus 3
cacuagacagaaa

SEQ ID NO: 2707942 - RNA, 15 nt, Human parainfluenza virus 3
acaauuagaaaugau

SEQ ID NO: 2707943 - RNA, 13 nt, Human parainfluenza virus 3
ccaugaucaaaac

SEQ ID NO: 2707944 - RNA, 22 nt, Human parainfluenza virus 3
gaaaacacuaaucccagaacaa

SEQ ID NO: 2707945 - RNA, 19 nt, Human parainfluenza virus 3
gaaguauuuauagcagaua

SEQ ID NO: 2707946 - RNA, 17 nt, Human parainfluenza virus 3
agacaaauggaaaggaa

SEQ ID NO: 2707947 - RNA, 20 nt, Human parainfluenza virus 3
aaauguacuaaacaauguag

SEQ ID NO: 2707948 - RNA, 21 nt, Human parainfluenza virus 3
gaagggacaaaaaaagcaaaa

SEQ ID NO: 2707949 - RNA, 16 nt, Human parainfluenza virus 3
auaaagauauaucuua

SEQ ID NO: 2707950 - RNA, 17 nt, Human parainfluenza virus 3
caacaucagacuacaga

SEQ ID NO: 2707951 - RNA, 23 nt, Human parainfluenza virus 3
gcuuaucaggaaacauaucccaa

SEQ ID NO: 2707952 - RNA, 21 nt, Human parainfluenza virus 3
ggauaucuacaaugauggaua

SEQ ID NO: 2707953 - RNA, 18 nt, Human parainfluenza virus 3
guauccacuaaaucccac

SEQ ID NO: 2707954 - RNA, 16 nt, Human parainfluenza virus 3
aaaugaauccaaugag

SEQ ID NO: 2707955 - RNA, 15 nt, Human parainfluenza virus 3
acacacacaaaauca

SEQ ID NO: 2707956 - RNA, 13 nt, Human parainfluenza virus 3
acuaaacacaaug

SEQ ID NO: 2707957 - RNA, 13 nt, Human parainfluenza virus 3
aaugcaacuggau

SEQ ID NO: 2707958 - RNA, 15 nt, Human parainfluenza virus 3
auacagacagaauca

SEQ ID NO: 2707959 - RNA, 23 nt, Human parainfluenza virus 3
uccaagauuaugucaacaaagaa

SEQ ID NO: 2707960 - RNA, 11 nt, Human parainfluenza virus 3
auagacugauc

SEQ ID NO: 2707961 - RNA, 16 nt, Human parainfluenza virus 3
agauauuuuuaaugaa

SEQ ID NO: 2707962 - RNA, 20 nt, Human parainfluenza virus 3
caaccaaaaaucaaaccaac

SEQ ID NO: 2707963 - RNA, 12 nt, Human parainfluenza virus 3
cacaauaucaau

SEQ ID NO: 2707964 - RNA, 20 nt, Human parainfluenza virus 3
aagaagcuuggaaucuauca

SEQ ID NO: 2707965 - RNA, 21 nt, Human parainfluenza virus 3
aaacaacaaccaucaacaccg

SEQ ID NO: 2707966 - RNA, 12 nt, Human parainfluenza virus 3
uugagcccaagg

SEQ ID NO: 2707967 - RNA, 18 nt, Human parainfluenza virus 3
guccaugguuuucagaua

SEQ ID NO: 2707968 - RNA, 14 nt, Human parainfluenza virus 3
accgaacaaacaga

SEQ ID NO: 2707969 - RNA, 21 nt, Human parainfluenza virus 3
accaaaaaaucugaucuauua

SEQ ID NO: 2707970 - RNA, 15 nt, Human parainfluenza virus 3
caacagaucaagcaa

SEQ ID NO: 2707971 - RNA, 15 nt, Human parainfluenza virus 3
ucaaaccaacagaaa

SEQ ID NO: 2707972 - RNA, 19 nt, Human parainfluenza virus 3
cagaauugguuuugauauu

SEQ ID NO: 2707973 - RNA, 14 nt, Human parainfluenza virus 3
gauccagaguuuaa

SEQ ID NO: 2707974 - RNA, 14 nt, Human parainfluenza virus 3
ucaaugaaauuaga

SEQ ID NO: 2707975 - RNA, 14 nt, Human parainfluenza virus 3
caauagauaucaau

SEQ ID NO: 2707976 - RNA, 18 nt, Human parainfluenza virus 3
gaugaagauaucacaaaa

SEQ ID NO: 2707977 - RNA, 17 nt, Human parainfluenza virus 3
aaagaguaaacgagcug

SEQ ID NO: 2707978 - RNA, 17 nt, Human parainfluenza virus 3
ucacaaagcacaaaaca

SEQ ID NO: 2707979 - RNA, 20 nt, Human parainfluenza virus 3
uugagcccaaggauagacaa

SEQ ID NO: 2707980 - RNA, 16 nt, Human parainfluenza virus 3
acagaagcaaaagaua

SEQ ID NO: 2707981 - RNA, 20 nt, Human parainfluenza virus 3
aaccuuuaucuuugagccca

SEQ ID NO: 2707982 - RNA, 18 nt, Human parainfluenza virus 3
caauuaggaauaauugau

SEQ ID NO: 2707983 - RNA, 21 nt, Human parainfluenza virus 3
uaaaucagaaaaguucaaaca

SEQ ID NO: 2707984 - RNA, 15 nt, Human parainfluenza virus 3
agcaggcaagaucag

SEQ ID NO: 2707985 - RNA, 21 nt, Human parainfluenza virus 3
auguauauugagaaacaauua

SEQ ID NO: 2707986 - RNA, 13 nt, Human parainfluenza virus 3
cuguacaauaaua

SEQ ID NO: 2707987 - RNA, 23 nt, Human parainfluenza virus 3
caauccaacucuacucauacaau

SEQ ID NO: 2707988 - RNA, 16 nt, Human parainfluenza virus 3
aauacccaaaaaagug

SEQ ID NO: 2707989 - RNA, 21 nt, Human parainfluenza virus 3
aacacucagaucuacaaagua

SEQ ID NO: 2707990 - RNA, 15 nt, Human parainfluenza virus 3
ggcaaacagaaauac

SEQ ID NO: 2707991 - RNA, 14 nt, Human parainfluenza virus 3
aaaauuacaaucua

SEQ ID NO: 2707992 - RNA, 17 nt, Human parainfluenza virus 3
aucaucaggaacacaau

SEQ ID NO: 2707993 - RNA, 13 nt, Human parainfluenza virus 3
aaaucaaacaaug

SEQ ID NO: 2707994 - RNA, 23 nt, Human parainfluenza virus 3
caacauuuugauccaaauuaaua

SEQ ID NO: 2707995 - RNA, 12 nt, Human parainfluenza virus 3
auuauauauacc

SEQ ID NO: 2707996 - RNA, 21 nt, Human parainfluenza virus 3
guacaccugauacaagaucaa

SEQ ID NO: 2707997 - RNA, 14 nt, Human parainfluenza virus 3
gaagaaaagaucaa

SEQ ID NO: 2707998 - RNA, 19 nt, Human parainfluenza virus 3
aaaaucaaaccaacagaaa

SEQ ID NO: 2707999 - RNA, 14 nt, Human parainfluenza virus 3
auucaucauaaaug

SEQ ID NO: 2708000 - RNA, 14 nt, Human parainfluenza virus 3
ugaugaagaagaaa

SEQ ID NO: 2708001 - RNA, 19 nt, Human parainfluenza virus 3
gaguuuauggagauuacag

SEQ ID NO: 2708002 - RNA, 14 nt, Human parainfluenza virus 3
aaauacuaaugaaa

SEQ ID NO: 2708003 - RNA, 16 nt, Human parainfluenza virus 3
ugauaacauaggauca

SEQ ID NO: 2708004 - RNA, 23 nt, Human parainfluenza virus 3
gcuugcaacucaaucaauagaga

SEQ ID NO: 2708005 - RNA, 17 nt, Human parainfluenza virus 3
caacuuauaaaucagau

SEQ ID NO: 2708006 - RNA, 18 nt, Human parainfluenza virus 3
augaucaaaacaaaauug

SEQ ID NO: 2708007 - RNA, 16 nt, Human parainfluenza virus 3
caaucacggaaaggau

SEQ ID NO: 2708008 - RNA, 12 nt, Human parainfluenza virus 3
cagacaaacaca

SEQ ID NO: 2708009 - RNA, 14 nt, Human parainfluenza virus 3
cacaaaaucaagca

SEQ ID NO: 2708010 - RNA, 19 nt, Human parainfluenza virus 3
caaaguagauuccauauca

SEQ ID NO: 2708011 - RNA, 20 nt, Human parainfluenza virus 3
acucaaacauugcaaaaaug

SEQ ID NO: 2708012 - RNA, 16 nt, Human parainfluenza virus 3
aguaagaaaaacaugu

SEQ ID NO: 2708013 - RNA, 13 nt, Human parainfluenza virus 3
auuauaaaugauc

SEQ ID NO: 2708014 - RNA, 18 nt, Human parainfluenza virus 3
gcuuaaacucaauuccaa

SEQ ID NO: 2708015 - RNA, 21 nt, Human parainfluenza virus 3
auugaaagaagaaaagaucaa

SEQ ID NO: 2708016 - RNA, 19 nt, Human parainfluenza virus 3
ucaacauaaaugacaauag

SEQ ID NO: 2708017 - RNA, 22 nt, Human parainfluenza virus 3
uagacucuuugcaaaaaugaca

SEQ ID NO: 2708018 - RNA, 20 nt, Human parainfluenza virus 3
acacaaaggggcaaacagaa

SEQ ID NO: 2708019 - RNA, 11 nt, Human parainfluenza virus 3
gagcccaagga

SEQ ID NO: 2708020 - RNA, 24 nt, Human parainfluenza virus 3
cagaucgaaccgaacagacaaaca

SEQ ID NO: 2708021 - RNA, 15 nt, Human parainfluenza virus 3
gucuuccaaucagaa

SEQ ID NO: 2708022 - RNA, 15 nt, Human parainfluenza virus 3
auagucucaaagaaa

SEQ ID NO: 2708023 - RNA, 22 nt, Human parainfluenza virus 3
acagaaacaagugagaaagaua

SEQ ID NO: 2708024 - RNA, 15 nt, Human parainfluenza virus 3
auccaacaaagaaac

SEQ ID NO: 2708025 - RNA, 19 nt, Human parainfluenza virus 3
accgaacagacaaacacaa

SEQ ID NO: 2708026 - RNA, 21 nt, Human parainfluenza virus 3
agcucaacaaggccaaaucag

SEQ ID NO: 2708027 - RNA, 21 nt, Human parainfluenza virus 3
gaaaacacagagagacugcaa

SEQ ID NO: 2708028 - RNA, 22 nt, Human parainfluenza virus 3
auuaacuaggcugcugaacacu

SEQ ID NO: 2708029 - RNA, 23 nt, Human parainfluenza virus 3
ugagaaacucaaagaagcaauca

SEQ ID NO: 2708030 - RNA, 16 nt, Human parainfluenza virus 3
gaacgaaucaaagaca

SEQ ID NO: 2708031 - RNA, 18 nt, Human parainfluenza virus 3
acacaaaauuaacacaga

SEQ ID NO: 2708032 - RNA, 21 nt, Human parainfluenza virus 3
aucaagaccaggaaacgauga

SEQ ID NO: 2708033 - RNA, 22 nt, Human parainfluenza virus 3
uucuaaaaauggaacccagaac

SEQ ID NO: 2708034 - RNA, 23 nt, Human parainfluenza virus 3
gaaucuaauaguagcaaucaaau

SEQ ID NO: 2708035 - RNA, 18 nt, Human parainfluenza virus 3
ggcaucuuucugccaaau

SEQ ID NO: 2708036 - RNA, 21 nt, Human parainfluenza virus 3
gauguauaacaggaguauaua

SEQ ID NO: 2708037 - RNA, 20 nt, Human parainfluenza virus 3
caaucaggaauccaaugaaa

SEQ ID NO: 2708038 - RNA, 22 nt, Human parainfluenza virus 3
uguaauauauauauaccaagca

SEQ ID NO: 2708039 - RNA, 22 nt, Human parainfluenza virus 3
aucucggauugaucaagagaaa

SEQ ID NO: 2708040 - RNA, 18 nt, Human parainfluenza virus 3
agaagauugauagaaaau

SEQ ID NO: 2708041 - RNA, 17 nt, Human parainfluenza virus 3
auuacaagaaaaaggaa

SEQ ID NO: 2708042 - RNA, 21 nt, Human parainfluenza virus 3
caacaagacuaauacccaaaa

SEQ ID NO: 2708043 - RNA, 13 nt, Human parainfluenza virus 3
aauauacaaauaa

SEQ ID NO: 2708044 - RNA, 16 nt, Human parainfluenza virus 3
gaaccauugcucuggg

SEQ ID NO: 2708045 - RNA, 18 nt, Human parainfluenza virus 3
uaaaaccuuuaaauccag

SEQ ID NO: 2708046 - RNA, 19 nt, Human parainfluenza virus 3
uauccugagugucaccuua

SEQ ID NO: 2708047 - RNA, 18 nt, Human parainfluenza virus 3
uauuaaguucauacaaug

SEQ ID NO: 2708048 - RNA, 22 nt, Human parainfluenza virus 3
caccauugauaacaacacagau

SEQ ID NO: 2708049 - RNA, 11 nt, Human parainfluenza virus 3
acaagcugcau

SEQ ID NO: 2708050 - RNA, 23 nt, Human parainfluenza virus 3
auggacacugaaucuaacaaugg

SEQ ID NO: 2708051 - RNA, 21 nt, Human parainfluenza virus 3
aaaaguaagaaaaacauguaa

SEQ ID NO: 2708052 - RNA, 18 nt, Human parainfluenza virus 3
cagaagcaaaagauagaa

SEQ ID NO: 2708053 - RNA, 17 nt, Human parainfluenza virus 3
caaaacaacaaaaccaa

SEQ ID NO: 2708054 - RNA, 13 nt, Human parainfluenza virus 3
aggcaaaauaaua

SEQ ID NO: 2708055 - RNA, 11 nt, Human parainfluenza virus 3
gggaugaagau

SEQ ID NO: 2708056 - RNA, 22 nt, Human parainfluenza virus 3
aguacaaaauauaaaaccagaa

SEQ ID NO: 2708057 - RNA, 17 nt, Human parainfluenza virus 3
gaauucagauacuaucc

SEQ ID NO: 2708058 - RNA, 23 nt, Human parainfluenza virus 3
gaacagucaaagcgaaagagaug

SEQ ID NO: 2708059 - RNA, 14 nt, Human parainfluenza virus 3
caacagaagcaaaa

SEQ ID NO: 2708060 - RNA, 23 nt, Human parainfluenza virus 3
ccaaauagauaucacaaaacuac

SEQ ID NO: 2708061 - RNA, 19 nt, Human parainfluenza virus 3
ccaagauuaugucaacaaa

SEQ ID NO: 2708062 - RNA, 14 nt, Human parainfluenza virus 3
aaguacagaacacc

SEQ ID NO: 2708063 - RNA, 23 nt, Human parainfluenza virus 3
aucacagcggcgguugcucuggu

SEQ ID NO: 2708064 - RNA, 23 nt, Human parainfluenza virus 3
auuaaaaaagggggaaaagggaa

SEQ ID NO: 2708065 - RNA, 15 nt, Human parainfluenza virus 3
caaaugcaacaagac

SEQ ID NO: 2708066 - RNA, 15 nt, Human parainfluenza virus 3
ucaagagaaaaauag

SEQ ID NO: 2708067 - RNA, 21 nt, Human parainfluenza virus 3
gacacaaaauuaacacagaua

SEQ ID NO: 2708068 - RNA, 16 nt, Human parainfluenza virus 3
caggagugaacacaag

SEQ ID NO: 2708069 - RNA, 20 nt, Human parainfluenza virus 3
gcaauuaugaucuuaaugaa

SEQ ID NO: 2708070 - RNA, 14 nt, Human parainfluenza virus 3
aagcugcaaccaaa

SEQ ID NO: 2708071 - RNA, 18 nt, Human parainfluenza virus 3
gcaaacacuaaacacaau

SEQ ID NO: 2708072 - RNA, 14 nt, Human parainfluenza virus 3
aucucaaaaacaac

SEQ ID NO: 2708073 - RNA, 15 nt, Human parainfluenza virus 3
agaaaucaaauggau

SEQ ID NO: 2708074 - RNA, 18 nt, Human parainfluenza virus 3
aggauacagaagagagca

SEQ ID NO: 2708075 - RNA, 14 nt, Human parainfluenza virus 3
agaucuacaaagua

SEQ ID NO: 2708076 - RNA, 17 nt, Human parainfluenza virus 3
gagcagaugucaaagaa

SEQ ID NO: 2708077 - RNA, 19 nt, Human parainfluenza virus 3
cauacuagacucacagaaa

SEQ ID NO: 2708078 - RNA, 15 nt, Human parainfluenza virus 3
aggaaucaagagaua

SEQ ID NO: 2708079 - RNA, 13 nt, Human parainfluenza virus 3
augucaacaaaga

SEQ ID NO: 2708080 - RNA, 16 nt, Human parainfluenza virus 3
aaagccauacagauga

SEQ ID NO: 2708081 - RNA, 17 nt, Human parainfluenza virus 3
uggaucaacugacaaaa

SEQ ID NO: 2708082 - RNA, 22 nt, Human parainfluenza virus 3
gaccaaaaugaauccaaugaga

SEQ ID NO: 2708083 - RNA, 15 nt, Human parainfluenza virus 3
agaagugagaagaac

SEQ ID NO: 2708084 - RNA, 14 nt, Human parainfluenza virus 3
uugcaacucaauca

SEQ ID NO: 2708085 - RNA, 19 nt, Human parainfluenza virus 3
ccgaacaaacagacaagaa

SEQ ID NO: 2708086 - RNA, 23 nt, Human parainfluenza virus 3
ugauaguaaccaaucaggaaucc

SEQ ID NO: 2708087 - RNA, 20 nt, Human parainfluenza virus 3
gccaaauagauaucacaaaa

SEQ ID NO: 2708088 - RNA, 19 nt, Human parainfluenza virus 3
ccgggaaaacacagagaga

SEQ ID NO: 2708089 - RNA, 15 nt, Human parainfluenza virus 3
uggcauaaugugcua

SEQ ID NO: 2708090 - RNA, 21 nt, Human parainfluenza virus 3
auaaugugcuaucaagaccag

SEQ ID NO: 2708091 - RNA, 12 nt, Human parainfluenza virus 3
ugaaagaagaaa

SEQ ID NO: 2708092 - RNA, 22 nt, Human parainfluenza virus 3
gcagaaucuugguguaauucaa

SEQ ID NO: 2708093 - RNA, 21 nt, Human parainfluenza virus 3
aucagagauauuaaguucaua

SEQ ID NO: 2708094 - RNA, 14 nt, Human parainfluenza virus 3
gaaauuaauaauau

SEQ ID NO: 2708095 - RNA, 12 nt, Human parainfluenza virus 3
auuaacacagau

SEQ ID NO: 2708096 - RNA, 23 nt, Human parainfluenza virus 3
guuacaaaguuuguggcucugga

SEQ ID NO: 2708097 - RNA, 15 nt, Human parainfluenza virus 3
auuauuuacagaauc

SEQ ID NO: 2708098 - RNA, 19 nt, Human parainfluenza virus 3
uuaaaaauaaaaaucccaa

SEQ ID NO: 2708099 - RNA, 15 nt, Human parainfluenza virus 3
auuccaaaaagcugc

SEQ ID NO: 2708100 - RNA, 14 nt, Human parainfluenza virus 3
aagauuacagaaag

SEQ ID NO: 2708101 - RNA, 21 nt, Human parainfluenza virus 3
acugagagaggaggaaagaaa

SEQ ID NO: 2708102 - RNA, 19 nt, Human parainfluenza virus 3
acuaauacccaaaaaagug

SEQ ID NO: 2708103 - RNA, 15 nt, Human parainfluenza virus 3
aauacaauaaagaua

SEQ ID NO: 2708104 - RNA, 18 nt, Human parainfluenza virus 3
aacuucgaaacaagauau

SEQ ID NO: 2708105 - RNA, 16 nt, Human parainfluenza virus 3
acacaaucaacacaag

SEQ ID NO: 2708106 - RNA, 18 nt, Human parainfluenza virus 3
acaccaagaagaugacaa

SEQ ID NO: 2708107 - RNA, 14 nt, Human parainfluenza virus 3
aauuauauaccaau

SEQ ID NO: 2708108 - RNA, 19 nt, Human parainfluenza virus 3
acaucaaaagggcagaaga

SEQ ID NO: 2708109 - RNA, 22 nt, Human parainfluenza virus 3
agagucauguccagaauuauau

SEQ ID NO: 2708110 - RNA, 17 nt, Human parainfluenza virus 3
gcaaauguacuaaacaa

SEQ ID NO: 2708111 - RNA, 22 nt, Human parainfluenza virus 3
uggaauauaagugcaugugcua

SEQ ID NO: 2708112 - RNA, 15 nt, Human parainfluenza virus 3
cagaugauauaacau

SEQ ID NO: 2708113 - RNA, 22 nt, Human parainfluenza virus 3
aaucagggacacaaacaaagca

SEQ ID NO: 2708114 - RNA, 19 nt, Human parainfluenza virus 3
auaaccuuguucaaaauuc

SEQ ID NO: 2708115 - RNA, 15 nt, Human parainfluenza virus 3
aucuuugagcccaag

SEQ ID NO: 2708116 - RNA, 18 nt, Human parainfluenza virus 3
caaacccaagacacaaaa

SEQ ID NO: 2708117 - RNA, 12 nt, Human parainfluenza virus 3
caaaauuacaau

SEQ ID NO: 2708118 - RNA, 18 nt, Human parainfluenza virus 3
ugcuguucgaugccaaca

SEQ ID NO: 2708119 - RNA, 20 nt, Human parainfluenza virus 3
ucuauuauuuacagaaucaa

SEQ ID NO: 2708120 - RNA, 15 nt, Human parainfluenza virus 3
uagauccaaaauuac

SEQ ID NO: 2708121 - RNA, 16 nt, Human parainfluenza virus 3
auacaaguauaugaua

SEQ ID NO: 2708122 - RNA, 15 nt, Human parainfluenza virus 3
caugaucaaaacaaa

SEQ ID NO: 2708123 - RNA, 19 nt, Human parainfluenza virus 3
cuuaaaauuaugacugaga

SEQ ID NO: 2708124 - RNA, 22 nt, Human parainfluenza virus 3
aaagggaugaagauaucacaaa

SEQ ID NO: 2708125 - RNA, 18 nt, Human parainfluenza virus 3
cacaacucccccaacaac

SEQ ID NO: 2708126 - RNA, 15 nt, Human parainfluenza virus 3
caaagaauaacacau

SEQ ID NO: 2708127 - RNA, 11 nt, Human parainfluenza virus 3
accaucuauca

SEQ ID NO: 2708128 - RNA, 17 nt, Human parainfluenza virus 3
auuaaccauaauaugca

SEQ ID NO: 2708129 - RNA, 19 nt, Human parainfluenza virus 3
auuucaaaucuuaaaauua

SEQ ID NO: 2708130 - RNA, 23 nt, Human parainfluenza virus 3
ccugguauuaacaguaaagugac

SEQ ID NO: 2708131 - RNA, 16 nt, Human parainfluenza virus 3
acagucccaaagggau

SEQ ID NO: 2708132 - RNA, 20 nt, Human parainfluenza virus 3
agauagaacauauagucaaa

SEQ ID NO: 2708133 - RNA, 19 nt, Human parainfluenza virus 3
gaucuauuaaaaauaaaaa

SEQ ID NO: 2708134 - RNA, 12 nt, Human parainfluenza virus 3
cauuauauuguu

SEQ ID NO: 2708135 - RNA, 13 nt, Human parainfluenza virus 3
aacaauguagaua

SEQ ID NO: 2708136 - RNA, 20 nt, Human parainfluenza virus 3
cuguucgaugccaacaaagu

SEQ ID NO: 2708137 - RNA, 21 nt, Human parainfluenza virus 3
gaacuaauaaucucuacuuca

SEQ ID NO: 2708138 - RNA, 12 nt, Human parainfluenza virus 3
ucgcaaaaggag

SEQ ID NO: 2708139 - RNA, 20 nt, Human parainfluenza virus 3
ucggaaaacgacacaaucaa

SEQ ID NO: 2708140 - RNA, 15 nt, Human parainfluenza virus 3
ggaacgaaucaaaga

SEQ ID NO: 2708141 - RNA, 14 nt, Human parainfluenza virus 3
uuaauuucaaaucu

SEQ ID NO: 2708142 - RNA, 14 nt, Human parainfluenza virus 3
cacaaauaucacag

SEQ ID NO: 2708143 - RNA, 16 nt, Human parainfluenza virus 3
ccucaguuagaugagg

SEQ ID NO: 2708144 - RNA, 22 nt, Human parainfluenza virus 3
auaccaagcagaguucuucucu

SEQ ID NO: 2708145 - RNA, 15 nt, Human parainfluenza virus 3
uuccaucaauaguga

SEQ ID NO: 2708146 - RNA, 22 nt, Human parainfluenza virus 3
auccaugaucaaaacaaaauug

SEQ ID NO: 2708147 - RNA, 17 nt, Human parainfluenza virus 3
uuaggauuaaagaauaa

SEQ ID NO: 2708148 - RNA, 12 nt, Human parainfluenza virus 3
caugaaauggag

SEQ ID NO: 2708149 - RNA, 20 nt, Human parainfluenza virus 3
acauucauguccaaauggau

SEQ ID NO: 2708150 - RNA, 15 nt, Human parainfluenza virus 3
agaagaacagucaaa

SEQ ID NO: 2708151 - RNA, 19 nt, Human parainfluenza virus 3
gaacaccaaaacaacaaaa

SEQ ID NO: 2708152 - RNA, 18 nt, Human parainfluenza virus 3
ccauauguacuaacaaac

SEQ ID NO: 2708153 - RNA, 15 nt, Human parainfluenza virus 3
gaaucaaagacaaau

SEQ ID NO: 2708154 - RNA, 15 nt, Human parainfluenza virus 3
ucaaugaacagagaa

SEQ ID NO: 2708155 - RNA, 20 nt, Human parainfluenza virus 3
acaacagaacaaaguagaaa

SEQ ID NO: 2708156 - RNA, 13 nt, Human parainfluenza virus 3
caaguaugauaug

SEQ ID NO: 2708157 - RNA, 14 nt, Human parainfluenza virus 3
aaaacuacagcaug

SEQ ID NO: 2708158 - RNA, 23 nt, Human parainfluenza virus 3
guuacugcugcaacaccagauga

SEQ ID NO: 2708159 - RNA, 16 nt, Human parainfluenza virus 3
aauacuguaaacagaa

SEQ ID NO: 2708160 - RNA, 20 nt, Human parainfluenza virus 3
aucacgucauuaauuucaaa

SEQ ID NO: 2708161 - RNA, 14 nt, Human parainfluenza virus 3
aauuagaaaugaua

SEQ ID NO: 2708162 - RNA, 20 nt, Human parainfluenza virus 3
ccaaauagauaucacaaaac

SEQ ID NO: 2708163 - RNA, 14 nt, Human parainfluenza virus 3
ucuuaaccuuuauc

SEQ ID NO: 2708164 - RNA, 17 nt, Human parainfluenza virus 3
acacaaaauuaacacag

SEQ ID NO: 2708165 - RNA, 18 nt, Human parainfluenza virus 3
aacauccaauaaaugaga

SEQ ID NO: 2708166 - RNA, 15 nt, Human parainfluenza virus 3
cuagauuuauaucaa

SEQ ID NO: 2708167 - RNA, 17 nt, Human parainfluenza virus 3
aaauguucaaauuauau

SEQ ID NO: 2708168 - RNA, 12 nt, Human parainfluenza virus 3
auccaacaaaga

SEQ ID NO: 2708169 - RNA, 13 nt, Human parainfluenza virus 3
gaugaugaagaag

SEQ ID NO: 2708170 - RNA, 15 nt, Human parainfluenza virus 3
uguacaacagaagca

SEQ ID NO: 2708171 - RNA, 14 nt, Human parainfluenza virus 3
ugaaguguacaaua

SEQ ID NO: 2708172 - RNA, 15 nt, Human parainfluenza virus 3
uauaccaagcagagu

SEQ ID NO: 2708173 - RNA, 21 nt, Human parainfluenza virus 3
aaucugaucuauuaaaaauaa

SEQ ID NO: 2708174 - RNA, 22 nt, Human parainfluenza virus 3
acuaggcuucuucgaaauggaa

SEQ ID NO: 2708175 - RNA, 19 nt, Human parainfluenza virus 3
aagaccaaaaugaauccaa

SEQ ID NO: 2708176 - RNA, 15 nt, Human parainfluenza virus 3
ucaauauacaaauaa

SEQ ID NO: 2708177 - RNA, 19 nt, Human parainfluenza virus 3
cacgaauguacaacagaag

SEQ ID NO: 2708178 - RNA, 12 nt, Human parainfluenza virus 3
ccagccauauca

SEQ ID NO: 2708179 - RNA, 19 nt, Human parainfluenza virus 3
uauaucaaaaguucacaca

SEQ ID NO: 2708180 - RNA, 22 nt, Human parainfluenza virus 3
aauugguuuugauauuagauaa

SEQ ID NO: 2708181 - RNA, 16 nt, Human parainfluenza virus 3
gaagaggaaucaagag

SEQ ID NO: 2708182 - RNA, 23 nt, Human parainfluenza virus 3
cuugcaacucaaucaauagagag

SEQ ID NO: 2708183 - RNA, 13 nt, Human parainfluenza virus 3
uuaauuauaaaug

SEQ ID NO: 2708184 - RNA, 15 nt, Human parainfluenza virus 3
cauagaagauugaua

SEQ ID NO: 2708185 - RNA, 17 nt, Human parainfluenza virus 3
aaguuacgcaauccaac

SEQ ID NO: 2708186 - RNA, 17 nt, Human parainfluenza virus 3
gaacagacaaacacaac

SEQ ID NO: 2708187 - RNA, 21 nt, Human parainfluenza virus 3
ccauuaagccgaagcaaauaa

SEQ ID NO: 2708188 - RNA, 12 nt, Human parainfluenza virus 3
ccagaacaaaac

SEQ ID NO: 2708189 - RNA, 21 nt, Human parainfluenza virus 3
ugucccgggaaaacacagaga

SEQ ID NO: 2708190 - RNA, 12 nt, Human parainfluenza virus 3
gaucaagagaaa

SEQ ID NO: 2708191 - RNA, 14 nt, Human parainfluenza virus 3
acugagaaagugaa

SEQ ID NO: 2708192 - RNA, 14 nt, Human parainfluenza virus 3
agaaugaaacaaua

SEQ ID NO: 2708193 - RNA, 14 nt, Human parainfluenza virus 3
aggauaaaauggac

SEQ ID NO: 2708194 - RNA, 22 nt, Human parainfluenza virus 3
gacaaauggaaaggaaaggaag

SEQ ID NO: 2708195 - RNA, 14 nt, Human parainfluenza virus 3
aaugucaaaagaaa

SEQ ID NO: 2708196 - RNA, 14 nt, Human parainfluenza virus 3
ugaaacaauagaua

SEQ ID NO: 2708197 - RNA, 21 nt, Human parainfluenza virus 3
ucauauauaaacgaacucaaa

SEQ ID NO: 2708198 - RNA, 15 nt, Human parainfluenza virus 3
ggcgguugcucuggu

SEQ ID NO: 2708199 - RNA, 22 nt, Human parainfluenza virus 3
auuaauggacauguucaaugaa

SEQ ID NO: 2708200 - RNA, 22 nt, Human parainfluenza virus 3
aagaaaucaaaagauacugaca

SEQ ID NO: 2708201 - RNA, 22 nt, Human parainfluenza virus 3
aagacugguuuaagaaaucaaa

SEQ ID NO: 2708202 - RNA, 19 nt, Human parainfluenza virus 3
uuaauaauaaauaagaaaa

SEQ ID NO: 2708203 - RNA, 16 nt, Human parainfluenza virus 3
gaaaagaucaagaaaa

SEQ ID NO: 2708204 - RNA, 17 nt, Human parainfluenza virus 3
auaaagcauuaucucca

SEQ ID NO: 2708205 - RNA, 14 nt, Human parainfluenza virus 3
agaugacaaaagaa

SEQ ID NO: 2708206 - RNA, 16 nt, Human parainfluenza virus 3
gacaauuuauaugaaa

SEQ ID NO: 2708207 - RNA, 13 nt, Human parainfluenza virus 3
ugguuuaagaaau

SEQ ID NO: 2708208 - RNA, 17 nt, Human parainfluenza virus 3
ggaaugaccaggaauua

SEQ ID NO: 2708209 - RNA, 16 nt, Human parainfluenza virus 3
gagaaacucaaagaag

SEQ ID NO: 2708210 - RNA, 19 nt, Human parainfluenza virus 3
acaaaacuucgaaacaaga

SEQ ID NO: 2708211 - RNA, 14 nt, Human parainfluenza virus 3
auacaauaaagaua

SEQ ID NO: 2708212 - RNA, 17 nt, Human parainfluenza virus 3
uggauauacaacaacaa

SEQ ID NO: 2708213 - RNA, 16 nt, Human parainfluenza virus 3
aucaaaugcaacaaga

SEQ ID NO: 2708214 - RNA, 18 nt, Human parainfluenza virus 3
auacugcaucaaagauag

SEQ ID NO: 2708215 - RNA, 15 nt, Human parainfluenza virus 3
ucaaaacaaaauuga

SEQ ID NO: 2708216 - RNA, 13 nt, Human parainfluenza virus 3
acuguaaacagaa

SEQ ID NO: 2708217 - RNA, 15 nt, Human parainfluenza virus 3
auacaguacaaaaua

SEQ ID NO: 2708218 - RNA, 23 nt, Human parainfluenza virus 3
gcuucaucaguagagauuacaag

SEQ ID NO: 2708219 - RNA, 17 nt, Human parainfluenza virus 3
aaagaggucaacaccaa

SEQ ID NO: 2708220 - RNA, 21 nt, Human parainfluenza virus 3
acaccaagaagaugacaaaag

SEQ ID NO: 2708221 - RNA, 16 nt, Human parainfluenza virus 3
cacugaaucuaacaau

SEQ ID NO: 2708222 - RNA, 12 nt, Human parainfluenza virus 3
auaaaucagaaa

SEQ ID NO: 2708223 - RNA, 17 nt, Human parainfluenza virus 3
aacgaacucaaacauug

SEQ ID NO: 2708224 - RNA, 16 nt, Human parainfluenza virus 3
cuaucaacacacacaa

SEQ ID NO: 2708225 - RNA, 19 nt, Human parainfluenza virus 3
agauauccagaaaugucaa

SEQ ID NO: 2708226 - RNA, 16 nt, Human parainfluenza virus 3
aacaucaacaguugau

SEQ ID NO: 2708227 - RNA, 18 nt, Human parainfluenza virus 3
caaugaaauuagaaagau

SEQ ID NO: 2708228 - RNA, 12 nt, Human parainfluenza virus 3
gaccaacagauc

SEQ ID NO: 2708229 - RNA, 20 nt, Human parainfluenza virus 3
caucaaaagggcagaagaaa

SEQ ID NO: 2708230 - RNA, 15 nt, Human parainfluenza virus 3
cgaacagacaaacac

SEQ ID NO: 2708231 - RNA, 15 nt, Human parainfluenza virus 3
caguuauaagcaaca

SEQ ID NO: 2708232 - RNA, 17 nt, Human parainfluenza virus 3
auaaaaucuuagauauu

SEQ ID NO: 2708233 - RNA, 14 nt, Human parainfluenza virus 3
aauauacaaauaag

SEQ ID NO: 2708234 - RNA, 20 nt, Human parainfluenza virus 3
uagauacugcaucaaagaua

SEQ ID NO: 2708235 - RNA, 17 nt, Human parainfluenza virus 3
gauauuacugauuacag

SEQ ID NO: 2708236 - RNA, 13 nt, Human parainfluenza virus 3
aaucaaagagaac

SEQ ID NO: 2708237 - RNA, 12 nt, Human parainfluenza virus 3
uaggacaaagaa

SEQ ID NO: 2708238 - RNA, 19 nt, Human parainfluenza virus 3
gcacuccuaaauacagaug

SEQ ID NO: 2708239 - RNA, 17 nt, Human parainfluenza virus 3
caacuggauccauauca

SEQ ID NO: 2708240 - RNA, 23 nt, Human parainfluenza virus 3
ggcacuguaucugacauacucua

SEQ ID NO: 2708241 - RNA, 22 nt, Human parainfluenza virus 3
gcagaaugaaacaauagauauc

SEQ ID NO: 2708242 - RNA, 21 nt, Human parainfluenza virus 3
aucugcagguacauaucaaaa

SEQ ID NO: 2708243 - RNA, 22 nt, Human parainfluenza virus 3
acacaagggauugacaagaaua

SEQ ID NO: 2708244 - RNA, 21 nt, Human parainfluenza virus 3
ucagauauugagaaacucaaa

SEQ ID NO: 2708245 - RNA, 16 nt, Human parainfluenza virus 3
uugggaaaaucaaaca

SEQ ID NO: 2708246 - RNA, 22 nt, Human parainfluenza virus 3
ggccaucagaaacagaacacuc

SEQ ID NO: 2708247 - RNA, 23 nt, Human parainfluenza virus 3
cauauaguagaaauaaaucagaa

SEQ ID NO: 2708248 - RNA, 15 nt, Human parainfluenza virus 3
augaagaagaaauac

SEQ ID NO: 2708249 - RNA, 20 nt, Human parainfluenza virus 3
aguuuauggagauuacagaa

SEQ ID NO: 2708250 - RNA, 17 nt, Human parainfluenza virus 3
uuaaccuaucuauaaua

SEQ ID NO: 2708251 - RNA, 13 nt, Human parainfluenza virus 3
agauuaugucaac

SEQ ID NO: 2708252 - RNA, 21 nt, Human parainfluenza virus 3
agaaacagugaucauggaaga

SEQ ID NO: 2708253 - RNA, 19 nt, Human parainfluenza virus 3
uaaaacucaauaaauuaga

SEQ ID NO: 2708254 - RNA, 15 nt, Human parainfluenza virus 3
cugguauucaaaagg

SEQ ID NO: 2708255 - RNA, 15 nt, Human parainfluenza virus 3
cauugcuacaagaaa

SEQ ID NO: 2708256 - RNA, 17 nt, Human parainfluenza virus 3
gaagaaaagaucaagaa

SEQ ID NO: 2708257 - RNA, 14 nt, Human parainfluenza virus 3
aacaaacaaauaac

SEQ ID NO: 2708258 - RNA, 19 nt, Human parainfluenza virus 3
agauuuauaucaagacaaa

SEQ ID NO: 2708259 - RNA, 15 nt, Human parainfluenza virus 3
gaaagaaagaccaaa

SEQ ID NO: 2708260 - RNA, 17 nt, Human parainfluenza virus 3
gaaaacacuaaucccag

SEQ ID NO: 2708261 - RNA, 17 nt, Human parainfluenza virus 3
auuauccuuaauucaaa

SEQ ID NO: 2708262 - RNA, 21 nt, Human parainfluenza virus 3
agcaaucagggacacaaacaa

SEQ ID NO: 2708263 - RNA, 23 nt, Human parainfluenza virus 3
caaaauuagccucaaaaaaugau

SEQ ID NO: 2708264 - RNA, 19 nt, Human parainfluenza virus 3
caggaaauacacuagagaa

SEQ ID NO: 2708265 - RNA, 21 nt, Human parainfluenza virus 3
gagagcaaucgauuuacagag

SEQ ID NO: 2708266 - RNA, 21 nt, Human parainfluenza virus 3
agaacauauagucaaaugacu

SEQ ID NO: 2708267 - RNA, 14 nt, Human parainfluenza virus 3
auacuagacucaca

SEQ ID NO: 2708268 - RNA, 13 nt, Human parainfluenza virus 3
agggcagaagaaa

SEQ ID NO: 2708269 - RNA, 16 nt, Human parainfluenza virus 3
acauugcaaaaaugau

SEQ ID NO: 2708270 - RNA, 23 nt, Human parainfluenza virus 3
agagacacuacuugcaaauaaua

SEQ ID NO: 2708271 - RNA, 16 nt, Human parainfluenza virus 3
caccauugauaacaac

SEQ ID NO: 2708272 - RNA, 13 nt, Human parainfluenza virus 3
ucaagaaaacuag

SEQ ID NO: 2708273 - RNA, 17 nt, Human parainfluenza virus 3
uacaaaauauaaaacca

SEQ ID NO: 2708274 - RNA, 20 nt, Human parainfluenza virus 3
ugaccuuaaaaccuacaaua

SEQ ID NO: 2708275 - RNA, 23 nt, Human parainfluenza virus 3
cagaaaaucgagaaaaugagauu

SEQ ID NO: 2708276 - RNA, 18 nt, Human parainfluenza virus 3
accuuuaucuuugagccc

SEQ ID NO: 2708277 - RNA, 17 nt, Human parainfluenza virus 3
cuucgaaacaagauauu

SEQ ID NO: 2708278 - RNA, 17 nt, Human parainfluenza virus 3
uuuaagaaaucaaaaga

SEQ ID NO: 2708279 - RNA, 17 nt, Human parainfluenza virus 3
acaagaucuacaaguug

SEQ ID NO: 2708280 - RNA, 18 nt, Human parainfluenza virus 3
gauagaaaaucaaagaga

SEQ ID NO: 2708281 - RNA, 22 nt, Human parainfluenza virus 3
aucuaucaacacacacaaaauc

SEQ ID NO: 2708282 - RNA, 11 nt, Human parainfluenza virus 3
uaccaagcaga

SEQ ID NO: 2708283 - RNA, 16 nt, Human parainfluenza virus 3
cucacaaagcacaaaa

SEQ ID NO: 2708284 - RNA, 21 nt, Human parainfluenza virus 3
agagauauuaaguucauacaa

SEQ ID NO: 2708285 - RNA, 12 nt, Human parainfluenza virus 3
guagcaaucaaa

SEQ ID NO: 2708286 - RNA, 12 nt, Human parainfluenza virus 3
aaacagaacacu

SEQ ID NO: 2708287 - RNA, 19 nt, Human parainfluenza virus 3
aucagaaaucuaagaaauu

SEQ ID NO: 2708288 - RNA, 19 nt, Human parainfluenza virus 3
caaaguuuguggcucugga

SEQ ID NO: 2708289 - RNA, 22 nt, Human parainfluenza virus 3
aagaaacgacaccgaacaaaca

SEQ ID NO: 2708290 - RNA, 17 nt, Human parainfluenza virus 3
aagucaaugaacagaga

SEQ ID NO: 2708291 - RNA, 16 nt, Human parainfluenza virus 3
cauccaauaaaugaga

SEQ ID NO: 2708292 - RNA, 14 nt, Human parainfluenza virus 3
gaggaaucaagaga

SEQ ID NO: 2708293 - RNA, 18 nt, Human parainfluenza virus 3
ccaagcagaguucuucuc

SEQ ID NO: 2708294 - RNA, 13 nt, Human parainfluenza virus 3
aacaagugagaaa

SEQ ID NO: 2708295 - RNA, 22 nt, Human parainfluenza virus 3
agcaaucagggacacaaacaaa

SEQ ID NO: 2708296 - RNA, 13 nt, Human parainfluenza virus 3
gaagaagaaauac

SEQ ID NO: 2708297 - RNA, 20 nt, Human parainfluenza virus 3
uaucggaaaacgacacaauc

SEQ ID NO: 2708298 - RNA, 14 nt, Human parainfluenza virus 3
acaaucaacacaag

SEQ ID NO: 2708299 - RNA, 20 nt, Human parainfluenza virus 3
gacaauuuauaugaaagaua

SEQ ID NO: 2708300 - RNA, 15 nt, Human parainfluenza virus 3
uaucuuugagcccaa

SEQ ID NO: 2708301 - RNA, 16 nt, Human parainfluenza virus 3
aaugacaauaggaagu

SEQ ID NO: 2708302 - RNA, 12 nt, Human parainfluenza virus 3
aaucaaauggau

SEQ ID NO: 2708303 - RNA, 24 nt, Human parainfluenza virus 3
ucuggauccaaacccaagacacaa

SEQ ID NO: 2708304 - RNA, 15 nt, Human parainfluenza virus 3
caauacaaacaaaga

SEQ ID NO: 2708305 - RNA, 23 nt, Human parainfluenza virus 3
guacagaacaccaaaacaacaaa

SEQ ID NO: 2708306 - RNA, 19 nt, Human parainfluenza virus 3
agauauugagaaacucaaa

SEQ ID NO: 2708307 - RNA, 10 nt, Human parainfluenza virus 3
gagcccaagg

SEQ ID NO: 2708308 - RNA, 13 nt, Human parainfluenza virus 3
ucccaaaagagac

SEQ ID NO: 2708309 - RNA, 13 nt, Human parainfluenza virus 3
ggauauaggaaaa

SEQ ID NO: 2708310 - RNA, 13 nt, Human parainfluenza virus 3
auaagaaaaacuu

SEQ ID NO: 2708311 - RNA, 19 nt, Human parainfluenza virus 3
uucgaaauggaacgaauca

SEQ ID NO: 2708312 - RNA, 12 nt, Human parainfluenza virus 3
cagaugaugaag

SEQ ID NO: 2708313 - RNA, 23 nt, Human parainfluenza virus 3
gacacaagggauugacaagaaua

SEQ ID NO: 2708314 - RNA, 16 nt, Human parainfluenza virus 3
ucaagagauaaaucaa

SEQ ID NO: 2708315 - RNA, 20 nt, Human parainfluenza virus 3
gaaaaaggaauaaaauuaca

SEQ ID NO: 2708316 - RNA, 14 nt, Human parainfluenza virus 3
aauuauaaaugauc

SEQ ID NO: 2708317 - RNA, 18 nt, Human parainfluenza virus 3
aucucuacccaacacaau

SEQ ID NO: 2708318 - RNA, 12 nt, Human parainfluenza virus 3
augaugaagaag

SEQ ID NO: 2708319 - RNA, 12 nt, Human parainfluenza virus 3
cucaaaaaauac

SEQ ID NO: 2708320 - RNA, 16 nt, Human parainfluenza virus 3
gaaaaucaaacaaugg

SEQ ID NO: 2708321 - RNA, 12 nt, Human parainfluenza virus 3
cagaacaccaaa

SEQ ID NO: 2708322 - RNA, 18 nt, Human parainfluenza virus 3
gaaauuaauaauauauca

SEQ ID NO: 2708323 - RNA, 15 nt, Human parainfluenza virus 3
agucuucaugucaau

SEQ ID NO: 2708324 - RNA, 22 nt, Human parainfluenza virus 3
acuguacagagaggaccuggga

SEQ ID NO: 2708325 - RNA, 14 nt, Human parainfluenza virus 3
uagauacugcauca

SEQ ID NO: 2708326 - RNA, 20 nt, Human parainfluenza virus 3
gcaacaccagaugaugaaga

SEQ ID NO: 2708327 - RNA, 17 nt, Human parainfluenza virus 3
aaaaguaagaaaaacau

SEQ ID NO: 2708328 - RNA, 17 nt, Human parainfluenza virus 3
aauuaaguauuacagaa

SEQ ID NO: 2708329 - RNA, 12 nt, Human parainfluenza virus 3
aaaaggaaaaua

SEQ ID NO: 2708330 - RNA, 21 nt, Human parainfluenza virus 3
aaaaagugagcaguacaauga

SEQ ID NO: 2708331 - RNA, 14 nt, Human parainfluenza virus 3
aaacauaucccaau

SEQ ID NO: 2708332 - RNA, 16 nt, Human parainfluenza virus 3
uauaccaagcagaguu

SEQ ID NO: 2708333 - RNA, 14 nt, Human parainfluenza virus 3
cgaaucaaagacaa

SEQ ID NO: 2708334 - RNA, 15 nt, Human parainfluenza virus 3
agggcgaaaaaucac

SEQ ID NO: 2708335 - RNA, 13 nt, Human parainfluenza virus 3
caacaccaacaac

SEQ ID NO: 2708336 - RNA, 14 nt, Human parainfluenza virus 3
ugauagaaaaucaa

SEQ ID NO: 2708337 - RNA, 14 nt, Human parainfluenza virus 3
ccauuuuuaaugag

SEQ ID NO: 2708338 - RNA, 15 nt, Human parainfluenza virus 3
acagaaaaucgagaa

SEQ ID NO: 2708339 - RNA, 13 nt, Human parainfluenza virus 3
cuuaauuauaaau

SEQ ID NO: 2708340 - RNA, 20 nt, Human parainfluenza virus 3
ucuucaauacaccaagaaga

SEQ ID NO: 2708341 - RNA, 15 nt, Human parainfluenza virus 3
aguaagaaaaacaug

SEQ ID NO: 2708342 - RNA, 14 nt, Human parainfluenza virus 3
caacaagacuaaua

SEQ ID NO: 2708343 - RNA, 17 nt, Human parainfluenza virus 3
gaaggauacagaagaga

SEQ ID NO: 2708344 - RNA, 20 nt, Human parainfluenza virus 3
uauuaccagagcuucauagg

SEQ ID NO: 2708345 - RNA, 20 nt, Human parainfluenza virus 3
aacaaucauauauaaacgaa

SEQ ID NO: 2708346 - RNA, 23 nt, Human parainfluenza virus 3
aguauuuauagcagauaguaaau

SEQ ID NO: 2708347 - RNA, 13 nt, Human parainfluenza virus 3
gggcagaagaaaa

SEQ ID NO: 2708348 - RNA, 12 nt, Human parainfluenza virus 3
ggaacaagaaag

SEQ ID NO: 2708349 - RNA, 13 nt, Human parainfluenza virus 3
aaaccucaaagca

SEQ ID NO: 2708350 - RNA, 16 nt, Human parainfluenza virus 3
ucggcaauagaaucaa

SEQ ID NO: 2708351 - RNA, 18 nt, Human parainfluenza virus 3
agucaacggauaucuaca

SEQ ID NO: 2708352 - RNA, 14 nt, Human parainfluenza virus 3
uauacaguacaaaa

SEQ ID NO: 2708353 - RNA, 14 nt, Human parainfluenza virus 3
agcaaucaaaucag

SEQ ID NO: 2708354 - RNA, 13 nt, Human parainfluenza virus 3
ucaauacaaacaa

SEQ ID NO: 2708355 - RNA, 20 nt, Human parainfluenza virus 3
aagaaagucaaaucaaaaac

SEQ ID NO: 2708356 - RNA, 22 nt, Human parainfluenza virus 3
uuaauauuaacugagaaaguga

SEQ ID NO: 2708357 - RNA, 15 nt, Human parainfluenza virus 3
auugaucucaaugaa

SEQ ID NO: 2708358 - RNA, 18 nt, Human parainfluenza virus 3
gugaaaagguccauaauu

SEQ ID NO: 2708359 - RNA, 12 nt, Human parainfluenza virus 3
ccgcaacaaaga

SEQ ID NO: 2708360 - RNA, 23 nt, Human parainfluenza virus 3
caaucucucacaaagcacaaaac

SEQ ID NO: 2708361 - RNA, 19 nt, Human parainfluenza virus 3
agguaauaaccuaugggaa

SEQ ID NO: 2708362 - RNA, 20 nt, Human parainfluenza virus 3
acaauaaagauauaucuuaa

SEQ ID NO: 2708363 - RNA, 19 nt, Human parainfluenza virus 3
augucggaucuuaggaaau

SEQ ID NO: 2708364 - RNA, 23 nt, Human parainfluenza virus 3
cagcagaaaagguuagaaaauau

SEQ ID NO: 2708365 - RNA, 18 nt, Human parainfluenza virus 3
auuuaauaaauucauaga

SEQ ID NO: 2708366 - RNA, 21 nt, Human parainfluenza virus 3
acgaugugcaaguuaaaucag

SEQ ID NO: 2708367 - RNA, 18 nt, Human parainfluenza virus 3
agaaaauauauguauauu

SEQ ID NO: 2708368 - RNA, 17 nt, Human parainfluenza virus 3
aaauccaccaaaacaug

SEQ ID NO: 2708369 - RNA, 17 nt, Human parainfluenza virus 3
cucuacucauacaauug

SEQ ID NO: 2708370 - RNA, 14 nt, Human parainfluenza virus 3
gcgguugcucuggu

SEQ ID NO: 2708371 - RNA, 23 nt, Human parainfluenza virus 3
ucaaaagaaauguucaaauuaua

SEQ ID NO: 2708372 - RNA, 18 nt, Human parainfluenza virus 3
auuacacacuaugacaaa

SEQ ID NO: 2708373 - RNA, 18 nt, Human parainfluenza virus 3
caaagaaacgacaccgaa

SEQ ID NO: 2708374 - RNA, 20 nt, Human parainfluenza virus 3
aauacgggaguguaaaugau

SEQ ID NO: 2708375 - RNA, 17 nt, Human parainfluenza virus 3
aaauuacaauuagaaau

SEQ ID NO: 2708376 - RNA, 20 nt, Human parainfluenza virus 3
caacagaaacaagugagaaa

SEQ ID NO: 2708377 - RNA, 15 nt, Human parainfluenza virus 3
ggacaacgacacaaa

SEQ ID NO: 2708378 - RNA, 22 nt, Human parainfluenza virus 3
ccaagauuaugucaacaaagaa

SEQ ID NO: 2708379 - RNA, 20 nt, Human parainfluenza virus 3
gaguuccacgguauaaugaa

SEQ ID NO: 2708380 - RNA, 20 nt, Human parainfluenza virus 3
cuuaaaauuaugacugagag

SEQ ID NO: 2708381 - RNA, 14 nt, Human parainfluenza virus 3
ccaaauagauauca

SEQ ID NO: 2708382 - RNA, 14 nt, Human parainfluenza virus 3
acuuaggaaaauac

SEQ ID NO: 2708383 - RNA, 16 nt, Human parainfluenza virus 3
augacauacaaaauga

SEQ ID NO: 2708384 - RNA, 23 nt, Human parainfluenza virus 3
gucaaucauaauuaaccauaaua

SEQ ID NO: 2708385 - RNA, 22 nt, Human parainfluenza virus 3
aauuugucuuccaaucagaaau

SEQ ID NO: 2708386 - RNA, 17 nt, Human parainfluenza virus 3
agggcaauuacucuauu

SEQ ID NO: 2708387 - RNA, 15 nt, Human parainfluenza virus 3
gaagugagaagaaca

SEQ ID NO: 2708388 - RNA, 15 nt, Human parainfluenza virus 3
agaaaucaaaagaua

SEQ ID NO: 2708389 - RNA, 15 nt, Human parainfluenza virus 3
uccuaaauacagaug

SEQ ID NO: 2708390 - RNA, 22 nt, Human parainfluenza virus 3
uagacaaaaaguaagaaaaaca

SEQ ID NO: 2708391 - RNA, 15 nt, Human parainfluenza virus 3
uaucuuaaccuuuau

SEQ ID NO: 2708392 - RNA, 22 nt, Human parainfluenza virus 3
auaggaggauggucaacuccau

SEQ ID NO: 2708393 - RNA, 23 nt, Human parainfluenza virus 3
auuaucuccaaaaaaaucaaauu

SEQ ID NO: 2708394 - RNA, 20 nt, Human parainfluenza virus 3
gaucaggaaacuguacagag

SEQ ID NO: 2708395 - RNA, 16 nt, Human parainfluenza virus 3
aaguaagaaaaacaug

SEQ ID NO: 2708396 - RNA, 20 nt, Human parainfluenza virus 3
ccaaagggaugaagauauca

SEQ ID NO: 2708397 - RNA, 22 nt, Human parainfluenza virus 3
aaugagagcuacacaaguuuua

SEQ ID NO: 2708398 - RNA, 22 nt, Human parainfluenza virus 3
auaacuaacucugcaauauaca

SEQ ID NO: 2708399 - RNA, 12 nt, Human parainfluenza virus 3
gccgaagcaaau

SEQ ID NO: 2708400 - RNA, 19 nt, Human parainfluenza virus 3
caacagaacaaaguagaaa

SEQ ID NO: 2708401 - RNA, 16 nt, Human parainfluenza virus 3
agacaagaaacaacag

SEQ ID NO: 2708402 - RNA, 15 nt, Human parainfluenza virus 3
acaaacaaagcagug

SEQ ID NO: 2708403 - RNA, 17 nt, Human parainfluenza virus 3
aagucaaaucaaaaacu

SEQ ID NO: 2708404 - RNA, 17 nt, Human parainfluenza virus 3
accugauacaagaucaa

SEQ ID NO: 2708405 - RNA, 17 nt, Human parainfluenza virus 3
agaagugagaagaacag

SEQ ID NO: 2708406 - RNA, 14 nt, Human parainfluenza virus 3
gauugaucaagaga

SEQ ID NO: 2708407 - RNA, 22 nt, Human parainfluenza virus 3
acuagauuuauaucaagacaaa

SEQ ID NO: 2708408 - RNA, 13 nt, Human parainfluenza virus 3
agcacaaaacaau

SEQ ID NO: 2708409 - RNA, 12 nt, Human parainfluenza virus 3
agcacaaaucac

SEQ ID NO: 2708410 - RNA, 19 nt, Human parainfluenza virus 3
ugaauccaaugagagagua

SEQ ID NO: 2708411 - RNA, 15 nt, Human parainfluenza virus 3
auaaaaccagaacua

SEQ ID NO: 2708412 - RNA, 16 nt, Human parainfluenza virus 3
auuacaaccauaauua

SEQ ID NO: 2708413 - RNA, 13 nt, Human parainfluenza virus 3
aaggccaaaucag

SEQ ID NO: 2708414 - RNA, 15 nt, Human parainfluenza virus 3
aacacagcaaacacu

SEQ ID NO: 2708415 - RNA, 14 nt, Human parainfluenza virus 3
cuaaugaaaaauag

SEQ ID NO: 2708416 - RNA, 20 nt, Human parainfluenza virus 3
agauaucaaucaauauacaa

SEQ ID NO: 2708417 - RNA, 12 nt, Human parainfluenza virus 3
ucuaacaauggc

SEQ ID NO: 2708418 - RNA, 17 nt, Human parainfluenza virus 3
agaaagaccaaaaugaa

SEQ ID NO: 2708419 - RNA, 18 nt, Human parainfluenza virus 3
aucucucacaaagcacaa

SEQ ID NO: 2708420 - RNA, 22 nt, Human parainfluenza virus 3
auuaauccuuauccaaaaugag

SEQ ID NO: 2708421 - RNA, 19 nt, Human parainfluenza virus 3
auuaugggagaaaagacau

SEQ ID NO: 2708422 - RNA, 15 nt, Human parainfluenza virus 3
agaacaccaaaacaa

SEQ ID NO: 2708423 - RNA, 22 nt, Human parainfluenza virus 3
acagaacaaaguagaaacagug

SEQ ID NO: 2708424 - RNA, 16 nt, Human parainfluenza virus 3
aaacacuagcaaguca

SEQ ID NO: 2708425 - RNA, 15 nt, Human parainfluenza virus 3
uagcacaauuacaca

SEQ ID NO: 2708426 - RNA, 22 nt, Human parainfluenza virus 3
cagcaaucucucacaaagcaca

SEQ ID NO: 2708427 - RNA, 22 nt, Human parainfluenza virus 3
aaucggaaauccaccaaaacau

SEQ ID NO: 2708428 - RNA, 14 nt, Human parainfluenza virus 3
cagcaacugaaaga

SEQ ID NO: 2708429 - RNA, 14 nt, Human parainfluenza virus 3
aaacagacaagaaa

SEQ ID NO: 2708430 - RNA, 20 nt, Human parainfluenza virus 3
ucgcaggaacaagaaagaag

SEQ ID NO: 2708431 - RNA, 21 nt, Human parainfluenza virus 3
auaaauacaauaaagauauau

SEQ ID NO: 2708432 - RNA, 19 nt, Human parainfluenza virus 3
cacaaaggggcaaacagaa

SEQ ID NO: 2708433 - RNA, 14 nt, Human parainfluenza virus 3
augaagaugucaau

SEQ ID NO: 2708434 - RNA, 20 nt, Human parainfluenza virus 3
agaggaccugggagaagaag

SEQ ID NO: 2708435 - RNA, 12 nt, Human parainfluenza virus 3
aaucaaaacaaa

SEQ ID NO: 2708436 - RNA, 16 nt, Human parainfluenza virus 3
ucaacaccgacacaaa

SEQ ID NO: 2708437 - RNA, 14 nt, Human parainfluenza virus 3
caaaaaugaugaag

SEQ ID NO: 2708438 - RNA, 20 nt, Human parainfluenza virus 3
aaacucaauaaauuagauaa

SEQ ID NO: 2708439 - RNA, 23 nt, Human parainfluenza virus 3
gucucuggaggaaucuccagaag

SEQ ID NO: 2708440 - RNA, 16 nt, Human parainfluenza virus 3
gauauuuuuaaugaau

SEQ ID NO: 2708441 - RNA, 16 nt, Human parainfluenza virus 3
cucuacccaacacaau

SEQ ID NO: 2708442 - RNA, 16 nt, Human parainfluenza virus 3
aaaucaaaacaaaaag

SEQ ID NO: 2708443 - RNA, 15 nt, Human parainfluenza virus 3
cuaauaagauaauau

SEQ ID NO: 2708444 - RNA, 16 nt, Human parainfluenza virus 3
ccacgguauaaugaag

SEQ ID NO: 2708445 - RNA, 16 nt, Human parainfluenza virus 3
gagcaguacaaugaga

SEQ ID NO: 2708446 - RNA, 19 nt, Human parainfluenza virus 3
cuuuaucuuugagcccaag

SEQ ID NO: 2708447 - RNA, 14 nt, Human parainfluenza virus 3
aggaggaaagaaag

SEQ ID NO: 2708448 - RNA, 22 nt, Human parainfluenza virus 3
auauaccugaucuauaucgaca

SEQ ID NO: 2708449 - RNA, 21 nt, Human parainfluenza virus 3
agagauuccaaaaagcugcag

SEQ ID NO: 2708450 - RNA, 23 nt, Human parainfluenza virus 3
aucaagaagugccgcaacaaaga

SEQ ID NO: 2708451 - RNA, 22 nt, Human parainfluenza virus 3
acaauaucuaugagacaaaauu

SEQ ID NO: 2708452 - RNA, 14 nt, Human parainfluenza virus 3
augauaaucaagaa

SEQ ID NO: 2708453 - RNA, 14 nt, Human parainfluenza virus 3
augagacaaaauua

SEQ ID NO: 2708454 - RNA, 22 nt, Human parainfluenza virus 3
aucauauauaaacgaacucaaa

SEQ ID NO: 2708455 - RNA, 23 nt, Human parainfluenza virus 3
caaaacagggguucagacugauu

SEQ ID NO: 2708456 - RNA, 21 nt, Human parainfluenza virus 3
agagagacugcaaucaggcau

SEQ ID NO: 2708457 - RNA, 12 nt, Human parainfluenza virus 3
ucaauauacaaa

SEQ ID NO: 2708458 - RNA, 18 nt, Human parainfluenza virus 3
aagggauaaucaaaaacu

SEQ ID NO: 2708459 - RNA, 22 nt, Human parainfluenza virus 3
cagaugaugaagaagaaauacu

SEQ ID NO: 2708460 - RNA, 23 nt, Human parainfluenza virus 3
cuucaauacaccaagaagaugac

SEQ ID NO: 2708461 - RNA, 19 nt, Human parainfluenza virus 3
ugcaaauaauauaggaaaa

SEQ ID NO: 2708462 - RNA, 17 nt, Human parainfluenza virus 3
aaguuggcauagcaaau

SEQ ID NO: 2708463 - RNA, 13 nt, Human parainfluenza virus 3
gaaaaucaaagag

SEQ ID NO: 2708464 - RNA, 15 nt, Human parainfluenza virus 3
gauccucaucagaua

SEQ ID NO: 2708465 - RNA, 15 nt, Human parainfluenza virus 3
aaaaauggaacccag

SEQ ID NO: 2708466 - RNA, 15 nt, Human parainfluenza virus 3
aaauuaauaauauau

SEQ ID NO: 2708467 - RNA, 15 nt, Human parainfluenza virus 3
uaagaaaucaaaaga

SEQ ID NO: 2708468 - RNA, 23 nt, Human parainfluenza virus 3
gcaucauuauaccgcacaaauau

SEQ ID NO: 2708469 - RNA, 17 nt, Human parainfluenza virus 3
ucgaaccgaacagacaa

SEQ ID NO: 2708470 - RNA, 13 nt, Human parainfluenza virus 3
gaaucaaagacaa

SEQ ID NO: 2708471 - RNA, 14 nt, Human parainfluenza virus 3
uaggacaaagaaaa

SEQ ID NO: 2708472 - RNA, 22 nt, Human parainfluenza virus 3
gagagcaaucgauuuacagaga

SEQ ID NO: 2708473 - RNA, 15 nt, Human parainfluenza virus 3
uagauaucaaucaau

SEQ ID NO: 2708474 - RNA, 20 nt, Human parainfluenza virus 3
ccaaucagaaaucuaagaaa

SEQ ID NO: 2708475 - RNA, 22 nt, Human parainfluenza virus 3
cuugaacauccaauaaaugaga

SEQ ID NO: 2708476 - RNA, 14 nt, Human parainfluenza virus 3
caaacagaaauaca

SEQ ID NO: 2708477 - RNA, 15 nt, Human parainfluenza virus 3
uagauuacauugaua

SEQ ID NO: 2708478 - RNA, 15 nt, Human parainfluenza virus 3
auugaucaagagaaa

SEQ ID NO: 2708479 - RNA, 13 nt, Human parainfluenza virus 3
uaucauugacaca

SEQ ID NO: 2708480 - RNA, 13 nt, Human parainfluenza virus 3
aaagaaaauggau

SEQ ID NO: 2708481 - RNA, 17 nt, Human parainfluenza virus 3
guaaucagcaaucagac

SEQ ID NO: 2708482 - RNA, 23 nt, Human parainfluenza virus 3
gacugguuuaagaaaucaaaaga

SEQ ID NO: 2708483 - RNA, 16 nt, Human parainfluenza virus 3
cagacugauuccaaag

SEQ ID NO: 2708484 - RNA, 14 nt, Human parainfluenza virus 3
ucagcacaaaucac

SEQ ID NO: 2708485 - RNA, 21 nt, Human parainfluenza virus 3
uaagaaaaacauguaauauau

SEQ ID NO: 2708486 - RNA, 15 nt, Human parainfluenza virus 3
gaucuacaaaguaga

SEQ ID NO: 2708487 - RNA, 22 nt, Human parainfluenza virus 3
ugauagaaaaucaaagagaaca

SEQ ID NO: 2708488 - RNA, 15 nt, Human parainfluenza virus 3
agguuagaaaauaua

SEQ ID NO: 2708489 - RNA, 23 nt, Human parainfluenza virus 3
guaauuggaaccauugcucuggg

SEQ ID NO: 2708490 - RNA, 14 nt, Human parainfluenza virus 3
gauuccaaagggau

SEQ ID NO: 2708491 - RNA, 16 nt, Human parainfluenza virus 3
caguaaagugacugaa

SEQ ID NO: 2708492 - RNA, 20 nt, Human parainfluenza virus 3
ccaagaagaugacaaaagaa

SEQ ID NO: 2708493 - RNA, 14 nt, Human parainfluenza virus 3
aaaagauagaacua

SEQ ID NO: 2708494 - RNA, 16 nt, Human parainfluenza virus 3
caagaagaugacaaaa

SEQ ID NO: 2708495 - RNA, 15 nt, Human parainfluenza virus 3
caaacuguauaacaa

SEQ ID NO: 2708496 - RNA, 15 nt, Human parainfluenza virus 3
cagggauauauuaca

SEQ ID NO: 2708497 - RNA, 13 nt, Human parainfluenza virus 3
acaccaaaacaac

SEQ ID NO: 2708498 - RNA, 20 nt, Human parainfluenza virus 3
ucaauggacaacgacacaaa

SEQ ID NO: 2708499 - RNA, 20 nt, Human parainfluenza virus 3
agcaaucgauuuacagagag

SEQ ID NO: 2708500 - RNA, 23 nt, Human parainfluenza virus 3
uauaccaagcagaguucuucucu

SEQ ID NO: 2708501 - RNA, 17 nt, Human parainfluenza virus 3
auuacaauuagaaauga

SEQ ID NO: 2708502 - RNA, 20 nt, Human parainfluenza virus 3
gcagguacauaucaaaacag

SEQ ID NO: 2708503 - RNA, 16 nt, Human parainfluenza virus 3
caaaaaugaugaagaa

SEQ ID NO: 2708504 - RNA, 23 nt, Human parainfluenza virus 3
gacagaaucaucaggaacacaau

SEQ ID NO: 2708505 - RNA, 16 nt, Human parainfluenza virus 3
gacugguuuaagaaau

SEQ ID NO: 2708506 - RNA, 14 nt, Human parainfluenza virus 3
aguuaaaucagaga

SEQ ID NO: 2708507 - RNA, 18 nt, Human parainfluenza virus 3
agucagcugguauucaaa

SEQ ID NO: 2708508 - RNA, 13 nt, Human parainfluenza virus 3
acuucgaaacaag

SEQ ID NO: 2708509 - RNA, 14 nt, Human parainfluenza virus 3
aaauuccuaaguca

SEQ ID NO: 2708510 - RNA, 19 nt, Human parainfluenza virus 3
auaguagcaaucaaaucag

SEQ ID NO: 2708511 - RNA, 15 nt, Human parainfluenza virus 3
auaauacaaguauau

SEQ ID NO: 2708512 - RNA, 20 nt, Human parainfluenza virus 3
auauaccaauaucauugaca

SEQ ID NO: 2708513 - RNA, 21 nt, Human parainfluenza virus 3
aggaaaggaaggauacagaag

SEQ ID NO: 2708514 - RNA, 20 nt, Human parainfluenza virus 3
aguagaaauaaaucagaaaa

SEQ ID NO: 2708515 - RNA, 18 nt, Human parainfluenza virus 3
aagcagaucuaaagaaaa

SEQ ID NO: 2708516 - RNA, 12 nt, Human parainfluenza virus 3
ucaaaacaaaaa

SEQ ID NO: 2708517 - RNA, 19 nt, Human parainfluenza virus 3
aaccaaucaggaauccaau

SEQ ID NO: 2708518 - RNA, 22 nt, Human parainfluenza virus 3
uaauauauauauaccaagcaga

SEQ ID NO: 2708519 - RNA, 15 nt, Human parainfluenza virus 3
aaaauaggcagaaug

SEQ ID NO: 2708520 - RNA, 20 nt, Human parainfluenza virus 3
auggacaacgacacaaaauu

SEQ ID NO: 2708521 - RNA, 14 nt, Human parainfluenza virus 3
cagaauuauauacc

SEQ ID NO: 2708522 - RNA, 21 nt, Human parainfluenza virus 3
auuaacgugcuaucaaaauua

SEQ ID NO: 2708523 - RNA, 16 nt, Human parainfluenza virus 3
cagaucaagcaauaca

SEQ ID NO: 2708524 - RNA, 21 nt, Human parainfluenza virus 3
aucuauuauuuacagaaucaa

SEQ ID NO: 2708525 - RNA, 14 nt, Human parainfluenza virus 3
acagauacaaaaug

SEQ ID NO: 2708526 - RNA, 17 nt, Human parainfluenza virus 3
aaucaauauacaaauaa

SEQ ID NO: 2708527 - RNA, 21 nt, Human parainfluenza virus 3
auuuucucuuuuuuuagaaca

SEQ ID NO: 2708528 - RNA, 13 nt, Human parainfluenza virus 3
agcaaucaaauca

SEQ ID NO: 2708529 - RNA, 21 nt, Human parainfluenza virus 3
gacauagaagugagaagaaca

SEQ ID NO: 2708530 - RNA, 18 nt, Human parainfluenza virus 3
caccagaugauauaacau

SEQ ID NO: 2708531 - RNA, 13 nt, Human parainfluenza virus 3
auaacaacacaga

SEQ ID NO: 2708532 - RNA, 14 nt, Human parainfluenza virus 3
auguauaucaacug

SEQ ID NO: 2708533 - RNA, 17 nt, Human parainfluenza virus 3
agaaacccaaaaauaag

SEQ ID NO: 2708534 - RNA, 12 nt, Human parainfluenza virus 3
caggaacaagaa

SEQ ID NO: 2708535 - RNA, 17 nt, Human parainfluenza virus 3
aaacacuaaacacaaug

SEQ ID NO: 2708536 - RNA, 22 nt, Human parainfluenza virus 3
uccaagaaccacgaucacauca

SEQ ID NO: 2708537 - RNA, 15 nt, Human parainfluenza virus 3
cgauaauuacaauug

SEQ ID NO: 2708538 - RNA, 15 nt, Human parainfluenza virus 3
uauauaccaagcaga

SEQ ID NO: 2708539 - RNA, 21 nt, Human parainfluenza virus 3
aauuagccucaaaaaaugaug

SEQ ID NO: 2708540 - RNA, 19 nt, Human parainfluenza virus 3
acaaaggcuuaaacucaau

SEQ ID NO: 2708541 - RNA, 23 nt, Human parainfluenza virus 3
aaucauaccaagucuuacaggua

SEQ ID NO: 2708542 - RNA, 17 nt, Human parainfluenza virus 3
guagauacugcaucaaa

SEQ ID NO: 2708543 - RNA, 17 nt, Human parainfluenza virus 3
aauuagauaaaagacaa

SEQ ID NO: 2708544 - RNA, 14 nt, Human parainfluenza virus 3
uccagaagcaucac

SEQ ID NO: 2708545 - RNA, 21 nt, Human parainfluenza virus 3
agcaaauguacuaaacaaugu

SEQ ID NO: 2708546 - RNA, 16 nt, Human parainfluenza virus 3
aauucuaaaaauggaa

SEQ ID NO: 2708547 - RNA, 14 nt, Human parainfluenza virus 3
ucuagaagaaucaa

SEQ ID NO: 2708548 - RNA, 14 nt, Human parainfluenza virus 3
ugaaauuacaauua

SEQ ID NO: 2708549 - RNA, 22 nt, Human parainfluenza virus 3
caacaagacuaauacccaaaaa

SEQ ID NO: 2708550 - RNA, 20 nt, Human parainfluenza virus 3
aucucuacccaacacaauau

SEQ ID NO: 2708551 - RNA, 14 nt, Human parainfluenza virus 3
caacagaucaagca

SEQ ID NO: 2708552 - RNA, 21 nt, Human parainfluenza virus 3
agaacaaaguagaaacaguga

SEQ ID NO: 2708553 - RNA, 18 nt, Human parainfluenza virus 3
caacucccccaacaacaa

SEQ ID NO: 2708554 - RNA, 18 nt, Human parainfluenza virus 3
ccaugaucaaaacaaaau

SEQ ID NO: 2708555 - RNA, 14 nt, Human parainfluenza virus 3
caagugagaaagau

SEQ ID NO: 2708556 - RNA, 20 nt, Human parainfluenza virus 3
gcaacacagcaaacacuaaa

SEQ ID NO: 2708557 - RNA, 18 nt, Human parainfluenza virus 3
caaagaauguauagaagc

SEQ ID NO: 2708558 - RNA, 19 nt, Human parainfluenza virus 3
aagauuaugucaacaaaga

SEQ ID NO: 2708559 - RNA, 18 nt, Human parainfluenza virus 3
aauggaugaaucacauag

SEQ ID NO: 2708560 - RNA, 18 nt, Human parainfluenza virus 3
agcaaauguacuaaacaa

SEQ ID NO: 2708561 - RNA, 11 nt, Human parainfluenza virus 3
accaaaaugaa

SEQ ID NO: 2708562 - RNA, 19 nt, Human parainfluenza virus 3
acaaaauugaaagaagaaa

SEQ ID NO: 2708563 - RNA, 17 nt, Human parainfluenza virus 3
ucaacaccgacacaaag

SEQ ID NO: 2708564 - RNA, 15 nt, Human parainfluenza virus 3
aaucgauuagggaau

SEQ ID NO: 2708565 - RNA, 21 nt, Human parainfluenza virus 3
aacacaagaacccagcaacuc

SEQ ID NO: 2708566 - RNA, 16 nt, Human parainfluenza virus 3
ucaaucucaacaacaa

SEQ ID NO: 2708567 - RNA, 14 nt, Human parainfluenza virus 3
caacacacacaaaa

SEQ ID NO: 2708568 - RNA, 15 nt, Human parainfluenza virus 3
accgaacaaacagac

SEQ ID NO: 2708569 - RNA, 17 nt, Human parainfluenza virus 3
aagaagcuuggaaucua

SEQ ID NO: 2708570 - RNA, 21 nt, Human parainfluenza virus 3
cagcugguauucaaaagggag

SEQ ID NO: 2708571 - RNA, 20 nt, Human parainfluenza virus 3
ucaaaagauacugacaacca

SEQ ID NO: 2708572 - RNA, 16 nt, Human parainfluenza virus 3
acacaaaagacaaaug

SEQ ID NO: 2708573 - RNA, 13 nt, Human parainfluenza virus 3
gaguucuucucuu

SEQ ID NO: 2708574 - RNA, 19 nt, Human parainfluenza virus 3
uaaucccagaacaaaacga

SEQ ID NO: 2708575 - RNA, 19 nt, Human parainfluenza virus 3
uaauccuuauccaaaauga

SEQ ID NO: 2708576 - RNA, 19 nt, Human parainfluenza virus 3
uaacacagauacaaaauga

SEQ ID NO: 2708577 - RNA, 18 nt, Human parainfluenza virus 3
acaauaaagauauaucuu

SEQ ID NO: 2708578 - RNA, 18 nt, Human parainfluenza virus 3
aacccaagacacaaaaga

SEQ ID NO: 2708579 - RNA, 17 nt, Human parainfluenza virus 3
aauccacaucaaaacua

SEQ ID NO: 2708580 - RNA, 14 nt, Human parainfluenza virus 3
aauccaccaaaaca

SEQ ID NO: 2708581 - RNA, 12 nt, Human parainfluenza virus 3
aaucccaaaaga

SEQ ID NO: 2708582 - RNA, 17 nt, Human parainfluenza virus 3
uauccaugaucaaaaca

SEQ ID NO: 2708583 - RNA, 13 nt, Human
cugaggugggagg

SEQ ID NO: 2708584 - RNA, 12 nt, Human
cugaggugggag

SEQ ID NO: 2708585 - RNA, 22 nt, Human
cugaggugggaggaucucuuga

SEQ ID NO: 2708586 - RNA, 14 nt, Human
cugaggggccucuu

SEQ ID NO: 2708587 - RNA, 23 nt, Human
cugaggaauccagacccggcugc

SEQ ID NO: 2708588 - RNA, 16 nt, Human
cugaggaauucuguau

SEQ ID NO: 2708589 - RNA, 15 nt, Human
cugaggaauucugua

SEQ ID NO: 2708590 - RNA, 19 nt, Human
cugaggaauucuguauaga

SEQ ID NO: 2708591 - RNA, 18 nt, Human
cugaggaauucuguauag

SEQ ID NO: 2708592 - RNA, 12 nt, Human
cugagcugggau

SEQ ID NO: 2708593 - RNA, 22 nt, Human
cugagcugggaugauuggaggg

SEQ ID NO: 2708594 - RNA, 19 nt, Human
cugacccugcuucaaauau

SEQ ID NO: 2708595 - RNA, 14 nt, Human
cugaucucucguga

SEQ ID NO: 2708596 - RNA, 17 nt, Human
cugaucucucgugauug

SEQ ID NO: 2708597 - RNA, 18 nt, Human
cugaucucucgugauuga

SEQ ID NO: 2708598 - RNA, 24 nt, Human
cucuugauucauaaugacuuaagc

SEQ ID NO: 2708599 - RNA, 23 nt, Human
cucuugagccuugaacuuugacc

SEQ ID NO: 2708600 - RNA, 15 nt, Human
cucuugagccuggga

SEQ ID NO: 2708601 - RNA, 16 nt, Human
cucuugagccugggag

SEQ ID NO: 2708602 - RNA, 22 nt, Human
cucuugauucauaaugacuuaa

SEQ ID NO: 2708603 - RNA, 13 nt, Human
cucuugagccugg

SEQ ID NO: 2708604 - RNA, 14 nt, Human
cucuugagccuggg

SEQ ID NO: 2708605 - RNA, 17 nt, Human
cucugcacaagcugcac

SEQ ID NO: 2708606 - RNA, 18 nt, Human
cucugcacaagcugcacc

SEQ ID NO: 2708607 - RNA, 14 nt, Human
cugaaaauguaugu

SEQ ID NO: 2708608 - RNA, 13 nt, Human
cugacacacagcu

SEQ ID NO: 2708609 - RNA, 15 nt, Human
cugacacacagcucu

SEQ ID NO: 2708610 - RNA, 16 nt, Human
cugacacacagcucug

SEQ ID NO: 2708611 - RNA, 17 nt, Human
cugacacacagcucugu

SEQ ID NO: 2708612 - RNA, 18 nt, Human
cugacacacagcucuguc

SEQ ID NO: 2708613 - RNA, 19 nt, Human
cugacacacagcucugucc

SEQ ID NO: 2708614 - RNA, 20 nt, Human
cugacacacagcucuguccu

SEQ ID NO: 2708615 - RNA, 21 nt, Human
cugacacacagcucuguccug

SEQ ID NO: 2708616 - RNA, 22 nt, Human
cugacacacagcucuguccugg

SEQ ID NO: 2708617 - RNA, 23 nt, Human
cugacacacagcucuguccuggg

SEQ ID NO: 2708618 - RNA, 24 nt, Human
cuccuuuucacaguucucuccuuc

SEQ ID NO: 2708619 - RNA, 23 nt, Human
cuccuuugugaggaagccgcugg

SEQ ID NO: 2708620 - RNA, 22 nt, Human
cuccuagccugugccucuggga

SEQ ID NO: 2708621 - RNA, 16 nt, Human
cuccuuuagcgcccag

SEQ ID NO: 2708622 - RNA, 17 nt, Human
cuccuuuagcgcccagu

SEQ ID NO: 2708623 - RNA, 13 nt, Human
cuccuuucucuuu

SEQ ID NO: 2708624 - RNA, 22 nt, Human
cuccuuuagcgcccaguugggu

SEQ ID NO: 2708625 - RNA, 11 nt, Human
cucggugccuu

SEQ ID NO: 2708626 - RNA, 23 nt, Human
cucgguguggagaagcggcuggc

SEQ ID NO: 2708627 - RNA, 10 nt, Human
cucuccucug

SEQ ID NO: 2708628 - RNA, 16 nt, Human
cucuccgaccagacac

SEQ ID NO: 2708629 - RNA, 13 nt, Human
cucuccuccuuuu

SEQ ID NO: 2708630 - RNA, 20 nt, Human
cucuccuccuuuucacaguu

SEQ ID NO: 2708631 - RNA, 13 nt, Human
cucucccuuggau

SEQ ID NO: 2708632 - RNA, 16 nt, Human
cucugcacaagcugca

SEQ ID NO: 2708633 - RNA, 22 nt, Human
cuccgcuuucuacccagcgagc

SEQ ID NO: 2708634 - RNA, 14 nt, Human
cuccgucaacucau

SEQ ID NO: 2708635 - RNA, 21 nt, Human
cuccgcuuucuacccagcgag

SEQ ID NO: 2708636 - RNA, 20 nt, Human
cuccgcuuucuacccagcga

SEQ ID NO: 2708637 - RNA, 15 nt, Human
cucccucuuucccuc

SEQ ID NO: 2708638 - RNA, 16 nt, Human
cucccucccucuuucc

SEQ ID NO: 2708639 - RNA, 19 nt, Human
cucccucuuucccucccuu

SEQ ID NO: 2708640 - RNA, 21 nt, Human
cuccagaauuucccaaagcag

SEQ ID NO: 2708641 - RNA, 17 nt, Human
cucagaaucucaaauaa

SEQ ID NO: 2708642 - RNA, 16 nt, Human
cucagaaucucaaaua

SEQ ID NO: 2708643 - RNA, 16 nt, Human
cuccagacacaugucc

SEQ ID NO: 2708644 - RNA, 22 nt, Human
cuccagaauuucccaaagcagu

SEQ ID NO: 2708645 - RNA, 11 nt, Human
cuccagacaca

SEQ ID NO: 2708646 - RNA, 23 nt, Human
cuccaggcuguaucccaugagcc

SEQ ID NO: 2708647 - RNA, 22 nt, Human
cuccaggcuguaucccaugagc

SEQ ID NO: 2708648 - RNA, 18 nt, Human
cuccaggugcacaagcuc

SEQ ID NO: 2708649 - RNA, 19 nt, Human
cuccaggugcacaagcucc

SEQ ID NO: 2708650 - RNA, 20 nt, Human
cuccaggugcacaagcucca

SEQ ID NO: 2708651 - RNA, 22 nt, Human
cuccaggugcacaagcuccaag

SEQ ID NO: 2708652 - RNA, 13 nt, Human
cucccaccucagc

SEQ ID NO: 2708653 - RNA, 14 nt, Human
cucccaccucagcc

SEQ ID NO: 2708654 - RNA, 16 nt, Human
cucccaccucagccuc

SEQ ID NO: 2708655 - RNA, 17 nt, Human
cucccaccucagccucc

SEQ ID NO: 2708656 - RNA, 24 nt, Human
cggagaagagcuguucacagccag

SEQ ID NO: 2708657 - RNA, 23 nt, Human
cggagaagagcuguucacagcca

SEQ ID NO: 2708658 - RNA, 15 nt, Human
cggagacggaguccc

SEQ ID NO: 2708659 - RNA, 15 nt, Human
cgguuuauauaagcu

SEQ ID NO: 2708660 - RNA, 16 nt, Human
cguacacauuuuauuu

SEQ ID NO: 2708661 - RNA, 13 nt, Human
cguacacauuuua

SEQ ID NO: 2708662 - RNA, 14 nt, Human
cuaacuggacuggu

SEQ ID NO: 2708663 - RNA, 14 nt, Human
cuaaagcugccagc

SEQ ID NO: 2708664 - RNA, 15 nt, Human
cuaaagcugccagcc

SEQ ID NO: 2708665 - RNA, 16 nt, Human
cuaaaggcuaccuuug

SEQ ID NO: 2708666 - RNA, 15 nt, Human
cuaaaggcuaccuuu

SEQ ID NO: 2708667 - RNA, 22 nt, Human
cuaaaguguauuuuuuuacuaa

SEQ ID NO: 2708668 - RNA, 19 nt, Human
cuaaaggcuaccuuuguau

SEQ ID NO: 2708669 - RNA, 17 nt, Human
cuaaaggcuaccuuugu

SEQ ID NO: 2708670 - RNA, 19 nt, Human
cuaaaguguauuuuuuuac

SEQ ID NO: 2708671 - RNA, 13 nt, Human
cguuaaaauacca

SEQ ID NO: 2708672 - RNA, 16 nt, Human
cuaaacuuuucugaua

SEQ ID NO: 2708673 - RNA, 15 nt, Human
cuaaacuuuucugau

SEQ ID NO: 2708674 - RNA, 16 nt, Human
cgccuuaaggauguuc

SEQ ID NO: 2708675 - RNA, 18 nt, Human
cgcugccccuggcagccc

SEQ ID NO: 2708676 - RNA, 19 nt, Human
cgcuggaccuugaacuggg

SEQ ID NO: 2708677 - RNA, 23 nt, Human
cgcuggaccuugaacuggguacu

SEQ ID NO: 2708678 - RNA, 13 nt, Human
cgcugccccuggc

SEQ ID NO: 2708679 - RNA, 16 nt, Human
cgcugccccuggcagc

SEQ ID NO: 2708680 - RNA, 17 nt, Human
cgcugccccuggcagcc

SEQ ID NO: 2708681 - RNA, 17 nt, Human
cgcuggggccaguuggu

SEQ ID NO: 2708682 - RNA, 20 nt, Human
cgcuggggccaguugguccc

SEQ ID NO: 2708683 - RNA, 19 nt, Human
cucagaaaacaaggaugaa

SEQ ID NO: 2708684 - RNA, 23 nt, Human
cucagaaaacaaggaugaauuaa

SEQ ID NO: 2708685 - RNA, 12 nt, Human
cucagaauauug

SEQ ID NO: 2708686 - RNA, 18 nt, Human
cucacuuguuuuauuuaa

SEQ ID NO: 2708687 - RNA, 13 nt, Human
cucaccucucccu

SEQ ID NO: 2708688 - RNA, 14 nt, Human
cucaccucucccuu

SEQ ID NO: 2708689 - RNA, 15 nt, Human
cucaccucucccuug

SEQ ID NO: 2708690 - RNA, 16 nt, Human
cucaccucucccuugg

SEQ ID NO: 2708691 - RNA, 17 nt, Human
cucaccucucccuugga

SEQ ID NO: 2708692 - RNA, 13 nt, Human
cucaccugccccu

SEQ ID NO: 2708693 - RNA, 18 nt, Human
cucaccugccccucaacu

SEQ ID NO: 2708694 - RNA, 14 nt, Human
cucaccugccccuc

SEQ ID NO: 2708695 - RNA, 16 nt, Human
cucaccugccccucaa

SEQ ID NO: 2708696 - RNA, 13 nt, Human
cucaaaacugcac

SEQ ID NO: 2708697 - RNA, 18 nt, Human
cucaaaaaaagaaaaaga

SEQ ID NO: 2708698 - RNA, 17 nt, Human
cucaaaaaaagaaaaag

SEQ ID NO: 2708699 - RNA, 16 nt, Human
cuauguugcccaggca

SEQ ID NO: 2708700 - RNA, 17 nt, Human
cuauguugcccaggcag

SEQ ID NO: 2708701 - RNA, 17 nt, Human
cuaugugagcacaaagg

SEQ ID NO: 2708702 - RNA, 16 nt, Human
cuauguaucaaugagu

SEQ ID NO: 2708703 - RNA, 22 nt, Human
cuauguguagggcgggaggaug

SEQ ID NO: 2708704 - RNA, 15 nt, Human
cuauguugcccaggc

SEQ ID NO: 2708705 - RNA, 14 nt, Human
cuauguugcccagg

SEQ ID NO: 2708706 - RNA, 19 nt, Human
cuauguaucaaugaguaac

SEQ ID NO: 2708707 - RNA, 20 nt, Human
cuaucucccccagccccauc

SEQ ID NO: 2708708 - RNA, 14 nt, Human
cucacacaugagca

SEQ ID NO: 2708709 - RNA, 21 nt, Human
cucacacaugagcaucaggcc

SEQ ID NO: 2708710 - RNA, 12 nt, Human
cucaaauaacua

SEQ ID NO: 2708711 - RNA, 14 nt, Human
cucacaaaggaugc

SEQ ID NO: 2708712 - RNA, 15 nt, Human
cuaccugaggggccu

SEQ ID NO: 2708713 - RNA, 16 nt, Human
cuaccugaggggccuc

SEQ ID NO: 2708714 - RNA, 19 nt, Human
cuaccugaggggccucuua

SEQ ID NO: 2708715 - RNA, 23 nt, Human
cuaccugaggggccucuuauggg

SEQ ID NO: 2708716 - RNA, 20 nt, Human
cuaguuugauuaaauucuug

SEQ ID NO: 2708717 - RNA, 15 nt, Human
cuaguuugauuaaau

SEQ ID NO: 2708718 - RNA, 19 nt, Human
cuaguuugauuaaauucuu

SEQ ID NO: 2708719 - RNA, 17 nt, Human
cuaguuugauuaaauuc

SEQ ID NO: 2708720 - RNA, 14 nt, Human
cuagggaagauaau

SEQ ID NO: 2708721 - RNA, 19 nt, Human
cuagccagaggagagagga

SEQ ID NO: 2708722 - RNA, 17 nt, Human
cuagccagaggagagag

SEQ ID NO: 2708723 - RNA, 13 nt, Human
cuaggccuggcca

SEQ ID NO: 2708724 - RNA, 12 nt, Human
cuaggccugggg

SEQ ID NO: 2708725 - RNA, 13 nt, Human
cuaggccugggga

SEQ ID NO: 2708726 - RNA, 14 nt, Human
cuaggccuggccag

SEQ ID NO: 2708727 - RNA, 15 nt, Human
cuaggccuggccaga

SEQ ID NO: 2708728 - RNA, 18 nt, Human
cuaggccuggccagaugc

SEQ ID NO: 2708729 - RNA, 19 nt, Human
cuaggccuggccagaugca

SEQ ID NO: 2708730 - RNA, 20 nt, Human
cuagcauacguacacauuuu

SEQ ID NO: 2708731 - RNA, 19 nt, Human
cuagcauacguacacauuu

SEQ ID NO: 2708732 - RNA, 18 nt, Human
cuagcauacguacacauu

SEQ ID NO: 2708733 - RNA, 16 nt, Human
cuagcauacguacaca

SEQ ID NO: 2708734 - RNA, 14 nt, Human
ccucggagaagagc

SEQ ID NO: 2708735 - RNA, 12 nt, Human
ccucggagaaga

SEQ ID NO: 2708736 - RNA, 23 nt, Human
ccuccuuugugaggaagccgcug

SEQ ID NO: 2708737 - RNA, 18 nt, Human
ccuccuuuucacaguucu

SEQ ID NO: 2708738 - RNA, 13 nt, Human
ccuccgccucuug

SEQ ID NO: 2708739 - RNA, 14 nt, Human
ccuccgccucuugg

SEQ ID NO: 2708740 - RNA, 20 nt, Human
ccuccaagaccuucuccuuc

SEQ ID NO: 2708741 - RNA, 12 nt, Human
ccucccaucacc

SEQ ID NO: 2708742 - RNA, 16 nt, Human
ccuccaagaccuucuc

SEQ ID NO: 2708743 - RNA, 17 nt, Human
ccuccaagaccuucucc

SEQ ID NO: 2708744 - RNA, 19 nt, Human
ccuccaagaccuucuccuu

SEQ ID NO: 2708745 - RNA, 17 nt, Human
ccucccaucacccgcua

SEQ ID NO: 2708746 - RNA, 23 nt, Human
ccucaagugauucuccugccuca

SEQ ID NO: 2708747 - RNA, 20 nt, Human
ccucaagugauucuccugcc

SEQ ID NO: 2708748 - RNA, 12 nt, Human
ccucaggcaggu

SEQ ID NO: 2708749 - RNA, 18 nt, Human
ccucaggcaggugggaug

SEQ ID NO: 2708750 - RNA, 10 nt, Human
ccucaggccu

SEQ ID NO: 2708751 - RNA, 16 nt, Human
ccucaacaccucugca

SEQ ID NO: 2708752 - RNA, 15 nt, Human
ccucaaccuccuggg

SEQ ID NO: 2708753 - RNA, 19 nt, Human
ccucaacucuccuccagag

SEQ ID NO: 2708754 - RNA, 21 nt, Human
ccucaacucuccuccagaguc

SEQ ID NO: 2708755 - RNA, 23 nt, Human
ccucaacucuccuccagagucag

SEQ ID NO: 2708756 - RNA, 17 nt, Human
ccggccaccugcggugc

SEQ ID NO: 2708757 - RNA, 18 nt, Human
ccggccaccugcggugcu

SEQ ID NO: 2708758 - RNA, 21 nt, Human
ccuagcauacguacacauuuu

SEQ ID NO: 2708759 - RNA, 22 nt, Human
ccuagccuuagaagucacacag

SEQ ID NO: 2708760 - RNA, 23 nt, Human
ccuagccugugccucugggacug

SEQ ID NO: 2708761 - RNA, 19 nt, Human
ccuagccuuagaagucaca

SEQ ID NO: 2708762 - RNA, 14 nt, Human
ccgcagcccugcag

SEQ ID NO: 2708763 - RNA, 18 nt, Human
ccgcagcccugcagaggg

SEQ ID NO: 2708764 - RNA, 23 nt, Human
ccgcagcccugcagagggcacag

SEQ ID NO: 2708765 - RNA, 14 nt, Human
cccuccuuucacca

SEQ ID NO: 2708766 - RNA, 21 nt, Human
cccugugaguacuacaguccu

SEQ ID NO: 2708767 - RNA, 23 nt, Human
cccugugaguacuacaguccucc

SEQ ID NO: 2708768 - RNA, 15 nt, Human
cccugugauggggcc

SEQ ID NO: 2708769 - RNA, 23 nt, Human
cccuuuuuuggcugcugaaggcu

SEQ ID NO: 2708770 - RNA, 21 nt, Human
cccuuuuuuggcugcugaagg

SEQ ID NO: 2708771 - RNA, 22 nt, Human
cccuuuuuuggcugcugaaggc

SEQ ID NO: 2708772 - RNA, 14 nt, Human
cccuucucuccagc

SEQ ID NO: 2708773 - RNA, 19 nt, Human
cccuucucuccagccccug

SEQ ID NO: 2708774 - RNA, 15 nt, Human
ccuggggagaaagua

SEQ ID NO: 2708775 - RNA, 13 nt, Human
ccugguguggaag

SEQ ID NO: 2708776 - RNA, 20 nt, Human
ccugguggcagugggagcug

SEQ ID NO: 2708777 - RNA, 15 nt, Human
ccugguggcaguggg

SEQ ID NO: 2708778 - RNA, 18 nt, Human
ccugguggcagugggagc

SEQ ID NO: 2708779 - RNA, 19 nt, Human
ccugguggcagugggagcu

SEQ ID NO: 2708780 - RNA, 22 nt, Human
ccuggccucaagugauucuccu

SEQ ID NO: 2708781 - RNA, 20 nt, Human
ccuggccccucagggucccu

SEQ ID NO: 2708782 - RNA, 21 nt, Human
ccuggccccucagggucccug

SEQ ID NO: 2708783 - RNA, 16 nt, Human
ccuggccccucagggu

SEQ ID NO: 2708784 - RNA, 18 nt, Human
ccuggccccucagggucc

SEQ ID NO: 2708785 - RNA, 17 nt, Human
ccuggauggggcugcac

SEQ ID NO: 2708786 - RNA, 18 nt, Human
ccuggauggggcugcacc

SEQ ID NO: 2708787 - RNA, 15 nt, Human
ccuggauggggcugc

SEQ ID NO: 2708788 - RNA, 16 nt, Human
ccugccucagccuccc

SEQ ID NO: 2708789 - RNA, 15 nt, Human
ccugccucagccucc

SEQ ID NO: 2708790 - RNA, 21 nt, Human
ccugcccaggccccugccacc

SEQ ID NO: 2708791 - RNA, 22 nt, Human
ccugcccaggccccugccaccc

SEQ ID NO: 2708792 - RNA, 18 nt, Human
ccugcccaggccccugcc

SEQ ID NO: 2708793 - RNA, 19 nt, Human
ccugcccaggccccugcca

SEQ ID NO: 2708794 - RNA, 18 nt, Human
ccugcccaccuggccucu

SEQ ID NO: 2708795 - RNA, 19 nt, Human
ccugcccaccuggccucug

SEQ ID NO: 2708796 - RNA, 15 nt, Human
ccugcccaccuggcc

SEQ ID NO: 2708797 - RNA, 17 nt, Human
ccugcccaccuggccuc

SEQ ID NO: 2708798 - RNA, 16 nt, Human
ccucuuucccucccuu

SEQ ID NO: 2708799 - RNA, 19 nt, Human
ccucuuucccucccuuccu

SEQ ID NO: 2708800 - RNA, 15 nt, Human
ccucuuugagugaag

SEQ ID NO: 2708801 - RNA, 14 nt, Human
ccugcaggcagcca

SEQ ID NO: 2708802 - RNA, 12 nt, Human
ccugcaggcagc

SEQ ID NO: 2708803 - RNA, 13 nt, Human
ccugcaggcagcc

SEQ ID NO: 2708804 - RNA, 13 nt, Human
cccaacuccagaa

SEQ ID NO: 2708805 - RNA, 17 nt, Human
cccaacucaccccagcc

SEQ ID NO: 2708806 - RNA, 20 nt, Human
cccaacucaccccagcccca

SEQ ID NO: 2708807 - RNA, 13 nt, Human
cccaagcucugcu

SEQ ID NO: 2708808 - RNA, 14 nt, Human
cccaagcucugcuc

SEQ ID NO: 2708809 - RNA, 12 nt, Human
cccaagcucugc

SEQ ID NO: 2708810 - RNA, 15 nt, Human
cccaagcucugcucc

SEQ ID NO: 2708811 - RNA, 12 nt, Human
cccacucccugc

SEQ ID NO: 2708812 - RNA, 13 nt, Human
cccacucccugca

SEQ ID NO: 2708813 - RNA, 23 nt, Human
cccacugcuuuuggucuguguga

SEQ ID NO: 2708814 - RNA, 22 nt, Human
cccacugcuuuuggucugugug

SEQ ID NO: 2708815 - RNA, 15 nt, Human
cccaacucaccccag

SEQ ID NO: 2708816 - RNA, 16 nt, Human
cccaacucaccccagc

SEQ ID NO: 2708817 - RNA, 13 nt, Human
ccaucccucccuc

SEQ ID NO: 2708818 - RNA, 22 nt, Human
ccauccccuguagagugggagc

SEQ ID NO: 2708819 - RNA, 21 nt, Human
ccaucccauaugccugggcag

SEQ ID NO: 2708820 - RNA, 20 nt, Human
ccaucccaaacccuucagug

SEQ ID NO: 2708821 - RNA, 19 nt, Human
ccaucccauaugccugggc

SEQ ID NO: 2708822 - RNA, 20 nt, Human
ccaucccauaugccugggca

SEQ ID NO: 2708823 - RNA, 18 nt, Human
ccaguuggucccccuucc

SEQ ID NO: 2708824 - RNA, 20 nt, Human
ccaguuggucccccuuccau

SEQ ID NO: 2708825 - RNA, 18 nt, Human
ccauccagguucagcuug

SEQ ID NO: 2708826 - RNA, 19 nt, Human
ccauccagguucagcuugu

SEQ ID NO: 2708827 - RNA, 23 nt, Human
ccaguuggguggaugccuggugg

SEQ ID NO: 2708828 - RNA, 13 nt, Human
ccaguuggucccc

SEQ ID NO: 2708829 - RNA, 14 nt, Human
ccaucccucccucc

SEQ ID NO: 2708830 - RNA, 15 nt, Human
ccaucccucccucca

SEQ ID NO: 2708831 - RNA, 20 nt, Human
ccaugaggaacaaggcaagg

SEQ ID NO: 2708832 - RNA, 23 nt, Human
ccaugaggaacaaggcaaggcug

SEQ ID NO: 2708833 - RNA, 18 nt, Human
ccaugaguccccuguuug

SEQ ID NO: 2708834 - RNA, 21 nt, Human
ccaggggaaaaucagccugcu

SEQ ID NO: 2708835 - RNA, 12 nt, Human
ccaggcuggcgu

SEQ ID NO: 2708836 - RNA, 23 nt, Human
ccaggcaggucuugaacuccugg

SEQ ID NO: 2708837 - RNA, 12 nt, Human
ccaggcaggucu

SEQ ID NO: 2708838 - RNA, 14 nt, Human
ccaggcaggucuug

SEQ ID NO: 2708839 - RNA, 15 nt, Human
ccagccccauccucu

SEQ ID NO: 2708840 - RNA, 17 nt, Human
ccagccccauccucugu

SEQ ID NO: 2708841 - RNA, 17 nt, Human
ccagccccagugcccac

SEQ ID NO: 2708842 - RNA, 14 nt, Human
ccagcagagcaccu

SEQ ID NO: 2708843 - RNA, 12 nt, Human
ccagcagagcac

SEQ ID NO: 2708844 - RNA, 13 nt, Human
ccagcagagcacc

SEQ ID NO: 2708845 - RNA, 23 nt, Human
ccagccccuucugacccaugcug

SEQ ID NO: 2708846 - RNA, 24 nt, Human
ccagccccuucugacccaugcugc

SEQ ID NO: 2708847 - RNA, 13 nt, Human
cccuccucugcuu

SEQ ID NO: 2708848 - RNA, 22 nt, Human
cccuccucugcuugccaucccu

SEQ ID NO: 2708849 - RNA, 17 nt, Human
ccccugaauuuaaauag

SEQ ID NO: 2708850 - RNA, 15 nt, Human
ccccugacaacacuc

SEQ ID NO: 2708851 - RNA, 13 nt, Human
ccccugaauuuaa

SEQ ID NO: 2708852 - RNA, 14 nt, Human
ccccugccacccug

SEQ ID NO: 2708853 - RNA, 16 nt, Human
ccccugccacccuggg

SEQ ID NO: 2708854 - RNA, 16 nt, Human
cccggccccugcuggu

SEQ ID NO: 2708855 - RNA, 15 nt, Human
cccggccccugcugg

SEQ ID NO: 2708856 - RNA, 15 nt, Human
cccgggaagggggcu

SEQ ID NO: 2708857 - RNA, 13 nt, Human
ccccuucugaccc

SEQ ID NO: 2708858 - RNA, 14 nt, Human
ccccuucugaccca

SEQ ID NO: 2708859 - RNA, 16 nt, Human
cccgaauagcugggac

SEQ ID NO: 2708860 - RNA, 17 nt, Human
cccgaauagcugggacu

SEQ ID NO: 2708861 - RNA, 18 nt, Human
cccgaauagcugggacua

SEQ ID NO: 2708862 - RNA, 16 nt, Human
cccucaacucuccucc

SEQ ID NO: 2708863 - RNA, 16 nt, Human
cccucaacaccucugc

SEQ ID NO: 2708864 - RNA, 18 nt, Human
cccgggaagggggcuggg

SEQ ID NO: 2708865 - RNA, 21 nt, Human
cccgggaagggggcugggaca

SEQ ID NO: 2708866 - RNA, 24 nt, Human
cccagccagcaguucagagcugcc

SEQ ID NO: 2708867 - RNA, 15 nt, Human
cccaggaaaggcucc

SEQ ID NO: 2708868 - RNA, 16 nt, Human
cccaggaaaggcucca

SEQ ID NO: 2708869 - RNA, 22 nt, Human
cccaggcuuagucacugagaca

SEQ ID NO: 2708870 - RNA, 17 nt, Human
cccaggaaaggcuccag

SEQ ID NO: 2708871 - RNA, 18 nt, Human
cccaggaaaggcuccagg

SEQ ID NO: 2708872 - RNA, 21 nt, Human
cccauccucuguacagagccc

SEQ ID NO: 2708873 - RNA, 22 nt, Human
cccauccucuguacagagccca

SEQ ID NO: 2708874 - RNA, 14 nt, Human
ccccgcacugggcu

SEQ ID NO: 2708875 - RNA, 15 nt, Human
cccauuugcuccuuu

SEQ ID NO: 2708876 - RNA, 19 nt, Human
cccauucugccugcccagg

SEQ ID NO: 2708877 - RNA, 14 nt, Human
cccauucugccugc

SEQ ID NO: 2708878 - RNA, 15 nt, Human
cccauucugccugcc

SEQ ID NO: 2708879 - RNA, 15 nt, Human
ccccagauugcaaca

SEQ ID NO: 2708880 - RNA, 20 nt, Human
ccccagauugcaacaggcug

SEQ ID NO: 2708881 - RNA, 23 nt, Human
caggaaaucaaauaugcaaagca

SEQ ID NO: 2708882 - RNA, 22 nt, Human
caggaaaucaaauaugcaaagc

SEQ ID NO: 2708883 - RNA, 14 nt, Human
caggaaaggcucca

SEQ ID NO: 2708884 - RNA, 15 nt, Human
caggaaaggcuccag

SEQ ID NO: 2708885 - RNA, 18 nt, Human
cagcugugcucuggacag

SEQ ID NO: 2708886 - RNA, 15 nt, Human
cagcuucauuuccug

SEQ ID NO: 2708887 - RNA, 18 nt, Human
cagcuucauuuccugugu

SEQ ID NO: 2708888 - RNA, 16 nt, Human
cagcuccccucggaga

SEQ ID NO: 2708889 - RNA, 18 nt, Human
cagcuccccucggagaag

SEQ ID NO: 2708890 - RNA, 17 nt, Human
cagcuccccucggagaa

SEQ ID NO: 2708891 - RNA, 23 nt, Human
cagcugccuccccuccucugcuu

SEQ ID NO: 2708892 - RNA, 24 nt, Human
cagcugccuccccuccucugcuug

SEQ ID NO: 2708893 - RNA, 21 nt, Human
cagcugccuccccuccucugc

SEQ ID NO: 2708894 - RNA, 22 nt, Human
cagcugccuccccuccucugcu

SEQ ID NO: 2708895 - RNA, 22 nt, Human
cagcuccagcucaccagcccca

SEQ ID NO: 2708896 - RNA, 16 nt, Human
cagcuccagcucacca

SEQ ID NO: 2708897 - RNA, 17 nt, Human
cagcuccagcucaccag

SEQ ID NO: 2708898 - RNA, 18 nt, Human
cagcuccagcucaccagc

SEQ ID NO: 2708899 - RNA, 20 nt, Human
cagcuccagcucaccagccc

SEQ ID NO: 2708900 - RNA, 13 nt, Human
cagcuccagcuca

SEQ ID NO: 2708901 - RNA, 19 nt, Human
cagcuccaagaauuucuag

SEQ ID NO: 2708902 - RNA, 14 nt, Human
cagcuccagcucac

SEQ ID NO: 2708903 - RNA, 15 nt, Human
cagcuccagcucacc

SEQ ID NO: 2708904 - RNA, 16 nt, Human
cagcuccaagaauuuc

SEQ ID NO: 2708905 - RNA, 15 nt, Human
cagcccuucuuucca

SEQ ID NO: 2708906 - RNA, 19 nt, Human
cagcccuucuuuccacaga

SEQ ID NO: 2708907 - RNA, 20 nt, Human
cagcccuucuuuccacagaa

SEQ ID NO: 2708908 - RNA, 20 nt, Human
cagccgagauagccaaggcc

SEQ ID NO: 2708909 - RNA, 21 nt, Human
cagccgagauagccaaggcca

SEQ ID NO: 2708910 - RNA, 15 nt, Human
cagcccuuagcaggg

SEQ ID NO: 2708911 - RNA, 16 nt, Human
cagcccuuagcaggga

SEQ ID NO: 2708912 - RNA, 21 nt, Human
cagcccuuagcagggaaacag

SEQ ID NO: 2708913 - RNA, 17 nt, Human
cagccccuggaugcagc

SEQ ID NO: 2708914 - RNA, 18 nt, Human
cagccccuggaugcagcc

SEQ ID NO: 2708915 - RNA, 19 nt, Human
cagccccuggaugcagccu

SEQ ID NO: 2708916 - RNA, 21 nt, Human
cagccccuggaugcagccuca

SEQ ID NO: 2708917 - RNA, 12 nt, Human
cagccccuggau

SEQ ID NO: 2708918 - RNA, 13 nt, Human
cagccccuggaug

SEQ ID NO: 2708919 - RNA, 14 nt, Human
cagccccuggaugc

SEQ ID NO: 2708920 - RNA, 15 nt, Human
cagcggggacagcuc

SEQ ID NO: 2708921 - RNA, 14 nt, Human
cagcggggacagcu

SEQ ID NO: 2708922 - RNA, 16 nt, Human
cagcggggacagcucc

SEQ ID NO: 2708923 - RNA, 17 nt, Human
cagcggggacagcuccu

SEQ ID NO: 2708924 - RNA, 22 nt, Human
cagcaguugaaaagacuccaaa

SEQ ID NO: 2708925 - RNA, 23 nt, Human
cagcauauucaggaagcucaggg

SEQ ID NO: 2708926 - RNA, 19 nt, Human
cagcauauucaggaagcuc

SEQ ID NO: 2708927 - RNA, 22 nt, Human
cagcauauucaggaagcucagg

SEQ ID NO: 2708928 - RNA, 17 nt, Human
cagcaguugaaaagacu

SEQ ID NO: 2708929 - RNA, 21 nt, Human
cagcaguugaaaagacuccaa

SEQ ID NO: 2708930 - RNA, 20 nt, Human
cagcaguugaaaagacucca

SEQ ID NO: 2708931 - RNA, 22 nt, Human
cagccagcaguucagagcugcc

SEQ ID NO: 2708932 - RNA, 15 nt, Human
cagccagcaguucag

SEQ ID NO: 2708933 - RNA, 21 nt, Human
cagccagcaguucagagcugc

SEQ ID NO: 2708934 - RNA, 14 nt, Human
cagccagcaguuca

SEQ ID NO: 2708935 - RNA, 22 nt, Human
cagccaggccacaagacccuug

SEQ ID NO: 2708936 - RNA, 12 nt, Human
cagccaggccac

SEQ ID NO: 2708937 - RNA, 13 nt, Human
cagccaggccaca

SEQ ID NO: 2708938 - RNA, 22 nt, Human
cagcacagccucuuagaugcag

SEQ ID NO: 2708939 - RNA, 17 nt, Human
cagagcugcccucuccu

SEQ ID NO: 2708940 - RNA, 13 nt, Human
cagagcugcccuc

SEQ ID NO: 2708941 - RNA, 15 nt, Human
cagagcugcccucuc

SEQ ID NO: 2708942 - RNA, 16 nt, Human
cagagcugccaccugc

SEQ ID NO: 2708943 - RNA, 18 nt, Human
cagagcugccaccugccu

SEQ ID NO: 2708944 - RNA, 20 nt, Human
cagaaguuugagaucagccu

SEQ ID NO: 2708945 - RNA, 23 nt, Human
cagaaguuucugccgcagcccug

SEQ ID NO: 2708946 - RNA, 19 nt, Human
cagaaguuucugccgcagc

SEQ ID NO: 2708947 - RNA, 22 nt, Human
cagaaguuugagaucagccugg

SEQ ID NO: 2708948 - RNA, 23 nt, Human
cagaaguuugagaucagccuggg

SEQ ID NO: 2708949 - RNA, 22 nt, Human
cagagggccugcaagggaguga

SEQ ID NO: 2708950 - RNA, 20 nt, Human
cagagucagaaguuucugcc

SEQ ID NO: 2708951 - RNA, 18 nt, Human
cagaggggguggccuccc

SEQ ID NO: 2708952 - RNA, 17 nt, Human
cagaggggguggccucc

SEQ ID NO: 2708953 - RNA, 19 nt, Human
cagaggggguggccuccca

SEQ ID NO: 2708954 - RNA, 20 nt, Human
cagaggggguggccucccaa

SEQ ID NO: 2708955 - RNA, 19 nt, Human
cagauaugauucaaauguc

SEQ ID NO: 2708956 - RNA, 17 nt, Human
cagauaugauucaaaug

SEQ ID NO: 2708957 - RNA, 16 nt, Human
cagauaugauucaaau

SEQ ID NO: 2708958 - RNA, 15 nt, Human
cagauaugauucaaa

SEQ ID NO: 2708959 - RNA, 22 nt, Human
cagucaccccggccaccugcgg

SEQ ID NO: 2708960 - RNA, 20 nt, Human
cagucaccccggccaccugc

SEQ ID NO: 2708961 - RNA, 19 nt, Human
cagucaccccggccaccug

SEQ ID NO: 2708962 - RNA, 21 nt, Human
caguauuguacaaaguauuaa

SEQ ID NO: 2708963 - RNA, 16 nt, Human
cagguuuaagcuguua

SEQ ID NO: 2708964 - RNA, 18 nt, Human
cagguuuaagcuguuacu

SEQ ID NO: 2708965 - RNA, 13 nt, Human
caguauuguacaa

SEQ ID NO: 2708966 - RNA, 12 nt, Human
caguauuguaca

SEQ ID NO: 2708967 - RNA, 19 nt, Human
caguauuguacaaaguauu

SEQ ID NO: 2708968 - RNA, 18 nt, Human
caguauuguacaaaguau

SEQ ID NO: 2708969 - RNA, 17 nt, Human
caguauuguacaaagua

SEQ ID NO: 2708970 - RNA, 16 nt, Human
caguauuguacaaagu

SEQ ID NO: 2708971 - RNA, 22 nt, Human
cagggucucacucugucgccca

SEQ ID NO: 2708972 - RNA, 21 nt, Human
cagggucucacucugucgccc

SEQ ID NO: 2708973 - RNA, 17 nt, Human
cagggucucacucuguc

SEQ ID NO: 2708974 - RNA, 18 nt, Human
cagggucucacucugucg

SEQ ID NO: 2708975 - RNA, 12 nt, Human
caggguuggccc

SEQ ID NO: 2708976 - RNA, 16 nt, Human
caggugauccacccac

SEQ ID NO: 2708977 - RNA, 17 nt, Human
caggugauccacccacc

SEQ ID NO: 2708978 - RNA, 14 nt, Human
caggugcgaaagga

SEQ ID NO: 2708979 - RNA, 18 nt, Human
caggugcuaggaacacuc

SEQ ID NO: 2708980 - RNA, 20 nt, Human
caggugcuaggaacacuccu

SEQ ID NO: 2708981 - RNA, 14 nt, Human
cagguugguggggg

SEQ ID NO: 2708982 - RNA, 15 nt, Human
cagucucaggaaauc

SEQ ID NO: 2708983 - RNA, 15 nt, Human
cagugccaaaaacaa

SEQ ID NO: 2708984 - RNA, 11 nt, Human
cagugggagcu

SEQ ID NO: 2708985 - RNA, 12 nt, Human
cagugcccacag

SEQ ID NO: 2708986 - RNA, 22 nt, Human
cagugcacuaauguguaagaca

SEQ ID NO: 2708987 - RNA, 19 nt, Human
cagucugauucccaagcuc

SEQ ID NO: 2708988 - RNA, 20 nt, Human
cagucugauucccaagcucu

SEQ ID NO: 2708989 - RNA, 19 nt, Human
cagugcaugcugucccuua

SEQ ID NO: 2708990 - RNA, 22 nt, Human
cagugcaugcugucccuuacgu

SEQ ID NO: 2708991 - RNA, 23 nt, Human
cagugcaugcugucccuuacgug

SEQ ID NO: 2708992 - RNA, 17 nt, Human
caggcugggcuucagug

SEQ ID NO: 2708993 - RNA, 19 nt, Human
caggcugggcuucaguggc

SEQ ID NO: 2708994 - RNA, 15 nt, Human
caggcuggcgugcag

SEQ ID NO: 2708995 - RNA, 16 nt, Human
caggcugggcuucagu

SEQ ID NO: 2708996 - RNA, 15 nt, Human
caggcugggcuucag

SEQ ID NO: 2708997 - RNA, 22 nt, Human
cagggaguccgaaagggacuug

SEQ ID NO: 2708998 - RNA, 18 nt, Human
cagggaggugaccccagg

SEQ ID NO: 2708999 - RNA, 17 nt, Human
caggaggccagccuuga

SEQ ID NO: 2709000 - RNA, 18 nt, Human
caggcacccaccaucaug

SEQ ID NO: 2709001 - RNA, 22 nt, Human
caggcacccaccaucaugucug

SEQ ID NO: 2709002 - RNA, 23 nt, Human
caggcacccaccaucaugucugg

SEQ ID NO: 2709003 - RNA, 14 nt, Human
caggaggccagccu

SEQ ID NO: 2709004 - RNA, 15 nt, Human
caggaggccagccuu

SEQ ID NO: 2709005 - RNA, 16 nt, Human
caggaggccagccuug

SEQ ID NO: 2709006 - RNA, 23 nt, Human
caggccagagggagugacagagg

SEQ ID NO: 2709007 - RNA, 16 nt, Human
caggccagagggagug

SEQ ID NO: 2709008 - RNA, 19 nt, Human
caggccagagggagugaca

SEQ ID NO: 2709009 - RNA, 21 nt, Human
caggccagagggagugacaga

SEQ ID NO: 2709010 - RNA, 12 nt, Human
cauuaucucaaa

SEQ ID NO: 2709011 - RNA, 23 nt, Human
cauuaucuagauacuguaucaug

SEQ ID NO: 2709012 - RNA, 13 nt, Human
cauuaucucaaaa

SEQ ID NO: 2709013 - RNA, 22 nt, Human
cauuaggugugacugaauuucu

SEQ ID NO: 2709014 - RNA, 12 nt, Human
cauguuggccag

SEQ ID NO: 2709015 - RNA, 13 nt, Human
cauguuggccagg

SEQ ID NO: 2709016 - RNA, 18 nt, Human
cauguccaagaagcccag

SEQ ID NO: 2709017 - RNA, 19 nt, Human
cauguccaagaagcccagg

SEQ ID NO: 2709018 - RNA, 20 nt, Human
cauguccaagaagcccagga

SEQ ID NO: 2709019 - RNA, 12 nt, Human
cauuccuguucc

SEQ ID NO: 2709020 - RNA, 14 nt, Human
caugcugcccugug

SEQ ID NO: 2709021 - RNA, 15 nt, Human
caugcugcccuguga

SEQ ID NO: 2709022 - RNA, 23 nt, Human
caugacacgaauauugcugaugg

SEQ ID NO: 2709023 - RNA, 21 nt, Human
caugacacgaauauugcugau

SEQ ID NO: 2709024 - RNA, 23 nt, Human
caugaaguaauaugcacacauuu

SEQ ID NO: 2709025 - RNA, 22 nt, Human
caugaaguaauaugcacacauu

SEQ ID NO: 2709026 - RNA, 19 nt, Human
caugaaguaauaugcacac

SEQ ID NO: 2709027 - RNA, 15 nt, Human
caugaaguaauaugc

SEQ ID NO: 2709028 - RNA, 16 nt, Human
caugcacgugugugca

SEQ ID NO: 2709029 - RNA, 13 nt, Human
caugcuccuggcc

SEQ ID NO: 2709030 - RNA, 12 nt, Human
caugcugcccug

SEQ ID NO: 2709031 - RNA, 13 nt, Human
caugcugcccugu

SEQ ID NO: 2709032 - RNA, 24 nt, Human
caugauuaaccacuucagcugacu

SEQ ID NO: 2709033 - RNA, 22 nt, Human
caugauuaaccacuucagcuga

SEQ ID NO: 2709034 - RNA, 23 nt, Human
caugauuaaccacuucagcugac

SEQ ID NO: 2709035 - RNA, 13 nt, Human
cauaauuuauaca

SEQ ID NO: 2709036 - RNA, 20 nt, Human
cauaauuuauacaggucaua

SEQ ID NO: 2709037 - RNA, 19 nt, Human
cauagcagagaaugaaagg

SEQ ID NO: 2709038 - RNA, 22 nt, Human
cauagcagagaaugaaagggcc

SEQ ID NO: 2709039 - RNA, 22 nt, Human
cauaugccugggcagaaggaag

SEQ ID NO: 2709040 - RNA, 15 nt, Human
cauaugccugggcag

SEQ ID NO: 2709041 - RNA, 20 nt, Human
cauaugccugggcagaagga

SEQ ID NO: 2709042 - RNA, 22 nt, Human
cauauucaggaagcucagggcc

SEQ ID NO: 2709043 - RNA, 20 nt, Human
cauauucaggaagcucaggg

SEQ ID NO: 2709044 - RNA, 14 nt, Human
cauauucaggaagc

SEQ ID NO: 2709045 - RNA, 15 nt, Human
cauauucaggaagcu

SEQ ID NO: 2709046 - RNA, 14 nt, Human
cauccccuguagag

SEQ ID NO: 2709047 - RNA, 19 nt, Human
caucccauaugccugggca

SEQ ID NO: 2709048 - RNA, 17 nt, Human
caucccagccccaauga

SEQ ID NO: 2709049 - RNA, 14 nt, Human
caucaggccaggcc

SEQ ID NO: 2709050 - RNA, 16 nt, Human
caucaggccaggcccu

SEQ ID NO: 2709051 - RNA, 19 nt, Human
caucaggccaggcccucug

SEQ ID NO: 2709052 - RNA, 15 nt, Human
caucaggccaggccc

SEQ ID NO: 2709053 - RNA, 16 nt, Human
ccacagaagcuccagg

SEQ ID NO: 2709054 - RNA, 18 nt, Human
ccaccagucugacuguuu

SEQ ID NO: 2709055 - RNA, 18 nt, Human
ccacagaagcuccaggua

SEQ ID NO: 2709056 - RNA, 22 nt, Human
ccacagagaaaguacuucucca

SEQ ID NO: 2709057 - RNA, 18 nt, Human
ccacgcuggaccuugaac

SEQ ID NO: 2709058 - RNA, 18 nt, Human
ccaccuuggcugcaggga

SEQ ID NO: 2709059 - RNA, 19 nt, Human
ccaccuuggcugcagggag

SEQ ID NO: 2709060 - RNA, 12 nt, Human
ccaccuuggcug

SEQ ID NO: 2709061 - RNA, 14 nt, Human
ccaccuuggcugca

SEQ ID NO: 2709062 - RNA, 15 nt, Human
ccaccuuggcugcag

SEQ ID NO: 2709063 - RNA, 16 nt, Human
ccaccuuggcugcagg

SEQ ID NO: 2709064 - RNA, 18 nt, Human
ccaccaucaccagacagg

SEQ ID NO: 2709065 - RNA, 19 nt, Human
ccaccaucaugucuggcua

SEQ ID NO: 2709066 - RNA, 18 nt, Human
ccaccaucaugucuggcu

SEQ ID NO: 2709067 - RNA, 14 nt, Human
ccaagaagcccagg

SEQ ID NO: 2709068 - RNA, 12 nt, Human
ccaagcuggucc

SEQ ID NO: 2709069 - RNA, 19 nt, Human
ccaagcuggucccacucag

SEQ ID NO: 2709070 - RNA, 15 nt, Human
ccaaggccaaaggaa

SEQ ID NO: 2709071 - RNA, 22 nt, Human
ccaaauggaaaugggcagagca

SEQ ID NO: 2709072 - RNA, 13 nt, Human
ccaacgucugugc

SEQ ID NO: 2709073 - RNA, 15 nt, Human
ccaacgucugugcca

SEQ ID NO: 2709074 - RNA, 13 nt, Human
ccaagaagcccag

SEQ ID NO: 2709075 - RNA, 16 nt, Human
ccaaggccaaaggaag

SEQ ID NO: 2709076 - RNA, 19 nt, Human
cauuuuuuaaaugcaccug

SEQ ID NO: 2709077 - RNA, 16 nt, Human
cauuuuuuaaaugcac

SEQ ID NO: 2709078 - RNA, 15 nt, Human
cauuuuuuaaaugca

SEQ ID NO: 2709079 - RNA, 14 nt, Human
cauuuauucugcuc

SEQ ID NO: 2709080 - RNA, 15 nt, Human
cauuuauucugcuca

SEQ ID NO: 2709081 - RNA, 22 nt, Human
cauuuggaaaucuuuaaaaaaa

SEQ ID NO: 2709082 - RNA, 21 nt, Human
cauuuggagacacaacuauuu

SEQ ID NO: 2709083 - RNA, 15 nt, Human
cauuuggauuggaug

SEQ ID NO: 2709084 - RNA, 17 nt, Human
cauuugucacacacuuu

SEQ ID NO: 2709085 - RNA, 19 nt, Human
cauuguaaauaguauuuga

SEQ ID NO: 2709086 - RNA, 16 nt, Human
auuuaauaaaugugcc

SEQ ID NO: 2709087 - RNA, 21 nt, Human
auuuaaugaaagacuguacaa

SEQ ID NO: 2709088 - RNA, 20 nt, Human
auuuaaugaaagacuguaca

SEQ ID NO: 2709089 - RNA, 15 nt, Human
auuuaaugaaagacu

SEQ ID NO: 2709090 - RNA, 16 nt, Human
auuuaaugaaagacug

SEQ ID NO: 2709091 - RNA, 14 nt, Human
auuucuaugaaaua

SEQ ID NO: 2709092 - RNA, 18 nt, Human
auuucuauauuuucauuc

SEQ ID NO: 2709093 - RNA, 17 nt, Human
auuucuauauuuucauu

SEQ ID NO: 2709094 - RNA, 16 nt, Human
auuucauaugcuguau

SEQ ID NO: 2709095 - RNA, 16 nt, Human
auuucuauauuuucau

SEQ ID NO: 2709096 - RNA, 15 nt, Human
auuucuauauuuuca

SEQ ID NO: 2709097 - RNA, 20 nt, Human
auuucauaccuaucaucuua

SEQ ID NO: 2709098 - RNA, 22 nt, Human
auuucuaugcugaguuugugcu

SEQ ID NO: 2709099 - RNA, 21 nt, Human
auuucuaugcugaguuugugc

SEQ ID NO: 2709100 - RNA, 19 nt, Human
auuucuaugcugaguuugu

SEQ ID NO: 2709101 - RNA, 19 nt, Human
auuucuauauuuucauucu

SEQ ID NO: 2709102 - RNA, 15 nt, Human
auuguuuaaaaucau

SEQ ID NO: 2709103 - RNA, 16 nt, Human
auuguugucugcaacu

SEQ ID NO: 2709104 - RNA, 17 nt, Human
auuguguugugaauguu

SEQ ID NO: 2709105 - RNA, 14 nt, Human
auuguguugugaau

SEQ ID NO: 2709106 - RNA, 19 nt, Human
auuguacaaaguauuaagc

SEQ ID NO: 2709107 - RNA, 17 nt, Human
auuguacaaaguauuaa

SEQ ID NO: 2709108 - RNA, 16 nt, Human
auuguacaaaguauua

SEQ ID NO: 2709109 - RNA, 21 nt, Human
auuguaauuauaucugaggaa

SEQ ID NO: 2709110 - RNA, 15 nt, Human
auuguaauuauaucu

SEQ ID NO: 2709111 - RNA, 17 nt, Human
auuguaauuauaucuga

SEQ ID NO: 2709112 - RNA, 16 nt, Human
auuguaauuauaucug

SEQ ID NO: 2709113 - RNA, 19 nt, Human
auuaugaauuacauuugua

SEQ ID NO: 2709114 - RNA, 20 nt, Human
auuaugaauuacauuuguau

SEQ ID NO: 2709115 - RNA, 22 nt, Human
auuaugaauuacauuuguauaa

SEQ ID NO: 2709116 - RNA, 17 nt, Human
auuaaaugcccagcccc

SEQ ID NO: 2709117 - RNA, 19 nt, Human
auuaaaugcccagccccuu

SEQ ID NO: 2709118 - RNA, 18 nt, Human
auucaaauguauuacagu

SEQ ID NO: 2709119 - RNA, 18 nt, Human
auucaacagguuuuccug

SEQ ID NO: 2709120 - RNA, 16 nt, Human
auucaaaugucuauaa

SEQ ID NO: 2709121 - RNA, 17 nt, Human
auucuccuuguguuacu

SEQ ID NO: 2709122 - RNA, 19 nt, Human
auucuccuuguguuacuaa

SEQ ID NO: 2709123 - RNA, 18 nt, Human
auucuccuuguguuacua

SEQ ID NO: 2709124 - RNA, 18 nt, Human
auucucuaguuugauuaa

SEQ ID NO: 2709125 - RNA, 17 nt, Human
auucucuaguuugauua

SEQ ID NO: 2709126 - RNA, 22 nt, Human
auucuccuuguguuacuaaguu

SEQ ID NO: 2709127 - RNA, 21 nt, Human
auucuccuuguguuacuaagu

SEQ ID NO: 2709128 - RNA, 19 nt, Human
auucuucugcuucagccuc

SEQ ID NO: 2709129 - RNA, 20 nt, Human
auucuucugcuucagccucc

SEQ ID NO: 2709130 - RNA, 22 nt, Human
auucuucuguacgucugacagg

SEQ ID NO: 2709131 - RNA, 14 nt, Human
auucuugcaaagua

SEQ ID NO: 2709132 - RNA, 16 nt, Human
auucuugcaaaguauc

SEQ ID NO: 2709133 - RNA, 15 nt, Human
auucuugcaaaguau

SEQ ID NO: 2709134 - RNA, 21 nt, Human
caaaucuuaacuugaaggagu

SEQ ID NO: 2709135 - RNA, 21 nt, Human
caaaguaucccuacuguaauu

SEQ ID NO: 2709136 - RNA, 19 nt, Human
caaaguaucccuacuguaa

SEQ ID NO: 2709137 - RNA, 22 nt, Human
caaaguagaagucuuagaugua

SEQ ID NO: 2709138 - RNA, 18 nt, Human
caaagggugaaaauuauu

SEQ ID NO: 2709139 - RNA, 22 nt, Human
caaagcagugcaugcugucccu

SEQ ID NO: 2709140 - RNA, 16 nt, Human
caaagauauuuugcuu

SEQ ID NO: 2709141 - RNA, 14 nt, Human
caaagauauuuugc

SEQ ID NO: 2709142 - RNA, 18 nt, Human
caaagcagugcaugcugu

SEQ ID NO: 2709143 - RNA, 21 nt, Human
caaagcagugcaugcuguccc

SEQ ID NO: 2709144 - RNA, 18 nt, Human
caagaccacguuucuaaa

SEQ ID NO: 2709145 - RNA, 17 nt, Human
caagaccacguuucuaa

SEQ ID NO: 2709146 - RNA, 13 nt, Human
caagaugguucua

SEQ ID NO: 2709147 - RNA, 16 nt, Human
caagaugguucuagca

SEQ ID NO: 2709148 - RNA, 22 nt, Human
caagaauugaagcaggacuaaa

SEQ ID NO: 2709149 - RNA, 14 nt, Human
caacucuccuccag

SEQ ID NO: 2709150 - RNA, 17 nt, Human
caacucauauuuucaug

SEQ ID NO: 2709151 - RNA, 17 nt, Human
caacucaccccagcccc

SEQ ID NO: 2709152 - RNA, 18 nt, Human
caacucaccccagcccca

SEQ ID NO: 2709153 - RNA, 12 nt, Human
auuuuauaucuu

SEQ ID NO: 2709154 - RNA, 19 nt, Human
auuuuagggguagcauuug

SEQ ID NO: 2709155 - RNA, 14 nt, Human
auuuuauaucuugu

SEQ ID NO: 2709156 - RNA, 16 nt, Human
auuuuauaucuuguag

SEQ ID NO: 2709157 - RNA, 14 nt, Human
auuuuuagacagag

SEQ ID NO: 2709158 - RNA, 19 nt, Human
auuuuuaagugcugcauuu

SEQ ID NO: 2709159 - RNA, 18 nt, Human
auuuuuaagugcugcauu

SEQ ID NO: 2709160 - RNA, 16 nt, Human
auuuuuaagugcugca

SEQ ID NO: 2709161 - RNA, 15 nt, Human
auuuuuauauuugaa

SEQ ID NO: 2709162 - RNA, 16 nt, Human
auuuuuauauuuacua

SEQ ID NO: 2709163 - RNA, 15 nt, Human
auuuuuauauuuacu

SEQ ID NO: 2709164 - RNA, 13 nt, Human
auuuuuuuguugu

SEQ ID NO: 2709165 - RNA, 18 nt, Human
auuuuuuuuuccuucagu

SEQ ID NO: 2709166 - RNA, 16 nt, Human
auuuuuuugagacaga

SEQ ID NO: 2709167 - RNA, 20 nt, Human
auuuuuuuuuccuucagugc

SEQ ID NO: 2709168 - RNA, 22 nt, Human
auuuuuuuuuccuucagugccu

SEQ ID NO: 2709169 - RNA, 19 nt, Human
caaaagcugggcagguugg

SEQ ID NO: 2709170 - RNA, 15 nt, Human
caaaccaaauaaaaa

SEQ ID NO: 2709171 - RNA, 14 nt, Human
caaaccaaauaaaa

SEQ ID NO: 2709172 - RNA, 21 nt, Human
caaaaggauaaugaauacuuu

SEQ ID NO: 2709173 - RNA, 15 nt, Human
caaacagucucagga

SEQ ID NO: 2709174 - RNA, 17 nt, Human
caaacagucucaggaaa

SEQ ID NO: 2709175 - RNA, 16 nt, Human
caaacagucucaggaa

SEQ ID NO: 2709176 - RNA, 15 nt, Human
caauaaaauggguuu

SEQ ID NO: 2709177 - RNA, 20 nt, Human
caauaaaauccauacauuug

SEQ ID NO: 2709178 - RNA, 23 nt, Human
caauaaaauccauacauuugugu

SEQ ID NO: 2709179 - RNA, 21 nt, Human
caagucagucauucagauaug

SEQ ID NO: 2709180 - RNA, 21 nt, Human
caaggccaaaggaagcacaug

SEQ ID NO: 2709181 - RNA, 19 nt, Human
caaggccaaaggaagcaca

SEQ ID NO: 2709182 - RNA, 20 nt, Human
caaggccaaaggaagcacau

SEQ ID NO: 2709183 - RNA, 16 nt, Human
caaggcaaggcuguca

SEQ ID NO: 2709184 - RNA, 17 nt, Human
caaggcaaggcugucaa

SEQ ID NO: 2709185 - RNA, 18 nt, Human
caaggcaaggcugucaau

SEQ ID NO: 2709186 - RNA, 17 nt, Human
cacaagagcccaggccu

SEQ ID NO: 2709187 - RNA, 20 nt, Human
cacaagagcccaggccuccu

SEQ ID NO: 2709188 - RNA, 18 nt, Human
cacaagcuccaagcuccc

SEQ ID NO: 2709189 - RNA, 19 nt, Human
cacaagcuccaagcuccca

SEQ ID NO: 2709190 - RNA, 18 nt, Human
cacaagagcccaggccuc

SEQ ID NO: 2709191 - RNA, 19 nt, Human
cacaagagcccaggccucc

SEQ ID NO: 2709192 - RNA, 15 nt, Human
caaugggagcucaug

SEQ ID NO: 2709193 - RNA, 16 nt, Human
caauggcagccuuggc

SEQ ID NO: 2709194 - RNA, 12 nt, Human
caaugcuggcug

SEQ ID NO: 2709195 - RNA, 20 nt, Human
caaugcuggcuguuggcugg

SEQ ID NO: 2709196 - RNA, 21 nt, Human
caaugcuggcuguuggcuggg

SEQ ID NO: 2709197 - RNA, 13 nt, Human
caaugcuggcugu

SEQ ID NO: 2709198 - RNA, 20 nt, Human
cacaagcuccaagcucccag

SEQ ID NO: 2709199 - RNA, 21 nt, Human
cacaagcuccaagcucccagg

SEQ ID NO: 2709200 - RNA, 11 nt, Human
cacacauuuuu

SEQ ID NO: 2709201 - RNA, 10 nt, Human
cacacauuuu

SEQ ID NO: 2709202 - RNA, 20 nt, Human
cacacauuuuuuaaaugcac

SEQ ID NO: 2709203 - RNA, 19 nt, Human
cacacauuuuuuaaaugca

SEQ ID NO: 2709204 - RNA, 16 nt, Human
cacacauuuuuuaaau

SEQ ID NO: 2709205 - RNA, 12 nt, Human
cacacauuuuuu

SEQ ID NO: 2709206 - RNA, 17 nt, Human
cacagcucuucuccagg

SEQ ID NO: 2709207 - RNA, 14 nt, Human
cacagcucuucucc

SEQ ID NO: 2709208 - RNA, 15 nt, Human
cacagcucuucucca

SEQ ID NO: 2709209 - RNA, 15 nt, Human
cacagcucuguccug

SEQ ID NO: 2709210 - RNA, 16 nt, Human
cacagcucuguccugg

SEQ ID NO: 2709211 - RNA, 18 nt, Human
cacagcucuguccuggga

SEQ ID NO: 2709212 - RNA, 11 nt, Human
cacagcucugu

SEQ ID NO: 2709213 - RNA, 14 nt, Human
cacagcucuguccu

SEQ ID NO: 2709214 - RNA, 18 nt, Human
cacagacccugcccugug

SEQ ID NO: 2709215 - RNA, 14 nt, Human
cacagacccugccc

SEQ ID NO: 2709216 - RNA, 16 nt, Human
cacagacccugcccug

SEQ ID NO: 2709217 - RNA, 17 nt, Human
cacagacccugcccugu

SEQ ID NO: 2709218 - RNA, 17 nt, Human
cacauuuuauuuuauua

SEQ ID NO: 2709219 - RNA, 21 nt, Human
cacauuuuauuuuauuaugca

SEQ ID NO: 2709220 - RNA, 20 nt, Human
cacauuuuauuuuauuaugc

SEQ ID NO: 2709221 - RNA, 19 nt, Human
cacauuuuauuuuauuaug

SEQ ID NO: 2709222 - RNA, 14 nt, Human
caccaacgucugug

SEQ ID NO: 2709223 - RNA, 16 nt, Human
caccaacgucugugcc

SEQ ID NO: 2709224 - RNA, 16 nt, Human
cacccaggagccccga

SEQ ID NO: 2709225 - RNA, 18 nt, Human
cacccaccucagccuccc

SEQ ID NO: 2709226 - RNA, 16 nt, Human
caccagccccagugcc

SEQ ID NO: 2709227 - RNA, 13 nt, Human
caccagccccagu

SEQ ID NO: 2709228 - RNA, 17 nt, Human
cacccaccucagccucc

SEQ ID NO: 2709229 - RNA, 22 nt, Human
cacuguuuugaaucucauaauu

SEQ ID NO: 2709230 - RNA, 23 nt, Human
cacuguugcccaggcuggcgugc

SEQ ID NO: 2709231 - RNA, 18 nt, Human
cacuguugcccaggcugg

SEQ ID NO: 2709232 - RNA, 19 nt, Human
cacuguugcccaggcuggc

SEQ ID NO: 2709233 - RNA, 17 nt, Human
cacugccaugccagcuu

SEQ ID NO: 2709234 - RNA, 20 nt, Human
cacugcagccucaaccuccu

SEQ ID NO: 2709235 - RNA, 21 nt, Human
cacugcagccucaaccuccug

SEQ ID NO: 2709236 - RNA, 22 nt, Human
cacugcagccucaaccuccugg

SEQ ID NO: 2709237 - RNA, 23 nt, Human
cacugcagccucaaccuccuggg

SEQ ID NO: 2709238 - RNA, 19 nt, Human
cacugcagccucaaccucc

SEQ ID NO: 2709239 - RNA, 14 nt, Human
cacugcagccucaa

SEQ ID NO: 2709240 - RNA, 17 nt, Human
cacuuguguuuugcaag

SEQ ID NO: 2709241 - RNA, 18 nt, Human
cacuuguguuaugaagca

SEQ ID NO: 2709242 - RNA, 13 nt, Human
cacuuucuagcca

SEQ ID NO: 2709243 - RNA, 16 nt, Human
cacuuucuagccagag

SEQ ID NO: 2709244 - RNA, 17 nt, Human
cacuuucuagccagagg

SEQ ID NO: 2709245 - RNA, 14 nt, Human
cagaaguuucugcc

SEQ ID NO: 2709246 - RNA, 16 nt, Human
cagaaguuucugccgc

SEQ ID NO: 2709247 - RNA, 16 nt, Human
cagaaauguacagcaa

SEQ ID NO: 2709248 - RNA, 16 nt, Human
cagaaaguuauugaua

SEQ ID NO: 2709249 - RNA, 11 nt, Human
cagaaaguuau

SEQ ID NO: 2709250 - RNA, 21 nt, Human
cacuacauucuguuaaucauu

SEQ ID NO: 2709251 - RNA, 17 nt, Human
cacuacauucuguuaau

SEQ ID NO: 2709252 - RNA, 16 nt, Human
cacuacauucuguuaa

SEQ ID NO: 2709253 - RNA, 13 nt, Human
cacuccagccugg

SEQ ID NO: 2709254 - RNA, 14 nt, Human
cacuccagccuggg

SEQ ID NO: 2709255 - RNA, 20 nt, Human
cacucugucgcccagucugg

SEQ ID NO: 2709256 - RNA, 15 nt, Human
cacggcucacugcag

SEQ ID NO: 2709257 - RNA, 14 nt, Human
cacggcucacugca

SEQ ID NO: 2709258 - RNA, 17 nt, Human
cacggccaggccagagg

SEQ ID NO: 2709259 - RNA, 12 nt, Human
cacggccaggcc

SEQ ID NO: 2709260 - RNA, 13 nt, Human
cacggccaggcca

SEQ ID NO: 2709261 - RNA, 20 nt, Human
cacucuuauugcccacgcug

SEQ ID NO: 2709262 - RNA, 21 nt, Human
cacucuuauugcccacgcugg

SEQ ID NO: 2709263 - RNA, 22 nt, Human
cacucuuauugcccacgcugga

SEQ ID NO: 2709264 - RNA, 12 nt, Human
caccucagccuc

SEQ ID NO: 2709265 - RNA, 14 nt, Human
caccuuucccaucu

SEQ ID NO: 2709266 - RNA, 18 nt, Human
caccuuggcugcagggag

SEQ ID NO: 2709267 - RNA, 15 nt, Human
caccuuggcugcagg

SEQ ID NO: 2709268 - RNA, 16 nt, Human
caccuuggcugcaggg

SEQ ID NO: 2709269 - RNA, 12 nt, Human
gcccccacuggu

SEQ ID NO: 2709270 - RNA, 17 nt, Human
gccccugccacccuggg

SEQ ID NO: 2709271 - RNA, 16 nt, Human
gccccugccacccugg

SEQ ID NO: 2709272 - RNA, 23 nt, Human
gcccgggcucugccucccaucac

SEQ ID NO: 2709273 - RNA, 20 nt, Human
gccuaggugacagagugaga

SEQ ID NO: 2709274 - RNA, 20 nt, Human
gccuagcauacguacacauu

SEQ ID NO: 2709275 - RNA, 22 nt, Human
gccuagcauacguacacauuuu

SEQ ID NO: 2709276 - RNA, 21 nt, Human
gccuagcauacguacacauuu

SEQ ID NO: 2709277 - RNA, 23 nt, Human
gccuagcauacguacacauuuua

SEQ ID NO: 2709278 - RNA, 13 nt, Human
gccuaggugacag

SEQ ID NO: 2709279 - RNA, 14 nt, Human
gccuaggugacaga

SEQ ID NO: 2709280 - RNA, 15 nt, Human
gccuaggugacagag

SEQ ID NO: 2709281 - RNA, 19 nt, Human
gccgcagcccugcagaggg

SEQ ID NO: 2709282 - RNA, 20 nt, Human
gccgcagcccugcagagggc

SEQ ID NO: 2709283 - RNA, 22 nt, Human
gcccuuagcagggaaacagcua

SEQ ID NO: 2709284 - RNA, 12 nt, Human
gcccugccuccu

SEQ ID NO: 2709285 - RNA, 13 nt, Human
gcccugccuccuu

SEQ ID NO: 2709286 - RNA, 19 nt, Human
gcccuuagcagggaaacag

SEQ ID NO: 2709287 - RNA, 20 nt, Human
gcccuuagcagggaaacagc

SEQ ID NO: 2709288 - RNA, 16 nt, Human
gcccugcagagggcac

SEQ ID NO: 2709289 - RNA, 18 nt, Human
gcccugcagagggcacag

SEQ ID NO: 2709290 - RNA, 11 nt, Human
gcccugccucc

SEQ ID NO: 2709291 - RNA, 17 nt, Human
gcccugcccaccuggcc

SEQ ID NO: 2709292 - RNA, 20 nt, Human
gcccugcccaccuggccucu

SEQ ID NO: 2709293 - RNA, 21 nt, Human
gcccugcccaccuggccucug

SEQ ID NO: 2709294 - RNA, 22 nt, Human
gcccugcccaccuggccucugc

SEQ ID NO: 2709295 - RNA, 22 nt, Human
gccugcccaggccccugccacc

SEQ ID NO: 2709296 - RNA, 15 nt, Human
gccugcccaggcccc

SEQ ID NO: 2709297 - RNA, 20 nt, Human
gccugcccaggccccugcca

SEQ ID NO: 2709298 - RNA, 15 nt, Human
gccucuuagaugcag

SEQ ID NO: 2709299 - RNA, 16 nt, Human
gccucuuaugggcugg

SEQ ID NO: 2709300 - RNA, 17 nt, Human
gccucuuaugggcuggg

SEQ ID NO: 2709301 - RNA, 18 nt, Human
gccucuuaugggcugggu

SEQ ID NO: 2709302 - RNA, 20 nt, Human
gccucgaacuggcugcaaag

SEQ ID NO: 2709303 - RNA, 22 nt, Human
gccucgaacuggcugcaaaggg

SEQ ID NO: 2709304 - RNA, 13 nt, Human
gccugcccaggcc

SEQ ID NO: 2709305 - RNA, 14 nt, Human
gccugcccaggccc

SEQ ID NO: 2709306 - RNA, 14 nt, Human
gccucuuggguuca

SEQ ID NO: 2709307 - RNA, 21 nt, Human
gccucuuaugggcuggguucu

SEQ ID NO: 2709308 - RNA, 17 nt, Human
gccucgaacuggcugca

SEQ ID NO: 2709309 - RNA, 19 nt, Human
gccuccugugugugcgccu

SEQ ID NO: 2709310 - RNA, 23 nt, Human
gccuccugugugugcgccuacag

SEQ ID NO: 2709311 - RNA, 16 nt, Human
gccucccaaagugcug

SEQ ID NO: 2709312 - RNA, 17 nt, Human
gccucccaaagugcugg

SEQ ID NO: 2709313 - RNA, 22 nt, Human
gcgaucuggguucacugcaacc

SEQ ID NO: 2709314 - RNA, 20 nt, Human
gccuugaccauucuccaccu

SEQ ID NO: 2709315 - RNA, 17 nt, Human
gccuugaccauucucca

SEQ ID NO: 2709316 - RNA, 19 nt, Human
gccuugaccauucuccacc

SEQ ID NO: 2709317 - RNA, 17 nt, Human
gcgagcccugguggcag

SEQ ID NO: 2709318 - RNA, 15 nt, Human
gcgagcccugguggc

SEQ ID NO: 2709319 - RNA, 20 nt, Human
gccuggccugagcugggaug

SEQ ID NO: 2709320 - RNA, 13 nt, Human
gccuggccugagc

SEQ ID NO: 2709321 - RNA, 14 nt, Human
gccuggccugagcu

SEQ ID NO: 2709322 - RNA, 18 nt, Human
gccuggccugagcuggga

SEQ ID NO: 2709323 - RNA, 18 nt, Human
gccugugccucugggacu

SEQ ID NO: 2709324 - RNA, 17 nt, Human
gccugugccucugggac

SEQ ID NO: 2709325 - RNA, 16 nt, Human
gccugugccucuggga

SEQ ID NO: 2709326 - RNA, 13 nt, Human
gccuggcucaggu

SEQ ID NO: 2709327 - RNA, 14 nt, Human
gccuguugggccag

SEQ ID NO: 2709328 - RNA, 15 nt, Human
gccuguugggccagg

SEQ ID NO: 2709329 - RNA, 16 nt, Human
gccuguugggccagga

SEQ ID NO: 2709330 - RNA, 18 nt, Human
gccuguugggccaggagc

SEQ ID NO: 2709331 - RNA, 20 nt, Human
gccuguugggccaggagccu

SEQ ID NO: 2709332 - RNA, 23 nt, Human
gcucugcaagaauugaagcagga

SEQ ID NO: 2709333 - RNA, 23 nt, Human
gcucugaucauccacugugccau

SEQ ID NO: 2709334 - RNA, 17 nt, Human
gcucugaucauccacug

SEQ ID NO: 2709335 - RNA, 11 nt, Human
gcucugcccuu

SEQ ID NO: 2709336 - RNA, 21 nt, Human
gcuccccucggagaagagcug

SEQ ID NO: 2709337 - RNA, 14 nt, Human
gcuccuggcccacu

SEQ ID NO: 2709338 - RNA, 15 nt, Human
gcuccuggcccacug

SEQ ID NO: 2709339 - RNA, 20 nt, Human
gcuccuggcccacugcaucg

SEQ ID NO: 2709340 - RNA, 18 nt, Human
gcuccuggcccacugcau

SEQ ID NO: 2709341 - RNA, 19 nt, Human
gcuccuggcccacugcauc

SEQ ID NO: 2709342 - RNA, 18 nt, Human
gcuccagcucaccagccc

SEQ ID NO: 2709343 - RNA, 20 nt, Human
gcuccagcucaccagcccca

SEQ ID NO: 2709344 - RNA, 21 nt, Human
gcuccagcucaccagccccag

SEQ ID NO: 2709345 - RNA, 17 nt, Human
gcucccaggcauucccc

SEQ ID NO: 2709346 - RNA, 16 nt, Human
gcuaggccuggccaga

SEQ ID NO: 2709347 - RNA, 17 nt, Human
gcuaggccuggccagau

SEQ ID NO: 2709348 - RNA, 23 nt, Human
gcuaggccuggccagaugcacca

SEQ ID NO: 2709349 - RNA, 19 nt, Human
gcuauucaguaauaacucu

SEQ ID NO: 2709350 - RNA, 13 nt, Human
gcuaugcauuuga

SEQ ID NO: 2709351 - RNA, 12 nt, Human
gcuaugcauuug

SEQ ID NO: 2709352 - RNA, 21 nt, Human
gcuagugugguguuuccuggc

SEQ ID NO: 2709353 - RNA, 22 nt, Human
gcuagugugguguuuccuggca

SEQ ID NO: 2709354 - RNA, 22 nt, Human
gcuauuucuauauuuucauucu

SEQ ID NO: 2709355 - RNA, 20 nt, Human
gcuauucaguaauaacucua

SEQ ID NO: 2709356 - RNA, 18 nt, Human
gcuauucaguaauaacuc

SEQ ID NO: 2709357 - RNA, 17 nt, Human
gcucacugcagccucaa

SEQ ID NO: 2709358 - RNA, 15 nt, Human
gcucacugcagccuc

SEQ ID NO: 2709359 - RNA, 16 nt, Human
gcucacugcagccuca

SEQ ID NO: 2709360 - RNA, 11 nt, Human
gcucacugcag

SEQ ID NO: 2709361 - RNA, 12 nt, Human
gcucacugcagc

SEQ ID NO: 2709362 - RNA, 13 nt, Human
gcucacugcagcc

SEQ ID NO: 2709363 - RNA, 14 nt, Human
gcucacugcagccu

SEQ ID NO: 2709364 - RNA, 13 nt, Human
gcucagagagggu

SEQ ID NO: 2709365 - RNA, 14 nt, Human
gcucagagagggug

SEQ ID NO: 2709366 - RNA, 16 nt, Human
gcucaggugucccugc

SEQ ID NO: 2709367 - RNA, 14 nt, Human
gcucaggugucccu

SEQ ID NO: 2709368 - RNA, 23 nt, Human
gcucagguggggucacucuggca

SEQ ID NO: 2709369 - RNA, 20 nt, Human
gcgggaggauguucugggac

SEQ ID NO: 2709370 - RNA, 20 nt, Human
gcgugcacacaccagagccc

SEQ ID NO: 2709371 - RNA, 21 nt, Human
gcgggaggauguucugggaca

SEQ ID NO: 2709372 - RNA, 22 nt, Human
gcgggaggauguucugggacac

SEQ ID NO: 2709373 - RNA, 19 nt, Human
gcgugcacacaccagagcc

SEQ ID NO: 2709374 - RNA, 23 nt, Human
gcgugcacacaccagagcccacc

SEQ ID NO: 2709375 - RNA, 18 nt, Human
gcguuucuaugacacaug

SEQ ID NO: 2709376 - RNA, 15 nt, Human
gcuaaugggacacua

SEQ ID NO: 2709377 - RNA, 13 nt, Human
gcuaaugggacac

SEQ ID NO: 2709378 - RNA, 23 nt, Human
gcuaagugauccucccaccucag

SEQ ID NO: 2709379 - RNA, 22 nt, Human
gcuuccucauaguaugguggcu

SEQ ID NO: 2709380 - RNA, 14 nt, Human
gcuugagcucagga

SEQ ID NO: 2709381 - RNA, 20 nt, Human
gcuuguaaauagcucaggug

SEQ ID NO: 2709382 - RNA, 12 nt, Human
gcuuguacauaa

SEQ ID NO: 2709383 - RNA, 19 nt, Human
gcuucacggaagagccuug

SEQ ID NO: 2709384 - RNA, 18 nt, Human
gcuucacggaagagccuu

SEQ ID NO: 2709385 - RNA, 12 nt, Human
gcuucagccucc

SEQ ID NO: 2709386 - RNA, 18 nt, Human
gcuucaaggauccugagc

SEQ ID NO: 2709387 - RNA, 19 nt, Human
gcuucaaggauccugagcc

SEQ ID NO: 2709388 - RNA, 17 nt, Human
gcuucacggaagagccu

SEQ ID NO: 2709389 - RNA, 15 nt, Human
gcuucacggaagagc

SEQ ID NO: 2709390 - RNA, 20 nt, Human
gcuucaaggauccugagcca

SEQ ID NO: 2709391 - RNA, 21 nt, Human
gcuucaaggauccugagccag

SEQ ID NO: 2709392 - RNA, 20 nt, Human
gcuggcgugcaguggugcga

SEQ ID NO: 2709393 - RNA, 18 nt, Human
gcuggagugcagugagcc

SEQ ID NO: 2709394 - RNA, 17 nt, Human
gcuggagugcagugagc

SEQ ID NO: 2709395 - RNA, 22 nt, Human
gcuggagugcagugagccgaga

SEQ ID NO: 2709396 - RNA, 20 nt, Human
gcuggccuggccccucaggg

SEQ ID NO: 2709397 - RNA, 13 nt, Human
gcucugcccuugg

SEQ ID NO: 2709398 - RNA, 15 nt, Human
gcucugguccauaga

SEQ ID NO: 2709399 - RNA, 16 nt, Human
gcucugguccauagag

SEQ ID NO: 2709400 - RNA, 13 nt, Human
gcugcugaaggcu

SEQ ID NO: 2709401 - RNA, 14 nt, Human
gcugcugaaggcuc

SEQ ID NO: 2709402 - RNA, 15 nt, Human
gcugcugaaggcucg

SEQ ID NO: 2709403 - RNA, 13 nt, Human
gcugcuggcuggu

SEQ ID NO: 2709404 - RNA, 21 nt, Human
gcuggguggcaccagcagccu

SEQ ID NO: 2709405 - RNA, 22 nt, Human
gcuggguggcaccagcagccug

SEQ ID NO: 2709406 - RNA, 23 nt, Human
gcuggguggcaccagcagccugg

SEQ ID NO: 2709407 - RNA, 14 nt, Human
gcugggguuaucug

SEQ ID NO: 2709408 - RNA, 23 nt, Human
gcugggguuaucugaagucagau

SEQ ID NO: 2709409 - RNA, 22 nt, Human
gcugggguuaucugaagucaga

SEQ ID NO: 2709410 - RNA, 15 nt, Human
gcuggcuguuggcug

SEQ ID NO: 2709411 - RNA, 16 nt, Human
gcuggcuguuggcugg

SEQ ID NO: 2709412 - RNA, 15 nt, Human
ggaagccgcuggggc

SEQ ID NO: 2709413 - RNA, 19 nt, Human
ggaaggaaacccagcucug

SEQ ID NO: 2709414 - RNA, 20 nt, Human
ggaaggaaacccagcucugg

SEQ ID NO: 2709415 - RNA, 11 nt, Human
ggaagcuccgc

SEQ ID NO: 2709416 - RNA, 15 nt, Human
ggaagcucagggccu

SEQ ID NO: 2709417 - RNA, 23 nt, Human
ggaagcucagggccuggcucagg

SEQ ID NO: 2709418 - RNA, 16 nt, Human
ggaaggaaacccagcu

SEQ ID NO: 2709419 - RNA, 17 nt, Human
ggacacuaaccacgcug

SEQ ID NO: 2709420 - RNA, 22 nt, Human
ggacacuaaccacgcuggaccu

SEQ ID NO: 2709421 - RNA, 19 nt, Human
ggacagcuccuucuguccu

SEQ ID NO: 2709422 - RNA, 20 nt, Human
ggacagcuccuucuguccua

SEQ ID NO: 2709423 - RNA, 14 nt, Human
ggacacagcucuuc

SEQ ID NO: 2709424 - RNA, 21 nt, Human
ggacacagcucuucuccaggc

SEQ ID NO: 2709425 - RNA, 15 nt, Human
ggacacagcucuucu

SEQ ID NO: 2709426 - RNA, 18 nt, Human
ggacacagcucuucucca

SEQ ID NO: 2709427 - RNA, 19 nt, Human
ggaaugaagauacugaaau

SEQ ID NO: 2709428 - RNA, 13 nt, Human
ggacaagagcagg

SEQ ID NO: 2709429 - RNA, 22 nt, Human
ggacaaggaugaucuaggaaga

SEQ ID NO: 2709430 - RNA, 23 nt, Human
ggacaaggaugaucuaggaagac

SEQ ID NO: 2709431 - RNA, 16 nt, Human
ggaauccagacccggc

SEQ ID NO: 2709432 - RNA, 18 nt, Human
ggaauaacauguaauuaa

SEQ ID NO: 2709433 - RNA, 15 nt, Human
ggaagagaaaaaaua

SEQ ID NO: 2709434 - RNA, 13 nt, Human
ggaagagaaaaaa

SEQ ID NO: 2709435 - RNA, 18 nt, Human
ggaagacuuuggaaagag

SEQ ID NO: 2709436 - RNA, 22 nt, Human
ggaagacaaugugaaaagaaaa

SEQ ID NO: 2709437 - RNA, 13 nt, Human
ggaagacagcucu

SEQ ID NO: 2709438 - RNA, 14 nt, Human
ggaagacagcucuu

SEQ ID NO: 2709439 - RNA, 12 nt, Human
ggaagacuuugg

SEQ ID NO: 2709440 - RNA, 13 nt, Human
ggaagacuuugga

SEQ ID NO: 2709441 - RNA, 17 nt, Human
ggaagacuuuggaaaga

SEQ ID NO: 2709442 - RNA, 15 nt, Human
ggaacacucugagac

SEQ ID NO: 2709443 - RNA, 16 nt, Human
ggaacacucugagacu

SEQ ID NO: 2709444 - RNA, 12 nt, Human
ggaacacucuga

SEQ ID NO: 2709445 - RNA, 14 nt, Human
ggaacacucugaga

SEQ ID NO: 2709446 - RNA, 12 nt, Human
ggacccccugaa

SEQ ID NO: 2709447 - RNA, 11 nt, Human
ggacccugagg

SEQ ID NO: 2709448 - RNA, 12 nt, Human
ggacccugaggc

SEQ ID NO: 2709449 - RNA, 13 nt, Human
ggacccugaggcc

SEQ ID NO: 2709450 - RNA, 13 nt, Human
ggaccucaggccu

SEQ ID NO: 2709451 - RNA, 20 nt, Human
ggacguguuaugacuccaga

SEQ ID NO: 2709452 - RNA, 14 nt, Human
ggaccucaggccug

SEQ ID NO: 2709453 - RNA, 15 nt, Human
ggaccucaggccugg

SEQ ID NO: 2709454 - RNA, 22 nt, Human
ggacucauuuuaaaaaauggaa

SEQ ID NO: 2709455 - RNA, 16 nt, Human
ggacucaaugcacuga

SEQ ID NO: 2709456 - RNA, 18 nt, Human
ggacucaaugcacugaca

SEQ ID NO: 2709457 - RNA, 20 nt, Human
ggacuaacuugucuuuggac

SEQ ID NO: 2709458 - RNA, 15 nt, Human
ggacucaaugcacug

SEQ ID NO: 2709459 - RNA, 14 nt, Human
ggacuacaggugug

SEQ ID NO: 2709460 - RNA, 24 nt, Human
ggacuaacuugucuuuggacccug

SEQ ID NO: 2709461 - RNA, 16 nt, Human
ggagaaaggaagggcu

SEQ ID NO: 2709462 - RNA, 22 nt, Human
ggacuucuuuaauuuuggaauu

SEQ ID NO: 2709463 - RNA, 18 nt, Human
ggacuucuuuaauuuugg

SEQ ID NO: 2709464 - RNA, 21 nt, Human
ggacuucuuuaauuuuggaau

SEQ ID NO: 2709465 - RNA, 15 nt, Human
ggacuuguuagaucu

SEQ ID NO: 2709466 - RNA, 14 nt, Human
ggacuuggaagcuc

SEQ ID NO: 2709467 - RNA, 12 nt, Human
ggacuuguuaga

SEQ ID NO: 2709468 - RNA, 21 nt, Human
ggcaguggugguuuucuguuc

SEQ ID NO: 2709469 - RNA, 20 nt, Human
ggcaguggugguuuucuguu

SEQ ID NO: 2709470 - RNA, 22 nt, Human
ggcagccccuguucuggcagag

SEQ ID NO: 2709471 - RNA, 16 nt, Human
ggagagaagagaaugc

SEQ ID NO: 2709472 - RNA, 21 nt, Human
ggcacaguuuucugagaaaga

SEQ ID NO: 2709473 - RNA, 23 nt, Human
ggcacagaaaauggaagacagcu

SEQ ID NO: 2709474 - RNA, 23 nt, Human
ggcacucagaagacacugauggg

SEQ ID NO: 2709475 - RNA, 20 nt, Human
ggcacucagaagacacugau

SEQ ID NO: 2709476 - RNA, 13 nt, Human
ggcacaucagcac

SEQ ID NO: 2709477 - RNA, 19 nt, Human
ggcacagaaaauggaagac

SEQ ID NO: 2709478 - RNA, 20 nt, Human
ggcacagaaaauggaagaca

SEQ ID NO: 2709479 - RNA, 21 nt, Human
ggcacagaaaauggaagacag

SEQ ID NO: 2709480 - RNA, 23 nt, Human
ggcagccccauucugccugccca

SEQ ID NO: 2709481 - RNA, 11 nt, Human
ggcagccccug

SEQ ID NO: 2709482 - RNA, 14 nt, Human
ggccaguugguccc

SEQ ID NO: 2709483 - RNA, 17 nt, Human
ggccaguuggucccccu

SEQ ID NO: 2709484 - RNA, 20 nt, Human
ggccagugugacaaggauug

SEQ ID NO: 2709485 - RNA, 17 nt, Human
ggcauaacauaaaucug

SEQ ID NO: 2709486 - RNA, 16 nt, Human
ggcauaacauaaaucu

SEQ ID NO: 2709487 - RNA, 22 nt, Human
ggcccuucucuccagccccugg

SEQ ID NO: 2709488 - RNA, 23 nt, Human
ggcccuucucuccagccccugga

SEQ ID NO: 2709489 - RNA, 23 nt, Human
ggccucaagugauucuccugccu

SEQ ID NO: 2709490 - RNA, 13 nt, Human
ggccccugcuggu

SEQ ID NO: 2709491 - RNA, 14 nt, Human
ggccccugcugguu

SEQ ID NO: 2709492 - RNA, 13 nt, Human
ggcccggcuccag

SEQ ID NO: 2709493 - RNA, 23 nt, Human
ggccccugcugguucaggguugg

SEQ ID NO: 2709494 - RNA, 15 nt, Human
ggcccggcuccaggc

SEQ ID NO: 2709495 - RNA, 19 nt, Human
ggcccuucucuccagcccc

SEQ ID NO: 2709496 - RNA, 20 nt, Human
ggcccuucucuccagccccu

SEQ ID NO: 2709497 - RNA, 21 nt, Human
ggcccuucucuccagccccug

SEQ ID NO: 2709498 - RNA, 11 nt, Human
ggcucucaggc

SEQ ID NO: 2709499 - RNA, 13 nt, Human
ggcucucaggcca

SEQ ID NO: 2709500 - RNA, 12 nt, Human
ggcucuuccagg

SEQ ID NO: 2709501 - RNA, 22 nt, Human
ggcugcggaaugaaccacaucu

SEQ ID NO: 2709502 - RNA, 21 nt, Human
ggcugccaaugggagcucaug

SEQ ID NO: 2709503 - RNA, 19 nt, Human
ggcugccaaugggagcuca

SEQ ID NO: 2709504 - RNA, 20 nt, Human
ggcugccaaugggagcucau

SEQ ID NO: 2709505 - RNA, 22 nt, Human
ggcugcaugcgggcuuccuccu

SEQ ID NO: 2709506 - RNA, 13 nt, Human
ggcugggagagcc

SEQ ID NO: 2709507 - RNA, 13 nt, Human
ggcugcugaaggc

SEQ ID NO: 2709508 - RNA, 14 nt, Human
ggcugggagagccu

SEQ ID NO: 2709509 - RNA, 15 nt, Human
ggcugggagagccuu

SEQ ID NO: 2709510 - RNA, 16 nt, Human
ggcugggagagccuuc

SEQ ID NO: 2709511 - RNA, 18 nt, Human
ggcucagcggggacagcu

SEQ ID NO: 2709512 - RNA, 19 nt, Human
ggcucagcggggacagcuc

SEQ ID NO: 2709513 - RNA, 20 nt, Human
ggcucagcggggacagcucc

SEQ ID NO: 2709514 - RNA, 19 nt, Human
ggcucagguggggucacuc

SEQ ID NO: 2709515 - RNA, 20 nt, Human
ggcucagguggggucacucu

SEQ ID NO: 2709516 - RNA, 20 nt, Human
gggacagucaccucauggaa

SEQ ID NO: 2709517 - RNA, 21 nt, Human
gggacagucaccucauggaau

SEQ ID NO: 2709518 - RNA, 22 nt, Human
gggacagucaccucauggaauu

SEQ ID NO: 2709519 - RNA, 15 nt, Human
gggacagcuccuucu

SEQ ID NO: 2709520 - RNA, 12 nt, Human
gggacagcuccu

SEQ ID NO: 2709521 - RNA, 13 nt, Human
gggacagcuccuu

SEQ ID NO: 2709522 - RNA, 13 nt, Human
gggaagagacuug

SEQ ID NO: 2709523 - RNA, 20 nt, Human
gggaacccaaguccaagcau

SEQ ID NO: 2709524 - RNA, 18 nt, Human
gggaagaagcucucuccu

SEQ ID NO: 2709525 - RNA, 21 nt, Human
ggcuuccuccugguguggaag

SEQ ID NO: 2709526 - RNA, 14 nt, Human
aaaaauaacaauga

SEQ ID NO: 2709527 - RNA, 15 nt, Human
ggcugggggccucag

SEQ ID NO: 2709528 - RNA, 16 nt, Human
ggcugggggccucagu

SEQ ID NO: 2709529 - RNA, 17 nt, Human
ggcugggggccucagug

SEQ ID NO: 2709530 - RNA, 19 nt, Human
ggcugggggccucagugcc

SEQ ID NO: 2709531 - RNA, 19 nt, Human
ggcuggguggcaccagcag

SEQ ID NO: 2709532 - RNA, 19 nt, Human
ggcuggguucuacccaggu

SEQ ID NO: 2709533 - RNA, 21 nt, Human
ggcuggguucuacccaggugc

SEQ ID NO: 2709534 - RNA, 22 nt, Human
ggcuucauccuccucagaucuu

SEQ ID NO: 2709535 - RNA, 18 nt, Human
ggcuucauccuccucaga

SEQ ID NO: 2709536 - RNA, 16 nt, Human
ggcuuccucauaguau

SEQ ID NO: 2709537 - RNA, 18 nt, Human
ggcuucaguggcagcugc

SEQ ID NO: 2709538 - RNA, 17 nt, Human
ggcuucaguggcagcug

SEQ ID NO: 2709539 - RNA, 19 nt, Human
ggcuucaguggcagcugcu

SEQ ID NO: 2709540 - RNA, 20 nt, Human
ggcuucaguggcagcugcuu

SEQ ID NO: 2709541 - RNA, 18 nt, Human
ggcuguaucccaugagcc

SEQ ID NO: 2709542 - RNA, 15 nt, Human
ggcuguacccaggaa

SEQ ID NO: 2709543 - RNA, 21 nt, Human
aaaagauuuucagaaaauauu

SEQ ID NO: 2709544 - RNA, 18 nt, Human
aaaacucuccucugcugc

SEQ ID NO: 2709545 - RNA, 14 nt, Human
gggaccagagcugc

SEQ ID NO: 2709546 - RNA, 20 nt, Human
gggaccagagcugccaccug

SEQ ID NO: 2709547 - RNA, 14 nt, Human
aaaacaugcuacac

SEQ ID NO: 2709548 - RNA, 13 nt, Human
aaaacaugcuaca

SEQ ID NO: 2709549 - RNA, 12 nt, Human
aaaacccaagug

SEQ ID NO: 2709550 - RNA, 17 nt, Human
aaaaccaguauuguaca

SEQ ID NO: 2709551 - RNA, 21 nt, Human
gggagaaccaaaaagaggcua

SEQ ID NO: 2709552 - RNA, 15 nt, Human
gggacuuggaagcuc

SEQ ID NO: 2709553 - RNA, 17 nt, Human
gggacuuggaagcuccg

SEQ ID NO: 2709554 - RNA, 18 nt, Human
gggacuuggaagcuccgc

SEQ ID NO: 2709555 - RNA, 23 nt, Human
gggacuuggaagcuccgcuuucu

SEQ ID NO: 2709556 - RNA, 23 nt, Human
gggagcaggcucgggcuccccag

SEQ ID NO: 2709557 - RNA, 15 nt, Human
gggagagccuuccag

SEQ ID NO: 2709558 - RNA, 19 nt, Human
gggagagccuuccaggggu

SEQ ID NO: 2709559 - RNA, 16 nt, Human
gggagggagggcucca

SEQ ID NO: 2709560 - RNA, 15 nt, Human
gggagggagggcucc

SEQ ID NO: 2709561 - RNA, 18 nt, Human
gggaggucaaggcugcag

SEQ ID NO: 2709562 - RNA, 11 nt, Human
guagagacagg

SEQ ID NO: 2709563 - RNA, 12 nt, Human
guagagacaggg

SEQ ID NO: 2709564 - RNA, 15 nt, Human
guagagccagggucu

SEQ ID NO: 2709565 - RNA, 18 nt, Human
guagagccagggucucac

SEQ ID NO: 2709566 - RNA, 13 nt, Human
guagagacagggu

SEQ ID NO: 2709567 - RNA, 10 nt, Human
guagagccag

SEQ ID NO: 2709568 - RNA, 11 nt, Human
guagagccagg

SEQ ID NO: 2709569 - RNA, 18 nt, Human
guagaagcccuucuaccu

SEQ ID NO: 2709570 - RNA, 21 nt, Human
guagaagucuuagauguauau

SEQ ID NO: 2709571 - RNA, 23 nt, Human
guagaaauaucugaaaauguaug

SEQ ID NO: 2709572 - RNA, 21 nt, Human
guagaaauaucugaaaaugua

SEQ ID NO: 2709573 - RNA, 20 nt, Human
guagaaauaucugaaaaugu

SEQ ID NO: 2709574 - RNA, 15 nt, Human
guacuucaugcuguc

SEQ ID NO: 2709575 - RNA, 21 nt, Human
guacuucaaauccuugaagau

SEQ ID NO: 2709576 - RNA, 22 nt, Human
guacuucaaauccuugaagauu

SEQ ID NO: 2709577 - RNA, 14 nt, Human
guacuuaacuauuc

SEQ ID NO: 2709578 - RNA, 16 nt, Human
guacuggagaaaaugg

SEQ ID NO: 2709579 - RNA, 17 nt, Human
guacuauguaucaauga

SEQ ID NO: 2709580 - RNA, 15 nt, Human
guacuauguaucaau

SEQ ID NO: 2709581 - RNA, 17 nt, Human
guacuacaguccuccca

SEQ ID NO: 2709582 - RNA, 13 nt, Human
guacuauguauca

SEQ ID NO: 2709583 - RNA, 13 nt, Human
guacccacugcuc

SEQ ID NO: 2709584 - RNA, 14 nt, Human
guacccacugcucu

SEQ ID NO: 2709585 - RNA, 18 nt, Human
guacuacaguccucccau

SEQ ID NO: 2709586 - RNA, 19 nt, Human
guacuacaguccucccauc

SEQ ID NO: 2709587 - RNA, 23 nt, Human
aaaucauuucugcaucagcugcu

SEQ ID NO: 2709588 - RNA, 22 nt, Human
aaaucauuucugcaucagcugc

SEQ ID NO: 2709589 - RNA, 21 nt, Human
aaaucauuucugcaucagcug

SEQ ID NO: 2709590 - RNA, 19 nt, Human
aaaucauuucugcaucagc

SEQ ID NO: 2709591 - RNA, 11 nt, Human
aaaucauuucu

SEQ ID NO: 2709592 - RNA, 12 nt, Human
aaaucauuucug

SEQ ID NO: 2709593 - RNA, 19 nt, Human
aaaucagccguguaaccau

SEQ ID NO: 2709594 - RNA, 12 nt, Human
aaaucagccugc

SEQ ID NO: 2709595 - RNA, 18 nt, Human
aaaucagccugcuccagc

SEQ ID NO: 2709596 - RNA, 16 nt, Human
aaaucagcugcuacua

SEQ ID NO: 2709597 - RNA, 17 nt, Human
aaauauuauguuaaaac

SEQ ID NO: 2709598 - RNA, 14 nt, Human
aaauauuauguguu

SEQ ID NO: 2709599 - RNA, 19 nt, Human
aaauauuaagaaagacuau

SEQ ID NO: 2709600 - RNA, 15 nt, Human
aaauauuauguguuu

SEQ ID NO: 2709601 - RNA, 15 nt, Human
aaauccauacauuug

SEQ ID NO: 2709602 - RNA, 18 nt, Human
aaauccauacauuugugu

SEQ ID NO: 2709603 - RNA, 14 nt, Human
guacaugaaaacac

SEQ ID NO: 2709604 - RNA, 16 nt, Human
guacaugaaaacacau

SEQ ID NO: 2709605 - RNA, 15 nt, Human
guacaugaaaacaca

SEQ ID NO: 2709606 - RNA, 19 nt, Human
guacauggaauaacaugua

SEQ ID NO: 2709607 - RNA, 20 nt, Human
guacaugaaaacacauuuuu

SEQ ID NO: 2709608 - RNA, 19 nt, Human
guacaugaaaacacauuuu

SEQ ID NO: 2709609 - RNA, 18 nt, Human
guacaugaaaacacauuu

SEQ ID NO: 2709610 - RNA, 17 nt, Human
guacaugaaaacacauu

SEQ ID NO: 2709611 - RNA, 12 nt, Human
guacccacugcu

SEQ ID NO: 2709612 - RNA, 15 nt, Human
guacauuuggagaca

SEQ ID NO: 2709613 - RNA, 20 nt, Human
guaauaggcguaacuaauuu

SEQ ID NO: 2709614 - RNA, 15 nt, Human
guaauaacugugaag

SEQ ID NO: 2709615 - RNA, 16 nt, Human
guaauaacugugaagu

SEQ ID NO: 2709616 - RNA, 22 nt, Human
guaauaacugugaaguuuacau

SEQ ID NO: 2709617 - RNA, 18 nt, Human
guaauaugcacacauuuu

SEQ ID NO: 2709618 - RNA, 17 nt, Human
guaauaugcacacauuu

SEQ ID NO: 2709619 - RNA, 16 nt, Human
guaauaugcacacauu

SEQ ID NO: 2709620 - RNA, 14 nt, Human
guaauaugcacaca

SEQ ID NO: 2709621 - RNA, 22 nt, Human
guaauuugugauacaaugcugu

SEQ ID NO: 2709622 - RNA, 23 nt, Human
guacacugccuucucaacuccaa

SEQ ID NO: 2709623 - RNA, 21 nt, Human
aaauaauuuuuauauuugaaa

SEQ ID NO: 2709624 - RNA, 15 nt, Human
aaauacacacucaaa

SEQ ID NO: 2709625 - RNA, 22 nt, Human
aaauacaauuuuguuucuguac

SEQ ID NO: 2709626 - RNA, 21 nt, Human
aaauacaauuuuguuucugua

SEQ ID NO: 2709627 - RNA, 20 nt, Human
aaauacaauuuuguuucugu

SEQ ID NO: 2709628 - RNA, 18 nt, Human
aaauacaauuuuguuucu

SEQ ID NO: 2709629 - RNA, 17 nt, Human
aaauacaauuuuguuuc

SEQ ID NO: 2709630 - RNA, 14 nt, Human
aaauacaauuuugu

SEQ ID NO: 2709631 - RNA, 22 nt, Human
aaauaauuuuuauauuugaaau

SEQ ID NO: 2709632 - RNA, 23 nt, Human
aaauaauuuuuauauuugaaaua

SEQ ID NO: 2709633 - RNA, 13 nt, Human
aaauacaauuuug

SEQ ID NO: 2709634 - RNA, 19 nt, Human
aaauacacacucaaaucaa

SEQ ID NO: 2709635 - RNA, 17 nt, Human
aaauacagauagauaua

SEQ ID NO: 2709636 - RNA, 18 nt, Human
aaauaccagccaguaaau

SEQ ID NO: 2709637 - RNA, 22 nt, Human
aaauacgugggcauucaaaugu

SEQ ID NO: 2709638 - RNA, 14 nt, Human
aaauauaauugaca

SEQ ID NO: 2709639 - RNA, 18 nt, Human
aaaguauguuagugcaaa

SEQ ID NO: 2709640 - RNA, 18 nt, Human
aaaguaucccuacuguaa

SEQ ID NO: 2709641 - RNA, 23 nt, Human
aaaguacuucuccacccugcucu

SEQ ID NO: 2709642 - RNA, 20 nt, Human
aaaguacuucuccacccugc

SEQ ID NO: 2709643 - RNA, 21 nt, Human
aaaguacuucuccacccugcu

SEQ ID NO: 2709644 - RNA, 20 nt, Human
aaaguacacuguuucaaacu

SEQ ID NO: 2709645 - RNA, 19 nt, Human
aaaguacuucuccacccug

SEQ ID NO: 2709646 - RNA, 14 nt, Human
aaaguugccuaaau

SEQ ID NO: 2709647 - RNA, 13 nt, Human
aaaguugccuaaa

SEQ ID NO: 2709648 - RNA, 20 nt, Human
aaaguuauugauaaguucau

SEQ ID NO: 2709649 - RNA, 20 nt, Human
aaaguauuaagcauauauuu

SEQ ID NO: 2709650 - RNA, 19 nt, Human
aaaguauuaagcauauauu

SEQ ID NO: 2709651 - RNA, 17 nt, Human
aaaguauguuagugcaa

SEQ ID NO: 2709652 - RNA, 18 nt, Human
aaaguauuaagcauauau

SEQ ID NO: 2709653 - RNA, 13 nt, Human
aaaguauuaagca

SEQ ID NO: 2709654 - RNA, 14 nt, Human
aaaguuuaauauua

SEQ ID NO: 2709655 - RNA, 12 nt, Human
aaaguuuaauau

SEQ ID NO: 2709656 - RNA, 23 nt, Human
aaaguugccuaaauccauuugga

SEQ ID NO: 2709657 - RNA, 17 nt, Human
aaaguugccuaaaucca

SEQ ID NO: 2709658 - RNA, 16 nt, Human
aaaguugccuaaaucc

SEQ ID NO: 2709659 - RNA, 14 nt, Human
aaauaaaaauauug

SEQ ID NO: 2709660 - RNA, 15 nt, Human
aaagaggcagcuuga

SEQ ID NO: 2709661 - RNA, 19 nt, Human
aaagaugcuucucacugcc

SEQ ID NO: 2709662 - RNA, 17 nt, Human
aaagaugcuucucacug

SEQ ID NO: 2709663 - RNA, 14 nt, Human
aaagaugcuucuca

SEQ ID NO: 2709664 - RNA, 23 nt, Human
aaagacugaguacguugugcauu

SEQ ID NO: 2709665 - RNA, 13 nt, Human
aaagacuguacaa

SEQ ID NO: 2709666 - RNA, 14 nt, Human
aaagacuguacaaa

SEQ ID NO: 2709667 - RNA, 12 nt, Human
gguccugcugca

SEQ ID NO: 2709668 - RNA, 11 nt, Human
gguccugcugc

SEQ ID NO: 2709669 - RNA, 14 nt, Human
aaagacuccaaaga

SEQ ID NO: 2709670 - RNA, 21 nt, Human
aaagacuccaaagaaauguaa

SEQ ID NO: 2709671 - RNA, 15 nt, Human
aaagacuccaaagaa

SEQ ID NO: 2709672 - RNA, 21 nt, Human
aaagacuauucaaacagucuc

SEQ ID NO: 2709673 - RNA, 17 nt, Human
aaagacuauucaaacag

SEQ ID NO: 2709674 - RNA, 22 nt, Human
aaagaccuuuggagcaaagcug

SEQ ID NO: 2709675 - RNA, 19 nt, Human
aaagacuauucaaacaguc

SEQ ID NO: 2709676 - RNA, 18 nt, Human
aaagacuauucaaacagu

SEQ ID NO: 2709677 - RNA, 13 nt, Human
aaagacagugaaa

SEQ ID NO: 2709678 - RNA, 11 nt, Human
aaacuuuucug

SEQ ID NO: 2709679 - RNA, 23 nt, Human
aaacuucagcgguuuauauaagc

SEQ ID NO: 2709680 - RNA, 14 nt, Human
ggguggccucccaa

SEQ ID NO: 2709681 - RNA, 20 nt, Human
aaagggauggcaagaugugg

SEQ ID NO: 2709682 - RNA, 22 nt, Human
aaagggacuuggaagcuccgcu

SEQ ID NO: 2709683 - RNA, 14 nt, Human
aaagguacuucaaa

SEQ ID NO: 2709684 - RNA, 17 nt, Human
aaagggugaaaauuauu

SEQ ID NO: 2709685 - RNA, 21 nt, Human
aaaggagagcuagcagcaggg

SEQ ID NO: 2709686 - RNA, 17 nt, Human
aaaggagagcuagcagc

SEQ ID NO: 2709687 - RNA, 17 nt, Human
aaaggagauuggaagga

SEQ ID NO: 2709688 - RNA, 22 nt, Human
aaaggaaagagggagguaagga

SEQ ID NO: 2709689 - RNA, 21 nt, Human
aaagcacugacuucuaaguaa

SEQ ID NO: 2709690 - RNA, 17 nt, Human
aaagcacugacuucuaa

SEQ ID NO: 2709691 - RNA, 13 nt, Human
aaagcugcugaca

SEQ ID NO: 2709692 - RNA, 15 nt, Human
aaagcuuguuaagau

SEQ ID NO: 2709693 - RNA, 13 nt, Human
ggucgaggcagga

SEQ ID NO: 2709694 - RNA, 13 nt, Human
ggugaacagaaca

SEQ ID NO: 2709695 - RNA, 13 nt, Human
ggugaaaauuauu

SEQ ID NO: 2709696 - RNA, 14 nt, Human
ggugaaaauuauuu

SEQ ID NO: 2709697 - RNA, 22 nt, Human
ggugaaaauuauuuuguucaua

SEQ ID NO: 2709698 - RNA, 12 nt, Human
ggugcaaugacc

SEQ ID NO: 2709699 - RNA, 13 nt, Human
ggugcaaugaccu

SEQ ID NO: 2709700 - RNA, 16 nt, Human
ggugcaaugaccuuuc

SEQ ID NO: 2709701 - RNA, 18 nt, Human
ggugauccacccaccuca

SEQ ID NO: 2709702 - RNA, 23 nt, Human
ggugauccacccaccucagccuc

SEQ ID NO: 2709703 - RNA, 24 nt, Human
ggugauccacccaccucagccucc

SEQ ID NO: 2709704 - RNA, 13 nt, Human
gguggaugccugg

SEQ ID NO: 2709705 - RNA, 15 nt, Human
aaacucguuaauuug

SEQ ID NO: 2709706 - RNA, 13 nt, Human
aaacgucuuaaau

SEQ ID NO: 2709707 - RNA, 14 nt, Human
aaacgucuuaaaua

SEQ ID NO: 2709708 - RNA, 19 nt, Human
ggguggcaccagcagccug

SEQ ID NO: 2709709 - RNA, 14 nt, Human
aaacuuaaucuaaa

SEQ ID NO: 2709710 - RNA, 16 nt, Human
aaacuuaaucuaaaug

SEQ ID NO: 2709711 - RNA, 18 nt, Human
aaacuuaaucuaaaugga

SEQ ID NO: 2709712 - RNA, 17 nt, Human
aaacuuaaucuaaaugg

SEQ ID NO: 2709713 - RNA, 13 nt, Human
aaacucuccucug

SEQ ID NO: 2709714 - RNA, 12 nt, Human
aaaccacagcag

SEQ ID NO: 2709715 - RNA, 23 nt, Human
aaaccaagucaagugaaaaagga

SEQ ID NO: 2709716 - RNA, 15 nt, Human
aaacgggcucagcaa

SEQ ID NO: 2709717 - RNA, 15 nt, Human
aaacagucucaggaa

SEQ ID NO: 2709718 - RNA, 19 nt, Human
ggggaauugaggacacuga

SEQ ID NO: 2709719 - RNA, 15 nt, Human
ggggaccagagcugc

SEQ ID NO: 2709720 - RNA, 16 nt, Human
ggggaccagagcugcc

SEQ ID NO: 2709721 - RNA, 18 nt, Human
ggggaauguuugccucug

SEQ ID NO: 2709722 - RNA, 22 nt, Human
ggggaauguuugccucugccuc

SEQ ID NO: 2709723 - RNA, 15 nt, Human
ggggccucagugcca

SEQ ID NO: 2709724 - RNA, 12 nt, Human
gggggccucagu

SEQ ID NO: 2709725 - RNA, 15 nt, Human
gggggccucagugcc

SEQ ID NO: 2709726 - RNA, 17 nt, Human
gggggccucagugccac

SEQ ID NO: 2709727 - RNA, 18 nt, Human
gggggccucagugccacu

SEQ ID NO: 2709728 - RNA, 11 nt, Human
ggggagaaagu

SEQ ID NO: 2709729 - RNA, 14 nt, Human
aaacacagcaaggg

SEQ ID NO: 2709730 - RNA, 12 nt, Human
aaacacagcaag

SEQ ID NO: 2709731 - RNA, 11 nt, Human
aaacacauuuu

SEQ ID NO: 2709732 - RNA, 11 nt, Human
aaacacagcaa

SEQ ID NO: 2709733 - RNA, 19 nt, Human
aaacacaaacgggcucagc

SEQ ID NO: 2709734 - RNA, 13 nt, Human
gggaugagaaagg

SEQ ID NO: 2709735 - RNA, 19 nt, Human
aaaauuuagaaauauaauu

SEQ ID NO: 2709736 - RNA, 20 nt, Human
aaaauuuugauguuuuaagg

SEQ ID NO: 2709737 - RNA, 14 nt, Human
gaccaucccugaag

SEQ ID NO: 2709738 - RNA, 15 nt, Human
gaccaucccugaagg

SEQ ID NO: 2709739 - RNA, 16 nt, Human
gaccaucccugaaggc

SEQ ID NO: 2709740 - RNA, 17 nt, Human
gaccaucccugaaggcc

SEQ ID NO: 2709741 - RNA, 16 nt, Human
gaccauucuccaccug

SEQ ID NO: 2709742 - RNA, 12 nt, Human
gacccggcugcg

SEQ ID NO: 2709743 - RNA, 13 nt, Human
gacccggcugcgu

SEQ ID NO: 2709744 - RNA, 16 nt, Human
gacccuauugcugcuu

SEQ ID NO: 2709745 - RNA, 21 nt, Human
gacagcccuucuuuccacaga

SEQ ID NO: 2709746 - RNA, 13 nt, Human
gacagcuccuucu

SEQ ID NO: 2709747 - RNA, 14 nt, Human
gacagcuccuucug

SEQ ID NO: 2709748 - RNA, 15 nt, Human
gacagcuccuucugu

SEQ ID NO: 2709749 - RNA, 23 nt, Human
gacuuuucuguccgagcuuugaa

SEQ ID NO: 2709750 - RNA, 21 nt, Human
gacuuuucuguccgagcuuug

SEQ ID NO: 2709751 - RNA, 22 nt, Human
gacuuuguuaguuucuccaagc

SEQ ID NO: 2709752 - RNA, 19 nt, Human
gacuuuggauaauaaggaa

SEQ ID NO: 2709753 - RNA, 14 nt, Human
gacuuuggaaagac

SEQ ID NO: 2709754 - RNA, 14 nt, Human
gacuuuggaaagag

SEQ ID NO: 2709755 - RNA, 16 nt, Human
gacuguuuucucuuga

SEQ ID NO: 2709756 - RNA, 18 nt, Human
gacuguuuucucuugaga

SEQ ID NO: 2709757 - RNA, 17 nt, Human
gacuguggugacuuugg

SEQ ID NO: 2709758 - RNA, 22 nt, Human
gacuguacaaaguagaagucuu

SEQ ID NO: 2709759 - RNA, 17 nt, Human
gacucaaugcacugaca

SEQ ID NO: 2709760 - RNA, 14 nt, Human
gacucaaugcacug

SEQ ID NO: 2709761 - RNA, 17 nt, Human
gagaagcggcuggcagc

SEQ ID NO: 2709762 - RNA, 13 nt, Human
gacgcugugcugc

SEQ ID NO: 2709763 - RNA, 12 nt, Human
gacgcugugcug

SEQ ID NO: 2709764 - RNA, 16 nt, Human
gacuauucaaacaguc

SEQ ID NO: 2709765 - RNA, 15 nt, Human
gacuauucaaacagu

SEQ ID NO: 2709766 - RNA, 19 nt, Human
gaguugauacuacaguuug

SEQ ID NO: 2709767 - RNA, 22 nt, Human
gaguugauacuacaguuuguua

SEQ ID NO: 2709768 - RNA, 21 nt, Human
gaguugauagcacagacccug

SEQ ID NO: 2709769 - RNA, 13 nt, Human
gagugcagugagc

SEQ ID NO: 2709770 - RNA, 18 nt, Human
gagugcagugagccgaga

SEQ ID NO: 2709771 - RNA, 14 nt, Human
gagugagacucugu

SEQ ID NO: 2709772 - RNA, 18 nt, Human
gagugagacucugucuca

SEQ ID NO: 2709773 - RNA, 18 nt, Human
gagucagaaguuucugcc

SEQ ID NO: 2709774 - RNA, 13 nt, Human
gaggugggauccu

SEQ ID NO: 2709775 - RNA, 15 nt, Human
gaggugggauccucc

SEQ ID NO: 2709776 - RNA, 16 nt, Human
gaggugggauccucca

SEQ ID NO: 2709777 - RNA, 17 nt, Human
gaggugggauccuccag

SEQ ID NO: 2709778 - RNA, 14 nt, Human
gagucacuggaaca

SEQ ID NO: 2709779 - RNA, 21 nt, Human
gagucacuggaacacuaauga

SEQ ID NO: 2709780 - RNA, 20 nt, Human
gaggccagagacacaagccu

SEQ ID NO: 2709781 - RNA, 12 nt, Human
gaggcucugccc

SEQ ID NO: 2709782 - RNA, 13 nt, Human
gaggcucugcccu

SEQ ID NO: 2709783 - RNA, 14 nt, Human
gaggcucugcccuu

SEQ ID NO: 2709784 - RNA, 15 nt, Human
gaggcucugcccuug

SEQ ID NO: 2709785 - RNA, 17 nt, Human
gaggcucugcccuuggu

SEQ ID NO: 2709786 - RNA, 12 nt, Human
gaggggaacaga

SEQ ID NO: 2709787 - RNA, 12 nt, Human
gagggcuccaga

SEQ ID NO: 2709788 - RNA, 13 nt, Human
gagggcuccagac

SEQ ID NO: 2709789 - RNA, 14 nt, Human
gagggcuccagaca

SEQ ID NO: 2709790 - RNA, 15 nt, Human
gagggcuccagacac

SEQ ID NO: 2709791 - RNA, 20 nt, Human
gagcaucaggccaggcccuc

SEQ ID NO: 2709792 - RNA, 22 nt, Human
gagcaucaggccaggcccucug

SEQ ID NO: 2709793 - RNA, 17 nt, Human
gagcggagaaaggaagg

SEQ ID NO: 2709794 - RNA, 15 nt, Human
gagcugccuguucag

SEQ ID NO: 2709795 - RNA, 16 nt, Human
gagcugccuguucagc

SEQ ID NO: 2709796 - RNA, 19 nt, Human
gagcugccuguucagcucc

SEQ ID NO: 2709797 - RNA, 12 nt, Human
gagccuuccagg

SEQ ID NO: 2709798 - RNA, 13 nt, Human
gagccuuccaggg

SEQ ID NO: 2709799 - RNA, 17 nt, Human
gagcaucaggccaggcc

SEQ ID NO: 2709800 - RNA, 16 nt, Human
gcauaccacuuuuguu

SEQ ID NO: 2709801 - RNA, 15 nt, Human
gcauaccacuuuugu

SEQ ID NO: 2709802 - RNA, 22 nt, Human
gcaguugaaaagacuccaaaga

SEQ ID NO: 2709803 - RNA, 15 nt, Human
gcauaaaaauuagcc

SEQ ID NO: 2709804 - RNA, 14 nt, Human
gcaguugccaguca

SEQ ID NO: 2709805 - RNA, 23 nt, Human
gcaguugccagucaccccggcca

SEQ ID NO: 2709806 - RNA, 13 nt, Human
gcauaacauaaau

SEQ ID NO: 2709807 - RNA, 16 nt, Human
gcacuuuguucuggcu

SEQ ID NO: 2709808 - RNA, 22 nt, Human
gcagcugcgguccacccaggag

SEQ ID NO: 2709809 - RNA, 23 nt, Human
gcagcugcgguccacccaggagc

SEQ ID NO: 2709810 - RNA, 13 nt, Human
gcagcugcuuuug

SEQ ID NO: 2709811 - RNA, 20 nt, Human
gcagcugcuuuugucuaugg

SEQ ID NO: 2709812 - RNA, 16 nt, Human
gcagcuugaggguugg

SEQ ID NO: 2709813 - RNA, 22 nt, Human
gcagggaaacagcuaaugggac

SEQ ID NO: 2709814 - RNA, 17 nt, Human
gcaggcucucaggccag

SEQ ID NO: 2709815 - RNA, 19 nt, Human
gcagcuugaggguugggcu

SEQ ID NO: 2709816 - RNA, 21 nt, Human
gcagcuugaggguugggcugg

SEQ ID NO: 2709817 - RNA, 22 nt, Human
gcaggcucgggcuccccagccc

SEQ ID NO: 2709818 - RNA, 12 nt, Human
gcaggcucucag

SEQ ID NO: 2709819 - RNA, 13 nt, Human
gcaggcucucagg

SEQ ID NO: 2709820 - RNA, 14 nt, Human
gcaggcucucaggc

SEQ ID NO: 2709821 - RNA, 15 nt, Human
gcaggcucucaggcc

SEQ ID NO: 2709822 - RNA, 16 nt, Human
gcaggcucucaggcca

SEQ ID NO: 2709823 - RNA, 11 nt, Human
gccaaggccaa

SEQ ID NO: 2709824 - RNA, 17 nt, Human
gccaaggccaaaggaag

SEQ ID NO: 2709825 - RNA, 17 nt, Human
gcauccuggcacccggc

SEQ ID NO: 2709826 - RNA, 21 nt, Human
gcauccuggcacccggccccu

SEQ ID NO: 2709827 - RNA, 18 nt, Human
gcauggcauauuuuucac

SEQ ID NO: 2709828 - RNA, 14 nt, Human
gcauccuggcaccc

SEQ ID NO: 2709829 - RNA, 22 nt, Human
gcauccuggcacccggccccug

SEQ ID NO: 2709830 - RNA, 23 nt, Human
gcauccuggcacccggccccugc

SEQ ID NO: 2709831 - RNA, 16 nt, Human
gcauuguaaaugugcu

SEQ ID NO: 2709832 - RNA, 17 nt, Human
gcaugugaugagaggaa

SEQ ID NO: 2709833 - RNA, 19 nt, Human
gcaugggaaugaaugucag

SEQ ID NO: 2709834 - RNA, 13 nt, Human
gcaugggaaugaa

SEQ ID NO: 2709835 - RNA, 16 nt, Human
gcaugggaaugaaugu

SEQ ID NO: 2709836 - RNA, 14 nt, Human
gccaagaauucuua

SEQ ID NO: 2709837 - RNA, 18 nt, Human
gccaagaauucuuaaaua

SEQ ID NO: 2709838 - RNA, 15 nt, Human
gcauuuaaaagauac

SEQ ID NO: 2709839 - RNA, 12 nt, Human
gcauuuaaaaga

SEQ ID NO: 2709840 - RNA, 16 nt, Human
gcauuugaaaauuuug

SEQ ID NO: 2709841 - RNA, 14 nt, Human
gcauuugaaaauuu

SEQ ID NO: 2709842 - RNA, 12 nt, Human
gcaccuccugcc

SEQ ID NO: 2709843 - RNA, 17 nt, Human
gcaccggcuggccuggc

SEQ ID NO: 2709844 - RNA, 15 nt, Human
gcaccggcuggccug

SEQ ID NO: 2709845 - RNA, 16 nt, Human
gcaccggcuggccugg

SEQ ID NO: 2709846 - RNA, 20 nt, Human
gcacacaccagagcccaccu

SEQ ID NO: 2709847 - RNA, 11 nt, Human
gcacacauuuu

SEQ ID NO: 2709848 - RNA, 12 nt, Human
gcacacauuuuu

SEQ ID NO: 2709849 - RNA, 22 nt, Human
gcacuauagccuaggugacaga

SEQ ID NO: 2709850 - RNA, 15 nt, Human
gcacuccagccuggg

SEQ ID NO: 2709851 - RNA, 17 nt, Human
gcacuccagccugggug

SEQ ID NO: 2709852 - RNA, 18 nt, Human
gcaauagucaaauugugu

SEQ ID NO: 2709853 - RNA, 23 nt, Human
gcaauaaggggagaguaacccug

SEQ ID NO: 2709854 - RNA, 16 nt, Human
gcaauaaaauggguuu

SEQ ID NO: 2709855 - RNA, 11 nt, Human
gcaauaaagca

SEQ ID NO: 2709856 - RNA, 12 nt, Human
gcacacaccaga

SEQ ID NO: 2709857 - RNA, 14 nt, Human
gcacacaccagagc

SEQ ID NO: 2709858 - RNA, 15 nt, Human
gcacacaccagagcc

SEQ ID NO: 2709859 - RNA, 16 nt, Human
gcacacaccagagccc

SEQ ID NO: 2709860 - RNA, 17 nt, Human
gcacacaccagagccca

SEQ ID NO: 2709861 - RNA, 18 nt, Human
gcacacaccagagcccac

SEQ ID NO: 2709862 - RNA, 19 nt, Human
gcacacaccagagcccacc

SEQ ID NO: 2709863 - RNA, 18 nt, Human
gcaaccuccgccucuugg

SEQ ID NO: 2709864 - RNA, 22 nt, Human
gcaacccuggugaccagcacca

SEQ ID NO: 2709865 - RNA, 16 nt, Human
gcaaaagaugcuucuc

SEQ ID NO: 2709866 - RNA, 17 nt, Human
gcaacccccagccugcu

SEQ ID NO: 2709867 - RNA, 18 nt, Human
gcaacccccagccugcua

SEQ ID NO: 2709868 - RNA, 15 nt, Human
gcaaaagaugcuucu

SEQ ID NO: 2709869 - RNA, 15 nt, Human
gauucuuaaaguuga

SEQ ID NO: 2709870 - RNA, 20 nt, Human
gauucuccugccucagccuc

SEQ ID NO: 2709871 - RNA, 21 nt, Human
gauucuccugccucagccucc

SEQ ID NO: 2709872 - RNA, 19 nt, Human
gauucuccugccucagccu

SEQ ID NO: 2709873 - RNA, 21 nt, Human
gauucuuaaaguugaauuuau

SEQ ID NO: 2709874 - RNA, 21 nt, Human
gauucuucugcuucagccucc

SEQ ID NO: 2709875 - RNA, 23 nt, Human
gauucuuauggacaaugacccag

SEQ ID NO: 2709876 - RNA, 17 nt, Human
gauucuuaaaguugaau

SEQ ID NO: 2709877 - RNA, 16 nt, Human
gauucuuaaaguugaa

SEQ ID NO: 2709878 - RNA, 23 nt, Human
gauuuaacagaaauguacagcaa

SEQ ID NO: 2709879 - RNA, 20 nt, Human
gauuuaacagaaauguacag

SEQ ID NO: 2709880 - RNA, 13 nt, Human
gauuucacucucc

SEQ ID NO: 2709881 - RNA, 16 nt, Human
gauuucacucuccuug

SEQ ID NO: 2709882 - RNA, 17 nt, Human
gauuucacucuccuugg

SEQ ID NO: 2709883 - RNA, 18 nt, Human
gauuucacucuccuuggu

SEQ ID NO: 2709884 - RNA, 16 nt, Human
gcaaaaauauuuuaug

SEQ ID NO: 2709885 - RNA, 23 nt, Human
gcaaaaauauuuuaugauccagc

SEQ ID NO: 2709886 - RNA, 22 nt, Human
gcaaaaauauuuuaugauccag

SEQ ID NO: 2709887 - RNA, 17 nt, Human
gcaaaaauauuuuauga

SEQ ID NO: 2709888 - RNA, 22 nt, Human
gauuuuuuuuuccuucagugcc

SEQ ID NO: 2709889 - RNA, 23 nt, Human
gauuuuuuuuuccuucagugccu

SEQ ID NO: 2709890 - RNA, 20 nt, Human
gaucuggguucacugcaacc

SEQ ID NO: 2709891 - RNA, 18 nt, Human
gaucuggguucacugcaa

SEQ ID NO: 2709892 - RNA, 21 nt, Human
gaugaugaaaugaggucagag

SEQ ID NO: 2709893 - RNA, 16 nt, Human
gaugcuuguacauaau

SEQ ID NO: 2709894 - RNA, 14 nt, Human
gaugcuuguacaua

SEQ ID NO: 2709895 - RNA, 13 nt, Human
gaaagggcccaga

SEQ ID NO: 2709896 - RNA, 12 nt, Human
gaaaggcuccag

SEQ ID NO: 2709897 - RNA, 13 nt, Human
gaaaggcuccagg

SEQ ID NO: 2709898 - RNA, 14 nt, Human
gaaaggcuccagga

SEQ ID NO: 2709899 - RNA, 15 nt, Human
gaaaggcuccaggag

SEQ ID NO: 2709900 - RNA, 17 nt, Human
gaaacuggauuaaacuu

SEQ ID NO: 2709901 - RNA, 13 nt, Human
gaaacuggauuaa

SEQ ID NO: 2709902 - RNA, 15 nt, Human
gaaaucuuuaaaaaa

SEQ ID NO: 2709903 - RNA, 12 nt, Human
gaaaucuuuaaa

SEQ ID NO: 2709904 - RNA, 15 nt, Human
gaaagggcccagaga

SEQ ID NO: 2709905 - RNA, 16 nt, Human
gaaagggcccagagag

SEQ ID NO: 2709906 - RNA, 23 nt, Human
gaaaagaaaaaugagccuggcaa

SEQ ID NO: 2709907 - RNA, 14 nt, Human
gaaaagacuccaaa

SEQ ID NO: 2709908 - RNA, 17 nt, Human
gaaaagacuccaaagaa

SEQ ID NO: 2709909 - RNA, 16 nt, Human
gaaaagacuccaaaga

SEQ ID NO: 2709910 - RNA, 20 nt, Human
gaaaauuauuuuguucauac

SEQ ID NO: 2709911 - RNA, 21 nt, Human
gaaaauuauuuuguucauaca

SEQ ID NO: 2709912 - RNA, 22 nt, Human
gaaaauuauuuuguucauacau

SEQ ID NO: 2709913 - RNA, 23 nt, Human
gaaaauuauuuuguucauacaua

SEQ ID NO: 2709914 - RNA, 18 nt, Human
gaaccaccacacccagcc

SEQ ID NO: 2709915 - RNA, 20 nt, Human
gaaccaccacacccagccca

SEQ ID NO: 2709916 - RNA, 21 nt, Human
gaaccaccacacccagcccac

SEQ ID NO: 2709917 - RNA, 22 nt, Human
gaaccaccacacccagcccacu

SEQ ID NO: 2709918 - RNA, 13 nt, Human
gaacuccuggccu

SEQ ID NO: 2709919 - RNA, 14 nt, Human
gaacuccuggccuc

SEQ ID NO: 2709920 - RNA, 17 nt, Human
gaacugauguaaguaaa

SEQ ID NO: 2709921 - RNA, 17 nt, Human
gaacccaaguccaagca

SEQ ID NO: 2709922 - RNA, 16 nt, Human
gaacccaaguccaagc

SEQ ID NO: 2709923 - RNA, 23 nt, Human
gaaccaccacacccagcccacuu

SEQ ID NO: 2709924 - RNA, 22 nt, Human
gaaccauggucggaaaacaugc

SEQ ID NO: 2709925 - RNA, 21 nt, Human
gaagcacaugccucucucagg

SEQ ID NO: 2709926 - RNA, 16 nt, Human
gaagcaccauaacuuu

SEQ ID NO: 2709927 - RNA, 13 nt, Human
gaagcacagcuuc

SEQ ID NO: 2709928 - RNA, 14 nt, Human
gaagcacagcuuca

SEQ ID NO: 2709929 - RNA, 14 nt, Human
gaagcacaugccuc

SEQ ID NO: 2709930 - RNA, 17 nt, Human
gaagcacagugaucaag

SEQ ID NO: 2709931 - RNA, 22 nt, Human
gaagcacaugccucucucaggc

SEQ ID NO: 2709932 - RNA, 17 nt, Human
gaagacucauucuucug

SEQ ID NO: 2709933 - RNA, 18 nt, Human
gaagacucauucuucugu

SEQ ID NO: 2709934 - RNA, 16 nt, Human
gaagacucauucuucu

SEQ ID NO: 2709935 - RNA, 14 nt, Human
gaagacagcucuua

SEQ ID NO: 2709936 - RNA, 15 nt, Human
gaagacagcucuuau

SEQ ID NO: 2709937 - RNA, 21 nt, Human
gaagacacugaugggcaaccc

SEQ ID NO: 2709938 - RNA, 16 nt, Human
gaagacacugaugggc

SEQ ID NO: 2709939 - RNA, 13 nt, Human
gaagacagagcua

SEQ ID NO: 2709940 - RNA, 15 nt, Human
gaagacagagcuaca

SEQ ID NO: 2709941 - RNA, 12 nt, Human
gaagacagcucu

SEQ ID NO: 2709942 - RNA, 13 nt, Human
gaagacagcucuu

SEQ ID NO: 2709943 - RNA, 19 nt, Human
cuuuuauaaacuuuaccuu

SEQ ID NO: 2709944 - RNA, 22 nt, Human
cuuuguauucucuccuguaccu

SEQ ID NO: 2709945 - RNA, 21 nt, Human
cuuuuauaaacuuuaccuuuu

SEQ ID NO: 2709946 - RNA, 20 nt, Human
cuuuuauaaacuuuaccuuu

SEQ ID NO: 2709947 - RNA, 17 nt, Human
cuuuguauucucuccug

SEQ ID NO: 2709948 - RNA, 15 nt, Human
cuuucuacccagcga

SEQ ID NO: 2709949 - RNA, 16 nt, Human
cuuucuacccagcgag

SEQ ID NO: 2709950 - RNA, 16 nt, Human
cuuugacgccauccca

SEQ ID NO: 2709951 - RNA, 17 nt, Human
cuuugacgccaucccag

SEQ ID NO: 2709952 - RNA, 22 nt, Human
cuuucagauacuggauuguacu

SEQ ID NO: 2709953 - RNA, 17 nt, Human
cuuucagauacuggauu

SEQ ID NO: 2709954 - RNA, 15 nt, Human
cuuucagauacugga

SEQ ID NO: 2709955 - RNA, 14 nt, Human
cuuucagauacugg

SEQ ID NO: 2709956 - RNA, 20 nt, Human
cuuucacccuuuucuguuug

SEQ ID NO: 2709957 - RNA, 14 nt, Human
cuuucacccuuuuc

SEQ ID NO: 2709958 - RNA, 15 nt, Human
cuuucacccuuuucu

SEQ ID NO: 2709959 - RNA, 23 nt, Human
cuuuaaugucacaggcaggucca

SEQ ID NO: 2709960 - RNA, 14 nt, Human
cuugguccugcugc

SEQ ID NO: 2709961 - RNA, 22 nt, Human
cuugguagaagcccuucuaccu

SEQ ID NO: 2709962 - RNA, 13 nt, Human
cuugucuuuggac

SEQ ID NO: 2709963 - RNA, 15 nt, Human
cuugucuuuggaccc

SEQ ID NO: 2709964 - RNA, 18 nt, Human
cuugucuuuggacccuga

SEQ ID NO: 2709965 - RNA, 19 nt, Human
cuugucuuuggacccugag

SEQ ID NO: 2709966 - RNA, 18 nt, Human
cuugucucagauuuuauu

SEQ ID NO: 2709967 - RNA, 20 nt, Human
cuuggugucgggcaugacac

SEQ ID NO: 2709968 - RNA, 19 nt, Human
cuuggugucgggcaugaca

SEQ ID NO: 2709969 - RNA, 13 nt, Human
cuugucucagauu

SEQ ID NO: 2709970 - RNA, 17 nt, Human
cuugucucagauuuuau

SEQ ID NO: 2709971 - RNA, 14 nt, Human
cuugucucagauuu

SEQ ID NO: 2709972 - RNA, 22 nt, Human
cuuggauuguccccgacccuug

SEQ ID NO: 2709973 - RNA, 23 nt, Human
cuuggauuguccccgacccuugc

SEQ ID NO: 2709974 - RNA, 24 nt, Human
cuuggauuguccccgacccuugcc

SEQ ID NO: 2709975 - RNA, 12 nt, Human
cuugcaaaguau

SEQ ID NO: 2709976 - RNA, 12 nt, Human
cuugauucauaa

SEQ ID NO: 2709977 - RNA, 18 nt, Human
cuugauguguuaucucuu

SEQ ID NO: 2709978 - RNA, 22 nt, Human
cuugauauccucuuugagugaa

SEQ ID NO: 2709979 - RNA, 17 nt, Human
cuugauauccucuuuga

SEQ ID NO: 2709980 - RNA, 16 nt, Human
cuugacaucaacugca

SEQ ID NO: 2709981 - RNA, 20 nt, Human
cuugacagggcacaccgggc

SEQ ID NO: 2709982 - RNA, 13 nt, Human
cuucuucagagac

SEQ ID NO: 2709983 - RNA, 14 nt, Human
cuucuucagagacu

SEQ ID NO: 2709984 - RNA, 23 nt, Human
cuucugaacuuggcgcugccccu

SEQ ID NO: 2709985 - RNA, 17 nt, Human
cuucuaaguaaaaccac

SEQ ID NO: 2709986 - RNA, 13 nt, Human
cuucuaaguaaaa

SEQ ID NO: 2709987 - RNA, 21 nt, Human
cuucuaaguaaaaccacagca

SEQ ID NO: 2709988 - RNA, 20 nt, Human
cuucucacauuuauauuuuu

SEQ ID NO: 2709989 - RNA, 13 nt, Human
cuucucacauuua

SEQ ID NO: 2709990 - RNA, 13 nt, Human
cuuccuccuggug

SEQ ID NO: 2709991 - RNA, 22 nt, Human
cuuccucuuuccaucuacccuc

SEQ ID NO: 2709992 - RNA, 21 nt, Human
cuuccucuuuccaucuacccu

SEQ ID NO: 2709993 - RNA, 15 nt, Human
cugggcagaaggaag

SEQ ID NO: 2709994 - RNA, 12 nt, Human
cugggcagaagg

SEQ ID NO: 2709995 - RNA, 14 nt, Human
cuggggagaaagua

SEQ ID NO: 2709996 - RNA, 18 nt, Human
cuggguucacugcaaccu

SEQ ID NO: 2709997 - RNA, 20 nt, Human
cuggguucacugcaaccucc

SEQ ID NO: 2709998 - RNA, 15 nt, Human
cuggguucacugcaa

SEQ ID NO: 2709999 - RNA, 17 nt, Human
cuggcagaguugaagac

SEQ ID NO: 2710000 - RNA, 18 nt, Human
cuggcagaguugaagaca

SEQ ID NO: 2710001 - RNA, 11 nt, Human
cuggcagccca

SEQ ID NO: 2710002 - RNA, 12 nt, Human
cuggcagccccu

SEQ ID NO: 2710003 - RNA, 19 nt, Human
cuggcagaguugaagacag

SEQ ID NO: 2710004 - RNA, 13 nt, Human
cuggcagccccug

SEQ ID NO: 2710005 - RNA, 14 nt, Human
cuggccuagcauac

SEQ ID NO: 2710006 - RNA, 22 nt, Human
cuggccccucagggucccuggu

SEQ ID NO: 2710007 - RNA, 11 nt, Human
cugggacacag

SEQ ID NO: 2710008 - RNA, 18 nt, Human
cugcugacuguuuucucu

SEQ ID NO: 2710009 - RNA, 21 nt, Human
cugcugacuguuuucucuuga

SEQ ID NO: 2710010 - RNA, 23 nt, Human
cugccuguugggccaggagccuc

SEQ ID NO: 2710011 - RNA, 21 nt, Human
cugccuguugggccaggagcc

SEQ ID NO: 2710012 - RNA, 22 nt, Human
cugccuguugggccaggagccu

SEQ ID NO: 2710013 - RNA, 17 nt, Human
cugccuguucagcucca

SEQ ID NO: 2710014 - RNA, 18 nt, Human
cugccuguucagcuccag

SEQ ID NO: 2710015 - RNA, 19 nt, Human
cugccuguucagcuccagc

SEQ ID NO: 2710016 - RNA, 20 nt, Human
cugccuguugggccaggagc

SEQ ID NO: 2710017 - RNA, 23 nt, Human
cugccucucccaucacuucccua

SEQ ID NO: 2710018 - RNA, 22 nt, Human
cugccucucccaucacuucccu

SEQ ID NO: 2710019 - RNA, 15 nt, Human
cugccucucccauca

SEQ ID NO: 2710020 - RNA, 14 nt, Human
cugcuucaaauauu

SEQ ID NO: 2710021 - RNA, 20 nt, Human
cugcuuuugucuaugggacu

SEQ ID NO: 2710022 - RNA, 22 nt, Human
cugcuucaaggauccugagcca

SEQ ID NO: 2710023 - RNA, 23 nt, Human
cugcuucaaggauccugagccag

SEQ ID NO: 2710024 - RNA, 19 nt, Human
cugcuucaaauauuucccu

SEQ ID NO: 2710025 - RNA, 12 nt, Human
cugcuucaagga

SEQ ID NO: 2710026 - RNA, 13 nt, Human
cugcuucaaggau

SEQ ID NO: 2710027 - RNA, 21 nt, Human
cugcuucaaggauccugagcc

SEQ ID NO: 2710028 - RNA, 19 nt, Human
cugcuuuugucuaugggac

SEQ ID NO: 2710029 - RNA, 19 nt, Human
cugcuuuuuaaagaaugcu

SEQ ID NO: 2710030 - RNA, 21 nt, Human
cugcuuuugucuaugggacuc

SEQ ID NO: 2710031 - RNA, 14 nt, Human
cuggagaaaaugga

SEQ ID NO: 2710032 - RNA, 15 nt, Human
cugucgcccagucug

SEQ ID NO: 2710033 - RNA, 16 nt, Human
cugucgcccagucugg

SEQ ID NO: 2710034 - RNA, 23 nt, Human
cugucaauuacaggaaguacugg

SEQ ID NO: 2710035 - RNA, 19 nt, Human
cugucaauuacaggaagua

SEQ ID NO: 2710036 - RNA, 20 nt, Human
cugucaauuacaggaaguac

SEQ ID NO: 2710037 - RNA, 21 nt, Human
cuguccugggagugagcuggu

SEQ ID NO: 2710038 - RNA, 13 nt, Human
cuguagaguggga

SEQ ID NO: 2710039 - RNA, 12 nt, Human
cugugcugcccu

SEQ ID NO: 2710040 - RNA, 13 nt, Human
cugugcugcccug

SEQ ID NO: 2710041 - RNA, 14 nt, Human
cugugcugcccugc

SEQ ID NO: 2710042 - RNA, 18 nt, Human
cugugccucugggacugg

SEQ ID NO: 2710043 - RNA, 13 nt, Human
cuguuauaaucuu

SEQ ID NO: 2710044 - RNA, 19 nt, Human
cuguuauaaucuuucacag

SEQ ID NO: 2710045 - RNA, 17 nt, Human
cugugucagcauagaag

SEQ ID NO: 2710046 - RNA, 19 nt, Human
cugugucagcauagaagua

SEQ ID NO: 2710047 - RNA, 15 nt, Human
cugugcugcccugcc

SEQ ID NO: 2710048 - RNA, 17 nt, Human
cugugcugcccugccca

SEQ ID NO: 2710049 - RNA, 18 nt, Human
cugugcugcccugcccac

SEQ ID NO: 2710050 - RNA, 19 nt, Human
cugugcugcccugcccacc

SEQ ID NO: 2710051 - RNA, 14 nt, Human
cuguuggcuggggg

SEQ ID NO: 2710052 - RNA, 19 nt, Human
cuguuggcugggggccuca

SEQ ID NO: 2710053 - RNA, 22 nt, Human
cuguuggcugggggccucagug

SEQ ID NO: 2710054 - RNA, 22 nt, Human
cuuaaaguugaauuuauuggcu

SEQ ID NO: 2710055 - RNA, 14 nt, Human
cuuaaaguugaauu

SEQ ID NO: 2710056 - RNA, 18 nt, Human
cuuaaaguugaauuuauu

SEQ ID NO: 2710057 - RNA, 15 nt, Human
cuuaaaguugaauuu

SEQ ID NO: 2710058 - RNA, 14 nt, Human
cuuaaaacaacacu

SEQ ID NO: 2710059 - RNA, 15 nt, Human
cuuaccagcagagca

SEQ ID NO: 2710060 - RNA, 21 nt, Human
cuuagggaaggauacaaaagc

SEQ ID NO: 2710061 - RNA, 19 nt, Human
cuuagggaaggauacaaaa

SEQ ID NO: 2710062 - RNA, 16 nt, Human
cuuaccagcagagcac

SEQ ID NO: 2710063 - RNA, 22 nt, Human
cuuagcucauucuccuuguguu

SEQ ID NO: 2710064 - RNA, 23 nt, Human
cuuagcucauucuccuuguguua

SEQ ID NO: 2710065 - RNA, 14 nt, Human
aauacacacucaaa

SEQ ID NO: 2710066 - RNA, 23 nt, Human
aauacaauuuuguuucuguacuu

SEQ ID NO: 2710067 - RNA, 22 nt, Human
aauacaauuuuguuucuguacu

SEQ ID NO: 2710068 - RNA, 15 nt, Human
aauacaccacuacau

SEQ ID NO: 2710069 - RNA, 13 nt, Human
aauacaauuuugu

SEQ ID NO: 2710070 - RNA, 12 nt, Human
aauacaauuuug

SEQ ID NO: 2710071 - RNA, 20 nt, Human
aauacaauuuuguuucugua

SEQ ID NO: 2710072 - RNA, 18 nt, Human
aauacaauuuuguuucug

SEQ ID NO: 2710073 - RNA, 17 nt, Human
aauacaauuuuguuucu

SEQ ID NO: 2710074 - RNA, 15 nt, Human
aauacaauuuuguuu

SEQ ID NO: 2710075 - RNA, 20 nt, Human
aauacaccacuacauucugu

SEQ ID NO: 2710076 - RNA, 18 nt, Human
aauacaccacuacauucu

SEQ ID NO: 2710077 - RNA, 16 nt, Human
aauacaccacuacauu

SEQ ID NO: 2710078 - RNA, 13 nt, Human
uaaauacaauuuu

SEQ ID NO: 2710079 - RNA, 22 nt, Human
uaaauacaauuuuguuucugua

SEQ ID NO: 2710080 - RNA, 15 nt, Human
uaaauacaauuuugu

SEQ ID NO: 2710081 - RNA, 19 nt, Human
uaaauagcuagacugguga

SEQ ID NO: 2710082 - RNA, 23 nt, Human
uaaauacaauuuuguuucuguac

SEQ ID NO: 2710083 - RNA, 23 nt, Human
uaaauagcuagacuggugacuga

SEQ ID NO: 2710084 - RNA, 12 nt, Human
uaaauagcuuuu

SEQ ID NO: 2710085 - RNA, 19 nt, Human
uaaaucuccaaaauaaaac

SEQ ID NO: 2710086 - RNA, 18 nt, Human
uaaauaguauuugagagu

SEQ ID NO: 2710087 - RNA, 23 nt, Human
uaaaucccauuauucaaaguugc

SEQ ID NO: 2710088 - RNA, 15 nt, Human
uaacaaugcuguauu

SEQ ID NO: 2710089 - RNA, 17 nt, Human
uaacaaugcuguauuuu

SEQ ID NO: 2710090 - RNA, 13 nt, Human
uaacaaugcugua

SEQ ID NO: 2710091 - RNA, 13 nt, Human
uaacaagccaccc

SEQ ID NO: 2710092 - RNA, 14 nt, Human
uaaauuuuauaucu

SEQ ID NO: 2710093 - RNA, 16 nt, Human
uaaauuuugaguucua

SEQ ID NO: 2710094 - RNA, 20 nt, Human
uaacaaaaaaauauauuuaa

SEQ ID NO: 2710095 - RNA, 23 nt, Human
uaacaaaaaaauauauuuaauga

SEQ ID NO: 2710096 - RNA, 16 nt, Human
uaacaacagcuggugc

SEQ ID NO: 2710097 - RNA, 15 nt, Human
uaaauguugacaugg

SEQ ID NO: 2710098 - RNA, 21 nt, Human
uaaaucuccaaaauaaaacuu

SEQ ID NO: 2710099 - RNA, 20 nt, Human
uaaaucuccaaaauaaaacu

SEQ ID NO: 2710100 - RNA, 22 nt, Human
uaaauuaacuuuuauaaacuuu

SEQ ID NO: 2710101 - RNA, 12 nt, Human
aauaaaaauaau

SEQ ID NO: 2710102 - RNA, 22 nt, Human
aauaaaaauauuguguugugaa

SEQ ID NO: 2710103 - RNA, 22 nt, Human
aauaaaauccauacauuugugu

SEQ ID NO: 2710104 - RNA, 14 nt, Human
aauaaaguaauuau

SEQ ID NO: 2710105 - RNA, 13 nt, Human
uaaagucaggggu

SEQ ID NO: 2710106 - RNA, 14 nt, Human
aauaaaaaauuaug

SEQ ID NO: 2710107 - RNA, 16 nt, Human
aauaaaaaauuaugac

SEQ ID NO: 2710108 - RNA, 15 nt, Human
aauaaaaaauuauga

SEQ ID NO: 2710109 - RNA, 14 nt, Human
uaaaguguauuuuu

SEQ ID NO: 2710110 - RNA, 19 nt, Human
uaaaguguauuuuuuuacu

SEQ ID NO: 2710111 - RNA, 15 nt, Human
uaaaguguauuuuuu

SEQ ID NO: 2710112 - RNA, 15 nt, Human
aauaacgauaaaaga

SEQ ID NO: 2710113 - RNA, 19 nt, Human
aauaacauguaauuaagua

SEQ ID NO: 2710114 - RNA, 12 nt, Human
aauaacauguaa

SEQ ID NO: 2710115 - RNA, 15 nt, Human
aauaacaauaaaaga

SEQ ID NO: 2710116 - RNA, 21 nt, Human
aauaaaugugccuucauuuuu

SEQ ID NO: 2710117 - RNA, 12 nt, Human
aauaaaugugcc

SEQ ID NO: 2710118 - RNA, 12 nt, Human
aauaaauuauuu

SEQ ID NO: 2710119 - RNA, 21 nt, Human
aauaaauagcuagacugguga

SEQ ID NO: 2710120 - RNA, 15 nt, Human
aauaaggaaaaguuu

SEQ ID NO: 2710121 - RNA, 13 nt, Human
aauaaggaaaagu

SEQ ID NO: 2710122 - RNA, 15 nt, Human
aauaacuaaaaggua

SEQ ID NO: 2710123 - RNA, 22 nt, Human
aauaaggaaaaguuuaauauua

SEQ ID NO: 2710124 - RNA, 19 nt, Human
aauaaggaaaaguuuaaua

SEQ ID NO: 2710125 - RNA, 16 nt, Human
aauaaggaaaaguuua

SEQ ID NO: 2710126 - RNA, 15 nt, Human
aauaauuauaugcua

SEQ ID NO: 2710127 - RNA, 14 nt, Human
aauaauuauaugcu

SEQ ID NO: 2710128 - RNA, 23 nt, Human
aauaauuauaugcuauuucuaua

SEQ ID NO: 2710129 - RNA, 22 nt, Human
aauaauuauaugcuauuucuau

SEQ ID NO: 2710130 - RNA, 21 nt, Human
aauaauuauaugcuauuucua

SEQ ID NO: 2710131 - RNA, 20 nt, Human
aauaauuauaugcuauuucu

SEQ ID NO: 2710132 - RNA, 18 nt, Human
aaguuuacauuguaaaua

SEQ ID NO: 2710133 - RNA, 19 nt, Human
aaguuuacauuguaaauag

SEQ ID NO: 2710134 - RNA, 18 nt, Human
aaguuuaauauuaaagcc

SEQ ID NO: 2710135 - RNA, 21 nt, Human
aaguuuaauauuaaagccaug

SEQ ID NO: 2710136 - RNA, 20 nt, Human
aaguuuaauauuaaagccau

SEQ ID NO: 2710137 - RNA, 19 nt, Human
aaguuuaauauuaaagcca

SEQ ID NO: 2710138 - RNA, 22 nt, Human
aaguuauugauaaguucauaca

SEQ ID NO: 2710139 - RNA, 23 nt, Human
aaguuauugauaaguucauacau

SEQ ID NO: 2710140 - RNA, 15 nt, Human
aaguucauacauugu

SEQ ID NO: 2710141 - RNA, 12 nt, Human
aaguucauacau

SEQ ID NO: 2710142 - RNA, 13 nt, Human
aaguucauacauu

SEQ ID NO: 2710143 - RNA, 14 nt, Human
aaguuaaauaaauc

SEQ ID NO: 2710144 - RNA, 12 nt, Human
aaguuaaauaaa

SEQ ID NO: 2710145 - RNA, 19 nt, Human
aaguuauugauaaguucau

SEQ ID NO: 2710146 - RNA, 20 nt, Human
aaguuauugauaaguucaua

SEQ ID NO: 2710147 - RNA, 18 nt, Human
uaaaccucaaaaugucua

SEQ ID NO: 2710148 - RNA, 19 nt, Human
uaaaccucaaaaugucuaa

SEQ ID NO: 2710149 - RNA, 16 nt, Human
uaaaccgccaaggcug

SEQ ID NO: 2710150 - RNA, 18 nt, Human
uaaaccgccaaggcuggg

SEQ ID NO: 2710151 - RNA, 22 nt, Human
uaaaccaugggauaaaugccau

SEQ ID NO: 2710152 - RNA, 21 nt, Human
uaaaccaugggauaaaugcca

SEQ ID NO: 2710153 - RNA, 20 nt, Human
uaaaccaugggauaaaugcc

SEQ ID NO: 2710154 - RNA, 18 nt, Human
uaaaccaugggauaaaug

SEQ ID NO: 2710155 - RNA, 17 nt, Human
uaaacgucuuaaauauu

SEQ ID NO: 2710156 - RNA, 13 nt, Human
uaaacgucuuaaa

SEQ ID NO: 2710157 - RNA, 21 nt, Human
uaaaggcuaccuuuguauucu

SEQ ID NO: 2710158 - RNA, 19 nt, Human
uaaaggcuaccuuuguauu

SEQ ID NO: 2710159 - RNA, 19 nt, Human
aaggaaaaaauaacaauga

SEQ ID NO: 2710160 - RNA, 16 nt, Human
aaggaaaaaauaacaa

SEQ ID NO: 2710161 - RNA, 18 nt, Human
aagcuguuacugucuuca

SEQ ID NO: 2710162 - RNA, 13 nt, Human
aagcucugcuccu

SEQ ID NO: 2710163 - RNA, 13 nt, Human
guguuuauuuaua

SEQ ID NO: 2710164 - RNA, 13 nt, Human
guguuuauuguca

SEQ ID NO: 2710165 - RNA, 11 nt, Human
aagcucccagg

SEQ ID NO: 2710166 - RNA, 23 nt, Human
aagcucccaggcauuccccagga

SEQ ID NO: 2710167 - RNA, 12 nt, Human
aagcucccaggc

SEQ ID NO: 2710168 - RNA, 22 nt, Human
aagcucccaggcauuccccagg

SEQ ID NO: 2710169 - RNA, 12 nt, Human
guucucugcccu

SEQ ID NO: 2710170 - RNA, 16 nt, Human
guucucugaggacacu

SEQ ID NO: 2710171 - RNA, 11 nt, Human
guucucugccc

SEQ ID NO: 2710172 - RNA, 22 nt, Human
guugauagcacagacccugccc

SEQ ID NO: 2710173 - RNA, 23 nt, Human
guugauagcacagacccugcccu

SEQ ID NO: 2710174 - RNA, 13 nt, Human
guugaauuuuaca

SEQ ID NO: 2710175 - RNA, 13 nt, Human
aaggauaaugaau

SEQ ID NO: 2710176 - RNA, 20 nt, Human
aaggaggaagagaaaaaaua

SEQ ID NO: 2710177 - RNA, 11 nt, Human
aaggauccuga

SEQ ID NO: 2710178 - RNA, 12 nt, Human
aaggauccugag

SEQ ID NO: 2710179 - RNA, 14 nt, Human
aaggaucuucaucu

SEQ ID NO: 2710180 - RNA, 20 nt, Human
aaggauccugagccagauuu

SEQ ID NO: 2710181 - RNA, 22 nt, Human
aaggauccugagccagauuuca

SEQ ID NO: 2710182 - RNA, 14 nt, Human
aaggaaaaugauac

SEQ ID NO: 2710183 - RNA, 12 nt, Human
aaggaaaaugau

SEQ ID NO: 2710184 - RNA, 15 nt, Human
aaggaaacccagcuc

SEQ ID NO: 2710185 - RNA, 18 nt, Human
aaggagauuuacaacugg

SEQ ID NO: 2710186 - RNA, 17 nt, Human
aaggagauuuacaacug

SEQ ID NO: 2710187 - RNA, 13 nt, Human
aaggcuaccuuug

SEQ ID NO: 2710188 - RNA, 14 nt, Human
guugcccaggcugg

SEQ ID NO: 2710189 - RNA, 15 nt, Human
aaggcuaccuuugua

SEQ ID NO: 2710190 - RNA, 19 nt, Human
aaggccccgcccaggcuua

SEQ ID NO: 2710191 - RNA, 14 nt, Human
aaggccccgcccag

SEQ ID NO: 2710192 - RNA, 16 nt, Human
aaggccccgcccaggc

SEQ ID NO: 2710193 - RNA, 19 nt, Human
aaggaugcccaaagaugca

SEQ ID NO: 2710194 - RNA, 14 nt, Human
aaggaugcccaaag

SEQ ID NO: 2710195 - RNA, 22 nt, Human
aaggaugcacagaguuguuaca

SEQ ID NO: 2710196 - RNA, 24 nt, Human
aaggaugcacagaguuguuacauu

SEQ ID NO: 2710197 - RNA, 23 nt, Human
guuggcugggggccucagugcca

SEQ ID NO: 2710198 - RNA, 15 nt, Human
guugcccaggcuggc

SEQ ID NO: 2710199 - RNA, 16 nt, Human
guugcccaggcuggcg

SEQ ID NO: 2710200 - RNA, 17 nt, Human
guugggcuggugucacc

SEQ ID NO: 2710201 - RNA, 23 nt, Human
guuuuuuuuuaaaaaagaaacau

SEQ ID NO: 2710202 - RNA, 16 nt, Human
guuuuugucuuaaaaa

SEQ ID NO: 2710203 - RNA, 18 nt, Human
guuuuucuaggccugggg

SEQ ID NO: 2710204 - RNA, 19 nt, Human
aagucuuagauguauauau

SEQ ID NO: 2710205 - RNA, 18 nt, Human
aagucuuagauguauaua

SEQ ID NO: 2710206 - RNA, 17 nt, Human
aagucuuagauguauau

SEQ ID NO: 2710207 - RNA, 23 nt, Human
aaguauguuagugcaaauuguca

SEQ ID NO: 2710208 - RNA, 21 nt, Human
aaguauguuagugcaaauugu

SEQ ID NO: 2710209 - RNA, 22 nt, Human
aaguacuucuccacccugcucu

SEQ ID NO: 2710210 - RNA, 23 nt, Human
aaguacuucuccacccugcucuc

SEQ ID NO: 2710211 - RNA, 13 nt, Human
aaguauuaagcau

SEQ ID NO: 2710212 - RNA, 15 nt, Human
aaguauucuaaauuu

SEQ ID NO: 2710213 - RNA, 13 nt, Human
aaguauucuaaau

SEQ ID NO: 2710214 - RNA, 22 nt, Human
guuuucugagaaagacuauuca

SEQ ID NO: 2710215 - RNA, 15 nt, Human
aaguacuauguauca

SEQ ID NO: 2710216 - RNA, 17 nt, Human
guuuucugagaaagacu

SEQ ID NO: 2710217 - RNA, 16 nt, Human
guuuucugagaaagac

SEQ ID NO: 2710218 - RNA, 16 nt, Human
aaguacuauguaucaa

SEQ ID NO: 2710219 - RNA, 21 nt, Human
aaguacuucuccacccugcuc

SEQ ID NO: 2710220 - RNA, 15 nt, Human
aaguacuggagaaaa

SEQ ID NO: 2710221 - RNA, 24 nt, Human
aagucacacaguauuacuucugcu

SEQ ID NO: 2710222 - RNA, 21 nt, Human
aagucaagugaaaaaggagga

SEQ ID NO: 2710223 - RNA, 19 nt, Human
aaguauucuuauuuaauga

SEQ ID NO: 2710224 - RNA, 18 nt, Human
aaguauucuuauuuaaug

SEQ ID NO: 2710225 - RNA, 20 nt, Human
aagucacauuccugaacagg

SEQ ID NO: 2710226 - RNA, 13 nt, Human
aagucacacagug

SEQ ID NO: 2710227 - RNA, 21 nt, Human
aagggugaugggaaagcauug

SEQ ID NO: 2710228 - RNA, 16 nt, Human
aaguaaaaccacagca

SEQ ID NO: 2710229 - RNA, 15 nt, Human
aaguaaaaccacagc

SEQ ID NO: 2710230 - RNA, 14 nt, Human
aaguaaaaccacag

SEQ ID NO: 2710231 - RNA, 18 nt, Human
aaguaaaaccacagcagu

SEQ ID NO: 2710232 - RNA, 17 nt, Human
aaguaaaaccacagcag

SEQ ID NO: 2710233 - RNA, 15 nt, Human
aagggcccagagagg

SEQ ID NO: 2710234 - RNA, 13 nt, Human
aagggcccagaga

SEQ ID NO: 2710235 - RNA, 17 nt, Human
aaggguaucaggugcug

SEQ ID NO: 2710236 - RNA, 14 nt, Human
aaggggcaguggug

SEQ ID NO: 2710237 - RNA, 19 nt, Human
aaggguaucaggugcugcc

SEQ ID NO: 2710238 - RNA, 16 nt, Human
aaggguaucuggugac

SEQ ID NO: 2710239 - RNA, 15 nt, Human
guuuuauaauuuugu

SEQ ID NO: 2710240 - RNA, 22 nt, Human
guuuuauaauuuugugaagcaa

SEQ ID NO: 2710241 - RNA, 15 nt, Human
guuuucugagaaaga

SEQ ID NO: 2710242 - RNA, 15 nt, Human
guuuuacugcagcuu

SEQ ID NO: 2710243 - RNA, 16 nt, Human
guuuuacugcagcuuu

SEQ ID NO: 2710244 - RNA, 18 nt, Human
guuuuacugcagcuuugu

SEQ ID NO: 2710245 - RNA, 14 nt, Human
guuuuaagaggcag

SEQ ID NO: 2710246 - RNA, 18 nt, Human
guuuuaaggaugcuugua

SEQ ID NO: 2710247 - RNA, 16 nt, Human
guuuuaagaggcaggg

SEQ ID NO: 2710248 - RNA, 22 nt, Human
guuucugccgcagcccugcaga

SEQ ID NO: 2710249 - RNA, 10 nt, Human
guuucuguac

SEQ ID NO: 2710250 - RNA, 18 nt, Human
guuucugccgcagcccug

SEQ ID NO: 2710251 - RNA, 15 nt, Human
guuucuguacuuuuu

SEQ ID NO: 2710252 - RNA, 17 nt, Human
guuugccucugccucug

SEQ ID NO: 2710253 - RNA, 13 nt, Human
guuugcuaaguga

SEQ ID NO: 2710254 - RNA, 13 nt, Human
aagaauauuuuaa

SEQ ID NO: 2710255 - RNA, 17 nt, Human
guggcagcugcggucca

SEQ ID NO: 2710256 - RNA, 24 nt, Human
aagaauuucuaggacugaauuaug

SEQ ID NO: 2710257 - RNA, 21 nt, Human
guggauuuaacagaaauguac

SEQ ID NO: 2710258 - RNA, 20 nt, Human
guggauuuaacagaaaugua

SEQ ID NO: 2710259 - RNA, 23 nt, Human
guggauuuaacagaaauguacag

SEQ ID NO: 2710260 - RNA, 14 nt, Human
guggcagcugcggu

SEQ ID NO: 2710261 - RNA, 22 nt, Human
guggcagcucaccucucccuug

SEQ ID NO: 2710262 - RNA, 13 nt, Human
guggcaccagcag

SEQ ID NO: 2710263 - RNA, 14 nt, Human
guggcaccagcagc

SEQ ID NO: 2710264 - RNA, 14 nt, Human
guggacacagcucu

SEQ ID NO: 2710265 - RNA, 15 nt, Human
guggacacagcucuu

SEQ ID NO: 2710266 - RNA, 17 nt, Human
guggacacagcucuucu

SEQ ID NO: 2710267 - RNA, 24 nt, Human
guggacacagcucuucuccaggcu

SEQ ID NO: 2710268 - RNA, 22 nt, Human
gugcugggguuaucugaaguca

SEQ ID NO: 2710269 - RNA, 19 nt, Human
gugcugguguaugugugaa

SEQ ID NO: 2710270 - RNA, 21 nt, Human
gugcugcccugcccaccuggc

SEQ ID NO: 2710271 - RNA, 19 nt, Human
gugcugcccugcccaccug

SEQ ID NO: 2710272 - RNA, 20 nt, Human
gugcugcccugcccaccugg

SEQ ID NO: 2710273 - RNA, 18 nt, Human
gugcugcccugcccaccu

SEQ ID NO: 2710274 - RNA, 13 nt, Human
aagaaaauaucac

SEQ ID NO: 2710275 - RNA, 22 nt, Human
aagaagcaccaaucaugaauua

SEQ ID NO: 2710276 - RNA, 16 nt, Human
aagaagcccaggaaag

SEQ ID NO: 2710277 - RNA, 17 nt, Human
aagaagcccaggaaagg

SEQ ID NO: 2710278 - RNA, 14 nt, Human
aagaagcucucucc

SEQ ID NO: 2710279 - RNA, 15 nt, Human
aagaagcucucuccu

SEQ ID NO: 2710280 - RNA, 14 nt, Human
aacuuguguaaaua

SEQ ID NO: 2710281 - RNA, 20 nt, Human
aacuuguguaaauacaauuu

SEQ ID NO: 2710282 - RNA, 15 nt, Human
aacuuguguaaauac

SEQ ID NO: 2710283 - RNA, 20 nt, Human
aagaaaaaggaugcacagag

SEQ ID NO: 2710284 - RNA, 19 nt, Human
aagaaaaaggaugcacaga

SEQ ID NO: 2710285 - RNA, 22 nt, Human
aagaaaaaggaugcacagaguu

SEQ ID NO: 2710286 - RNA, 12 nt, Human
gugcacacacca

SEQ ID NO: 2710287 - RNA, 14 nt, Human
gugcacacaccaga

SEQ ID NO: 2710288 - RNA, 18 nt, Human
gugcacguacacacacau

SEQ ID NO: 2710289 - RNA, 17 nt, Human
gugcacacaccagagcc

SEQ ID NO: 2710290 - RNA, 14 nt, Human
gugccaagcagagg

SEQ ID NO: 2710291 - RNA, 15 nt, Human
gugcauuuggugguu

SEQ ID NO: 2710292 - RNA, 20 nt, Human
gugcacuaauguguaagaca

SEQ ID NO: 2710293 - RNA, 20 nt, Human
gugcauuugaggucuguucu

SEQ ID NO: 2710294 - RNA, 22 nt, Human
gugcauuugaggucuguucuuu

SEQ ID NO: 2710295 - RNA, 21 nt, Human
gugcauuugaggucuguucuu

SEQ ID NO: 2710296 - RNA, 15 nt, Human
gugccucugggacug

SEQ ID NO: 2710297 - RNA, 14 nt, Human
gugccucugggacu

SEQ ID NO: 2710298 - RNA, 14 nt, Human
aacuuggcgcugcc

SEQ ID NO: 2710299 - RNA, 23 nt, Human
aacuugguucccauuugcuccuu

SEQ ID NO: 2710300 - RNA, 19 nt, Human
aagcaaaauuuuuucucua

SEQ ID NO: 2710301 - RNA, 22 nt, Human
aagauauuuugcuuugugauuu

SEQ ID NO: 2710302 - RNA, 20 nt, Human
aagauauuuugcuuugugau

SEQ ID NO: 2710303 - RNA, 17 nt, Human
aagauauuuugcuuugu

SEQ ID NO: 2710304 - RNA, 18 nt, Human
gugguuauggagagggug

SEQ ID NO: 2710305 - RNA, 19 nt, Human
gugguguuuccuggcacug

SEQ ID NO: 2710306 - RNA, 16 nt, Human
aagaguaggaagacuu

SEQ ID NO: 2710307 - RNA, 18 nt, Human
aagaguaggaagacuuug

SEQ ID NO: 2710308 - RNA, 19 nt, Human
aagaguaggaagacuuugg

SEQ ID NO: 2710309 - RNA, 15 nt, Human
aagauauuuugcuuu

SEQ ID NO: 2710310 - RNA, 16 nt, Human
aagcaaguauuagaau

SEQ ID NO: 2710311 - RNA, 19 nt, Human
gugucuugcaauggcagcc

SEQ ID NO: 2710312 - RNA, 20 nt, Human
gugucccaaaaagaaaggag

SEQ ID NO: 2710313 - RNA, 21 nt, Human
gugucuugcaauggcagccuu

SEQ ID NO: 2710314 - RNA, 13 nt, Human
gugugagucacca

SEQ ID NO: 2710315 - RNA, 18 nt, Human
gugugagucaccaagccc

SEQ ID NO: 2710316 - RNA, 15 nt, Human
gugugguguuuccug

SEQ ID NO: 2710317 - RNA, 19 nt, Human
gugugguguuuccuggcac

SEQ ID NO: 2710318 - RNA, 23 nt, Human
guguugaaacggaugauuucuau

SEQ ID NO: 2710319 - RNA, 21 nt, Human
guguugaaacggaugauuucu

SEQ ID NO: 2710320 - RNA, 13 nt, Human
aagacuauucaaa

SEQ ID NO: 2710321 - RNA, 20 nt, Human
aagacgcugugcugcccugc

SEQ ID NO: 2710322 - RNA, 23 nt, Human
aagacgcugugcugcccugccca

SEQ ID NO: 2710323 - RNA, 14 nt, Human
aagacuauucaaac

SEQ ID NO: 2710324 - RNA, 21 nt, Human
aagacgcugugcugcccugcc

SEQ ID NO: 2710325 - RNA, 22 nt, Human
aagacgcugugcugcccugccc

SEQ ID NO: 2710326 - RNA, 14 nt, Human
aagacuccaaagaa

SEQ ID NO: 2710327 - RNA, 17 nt, Human
aagacucauucuucugu

SEQ ID NO: 2710328 - RNA, 17 nt, Human
aagacuccaaagaaaug

SEQ ID NO: 2710329 - RNA, 16 nt, Human
aagacuccaaagaaau

SEQ ID NO: 2710330 - RNA, 18 nt, Human
aagagcuguucacagcca

SEQ ID NO: 2710331 - RNA, 16 nt, Human
aagacuguacaaagua

SEQ ID NO: 2710332 - RNA, 16 nt, Human
aagagauugugguuuc

SEQ ID NO: 2710333 - RNA, 19 nt, Human
aagagauugugguuucauu

SEQ ID NO: 2710334 - RNA, 16 nt, Human
aagagcccaggccucc

SEQ ID NO: 2710335 - RNA, 12 nt, Human
aagagcccaggc

SEQ ID NO: 2710336 - RNA, 14 nt, Human
aagagcccaggccu

SEQ ID NO: 2710337 - RNA, 14 nt, Human
guggguagacacac

SEQ ID NO: 2710338 - RNA, 15 nt, Human
gugguguuuccuggc

SEQ ID NO: 2710339 - RNA, 16 nt, Human
gugguguuuccuggca

SEQ ID NO: 2710340 - RNA, 12 nt, Human
gugggagcugag

SEQ ID NO: 2710341 - RNA, 15 nt, Human
gugggauccuccagg

SEQ ID NO: 2710342 - RNA, 18 nt, Human
gugggauccuccaggugc

SEQ ID NO: 2710343 - RNA, 13 nt, Human
guggccucccaac

SEQ ID NO: 2710344 - RNA, 14 nt, Human
guggccucccaacu

SEQ ID NO: 2710345 - RNA, 15 nt, Human
guggccucccaacuc

SEQ ID NO: 2710346 - RNA, 19 nt, Human
aacagucucaggaaaucaa

SEQ ID NO: 2710347 - RNA, 17 nt, Human
aacagucucaggaaauc

SEQ ID NO: 2710348 - RNA, 19 nt, Human
aacagauuauuaccuuaca

SEQ ID NO: 2710349 - RNA, 13 nt, Human
guccuacccaccc

SEQ ID NO: 2710350 - RNA, 20 nt, Human
aacagacuggaagcacagcu

SEQ ID NO: 2710351 - RNA, 16 nt, Human
aacauauauaacaaug

SEQ ID NO: 2710352 - RNA, 14 nt, Human
aacaucaacaucuu

SEQ ID NO: 2710353 - RNA, 23 nt, Human
aacauguuaaaccaugggauaaa

SEQ ID NO: 2710354 - RNA, 22 nt, Human
aacauguuuuucuucucccuca

SEQ ID NO: 2710355 - RNA, 14 nt, Human
aacauaaaucugug

SEQ ID NO: 2710356 - RNA, 12 nt, Human
aacauaaaucug

SEQ ID NO: 2710357 - RNA, 15 nt, Human
aacauaaaucuguga

SEQ ID NO: 2710358 - RNA, 18 nt, Human
aacauacucccaucugug

SEQ ID NO: 2710359 - RNA, 16 nt, Human
aacauacucccaucug

SEQ ID NO: 2710360 - RNA, 12 nt, Human
aacauaauuaaa

SEQ ID NO: 2710361 - RNA, 20 nt, Human
aacauacucccaucugugaa

SEQ ID NO: 2710362 - RNA, 19 nt, Human
gucccaccuuggcugcagg

SEQ ID NO: 2710363 - RNA, 17 nt, Human
gucccaccuuggcugca

SEQ ID NO: 2710364 - RNA, 18 nt, Human
gucccaccuuggcugcag

SEQ ID NO: 2710365 - RNA, 22 nt, Human
guagcucuaggagggcuggcaa

SEQ ID NO: 2710366 - RNA, 23 nt, Human
guccccuguuuguuucugaaagg

SEQ ID NO: 2710367 - RNA, 13 nt, Human
gucccccugacaa

SEQ ID NO: 2710368 - RNA, 15 nt, Human
guccccgcacugggc

SEQ ID NO: 2710369 - RNA, 16 nt, Human
guccccgcacugggcu

SEQ ID NO: 2710370 - RNA, 22 nt, Human
guccgaaagggacuuggaagcu

SEQ ID NO: 2710371 - RNA, 21 nt, Human
guccgaaagggacuuggaagc

SEQ ID NO: 2710372 - RNA, 13 nt, Human
gucccuuuuccuu

SEQ ID NO: 2710373 - RNA, 19 nt, Human
gucucaaaaaaagaaaaag

SEQ ID NO: 2710374 - RNA, 22 nt, Human
gucucaaacucuugaccucagg

SEQ ID NO: 2710375 - RNA, 14 nt, Human
gucuaugggacuca

SEQ ID NO: 2710376 - RNA, 15 nt, Human
gucuaugggacucaa

SEQ ID NO: 2710377 - RNA, 13 nt, Human
aaccacaucuugc

SEQ ID NO: 2710378 - RNA, 13 nt, Human
gucuccauguuug

SEQ ID NO: 2710379 - RNA, 14 nt, Human
gucgaggacaggga

SEQ ID NO: 2710380 - RNA, 13 nt, Human
gucgcccagucug

SEQ ID NO: 2710381 - RNA, 14 nt, Human
gucgcccagucugg

SEQ ID NO: 2710382 - RNA, 20 nt, Human
gucuaccugaggggccucuu

SEQ ID NO: 2710383 - RNA, 23 nt, Human
gucgcccagucuggaaugcagug

SEQ ID NO: 2710384 - RNA, 13 nt, Human
guccugcugcagu

SEQ ID NO: 2710385 - RNA, 16 nt, Human
guccugcugcaguugc

SEQ ID NO: 2710386 - RNA, 13 nt, Human
gucuucacaacag

SEQ ID NO: 2710387 - RNA, 21 nt, Human
gucugacaggcaaugcuggcu

SEQ ID NO: 2710388 - RNA, 22 nt, Human
gucugacaggcaaugcuggcug

SEQ ID NO: 2710389 - RNA, 23 nt, Human
gucugacaggcaaugcuggcugu

SEQ ID NO: 2710390 - RNA, 18 nt, Human
gucucuuuaaugucacag

SEQ ID NO: 2710391 - RNA, 19 nt, Human
gucucuuuaaugucacagg

SEQ ID NO: 2710392 - RNA, 20 nt, Human
gucucuuuaaugucacaggc

SEQ ID NO: 2710393 - RNA, 14 nt, Human
gucugaaggcuggg

SEQ ID NO: 2710394 - RNA, 19 nt, Human
gucugaaggcuggguucug

SEQ ID NO: 2710395 - RNA, 22 nt, Human
gucucuuuaaugucacaggcag

SEQ ID NO: 2710396 - RNA, 23 nt, Human
gucucuuuaaugucacaggcagg

SEQ ID NO: 2710397 - RNA, 17 nt, Human
gucucuugguccugcug

SEQ ID NO: 2710398 - RNA, 13 nt, Human
gucucuugguccu

SEQ ID NO: 2710399 - RNA, 20 nt, Human
gucucuugguccugcugcag

SEQ ID NO: 2710400 - RNA, 18 nt, Human
gucucuugguccugcugc

SEQ ID NO: 2710401 - RNA, 19 nt, Human
gucucuugguccugcugca

SEQ ID NO: 2710402 - RNA, 23 nt, Human
aacguggcugcuucaaggauccu

SEQ ID NO: 2710403 - RNA, 16 nt, Human
gucuucaguaagccgu

SEQ ID NO: 2710404 - RNA, 16 nt, Human
gucuuuguacagacaa

SEQ ID NO: 2710405 - RNA, 15 nt, Human
gucuuuguacagaca

SEQ ID NO: 2710406 - RNA, 18 nt, Human
aaccugauugugucucuu

SEQ ID NO: 2710407 - RNA, 19 nt, Human
aaccugauugugucucuug

SEQ ID NO: 2710408 - RNA, 13 nt, Human
aacugaaaucaua

SEQ ID NO: 2710409 - RNA, 20 nt, Human
aacugaaaucauacuucuua

SEQ ID NO: 2710410 - RNA, 20 nt, Human
gugaguccuggcaugggaau

SEQ ID NO: 2710411 - RNA, 17 nt, Human
gugaguccuggcauggg

SEQ ID NO: 2710412 - RNA, 19 nt, Human
gugaguacuacaguccucc

SEQ ID NO: 2710413 - RNA, 12 nt, Human
gugagagcuggg

SEQ ID NO: 2710414 - RNA, 12 nt, Human
gugaccccaggu

SEQ ID NO: 2710415 - RNA, 17 nt, Human
gugaguacuacaguccu

SEQ ID NO: 2710416 - RNA, 21 nt, Human
gugagcacuaaggugugcucu

SEQ ID NO: 2710417 - RNA, 15 nt, Human
gugagcaauccugca

SEQ ID NO: 2710418 - RNA, 13 nt, Human
gugagagcugggu

SEQ ID NO: 2710419 - RNA, 16 nt, Human
gugagaggggaacaga

SEQ ID NO: 2710420 - RNA, 13 nt, Human
aacuauauuguuu

SEQ ID NO: 2710421 - RNA, 20 nt, Human
aacuaucucauuuccaagca

SEQ ID NO: 2710422 - RNA, 23 nt, Human
gugaagacaaugacuuacuguac

SEQ ID NO: 2710423 - RNA, 16 nt, Human
gugaagugaaugaaac

SEQ ID NO: 2710424 - RNA, 14 nt, Human
gugaagugaagaca

SEQ ID NO: 2710425 - RNA, 18 nt, Human
gugaccauguuuuguuua

SEQ ID NO: 2710426 - RNA, 18 nt, Human
gugaccagcaccaucucu

SEQ ID NO: 2710427 - RNA, 21 nt, Human
gugaccagcaccaucucuccu

SEQ ID NO: 2710428 - RNA, 17 nt, Human
gugaccaaugaugguca

SEQ ID NO: 2710429 - RNA, 14 nt, Human
gugacaugucuuuu

SEQ ID NO: 2710430 - RNA, 16 nt, Human
gugacagaggcagccc

SEQ ID NO: 2710431 - RNA, 18 nt, Human
gugacagaggcagcccca

SEQ ID NO: 2710432 - RNA, 19 nt, Human
gugacagaggcagccccau

SEQ ID NO: 2710433 - RNA, 14 nt, Human
aaugaaugaaacau

SEQ ID NO: 2710434 - RNA, 15 nt, Human
aaugaaugucagugu

SEQ ID NO: 2710435 - RNA, 14 nt, Human
aaugaaugucagug

SEQ ID NO: 2710436 - RNA, 23 nt, Human
aaucuucugaacuuggcgcugcc

SEQ ID NO: 2710437 - RNA, 17 nt, Human
uaauguaagcucuacug

SEQ ID NO: 2710438 - RNA, 16 nt, Human
uaauguaagcucuacu

SEQ ID NO: 2710439 - RNA, 16 nt, Human
uaaugucacaggcagg

SEQ ID NO: 2710440 - RNA, 17 nt, Human
uaaugucacaggcaggu

SEQ ID NO: 2710441 - RNA, 15 nt, Human
uaaugucacaggcag

SEQ ID NO: 2710442 - RNA, 17 nt, Human
uaauguaauaacuguga

SEQ ID NO: 2710443 - RNA, 23 nt, Human
uaaugugaaacuggauuaaacuu

SEQ ID NO: 2710444 - RNA, 22 nt, Human
uaaugugaaacuggauuaaacu

SEQ ID NO: 2710445 - RNA, 20 nt, Human
uaaugugaaacuggauuaaa

SEQ ID NO: 2710446 - RNA, 12 nt, Human
uaaugugaaacu

SEQ ID NO: 2710447 - RNA, 20 nt, Human
aauacaguaucucagggccu

SEQ ID NO: 2710448 - RNA, 23 nt, Human
uaauacaccacuacauucuguua

SEQ ID NO: 2710449 - RNA, 21 nt, Human
uaauacaccacuacauucugu

SEQ ID NO: 2710450 - RNA, 22 nt, Human
uaauacaccacuacauucuguu

SEQ ID NO: 2710451 - RNA, 17 nt, Human
uaaucagugugucuaaa

SEQ ID NO: 2710452 - RNA, 18 nt, Human
uaaucagugugucuaaau

SEQ ID NO: 2710453 - RNA, 21 nt, Human
uaauauugauaugcuuauaca

SEQ ID NO: 2710454 - RNA, 18 nt, Human
uacaaaaacacagcaagg

SEQ ID NO: 2710455 - RNA, 17 nt, Human
uacaaaaacacagcaag

SEQ ID NO: 2710456 - RNA, 16 nt, Human
uacaaaaacacagcaa

SEQ ID NO: 2710457 - RNA, 21 nt, Human
uacaagcgugagccacugcac

SEQ ID NO: 2710458 - RNA, 16 nt, Human
uacaagcgugagccac

SEQ ID NO: 2710459 - RNA, 18 nt, Human
uacaagcgugagccacug

SEQ ID NO: 2710460 - RNA, 19 nt, Human
uacaagcgugagccacugc

SEQ ID NO: 2710461 - RNA, 20 nt, Human
uacaagcgugagccacugca

SEQ ID NO: 2710462 - RNA, 17 nt, Human
uaauuuaccugaagucu

SEQ ID NO: 2710463 - RNA, 18 nt, Human
uaauuuaccugaagucuu

SEQ ID NO: 2710464 - RNA, 23 nt, Human
uaauuaguuccucauuagcauuu

SEQ ID NO: 2710465 - RNA, 19 nt, Human
aaugcacuuuguucuggcu

SEQ ID NO: 2710466 - RNA, 20 nt, Human
aaugcacuuuguucuggcuc

SEQ ID NO: 2710467 - RNA, 19 nt, Human
aaugcacaaacagaggccg

SEQ ID NO: 2710468 - RNA, 20 nt, Human
aaugcacaaacagaggccgc

SEQ ID NO: 2710469 - RNA, 13 nt, Human
aaugcacuuuguu

SEQ ID NO: 2710470 - RNA, 16 nt, Human
aaugcacuuuguucug

SEQ ID NO: 2710471 - RNA, 17 nt, Human
uaauuauaucugaggaa

SEQ ID NO: 2710472 - RNA, 13 nt, Human
uaauuauaucuga

SEQ ID NO: 2710473 - RNA, 20 nt, Human
uaauuauaugcuauuucuau

SEQ ID NO: 2710474 - RNA, 21 nt, Human
uaauuauaugcuauuucuaua

SEQ ID NO: 2710475 - RNA, 22 nt, Human
aaugcaaaccaucauugaaauc

SEQ ID NO: 2710476 - RNA, 23 nt, Human
aaugcaaaccaucauugaaaucu

SEQ ID NO: 2710477 - RNA, 18 nt, Human
aaugcacaaacagaggcc

SEQ ID NO: 2710478 - RNA, 20 nt, Human
aaugaaugucagugugacug

SEQ ID NO: 2710479 - RNA, 21 nt, Human
aaugaaugucagugugacuga

SEQ ID NO: 2710480 - RNA, 13 nt, Human
aaugaccuuucaa

SEQ ID NO: 2710481 - RNA, 14 nt, Human
aaugaccuuucaau

SEQ ID NO: 2710482 - RNA, 14 nt, Human
aaugcaaaccauca

SEQ ID NO: 2710483 - RNA, 16 nt, Human
aaugcaaaccaucauu

SEQ ID NO: 2710484 - RNA, 22 nt, Human
aaugguuuucuuguguguuuau

SEQ ID NO: 2710485 - RNA, 17 nt, Human
aaugguuuucuugugug

SEQ ID NO: 2710486 - RNA, 18 nt, Human
aaugguuuucuugugugu

SEQ ID NO: 2710487 - RNA, 15 nt, Human
aauguaagcucuacu

SEQ ID NO: 2710488 - RNA, 13 nt, Human
aauguaagcucua

SEQ ID NO: 2710489 - RNA, 23 nt, Human
aauguacagcaaggagauuuaca

SEQ ID NO: 2710490 - RNA, 21 nt, Human
aauguacagcaaggagauuua

SEQ ID NO: 2710491 - RNA, 22 nt, Human
uacagcaaggagauuuacaacu

SEQ ID NO: 2710492 - RNA, 15 nt, Human
uacauaaugcgugca

SEQ ID NO: 2710493 - RNA, 19 nt, Human
uacauaaguaauucaagaa

SEQ ID NO: 2710494 - RNA, 15 nt, Human
uacauaaguaauuca

SEQ ID NO: 2710495 - RNA, 20 nt, Human
uacaguggggaaugaagaua

SEQ ID NO: 2710496 - RNA, 16 nt, Human
uacauaaguaauucaa

SEQ ID NO: 2710497 - RNA, 17 nt, Human
uacauaaguaauucaag

SEQ ID NO: 2710498 - RNA, 18 nt, Human
uacaguaucucagggccu

SEQ ID NO: 2710499 - RNA, 12 nt, Human
uacaguccuccc

SEQ ID NO: 2710500 - RNA, 15 nt, Human
uacaguccucccauc

SEQ ID NO: 2710501 - RNA, 17 nt, Human
uacaguccucccaucuc

SEQ ID NO: 2710502 - RNA, 18 nt, Human
uacaguccucccaucuca

SEQ ID NO: 2710503 - RNA, 13 nt, Human
aaugucacaggca

SEQ ID NO: 2710504 - RNA, 14 nt, Human
aaugucacaggcag

SEQ ID NO: 2710505 - RNA, 22 nt, Human
aaugugaaacuggauuaaacuu

SEQ ID NO: 2710506 - RNA, 18 nt, Human
aauguugacaugggacau

SEQ ID NO: 2710507 - RNA, 14 nt, Human
aauuaacauguuaa

SEQ ID NO: 2710508 - RNA, 13 nt, Human
aauuaacauguua

SEQ ID NO: 2710509 - RNA, 22 nt, Human
aauuaacuuuuauaaacuuuac

SEQ ID NO: 2710510 - RNA, 15 nt, Human
aauuaagagagucua

SEQ ID NO: 2710511 - RNA, 20 nt, Human
aauuaacuuuuauaaacuuu

SEQ ID NO: 2710512 - RNA, 18 nt, Human
aauuaacuuuuauaaacu

SEQ ID NO: 2710513 - RNA, 13 nt, Human
aauuaaguacuau

SEQ ID NO: 2710514 - RNA, 18 nt, Human
aauuaacauguuaaacca

SEQ ID NO: 2710515 - RNA, 23 nt, Human
uacauggcuggagcuagaauuug

SEQ ID NO: 2710516 - RNA, 23 nt, Human
uacauuguacgaagaguauuuuu

SEQ ID NO: 2710517 - RNA, 20 nt, Human
uacauuguacgaagaguauu

SEQ ID NO: 2710518 - RNA, 22 nt, Human
uacauuguacgaagaguauuuu

SEQ ID NO: 2710519 - RNA, 17 nt, Human
uaccauccccuguagag

SEQ ID NO: 2710520 - RNA, 17 nt, Human
uaccacuuuuguucuug

SEQ ID NO: 2710521 - RNA, 20 nt, Human
uacccgggaagggggcuggg

SEQ ID NO: 2710522 - RNA, 15 nt, Human
uacccucauguucuu

SEQ ID NO: 2710523 - RNA, 16 nt, Human
uacccucauguucuua

SEQ ID NO: 2710524 - RNA, 22 nt, Human
uacccuggcacuauaauguaag

SEQ ID NO: 2710525 - RNA, 20 nt, Human
uacccuggcacuauaaugua

SEQ ID NO: 2710526 - RNA, 14 nt, Human
uacguacacauuuu

SEQ ID NO: 2710527 - RNA, 15 nt, Human
uacguacacauuuua

SEQ ID NO: 2710528 - RNA, 14 nt, Human
aauucuuucauuuu

SEQ ID NO: 2710529 - RNA, 21 nt, Human
aauucuugccaaauauaaaua

SEQ ID NO: 2710530 - RNA, 20 nt, Human
aauucuugcaaaguaucccu

SEQ ID NO: 2710531 - RNA, 14 nt, Human
aauucuugcaaagu

SEQ ID NO: 2710532 - RNA, 22 nt, Human
aauucuucuccacuuucuagcc

SEQ ID NO: 2710533 - RNA, 15 nt, Human
aauucuugaaggaaa

SEQ ID NO: 2710534 - RNA, 16 nt, Human
aauucuugaaggaaaa

SEQ ID NO: 2710535 - RNA, 21 nt, Human
aauucuugaaggaaaaugaua

SEQ ID NO: 2710536 - RNA, 13 nt, Human
aauucuuaaauau

SEQ ID NO: 2710537 - RNA, 16 nt, Human
uacuauaauuuaccug

SEQ ID NO: 2710538 - RNA, 16 nt, Human
uacuauguaucaauga

SEQ ID NO: 2710539 - RNA, 14 nt, Human
uacguugugcauuu

SEQ ID NO: 2710540 - RNA, 13 nt, Human
uacguugugcauu

SEQ ID NO: 2710541 - RNA, 14 nt, Human
uacgucugacaggc

SEQ ID NO: 2710542 - RNA, 22 nt, Human
uacucuuauaucuauauuuuac

SEQ ID NO: 2710543 - RNA, 20 nt, Human
uacucuuauaucuauauuuu

SEQ ID NO: 2710544 - RNA, 21 nt, Human
uacucugugucagguggggca

SEQ ID NO: 2710545 - RNA, 12 nt, Human
uacucaauuuua

SEQ ID NO: 2710546 - RNA, 14 nt, Human
uacucaauuuuaac

SEQ ID NO: 2710547 - RNA, 13 nt, Human
uacucaauuuuaa

SEQ ID NO: 2710548 - RNA, 13 nt, Human
uacuguaagaaaa

SEQ ID NO: 2710549 - RNA, 23 nt, Human
aauugugugaaagguacuucaaa

SEQ ID NO: 2710550 - RNA, 22 nt, Human
aauuguuuggggaugagaaagg

SEQ ID NO: 2710551 - RNA, 16 nt, Human
aauuuaaauagcuuuu

SEQ ID NO: 2710552 - RNA, 15 nt, Human
aauuuaaauagcuuu

SEQ ID NO: 2710553 - RNA, 19 nt, Human
aauuuacauacucugcuua

SEQ ID NO: 2710554 - RNA, 13 nt, Human
aauuuaaaagucu

SEQ ID NO: 2710555 - RNA, 20 nt, Human
aauuucucccagucauuuaa

SEQ ID NO: 2710556 - RNA, 21 nt, Human
aauuucuaaaucuccaaaaua

SEQ ID NO: 2710557 - RNA, 13 nt, Human
aauuucuaaaucu

SEQ ID NO: 2710558 - RNA, 17 nt, Human
aauuuagaaauauaauu

SEQ ID NO: 2710559 - RNA, 14 nt, Human
uacuucaaauccuu

SEQ ID NO: 2710560 - RNA, 19 nt, Human
uacuucaaauccuugaaga

SEQ ID NO: 2710561 - RNA, 19 nt, Human
aauuugauaugugaacagu

SEQ ID NO: 2710562 - RNA, 15 nt, Human
aauuugauaugugaa

SEQ ID NO: 2710563 - RNA, 18 nt, Human
aauuugauaugugaacag

SEQ ID NO: 2710564 - RNA, 16 nt, Human
aauuugauaugugaac

SEQ ID NO: 2710565 - RNA, 18 nt, Human
aauuugaauuuuguguua

SEQ ID NO: 2710566 - RNA, 16 nt, Human
aauuugaauuuugugu

SEQ ID NO: 2710567 - RNA, 13 nt, Human
aauuugaauuuug

SEQ ID NO: 2710568 - RNA, 19 nt, Human
aauuuuuucucuaggaaau

SEQ ID NO: 2710569 - RNA, 16 nt, Human
acaaaaacacagcaag

SEQ ID NO: 2710570 - RNA, 20 nt, Human
acaaaaaaauauauuuaaug

SEQ ID NO: 2710571 - RNA, 13 nt, Human
acaaaaaaauaua

SEQ ID NO: 2710572 - RNA, 17 nt, Human
acaaaaaaauauauuua

SEQ ID NO: 2710573 - RNA, 17 nt, Human
aauuuuuuugagacaga

SEQ ID NO: 2710574 - RNA, 19 nt, Human
aauuuuuauauuugaaaua

SEQ ID NO: 2710575 - RNA, 18 nt, Human
aauuuuuauuaaauuaug

SEQ ID NO: 2710576 - RNA, 17 nt, Human
aauuuuuauuaaauuau

SEQ ID NO: 2710577 - RNA, 12 nt, Human
uagacagucccu

SEQ ID NO: 2710578 - RNA, 14 nt, Human
uagacagucccugc

SEQ ID NO: 2710579 - RNA, 15 nt, Human
uagaagucacacagu

SEQ ID NO: 2710580 - RNA, 21 nt, Human
uacuucaaauccuugaagauu

SEQ ID NO: 2710581 - RNA, 14 nt, Human
uagaaccucuuugu

SEQ ID NO: 2710582 - RNA, 21 nt, Human
uagacagagucucacuguugc

SEQ ID NO: 2710583 - RNA, 16 nt, Human
uagacaauuuauuaug

SEQ ID NO: 2710584 - RNA, 23 nt, Human
uagaagucacauuccugaacagg

SEQ ID NO: 2710585 - RNA, 16 nt, Human
uagaagucacacagua

SEQ ID NO: 2710586 - RNA, 17 nt, Human
uagaagucuuagaugua

SEQ ID NO: 2710587 - RNA, 16 nt, Human
uagaagucuuagaugu

SEQ ID NO: 2710588 - RNA, 19 nt, Human
uagaagucuuagauguaua

SEQ ID NO: 2710589 - RNA, 18 nt, Human
uagaagucuuagauguau

SEQ ID NO: 2710590 - RNA, 12 nt, Human
acaacacucaca

SEQ ID NO: 2710591 - RNA, 15 nt, Human
acaacaacaaaauga

SEQ ID NO: 2710592 - RNA, 19 nt, Human
uagcauuuguguugaagag

SEQ ID NO: 2710593 - RNA, 18 nt, Human
acaagcacuaaacaaaga

SEQ ID NO: 2710594 - RNA, 18 nt, Human
acaagagcccaggccucc

SEQ ID NO: 2710595 - RNA, 17 nt, Human
acaagagcccaggccuc

SEQ ID NO: 2710596 - RNA, 13 nt, Human
acaagcugcaccc

SEQ ID NO: 2710597 - RNA, 18 nt, Human
acaagcgugagccacugc

SEQ ID NO: 2710598 - RNA, 20 nt, Human
acaagcgugagccacugcac

SEQ ID NO: 2710599 - RNA, 21 nt, Human
acaagcgugagccacugcacc

SEQ ID NO: 2710600 - RNA, 12 nt, Human
acaagccacccc

SEQ ID NO: 2710601 - RNA, 18 nt, Human
uagcaugucgucaaagcu

SEQ ID NO: 2710602 - RNA, 21 nt, Human
uagcaugucgucaaagcugaa

SEQ ID NO: 2710603 - RNA, 22 nt, Human
uagauuuuagacccuauugcug

SEQ ID NO: 2710604 - RNA, 16 nt, Human
uagcacagacccugcc

SEQ ID NO: 2710605 - RNA, 17 nt, Human
uagcacagacccugccc

SEQ ID NO: 2710606 - RNA, 18 nt, Human
uagcacagacccugcccu

SEQ ID NO: 2710607 - RNA, 19 nt, Human
uagcacagacccugcccug

SEQ ID NO: 2710608 - RNA, 17 nt, Human
uagaugcaguucugaag

SEQ ID NO: 2710609 - RNA, 19 nt, Human
uagaugcaguucugaagaa

SEQ ID NO: 2710610 - RNA, 16 nt, Human
uagaugcaguucugaa

SEQ ID NO: 2710611 - RNA, 21 nt, Human
uagaggaagccugauuaaaga

SEQ ID NO: 2710612 - RNA, 16 nt, Human
acaaaaagcauaaaaa

SEQ ID NO: 2710613 - RNA, 14 nt, Human
uauuuauuuuaaua

SEQ ID NO: 2710614 - RNA, 16 nt, Human
uauuuauuuuaauaau

SEQ ID NO: 2710615 - RNA, 18 nt, Human
uauuuauuuuaauaaugu

SEQ ID NO: 2710616 - RNA, 14 nt, Human
uauuuauuuaaauu

SEQ ID NO: 2710617 - RNA, 13 nt, Human
uauuuauuuaaau

SEQ ID NO: 2710618 - RNA, 18 nt, Human
uauuuacuucuuauacau

SEQ ID NO: 2710619 - RNA, 18 nt, Human
uauuuacuaaaauggacu

SEQ ID NO: 2710620 - RNA, 19 nt, Human
uauuuaaugauaaguaaau

SEQ ID NO: 2710621 - RNA, 23 nt, Human
uauuuaauuuuuuugagacagag

SEQ ID NO: 2710622 - RNA, 17 nt, Human
uauugucuagugaaacu

SEQ ID NO: 2710623 - RNA, 18 nt, Human
uauuuaaccucuaaauuc

SEQ ID NO: 2710624 - RNA, 17 nt, Human
uauuuaaccucuaaauu

SEQ ID NO: 2710625 - RNA, 14 nt, Human
uauuuaauagguuu

SEQ ID NO: 2710626 - RNA, 21 nt, Human
uauuuaaugaaagacuguaca

SEQ ID NO: 2710627 - RNA, 15 nt, Human
uauuuaaugaaagac

SEQ ID NO: 2710628 - RNA, 13 nt, Human
uauugucaaagug

SEQ ID NO: 2710629 - RNA, 17 nt, Human
uauugucaaagugguga

SEQ ID NO: 2710630 - RNA, 21 nt, Human
uauuguagcauccuggaauau

SEQ ID NO: 2710631 - RNA, 20 nt, Human
uauuguagcauccuggaaua

SEQ ID NO: 2710632 - RNA, 18 nt, Human
uauuguagcauccuggaa

SEQ ID NO: 2710633 - RNA, 17 nt, Human
uauuguagcauccugga

SEQ ID NO: 2710634 - RNA, 23 nt, Human
uauuguacaaaguauuaagcaua

SEQ ID NO: 2710635 - RNA, 22 nt, Human
uauuguacaaaguauuaagcau

SEQ ID NO: 2710636 - RNA, 21 nt, Human
uauuguacaaaguauuaagca

SEQ ID NO: 2710637 - RNA, 16 nt, Human
uauuguacaaaguauu

SEQ ID NO: 2710638 - RNA, 15 nt, Human
uauuguacaaaguau

SEQ ID NO: 2710639 - RNA, 23 nt, Human
acaguucggugagcuacaaaugc

SEQ ID NO: 2710640 - RNA, 16 nt, Human
acaguucucuccuucu

SEQ ID NO: 2710641 - RNA, 22 nt, Human
acaguucggugagcuacaaaug

SEQ ID NO: 2710642 - RNA, 19 nt, Human
acaguucggugagcuacaa

SEQ ID NO: 2710643 - RNA, 20 nt, Human
acaguuacucagaauucucu

SEQ ID NO: 2710644 - RNA, 13 nt, Human
acaguuacucaga

SEQ ID NO: 2710645 - RNA, 20 nt, Human
acaguucaauucucauuugu

SEQ ID NO: 2710646 - RNA, 15 nt, Human
uauucuuauuuaaug

SEQ ID NO: 2710647 - RNA, 16 nt, Human
uauucuguuggccagu

SEQ ID NO: 2710648 - RNA, 17 nt, Human
acaguucucuccuucuu

SEQ ID NO: 2710649 - RNA, 24 nt, Human
uauucucuccuguaccucuugagc

SEQ ID NO: 2710650 - RNA, 20 nt, Human
uauucucuccuguaccucuu

SEQ ID NO: 2710651 - RNA, 18 nt, Human
uauucucuccuguaccuc

SEQ ID NO: 2710652 - RNA, 22 nt, Human
uauuggcuuuucugauccaguu

SEQ ID NO: 2710653 - RNA, 21 nt, Human
uauuggcuuuucugauccagu

SEQ ID NO: 2710654 - RNA, 14 nt, Human
uauuggcuuuucug

SEQ ID NO: 2710655 - RNA, 18 nt, Human
uauuggcuuuucugaucc

SEQ ID NO: 2710656 - RNA, 17 nt, Human
uauuggcuuuucugauc

SEQ ID NO: 2710657 - RNA, 16 nt, Human
uauuggcuuuucugau

SEQ ID NO: 2710658 - RNA, 15 nt, Human
uauuggcuuuucuga

SEQ ID NO: 2710659 - RNA, 16 nt, Human
uauucaggagaguaga

SEQ ID NO: 2710660 - RNA, 18 nt, Human
uauucaggaagcucaggg

SEQ ID NO: 2710661 - RNA, 22 nt, Human
uauucaggaagcucagggccug

SEQ ID NO: 2710662 - RNA, 16 nt, Human
uauucaggaagcucag

SEQ ID NO: 2710663 - RNA, 13 nt, Human
uauucacugauuu

SEQ ID NO: 2710664 - RNA, 22 nt, Human
uauucacugauuugacauaguc

SEQ ID NO: 2710665 - RNA, 19 nt, Human
uauucacugauuugacaua

SEQ ID NO: 2710666 - RNA, 23 nt, Human
uauucaaaguugccuaaauccau

SEQ ID NO: 2710667 - RNA, 18 nt, Human
uauucaaaguugccuaaa

SEQ ID NO: 2710668 - RNA, 22 nt, Human
uauucaaaguugccuaaaucca

SEQ ID NO: 2710669 - RNA, 21 nt, Human
uauucaaaguugccuaaaucc

SEQ ID NO: 2710670 - RNA, 15 nt, Human
uauuagaauaccaca

SEQ ID NO: 2710671 - RNA, 16 nt, Human
uauuaccacagacaua

SEQ ID NO: 2710672 - RNA, 12 nt, Human
uauuagagaaga

SEQ ID NO: 2710673 - RNA, 12 nt, Human
uauuaaaacuca

SEQ ID NO: 2710674 - RNA, 23 nt, Human
uauuaaaaaucucaaauuucuaa

SEQ ID NO: 2710675 - RNA, 12 nt, Human
uauuaaagccau

SEQ ID NO: 2710676 - RNA, 14 nt, Human
uauuaaagccaugu

SEQ ID NO: 2710677 - RNA, 13 nt, Human
uauuaaagccaug

SEQ ID NO: 2710678 - RNA, 20 nt, Human
uauuaaagccauguuuauua

SEQ ID NO: 2710679 - RNA, 18 nt, Human
uauuaaagccauguuuau

SEQ ID NO: 2710680 - RNA, 17 nt, Human
uauuaaagccauguuua

SEQ ID NO: 2710681 - RNA, 23 nt, Human
uauuacaguggggaaugaagaua

SEQ ID NO: 2710682 - RNA, 14 nt, Human
uauuacaguauaau

SEQ ID NO: 2710683 - RNA, 21 nt, Human
uauuacaguauaauuaacaug

SEQ ID NO: 2710684 - RNA, 20 nt, Human
uauuacaguauaauuaacau

SEQ ID NO: 2710685 - RNA, 18 nt, Human
uauuacaguauaauuaac

SEQ ID NO: 2710686 - RNA, 16 nt, Human
uauuacaguauaauua

SEQ ID NO: 2710687 - RNA, 20 nt, Human
acagcuggugcccugcuuuc

SEQ ID NO: 2710688 - RNA, 17 nt, Human
acagcuggugcccugcu

SEQ ID NO: 2710689 - RNA, 17 nt, Human
uauguuuuaagaggcag

SEQ ID NO: 2710690 - RNA, 19 nt, Human
uauguuuuaagaggcaggg

SEQ ID NO: 2710691 - RNA, 22 nt, Human
uauuaaaaaucucaaauuucua

SEQ ID NO: 2710692 - RNA, 20 nt, Human
uauuaaaaaucucaaauuuc

SEQ ID NO: 2710693 - RNA, 18 nt, Human
uauuaaaaaucucaaauu

SEQ ID NO: 2710694 - RNA, 16 nt, Human
uauuaaaaaucucaaa

SEQ ID NO: 2710695 - RNA, 16 nt, Human
acagucucaggaaauc

SEQ ID NO: 2710696 - RNA, 15 nt, Human
acagucucaggaaau

SEQ ID NO: 2710697 - RNA, 14 nt, Human
acagucucaggaaa

SEQ ID NO: 2710698 - RNA, 13 nt, Human
acagucucaggaa

SEQ ID NO: 2710699 - RNA, 21 nt, Human
acaguccuuaccagcagagca

SEQ ID NO: 2710700 - RNA, 22 nt, Human
acaguccuuaccagcagagcac

SEQ ID NO: 2710701 - RNA, 20 nt, Human
acagugaaagaaaauaacaa

SEQ ID NO: 2710702 - RNA, 17 nt, Human
acagucucaggaaauca

SEQ ID NO: 2710703 - RNA, 21 nt, Human
acaguuaccucugccucagaa

SEQ ID NO: 2710704 - RNA, 15 nt, Human
acaguuaagagaaau

SEQ ID NO: 2710705 - RNA, 23 nt, Human
acaguauaauuaacauguuaaac

SEQ ID NO: 2710706 - RNA, 21 nt, Human
acaguauaauuaacauguuaa

SEQ ID NO: 2710707 - RNA, 22 nt, Human
acagguuuuccugaagaauuga

SEQ ID NO: 2710708 - RNA, 22 nt, Human
acagggcacaccgggcacucag

SEQ ID NO: 2710709 - RNA, 21 nt, Human
acaggcugggcuucaguggca

SEQ ID NO: 2710710 - RNA, 14 nt, Human
acaggcugggcuuc

SEQ ID NO: 2710711 - RNA, 17 nt, Human
acaggcugggcuucagu

SEQ ID NO: 2710712 - RNA, 12 nt, Human
acagucccugcc

SEQ ID NO: 2710713 - RNA, 13 nt, Human
acagucccugcca

SEQ ID NO: 2710714 - RNA, 15 nt, Human
acaguauuacuucug

SEQ ID NO: 2710715 - RNA, 16 nt, Human
acaguauuacuucugc

SEQ ID NO: 2710716 - RNA, 17 nt, Human
acaguauuacuucugcu

SEQ ID NO: 2710717 - RNA, 19 nt, Human
acaguauuacuucugcuac

SEQ ID NO: 2710718 - RNA, 17 nt, Human
acaguccucccaucuca

SEQ ID NO: 2710719 - RNA, 18 nt, Human
acaguccuuaccagcaga

SEQ ID NO: 2710720 - RNA, 20 nt, Human
acaguccuuaccagcagagc

SEQ ID NO: 2710721 - RNA, 15 nt, Human
acagucccugccaau

SEQ ID NO: 2710722 - RNA, 13 nt, Human
acaguccucccau

SEQ ID NO: 2710723 - RNA, 14 nt, Human
acaguccucccauc

SEQ ID NO: 2710724 - RNA, 15 nt, Human
acaguccucccaucu

SEQ ID NO: 2710725 - RNA, 15 nt, Human
uauauuuacaaaugg

SEQ ID NO: 2710726 - RNA, 18 nt, Human
uaucaaguauuauaccuu

SEQ ID NO: 2710727 - RNA, 21 nt, Human
uaucaaguauuauaccuuuuu

SEQ ID NO: 2710728 - RNA, 14 nt, Human
uauauuuacaaaug

SEQ ID NO: 2710729 - RNA, 18 nt, Human
uaucacccagaagaaaau

SEQ ID NO: 2710730 - RNA, 20 nt, Human
uaucaccugucuugccuuuu

SEQ ID NO: 2710731 - RNA, 17 nt, Human
acagacccugcccugug

SEQ ID NO: 2710732 - RNA, 16 nt, Human
acagacccugcccugu

SEQ ID NO: 2710733 - RNA, 23 nt, Human
acagacacaggcccggcuccagg

SEQ ID NO: 2710734 - RNA, 11 nt, Human
acacuccuuca

SEQ ID NO: 2710735 - RNA, 14 nt, Human
acagacuggaagca

SEQ ID NO: 2710736 - RNA, 18 nt, Human
acagacccugcccugugg

SEQ ID NO: 2710737 - RNA, 20 nt, Human
acagacccugcccugugggc

SEQ ID NO: 2710738 - RNA, 19 nt, Human
uaucuagauacuguaucau

SEQ ID NO: 2710739 - RNA, 14 nt, Human
uaucuaguaugaaa

SEQ ID NO: 2710740 - RNA, 16 nt, Human
uaucuaguaugaaauu

SEQ ID NO: 2710741 - RNA, 17 nt, Human
uaucuaguaugaaauua

SEQ ID NO: 2710742 - RNA, 16 nt, Human
uaucucccccagcccc

SEQ ID NO: 2710743 - RNA, 18 nt, Human
uaucucccccagccccau

SEQ ID NO: 2710744 - RNA, 17 nt, Human
uaucucccccagcccca

SEQ ID NO: 2710745 - RNA, 10 nt, Human
uaucagaauu

SEQ ID NO: 2710746 - RNA, 16 nt, Human
uaucuagauacuguau

SEQ ID NO: 2710747 - RNA, 15 nt, Human
uaucuagauacugua

SEQ ID NO: 2710748 - RNA, 22 nt, Human
acagacuggaagcacagcuuca

SEQ ID NO: 2710749 - RNA, 18 nt, Human
acagagcuacacagggga

SEQ ID NO: 2710750 - RNA, 21 nt, Human
acagagugagacucugucuca

SEQ ID NO: 2710751 - RNA, 20 nt, Human
acagagcccacgcccccacu

SEQ ID NO: 2710752 - RNA, 16 nt, Human
acagagcuacacaggg

SEQ ID NO: 2710753 - RNA, 17 nt, Human
uauggcuauaggugcua

SEQ ID NO: 2710754 - RNA, 10 nt, Human
uaugggagag

SEQ ID NO: 2710755 - RNA, 16 nt, Human
uauggcuuuugugcau

SEQ ID NO: 2710756 - RNA, 15 nt, Human
acagcuccaagaauu

SEQ ID NO: 2710757 - RNA, 17 nt, Human
acagcuaacauggaagu

SEQ ID NO: 2710758 - RNA, 14 nt, Human
acagcuaacaugga

SEQ ID NO: 2710759 - RNA, 15 nt, Human
acagcuaacauggaa

SEQ ID NO: 2710760 - RNA, 16 nt, Human
uauggcuauaggugcu

SEQ ID NO: 2710761 - RNA, 19 nt, Human
uaugcucugcauguuacau

SEQ ID NO: 2710762 - RNA, 22 nt, Human
uauggcccuggccuagcauacg

SEQ ID NO: 2710763 - RNA, 22 nt, Human
uaugauccagcagauuauucac

SEQ ID NO: 2710764 - RNA, 21 nt, Human
uaugauccagcagauuauuca

SEQ ID NO: 2710765 - RNA, 20 nt, Human
uaugauccagcagauuauuc

SEQ ID NO: 2710766 - RNA, 14 nt, Human
uaugcucugcaugu

SEQ ID NO: 2710767 - RNA, 18 nt, Human
uaugcucugcauguuaca

SEQ ID NO: 2710768 - RNA, 14 nt, Human
uaugaucacggcuc

SEQ ID NO: 2710769 - RNA, 21 nt, Human
uaugaucacggcucacugcag

SEQ ID NO: 2710770 - RNA, 23 nt, Human
uaugaucacggcucacugcagcc

SEQ ID NO: 2710771 - RNA, 10 nt, Human
uaugauccag

SEQ ID NO: 2710772 - RNA, 19 nt, Human
uaugauccagcagauuauu

SEQ ID NO: 2710773 - RNA, 11 nt, Human
uaugauccagc

SEQ ID NO: 2710774 - RNA, 21 nt, Human
uaugagcuuccuucugugaaa

SEQ ID NO: 2710775 - RNA, 23 nt, Human
uaugaggcauuuguuugaacuga

SEQ ID NO: 2710776 - RNA, 13 nt, Human
uaugaggcauuug

SEQ ID NO: 2710777 - RNA, 18 nt, Human
uaugagcuuccuucugug

SEQ ID NO: 2710778 - RNA, 15 nt, Human
uaucuugaagacuuu

SEQ ID NO: 2710779 - RNA, 20 nt, Human
acagaguuuucacucuuauu

SEQ ID NO: 2710780 - RNA, 18 nt, Human
acagaguuuucacucuua

SEQ ID NO: 2710781 - RNA, 14 nt, Human
uaucuugaagacuu

SEQ ID NO: 2710782 - RNA, 20 nt, Human
uauagccuaggugacagagu

SEQ ID NO: 2710783 - RNA, 23 nt, Human
uauaggugcuacaaaaacacagc

SEQ ID NO: 2710784 - RNA, 20 nt, Human
uauaggugcuacaaaaacac

SEQ ID NO: 2710785 - RNA, 21 nt, Human
uauaggugcuacaaaaacaca

SEQ ID NO: 2710786 - RNA, 23 nt, Human
uauauauuuuuuucugaaauuuc

SEQ ID NO: 2710787 - RNA, 20 nt, Human
uauauauuuuuuucugaaau

SEQ ID NO: 2710788 - RNA, 22 nt, Human
uauauauuuuuuucugaaauuu

SEQ ID NO: 2710789 - RNA, 21 nt, Human
uauauauuuuuuucugaaauu

SEQ ID NO: 2710790 - RNA, 19 nt, Human
acacucauugaccugaggc

SEQ ID NO: 2710791 - RNA, 16 nt, Human
uauauccuuucuaaca

SEQ ID NO: 2710792 - RNA, 21 nt, Human
acacucauugaccugaggccc

SEQ ID NO: 2710793 - RNA, 23 nt, Human
acacucauugaccugaggcccuu

SEQ ID NO: 2710794 - RNA, 18 nt, Human
uauaacaaugcuguauuu

SEQ ID NO: 2710795 - RNA, 14 nt, Human
uauaauuuugugaa

SEQ ID NO: 2710796 - RNA, 21 nt, Human
uauaauuuaccugaagucuuu

SEQ ID NO: 2710797 - RNA, 20 nt, Human
uauaaccaguguuguggauu

SEQ ID NO: 2710798 - RNA, 14 nt, Human
uauacauaaacaag

SEQ ID NO: 2710799 - RNA, 13 nt, Human
uauacauaaacaa

SEQ ID NO: 2710800 - RNA, 14 nt, Human
uauacauuugauaa

SEQ ID NO: 2710801 - RNA, 19 nt, Human
uauagauuagaauucugua

SEQ ID NO: 2710802 - RNA, 20 nt, Human
uauagauuagaauucuguau

SEQ ID NO: 2710803 - RNA, 22 nt, Human
uauagauuagagaguguugaaa

SEQ ID NO: 2710804 - RNA, 19 nt, Human
uauagauuagagaguguug

SEQ ID NO: 2710805 - RNA, 15 nt, Human
uaguuuuauaugcuu

SEQ ID NO: 2710806 - RNA, 16 nt, Human
uaguuuuauaugcuuc

SEQ ID NO: 2710807 - RNA, 20 nt, Human
uaguuccucauuagcauuuu

SEQ ID NO: 2710808 - RNA, 22 nt, Human
uagugagcagucaggaaagaga

SEQ ID NO: 2710809 - RNA, 21 nt, Human
uagucaggugccucaagagaa

SEQ ID NO: 2710810 - RNA, 19 nt, Human
acaagcugcacccucaggc

SEQ ID NO: 2710811 - RNA, 21 nt, Human
acaagcugcacccucaggcag

SEQ ID NO: 2710812 - RNA, 22 nt, Human
acaagcugcacccucaggcagg

SEQ ID NO: 2710813 - RNA, 23 nt, Human
acaagcugcacccucaggcaggu

SEQ ID NO: 2710814 - RNA, 22 nt, Human
acacaucagcuugcccuguuaa

SEQ ID NO: 2710815 - RNA, 18 nt, Human
acacaugcaaggucauuu

SEQ ID NO: 2710816 - RNA, 20 nt, Human
acacaugcaaggucauuuuu

SEQ ID NO: 2710817 - RNA, 19 nt, Human
acacaugcaaggucauuuu

SEQ ID NO: 2710818 - RNA, 21 nt, Human
uauaaaauaauuuuuauauuu

SEQ ID NO: 2710819 - RNA, 22 nt, Human
uauaaaauaauuuuuauauuug

SEQ ID NO: 2710820 - RNA, 11 nt, Human
acacccuguga

SEQ ID NO: 2710821 - RNA, 12 nt, Human
acacccugugau

SEQ ID NO: 2710822 - RNA, 18 nt, Human
acacccugugauggggcc

SEQ ID NO: 2710823 - RNA, 19 nt, Human
acacccagcccacuucugc

SEQ ID NO: 2710824 - RNA, 20 nt, Human
acacccagcccacuucugcc

SEQ ID NO: 2710825 - RNA, 21 nt, Human
acacccagcccacuucugcca

SEQ ID NO: 2710826 - RNA, 21 nt, Human
acacaugcaaggucauuuuuu

SEQ ID NO: 2710827 - RNA, 20 nt, Human
acucauuuuaaaaaauggaa

SEQ ID NO: 2710828 - RNA, 21 nt, Human
ucccucagucuggcccuuccu

SEQ ID NO: 2710829 - RNA, 22 nt, Human
ucccucauccucauacccaccc

SEQ ID NO: 2710830 - RNA, 20 nt, Human
uccuagcacuuugggaggcc

SEQ ID NO: 2710831 - RNA, 14 nt, Human
uccuaggcauuugc

SEQ ID NO: 2710832 - RNA, 15 nt, Human
uccgugcuaaggacu

SEQ ID NO: 2710833 - RNA, 14 nt, Human
uccgugcuaaggac

SEQ ID NO: 2710834 - RNA, 21 nt, Human
ucccuuugacgccaucccagc

SEQ ID NO: 2710835 - RNA, 22 nt, Human
ucccuuugacgccaucccagcc

SEQ ID NO: 2710836 - RNA, 23 nt, Human
ucccuuugacgccaucccagccc

SEQ ID NO: 2710837 - RNA, 22 nt, Human
ucccuuuccaaaugcccagcuu

SEQ ID NO: 2710838 - RNA, 18 nt, Human
ucccuuacgugaguccug

SEQ ID NO: 2710839 - RNA, 22 nt, Human
ucccuuacgugaguccuggcau

SEQ ID NO: 2710840 - RNA, 23 nt, Human
ucccugguggcagcucaccucuc

SEQ ID NO: 2710841 - RNA, 16 nt, Human
acucuuauugcccacg

SEQ ID NO: 2710842 - RNA, 19 nt, Human
acucuuauugcccacgcug

SEQ ID NO: 2710843 - RNA, 20 nt, Human
uccucagaucuucugugggu

SEQ ID NO: 2710844 - RNA, 22 nt, Human
uccucauacccacccccaccca

SEQ ID NO: 2710845 - RNA, 14 nt, Human
uccucauacccacc

SEQ ID NO: 2710846 - RNA, 18 nt, Human
uccucauacccaccccca

SEQ ID NO: 2710847 - RNA, 12 nt, Human
uccucuccccag

SEQ ID NO: 2710848 - RNA, 15 nt, Human
uccucccucccucuu

SEQ ID NO: 2710849 - RNA, 17 nt, Human
uccucccucccucuuuc

SEQ ID NO: 2710850 - RNA, 19 nt, Human
uccucccucccucuuuccc

SEQ ID NO: 2710851 - RNA, 23 nt, Human
acucuuauaucuauauuuuacau

SEQ ID NO: 2710852 - RNA, 22 nt, Human
acucuuauaucuauauuuuaca

SEQ ID NO: 2710853 - RNA, 18 nt, Human
acucuccucugcugcugg

SEQ ID NO: 2710854 - RNA, 19 nt, Human
acucuccucugcugcuggc

SEQ ID NO: 2710855 - RNA, 22 nt, Human
acucuccauuuaauaauuauau

SEQ ID NO: 2710856 - RNA, 17 nt, Human
acucuccucugcugcug

SEQ ID NO: 2710857 - RNA, 17 nt, Human
acucgcgacaaugcaaa

SEQ ID NO: 2710858 - RNA, 20 nt, Human
acucgcgacaaugcaaacca

SEQ ID NO: 2710859 - RNA, 23 nt, Human
acucgcgacaaugcaaaccauca

SEQ ID NO: 2710860 - RNA, 19 nt, Human
uccuaggcauuugcugaau

SEQ ID NO: 2710861 - RNA, 18 nt, Human
acucgcgacaaugcaaac

SEQ ID NO: 2710862 - RNA, 12 nt, Human
uccccuccucug

SEQ ID NO: 2710863 - RNA, 15 nt, Human
ucccgaauagcuggg

SEQ ID NO: 2710864 - RNA, 16 nt, Human
ucccgaauagcuggga

SEQ ID NO: 2710865 - RNA, 18 nt, Human
ucccuauuagagaagaga

SEQ ID NO: 2710866 - RNA, 20 nt, Human
ucccgaguagcugggacuac

SEQ ID NO: 2710867 - RNA, 18 nt, Human
ucccgaauagcugggacu

SEQ ID NO: 2710868 - RNA, 17 nt, Human
acuauguugcccaggca

SEQ ID NO: 2710869 - RNA, 18 nt, Human
acuauguugcccaggcag

SEQ ID NO: 2710870 - RNA, 19 nt, Human
acuauguugcccaggcagg

SEQ ID NO: 2710871 - RNA, 20 nt, Human
acuauguugcccaggcaggu

SEQ ID NO: 2710872 - RNA, 23 nt, Human
acuauguugcccaggcaggucuu

SEQ ID NO: 2710873 - RNA, 17 nt, Human
acuauagccuaggugac

SEQ ID NO: 2710874 - RNA, 23 nt, Human
acuauaauuuaccugaagucuuu

SEQ ID NO: 2710875 - RNA, 21 nt, Human
acuauaauguaagcucuacug

SEQ ID NO: 2710876 - RNA, 24 nt, Human
uccccaccgcagacaggaccaggg

SEQ ID NO: 2710877 - RNA, 23 nt, Human
uccccaggaggccagccuugacc

SEQ ID NO: 2710878 - RNA, 14 nt, Human
acguuucuaaaggc

SEQ ID NO: 2710879 - RNA, 13 nt, Human
uccagccugggug

SEQ ID NO: 2710880 - RNA, 24 nt, Human
uccagccugggugacagagcaagu

SEQ ID NO: 2710881 - RNA, 14 nt, Human
uccagcucaccagc

SEQ ID NO: 2710882 - RNA, 12 nt, Human
acguuucuaaag

SEQ ID NO: 2710883 - RNA, 15 nt, Human
acuacaguccuccca

SEQ ID NO: 2710884 - RNA, 23 nt, Human
acuacaggugugagucaccaagc

SEQ ID NO: 2710885 - RNA, 17 nt, Human
acuaaccagcagaaaug

SEQ ID NO: 2710886 - RNA, 13 nt, Human
acuaaccacgcug

SEQ ID NO: 2710887 - RNA, 16 nt, Human
acuaaccagcagaaau

SEQ ID NO: 2710888 - RNA, 15 nt, Human
ucccauaugccuggg

SEQ ID NO: 2710889 - RNA, 13 nt, Human
ucccaucucacac

SEQ ID NO: 2710890 - RNA, 14 nt, Human
ucccaucucacaca

SEQ ID NO: 2710891 - RNA, 19 nt, Human
ucccaucucacacaugagc

SEQ ID NO: 2710892 - RNA, 16 nt, Human
acuacaguccucccau

SEQ ID NO: 2710893 - RNA, 19 nt, Human
ucccagugccgagaaggaa

SEQ ID NO: 2710894 - RNA, 22 nt, Human
ucccagugccgagaaggaagcc

SEQ ID NO: 2710895 - RNA, 15 nt, Human
ucccagugaauucuu

SEQ ID NO: 2710896 - RNA, 11 nt, Human
uccuucagugc

SEQ ID NO: 2710897 - RNA, 12 nt, Human
uccuucagugcc

SEQ ID NO: 2710898 - RNA, 22 nt, Human
uccuucagugccuuauggaaca

SEQ ID NO: 2710899 - RNA, 13 nt, Human
uccuucagugccu

SEQ ID NO: 2710900 - RNA, 20 nt, Human
uccuucagugccuuauggaa

SEQ ID NO: 2710901 - RNA, 22 nt, Human
acuggcacaguuuucugagaaa

SEQ ID NO: 2710902 - RNA, 21 nt, Human
acuggcacaguuuucugagaa

SEQ ID NO: 2710903 - RNA, 22 nt, Human
acuggcugcaaaggguaucagg

SEQ ID NO: 2710904 - RNA, 20 nt, Human
acugccuucucaacuccaaa

SEQ ID NO: 2710905 - RNA, 22 nt, Human
acugccuucucaacuccaaacu

SEQ ID NO: 2710906 - RNA, 16 nt, Human
acuggauuguacuuug

SEQ ID NO: 2710907 - RNA, 22 nt, Human
acuggauuaaacuuaaucuaaa

SEQ ID NO: 2710908 - RNA, 13 nt, Human
acuggauuguacu

SEQ ID NO: 2710909 - RNA, 18 nt, Human
acugcuuccagugaggcu

SEQ ID NO: 2710910 - RNA, 21 nt, Human
acugcuuccagugaggcucug

SEQ ID NO: 2710911 - RNA, 22 nt, Human
acugcuuccagugaggcucugc

SEQ ID NO: 2710912 - RNA, 23 nt, Human
acugcuuccagugaggcucugcc

SEQ ID NO: 2710913 - RNA, 14 nt, Human
ucgcgacaaugcaa

SEQ ID NO: 2710914 - RNA, 13 nt, Human
ucgcgacaaugca

SEQ ID NO: 2710915 - RNA, 14 nt, Human
ucgaggacagggag

SEQ ID NO: 2710916 - RNA, 17 nt, Human
ucgaggacagggaggug

SEQ ID NO: 2710917 - RNA, 13 nt, Human
ucgaggacaggga

SEQ ID NO: 2710918 - RNA, 14 nt, Human
ucgagcaugccugg

SEQ ID NO: 2710919 - RNA, 15 nt, Human
uccuuucaccacaug

SEQ ID NO: 2710920 - RNA, 22 nt, Human
uccuuucuaacaaaaaaauaua

SEQ ID NO: 2710921 - RNA, 15 nt, Human
ucgaacuggcugcaa

SEQ ID NO: 2710922 - RNA, 14 nt, Human
ucgaacuggcugca

SEQ ID NO: 2710923 - RNA, 13 nt, Human
ucgaacuggcugc

SEQ ID NO: 2710924 - RNA, 20 nt, Human
acuggguacuuguggacaca

SEQ ID NO: 2710925 - RNA, 23 nt, Human
acuggguacuuguggacacagcu

SEQ ID NO: 2710926 - RNA, 19 nt, Human
acuggguacuuguggacac

SEQ ID NO: 2710927 - RNA, 12 nt, Human
ucgcuccugugu

SEQ ID NO: 2710928 - RNA, 13 nt, Human
ucgcuccuguguc

SEQ ID NO: 2710929 - RNA, 22 nt, Human
acugggcuuggggaccagagcu

SEQ ID NO: 2710930 - RNA, 14 nt, Human
acuguacaugaaaa

SEQ ID NO: 2710931 - RNA, 13 nt, Human
acuguacaugaaa

SEQ ID NO: 2710932 - RNA, 23 nt, Human
acuguacaugaaaacacauuuuu

SEQ ID NO: 2710933 - RNA, 13 nt, Human
acuguacaaagua

SEQ ID NO: 2710934 - RNA, 19 nt, Human
acuguaauuugugauacaa

SEQ ID NO: 2710935 - RNA, 15 nt, Human
acuguacaaaguaga

SEQ ID NO: 2710936 - RNA, 14 nt, Human
acuguacaaaguag

SEQ ID NO: 2710937 - RNA, 18 nt, Human
uccugggcagcugccucc

SEQ ID NO: 2710938 - RNA, 19 nt, Human
uccugggcagcugccuccc

SEQ ID NO: 2710939 - RNA, 22 nt, Human
uccugggcagcugccuccccuc

SEQ ID NO: 2710940 - RNA, 23 nt, Human
uccugggcagcugccuccccucc

SEQ ID NO: 2710941 - RNA, 14 nt, Human
uccugggcagcugc

SEQ ID NO: 2710942 - RNA, 15 nt, Human
uccugggcagcugcc

SEQ ID NO: 2710943 - RNA, 16 nt, Human
uccugggcagcugccu

SEQ ID NO: 2710944 - RNA, 17 nt, Human
uccugggcagcugccuc

SEQ ID NO: 2710945 - RNA, 13 nt, Human
uccugcugcaguu

SEQ ID NO: 2710946 - RNA, 19 nt, Human
acugcagccucaaccuccu

SEQ ID NO: 2710947 - RNA, 21 nt, Human
acugcagccucaaccuccugg

SEQ ID NO: 2710948 - RNA, 22 nt, Human
acugcagccucaaccuccuggg

SEQ ID NO: 2710949 - RNA, 13 nt, Human
acugcacuguuuu

SEQ ID NO: 2710950 - RNA, 23 nt, Human
acugcagccucaaccuccugggc

SEQ ID NO: 2710951 - RNA, 19 nt, Human
uccuguucccaugagauga

SEQ ID NO: 2710952 - RNA, 23 nt, Human
uccugugucuugcaauggcagcc

SEQ ID NO: 2710953 - RNA, 24 nt, Human
uccugugucuugcaauggcagccu

SEQ ID NO: 2710954 - RNA, 18 nt, Human
uccugugugugcgccuac

SEQ ID NO: 2710955 - RNA, 13 nt, Human
uccugugugugcg

SEQ ID NO: 2710956 - RNA, 14 nt, Human
uccugugugugcgc

SEQ ID NO: 2710957 - RNA, 15 nt, Human
uccucuccccagcaa

SEQ ID NO: 2710958 - RNA, 23 nt, Human
acugaguacguugugcauuuggu

SEQ ID NO: 2710959 - RNA, 22 nt, Human
acugaguacguugugcauuugg

SEQ ID NO: 2710960 - RNA, 18 nt, Human
acugaguacguugugcau

SEQ ID NO: 2710961 - RNA, 21 nt, Human
acugaguacguugugcauuug

SEQ ID NO: 2710962 - RNA, 19 nt, Human
acugaguacguugugcauu

SEQ ID NO: 2710963 - RNA, 13 nt, Human
acugcaaccuccg

SEQ ID NO: 2710964 - RNA, 14 nt, Human
acugcaaccuccgc

SEQ ID NO: 2710965 - RNA, 16 nt, Human
acugcaaccuccgccu

SEQ ID NO: 2710966 - RNA, 22 nt, Human
acugcaaccuccgccucuuggg

SEQ ID NO: 2710967 - RNA, 20 nt, Human
uccugccucgaacuggcugc

SEQ ID NO: 2710968 - RNA, 22 nt, Human
uccugcaggcagccaggccaca

SEQ ID NO: 2710969 - RNA, 19 nt, Human
uccugccucagccucccaa

SEQ ID NO: 2710970 - RNA, 16 nt, Human
uccugcaggcagccag

SEQ ID NO: 2710971 - RNA, 17 nt, Human
uccugcaggcagccagg

SEQ ID NO: 2710972 - RNA, 19 nt, Human
uccugcaggcagccaggcc

SEQ ID NO: 2710973 - RNA, 20 nt, Human
uccugcaggcagccaggcca

SEQ ID NO: 2710974 - RNA, 15 nt, Human
uccugcaggcagcca

SEQ ID NO: 2710975 - RNA, 22 nt, Human
uccagccccuggaugcagccuc

SEQ ID NO: 2710976 - RNA, 11 nt, Human
uccagccuggg

SEQ ID NO: 2710977 - RNA, 15 nt, Human
uccagccccuggaug

SEQ ID NO: 2710978 - RNA, 14 nt, Human
uccagccccuggau

SEQ ID NO: 2710979 - RNA, 16 nt, Human
uccagccccuggaugc

SEQ ID NO: 2710980 - RNA, 17 nt, Human
uccagccccuggaugca

SEQ ID NO: 2710981 - RNA, 19 nt, Human
uccagccccuggaugcagc

SEQ ID NO: 2710982 - RNA, 21 nt, Human
uccagccccuggaugcagccu

SEQ ID NO: 2710983 - RNA, 22 nt, Human
uccagaaguuugagaucagccu

SEQ ID NO: 2710984 - RNA, 23 nt, Human
accuuuguauucucuccuguacc

SEQ ID NO: 2710985 - RNA, 19 nt, Human
accuuuguauucucuccug

SEQ ID NO: 2710986 - RNA, 15 nt, Human
accuuuguauucucu

SEQ ID NO: 2710987 - RNA, 15 nt, Human
uccaccaucaagcca

SEQ ID NO: 2710988 - RNA, 17 nt, Human
accuuagacagucccug

SEQ ID NO: 2710989 - RNA, 12 nt, Human
accuucuccuuc

SEQ ID NO: 2710990 - RNA, 15 nt, Human
accuugacagggcac

SEQ ID NO: 2710991 - RNA, 14 nt, Human
accuugacagggca

SEQ ID NO: 2710992 - RNA, 15 nt, Human
accuugaaugaugcc

SEQ ID NO: 2710993 - RNA, 13 nt, Human
accuucuccuuca

SEQ ID NO: 2710994 - RNA, 12 nt, Human
uccaagcuccca

SEQ ID NO: 2710995 - RNA, 13 nt, Human
uccaagcucccag

SEQ ID NO: 2710996 - RNA, 16 nt, Human
uccaagcucccaggca

SEQ ID NO: 2710997 - RNA, 14 nt, Human
uccaagcucccagg

SEQ ID NO: 2710998 - RNA, 15 nt, Human
uccaagcucccaggc

SEQ ID NO: 2710999 - RNA, 11 nt, Human
uccaagcuggu

SEQ ID NO: 2711000 - RNA, 19 nt, Human
ucauuugagcagggcucag

SEQ ID NO: 2711001 - RNA, 17 nt, Human
accuggaauauauaacc

SEQ ID NO: 2711002 - RNA, 14 nt, Human
accuggaauauaua

SEQ ID NO: 2711003 - RNA, 18 nt, Human
accugcggugcuaucucc

SEQ ID NO: 2711004 - RNA, 15 nt, Human
accugaagucuuugu

SEQ ID NO: 2711005 - RNA, 22 nt, Human
accugaagucuuuguacagaca

SEQ ID NO: 2711006 - RNA, 23 nt, Human
accugcggugcuaucucccccag

SEQ ID NO: 2711007 - RNA, 19 nt, Human
accugcggugcuaucuccc

SEQ ID NO: 2711008 - RNA, 22 nt, Human
accugcggugcuaucuccccca

SEQ ID NO: 2711009 - RNA, 20 nt, Human
ucauuuuagggguagcauuu

SEQ ID NO: 2711010 - RNA, 21 nt, Human
ucauuugagcagggcucagcg

SEQ ID NO: 2711011 - RNA, 13 nt, Human
ucauuuuuuuuaa

SEQ ID NO: 2711012 - RNA, 22 nt, Human
ucaugaauuaguuuuauaugcu

SEQ ID NO: 2711013 - RNA, 23 nt, Human
ucauccacugugccaugugccag

SEQ ID NO: 2711014 - RNA, 19 nt, Human
ucauccacugugccaugug

SEQ ID NO: 2711015 - RNA, 21 nt, Human
ucauccacugugccaugugcc

SEQ ID NO: 2711016 - RNA, 19 nt, Human
ucaugacaaagacugagua

SEQ ID NO: 2711017 - RNA, 21 nt, Human
ucaugaauuaguuuuauaugc

SEQ ID NO: 2711018 - RNA, 13 nt, Human
ucaugucuggcua

SEQ ID NO: 2711019 - RNA, 17 nt, Human
ucauguucuuaauucuu

SEQ ID NO: 2711020 - RNA, 11 nt, Human
ucauguucuua

SEQ ID NO: 2711021 - RNA, 12 nt, Human
accucugcacaa

SEQ ID NO: 2711022 - RNA, 19 nt, Human
accucucucacuccuugaa

SEQ ID NO: 2711023 - RNA, 23 nt, Human
accucucccuuggauuguccccg

SEQ ID NO: 2711024 - RNA, 14 nt, Human
accucucucacucc

SEQ ID NO: 2711025 - RNA, 13 nt, Human
accucucccuugg

SEQ ID NO: 2711026 - RNA, 14 nt, Human
accucucccuugga

SEQ ID NO: 2711027 - RNA, 15 nt, Human
accucucccuuggau

SEQ ID NO: 2711028 - RNA, 21 nt, Human
accucuaaauucuuucauuuu

SEQ ID NO: 2711029 - RNA, 22 nt, Human
ucauugaccugaggcccuucuc

SEQ ID NO: 2711030 - RNA, 19 nt, Human
ucauugaccugaggcccuu

SEQ ID NO: 2711031 - RNA, 21 nt, Human
ucauucuccuuguguuacuaa

SEQ ID NO: 2711032 - RNA, 17 nt, Human
accucggugccuuccuc

SEQ ID NO: 2711033 - RNA, 18 nt, Human
accucuaaauucuuucau

SEQ ID NO: 2711034 - RNA, 20 nt, Human
accuccgccucuuggguuca

SEQ ID NO: 2711035 - RNA, 13 nt, Human
accuagccuuaga

SEQ ID NO: 2711036 - RNA, 10 nt, Human
acccuuuucu

SEQ ID NO: 2711037 - RNA, 19 nt, Human
ucauauuaauauauuucca

SEQ ID NO: 2711038 - RNA, 16 nt, Human
ucauauuuacuucuua

SEQ ID NO: 2711039 - RNA, 22 nt, Human
ucauauuuacuucuuauacauu

SEQ ID NO: 2711040 - RNA, 21 nt, Human
ucauauuuacuucuuauacau

SEQ ID NO: 2711041 - RNA, 20 nt, Human
ucauauuuacuucuuauaca

SEQ ID NO: 2711042 - RNA, 17 nt, Human
accgccaaggcuggggg

SEQ ID NO: 2711043 - RNA, 20 nt, Human
accgcagacaggaccaggga

SEQ ID NO: 2711044 - RNA, 13 nt, Human
ucagauuuuauua

SEQ ID NO: 2711045 - RNA, 15 nt, Human
ucagauuuuauuaug

SEQ ID NO: 2711046 - RNA, 14 nt, Human
ucagauuuuauuau

SEQ ID NO: 2711047 - RNA, 13 nt, Human
ucagaucuucugu

SEQ ID NO: 2711048 - RNA, 13 nt, Human
ucagaagacacug

SEQ ID NO: 2711049 - RNA, 21 nt, Human
ucagaucugccuaaggacuuc

SEQ ID NO: 2711050 - RNA, 13 nt, Human
acccagcucuggu

SEQ ID NO: 2711051 - RNA, 15 nt, Human
acccagcucuggucc

SEQ ID NO: 2711052 - RNA, 20 nt, Human
ucagauuuuauuauguaaau

SEQ ID NO: 2711053 - RNA, 19 nt, Human
ucagauuuuauuauguaaa

SEQ ID NO: 2711054 - RNA, 16 nt, Human
ucagauuuuauuaugu

SEQ ID NO: 2711055 - RNA, 10 nt, Human
ucagccuggg

SEQ ID NO: 2711056 - RNA, 12 nt, Human
ucagccugggca

SEQ ID NO: 2711057 - RNA, 15 nt, Human
acccccagccugcua

SEQ ID NO: 2711058 - RNA, 14 nt, Human
acccccagccugcu

SEQ ID NO: 2711059 - RNA, 14 nt, Human
acccucuuagaaaa

SEQ ID NO: 2711060 - RNA, 14 nt, Human
acccugcccugugg

SEQ ID NO: 2711061 - RNA, 13 nt, Human
acccugcccugug

SEQ ID NO: 2711062 - RNA, 11 nt, Human
acccugcccug

SEQ ID NO: 2711063 - RNA, 12 nt, Human
acccugcccugu

SEQ ID NO: 2711064 - RNA, 15 nt, Human
acccuugugguccca

SEQ ID NO: 2711065 - RNA, 19 nt, Human
acccuuguggucccacccc

SEQ ID NO: 2711066 - RNA, 16 nt, Human
acccuuguggucccac

SEQ ID NO: 2711067 - RNA, 17 nt, Human
acccuuguggucccacc

SEQ ID NO: 2711068 - RNA, 23 nt, Human
ucaggguuggccccugcccggcu

SEQ ID NO: 2711069 - RNA, 20 nt, Human
accccuucgcuccugugucu

SEQ ID NO: 2711070 - RNA, 13 nt, Human
ucagggucccugg

SEQ ID NO: 2711071 - RNA, 14 nt, Human
ucagggucccuggu

SEQ ID NO: 2711072 - RNA, 18 nt, Human
ucagggucccugguggca

SEQ ID NO: 2711073 - RNA, 13 nt, Human
ucagguaacaggc

SEQ ID NO: 2711074 - RNA, 15 nt, Human
ucagguaacaggcag

SEQ ID NO: 2711075 - RNA, 16 nt, Human
ucagguaacaggcaga

SEQ ID NO: 2711076 - RNA, 19 nt, Human
accccuucgcuccuguguc

SEQ ID NO: 2711077 - RNA, 15 nt, Human
ucaggccagcugcuu

SEQ ID NO: 2711078 - RNA, 20 nt, Human
ucaggccagcugcuugggcu

SEQ ID NO: 2711079 - RNA, 11 nt, Human
ucaggccaggc

SEQ ID NO: 2711080 - RNA, 14 nt, Human
ucaggccagcugcu

SEQ ID NO: 2711081 - RNA, 20 nt, Human
ucaggccaaacucaccugcc

SEQ ID NO: 2711082 - RNA, 23 nt, Human
ucaggccaaacucaccugccccu

SEQ ID NO: 2711083 - RNA, 16 nt, Human
ucaggaagcucagggc

SEQ ID NO: 2711084 - RNA, 17 nt, Human
ucaggaagcucagggcc

SEQ ID NO: 2711085 - RNA, 19 nt, Human
ucaggaagcucagggccug

SEQ ID NO: 2711086 - RNA, 20 nt, Human
ucaggaagcucagggccugg

SEQ ID NO: 2711087 - RNA, 15 nt, Human
ucagcggggacagcu

SEQ ID NO: 2711088 - RNA, 16 nt, Human
ucagcggggacagcuc

SEQ ID NO: 2711089 - RNA, 17 nt, Human
ucagcggggacagcucc

SEQ ID NO: 2711090 - RNA, 23 nt, Human
accauuuugggguacccacugcu

SEQ ID NO: 2711091 - RNA, 22 nt, Human
accauuuugggguacccacugc

SEQ ID NO: 2711092 - RNA, 23 nt, Human
accaugauuaaccacuucagcug

SEQ ID NO: 2711093 - RNA, 22 nt, Human
accaugauuaaccacuucagcu

SEQ ID NO: 2711094 - RNA, 18 nt, Human
accauucuccaccugcca

SEQ ID NO: 2711095 - RNA, 13 nt, Human
accauucuccacc

SEQ ID NO: 2711096 - RNA, 16 nt, Human
accauucuccaccugc

SEQ ID NO: 2711097 - RNA, 16 nt, Human
acccagaagaaaauag

SEQ ID NO: 2711098 - RNA, 16 nt, Human
acccagcccacuucug

SEQ ID NO: 2711099 - RNA, 17 nt, Human
acccagcccacuucugc

SEQ ID NO: 2711100 - RNA, 18 nt, Human
acccagcccacuucugcc

SEQ ID NO: 2711101 - RNA, 16 nt, Human
ucaccugccccucaac

SEQ ID NO: 2711102 - RNA, 13 nt, Human
ucacugagacagc

SEQ ID NO: 2711103 - RNA, 14 nt, Human
ucacugagacagcc

SEQ ID NO: 2711104 - RNA, 15 nt, Human
ucacugagacagccc

SEQ ID NO: 2711105 - RNA, 16 nt, Human
ucacuguugcccaggc

SEQ ID NO: 2711106 - RNA, 12 nt, Human
ucacugcagccu

SEQ ID NO: 2711107 - RNA, 17 nt, Human
ucacuguugcccaggcu

SEQ ID NO: 2711108 - RNA, 18 nt, Human
ucacuguugcccaggcug

SEQ ID NO: 2711109 - RNA, 21 nt, Human
accaguguuguggauuuaaca

SEQ ID NO: 2711110 - RNA, 12 nt, Human
uauuucauuucu

SEQ ID NO: 2711111 - RNA, 11 nt, Human
accacagcagu

SEQ ID NO: 2711112 - RNA, 14 nt, Human
accacaucuugcuc

SEQ ID NO: 2711113 - RNA, 22 nt, Human
accacagacauacuaaccagca

SEQ ID NO: 2711114 - RNA, 21 nt, Human
accacagacauacuaaccagc

SEQ ID NO: 2711115 - RNA, 15 nt, Human
accacuucagcugac

SEQ ID NO: 2711116 - RNA, 13 nt, Human
accacuucagcug

SEQ ID NO: 2711117 - RNA, 14 nt, Human
accacuucagcuga

SEQ ID NO: 2711118 - RNA, 20 nt, Human
accacucuaucaaguauuau

SEQ ID NO: 2711119 - RNA, 20 nt, Human
accacaucuugcucugcuga

SEQ ID NO: 2711120 - RNA, 21 nt, Human
accacaucuugcucugcugac

SEQ ID NO: 2711121 - RNA, 24 nt, Human
accacaucuugcucugcugacaga

SEQ ID NO: 2711122 - RNA, 19 nt, Human
accacuuguguuuugcaag

SEQ ID NO: 2711123 - RNA, 23 nt, Human
accacuuguguuuugcaagccag

SEQ ID NO: 2711124 - RNA, 17 nt, Human
accagacaccuugacag

SEQ ID NO: 2711125 - RNA, 12 nt, Human
accacuuuuguu

SEQ ID NO: 2711126 - RNA, 22 nt, Human
accagacaccuugacagggcac

SEQ ID NO: 2711127 - RNA, 23 nt, Human
accagacaccuugacagggcaca

SEQ ID NO: 2711128 - RNA, 17 nt, Human
accagagcccaccuugg

SEQ ID NO: 2711129 - RNA, 19 nt, Human
accagagcccaccuuggcu

SEQ ID NO: 2711130 - RNA, 22 nt, Human
accagagcccaccuuggcucaa

SEQ ID NO: 2711131 - RNA, 19 nt, Human
ucaccugaagacucauucu

SEQ ID NO: 2711132 - RNA, 23 nt, Human
ucaccugaagacucauucuucug

SEQ ID NO: 2711133 - RNA, 16 nt, Human
agcaccaaucaugaau

SEQ ID NO: 2711134 - RNA, 22 nt, Human
agcaccaaaagcuuaccaaggg

SEQ ID NO: 2711135 - RNA, 14 nt, Human
agcacaugccucuc

SEQ ID NO: 2711136 - RNA, 13 nt, Human
agcacaugccucu

SEQ ID NO: 2711137 - RNA, 22 nt, Human
agcacagccucuuagaugcagu

SEQ ID NO: 2711138 - RNA, 16 nt, Human
agcacagcuucauuuc

SEQ ID NO: 2711139 - RNA, 15 nt, Human
agcacagugaucaag

SEQ ID NO: 2711140 - RNA, 22 nt, Human
agcaagugagagcuggguguca

SEQ ID NO: 2711141 - RNA, 18 nt, Human
agcaagugagagcugggu

SEQ ID NO: 2711142 - RNA, 14 nt, Human
agcaagugagagcu

SEQ ID NO: 2711143 - RNA, 20 nt, Human
agcaagugagacccugucuc

SEQ ID NO: 2711144 - RNA, 13 nt, Human
agcaagugagagc

SEQ ID NO: 2711145 - RNA, 17 nt, Human
ugagccagauuucacuc

SEQ ID NO: 2711146 - RNA, 22 nt, Human
ugagccagauuucacucuccuu

SEQ ID NO: 2711147 - RNA, 14 nt, Human
agcaacgcaggccc

SEQ ID NO: 2711148 - RNA, 15 nt, Human
ugagcaauccugcaa

SEQ ID NO: 2711149 - RNA, 20 nt, Human
ugagcacuaaggugugcucu

SEQ ID NO: 2711150 - RNA, 21 nt, Human
ugagcacuaaggugugcucug

SEQ ID NO: 2711151 - RNA, 22 nt, Human
ugagcacuaaggugugcucuga

SEQ ID NO: 2711152 - RNA, 23 nt, Human
ugagcacuaaggugugcucugau

SEQ ID NO: 2711153 - RNA, 21 nt, Human
ugagcaucaggccaggcccuc

SEQ ID NO: 2711154 - RNA, 22 nt, Human
ugagcaucaggccaggcccucu

SEQ ID NO: 2711155 - RNA, 24 nt, Human
ugagcaucaggccaggcccucugc

SEQ ID NO: 2711156 - RNA, 21 nt, Human
ugagccacugcaccgggccac

SEQ ID NO: 2711157 - RNA, 18 nt, Human
ugagccacugcaccgggc

SEQ ID NO: 2711158 - RNA, 23 nt, Human
ugagccacugcaccgggccacag

SEQ ID NO: 2711159 - RNA, 13 nt, Human
ugagccagauuuc

SEQ ID NO: 2711160 - RNA, 14 nt, Human
ugagccagauuuca

SEQ ID NO: 2711161 - RNA, 16 nt, Human
ugagccagauuucacu

SEQ ID NO: 2711162 - RNA, 19 nt, Human
agcagaaaugccuuacccu

SEQ ID NO: 2711163 - RNA, 13 nt, Human
agcagaaaugccu

SEQ ID NO: 2711164 - RNA, 12 nt, Human
agcagaaaugcc

SEQ ID NO: 2711165 - RNA, 22 nt, Human
agcacuuugggaggccaaggug

SEQ ID NO: 2711166 - RNA, 23 nt, Human
agcacuuugggaggccaaggugg

SEQ ID NO: 2711167 - RNA, 13 nt, Human
agcacgauuucug

SEQ ID NO: 2711168 - RNA, 23 nt, Human
agcaccuuagacagucccugcca

SEQ ID NO: 2711169 - RNA, 16 nt, Human
agcacgauuucuguuu

SEQ ID NO: 2711170 - RNA, 15 nt, Human
agcacgauuucuguu

SEQ ID NO: 2711171 - RNA, 14 nt, Human
agcacgauuucugu

SEQ ID NO: 2711172 - RNA, 19 nt, Human
agcaccuuagacagucccu

SEQ ID NO: 2711173 - RNA, 20 nt, Human
agcaccuuagacagucccug

SEQ ID NO: 2711174 - RNA, 21 nt, Human
agcaccuuagacagucccugc

SEQ ID NO: 2711175 - RNA, 22 nt, Human
agcaccuuagacagucccugcc

SEQ ID NO: 2711176 - RNA, 19 nt, Human
ugagccuugaacuuugacc

SEQ ID NO: 2711177 - RNA, 18 nt, Human
ugagccuugaacuuugac

SEQ ID NO: 2711178 - RNA, 17 nt, Human
ugagccuugaacuuuga

SEQ ID NO: 2711179 - RNA, 15 nt, Human
ugagccuugaacuuu

SEQ ID NO: 2711180 - RNA, 14 nt, Human
ugagccugggaggu

SEQ ID NO: 2711181 - RNA, 11 nt, Human
ugagccuggca

SEQ ID NO: 2711182 - RNA, 16 nt, Human
ugagccuggcaagaau

SEQ ID NO: 2711183 - RNA, 19 nt, Human
ugagccugggaggucaagg

SEQ ID NO: 2711184 - RNA, 22 nt, Human
ugagccugggaggucaaggcug

SEQ ID NO: 2711185 - RNA, 14 nt, Human
ugagccuugaacuu

SEQ ID NO: 2711186 - RNA, 10 nt, Human
ugagccuggc

SEQ ID NO: 2711187 - RNA, 15 nt, Human
agcagagaccauccc

SEQ ID NO: 2711188 - RNA, 16 nt, Human
agcagagaccaucccu

SEQ ID NO: 2711189 - RNA, 21 nt, Human
agcagagaauucucuuaucca

SEQ ID NO: 2711190 - RNA, 14 nt, Human
agcagagaauucuc

SEQ ID NO: 2711191 - RNA, 22 nt, Human
agcagagaaugaaagggcccag

SEQ ID NO: 2711192 - RNA, 23 nt, Human
agcagagaaugaaagggcccaga

SEQ ID NO: 2711193 - RNA, 21 nt, Human
agcagagaaugaaagggccca

SEQ ID NO: 2711194 - RNA, 13 nt, Human
ugaggucagagcc

SEQ ID NO: 2711195 - RNA, 14 nt, Human
ugaggucagagccu

SEQ ID NO: 2711196 - RNA, 16 nt, Human
ugaggucagagccugc

SEQ ID NO: 2711197 - RNA, 20 nt, Human
ugaggguugggcugguguca

SEQ ID NO: 2711198 - RNA, 20 nt, Human
agcagagaccaucccugaag

SEQ ID NO: 2711199 - RNA, 20 nt, Human
agcagagcaccuuagacagu

SEQ ID NO: 2711200 - RNA, 17 nt, Human
ugaggucagagccugca

SEQ ID NO: 2711201 - RNA, 17 nt, Human
agcagagaccaucccug

SEQ ID NO: 2711202 - RNA, 18 nt, Human
agcagagaccaucccuga

SEQ ID NO: 2711203 - RNA, 19 nt, Human
agcagagaccaucccugaa

SEQ ID NO: 2711204 - RNA, 17 nt, Human
agcagaggaaggagagg

SEQ ID NO: 2711205 - RNA, 20 nt, Human
agcagauuauucacugauuu

SEQ ID NO: 2711206 - RNA, 19 nt, Human
agcagauuauucacugauu

SEQ ID NO: 2711207 - RNA, 19 nt, Human
agcagauggagaccccuug

SEQ ID NO: 2711208 - RNA, 21 nt, Human
agcagauggaaugcuguguua

SEQ ID NO: 2711209 - RNA, 14 nt, Human
agcagauuauucac

SEQ ID NO: 2711210 - RNA, 16 nt, Human
agcagauuauucacug

SEQ ID NO: 2711211 - RNA, 15 nt, Human
agcagauuauucacu

SEQ ID NO: 2711212 - RNA, 19 nt, Human
ugagggauacccaucccau

SEQ ID NO: 2711213 - RNA, 16 nt, Human
ugaggcccuucucucc

SEQ ID NO: 2711214 - RNA, 18 nt, Human
ugaggcccuucucuccag

SEQ ID NO: 2711215 - RNA, 19 nt, Human
ugaggcccuucucuccagc

SEQ ID NO: 2711216 - RNA, 20 nt, Human
ugaggcccuucucuccagcc

SEQ ID NO: 2711217 - RNA, 22 nt, Human
ugaggcccuucucuccagcccc

SEQ ID NO: 2711218 - RNA, 23 nt, Human
ugaggcccuucucuccagccccu

SEQ ID NO: 2711219 - RNA, 24 nt, Human
ugaggcccuucucuccagccccug

SEQ ID NO: 2711220 - RNA, 12 nt, Human
ugaggggccucu

SEQ ID NO: 2711221 - RNA, 13 nt, Human
ugaggggccucuu

SEQ ID NO: 2711222 - RNA, 15 nt, Human
ugaggacacugauau

SEQ ID NO: 2711223 - RNA, 21 nt, Human
ugaggacacuaaccacgcugg

SEQ ID NO: 2711224 - RNA, 23 nt, Human
ugaggcauuuguuugaacugaua

SEQ ID NO: 2711225 - RNA, 12 nt, Human
ugaggccagaga

SEQ ID NO: 2711226 - RNA, 21 nt, Human
ugaggaauccagacccggcug

SEQ ID NO: 2711227 - RNA, 22 nt, Human
ugaggaauccagacccggcugc

SEQ ID NO: 2711228 - RNA, 14 nt, Human
ugaggaauucugua

SEQ ID NO: 2711229 - RNA, 16 nt, Human
ugaggaauucuguaua

SEQ ID NO: 2711230 - RNA, 15 nt, Human
ugaggaauucuguau

SEQ ID NO: 2711231 - RNA, 19 nt, Human
ugaggaauucuguauagau

SEQ ID NO: 2711232 - RNA, 18 nt, Human
ugaggaauucuguauaga

SEQ ID NO: 2711233 - RNA, 23 nt, Human
ugaggcccagagggccugcaagg

SEQ ID NO: 2711234 - RNA, 21 nt, Human
ugaggcccagagggccugcaa

SEQ ID NO: 2711235 - RNA, 22 nt, Human
ugaggcccagagggccugcaag

SEQ ID NO: 2711236 - RNA, 15 nt, Human
ugaggcccagagggc

SEQ ID NO: 2711237 - RNA, 17 nt, Human
ugaggcccagagggccu

SEQ ID NO: 2711238 - RNA, 18 nt, Human
ugaggcccagagggccug

SEQ ID NO: 2711239 - RNA, 20 nt, Human
ugaggcccagagggccugca

SEQ ID NO: 2711240 - RNA, 12 nt, Human
ugaggcccagag

SEQ ID NO: 2711241 - RNA, 13 nt, Human
ugaggcccagagg

SEQ ID NO: 2711242 - RNA, 20 nt, Human
ugaggccagagacacaagcc

SEQ ID NO: 2711243 - RNA, 14 nt, Human
ugaggccagagaca

SEQ ID NO: 2711244 - RNA, 16 nt, Human
ugaggccagagacaca

SEQ ID NO: 2711245 - RNA, 14 nt, Human
ugagcuacaaaugc

SEQ ID NO: 2711246 - RNA, 13 nt, Human
ugagcuacaaaug

SEQ ID NO: 2711247 - RNA, 16 nt, Human
ugagcuacaaaugcau

SEQ ID NO: 2711248 - RNA, 19 nt, Human
ugaggaagccgcuggggcc

SEQ ID NO: 2711249 - RNA, 21 nt, Human
ugaggaagccgcuggggccag

SEQ ID NO: 2711250 - RNA, 22 nt, Human
ugaggaagcaaaagcaucuaug

SEQ ID NO: 2711251 - RNA, 14 nt, Human
ugaggaagccgcug

SEQ ID NO: 2711252 - RNA, 17 nt, Human
ugaggaagccgcugggg

SEQ ID NO: 2711253 - RNA, 18 nt, Human
ugaggaagccgcuggggc

SEQ ID NO: 2711254 - RNA, 15 nt, Human
ugaggaagcaaaagc

SEQ ID NO: 2711255 - RNA, 18 nt, Human
agagucuauuuacggaac

SEQ ID NO: 2711256 - RNA, 15 nt, Human
agagugagacucugu

SEQ ID NO: 2711257 - RNA, 16 nt, Human
agagugagacucuguc

SEQ ID NO: 2711258 - RNA, 22 nt, Human
agagucucacuguugcccaggc

SEQ ID NO: 2711259 - RNA, 20 nt, Human
agagucucacuguugcccag

SEQ ID NO: 2711260 - RNA, 14 nt, Human
ugaaugucagugug

SEQ ID NO: 2711261 - RNA, 15 nt, Human
ugaaugucaguguga

SEQ ID NO: 2711262 - RNA, 18 nt, Human
ugaaugucagugugacug

SEQ ID NO: 2711263 - RNA, 19 nt, Human
agauaaucagugugucuaa

SEQ ID NO: 2711264 - RNA, 19 nt, Human
agagugagacucugucuca

SEQ ID NO: 2711265 - RNA, 17 nt, Human
agauaaggguaucuggu

SEQ ID NO: 2711266 - RNA, 19 nt, Human
agauaaggguaucugguga

SEQ ID NO: 2711267 - RNA, 22 nt, Human
agauauuuugcuuugugauuuu

SEQ ID NO: 2711268 - RNA, 19 nt, Human
agauacaggaaaagcugcu

SEQ ID NO: 2711269 - RNA, 14 nt, Human
agaucaaccccuuc

SEQ ID NO: 2711270 - RNA, 19 nt, Human
agaucaaccccuucgcucc

SEQ ID NO: 2711271 - RNA, 21 nt, Human
agaucaaccccuucgcuccug

SEQ ID NO: 2711272 - RNA, 22 nt, Human
agagggagggagggcuccagac

SEQ ID NO: 2711273 - RNA, 21 nt, Human
agagggagggagggcuccaga

SEQ ID NO: 2711274 - RNA, 20 nt, Human
agagggagggagggcuccag

SEQ ID NO: 2711275 - RNA, 14 nt, Human
ugaagaagauggua

SEQ ID NO: 2711276 - RNA, 20 nt, Human
ugaagaagcaccaaucauga

SEQ ID NO: 2711277 - RNA, 16 nt, Human
ugaacuuugaccucug

SEQ ID NO: 2711278 - RNA, 11 nt, Human
ugaagacaaug

SEQ ID NO: 2711279 - RNA, 17 nt, Human
ugaagacaaugacuuac

SEQ ID NO: 2711280 - RNA, 13 nt, Human
ugaagacaaugac

SEQ ID NO: 2711281 - RNA, 14 nt, Human
ucuuuggucuacac

SEQ ID NO: 2711282 - RNA, 21 nt, Human
ucuuuggucuacacugugcug

SEQ ID NO: 2711283 - RNA, 11 nt, Human
ugaacuuugac

SEQ ID NO: 2711284 - RNA, 19 nt, Human
agagcugggugucaagagg

SEQ ID NO: 2711285 - RNA, 18 nt, Human
agaggcaacugcauuggc

SEQ ID NO: 2711286 - RNA, 21 nt, Human
agaggaaaucaccgaaaacgu

SEQ ID NO: 2711287 - RNA, 11 nt, Human
agaggaaauca

SEQ ID NO: 2711288 - RNA, 12 nt, Human
agaggaaaucac

SEQ ID NO: 2711289 - RNA, 12 nt, Human
agaggaaagcaa

SEQ ID NO: 2711290 - RNA, 16 nt, Human
agaggaaagcaaagga

SEQ ID NO: 2711291 - RNA, 18 nt, Human
agaggaaagcaaaggaga

SEQ ID NO: 2711292 - RNA, 19 nt, Human
agaggaaagcaaaggagau

SEQ ID NO: 2711293 - RNA, 18 nt, Human
agaugcuucucacugcca

SEQ ID NO: 2711294 - RNA, 16 nt, Human
agaugcuucucacugc

SEQ ID NO: 2711295 - RNA, 14 nt, Human
ugaccucugccuga

SEQ ID NO: 2711296 - RNA, 12 nt, Human
ugaccugaggcc

SEQ ID NO: 2711297 - RNA, 13 nt, Human
ugaccucugccug

SEQ ID NO: 2711298 - RNA, 19 nt, Human
agaugaugaugaucuuuaa

SEQ ID NO: 2711299 - RNA, 14 nt, Human
agauccuggaaauc

SEQ ID NO: 2711300 - RNA, 12 nt, Human
ugaauuuauugg

SEQ ID NO: 2711301 - RNA, 16 nt, Human
ugaauuuauuggcuuu

SEQ ID NO: 2711302 - RNA, 15 nt, Human
ugaauuuauuggcuu

SEQ ID NO: 2711303 - RNA, 15 nt, Human
ugacuguuuccauca

SEQ ID NO: 2711304 - RNA, 20 nt, Human
ugacuccagaauuucccaaa

SEQ ID NO: 2711305 - RNA, 23 nt, Human
ugacuccagaauuucccaaagca

SEQ ID NO: 2711306 - RNA, 17 nt, Human
ugaccugaggcccuucu

SEQ ID NO: 2711307 - RNA, 14 nt, Human
ugaccugaggcccu

SEQ ID NO: 2711308 - RNA, 15 nt, Human
ugaccugaggcccuu

SEQ ID NO: 2711309 - RNA, 17 nt, Human
ugacuccagaauuuccc

SEQ ID NO: 2711310 - RNA, 19 nt, Human
ugacuccagaauuucccaa

SEQ ID NO: 2711311 - RNA, 23 nt, Human
agauuauauauauuuuuuucuga

SEQ ID NO: 2711312 - RNA, 16 nt, Human
agauuauucacugauu

SEQ ID NO: 2711313 - RNA, 22 nt, Human
agauucaaugccccugaauuua

SEQ ID NO: 2711314 - RNA, 21 nt, Human
agauucaaugccccugaauuu

SEQ ID NO: 2711315 - RNA, 16 nt, Human
agauuuaccacuugug

SEQ ID NO: 2711316 - RNA, 13 nt, Human
agauuucacucuc

SEQ ID NO: 2711317 - RNA, 14 nt, Human
agauuucacucucc

SEQ ID NO: 2711318 - RNA, 23 nt, Human
agcaaaaauauuuuaugauccag

SEQ ID NO: 2711319 - RNA, 19 nt, Human
agcaaaaauauuuuaugau

SEQ ID NO: 2711320 - RNA, 18 nt, Human
agcaaaaauauuuuauga

SEQ ID NO: 2711321 - RNA, 17 nt, Human
agcaaaaauauuuuaug

SEQ ID NO: 2711322 - RNA, 15 nt, Human
agcaaaaauauuuua

SEQ ID NO: 2711323 - RNA, 12 nt, Human
agauuuucagaa

SEQ ID NO: 2711324 - RNA, 22 nt, Human
agauuuuauuauguaaauccca

SEQ ID NO: 2711325 - RNA, 20 nt, Human
agauuuuauuauguaaaucc

SEQ ID NO: 2711326 - RNA, 21 nt, Human
agauuuuauuauguaaauccc

SEQ ID NO: 2711327 - RNA, 17 nt, Human
agauuuucagaaaauau

SEQ ID NO: 2711328 - RNA, 12 nt, Human
ucucuucuuuaa

SEQ ID NO: 2711329 - RNA, 13 nt, Human
ucucuucuuuaaa

SEQ ID NO: 2711330 - RNA, 14 nt, Human
ucucuugagagggu

SEQ ID NO: 2711331 - RNA, 15 nt, Human
ucucuccagccccug

SEQ ID NO: 2711332 - RNA, 22 nt, Human
ucucuccuguaccucuugagcc

SEQ ID NO: 2711333 - RNA, 20 nt, Human
ucucuccuguaccucuugag

SEQ ID NO: 2711334 - RNA, 13 nt, Human
ucucuccagcccc

SEQ ID NO: 2711335 - RNA, 14 nt, Human
ucucuccagccccu

SEQ ID NO: 2711336 - RNA, 20 nt, Human
ucuccuucaccuuugucccc

SEQ ID NO: 2711337 - RNA, 18 nt, Human
ucuccuucaccuuugucc

SEQ ID NO: 2711338 - RNA, 15 nt, Human
agaaacauuugguaa

SEQ ID NO: 2711339 - RNA, 19 nt, Human
agaaaacaaggaugaauua

SEQ ID NO: 2711340 - RNA, 16 nt, Human
agaaaacaaggaugaa

SEQ ID NO: 2711341 - RNA, 17 nt, Human
agaaaaaugagccuggc

SEQ ID NO: 2711342 - RNA, 18 nt, Human
agaaaaaggaugcacaga

SEQ ID NO: 2711343 - RNA, 13 nt, Human
ucucuugagccug

SEQ ID NO: 2711344 - RNA, 14 nt, Human
ucucuugagccugg

SEQ ID NO: 2711345 - RNA, 15 nt, Human
ucucuugagccuggg

SEQ ID NO: 2711346 - RNA, 22 nt, Human
ucucuuuaaugucacaggcagg

SEQ ID NO: 2711347 - RNA, 22 nt, Human
acuuuuuauggcacuaguauuu

SEQ ID NO: 2711348 - RNA, 14 nt, Human
acuuuuggaaggua

SEQ ID NO: 2711349 - RNA, 18 nt, Human
acuuuaccuuuuuuauac

SEQ ID NO: 2711350 - RNA, 22 nt, Human
acuuuaccuuuuuuauacauaa

SEQ ID NO: 2711351 - RNA, 19 nt, Human
acuuuaccuuuuuuauaca

SEQ ID NO: 2711352 - RNA, 23 nt, Human
acuuugaccucugcagcaauaaa

SEQ ID NO: 2711353 - RNA, 19 nt, Human
acuuugaccucugcagcaa

SEQ ID NO: 2711354 - RNA, 12 nt, Human
acuuuggaaaga

SEQ ID NO: 2711355 - RNA, 13 nt, Human
acuuuggaaagac

SEQ ID NO: 2711356 - RNA, 14 nt, Human
acuuuggaaagacu

SEQ ID NO: 2711357 - RNA, 17 nt, Human
acuuuggaaagacuuuu

SEQ ID NO: 2711358 - RNA, 12 nt, Human
ucuccucugcug

SEQ ID NO: 2711359 - RNA, 19 nt, Human
ucucccuuggauugucccc

SEQ ID NO: 2711360 - RNA, 21 nt, Human
ucucccuuggauuguccccga

SEQ ID NO: 2711361 - RNA, 13 nt, Human
ucuccucugcugc

SEQ ID NO: 2711362 - RNA, 14 nt, Human
ucuccucugcugcu

SEQ ID NO: 2711363 - RNA, 23 nt, Human
acuuguguaaauacaauuuuguu

SEQ ID NO: 2711364 - RNA, 22 nt, Human
acuuguguaaauacaauuuugu

SEQ ID NO: 2711365 - RNA, 21 nt, Human
acuuguguaaauacaauuuug

SEQ ID NO: 2711366 - RNA, 15 nt, Human
ucucccagucauuua

SEQ ID NO: 2711367 - RNA, 11 nt, Human
ucucccuugga

SEQ ID NO: 2711368 - RNA, 18 nt, Human
ucucccuuggauuguccc

SEQ ID NO: 2711369 - RNA, 19 nt, Human
ucuccauuuaauaauuaua

SEQ ID NO: 2711370 - RNA, 16 nt, Human
ucuccauuuaauaauu

SEQ ID NO: 2711371 - RNA, 12 nt, Human
ucuccauuuaau

SEQ ID NO: 2711372 - RNA, 12 nt, Human
ucugcuugccau

SEQ ID NO: 2711373 - RNA, 23 nt, Human
ucugcuuuuuaaagaaugcucuu

SEQ ID NO: 2711374 - RNA, 18 nt, Human
ucuggagguacgaaaaga

SEQ ID NO: 2711375 - RNA, 14 nt, Human
ucuggcagcucaga

SEQ ID NO: 2711376 - RNA, 15 nt, Human
ucuggcagcucagag

SEQ ID NO: 2711377 - RNA, 15 nt, Human
agaagcggcuggcag

SEQ ID NO: 2711378 - RNA, 16 nt, Human
agaagcggcuggcagc

SEQ ID NO: 2711379 - RNA, 11 nt, Human
ucugcuugcca

SEQ ID NO: 2711380 - RNA, 16 nt, Human
ucugcucacauaucug

SEQ ID NO: 2711381 - RNA, 21 nt, Human
agaagaacugaaaucauacuu

SEQ ID NO: 2711382 - RNA, 13 nt, Human
ucugccuaaggac

SEQ ID NO: 2711383 - RNA, 14 nt, Human
ucugcccuccaaga

SEQ ID NO: 2711384 - RNA, 23 nt, Human
ucugccgcagcccugcagagggc

SEQ ID NO: 2711385 - RNA, 16 nt, Human
ucugccuaaggacuuc

SEQ ID NO: 2711386 - RNA, 15 nt, Human
ucugccuaaggacuu

SEQ ID NO: 2711387 - RNA, 14 nt, Human
ucugccuaaggacu

SEQ ID NO: 2711388 - RNA, 22 nt, Human
agaaccucuuugucuacaccau

SEQ ID NO: 2711389 - RNA, 11 nt, Human
agaaauguguu

SEQ ID NO: 2711390 - RNA, 16 nt, Human
agaaauguacagcaag

SEQ ID NO: 2711391 - RNA, 17 nt, Human
agaaauguacagcaagg

SEQ ID NO: 2711392 - RNA, 22 nt, Human
ucugagaaagacuauucaaaca

SEQ ID NO: 2711393 - RNA, 21 nt, Human
ucugagaaagacuauucaaac

SEQ ID NO: 2711394 - RNA, 23 nt, Human
ucugagaaagacuauucaaacag

SEQ ID NO: 2711395 - RNA, 17 nt, Human
ucugauacagaaaaguu

SEQ ID NO: 2711396 - RNA, 16 nt, Human
ucugauacagaaaagu

SEQ ID NO: 2711397 - RNA, 19 nt, Human
ucugauucccaagcucugc

SEQ ID NO: 2711398 - RNA, 20 nt, Human
ucugauucccaagcucugcu

SEQ ID NO: 2711399 - RNA, 21 nt, Human
ucugauucccaagcucugcuc

SEQ ID NO: 2711400 - RNA, 22 nt, Human
ucugcacuccccugcugggugu

SEQ ID NO: 2711401 - RNA, 20 nt, Human
ucugagaaagacuauucaaa

SEQ ID NO: 2711402 - RNA, 19 nt, Human
ucugagaaagacuauucaa

SEQ ID NO: 2711403 - RNA, 15 nt, Human
ucugagaaagacuau

SEQ ID NO: 2711404 - RNA, 14 nt, Human
ucugagaaagacua

SEQ ID NO: 2711405 - RNA, 21 nt, Human
ucugacuguuuccaucaaggg

SEQ ID NO: 2711406 - RNA, 23 nt, Human
agaaagacuauucaaacagucuc

SEQ ID NO: 2711407 - RNA, 20 nt, Human
agaaagacuauucaaacagu

SEQ ID NO: 2711408 - RNA, 18 nt, Human
agaaagacuauucaaaca

SEQ ID NO: 2711409 - RNA, 19 nt, Human
agaaagacuauucaaacag

SEQ ID NO: 2711410 - RNA, 19 nt, Human
ucugacccugcuucaaaua

SEQ ID NO: 2711411 - RNA, 21 nt, Human
agacuauucaaacagucucag

SEQ ID NO: 2711412 - RNA, 17 nt, Human
agacucauucuucugua

SEQ ID NO: 2711413 - RNA, 20 nt, Human
agacuauucaaacagucuca

SEQ ID NO: 2711414 - RNA, 18 nt, Human
agacuauucaaacagucu

SEQ ID NO: 2711415 - RNA, 12 nt, Human
agacuccaaaga

SEQ ID NO: 2711416 - RNA, 18 nt, Human
agacucauucuucuguac

SEQ ID NO: 2711417 - RNA, 14 nt, Human
agacuccaaagaaa

SEQ ID NO: 2711418 - RNA, 13 nt, Human
agacuccaaagaa

SEQ ID NO: 2711419 - RNA, 16 nt, Human
agacuauucaaacagu

SEQ ID NO: 2711420 - RNA, 19 nt, Human
agacuaucuaaauguugaa

SEQ ID NO: 2711421 - RNA, 18 nt, Human
agacuaucuaaauguuga

SEQ ID NO: 2711422 - RNA, 17 nt, Human
agacuaucuaaauguug

SEQ ID NO: 2711423 - RNA, 15 nt, Human
agacuaucuaaaugu

SEQ ID NO: 2711424 - RNA, 19 nt, Human
agacuccaaagaaauguaa

SEQ ID NO: 2711425 - RNA, 16 nt, Human
agacuccaaagaaaug

SEQ ID NO: 2711426 - RNA, 17 nt, Human
ucuugcaauggcagccu

SEQ ID NO: 2711427 - RNA, 13 nt, Human
ucuugcaauggca

SEQ ID NO: 2711428 - RNA, 16 nt, Human
ucuugcaauggcagcc

SEQ ID NO: 2711429 - RNA, 12 nt, Human
agacccugcccu

SEQ ID NO: 2711430 - RNA, 13 nt, Human
agacccugcccug

SEQ ID NO: 2711431 - RNA, 14 nt, Human
agacccugcccugu

SEQ ID NO: 2711432 - RNA, 13 nt, Human
agacccuuguggu

SEQ ID NO: 2711433 - RNA, 15 nt, Human
agacccuuguggucc

SEQ ID NO: 2711434 - RNA, 16 nt, Human
agacccugcccugugg

SEQ ID NO: 2711435 - RNA, 19 nt, Human
agacccugcccugugggcc

SEQ ID NO: 2711436 - RNA, 21 nt, Human
agacccugcccugugggcccc

SEQ ID NO: 2711437 - RNA, 23 nt, Human
agacccugcccugugggccccca

SEQ ID NO: 2711438 - RNA, 19 nt, Human
agacccuuguggucccacc

SEQ ID NO: 2711439 - RNA, 20 nt, Human
agacccuuguggucccaccc

SEQ ID NO: 2711440 - RNA, 22 nt, Human
agacccuuguggucccacccca

SEQ ID NO: 2711441 - RNA, 23 nt, Human
agacccuuguggucccaccccac

SEQ ID NO: 2711442 - RNA, 21 nt, Human
ucuuuaaagggauggcaagau

SEQ ID NO: 2711443 - RNA, 13 nt, Human
ucuuuaauuuugg

SEQ ID NO: 2711444 - RNA, 17 nt, Human
ucuuuaaaauacacacu

SEQ ID NO: 2711445 - RNA, 15 nt, Human
ucuuuacuucaugga

SEQ ID NO: 2711446 - RNA, 18 nt, Human
ucuuuaauuuuggaauuu

SEQ ID NO: 2711447 - RNA, 17 nt, Human
ucuuuaauuuuggaauu

SEQ ID NO: 2711448 - RNA, 16 nt, Human
ucuuuaauuuuggaau

SEQ ID NO: 2711449 - RNA, 15 nt, Human
ucuuuaauuuuggaa

SEQ ID NO: 2711450 - RNA, 14 nt, Human
ucuuuaauuuugga

SEQ ID NO: 2711451 - RNA, 19 nt, Human
agacucuacagaggccaug

SEQ ID NO: 2711452 - RNA, 17 nt, Human
agacucuacagaggcca

SEQ ID NO: 2711453 - RNA, 21 nt, Human
agacucgcgacaaugcaaacc

SEQ ID NO: 2711454 - RNA, 18 nt, Human
agacuccugcaggcagcc

SEQ ID NO: 2711455 - RNA, 19 nt, Human
agacuccugcaggcagcca

SEQ ID NO: 2711456 - RNA, 20 nt, Human
agacuccugcaggcagccag

SEQ ID NO: 2711457 - RNA, 23 nt, Human
agacuccugcaggcagccaggcc

SEQ ID NO: 2711458 - RNA, 13 nt, Human
ucuuuccugaggc

SEQ ID NO: 2711459 - RNA, 14 nt, Human
ucuuuccugaggcu

SEQ ID NO: 2711460 - RNA, 15 nt, Human
ucuuuccugaggcug

SEQ ID NO: 2711461 - RNA, 16 nt, Human
ucuuuccugaggcugg

SEQ ID NO: 2711462 - RNA, 14 nt, Human
agacuccugcaggc

SEQ ID NO: 2711463 - RNA, 15 nt, Human
agacuccugcaggca

SEQ ID NO: 2711464 - RNA, 16 nt, Human
agacuccugcaggcag

SEQ ID NO: 2711465 - RNA, 17 nt, Human
agacuccugcaggcagc

SEQ ID NO: 2711466 - RNA, 18 nt, Human
agagacacacugaagaag

SEQ ID NO: 2711467 - RNA, 20 nt, Human
agagacacacugaagaagca

SEQ ID NO: 2711468 - RNA, 13 nt, Human
agagaccaucccu

SEQ ID NO: 2711469 - RNA, 14 nt, Human
agagaccaucccug

SEQ ID NO: 2711470 - RNA, 15 nt, Human
agagaccaucccuga

SEQ ID NO: 2711471 - RNA, 15 nt, Human
agagaaugagagaca

SEQ ID NO: 2711472 - RNA, 17 nt, Human
agagacacacugaagaa

SEQ ID NO: 2711473 - RNA, 12 nt, Human
agacuuuggaaa

SEQ ID NO: 2711474 - RNA, 18 nt, Human
agagaaugaaagggccca

SEQ ID NO: 2711475 - RNA, 14 nt, Human
agacuuuggaaaga

SEQ ID NO: 2711476 - RNA, 15 nt, Human
agacuggcacaguuu

SEQ ID NO: 2711477 - RNA, 14 nt, Human
agacuggcacaguu

SEQ ID NO: 2711478 - RNA, 18 nt, Human
agacuggcacaguuuucu

SEQ ID NO: 2711479 - RNA, 14 nt, Human
agacuucaucccuc

SEQ ID NO: 2711480 - RNA, 17 nt, Human
agacuucaucccucugg

SEQ ID NO: 2711481 - RNA, 14 nt, Human
ucuuaauuaaaaga

SEQ ID NO: 2711482 - RNA, 21 nt, Human
ucuuaauuaaaagaauauuuu

SEQ ID NO: 2711483 - RNA, 18 nt, Human
ucuuaauuaaaagaauau

SEQ ID NO: 2711484 - RNA, 18 nt, Human
ucuuaugggcuggguucu

SEQ ID NO: 2711485 - RNA, 14 nt, Human
ucuuauugcccacg

SEQ ID NO: 2711486 - RNA, 18 nt, Human
ucuuauugcccacgcugg

SEQ ID NO: 2711487 - RNA, 22 nt, Human
ucuuauugcccacgcuggagug

SEQ ID NO: 2711488 - RNA, 15 nt, Human
ucuuaugggcugggu

SEQ ID NO: 2711489 - RNA, 16 nt, Human
ucuuaugggcuggguu

SEQ ID NO: 2711490 - RNA, 14 nt, Human
ucuuaugggcuggg

SEQ ID NO: 2711491 - RNA, 22 nt, Human
ucuuccaggcugggagagccuu

SEQ ID NO: 2711492 - RNA, 15 nt, Human
agacagucccugcca

SEQ ID NO: 2711493 - RNA, 16 nt, Human
agacagucccugccaa

SEQ ID NO: 2711494 - RNA, 17 nt, Human
agacagucccugccaau

SEQ ID NO: 2711495 - RNA, 23 nt, Human
agacaggcaagcaccuccugccu

SEQ ID NO: 2711496 - RNA, 15 nt, Human
agacaggaccaggga

SEQ ID NO: 2711497 - RNA, 21 nt, Human
agacaggguuuugccauguug

SEQ ID NO: 2711498 - RNA, 17 nt, Human
agaauuugauaugugaa

SEQ ID NO: 2711499 - RNA, 19 nt, Human
agaauuugauaugugaaca

SEQ ID NO: 2711500 - RNA, 18 nt, Human
agaauuugauaugugaac

SEQ ID NO: 2711501 - RNA, 20 nt, Human
agaauuugauaugugaacag

SEQ ID NO: 2711502 - RNA, 18 nt, Human
ucuguuuuauaauuuugu

SEQ ID NO: 2711503 - RNA, 17 nt, Human
agaauuucccaaagcag

SEQ ID NO: 2711504 - RNA, 18 nt, Human
agaauuucccaaagcagu

SEQ ID NO: 2711505 - RNA, 21 nt, Human
agaauuucuaggacugaauua

SEQ ID NO: 2711506 - RNA, 13 nt, Human
agaauuucuagga

SEQ ID NO: 2711507 - RNA, 23 nt, Human
agaauuucccaaagcagugcaug

SEQ ID NO: 2711508 - RNA, 18 nt, Human
ucuguuggccagugugac

SEQ ID NO: 2711509 - RNA, 19 nt, Human
ucuguuggccagugugaca

SEQ ID NO: 2711510 - RNA, 20 nt, Human
ucuguuggccagugugacaa

SEQ ID NO: 2711511 - RNA, 15 nt, Human
ucugugaaaggaaag

SEQ ID NO: 2711512 - RNA, 21 nt, Human
ucugugaaaggaaagagggag

SEQ ID NO: 2711513 - RNA, 17 nt, Human
ucuguauagauuagaau

SEQ ID NO: 2711514 - RNA, 20 nt, Human
ucugucauuugagcagggcu

SEQ ID NO: 2711515 - RNA, 23 nt, Human
ucugucauuugagcagggcucag

SEQ ID NO: 2711516 - RNA, 15 nt, Human
ucugucauuugagca

SEQ ID NO: 2711517 - RNA, 16 nt, Human
ucuguauagauuagag

SEQ ID NO: 2711518 - RNA, 11 nt, Human
ucuggggcugu

SEQ ID NO: 2711519 - RNA, 14 nt, Human
ucuggguucacugc

SEQ ID NO: 2711520 - RNA, 16 nt, Human
ucuggguucacugcaa

SEQ ID NO: 2711521 - RNA, 18 nt, Human
ucugguccauagagagca

SEQ ID NO: 2711522 - RNA, 19 nt, Human
agcuauggugucauaggcu

SEQ ID NO: 2711523 - RNA, 21 nt, Human
ugccauguuggccaggcuggu

SEQ ID NO: 2711524 - RNA, 20 nt, Human
ugccauguuggccaggcugg

SEQ ID NO: 2711525 - RNA, 15 nt, Human
agcucagggccuggc

SEQ ID NO: 2711526 - RNA, 16 nt, Human
agcucagggccuggcu

SEQ ID NO: 2711527 - RNA, 17 nt, Human
ugccauguuggccaggc

SEQ ID NO: 2711528 - RNA, 17 nt, Human
agcucagggccuggcuc

SEQ ID NO: 2711529 - RNA, 18 nt, Human
ugccauguuggccaggcu

SEQ ID NO: 2711530 - RNA, 19 nt, Human
ugccauguuggccaggcug

SEQ ID NO: 2711531 - RNA, 12 nt, Human
ugcccaggcccc

SEQ ID NO: 2711532 - RNA, 20 nt, Human
ugcccaggccccugccaccc

SEQ ID NO: 2711533 - RNA, 22 nt, Human
ugcccaggccccugccacccug

SEQ ID NO: 2711534 - RNA, 14 nt, Human
ugcccacaggauca

SEQ ID NO: 2711535 - RNA, 15 nt, Human
ugcccaggcaggucu

SEQ ID NO: 2711536 - RNA, 16 nt, Human
ugcccaggcaggucuu

SEQ ID NO: 2711537 - RNA, 17 nt, Human
ugcccaggcaggucuug

SEQ ID NO: 2711538 - RNA, 20 nt, Human
ugcccaggcaggucuugaac

SEQ ID NO: 2711539 - RNA, 11 nt, Human
ugcccaggccc

SEQ ID NO: 2711540 - RNA, 19 nt, Human
agcuacuaauuuuaaaaug

SEQ ID NO: 2711541 - RNA, 23 nt, Human
agcgugguggacaugcacagcua

SEQ ID NO: 2711542 - RNA, 16 nt, Human
agcgugagccacugca

SEQ ID NO: 2711543 - RNA, 17 nt, Human
agcgugagccacugcac

SEQ ID NO: 2711544 - RNA, 20 nt, Human
agcgugguggacaugcacag

SEQ ID NO: 2711545 - RNA, 13 nt, Human
agcgugagccacu

SEQ ID NO: 2711546 - RNA, 15 nt, Human
agcgugagccacugc

SEQ ID NO: 2711547 - RNA, 16 nt, Human
agcggggacagcuccu

SEQ ID NO: 2711548 - RNA, 17 nt, Human
agcggggacagcuccuu

SEQ ID NO: 2711549 - RNA, 15 nt, Human
agcggggacagcucc

SEQ ID NO: 2711550 - RNA, 20 nt, Human
ugccauauucuguuggccag

SEQ ID NO: 2711551 - RNA, 21 nt, Human
ugccauauucuguuggccagu

SEQ ID NO: 2711552 - RNA, 15 nt, Human
ugccagucaccccgg

SEQ ID NO: 2711553 - RNA, 16 nt, Human
ugccagucaccccggc

SEQ ID NO: 2711554 - RNA, 18 nt, Human
ugccagucaccccggcca

SEQ ID NO: 2711555 - RNA, 20 nt, Human
ugccagucaccccggccacc

SEQ ID NO: 2711556 - RNA, 22 nt, Human
ugccagucaccccggccaccug

SEQ ID NO: 2711557 - RNA, 23 nt, Human
ugccagucaccccggccaccugc

SEQ ID NO: 2711558 - RNA, 16 nt, Human
ugccauauucuguugg

SEQ ID NO: 2711559 - RNA, 17 nt, Human
ugccauauucuguuggc

SEQ ID NO: 2711560 - RNA, 15 nt, Human
ugccauauucuguug

SEQ ID NO: 2711561 - RNA, 23 nt, Human
ugcauuugaaaauuuugauguuu

SEQ ID NO: 2711562 - RNA, 19 nt, Human
ugcauuugaaaauuuugau

SEQ ID NO: 2711563 - RNA, 14 nt, Human
agcgcccaguuggg

SEQ ID NO: 2711564 - RNA, 22 nt, Human
agcgcccaguuggguggaugcc

SEQ ID NO: 2711565 - RNA, 18 nt, Human
agcccuucuuuccacaga

SEQ ID NO: 2711566 - RNA, 19 nt, Human
agcccuucuuuccacagaa

SEQ ID NO: 2711567 - RNA, 15 nt, Human
agccucaaccuccug

SEQ ID NO: 2711568 - RNA, 15 nt, Human
agccuaggugacaga

SEQ ID NO: 2711569 - RNA, 17 nt, Human
agccuaggugacagagu

SEQ ID NO: 2711570 - RNA, 17 nt, Human
agcccuucuuuccacag

SEQ ID NO: 2711571 - RNA, 22 nt, Human
ugcagacucuacagaggccaug

SEQ ID NO: 2711572 - RNA, 15 nt, Human
ugcacuccccugcug

SEQ ID NO: 2711573 - RNA, 19 nt, Human
ugcagacucuacagaggcc

SEQ ID NO: 2711574 - RNA, 20 nt, Human
ugcagacucuacagaggcca

SEQ ID NO: 2711575 - RNA, 18 nt, Human
ugcagacucuacagaggc

SEQ ID NO: 2711576 - RNA, 14 nt, Human
ugcacaagcugcac

SEQ ID NO: 2711577 - RNA, 15 nt, Human
ugcacacaccagagc

SEQ ID NO: 2711578 - RNA, 15 nt, Human
ugcacaagcuccaag

SEQ ID NO: 2711579 - RNA, 16 nt, Human
ugcacaagcuccaagc

SEQ ID NO: 2711580 - RNA, 18 nt, Human
ugcacaagcuccaagcuc

SEQ ID NO: 2711581 - RNA, 20 nt, Human
ugcacaagcuccaagcuccc

SEQ ID NO: 2711582 - RNA, 22 nt, Human
ugcacaagcuccaagcucccag

SEQ ID NO: 2711583 - RNA, 23 nt, Human
ugcacaagcuccaagcucccagg

SEQ ID NO: 2711584 - RNA, 14 nt, Human
ugcaccacugcacu

SEQ ID NO: 2711585 - RNA, 19 nt, Human
ugcacguacacacacauac

SEQ ID NO: 2711586 - RNA, 22 nt, Human
ugcacuauagccuaggugacag

SEQ ID NO: 2711587 - RNA, 12 nt, Human
ugcacuccccug

SEQ ID NO: 2711588 - RNA, 13 nt, Human
ugcacuccccugc

SEQ ID NO: 2711589 - RNA, 15 nt, Human
agccucagcauccug

SEQ ID NO: 2711590 - RNA, 17 nt, Human
agccucaaccuccuggg

SEQ ID NO: 2711591 - RNA, 18 nt, Human
agccucaaccuccugggc

SEQ ID NO: 2711592 - RNA, 13 nt, Human
agccucagcaucc

SEQ ID NO: 2711593 - RNA, 14 nt, Human
agccucagcauccu

SEQ ID NO: 2711594 - RNA, 18 nt, Human
ugcagccucaaccuccug

SEQ ID NO: 2711595 - RNA, 19 nt, Human
ugcagccucaaccuccugg

SEQ ID NO: 2711596 - RNA, 14 nt, Human
ugcagugagccgag

SEQ ID NO: 2711597 - RNA, 16 nt, Human
ugcaugcugucccuua

SEQ ID NO: 2711598 - RNA, 19 nt, Human
agccugcaauuucauaugc

SEQ ID NO: 2711599 - RNA, 14 nt, Human
agccugauuaaaga

SEQ ID NO: 2711600 - RNA, 18 nt, Human
agccugcacggugaaugg

SEQ ID NO: 2711601 - RNA, 21 nt, Human
agccugcaauuucauaugcug

SEQ ID NO: 2711602 - RNA, 16 nt, Human
agccugcacggugaau

SEQ ID NO: 2711603 - RNA, 23 nt, Human
agccugcaguuauuaacacuaac

SEQ ID NO: 2711604 - RNA, 16 nt, Human
agccugccucuucucu

SEQ ID NO: 2711605 - RNA, 19 nt, Human
agccugccucuucucuacu

SEQ ID NO: 2711606 - RNA, 21 nt, Human
ugcauaccacuuuuguucuug

SEQ ID NO: 2711607 - RNA, 22 nt, Human
ugcauaccacuuuuguucuugg

SEQ ID NO: 2711608 - RNA, 13 nt, Human
ugcaugcuguccc

SEQ ID NO: 2711609 - RNA, 14 nt, Human
ugcaugcugucccu

SEQ ID NO: 2711610 - RNA, 15 nt, Human
ugcaugcugucccuu

SEQ ID NO: 2711611 - RNA, 20 nt, Human
ugcaugaaguaauaugcaca

SEQ ID NO: 2711612 - RNA, 22 nt, Human
ugcaugaaguaauaugcacaca

SEQ ID NO: 2711613 - RNA, 21 nt, Human
ugcaugaggcuaguguggugu

SEQ ID NO: 2711614 - RNA, 13 nt, Human
agcuggaaaagua

SEQ ID NO: 2711615 - RNA, 21 nt, Human
agcugccugggaucccucauc

SEQ ID NO: 2711616 - RNA, 13 nt, Human
agcugccugggau

SEQ ID NO: 2711617 - RNA, 19 nt, Human
agcugccugggaucccuca

SEQ ID NO: 2711618 - RNA, 17 nt, Human
agcugccuccccuccuc

SEQ ID NO: 2711619 - RNA, 18 nt, Human
agcugccuccccuccucu

SEQ ID NO: 2711620 - RNA, 19 nt, Human
agcugccuccccuccucug

SEQ ID NO: 2711621 - RNA, 20 nt, Human
agcugccuccccuccucugc

SEQ ID NO: 2711622 - RNA, 22 nt, Human
ugccucugacacacagcucugu

SEQ ID NO: 2711623 - RNA, 21 nt, Human
agcugccuccccuccucugcu

SEQ ID NO: 2711624 - RNA, 22 nt, Human
agcugccuccccuccucugcuu

SEQ ID NO: 2711625 - RNA, 23 nt, Human
agcugccuccccuccucugcuug

SEQ ID NO: 2711626 - RNA, 14 nt, Human
agcugggcagguug

SEQ ID NO: 2711627 - RNA, 23 nt, Human
agcugggaugauuggagggggga

SEQ ID NO: 2711628 - RNA, 17 nt, Human
agcugggacuacaggug

SEQ ID NO: 2711629 - RNA, 19 nt, Human
agcugggacuacaggugug

SEQ ID NO: 2711630 - RNA, 15 nt, Human
ugccuguucagcucc

SEQ ID NO: 2711631 - RNA, 16 nt, Human
ugccuguucagcucca

SEQ ID NO: 2711632 - RNA, 13 nt, Human
ugcgaaaggauga

SEQ ID NO: 2711633 - RNA, 21 nt, Human
ugccuuuuucauuauuuuauu

SEQ ID NO: 2711634 - RNA, 17 nt, Human
ugccuuuuucauuauuu

SEQ ID NO: 2711635 - RNA, 16 nt, Human
ugccuuuuucauuauu

SEQ ID NO: 2711636 - RNA, 15 nt, Human
ugccuuuuucauuau

SEQ ID NO: 2711637 - RNA, 14 nt, Human
ugccuuuuucauua

SEQ ID NO: 2711638 - RNA, 13 nt, Human
ugccuuuuucauu

SEQ ID NO: 2711639 - RNA, 18 nt, Human
ugcggacagccacggcca

SEQ ID NO: 2711640 - RNA, 17 nt, Human
ugcggacagccacggcc

SEQ ID NO: 2711641 - RNA, 19 nt, Human
ugcgaaaggaugaaaguga

SEQ ID NO: 2711642 - RNA, 13 nt, Human
ugccucccaucac

SEQ ID NO: 2711643 - RNA, 14 nt, Human
ugccucccaucacc

SEQ ID NO: 2711644 - RNA, 19 nt, Human
ugccucccaucacccgcua

SEQ ID NO: 2711645 - RNA, 13 nt, Human
ugccucucucagg

SEQ ID NO: 2711646 - RNA, 14 nt, Human
ugccucucucaggc

SEQ ID NO: 2711647 - RNA, 15 nt, Human
ugccucucucaggcc

SEQ ID NO: 2711648 - RNA, 20 nt, Human
ugccucugacacacagcucu

SEQ ID NO: 2711649 - RNA, 21 nt, Human
ugccucugacacacagcucug

SEQ ID NO: 2711650 - RNA, 13 nt, Human
agcugccaccugc

SEQ ID NO: 2711651 - RNA, 18 nt, Human
agcugcacccucaggcag

SEQ ID NO: 2711652 - RNA, 19 nt, Human
agcugcacccucaggcagg

SEQ ID NO: 2711653 - RNA, 20 nt, Human
agcugcacccucaggcaggu

SEQ ID NO: 2711654 - RNA, 22 nt, Human
agcugcacccucaggcaggugg

SEQ ID NO: 2711655 - RNA, 13 nt, Human
agcugcacccuca

SEQ ID NO: 2711656 - RNA, 17 nt, Human
agcugcacccucaggca

SEQ ID NO: 2711657 - RNA, 18 nt, Human
agcucuucuccaggcugu

SEQ ID NO: 2711658 - RNA, 17 nt, Human
agcucuucuccaggcug

SEQ ID NO: 2711659 - RNA, 12 nt, Human
agcucuguccug

SEQ ID NO: 2711660 - RNA, 12 nt, Human
agcucugcuccu

SEQ ID NO: 2711661 - RNA, 22 nt, Human
agcucugcuccucuccccagca

SEQ ID NO: 2711662 - RNA, 20 nt, Human
agcucugguccauagagagc

SEQ ID NO: 2711663 - RNA, 16 nt, Human
agcucucuccucccuu

SEQ ID NO: 2711664 - RNA, 22 nt, Human
ugcccuccaagaccuucuccuu

SEQ ID NO: 2711665 - RNA, 19 nt, Human
ugcccuccaagaccuucuc

SEQ ID NO: 2711666 - RNA, 20 nt, Human
ugcccuccaagaccuucucc

SEQ ID NO: 2711667 - RNA, 16 nt, Human
ugcuaguaauuggaaa

SEQ ID NO: 2711668 - RNA, 14 nt, Human
ugcuaguaauugga

SEQ ID NO: 2711669 - RNA, 19 nt, Human
aggaaagcaaaggagauug

SEQ ID NO: 2711670 - RNA, 16 nt, Human
aggaaagaggcucugg

SEQ ID NO: 2711671 - RNA, 17 nt, Human
aggaaagcaaaggagau

SEQ ID NO: 2711672 - RNA, 13 nt, Human
aggaaagagaacu

SEQ ID NO: 2711673 - RNA, 19 nt, Human
aggaaagagaacuuccaga

SEQ ID NO: 2711674 - RNA, 12 nt, Human
aggaaagaggcu

SEQ ID NO: 2711675 - RNA, 13 nt, Human
aggaaagaggcuc

SEQ ID NO: 2711676 - RNA, 12 nt, Human
agcuuugaaaau

SEQ ID NO: 2711677 - RNA, 16 nt, Human
agcuuugaaaauucag

SEQ ID NO: 2711678 - RNA, 18 nt, Human
agcuuugaaaauucagug

SEQ ID NO: 2711679 - RNA, 19 nt, Human
agcuuugaaaauucagugg

SEQ ID NO: 2711680 - RNA, 21 nt, Human
aggaaaaguuuaauauuaaag

SEQ ID NO: 2711681 - RNA, 24 nt, Human
aggaaaaguuuaauauuaaagcca

SEQ ID NO: 2711682 - RNA, 23 nt, Human
aggaaaaguuuaauauuaaagcc

SEQ ID NO: 2711683 - RNA, 21 nt, Human
aggaaacccagcucuggucca

SEQ ID NO: 2711684 - RNA, 18 nt, Human
aggaaacccagcucuggu

SEQ ID NO: 2711685 - RNA, 20 nt, Human
aggaaacccagcucuggucc

SEQ ID NO: 2711686 - RNA, 15 nt, Human
aggaaacccagcucu

SEQ ID NO: 2711687 - RNA, 16 nt, Human
aggaaacccagcucug

SEQ ID NO: 2711688 - RNA, 17 nt, Human
aggaaacccagcucugg

SEQ ID NO: 2711689 - RNA, 15 nt, Human
agcuuauuaaaacuc

SEQ ID NO: 2711690 - RNA, 20 nt, Human
agcuuauuaaaacucauuuu

SEQ ID NO: 2711691 - RNA, 21 nt, Human
agcuuauugucuagugaaacu

SEQ ID NO: 2711692 - RNA, 18 nt, Human
agcuuguaaauagcucag

SEQ ID NO: 2711693 - RNA, 19 nt, Human
agcuuguaaauagcucagg

SEQ ID NO: 2711694 - RNA, 20 nt, Human
agcuuguaaauagcucaggu

SEQ ID NO: 2711695 - RNA, 21 nt, Human
agcuuguaaauagcucaggug

SEQ ID NO: 2711696 - RNA, 20 nt, Human
ugcggacagccacggccagg

SEQ ID NO: 2711697 - RNA, 21 nt, Human
ugcggacagccacggccaggc

SEQ ID NO: 2711698 - RNA, 12 nt, Human
agcuuaucucag

SEQ ID NO: 2711699 - RNA, 14 nt, Human
agcuuaucucaggg

SEQ ID NO: 2711700 - RNA, 15 nt, Human
agcuuaucucagggg

SEQ ID NO: 2711701 - RNA, 23 nt, Human
aggaauucuguauagauuagaau

SEQ ID NO: 2711702 - RNA, 16 nt, Human
aggaauucuguauaga

SEQ ID NO: 2711703 - RNA, 22 nt, Human
aggaauucuguauagauuagaa

SEQ ID NO: 2711704 - RNA, 17 nt, Human
aggaauucuguauagau

SEQ ID NO: 2711705 - RNA, 23 nt, Human
aggaauccagacccggcugcgug

SEQ ID NO: 2711706 - RNA, 15 nt, Human
aggaagacuuuggaa

SEQ ID NO: 2711707 - RNA, 14 nt, Human
aggaagagaaaaaa

SEQ ID NO: 2711708 - RNA, 17 nt, Human
aggaagcucagggccug

SEQ ID NO: 2711709 - RNA, 18 nt, Human
aggaagcucagggccugg

SEQ ID NO: 2711710 - RNA, 22 nt, Human
aggaagcucagggccuggcuca

SEQ ID NO: 2711711 - RNA, 21 nt, Human
ugcugccauccagguucagcu

SEQ ID NO: 2711712 - RNA, 22 nt, Human
ugcugccauccagguucagcuu

SEQ ID NO: 2711713 - RNA, 12 nt, Human
ugcugccaucca

SEQ ID NO: 2711714 - RNA, 13 nt, Human
ugcugccauccag

SEQ ID NO: 2711715 - RNA, 14 nt, Human
ugcugccauccagg

SEQ ID NO: 2711716 - RNA, 15 nt, Human
ugcugccauccaggu

SEQ ID NO: 2711717 - RNA, 15 nt, Human
aggaauucuguauag

SEQ ID NO: 2711718 - RNA, 11 nt, Human
ugcugccaucc

SEQ ID NO: 2711719 - RNA, 14 nt, Human
aggaaauauuuauu

SEQ ID NO: 2711720 - RNA, 18 nt, Human
aggaaauauuuauuuuaa

SEQ ID NO: 2711721 - RNA, 22 nt, Human
aggaaaggcuccaggagcagcc

SEQ ID NO: 2711722 - RNA, 13 nt, Human
aggaaauauuuau

SEQ ID NO: 2711723 - RNA, 18 nt, Human
aggaaaggcuccaggagc

SEQ ID NO: 2711724 - RNA, 20 nt, Human
aggaaaggcuccaggagcag

SEQ ID NO: 2711725 - RNA, 21 nt, Human
ugcugacuguuuucucuugag

SEQ ID NO: 2711726 - RNA, 24 nt, Human
ugcugacuguuuucucuugagagg

SEQ ID NO: 2711727 - RNA, 16 nt, Human
ugcugacuguuuucuc

SEQ ID NO: 2711728 - RNA, 19 nt, Human
ugcucugaucauccacugu

SEQ ID NO: 2711729 - RNA, 22 nt, Human
ugcucugaucauccacugugcc

SEQ ID NO: 2711730 - RNA, 17 nt, Human
ugcugacuguuuucucu

SEQ ID NO: 2711731 - RNA, 17 nt, Human
ugcucuggacaggcaug

SEQ ID NO: 2711732 - RNA, 18 nt, Human
ugcucugcauguuacaua

SEQ ID NO: 2711733 - RNA, 15 nt, Human
ugcucugcauguuac

SEQ ID NO: 2711734 - RNA, 20 nt, Human
aggcagcucuaaaugucaau

SEQ ID NO: 2711735 - RNA, 22 nt, Human
aggcagccccauucugccugcc

SEQ ID NO: 2711736 - RNA, 19 nt, Human
aggcagccccauucugccu

SEQ ID NO: 2711737 - RNA, 20 nt, Human
aggcagccccauucugccug

SEQ ID NO: 2711738 - RNA, 21 nt, Human
aggcagccccauucugccugc

SEQ ID NO: 2711739 - RNA, 12 nt, Human
aggcaggauggc

SEQ ID NO: 2711740 - RNA, 21 nt, Human
aggcaggucuugaacuccugg

SEQ ID NO: 2711741 - RNA, 22 nt, Human
aggcagggucucacucugucgc

SEQ ID NO: 2711742 - RNA, 14 nt, Human
aggcagguccaggg

SEQ ID NO: 2711743 - RNA, 19 nt, Human
aggcagggucucacucugu

SEQ ID NO: 2711744 - RNA, 18 nt, Human
aggcagggucucacucug

SEQ ID NO: 2711745 - RNA, 20 nt, Human
aggcagggucucacucuguc

SEQ ID NO: 2711746 - RNA, 21 nt, Human
aggcagggucucacucugucg

SEQ ID NO: 2711747 - RNA, 16 nt, Human
uggagaagaacugaaa

SEQ ID NO: 2711748 - RNA, 24 nt, Human
uggacuuuguuaguuucuccaagc

SEQ ID NO: 2711749 - RNA, 22 nt, Human
uggacuuuguuaguuucuccaa

SEQ ID NO: 2711750 - RNA, 11 nt, Human
uggacuuuguu

SEQ ID NO: 2711751 - RNA, 15 nt, Human
aggcaaugcuggcug

SEQ ID NO: 2711752 - RNA, 16 nt, Human
aggcaaugcuggcugu

SEQ ID NO: 2711753 - RNA, 23 nt, Human
uggagccugcacggugaauggcu

SEQ ID NO: 2711754 - RNA, 21 nt, Human
uggagcucgugggacagucac

SEQ ID NO: 2711755 - RNA, 22 nt, Human
aggauugcuacuguccuaccca

SEQ ID NO: 2711756 - RNA, 18 nt, Human
aggaugcuuguacauaau

SEQ ID NO: 2711757 - RNA, 12 nt, Human
aggaucagucug

SEQ ID NO: 2711758 - RNA, 21 nt, Human
aggauccugagccagauuuca

SEQ ID NO: 2711759 - RNA, 16 nt, Human
aggaugcuuguacaua

SEQ ID NO: 2711760 - RNA, 15 nt, Human
aggaugcuuguacau

SEQ ID NO: 2711761 - RNA, 14 nt, Human
uggacaaaauggaa

SEQ ID NO: 2711762 - RNA, 17 nt, Human
uggacaaaauggaauac

SEQ ID NO: 2711763 - RNA, 14 nt, Human
aggcaagcaccucc

SEQ ID NO: 2711764 - RNA, 19 nt, Human
aggcaacugcauuggcuuu

SEQ ID NO: 2711765 - RNA, 21 nt, Human
uggaauuuuccuccuuucucu

SEQ ID NO: 2711766 - RNA, 17 nt, Human
uggaauuuuccuccuuu

SEQ ID NO: 2711767 - RNA, 21 nt, Human
aggaguuugagaccaaccugg

SEQ ID NO: 2711768 - RNA, 15 nt, Human
aggaggccagccuug

SEQ ID NO: 2711769 - RNA, 10 nt, Human
ugcugcccug

SEQ ID NO: 2711770 - RNA, 12 nt, Human
ugcugcccugcc

SEQ ID NO: 2711771 - RNA, 21 nt, Human
uggaacaagaugguucuagca

SEQ ID NO: 2711772 - RNA, 18 nt, Human
uggaaguacuauaauuua

SEQ ID NO: 2711773 - RNA, 20 nt, Human
uggaaguacuauaauuuacc

SEQ ID NO: 2711774 - RNA, 13 nt, Human
uggaagcuccgcu

SEQ ID NO: 2711775 - RNA, 14 nt, Human
uggaacacucugag

SEQ ID NO: 2711776 - RNA, 12 nt, Human
uggaacacucug

SEQ ID NO: 2711777 - RNA, 13 nt, Human
aggcuccaggagc

SEQ ID NO: 2711778 - RNA, 14 nt, Human
aggcuccaggagca

SEQ ID NO: 2711779 - RNA, 16 nt, Human
aggcuccaggagcagc

SEQ ID NO: 2711780 - RNA, 17 nt, Human
aggccuucucugaagga

SEQ ID NO: 2711781 - RNA, 18 nt, Human
aggccuucucugaaggac

SEQ ID NO: 2711782 - RNA, 22 nt, Human
uggcaugggaaugaaugucagu

SEQ ID NO: 2711783 - RNA, 19 nt, Human
uggcccacgcacuucggga

SEQ ID NO: 2711784 - RNA, 13 nt, Human
uggcccacugcau

SEQ ID NO: 2711785 - RNA, 14 nt, Human
uggcccacugcauc

SEQ ID NO: 2711786 - RNA, 18 nt, Human
uggccugagcugggauga

SEQ ID NO: 2711787 - RNA, 20 nt, Human
uggccucugcacuccccugc

SEQ ID NO: 2711788 - RNA, 18 nt, Human
uggccucugcacuccccu

SEQ ID NO: 2711789 - RNA, 19 nt, Human
uggccucugcacuccccug

SEQ ID NO: 2711790 - RNA, 15 nt, Human
aggcccagagggccu

SEQ ID NO: 2711791 - RNA, 16 nt, Human
aggcccagagggccug

SEQ ID NO: 2711792 - RNA, 18 nt, Human
aggccaugggccuccugu

SEQ ID NO: 2711793 - RNA, 23 nt, Human
aggccagagacacaagccuucgg

SEQ ID NO: 2711794 - RNA, 14 nt, Human
uggcagcucagaga

SEQ ID NO: 2711795 - RNA, 15 nt, Human
uggcagcucagagag

SEQ ID NO: 2711796 - RNA, 16 nt, Human
uggcagcucagagagg

SEQ ID NO: 2711797 - RNA, 18 nt, Human
uggcagcucagagagggu

SEQ ID NO: 2711798 - RNA, 13 nt, Human
aggccagagacac

SEQ ID NO: 2711799 - RNA, 18 nt, Human
aggccagagacacaagcc

SEQ ID NO: 2711800 - RNA, 16 nt, Human
uggcaccagcagccug

SEQ ID NO: 2711801 - RNA, 17 nt, Human
uggcaccagcagccugg

SEQ ID NO: 2711802 - RNA, 13 nt, Human
aggccuggccaga

SEQ ID NO: 2711803 - RNA, 12 nt, Human
aggccuggccag

SEQ ID NO: 2711804 - RNA, 14 nt, Human
aggcccggcuccag

SEQ ID NO: 2711805 - RNA, 15 nt, Human
aggcccggcuccagg

SEQ ID NO: 2711806 - RNA, 16 nt, Human
aggcccggcuccaggc

SEQ ID NO: 2711807 - RNA, 13 nt, Human
aggccccugccac

SEQ ID NO: 2711808 - RNA, 15 nt, Human
aggccccugccaccc

SEQ ID NO: 2711809 - RNA, 19 nt, Human
aggcccagagggccugcaa

SEQ ID NO: 2711810 - RNA, 20 nt, Human
aggcccagagggccugcaag

SEQ ID NO: 2711811 - RNA, 17 nt, Human
aggccccugccacccug

SEQ ID NO: 2711812 - RNA, 18 nt, Human
aggccccugccacccugg

SEQ ID NO: 2711813 - RNA, 21 nt, Human
aggccccugccacccugggga

SEQ ID NO: 2711814 - RNA, 19 nt, Human
uggcuauaggugcuacaaa

SEQ ID NO: 2711815 - RNA, 15 nt, Human
uggcuauaggugcua

SEQ ID NO: 2711816 - RNA, 19 nt, Human
uggcuaauguacugcauau

SEQ ID NO: 2711817 - RNA, 17 nt, Human
uggcuaauguacugcau

SEQ ID NO: 2711818 - RNA, 14 nt, Human
uggcuaaauucaug

SEQ ID NO: 2711819 - RNA, 17 nt, Human
aggcuccaggagcagcc

SEQ ID NO: 2711820 - RNA, 18 nt, Human
aggcuccaggagcagcca

SEQ ID NO: 2711821 - RNA, 19 nt, Human
aggcuccaggagcagccac

SEQ ID NO: 2711822 - RNA, 23 nt, Human
aggcuccaggagcagccacauuc

SEQ ID NO: 2711823 - RNA, 23 nt, Human
uggcuauaggugcuacaaaaaca

SEQ ID NO: 2711824 - RNA, 13 nt, Human
uggcucacgccug

SEQ ID NO: 2711825 - RNA, 18 nt, Human
ugggaaacaaaaggauaa

SEQ ID NO: 2711826 - RNA, 21 nt, Human
uggcuuuugugcauuaucuag

SEQ ID NO: 2711827 - RNA, 17 nt, Human
uggcuucacggaagagc

SEQ ID NO: 2711828 - RNA, 20 nt, Human
uggcuucacggaagagccuu

SEQ ID NO: 2711829 - RNA, 16 nt, Human
uggcuuuugugcauua

SEQ ID NO: 2711830 - RNA, 15 nt, Human
uggcuuuugugcauu

SEQ ID NO: 2711831 - RNA, 18 nt, Human
ugggaaagcauuguaaau

SEQ ID NO: 2711832 - RNA, 17 nt, Human
ugggaaagcauuguaaa

SEQ ID NO: 2711833 - RNA, 16 nt, Human
ugggaaagcauuguaa

SEQ ID NO: 2711834 - RNA, 14 nt, Human
ugggaaagcauugu

SEQ ID NO: 2711835 - RNA, 14 nt, Human
uggcuucacggaag

SEQ ID NO: 2711836 - RNA, 23 nt, Human
uggcuguuggcugggggccucag

SEQ ID NO: 2711837 - RNA, 16 nt, Human
uggcuguuggcugggg

SEQ ID NO: 2711838 - RNA, 18 nt, Human
uggcuguuggcugggggc

SEQ ID NO: 2711839 - RNA, 23 nt, Human
uggcugcaaaggguaucaggugc

SEQ ID NO: 2711840 - RNA, 15 nt, Human
agggaaacugccagc

SEQ ID NO: 2711841 - RNA, 14 nt, Human
agggaaacugccag

SEQ ID NO: 2711842 - RNA, 23 nt, Human
agggaaacugccagcaacgcagg

SEQ ID NO: 2711843 - RNA, 21 nt, Human
agggaaacugccagcaacgca

SEQ ID NO: 2711844 - RNA, 19 nt, Human
agggaaacugccagcaacg

SEQ ID NO: 2711845 - RNA, 16 nt, Human
agggaaacugccagca

SEQ ID NO: 2711846 - RNA, 23 nt, Human
aggcuuagucacugagacagccc

SEQ ID NO: 2711847 - RNA, 21 nt, Human
aggcuuagucacugagacagc

SEQ ID NO: 2711848 - RNA, 22 nt, Human
aggcuuagucacugagacagcc

SEQ ID NO: 2711849 - RNA, 20 nt, Human
ugggaacccaaguccaagca

SEQ ID NO: 2711850 - RNA, 19 nt, Human
aggcugggagagccuucca

SEQ ID NO: 2711851 - RNA, 16 nt, Human
aggcugggagagccuu

SEQ ID NO: 2711852 - RNA, 22 nt, Human
aggcugggagagccuuccaggg

SEQ ID NO: 2711853 - RNA, 20 nt, Human
aggcugggagagccuuccag

SEQ ID NO: 2711854 - RNA, 21 nt, Human
aggcugggagagccuuccagg

SEQ ID NO: 2711855 - RNA, 13 nt, Human
aggcugggcuccc

SEQ ID NO: 2711856 - RNA, 14 nt, Human
aggcugggcucccu

SEQ ID NO: 2711857 - RNA, 18 nt, Human
aggcugggcucccuuccc

SEQ ID NO: 2711858 - RNA, 14 nt, Human
aggcugggcuucag

SEQ ID NO: 2711859 - RNA, 21 nt, Human
aggcugggcucccuucccacc

SEQ ID NO: 2711860 - RNA, 23 nt, Human
aggcugggcucccuucccaccuc

SEQ ID NO: 2711861 - RNA, 17 nt, Human
aggcugggggaagaagc

SEQ ID NO: 2711862 - RNA, 22 nt, Human
aggcugggcuucaguggcagcu

SEQ ID NO: 2711863 - RNA, 23 nt, Human
aggcugggcuucaguggcagcug

SEQ ID NO: 2711864 - RNA, 18 nt, Human
aggcugggcuucaguggc

SEQ ID NO: 2711865 - RNA, 19 nt, Human
aggcugggcuucaguggca

SEQ ID NO: 2711866 - RNA, 20 nt, Human
aggcugggcuucaguggcag

SEQ ID NO: 2711867 - RNA, 21 nt, Human
aggcugggcuucaguggcagc

SEQ ID NO: 2711868 - RNA, 22 nt, Human
aggcugggggaagaagcucucu

SEQ ID NO: 2711869 - RNA, 14 nt, Human
aggcuggguucuga

SEQ ID NO: 2711870 - RNA, 17 nt, Human
aggcuggguucugaucc

SEQ ID NO: 2711871 - RNA, 22 nt, Human
agggcuguuauaaucuuucaca

SEQ ID NO: 2711872 - RNA, 21 nt, Human
ugggcucccuucccaccucuc

SEQ ID NO: 2711873 - RNA, 15 nt, Human
ugggcucccuuccca

SEQ ID NO: 2711874 - RNA, 14 nt, Human
ugggcucccuuccc

SEQ ID NO: 2711875 - RNA, 20 nt, Human
agggcuccagacacaugucc

SEQ ID NO: 2711876 - RNA, 14 nt, Human
agggcccagagagg

SEQ ID NO: 2711877 - RNA, 23 nt, Human
agggaguccgaaagggacuugga

SEQ ID NO: 2711878 - RNA, 20 nt, Human
agggagugacagaggcagcc

SEQ ID NO: 2711879 - RNA, 20 nt, Human
agggagugaguugauagcac

SEQ ID NO: 2711880 - RNA, 20 nt, Human
agggaguccgaaagggacuu

SEQ ID NO: 2711881 - RNA, 22 nt, Human
agggagggcuccagacacaugu

SEQ ID NO: 2711882 - RNA, 17 nt, Human
agggagggagggcucca

SEQ ID NO: 2711883 - RNA, 12 nt, Human
agggagggcucc

SEQ ID NO: 2711884 - RNA, 17 nt, Human
agggagggcuccagaca

SEQ ID NO: 2711885 - RNA, 19 nt, Human
agggagggcuccagacaca

SEQ ID NO: 2711886 - RNA, 12 nt, Human
agggcccagaga

SEQ ID NO: 2711887 - RNA, 13 nt, Human
agggcccagagag

SEQ ID NO: 2711888 - RNA, 23 nt, Human
agggacuucugucuucacaacag

SEQ ID NO: 2711889 - RNA, 15 nt, Human
agggacuuggaagcu

SEQ ID NO: 2711890 - RNA, 18 nt, Human
agggacuuggaagcuccg

SEQ ID NO: 2711891 - RNA, 19 nt, Human
agggacuuggaagcuccgc

SEQ ID NO: 2711892 - RNA, 14 nt, Human
agggagagaagaua

SEQ ID NO: 2711893 - RNA, 13 nt, Human
agggagagaagau

SEQ ID NO: 2711894 - RNA, 20 nt, Human
agggacuuggaagcuccgcu

SEQ ID NO: 2711895 - RNA, 18 nt, Human
ugggacuacaggcaccca

SEQ ID NO: 2711896 - RNA, 16 nt, Human
ugggacuacaggugug

SEQ ID NO: 2711897 - RNA, 18 nt, Human
ugggacucaaugcacuga

SEQ ID NO: 2711898 - RNA, 22 nt, Human
ugggaggauugcuugagcucag

SEQ ID NO: 2711899 - RNA, 18 nt, Human
ugggaggauugcuugagc

SEQ ID NO: 2711900 - RNA, 21 nt, Human
ugggaggauugcuugagcuca

SEQ ID NO: 2711901 - RNA, 21 nt, Human
ugggagaaccaaaaagaggcu

SEQ ID NO: 2711902 - RNA, 21 nt, Human
ugggcaacccccagccugcua

SEQ ID NO: 2711903 - RNA, 13 nt, Human
ugggcagaaggaa

SEQ ID NO: 2711904 - RNA, 23 nt, Human
ugggcagaaggaagacuucaucc

SEQ ID NO: 2711905 - RNA, 13 nt, Human
ugggcauucaaau

SEQ ID NO: 2711906 - RNA, 14 nt, Human
ugggcauucaaaug

SEQ ID NO: 2711907 - RNA, 16 nt, Human
ugggcagaaggaagac

SEQ ID NO: 2711908 - RNA, 20 nt, Human
ugggcagaaggaagacuuca

SEQ ID NO: 2711909 - RNA, 16 nt, Human
uguccaagaagcccag

SEQ ID NO: 2711910 - RNA, 17 nt, Human
uguccaagaagcccagg

SEQ ID NO: 2711911 - RNA, 18 nt, Human
uguccaagaagcccagga

SEQ ID NO: 2711912 - RNA, 22 nt, Human
uguccaagaagcccaggaaagg

SEQ ID NO: 2711913 - RNA, 20 nt, Human
ugucccugcacuugcagacu

SEQ ID NO: 2711914 - RNA, 22 nt, Human
ugucccugcacuugcagacucu

SEQ ID NO: 2711915 - RNA, 23 nt, Human
ugucccugcacuugcagacucua

SEQ ID NO: 2711916 - RNA, 14 nt, Human
uguccaagaagccc

SEQ ID NO: 2711917 - RNA, 15 nt, Human
uguccaagaagccca

SEQ ID NO: 2711918 - RNA, 17 nt, Human
ugucagguggggcagcu

SEQ ID NO: 2711919 - RNA, 18 nt, Human
ugucagguggggcagcuu

SEQ ID NO: 2711920 - RNA, 20 nt, Human
ugucagguggggcagcuuga

SEQ ID NO: 2711921 - RNA, 20 nt, Human
ugucauuugagcagggcuca

SEQ ID NO: 2711922 - RNA, 21 nt, Human
ugucauuugagcagggcucag

SEQ ID NO: 2711923 - RNA, 22 nt, Human
ugucauuugagcagggcucagc

SEQ ID NO: 2711924 - RNA, 23 nt, Human
aguauaauuaacauguuaaacca

SEQ ID NO: 2711925 - RNA, 16 nt, Human
aguauaauuaacaugu

SEQ ID NO: 2711926 - RNA, 14 nt, Human
aguauaauuaacau

SEQ ID NO: 2711927 - RNA, 13 nt, Human
aguauaauuaaca

SEQ ID NO: 2711928 - RNA, 14 nt, Human
aguauuaagcauau

SEQ ID NO: 2711929 - RNA, 12 nt, Human
aguauuaagcau

SEQ ID NO: 2711930 - RNA, 15 nt, Human
agucaccaagcccag

SEQ ID NO: 2711931 - RNA, 17 nt, Human
agucaccccggccaccu

SEQ ID NO: 2711932 - RNA, 19 nt, Human
aguauucuuauuuaaugaa

SEQ ID NO: 2711933 - RNA, 14 nt, Human
agucaggaaagaga

SEQ ID NO: 2711934 - RNA, 19 nt, Human
ugucccuuacgugaguccu

SEQ ID NO: 2711935 - RNA, 23 nt, Human
ugucccuuacgugaguccuggca

SEQ ID NO: 2711936 - RNA, 18 nt, Human
agucccaccuuggcugca

SEQ ID NO: 2711937 - RNA, 19 nt, Human
agucccaccuuggcugcag

SEQ ID NO: 2711938 - RNA, 15 nt, Human
agucccaccuuggcu

SEQ ID NO: 2711939 - RNA, 16 nt, Human
agucccaccuuggcug

SEQ ID NO: 2711940 - RNA, 13 nt, Human
agucucaggaaau

SEQ ID NO: 2711941 - RNA, 23 nt, Human
agucucacuguugcccaggcugg

SEQ ID NO: 2711942 - RNA, 20 nt, Human
agucuauuuacggaacucaa

SEQ ID NO: 2711943 - RNA, 15 nt, Human
agucuauuuacggaa

SEQ ID NO: 2711944 - RNA, 14 nt, Human
aguccucccaucuc

SEQ ID NO: 2711945 - RNA, 16 nt, Human
aguccucccaucucac

SEQ ID NO: 2711946 - RNA, 16 nt, Human
aggugcuacaaaaaca

SEQ ID NO: 2711947 - RNA, 12 nt, Human
aggugggaggau

SEQ ID NO: 2711948 - RNA, 14 nt, Human
agguugaagcacca

SEQ ID NO: 2711949 - RNA, 12 nt, Human
aggugugcucug

SEQ ID NO: 2711950 - RNA, 16 nt, Human
aggugucccugcacuu

SEQ ID NO: 2711951 - RNA, 20 nt, Human
aggugucccugcacuugcag

SEQ ID NO: 2711952 - RNA, 21 nt, Human
aggugugagucaccaagccca

SEQ ID NO: 2711953 - RNA, 22 nt, Human
aggugugagucaccaagcccag

SEQ ID NO: 2711954 - RNA, 19 nt, Human
uguaagggaaacugccagc

SEQ ID NO: 2711955 - RNA, 18 nt, Human
uguaauuaaguacuaugu

SEQ ID NO: 2711956 - RNA, 21 nt, Human
uguaauuaaguacuauguauc

SEQ ID NO: 2711957 - RNA, 19 nt, Human
uguaauuaaguacuaugua

SEQ ID NO: 2711958 - RNA, 18 nt, Human
uguaagggaaacugccag

SEQ ID NO: 2711959 - RNA, 13 nt, Human
uguaagggaaacu

SEQ ID NO: 2711960 - RNA, 20 nt, Human
agguuggcaaaaaggcagga

SEQ ID NO: 2711961 - RNA, 16 nt, Human
uguacaugaaaacaca

SEQ ID NO: 2711962 - RNA, 14 nt, Human
uguacaugaaaaca

SEQ ID NO: 2711963 - RNA, 20 nt, Human
uguaauuuuuuuaucgucac

SEQ ID NO: 2711964 - RNA, 20 nt, Human
uguacauaaugcgugcauac

SEQ ID NO: 2711965 - RNA, 19 nt, Human
uguacauaaugcgugcaua

SEQ ID NO: 2711966 - RNA, 17 nt, Human
uguaguguuggagaaga

SEQ ID NO: 2711967 - RNA, 18 nt, Human
uguaguguuggagaagaa

SEQ ID NO: 2711968 - RNA, 18 nt, Human
uguauauccuuucuaaca

SEQ ID NO: 2711969 - RNA, 22 nt, Human
uguauauauuuccuauauuguu

SEQ ID NO: 2711970 - RNA, 18 nt, Human
uguauauauuuccuauau

SEQ ID NO: 2711971 - RNA, 16 nt, Human
uguaguguuggagaag

SEQ ID NO: 2711972 - RNA, 16 nt, Human
uguaggguuauaauaa

SEQ ID NO: 2711973 - RNA, 17 nt, Human
uguaggguuauaauaau

SEQ ID NO: 2711974 - RNA, 20 nt, Human
aguaaaaccacagcaguuga

SEQ ID NO: 2711975 - RNA, 19 nt, Human
aguaaaaccacagcaguug

SEQ ID NO: 2711976 - RNA, 17 nt, Human
aguaaaaccacagcagu

SEQ ID NO: 2711977 - RNA, 16 nt, Human
aguaaaaccacagcag

SEQ ID NO: 2711978 - RNA, 13 nt, Human
aguaauagagcaa

SEQ ID NO: 2711979 - RNA, 21 nt, Human
uguacauggaauaacauguaa

SEQ ID NO: 2711980 - RNA, 12 nt, Human
aguaauuggaaa

SEQ ID NO: 2711981 - RNA, 13 nt, Human
aguaauuggaaag

SEQ ID NO: 2711982 - RNA, 19 nt, Human
aguaauucaagaaaacaac

SEQ ID NO: 2711983 - RNA, 21 nt, Human
aguacacuguuucaaacuuua

SEQ ID NO: 2711984 - RNA, 19 nt, Human
aguacauuuggagacacaa

SEQ ID NO: 2711985 - RNA, 23 nt, Human
aguacacuguuucaaacuuuacu

SEQ ID NO: 2711986 - RNA, 23 nt, Human
aguguuggagaagaacugaaauc

SEQ ID NO: 2711987 - RNA, 16 nt, Human
aguguuguggauuuaa

SEQ ID NO: 2711988 - RNA, 13 nt, Human
aguuacucagaau

SEQ ID NO: 2711989 - RNA, 20 nt, Human
aguguuguggauuuaacaga

SEQ ID NO: 2711990 - RNA, 19 nt, Human
aguguuguggauuuaacag

SEQ ID NO: 2711991 - RNA, 22 nt, Human
uguugcccacagcuguaugauu

SEQ ID NO: 2711992 - RNA, 23 nt, Human
uguugcccaggcuggcgugcagu

SEQ ID NO: 2711993 - RNA, 20 nt, Human
uguugcccaggcuggcgugc

SEQ ID NO: 2711994 - RNA, 20 nt, Human
agugugccugaagucccaga

SEQ ID NO: 2711995 - RNA, 20 nt, Human
agugugacugaucucucgug

SEQ ID NO: 2711996 - RNA, 21 nt, Human
agugugccugaagucccagau

SEQ ID NO: 2711997 - RNA, 20 nt, Human
agugugguguuuccuggcac

SEQ ID NO: 2711998 - RNA, 22 nt, Human
agugugguguuuccuggcacug

SEQ ID NO: 2711999 - RNA, 17 nt, Human
uguuaugacuccagaau

SEQ ID NO: 2712000 - RNA, 13 nt, Human
uguuaugacucca

SEQ ID NO: 2712001 - RNA, 19 nt, Human
uguuccacaaguuaaauaa

SEQ ID NO: 2712002 - RNA, 19 nt, Human
uguuacauaagauaaaugu

SEQ ID NO: 2712003 - RNA, 22 nt, Human
uguguuaaguauguguaaaaug

SEQ ID NO: 2712004 - RNA, 22 nt, Human
uguguuaucacccagaagaaaa

SEQ ID NO: 2712005 - RNA, 16 nt, Human
uguguuagagauuuuu

SEQ ID NO: 2712006 - RNA, 23 nt, Human
uguuaagcagauggaaugcugug

SEQ ID NO: 2712007 - RNA, 22 nt, Human
agugggcccaaugcacuuuguu

SEQ ID NO: 2712008 - RNA, 16 nt, Human
aguggggaaugaagau

SEQ ID NO: 2712009 - RNA, 20 nt, Human
ugugucagguggggcagcuu

SEQ ID NO: 2712010 - RNA, 14 nt, Human
uguguaaaauguga

SEQ ID NO: 2712011 - RNA, 11 nt, Human
uguguguuuau

SEQ ID NO: 2712012 - RNA, 22 nt, Human
ugugucucuugguccugcugca

SEQ ID NO: 2712013 - RNA, 19 nt, Human
ugugucuaaauuugaaugu

SEQ ID NO: 2712014 - RNA, 22 nt, Human
ugugucuaaauuugaauguuaa

SEQ ID NO: 2712015 - RNA, 16 nt, Human
agucuuucacauuuaa

SEQ ID NO: 2712016 - RNA, 21 nt, Human
agucuugucucagauuuuauu

SEQ ID NO: 2712017 - RNA, 20 nt, Human
agucuugucucagauuuuau

SEQ ID NO: 2712018 - RNA, 16 nt, Human
agugaacuugggccac

SEQ ID NO: 2712019 - RNA, 21 nt, Human
agugacugauggcuaauguac

SEQ ID NO: 2712020 - RNA, 18 nt, Human
ugugaugagaggaaauca

SEQ ID NO: 2712021 - RNA, 19 nt, Human
ugugaugagaggaaaucac

SEQ ID NO: 2712022 - RNA, 22 nt, Human
ugugaugaugaaaugaggucag

SEQ ID NO: 2712023 - RNA, 12 nt, Human
agugagcugguu

SEQ ID NO: 2712024 - RNA, 14 nt, Human
agugagcacuaagg

SEQ ID NO: 2712025 - RNA, 22 nt, Human
agugagcacuaaggugugcucu

SEQ ID NO: 2712026 - RNA, 13 nt, Human
agucuuagaugua

SEQ ID NO: 2712027 - RNA, 23 nt, Human
agucuuagauguauauauuuccu

SEQ ID NO: 2712028 - RNA, 16 nt, Human
agucuugucucagauu

SEQ ID NO: 2712029 - RNA, 19 nt, Human
agucuugucucagauuuua

SEQ ID NO: 2712030 - RNA, 17 nt, Human
agucuugucucagauuu

SEQ ID NO: 2712031 - RNA, 16 nt, Human
agucuuagauguauau

SEQ ID NO: 2712032 - RNA, 14 nt, Human
agucuuagauguau

SEQ ID NO: 2712033 - RNA, 16 nt, Human
agucucuugauucaua

SEQ ID NO: 2712034 - RNA, 17 nt, Human
agucucuugauucauaa

SEQ ID NO: 2712035 - RNA, 11 nt, Human
ugugaggaagc

SEQ ID NO: 2712036 - RNA, 16 nt, Human
ugugacugaucucucg

SEQ ID NO: 2712037 - RNA, 14 nt, Human
agugcaaauuguca

SEQ ID NO: 2712038 - RNA, 16 nt, Human
agugaggaugaaaaaa

SEQ ID NO: 2712039 - RNA, 21 nt, Human
agugaguuggguguauugugc

SEQ ID NO: 2712040 - RNA, 13 nt, Human
agugaggcucugc

SEQ ID NO: 2712041 - RNA, 12 nt, Human
agugaggcucug

SEQ ID NO: 2712042 - RNA, 16 nt, Human
agugcaugcugucccu

SEQ ID NO: 2712043 - RNA, 14 nt, Human
agugcaugcugucc

SEQ ID NO: 2712044 - RNA, 14 nt, Human
agugccaaaaacaa

SEQ ID NO: 2712045 - RNA, 17 nt, Human
agugcagugagccgaga

SEQ ID NO: 2712046 - RNA, 14 nt, Human
agugcacuaaugug

SEQ ID NO: 2712047 - RNA, 21 nt, Human
agugcacuaauguguaagaca

SEQ ID NO: 2712048 - RNA, 17 nt, Human
agugcacuaauguguaa

SEQ ID NO: 2712049 - RNA, 19 nt, Human
ugugcugagucugaaggcu

SEQ ID NO: 2712050 - RNA, 18 nt, Human
ugugcugagucugaaggc

SEQ ID NO: 2712051 - RNA, 14 nt, Human
uguggaugauaaaa

SEQ ID NO: 2712052 - RNA, 23 nt, Human
agugagcugguuuuuagcggaga

SEQ ID NO: 2712053 - RNA, 22 nt, Human
uguggauuuaacagaaauguac

SEQ ID NO: 2712054 - RNA, 20 nt, Human
uguggauuuaacagaaaugu

SEQ ID NO: 2712055 - RNA, 19 nt, Human
uguggauuuaacagaaaug

SEQ ID NO: 2712056 - RNA, 20 nt, Human
ugugcugguguaugugugaa

SEQ ID NO: 2712057 - RNA, 19 nt, Human
ugugcugggguuaucugaa

SEQ ID NO: 2712058 - RNA, 18 nt, Human
ugugcugcccugcccacc

SEQ ID NO: 2712059 - RNA, 19 nt, Human
ugugcugcccugcccaccu

SEQ ID NO: 2712060 - RNA, 20 nt, Human
ugugcugcccugcccaccug

SEQ ID NO: 2712061 - RNA, 21 nt, Human
ugugcugcccugcccaccugg

SEQ ID NO: 2712062 - RNA, 17 nt, Human
auacuauggaauuucuc

SEQ ID NO: 2712063 - RNA, 20 nt, Human
auacuaaccagcagaaaugc

SEQ ID NO: 2712064 - RNA, 19 nt, Human
auacuaaccagcagaaaug

SEQ ID NO: 2712065 - RNA, 13 nt, Human
auacuaaccagca

SEQ ID NO: 2712066 - RNA, 15 nt, Human
uuauauuugaaauau

SEQ ID NO: 2712067 - RNA, 19 nt, Human
uuauauuugaaauauugac

SEQ ID NO: 2712068 - RNA, 18 nt, Human
auaccacuuuuguucuug

SEQ ID NO: 2712069 - RNA, 17 nt, Human
auaccacuuuuguucuu

SEQ ID NO: 2712070 - RNA, 14 nt, Human
auaccuuuuuuaga

SEQ ID NO: 2712071 - RNA, 23 nt, Human
auacgcaacauaauuaaauuuug

SEQ ID NO: 2712072 - RNA, 13 nt, Human
auacguacacauu

SEQ ID NO: 2712073 - RNA, 16 nt, Human
auacguacacauuuua

SEQ ID NO: 2712074 - RNA, 19 nt, Human
auacgugggcauucaaaug

SEQ ID NO: 2712075 - RNA, 18 nt, Human
auacgugggcauucaaau

SEQ ID NO: 2712076 - RNA, 15 nt, Human
auacguacacauuuu

SEQ ID NO: 2712077 - RNA, 14 nt, Human
auacguacacauuu

SEQ ID NO: 2712078 - RNA, 18 nt, Human
uuauaaacuuuaccuuuu

SEQ ID NO: 2712079 - RNA, 17 nt, Human
uuauaaacuuuaccuuu

SEQ ID NO: 2712080 - RNA, 16 nt, Human
auacagaggcaacugc

SEQ ID NO: 2712081 - RNA, 17 nt, Human
auacagaggcaacugca

SEQ ID NO: 2712082 - RNA, 18 nt, Human
auacaguuacucagaauu

SEQ ID NO: 2712083 - RNA, 23 nt, Human
auacagauagauauaugcucugc

SEQ ID NO: 2712084 - RNA, 22 nt, Human
auacaggaaaagcugcugacag

SEQ ID NO: 2712085 - RNA, 23 nt, Human
auacaggaaaagcugcugacagu

SEQ ID NO: 2712086 - RNA, 20 nt, Human
auacauaaacaagaccacgu

SEQ ID NO: 2712087 - RNA, 20 nt, Human
auacaguuacucagaauucu

SEQ ID NO: 2712088 - RNA, 14 nt, Human
uuaugaauuacauu

SEQ ID NO: 2712089 - RNA, 16 nt, Human
uuaugaauuacauuug

SEQ ID NO: 2712090 - RNA, 17 nt, Human
uuaugaauuacauuugu

SEQ ID NO: 2712091 - RNA, 21 nt, Human
uuaugaauuacauuuguauaa

SEQ ID NO: 2712092 - RNA, 11 nt, Human
uuaugacucca

SEQ ID NO: 2712093 - RNA, 18 nt, Human
uuaugauccagcagauua

SEQ ID NO: 2712094 - RNA, 13 nt, Human
uuaugauccagca

SEQ ID NO: 2712095 - RNA, 21 nt, Human
uuaucacccagaagaaaauag

SEQ ID NO: 2712096 - RNA, 19 nt, Human
uuaucacccagaagaaaau

SEQ ID NO: 2712097 - RNA, 18 nt, Human
uuaucacccagaagaaaa

SEQ ID NO: 2712098 - RNA, 17 nt, Human
uuaucacccagaagaaa

SEQ ID NO: 2712099 - RNA, 19 nt, Human
uuaugaaacuuuuggaagg

SEQ ID NO: 2712100 - RNA, 14 nt, Human
uuaugaaacuuuug

SEQ ID NO: 2712101 - RNA, 19 nt, Human
uuaugaaacuuguguaaau

SEQ ID NO: 2712102 - RNA, 18 nt, Human
uuaugaaacuuuuggaag

SEQ ID NO: 2712103 - RNA, 17 nt, Human
uuaugaaacuuuuggaa

SEQ ID NO: 2712104 - RNA, 13 nt, Human
uuaugaaacuugu

SEQ ID NO: 2712105 - RNA, 18 nt, Human
uuaugaaacuuguguaaa

SEQ ID NO: 2712106 - RNA, 16 nt, Human
uuaugaaacuugugua

SEQ ID NO: 2712107 - RNA, 19 nt, Human
uuaugauuaaguaaugaua

SEQ ID NO: 2712108 - RNA, 23 nt, Human
uuaugauccagcagauuauucac

SEQ ID NO: 2712109 - RNA, 22 nt, Human
uuaugauccagcagauuauuca

SEQ ID NO: 2712110 - RNA, 13 nt, Human
uuaugggcugggu

SEQ ID NO: 2712111 - RNA, 19 nt, Human
uuauggcuuuugugcauua

SEQ ID NO: 2712112 - RNA, 11 nt, Human
uuauguaaauc

SEQ ID NO: 2712113 - RNA, 13 nt, Human
uuauguaaauccc

SEQ ID NO: 2712114 - RNA, 12 nt, Human
uuauguaaaucc

SEQ ID NO: 2712115 - RNA, 23 nt, Human
uuauguaaaucccauuauucaaa

SEQ ID NO: 2712116 - RNA, 22 nt, Human
uuauguaaaucccauuauucaa

SEQ ID NO: 2712117 - RNA, 21 nt, Human
uuauguaaaucccauuauuca

SEQ ID NO: 2712118 - RNA, 19 nt, Human
uuauguaaaucccauuauu

SEQ ID NO: 2712119 - RNA, 22 nt, Human
uuaugggcuggguucuacccag

SEQ ID NO: 2712120 - RNA, 16 nt, Human
uuaugugcgcugauaa

SEQ ID NO: 2712121 - RNA, 13 nt, Human
auagaaguaaaaa

SEQ ID NO: 2712122 - RNA, 14 nt, Human
auagaaccucuuug

SEQ ID NO: 2712123 - RNA, 20 nt, Human
auagaaccucuuugucuaca

SEQ ID NO: 2712124 - RNA, 23 nt, Human
auagacaauuuauuauggcacau

SEQ ID NO: 2712125 - RNA, 22 nt, Human
auagacaauuuauuauggcaca

SEQ ID NO: 2712126 - RNA, 16 nt, Human
auagacaauuuauuau

SEQ ID NO: 2712127 - RNA, 18 nt, Human
auagauaggucagugcaa

SEQ ID NO: 2712128 - RNA, 21 nt, Human
auagaguguacuuaacuauuc

SEQ ID NO: 2712129 - RNA, 14 nt, Human
auagaguguacuua

SEQ ID NO: 2712130 - RNA, 19 nt, Human
auagaguguacuuaacuau

SEQ ID NO: 2712131 - RNA, 22 nt, Human
auagaggaagccugauuaaaga

SEQ ID NO: 2712132 - RNA, 21 nt, Human
auagaggaagccugauuaaag

SEQ ID NO: 2712133 - RNA, 14 nt, Human
auagagagagacca

SEQ ID NO: 2712134 - RNA, 15 nt, Human
auagagcaaaauuga

SEQ ID NO: 2712135 - RNA, 17 nt, Human
auagagcaaaauugaug

SEQ ID NO: 2712136 - RNA, 21 nt, Human
auagagcaaaauugauguguu

SEQ ID NO: 2712137 - RNA, 22 nt, Human
auagagcaaaauugauguguuu

SEQ ID NO: 2712138 - RNA, 21 nt, Human
auagauuagagaguguugaaa

SEQ ID NO: 2712139 - RNA, 16 nt, Human
auagauuagaauucug

SEQ ID NO: 2712140 - RNA, 15 nt, Human
auagauuagaauucu

SEQ ID NO: 2712141 - RNA, 13 nt, Human
auagauuagaauu

SEQ ID NO: 2712142 - RNA, 22 nt, Human
auagauuagagaguguugaaac

SEQ ID NO: 2712143 - RNA, 11 nt, Human
auacucccauc

SEQ ID NO: 2712144 - RNA, 14 nt, Human
auacucccaucugu

SEQ ID NO: 2712145 - RNA, 16 nt, Human
auacucugcuuagaau

SEQ ID NO: 2712146 - RNA, 18 nt, Human
auacucuuauaucuauau

SEQ ID NO: 2712147 - RNA, 14 nt, Human
auacucuuauaucu

SEQ ID NO: 2712148 - RNA, 15 nt, Human
auacuggauuguacu

SEQ ID NO: 2712149 - RNA, 19 nt, Human
uuauguuaaaacugggaca

SEQ ID NO: 2712150 - RNA, 14 nt, Human
uuauuauauuuaca

SEQ ID NO: 2712151 - RNA, 15 nt, Human
uuauuauauuuacaa

SEQ ID NO: 2712152 - RNA, 11 nt, Human
uuauuaugaaa

SEQ ID NO: 2712153 - RNA, 23 nt, Human
uuauuaugaaacuuguguaaaua

SEQ ID NO: 2712154 - RNA, 12 nt, Human
uuauuaugcaug

SEQ ID NO: 2712155 - RNA, 22 nt, Human
uuauuaugaaacuuguguaaau

SEQ ID NO: 2712156 - RNA, 21 nt, Human
uuauuaugaaacuuguguaaa

SEQ ID NO: 2712157 - RNA, 20 nt, Human
uuauuaugaaacuuguguaa

SEQ ID NO: 2712158 - RNA, 17 nt, Human
uuauuaugaaacuugug

SEQ ID NO: 2712159 - RNA, 19 nt, Human
uuauucaaaguugccuaaa

SEQ ID NO: 2712160 - RNA, 15 nt, Human
uuauucaaaguugcc

SEQ ID NO: 2712161 - RNA, 13 nt, Human
uuauucaaaguug

SEQ ID NO: 2712162 - RNA, 13 nt, Human
uuauuaugcauga

SEQ ID NO: 2712163 - RNA, 14 nt, Human
uuauuauguaaauc

SEQ ID NO: 2712164 - RNA, 13 nt, Human
uuauuauguaaau

SEQ ID NO: 2712165 - RNA, 22 nt, Human
uuauuauguaaaucccauuauu

SEQ ID NO: 2712166 - RNA, 16 nt, Human
uuauuauguaaauccc

SEQ ID NO: 2712167 - RNA, 14 nt, Human
uuauucacugauuu

SEQ ID NO: 2712168 - RNA, 16 nt, Human
aguuuuauaugcuucu

SEQ ID NO: 2712169 - RNA, 12 nt, Human
aguuuuguuugg

SEQ ID NO: 2712170 - RNA, 16 nt, Human
aguuuuguuuggacca

SEQ ID NO: 2712171 - RNA, 14 nt, Human
aguuuuguuuggac

SEQ ID NO: 2712172 - RNA, 18 nt, Human
aguuuuguuuggaccaaa

SEQ ID NO: 2712173 - RNA, 23 nt, Human
uuaacuuuuauaaacuuuaccuu

SEQ ID NO: 2712174 - RNA, 22 nt, Human
uuaacuuuuauaaacuuuaccu

SEQ ID NO: 2712175 - RNA, 15 nt, Human
uuaauuuuggaauuu

SEQ ID NO: 2712176 - RNA, 14 nt, Human
uuaauuuuggaauu

SEQ ID NO: 2712177 - RNA, 16 nt, Human
uuaauuugguuuucac

SEQ ID NO: 2712178 - RNA, 13 nt, Human
uuaauuuuggaau

SEQ ID NO: 2712179 - RNA, 22 nt, Human
uuaagagagucuauuuacggaa

SEQ ID NO: 2712180 - RNA, 15 nt, Human
uuaaucuaaauggaa

SEQ ID NO: 2712181 - RNA, 20 nt, Human
aguuuaaauuguaauaggcg

SEQ ID NO: 2712182 - RNA, 17 nt, Human
aguuuaaauuguaauag

SEQ ID NO: 2712183 - RNA, 15 nt, Human
aguuuacauuguaaa

SEQ ID NO: 2712184 - RNA, 17 nt, Human
aguuuacauuguaaaua

SEQ ID NO: 2712185 - RNA, 13 nt, Human
aguuuacauugua

SEQ ID NO: 2712186 - RNA, 15 nt, Human
aguuuagcuggaaaa

SEQ ID NO: 2712187 - RNA, 19 nt, Human
uuaaaaaagaaacauuugg

SEQ ID NO: 2712188 - RNA, 16 nt, Human
uuaaaaaauggaacau

SEQ ID NO: 2712189 - RNA, 19 nt, Human
uuaaaaaucucaaauuucu

SEQ ID NO: 2712190 - RNA, 17 nt, Human
uuaaaaaucucaaauuu

SEQ ID NO: 2712191 - RNA, 20 nt, Human
uuaaaaaucucaaauuucua

SEQ ID NO: 2712192 - RNA, 14 nt, Human
uuaaaaucauuucu

SEQ ID NO: 2712193 - RNA, 22 nt, Human
uuaaaaucauuucugcaucagc

SEQ ID NO: 2712194 - RNA, 17 nt, Human
uuaaaccaugggauaaa

SEQ ID NO: 2712195 - RNA, 12 nt, Human
uuaacagaaaug

SEQ ID NO: 2712196 - RNA, 14 nt, Human
uuaacagaaaugua

SEQ ID NO: 2712197 - RNA, 13 nt, Human
uuaacagaaaugu

SEQ ID NO: 2712198 - RNA, 23 nt, Human
uuaaaccaugggauaaaugccau

SEQ ID NO: 2712199 - RNA, 22 nt, Human
uuaaaccaugggauaaaugcca

SEQ ID NO: 2712200 - RNA, 21 nt, Human
uuaaaccaugggauaaaugcc

SEQ ID NO: 2712201 - RNA, 22 nt, Human
uuaaaguugaauuuauuggcuu

SEQ ID NO: 2712202 - RNA, 17 nt, Human
uuaaaguugaauuuauu

SEQ ID NO: 2712203 - RNA, 16 nt, Human
uuaaaguugaauuuau

SEQ ID NO: 2712204 - RNA, 13 nt, Human
uuaaaguugaauu

SEQ ID NO: 2712205 - RNA, 15 nt, Human
uuaaauuuugaguuc

SEQ ID NO: 2712206 - RNA, 20 nt, Human
uuaaauuuugaguucuacau

SEQ ID NO: 2712207 - RNA, 22 nt, Human
aguuuguuaguaugaggcauuu

SEQ ID NO: 2712208 - RNA, 19 nt, Human
aguuucugccgcagcccug

SEQ ID NO: 2712209 - RNA, 19 nt, Human
aguuugugcugguguaugu

SEQ ID NO: 2712210 - RNA, 14 nt, Human
aguuucucuuuuca

SEQ ID NO: 2712211 - RNA, 15 nt, Human
aguuucugccgcagc

SEQ ID NO: 2712212 - RNA, 14 nt, Human
uuaggguuaugauu

SEQ ID NO: 2712213 - RNA, 16 nt, Human
uuaggguuaugauuaa

SEQ ID NO: 2712214 - RNA, 14 nt, Human
uuagggagagaaga

SEQ ID NO: 2712215 - RNA, 15 nt, Human
uuagggagagaagau

SEQ ID NO: 2712216 - RNA, 19 nt, Human
uuaggugugggggaagcac

SEQ ID NO: 2712217 - RNA, 13 nt, Human
uuaguagagacag

SEQ ID NO: 2712218 - RNA, 14 nt, Human
uuaguagagacagg

SEQ ID NO: 2712219 - RNA, 13 nt, Human
uuauaaacuuuac

SEQ ID NO: 2712220 - RNA, 14 nt, Human
auaaucuuucacag

SEQ ID NO: 2712221 - RNA, 21 nt, Human
auaauuuauacaggucauauu

SEQ ID NO: 2712222 - RNA, 19 nt, Human
auaauuuauacaggucaua

SEQ ID NO: 2712223 - RNA, 18 nt, Human
auaauuuaccugaagucu

SEQ ID NO: 2712224 - RNA, 17 nt, Human
auaauucagaaggaucu

SEQ ID NO: 2712225 - RNA, 22 nt, Human
auaagccaaaaaaugcuugcuu

SEQ ID NO: 2712226 - RNA, 21 nt, Human
auaagauucauauuuacuucu

SEQ ID NO: 2712227 - RNA, 14 nt, Human
uuacaggugugaac

SEQ ID NO: 2712228 - RNA, 17 nt, Human
uuacaguggggaaugaa

SEQ ID NO: 2712229 - RNA, 19 nt, Human
uuaccagcagagcaccuua

SEQ ID NO: 2712230 - RNA, 18 nt, Human
auaaaugccaucaauaaa

SEQ ID NO: 2712231 - RNA, 17 nt, Human
auaaaugccaucaauaa

SEQ ID NO: 2712232 - RNA, 19 nt, Human
auaaaucugugaacuugaa

SEQ ID NO: 2712233 - RNA, 16 nt, Human
auaaaucugugaacuu

SEQ ID NO: 2712234 - RNA, 15 nt, Human
auaaaucugugaacu

SEQ ID NO: 2712235 - RNA, 14 nt, Human
auaagauucauauu

SEQ ID NO: 2712236 - RNA, 17 nt, Human
uuagaauucuguauaga

SEQ ID NO: 2712237 - RNA, 15 nt, Human
uuagaauucuguaua

SEQ ID NO: 2712238 - RNA, 14 nt, Human
uuagaauucuguau

SEQ ID NO: 2712239 - RNA, 16 nt, Human
uuagaagucacacagu

SEQ ID NO: 2712240 - RNA, 15 nt, Human
uuacugcagcuuugu

SEQ ID NO: 2712241 - RNA, 12 nt, Human
uuacuguacaug

SEQ ID NO: 2712242 - RNA, 23 nt, Human
uuacuguacaugaaaacacauuu

SEQ ID NO: 2712243 - RNA, 22 nt, Human
uuacuguacaugaaaacacauu

SEQ ID NO: 2712244 - RNA, 14 nt, Human
uuacuguacaugaa

SEQ ID NO: 2712245 - RNA, 13 nt, Human
uuacuguacauga

SEQ ID NO: 2712246 - RNA, 15 nt, Human
augaauuaaguuuuu

SEQ ID NO: 2712247 - RNA, 15 nt, Human
augaauuacauuugu

SEQ ID NO: 2712248 - RNA, 16 nt, Human
augaauuacauuugua

SEQ ID NO: 2712249 - RNA, 18 nt, Human
uuggggaccagagcugcc

SEQ ID NO: 2712250 - RNA, 19 nt, Human
augaaagggcccagagagg

SEQ ID NO: 2712251 - RNA, 19 nt, Human
augaaauuauauaaguauu

SEQ ID NO: 2712252 - RNA, 21 nt, Human
augaaauuauauaaguauucu

SEQ ID NO: 2712253 - RNA, 15 nt, Human
augaaagggcccaga

SEQ ID NO: 2712254 - RNA, 18 nt, Human
augaaagggcccagagag

SEQ ID NO: 2712255 - RNA, 17 nt, Human
aucuuugcagacaggca

SEQ ID NO: 2712256 - RNA, 22 nt, Human
aucuuuucauuuaggugaggaa

SEQ ID NO: 2712257 - RNA, 23 nt, Human
uuggcuauuagagaucaaccccu

SEQ ID NO: 2712258 - RNA, 18 nt, Human
uuggccccugcccggcug

SEQ ID NO: 2712259 - RNA, 16 nt, Human
uuggagggugucccaa

SEQ ID NO: 2712260 - RNA, 20 nt, Human
uuggagacacaacuauuuuu

SEQ ID NO: 2712261 - RNA, 14 nt, Human
aucuuauaauuuaa

SEQ ID NO: 2712262 - RNA, 20 nt, Human
aucuuggucagauuugaacu

SEQ ID NO: 2712263 - RNA, 13 nt, Human
aucuugcucugcu

SEQ ID NO: 2712264 - RNA, 18 nt, Human
aucuuguagcuuuaucaa

SEQ ID NO: 2712265 - RNA, 18 nt, Human
aucugugaaaggaaagag

SEQ ID NO: 2712266 - RNA, 19 nt, Human
aucuuguagcuuuaucaaa

SEQ ID NO: 2712267 - RNA, 20 nt, Human
aucuuguagcuuuaucaaag

SEQ ID NO: 2712268 - RNA, 17 nt, Human
aucugugaaaggaaaga

SEQ ID NO: 2712269 - RNA, 10 nt, Human
aucuggugac

SEQ ID NO: 2712270 - RNA, 16 nt, Human
aucuggugacuuuccu

SEQ ID NO: 2712271 - RNA, 17 nt, Human
aucuggugacuuuccuc

SEQ ID NO: 2712272 - RNA, 23 nt, Human
aucugccuaaggacuucuuuaau

SEQ ID NO: 2712273 - RNA, 22 nt, Human
aucugccuaaggacuucuuuaa

SEQ ID NO: 2712274 - RNA, 21 nt, Human
aucugccuaaggacuucuuua

SEQ ID NO: 2712275 - RNA, 11 nt, Human
aucugccuaag

SEQ ID NO: 2712276 - RNA, 18 nt, Human
aucuaauauguaacaagc

SEQ ID NO: 2712277 - RNA, 20 nt, Human
uugaguugauucagcucugc

SEQ ID NO: 2712278 - RNA, 20 nt, Human
uugagugaagcugggagaac

SEQ ID NO: 2712279 - RNA, 15 nt, Human
uugagaucagccugg

SEQ ID NO: 2712280 - RNA, 16 nt, Human
uugagaucagccuggg

SEQ ID NO: 2712281 - RNA, 12 nt, Human
uugagacagagu

SEQ ID NO: 2712282 - RNA, 20 nt, Human
uugacagaauauguuucaaa

SEQ ID NO: 2712283 - RNA, 17 nt, Human
uugaagggaaauuucag

SEQ ID NO: 2712284 - RNA, 17 nt, Human
uugacagaauauguuuc

SEQ ID NO: 2712285 - RNA, 16 nt, Human
auccucuguacagagc

SEQ ID NO: 2712286 - RNA, 17 nt, Human
auccucuguacagagcc

SEQ ID NO: 2712287 - RNA, 18 nt, Human
aucuaaauggaaccacuc

SEQ ID NO: 2712288 - RNA, 17 nt, Human
aucuaaauggaaccacu

SEQ ID NO: 2712289 - RNA, 13 nt, Human
aucuaaauggaac

SEQ ID NO: 2712290 - RNA, 14 nt, Human
aucucauuuccaag

SEQ ID NO: 2712291 - RNA, 14 nt, Human
aucuccaaaauaaa

SEQ ID NO: 2712292 - RNA, 13 nt, Human
aucuccaaaauaa

SEQ ID NO: 2712293 - RNA, 21 nt, Human
aucuccaaaauaaaacuuuuu

SEQ ID NO: 2712294 - RNA, 20 nt, Human
aucuccaaaauaaaacuuuu

SEQ ID NO: 2712295 - RNA, 17 nt, Human
aucuccaaaauaaaacu

SEQ ID NO: 2712296 - RNA, 16 nt, Human
aucucagggccugguc

SEQ ID NO: 2712297 - RNA, 14 nt, Human
aucucagggccugg

SEQ ID NO: 2712298 - RNA, 18 nt, Human
aucucuugagccugggag

SEQ ID NO: 2712299 - RNA, 14 nt, Human
aucugaaaauguau

SEQ ID NO: 2712300 - RNA, 15 nt, Human
aucucuugagccugg

SEQ ID NO: 2712301 - RNA, 22 nt, Human
aucugaaaauguauguguaagu

SEQ ID NO: 2712302 - RNA, 20 nt, Human
aucugaaaauguauguguaa

SEQ ID NO: 2712303 - RNA, 19 nt, Human
aucugaaaauguaugugua

SEQ ID NO: 2712304 - RNA, 16 nt, Human
aucugaaaauguaugu

SEQ ID NO: 2712305 - RNA, 15 nt, Human
aucucccccagcccc

SEQ ID NO: 2712306 - RNA, 14 nt, Human
aucucccccagccc

SEQ ID NO: 2712307 - RNA, 16 nt, Human
aucucccccagcccca

SEQ ID NO: 2712308 - RNA, 17 nt, Human
aucucccccagccccau

SEQ ID NO: 2712309 - RNA, 22 nt, Human
uugcaagccagauuuuccugaa

SEQ ID NO: 2712310 - RNA, 14 nt, Human
uugauuaaauucuu

SEQ ID NO: 2712311 - RNA, 12 nt, Human
aucugaaaaugu

SEQ ID NO: 2712312 - RNA, 23 nt, Human
aucugaaaauguauguguaagua

SEQ ID NO: 2712313 - RNA, 13 nt, Human
uugauuaaauucu

SEQ ID NO: 2712314 - RNA, 23 nt, Human
uugauguuuuaaggaugcuugua

SEQ ID NO: 2712315 - RNA, 13 nt, Human
uugcaucaauuuu

SEQ ID NO: 2712316 - RNA, 14 nt, Human
uugcaccacugcac

SEQ ID NO: 2712317 - RNA, 15 nt, Human
uugcaccacugcacu

SEQ ID NO: 2712318 - RNA, 16 nt, Human
uugcaccacugcacuc

SEQ ID NO: 2712319 - RNA, 18 nt, Human
uugcaccacugcacucca

SEQ ID NO: 2712320 - RNA, 16 nt, Human
uugcaauggcagccuu

SEQ ID NO: 2712321 - RNA, 17 nt, Human
uugcaauggcagccuug

SEQ ID NO: 2712322 - RNA, 19 nt, Human
uugcaauggcagccuuggc

SEQ ID NO: 2712323 - RNA, 17 nt, Human
uugaaauuguaauuaua

SEQ ID NO: 2712324 - RNA, 15 nt, Human
uugaaauuguaauua

SEQ ID NO: 2712325 - RNA, 17 nt, Human
uugaaauuguauuacaa

SEQ ID NO: 2712326 - RNA, 14 nt, Human
uugaaauuguaauu

SEQ ID NO: 2712327 - RNA, 13 nt, Human
uugaaauuguaau

SEQ ID NO: 2712328 - RNA, 16 nt, Human
auccuccucagaucuu

SEQ ID NO: 2712329 - RNA, 16 nt, Human
auccuaggcauuugcu

SEQ ID NO: 2712330 - RNA, 12 nt, Human
auccuaagcuau

SEQ ID NO: 2712331 - RNA, 20 nt, Human
uucuucugcuucagccuccc

SEQ ID NO: 2712332 - RNA, 13 nt, Human
aucccucauccuc

SEQ ID NO: 2712333 - RNA, 21 nt, Human
aucccucauccucauacccac

SEQ ID NO: 2712334 - RNA, 23 nt, Human
aucccucauccucauacccaccc

SEQ ID NO: 2712335 - RNA, 24 nt, Human
aucccauaugccugggcagaagga

SEQ ID NO: 2712336 - RNA, 14 nt, Human
aucccucauccuca

SEQ ID NO: 2712337 - RNA, 14 nt, Human
uucuucucccucag

SEQ ID NO: 2712338 - RNA, 13 nt, Human
uucuucugcuuca

SEQ ID NO: 2712339 - RNA, 15 nt, Human
uucuucugcuucagc

SEQ ID NO: 2712340 - RNA, 13 nt, Human
uucuucucccuca

SEQ ID NO: 2712341 - RNA, 11 nt, Human
uucuucucccu

SEQ ID NO: 2712342 - RNA, 12 nt, Human
uucucuaggaaa

SEQ ID NO: 2712343 - RNA, 17 nt, Human
uucucuaguuugauuaa

SEQ ID NO: 2712344 - RNA, 15 nt, Human
uucucuaguuugauu

SEQ ID NO: 2712345 - RNA, 20 nt, Human
uucucuaguuugauuaaauu

SEQ ID NO: 2712346 - RNA, 21 nt, Human
uucuccuuguguuacuaaguu

SEQ ID NO: 2712347 - RNA, 16 nt, Human
uucuggcucuuccagg

SEQ ID NO: 2712348 - RNA, 17 nt, Human
uucuggcucuuccaggc

SEQ ID NO: 2712349 - RNA, 15 nt, Human
uucuggcucuuccag

SEQ ID NO: 2712350 - RNA, 21 nt, Human
uucugccugcccaggccccug

SEQ ID NO: 2712351 - RNA, 17 nt, Human
uucugccugcccaggcc

SEQ ID NO: 2712352 - RNA, 18 nt, Human
uucugccugcccaggccc

SEQ ID NO: 2712353 - RNA, 15 nt, Human
uucugccauauucug

SEQ ID NO: 2712354 - RNA, 23 nt, Human
uucugaacuuggcgcugccccug

SEQ ID NO: 2712355 - RNA, 19 nt, Human
uucugaacuuggcgcugcc

SEQ ID NO: 2712356 - RNA, 22 nt, Human
uucugaacuuggcgcugccccu

SEQ ID NO: 2712357 - RNA, 21 nt, Human
auccaguaucuugaagacuuu

SEQ ID NO: 2712358 - RNA, 21 nt, Human
auccauuuggaaaucuuuaaa

SEQ ID NO: 2712359 - RNA, 20 nt, Human
auccauuuggaaaucuuuaa

SEQ ID NO: 2712360 - RNA, 18 nt, Human
aucccauaugccugggca

SEQ ID NO: 2712361 - RNA, 12 nt, Human
aucccagcccca

SEQ ID NO: 2712362 - RNA, 19 nt, Human
aucccaaacccuucagugc

SEQ ID NO: 2712363 - RNA, 20 nt, Human
aucccaaacccuucagugcc

SEQ ID NO: 2712364 - RNA, 18 nt, Human
auccaagcuggucccacu

SEQ ID NO: 2712365 - RNA, 21 nt, Human
auccaagcuggucccacucag

SEQ ID NO: 2712366 - RNA, 13 nt, Human
auccacccaccuc

SEQ ID NO: 2712367 - RNA, 15 nt, Human
auccacccaccucag

SEQ ID NO: 2712368 - RNA, 16 nt, Human
auccaguaucuugaag

SEQ ID NO: 2712369 - RNA, 19 nt, Human
uuccguagguuauuuucag

SEQ ID NO: 2712370 - RNA, 16 nt, Human
uuccguuaaaauacca

SEQ ID NO: 2712371 - RNA, 14 nt, Human
uuccguuaaaauac

SEQ ID NO: 2712372 - RNA, 20 nt, Human
uucccucaccuuucccaucu

SEQ ID NO: 2712373 - RNA, 15 nt, Human
uucccuauuagagaa

SEQ ID NO: 2712374 - RNA, 17 nt, Human
uuccuaauccucuagga

SEQ ID NO: 2712375 - RNA, 13 nt, Human
uuccucuuuccau

SEQ ID NO: 2712376 - RNA, 22 nt, Human
uuccucuuuccaucuacccucc

SEQ ID NO: 2712377 - RNA, 17 nt, Human
uuccucuuuccaucuac

SEQ ID NO: 2712378 - RNA, 14 nt, Human
uuccugaaccgaug

SEQ ID NO: 2712379 - RNA, 14 nt, Human
uuccugaacaggau

SEQ ID NO: 2712380 - RNA, 18 nt, Human
uuccugaagaauugaaaa

SEQ ID NO: 2712381 - RNA, 15 nt, Human
uuccugaacaggaua

SEQ ID NO: 2712382 - RNA, 21 nt, Human
aucaagaugugacauguuuua

SEQ ID NO: 2712383 - RNA, 12 nt, Human
auauuuuucaca

SEQ ID NO: 2712384 - RNA, 13 nt, Human
auauuuuucacau

SEQ ID NO: 2712385 - RNA, 14 nt, Human
auauuuuucacaua

SEQ ID NO: 2712386 - RNA, 15 nt, Human
auauuuuucacauau

SEQ ID NO: 2712387 - RNA, 17 nt, Human
auauuuuucacauaucu

SEQ ID NO: 2712388 - RNA, 11 nt, Human
uuccugugucu

SEQ ID NO: 2712389 - RNA, 14 nt, Human
aucaaugaguaaca

SEQ ID NO: 2712390 - RNA, 22 nt, Human
aucaccugucuugccuuuuuca

SEQ ID NO: 2712391 - RNA, 23 nt, Human
aucaccugucuugccuuuuucau

SEQ ID NO: 2712392 - RNA, 18 nt, Human
aucacggcucacugcagc

SEQ ID NO: 2712393 - RNA, 19 nt, Human
aucacggcucacugcagcc

SEQ ID NO: 2712394 - RNA, 13 nt, Human
aucacgccacugc

SEQ ID NO: 2712395 - RNA, 15 nt, Human
aucacggcucacugc

SEQ ID NO: 2712396 - RNA, 22 nt, Human
aucacuugucaauaaaauccau

SEQ ID NO: 2712397 - RNA, 11 nt, Human
aucagaauucu

SEQ ID NO: 2712398 - RNA, 16 nt, Human
uucuaggacugaauua

SEQ ID NO: 2712399 - RNA, 20 nt, Human
uucucacagcuccaagaauu

SEQ ID NO: 2712400 - RNA, 14 nt, Human
uucuaggacugaau

SEQ ID NO: 2712401 - RNA, 13 nt, Human
uucuaggacugaa

SEQ ID NO: 2712402 - RNA, 17 nt, Human
aucaggguuaguauugu

SEQ ID NO: 2712403 - RNA, 14 nt, Human
aucaggccaggccc

SEQ ID NO: 2712404 - RNA, 12 nt, Human
aucagaauucuc

SEQ ID NO: 2712405 - RNA, 13 nt, Human
aucagcacgauuu

SEQ ID NO: 2712406 - RNA, 15 nt, Human
aucaggccaggcccu

SEQ ID NO: 2712407 - RNA, 16 nt, Human
aucaggccaggcccuc

SEQ ID NO: 2712408 - RNA, 18 nt, Human
aucaggccaggcccucug

SEQ ID NO: 2712409 - RNA, 14 nt, Human
uucuagcauggcau

SEQ ID NO: 2712410 - RNA, 15 nt, Human
uucuagcauggcaua

SEQ ID NO: 2712411 - RNA, 18 nt, Human
uucuagcauggcauauuu

SEQ ID NO: 2712412 - RNA, 20 nt, Human
uucuagcauggcauauuuuu

SEQ ID NO: 2712413 - RNA, 21 nt, Human
uucuagcauggcauauuuuuc

SEQ ID NO: 2712414 - RNA, 17 nt, Human
uucuagcuaauguaaua

SEQ ID NO: 2712415 - RNA, 16 nt, Human
uucuagcauggcugcc

SEQ ID NO: 2712416 - RNA, 22 nt, Human
uucuagcauggcauauuuuuca

SEQ ID NO: 2712417 - RNA, 16 nt, Human
uucuaaguaaaaccac

SEQ ID NO: 2712418 - RNA, 15 nt, Human
uucuaaguaaaacca

SEQ ID NO: 2712419 - RNA, 14 nt, Human
uucuaaauuuuaua

SEQ ID NO: 2712420 - RNA, 19 nt, Human
uucuaaaggcuaccuuugu

SEQ ID NO: 2712421 - RNA, 21 nt, Human
uucuaaaggcuaccuuuguau

SEQ ID NO: 2712422 - RNA, 20 nt, Human
uucuaaaggcuaccuuugua

SEQ ID NO: 2712423 - RNA, 21 nt, Human
uucuaaaucuccaaaauaaaa

SEQ ID NO: 2712424 - RNA, 15 nt, Human
uucgcuccugugucu

SEQ ID NO: 2712425 - RNA, 19 nt, Human
uucgcuccugugucuugca

SEQ ID NO: 2712426 - RNA, 19 nt, Human
uuuguaguguuggagaaga

SEQ ID NO: 2712427 - RNA, 21 nt, Human
uuuguaguguuggagaagaac

SEQ ID NO: 2712428 - RNA, 17 nt, Human
uuugugaagcaaaauuu

SEQ ID NO: 2712429 - RNA, 19 nt, Human
uuugugcugguguaugugu

SEQ ID NO: 2712430 - RNA, 23 nt, Human
augucucuuuaaugucacaggca

SEQ ID NO: 2712431 - RNA, 16 nt, Human
augugaugagaggaaa

SEQ ID NO: 2712432 - RNA, 15 nt, Human
augugaugagaggaa

SEQ ID NO: 2712433 - RNA, 17 nt, Human
augugaugagaggaaau

SEQ ID NO: 2712434 - RNA, 19 nt, Human
augugaugagaggaaauca

SEQ ID NO: 2712435 - RNA, 23 nt, Human
augugcacaugcacgugugugca

SEQ ID NO: 2712436 - RNA, 12 nt, Human
augucaguguga

SEQ ID NO: 2712437 - RNA, 13 nt, Human
augucagugugac

SEQ ID NO: 2712438 - RNA, 22 nt, Human
auguauuacaguggggaaugaa

SEQ ID NO: 2712439 - RNA, 16 nt, Human
auguauguguaaguau

SEQ ID NO: 2712440 - RNA, 15 nt, Human
auguauguguaagua

SEQ ID NO: 2712441 - RNA, 20 nt, Human
uuuggcauaacauaaaucug

SEQ ID NO: 2712442 - RNA, 21 nt, Human
uuuggcauaacauaaaucugu

SEQ ID NO: 2712443 - RNA, 16 nt, Human
auguacuucaugcugu

SEQ ID NO: 2712444 - RNA, 22 nt, Human
uuugacagaauauguuucaaac

SEQ ID NO: 2712445 - RNA, 12 nt, Human
uuugaccucugc

SEQ ID NO: 2712446 - RNA, 14 nt, Human
uuugcaagccagau

SEQ ID NO: 2712447 - RNA, 15 nt, Human
uuugccguuauuaaa

SEQ ID NO: 2712448 - RNA, 22 nt, Human
uuugauucagacagcugccugg

SEQ ID NO: 2712449 - RNA, 13 nt, Human
uuugccucugccu

SEQ ID NO: 2712450 - RNA, 13 nt, Human
uuugauuaaauuc

SEQ ID NO: 2712451 - RNA, 22 nt, Human
uuugauguucuuucacccuuuu

SEQ ID NO: 2712452 - RNA, 23 nt, Human
uuugauuaaauucuugcaaagua

SEQ ID NO: 2712453 - RNA, 21 nt, Human
uuugauucagacagcugccug

SEQ ID NO: 2712454 - RNA, 21 nt, Human
uuugauuaaauucuugcaaag

SEQ ID NO: 2712455 - RNA, 18 nt, Human
uuugauuaaauucuugca

SEQ ID NO: 2712456 - RNA, 20 nt, Human
uuugacgccaucccagcccc

SEQ ID NO: 2712457 - RNA, 13 nt, Human
uuugacgccaucc

SEQ ID NO: 2712458 - RNA, 14 nt, Human
uuugacgccauccc

SEQ ID NO: 2712459 - RNA, 16 nt, Human
uuugacgccaucccag

SEQ ID NO: 2712460 - RNA, 19 nt, Human
uuugacgccaucccagccc

SEQ ID NO: 2712461 - RNA, 21 nt, Human
augguucccuugaugaagaag

SEQ ID NO: 2712462 - RNA, 16 nt, Human
augguuuucaaaauaa

SEQ ID NO: 2712463 - RNA, 14 nt, Human
augguuuucuugug

SEQ ID NO: 2712464 - RNA, 15 nt, Human
augguuuucaaaaua

SEQ ID NO: 2712465 - RNA, 14 nt, Human
augguuuucaaaau

SEQ ID NO: 2712466 - RNA, 23 nt, Human
auguaaaucccauuauucaaagu

SEQ ID NO: 2712467 - RNA, 22 nt, Human
auguaaaucccauuauucaaag

SEQ ID NO: 2712468 - RNA, 20 nt, Human
auguaaaucccauuauucaa

SEQ ID NO: 2712469 - RNA, 14 nt, Human
auguaaaucccauu

SEQ ID NO: 2712470 - RNA, 12 nt, Human
auggugcaauga

SEQ ID NO: 2712471 - RNA, 13 nt, Human
auggugcaaugac

SEQ ID NO: 2712472 - RNA, 15 nt, Human
auggugcaaugaccu

SEQ ID NO: 2712473 - RNA, 15 nt, Human
augggugcuuggagg

SEQ ID NO: 2712474 - RNA, 20 nt, Human
auggugagggauacccaucc

SEQ ID NO: 2712475 - RNA, 19 nt, Human
auggugcaaugaccuuuca

SEQ ID NO: 2712476 - RNA, 16 nt, Human
auggugcaaugaccuu

SEQ ID NO: 2712477 - RNA, 17 nt, Human
auggugcaaugaccuuu

SEQ ID NO: 2712478 - RNA, 12 nt, Human
augguggcuggg

SEQ ID NO: 2712479 - RNA, 13 nt, Human
augguggcugggu

SEQ ID NO: 2712480 - RNA, 15 nt, Human
augguggcuggguug

SEQ ID NO: 2712481 - RNA, 17 nt, Human
augguggcuggguugga

SEQ ID NO: 2712482 - RNA, 17 nt, Human
uuucucccagucauuua

SEQ ID NO: 2712483 - RNA, 18 nt, Human
uuucucccagucauuuaa

SEQ ID NO: 2712484 - RNA, 20 nt, Human
augggauaaaugccaucaau

SEQ ID NO: 2712485 - RNA, 16 nt, Human
augggauaaaugccau

SEQ ID NO: 2712486 - RNA, 15 nt, Human
augggauaaaugcca

SEQ ID NO: 2712487 - RNA, 15 nt, Human
augggauccuggagu

SEQ ID NO: 2712488 - RNA, 19 nt, Human
uuucugcagccacuauugu

SEQ ID NO: 2712489 - RNA, 19 nt, Human
uuucuggcuaugcauuuga

SEQ ID NO: 2712490 - RNA, 18 nt, Human
uuucuggcuaugcauuug

SEQ ID NO: 2712491 - RNA, 16 nt, Human
uuucuggcuaugcauu

SEQ ID NO: 2712492 - RNA, 15 nt, Human
uuucuggcuaugcau

SEQ ID NO: 2712493 - RNA, 21 nt, Human
uuucugcagccacuauuguua

SEQ ID NO: 2712494 - RNA, 19 nt, Human
uuucuguacuuuuuggcau

SEQ ID NO: 2712495 - RNA, 20 nt, Human
uuucuguacuuuuuggcaua

SEQ ID NO: 2712496 - RNA, 15 nt, Human
uuugaaauauugacu

SEQ ID NO: 2712497 - RNA, 20 nt, Human
augggcuggguucuacccag

SEQ ID NO: 2712498 - RNA, 18 nt, Human
augggccuccugugugug

SEQ ID NO: 2712499 - RNA, 15 nt, Human
augggggugcauuug

SEQ ID NO: 2712500 - RNA, 14 nt, Human
augggggugcauuu

SEQ ID NO: 2712501 - RNA, 24 nt, Human
auggggcugcaccggcuggccugg

SEQ ID NO: 2712502 - RNA, 12 nt, Human
auggggcugcac

SEQ ID NO: 2712503 - RNA, 18 nt, Human
uuuaaauauaugcuaagu

SEQ ID NO: 2712504 - RNA, 21 nt, Human
uuuaaauaaauaaauagcuag

SEQ ID NO: 2712505 - RNA, 19 nt, Human
uuuaauuuuuuugagacag

SEQ ID NO: 2712506 - RNA, 18 nt, Human
augcagccucacaguccu

SEQ ID NO: 2712507 - RNA, 13 nt, Human
augcaguucugaa

SEQ ID NO: 2712508 - RNA, 13 nt, Human
augcagugcuucc

SEQ ID NO: 2712509 - RNA, 23 nt, Human
augcagugguaugaucacggcuc

SEQ ID NO: 2712510 - RNA, 21 nt, Human
augccauuuaaagcuuauuaa

SEQ ID NO: 2712511 - RNA, 17 nt, Human
augccauuuaaagcuua

SEQ ID NO: 2712512 - RNA, 11 nt, Human
augcccagccc

SEQ ID NO: 2712513 - RNA, 14 nt, Human
augcccagccccuu

SEQ ID NO: 2712514 - RNA, 12 nt, Human
augcccagcccc

SEQ ID NO: 2712515 - RNA, 13 nt, Human
augcccagccccu

SEQ ID NO: 2712516 - RNA, 18 nt, Human
augauuaaguaaugauaa

SEQ ID NO: 2712517 - RNA, 14 nt, Human
augauuaaguaaug

SEQ ID NO: 2712518 - RNA, 22 nt, Human
augauccagcagauuauucacu

SEQ ID NO: 2712519 - RNA, 15 nt, Human
augaucuaggaagac

SEQ ID NO: 2712520 - RNA, 17 nt, Human
augaucuaggaagacuu

SEQ ID NO: 2712521 - RNA, 20 nt, Human
augaucuaggaagacuuugg

SEQ ID NO: 2712522 - RNA, 10 nt, Human
augauccagc

SEQ ID NO: 2712523 - RNA, 20 nt, Human
augauccagcagauuauuca

SEQ ID NO: 2712524 - RNA, 19 nt, Human
augauccagcagauuauuc

SEQ ID NO: 2712525 - RNA, 15 nt, Human
augauaacuggaaac

SEQ ID NO: 2712526 - RNA, 17 nt, Human
augauaaguaaaugcua

SEQ ID NO: 2712527 - RNA, 20 nt, Human
uuguucuugguuuguaaauu

SEQ ID NO: 2712528 - RNA, 21 nt, Human
uuguuccacaaguuaaauaaa

SEQ ID NO: 2712529 - RNA, 13 nt, Human
uuguguuacuaag

SEQ ID NO: 2712530 - RNA, 20 nt, Human
uuguguuacuaaguuuuuau

SEQ ID NO: 2712531 - RNA, 15 nt, Human
uuguguuacuaaguu

SEQ ID NO: 2712532 - RNA, 13 nt, Human
augcaccuggaau

SEQ ID NO: 2712533 - RNA, 22 nt, Human
augcaccagcccuuagcaggga

SEQ ID NO: 2712534 - RNA, 16 nt, Human
augcacuuuguucugg

SEQ ID NO: 2712535 - RNA, 17 nt, Human
augcacuuuguucuggc

SEQ ID NO: 2712536 - RNA, 19 nt, Human
augcacuuuguucuggcuc

SEQ ID NO: 2712537 - RNA, 20 nt, Human
augcacuuuguucuggcucu

SEQ ID NO: 2712538 - RNA, 13 nt, Human
uuuaaagaaugcu

SEQ ID NO: 2712539 - RNA, 23 nt, Human
uuuaaaaauacagauagauauau

SEQ ID NO: 2712540 - RNA, 14 nt, Human
auggcacuaguauu

SEQ ID NO: 2712541 - RNA, 16 nt, Human
auggcacuaguauuuc

SEQ ID NO: 2712542 - RNA, 18 nt, Human
auggcauauuuuucacau

SEQ ID NO: 2712543 - RNA, 20 nt, Human
auggcauauuuuucacauau

SEQ ID NO: 2712544 - RNA, 21 nt, Human
auggcauauuuuucacauauc

SEQ ID NO: 2712545 - RNA, 22 nt, Human
auggcauauuuuucacauaucu

SEQ ID NO: 2712546 - RNA, 23 nt, Human
auggcauauuuuucacauaucua

SEQ ID NO: 2712547 - RNA, 23 nt, Human
auggcuauaggugcuacaaaaac

SEQ ID NO: 2712548 - RNA, 18 nt, Human
auggcuaauguacugcau

SEQ ID NO: 2712549 - RNA, 14 nt, Human
augggauaaaugcc

SEQ ID NO: 2712550 - RNA, 19 nt, Human
augggagagaagagaaugc

SEQ ID NO: 2712551 - RNA, 15 nt, Human
augggagagaagaga

SEQ ID NO: 2712552 - RNA, 19 nt, Human
auggacuaacuugucuuug

SEQ ID NO: 2712553 - RNA, 11 nt, Human
auggacuuugu

SEQ ID NO: 2712554 - RNA, 12 nt, Human
auggacuuuguu

SEQ ID NO: 2712555 - RNA, 16 nt, Human
auggacuguggugacu

SEQ ID NO: 2712556 - RNA, 22 nt, Human
auggacuguggugacuuuggau

SEQ ID NO: 2712557 - RNA, 17 nt, Human
auggacuguggugacuu

SEQ ID NO: 2712558 - RNA, 14 nt, Human
uuucaaacuuugga

SEQ ID NO: 2712559 - RNA, 15 nt, Human
uuucauuauuuuauu

SEQ ID NO: 2712560 - RNA, 13 nt, Human
uuucauuauuuua

SEQ ID NO: 2712561 - RNA, 20 nt, Human
uuucauuauuuuauuaugaa

SEQ ID NO: 2712562 - RNA, 19 nt, Human
uuucauuauuuuauuauga

SEQ ID NO: 2712563 - RNA, 17 nt, Human
uuuccaugaguccccug

SEQ ID NO: 2712564 - RNA, 18 nt, Human
uuuccaugaguccccugu

SEQ ID NO: 2712565 - RNA, 16 nt, Human
uuucaaacauauauaa

SEQ ID NO: 2712566 - RNA, 16 nt, Human
uuucaaacuuuacuau

SEQ ID NO: 2712567 - RNA, 15 nt, Human
uuucaaacuuuacua

SEQ ID NO: 2712568 - RNA, 22 nt, Human
uuucaaacuuuacuauggcccu

SEQ ID NO: 2712569 - RNA, 19 nt, Human
auggaacgcguugaaauug

SEQ ID NO: 2712570 - RNA, 18 nt, Human
auggaacgcguugaaauu

SEQ ID NO: 2712571 - RNA, 17 nt, Human
augcuguucaugaaaga

SEQ ID NO: 2712572 - RNA, 22 nt, Human
augcugugcccuaaaguguauu

SEQ ID NO: 2712573 - RNA, 13 nt, Human
augcuucucacug

SEQ ID NO: 2712574 - RNA, 15 nt, Human
auggaacgcguugaa

SEQ ID NO: 2712575 - RNA, 17 nt, Human
auggaacgcguugaaau

SEQ ID NO: 2712576 - RNA, 16 nt, Human
auggaacgcguugaaa

SEQ ID NO: 2712577 - RNA, 19 nt, Human
augcuguucaugaaagauu

SEQ ID NO: 2712578 - RNA, 18 nt, Human
uuuauuacaguauaauua

SEQ ID NO: 2712579 - RNA, 14 nt, Human
uuuauuacaguaua

SEQ ID NO: 2712580 - RNA, 23 nt, Human
augcuauuucuauauuuucauuc

SEQ ID NO: 2712581 - RNA, 22 nt, Human
augcuauuucuauauuuucauu

SEQ ID NO: 2712582 - RNA, 21 nt, Human
augcuauuucuauauuuucau

SEQ ID NO: 2712583 - RNA, 18 nt, Human
augcuagguuaauuccaa

SEQ ID NO: 2712584 - RNA, 11 nt, Human
augcuauuucu

SEQ ID NO: 2712585 - RNA, 20 nt, Human
augcuauuucuauauuuuca

SEQ ID NO: 2712586 - RNA, 15 nt, Human
augcuauuucuauau

SEQ ID NO: 2712587 - RNA, 14 nt, Human
augcuauuucuaua

SEQ ID NO: 2712588 - RNA, 13 nt, Human
augcuauuucuau

SEQ ID NO: 2712589 - RNA, 16 nt, Human
uuuauauuuacuaaaa

SEQ ID NO: 2712590 - RNA, 13 nt, Human
uuuauauuuacua

SEQ ID NO: 2712591 - RNA, 21 nt, Human
uuuaucaaagggugaaaauua

SEQ ID NO: 2712592 - RNA, 19 nt, Human
auuggacaguaaaauccac

SEQ ID NO: 2712593 - RNA, 19 nt, Human
auuggagcucgugggacag

SEQ ID NO: 2712594 - RNA, 13 nt, Human
auugacuuuuuau

SEQ ID NO: 2712595 - RNA, 18 nt, Human
auugcuuuggucauauga

SEQ ID NO: 2712596 - RNA, 21 nt, Human
auugauuuccguuaaaauacc

SEQ ID NO: 2712597 - RNA, 14 nt, Human
auugcuuuggucau

SEQ ID NO: 2712598 - RNA, 15 nt, Human
auuggcuuuucugau

SEQ ID NO: 2712599 - RNA, 13 nt, Human
auuggcuuuucug

SEQ ID NO: 2712600 - RNA, 20 nt, Human
auuggcuuuucugauccagu

SEQ ID NO: 2712601 - RNA, 19 nt, Human
auuggcuuuucugauccag

SEQ ID NO: 2712602 - RNA, 16 nt, Human
auuggcuuuucugauc

SEQ ID NO: 2712603 - RNA, 13 nt, Human
auugucuagugaa

SEQ ID NO: 2712604 - RNA, 13 nt, Human
auugugggaaggg

SEQ ID NO: 2712605 - RNA, 14 nt, Human
auugugggaagggg

SEQ ID NO: 2712606 - RNA, 16 nt, Human
auuguacgaagaguau

SEQ ID NO: 2712607 - RNA, 23 nt, Human
auugucaaaguggugagaggcau

SEQ ID NO: 2712608 - RNA, 16 nt, Human
auugucaaagugguga

SEQ ID NO: 2712609 - RNA, 17 nt, Human
auuuaaaagauacaguu

SEQ ID NO: 2712610 - RNA, 16 nt, Human
auuuaaaagauacagu

SEQ ID NO: 2712611 - RNA, 14 nt, Human
auuuaaaagauaca

SEQ ID NO: 2712612 - RNA, 13 nt, Human
auuuaaaagauac

SEQ ID NO: 2712613 - RNA, 21 nt, Human
auuguuuggggaugagaaagg

SEQ ID NO: 2712614 - RNA, 14 nt, Human
auuuauuuuaauaa

SEQ ID NO: 2712615 - RNA, 14 nt, Human
auuuauuuaaauuu

SEQ ID NO: 2712616 - RNA, 12 nt, Human
auuuauuuaaau

SEQ ID NO: 2712617 - RNA, 19 nt, Human
auuucccaaagcagugcau

SEQ ID NO: 2712618 - RNA, 15 nt, Human
auuugaauuuugugu

SEQ ID NO: 2712619 - RNA, 21 nt, Human
auuugacauagucuggcugua

SEQ ID NO: 2712620 - RNA, 17 nt, Human
auuugacauagucuggc

SEQ ID NO: 2712621 - RNA, 16 nt, Human
auuugacauagucugg

SEQ ID NO: 2712622 - RNA, 15 nt, Human
auuugaaaauuuuga

SEQ ID NO: 2712623 - RNA, 16 nt, Human
auuugaaaauuuugau

SEQ ID NO: 2712624 - RNA, 20 nt, Human
auuucuuccacaagagccca

SEQ ID NO: 2712625 - RNA, 23 nt, Human
auuucuuccacaagagcccaggc

SEQ ID NO: 2712626 - RNA, 23 nt, Human
auuucuaggacugaauuaugaaa

SEQ ID NO: 2712627 - RNA, 20 nt, Human
auuucuaggacugaauuaug

SEQ ID NO: 2712628 - RNA, 18 nt, Human
auuucuaggacugaauua

SEQ ID NO: 2712629 - RNA, 17 nt, Human
auuucuaggacugaauu

SEQ ID NO: 2712630 - RNA, 19 nt, Human
auuuguaguguuggagaag

SEQ ID NO: 2712631 - RNA, 22 nt, Human
auuuguaguguuggagaagaac

SEQ ID NO: 2712632 - RNA, 14 nt, Human
auuuguauaaaaua

SEQ ID NO: 2712633 - RNA, 23 nt, Human
auuuuaaaagaaugauuaugaau

SEQ ID NO: 2712634 - RNA, 16 nt, Human
auuuuaaaagaaugau

SEQ ID NO: 2712635 - RNA, 22 nt, Human
auuuuaaaaauacagauagaua

SEQ ID NO: 2712636 - RNA, 12 nt, Human
auuuuaauaaug

SEQ ID NO: 2712637 - RNA, 15 nt, Human
auuuucuauaauuua

SEQ ID NO: 2712638 - RNA, 14 nt, Human
auuuucuauaauuu

SEQ ID NO: 2712639 - RNA, 14 nt, Human
auuuuccugaaaac

SEQ ID NO: 2712640 - RNA, 19 nt, Human
auuuucccuauuagagaag

SEQ ID NO: 2712641 - RNA, 16 nt, Human
auuuuccugccaggca

SEQ ID NO: 2712642 - RNA, 20 nt, Human
auuuugcuaaaugugaauga

SEQ ID NO: 2712643 - RNA, 21 nt, Human
auuuugcugucccuuuuccuu

SEQ ID NO: 2712644 - RNA, 19 nt, Human
auuuugauccaagcugguc

SEQ ID NO: 2712645 - RNA, 15 nt, Human
auuuugauguuuuaa

SEQ ID NO: 2712646 - RNA, 17 nt, Human
auuuugauguuuuaagg

SEQ ID NO: 2712647 - RNA, 12 nt, Human
auuuugcuuugu

SEQ ID NO: 2712648 - RNA, 20 nt, Human
auuuugcuuugugauuuuug

SEQ ID NO: 2712649 - RNA, 18 nt, Human
auuuugcuuugugauuuu

SEQ ID NO: 2712650 - RNA, 20 nt, Human
auuuuggaaaauaaauuauu

SEQ ID NO: 2712651 - RNA, 12 nt, Human
auuuuggaauuu

SEQ ID NO: 2712652 - RNA, 19 nt, Human
auuuuggaaaauaaauuau

SEQ ID NO: 2712653 - RNA, 14 nt, Human
auuuuggaaaauaa

SEQ ID NO: 2712654 - RNA, 19 nt, Human
auuuugugcccccauguaa

SEQ ID NO: 2712655 - RNA, 23 nt, Human
auuuugucauauaagauucauau

SEQ ID NO: 2712656 - RNA, 16 nt, Human
auuuuguuucagugca

SEQ ID NO: 2712657 - RNA, 11 nt, Human
auuuuguuucu

SEQ ID NO: 2712658 - RNA, 12 nt, Human
auuuuguucaua

SEQ ID NO: 2712659 - RNA, 14 nt, Human
auuuuguucauaca

SEQ ID NO: 2712660 - RNA, 15 nt, Human
auuuuguucauacau

SEQ ID NO: 2712661 - RNA, 16 nt, Human
auuuuguucauacaua

SEQ ID NO: 2712662 - RNA, 18 nt, Human
auuuuguucauacauauu

SEQ ID NO: 2712663 - RNA, 15 nt, Human
auuuuucuuauuuca

SEQ ID NO: 2712664 - RNA, 22 nt, Human
auuuuucuuagggaaggauaca

SEQ ID NO: 2712665 - RNA, 20 nt, Human
auuuuucuuauuucauuucu

SEQ ID NO: 2712666 - RNA, 19 nt, Human
auuuuucuuauuucauuuc

SEQ ID NO: 2712667 - RNA, 12 nt, Human
auuuuugacaga

SEQ ID NO: 2712668 - RNA, 13 nt, Human
auuuuugacagaa

SEQ ID NO: 2712669 - RNA, 14 nt, Human
auuuuugacagaau

SEQ ID NO: 2712670 - RNA, 15 nt, Human
auuuuugacagaaua

SEQ ID NO: 2712671 - RNA, 22 nt, Human
auuuuugacagaauauguuuca

SEQ ID NO: 2712672 - RNA, 15 nt, Human
auuuuucacauaucu

SEQ ID NO: 2712673 - RNA, 18 nt, Human
auuuuucacauaucuagu

SEQ ID NO: 2712674 - RNA, 21 nt, Human
auuuuucacauaucuaguaug

SEQ ID NO: 2712675 - RNA, 21 nt, Human
auuuuguuuuugucuuaaaaa

SEQ ID NO: 2712676 - RNA, 15 nt, Human
auuuuguuucuguac

SEQ ID NO: 2712677 - RNA, 14 nt, Human
auuuuguuucugua

SEQ ID NO: 2712678 - RNA, 21 nt, Human
auuuuucuuagggaaggauac

SEQ ID NO: 2712679 - RNA, 15 nt, Human
auuuuuccaaaauaa

SEQ ID NO: 2712680 - RNA, 22 nt, Human
auuuuugugauuuugugauuga

SEQ ID NO: 2712681 - RNA, 19 nt, Human
auuuuuguagagccagggu

SEQ ID NO: 2712682 - RNA, 12 nt, Human
auuuuuguaauu

SEQ ID NO: 2712683 - RNA, 21 nt, Human
auuuuuguagcacugacagau

SEQ ID NO: 2712684 - RNA, 20 nt, Human
auuuuuguagcacugacaga

SEQ ID NO: 2712685 - RNA, 21 nt, Human
auuuuuguuuucauuaucuca

SEQ ID NO: 2712686 - RNA, 14 nt, Human
auuuuuuaaaugca

SEQ ID NO: 2712687 - RNA, 13 nt, Human
auuuuuuaaaugc

SEQ ID NO: 2712688 - RNA, 20 nt, Human
auuuuuucucuaggaaauau

SEQ ID NO: 2712689 - RNA, 23 nt, Human
auuuuuucucuaggaaauauuua

SEQ ID NO: 2712690 - RNA, 17 nt, Human
auugaccugaggcccuu

SEQ ID NO: 2712691 - RNA, 15 nt, Human
auugaaaaaccauuu

SEQ ID NO: 2712692 - RNA, 12 nt, Human
auugaaaucuuu

SEQ ID NO: 2712693 - RNA, 20 nt, Human
auugaaaucuuuuugcuuug

SEQ ID NO: 2712694 - RNA, 17 nt, Human
auugaaaucuuuuugcu

SEQ ID NO: 2712695 - RNA, 18 nt, Human
auugaaaucuuuuugcuu

SEQ ID NO: 2712696 - RNA, 21 nt, Human
auucuuaaaguugaauuuauu

SEQ ID NO: 2712697 - RNA, 14 nt, Human
auucuuaaauaugu

SEQ ID NO: 2712698 - RNA, 20 nt, Human
auucuuaaaguugaauuuau

SEQ ID NO: 2712699 - RNA, 19 nt, Human
auucuuaaaguugaauuua

SEQ ID NO: 2712700 - RNA, 12 nt, Human
auucuguauaga

SEQ ID NO: 2712701 - RNA, 11 nt, Human
auucuguauag

SEQ ID NO: 2712702 - RNA, 19 nt, Human
auucuguuggccaguguga

SEQ ID NO: 2712703 - RNA, 21 nt, Human
auucuguuggccagugugaca

SEQ ID NO: 2712704 - RNA, 14 nt, Human
auucuguuggccag

SEQ ID NO: 2712705 - RNA, 13 nt, Human
auucuguauagau

SEQ ID NO: 2712706 - RNA, 18 nt, Human
auucugcucacauaucug

SEQ ID NO: 2712707 - RNA, 20 nt, Human
auucugccugcccaggcccc

SEQ ID NO: 2712708 - RNA, 21 nt, Human
auucugccugcccaggccccu

SEQ ID NO: 2712709 - RNA, 19 nt, Human
auucugcucacauaucugu

SEQ ID NO: 2712710 - RNA, 20 nt, Human
auucugcucacauaucuguc

SEQ ID NO: 2712711 - RNA, 21 nt, Human
auucugcucacauaucuguca

SEQ ID NO: 2712712 - RNA, 22 nt, Human
auucugcucacauaucugucau

SEQ ID NO: 2712713 - RNA, 15 nt, Human
auucuagcuaaugua

SEQ ID NO: 2712714 - RNA, 18 nt, Human
auucuagcuaauguaaua

SEQ ID NO: 2712715 - RNA, 17 nt, Human
auucucauuugucacac

SEQ ID NO: 2712716 - RNA, 11 nt, Human
auucugccugc

SEQ ID NO: 2712717 - RNA, 13 nt, Human
auucugccugccc

SEQ ID NO: 2712718 - RNA, 14 nt, Human
auucugccugccca

SEQ ID NO: 2712719 - RNA, 15 nt, Human
auucugccugcccag

SEQ ID NO: 2712720 - RNA, 16 nt, Human
auucugccugcccagg

SEQ ID NO: 2712721 - RNA, 17 nt, Human
auucugccugcccaggc

SEQ ID NO: 2712722 - RNA, 18 nt, Human
auucugccugcccaggcc

SEQ ID NO: 2712723 - RNA, 19 nt, Human
auucugccugcccaggccc

SEQ ID NO: 2712724 - RNA, 15 nt, Human
auuauauuuacaaau

SEQ ID NO: 2712725 - RNA, 19 nt, Human
auucagacagcugccuggg

SEQ ID NO: 2712726 - RNA, 20 nt, Human
auucaaacagucucaggaaa

SEQ ID NO: 2712727 - RNA, 19 nt, Human
auucaaacagucucaggaa

SEQ ID NO: 2712728 - RNA, 18 nt, Human
auucaaacagucucagga

SEQ ID NO: 2712729 - RNA, 16 nt, Human
auucaaacagucucag

SEQ ID NO: 2712730 - RNA, 21 nt, Human
auuauuuuguucauacauauu

SEQ ID NO: 2712731 - RNA, 19 nt, Human
auuauuuuguucauacaua

SEQ ID NO: 2712732 - RNA, 17 nt, Human
auuauuuuguucauaca

SEQ ID NO: 2712733 - RNA, 18 nt, Human
auuauuuuguucauacau

SEQ ID NO: 2712734 - RNA, 15 nt, Human
auuauuuuguucaua

SEQ ID NO: 2712735 - RNA, 16 nt, Human
auuauuuuguucauac

SEQ ID NO: 2712736 - RNA, 17 nt, Human
auuauucaaaguugccu

SEQ ID NO: 2712737 - RNA, 13 nt, Human
auuauucaaaguu

SEQ ID NO: 2712738 - RNA, 15 nt, Human
auuauucaaaguugc

SEQ ID NO: 2712739 - RNA, 14 nt, Human
auuauucaaaguug

SEQ ID NO: 2712740 - RNA, 21 nt, Human
auuauguuaaaacugggacag

SEQ ID NO: 2712741 - RNA, 18 nt, Human
auuaucuagauacuguau

SEQ ID NO: 2712742 - RNA, 14 nt, Human
auuaucuagauacu

SEQ ID NO: 2712743 - RNA, 15 nt, Human
auuauauuuauuacu

SEQ ID NO: 2712744 - RNA, 18 nt, Human
auuauauuuauuacugua

SEQ ID NO: 2712745 - RNA, 18 nt, Human
auucagaaggaucuucau

SEQ ID NO: 2712746 - RNA, 11 nt, Human
auucagacagc

SEQ ID NO: 2712747 - RNA, 24 nt, Human
auucagaaggaucuucaucugacu

SEQ ID NO: 2712748 - RNA, 12 nt, Human
auucagacagcu

SEQ ID NO: 2712749 - RNA, 13 nt, Human
auucagacagcug

SEQ ID NO: 2712750 - RNA, 12 nt, Human
auucaggaagcu

SEQ ID NO: 2712751 - RNA, 18 nt, Human
auucagacagcugccugg

SEQ ID NO: 2712752 - RNA, 14 nt, Human
auucagacagcugc

SEQ ID NO: 2712753 - RNA, 15 nt, Human
auucagacagcugcc

SEQ ID NO: 2712754 - RNA, 16 nt, Human
auucagacagcugccu

SEQ ID NO: 2712755 - RNA, 17 nt, Human
auucagacagcugccug

SEQ ID NO: 2712756 - RNA, 13 nt, Human
auucaggaagcuc

SEQ ID NO: 2712757 - RNA, 14 nt, Human
auucuaaauuuuau

SEQ ID NO: 2712758 - RNA, 15 nt, Human
aaaaaauauuuuccu

SEQ ID NO: 2712759 - RNA, 13 nt, Human
aaaaacacagcaa

SEQ ID NO: 2712760 - RNA, 18 nt, Human
aaaaaauuggggauucuu

SEQ ID NO: 2712761 - RNA, 18 nt, Human
aaaaacacagcaagggug

SEQ ID NO: 2712762 - RNA, 12 nt, Human
aaaaacacagca

SEQ ID NO: 2712763 - RNA, 20 nt, Human
aaaaaccaguauuguacaaa

SEQ ID NO: 2712764 - RNA, 21 nt, Human
acucuaucaaguauuauaccu

SEQ ID NO: 2712765 - RNA, 23 nt, Human
acucuaucaaguauuauaccuuu

SEQ ID NO: 2712766 - RNA, 19 nt, Human
acucugucgcccagucugg

SEQ ID NO: 2712767 - RNA, 15 nt, Human
acucuagggaaaaac

SEQ ID NO: 2712768 - RNA, 17 nt, Human
acucuagggaaaaacca

SEQ ID NO: 2712769 - RNA, 15 nt, Human
acucauauuuucaug

SEQ ID NO: 2712770 - RNA, 20 nt, Human
acuaguauuucuaugaaaua

SEQ ID NO: 2712771 - RNA, 21 nt, Human
acuauucaaacagucucagga

SEQ ID NO: 2712772 - RNA, 22 nt, Human
acuauucaggagaguagaacag

SEQ ID NO: 2712773 - RNA, 13 nt, Human
acucaaaagcugg

SEQ ID NO: 2712774 - RNA, 14 nt, Human
acucaaaucaagaa

SEQ ID NO: 2712775 - RNA, 19 nt, Human
acucaguccauagcagaga

SEQ ID NO: 2712776 - RNA, 22 nt, Human
acgcaggcccccaggugccagu

SEQ ID NO: 2712777 - RNA, 19 nt, Human
acgcaggcccccaggugcc

SEQ ID NO: 2712778 - RNA, 11 nt, Human
acgcugugcug

SEQ ID NO: 2712779 - RNA, 12 nt, Human
acgcugugcugc

SEQ ID NO: 2712780 - RNA, 14 nt, Human
acgcugugcugccc

SEQ ID NO: 2712781 - RNA, 14 nt, Human
acggaacucaaaua

SEQ ID NO: 2712782 - RNA, 13 nt, Human
acgucugacaggc

SEQ ID NO: 2712783 - RNA, 14 nt, Human
acgucugacaggca

SEQ ID NO: 2712784 - RNA, 13 nt, Human
acuaagagagaau

SEQ ID NO: 2712785 - RNA, 11 nt, Human
acgugaguccu

SEQ ID NO: 2712786 - RNA, 18 nt, Human
accuuggcugcagggagu

SEQ ID NO: 2712787 - RNA, 17 nt, Human
accuuggcugcagggag

SEQ ID NO: 2712788 - RNA, 18 nt, Human
accuuucccaucuuccaa

SEQ ID NO: 2712789 - RNA, 13 nt, Human
accuuucccaucu

SEQ ID NO: 2712790 - RNA, 15 nt, Human
accuuuaagagaaau

SEQ ID NO: 2712791 - RNA, 16 nt, Human
accugucccccugaca

SEQ ID NO: 2712792 - RNA, 12 nt, Human
accugucccccu

SEQ ID NO: 2712793 - RNA, 15 nt, Human
accugucccccugac

SEQ ID NO: 2712794 - RNA, 15 nt, Human
accucugcagcaaua

SEQ ID NO: 2712795 - RNA, 20 nt, Human
accucugcagcaauaaagca

SEQ ID NO: 2712796 - RNA, 18 nt, Human
accucugcagcaauaaag

SEQ ID NO: 2712797 - RNA, 21 nt, Human
accucugcagcaauaaagcag

SEQ ID NO: 2712798 - RNA, 14 nt, Human
agaaaauaacaaua

SEQ ID NO: 2712799 - RNA, 14 nt, Human
acuuuucuuugugg

SEQ ID NO: 2712800 - RNA, 19 nt, Human
agaaaauaguggugugauu

SEQ ID NO: 2712801 - RNA, 20 nt, Human
acuuuucauaaccuagccuu

SEQ ID NO: 2712802 - RNA, 16 nt, Human
acuuuucuuucagcca

SEQ ID NO: 2712803 - RNA, 22 nt, Human
acuuuauuuucuauaauuuaaa

SEQ ID NO: 2712804 - RNA, 16 nt, Human
acuuuguucuggcucu

SEQ ID NO: 2712805 - RNA, 17 nt, Human
acuuuguucuggcucuu

SEQ ID NO: 2712806 - RNA, 13 nt, Human
acuuuuauaaacu

SEQ ID NO: 2712807 - RNA, 20 nt, Human
acuuuguucuggcucuucca

SEQ ID NO: 2712808 - RNA, 19 nt, Human
acuuuguucuggcucuucc

SEQ ID NO: 2712809 - RNA, 20 nt, Human
acuuuauacccagaaaguua

SEQ ID NO: 2712810 - RNA, 22 nt, Human
acuuuauacccagaaaguuauu

SEQ ID NO: 2712811 - RNA, 23 nt, Human
agaaaguuauugauaaguucaua

SEQ ID NO: 2712812 - RNA, 11 nt, Human
agaaaguuauu

SEQ ID NO: 2712813 - RNA, 22 nt, Human
agaaaguacuucuccacccugc

SEQ ID NO: 2712814 - RNA, 23 nt, Human
agaaaguacuucuccacccugcu

SEQ ID NO: 2712815 - RNA, 22 nt, Human
acuguaagaaaauaucacuugu

SEQ ID NO: 2712816 - RNA, 19 nt, Human
acuguaagaaaauaucacu

SEQ ID NO: 2712817 - RNA, 13 nt, Human
acuguaagaaaau

SEQ ID NO: 2712818 - RNA, 18 nt, Human
acugguuccauggccucu

SEQ ID NO: 2712819 - RNA, 14 nt, Human
acuggugacugauu

SEQ ID NO: 2712820 - RNA, 22 nt, Human
acugugaaguuuacauuguaaa

SEQ ID NO: 2712821 - RNA, 19 nt, Human
acuggaagcacagcuucau

SEQ ID NO: 2712822 - RNA, 17 nt, Human
acuggaagcacagcuuc

SEQ ID NO: 2712823 - RNA, 15 nt, Human
acuggagaaaaugga

SEQ ID NO: 2712824 - RNA, 13 nt, Human
acugccagcaacg

SEQ ID NO: 2712825 - RNA, 21 nt, Human
acuucugucuucacaacagau

SEQ ID NO: 2712826 - RNA, 23 nt, Human
acuucacauauugauuuccguua

SEQ ID NO: 2712827 - RNA, 22 nt, Human
acuucugucuucacaacagauu

SEQ ID NO: 2712828 - RNA, 15 nt, Human
acuugggccacugug

SEQ ID NO: 2712829 - RNA, 14 nt, Human
acuugggccacugu

SEQ ID NO: 2712830 - RNA, 16 nt, Human
acuugguuuuuaaaaa

SEQ ID NO: 2712831 - RNA, 22 nt, Human
acugugcugagucugaaggcug

SEQ ID NO: 2712832 - RNA, 20 nt, Human
acugugcugagucugaaggc

SEQ ID NO: 2712833 - RNA, 16 nt, Human
acccaccucagccucc

SEQ ID NO: 2712834 - RNA, 11 nt, Human
acccccugaau

SEQ ID NO: 2712835 - RNA, 23 nt, Human
acccaagggccuggccugagcug

SEQ ID NO: 2712836 - RNA, 13 nt, Human
acccaccucagcc

SEQ ID NO: 2712837 - RNA, 14 nt, Human
acccaccucagccu

SEQ ID NO: 2712838 - RNA, 15 nt, Human
acccaccucagccuc

SEQ ID NO: 2712839 - RNA, 20 nt, Human
accauauuaccacagacaua

SEQ ID NO: 2712840 - RNA, 18 nt, Human
acccaagggccuggccug

SEQ ID NO: 2712841 - RNA, 19 nt, Human
acccaagggccuggccuga

SEQ ID NO: 2712842 - RNA, 22 nt, Human
acccaagggccuggccugagcu

SEQ ID NO: 2712843 - RNA, 16 nt, Human
accauauuaccacaga

SEQ ID NO: 2712844 - RNA, 14 nt, Human
accauauuaccaca

SEQ ID NO: 2712845 - RNA, 16 nt, Human
accccuccaugugggc

SEQ ID NO: 2712846 - RNA, 19 nt, Human
accccuccaugugggcuag

SEQ ID NO: 2712847 - RNA, 16 nt, Human
acaugugcacaugcac

SEQ ID NO: 2712848 - RNA, 18 nt, Human
acaugugcacaugcacgu

SEQ ID NO: 2712849 - RNA, 19 nt, Human
acaugaucuucuuuauaau

SEQ ID NO: 2712850 - RNA, 18 nt, Human
acaucagcacgauuucug

SEQ ID NO: 2712851 - RNA, 17 nt, Human
acaucagcacgauuucu

SEQ ID NO: 2712852 - RNA, 15 nt, Human
acaucagcacgauuu

SEQ ID NO: 2712853 - RNA, 19 nt, Human
acaggguuuugccauguug

SEQ ID NO: 2712854 - RNA, 19 nt, Human
acaggcaaugcuggcuguu

SEQ ID NO: 2712855 - RNA, 23 nt, Human
acaggcaaugcuggcuguuggcu

SEQ ID NO: 2712856 - RNA, 21 nt, Human
acauaaugcgugcauaccacu

SEQ ID NO: 2712857 - RNA, 22 nt, Human
acauaaugcgugcauaccacuu

SEQ ID NO: 2712858 - RNA, 23 nt, Human
acauaaugcgugcauaccacuuu

SEQ ID NO: 2712859 - RNA, 15 nt, Human
acauuuauucugcuc

SEQ ID NO: 2712860 - RNA, 12 nt, Human
accaagcccagu

SEQ ID NO: 2712861 - RNA, 13 nt, Human
accagcagaaaug

SEQ ID NO: 2712862 - RNA, 17 nt, Human
accagccaguaaauggg

SEQ ID NO: 2712863 - RNA, 19 nt, Human
accagagcugccaccugcc

SEQ ID NO: 2712864 - RNA, 14 nt, Human
acauuuauucugcu

SEQ ID NO: 2712865 - RNA, 21 nt, Human
acagcaguugaaaagacucca

SEQ ID NO: 2712866 - RNA, 19 nt, Human
acagagugagacucugucu

SEQ ID NO: 2712867 - RNA, 23 nt, Human
acagcaguugaaaagacuccaaa

SEQ ID NO: 2712868 - RNA, 22 nt, Human
acagcaguugaaaagacuccaa

SEQ ID NO: 2712869 - RNA, 23 nt, Human
acagagucucacuguugcccagg

SEQ ID NO: 2712870 - RNA, 14 nt, Human
acagaggggguggc

SEQ ID NO: 2712871 - RNA, 15 nt, Human
acagagugagacucu

SEQ ID NO: 2712872 - RNA, 13 nt, Human
acagacaaagcgu

SEQ ID NO: 2712873 - RNA, 11 nt, Human
acagacacagg

SEQ ID NO: 2712874 - RNA, 15 nt, Human
acacuguacugcaau

SEQ ID NO: 2712875 - RNA, 19 nt, Human
acagaggcagccccauucu

SEQ ID NO: 2712876 - RNA, 13 nt, Human
acagacacaggcc

SEQ ID NO: 2712877 - RNA, 14 nt, Human
acagacacaggccc

SEQ ID NO: 2712878 - RNA, 14 nt, Human
acagaggcagcccc

SEQ ID NO: 2712879 - RNA, 15 nt, Human
acagaggcagcccca

SEQ ID NO: 2712880 - RNA, 15 nt, Human
acacugcauguuugu

SEQ ID NO: 2712881 - RNA, 14 nt, Human
acacugcauguuug

SEQ ID NO: 2712882 - RNA, 14 nt, Human
acaggauuauugga

SEQ ID NO: 2712883 - RNA, 18 nt, Human
acaggcaaugcuggcugu

SEQ ID NO: 2712884 - RNA, 12 nt, Human
acaggcaagcac

SEQ ID NO: 2712885 - RNA, 16 nt, Human
acagcucuucuccagg

SEQ ID NO: 2712886 - RNA, 17 nt, Human
acagcucuucuccaggc

SEQ ID NO: 2712887 - RNA, 15 nt, Human
acaggaucagucuga

SEQ ID NO: 2712888 - RNA, 18 nt, Human
acagccacggccaggcca

SEQ ID NO: 2712889 - RNA, 15 nt, Human
acagccacggccagg

SEQ ID NO: 2712890 - RNA, 16 nt, Human
acagccacggccaggc

SEQ ID NO: 2712891 - RNA, 17 nt, Human
acagccacggccaggcc

SEQ ID NO: 2712892 - RNA, 21 nt, Human
acacgagcaggcuacugucag

SEQ ID NO: 2712893 - RNA, 15 nt, Human
acacgcgugcacaca

SEQ ID NO: 2712894 - RNA, 17 nt, Human
acacgcgugcacacacc

SEQ ID NO: 2712895 - RNA, 19 nt, Human
acacgagcaggcuacuguc

SEQ ID NO: 2712896 - RNA, 14 nt, Human
acacgagcaggcua

SEQ ID NO: 2712897 - RNA, 21 nt, Human
acacauuuuauuuuauuaugc

SEQ ID NO: 2712898 - RNA, 22 nt, Human
acacauuuuauuuuauuaugca

SEQ ID NO: 2712899 - RNA, 11 nt, Human
acacagcucuu

SEQ ID NO: 2712900 - RNA, 13 nt, Human
acacagcucuucu

SEQ ID NO: 2712901 - RNA, 12 nt, Human
acacauuuuucu

SEQ ID NO: 2712902 - RNA, 22 nt, Human
acacauuuuuuaaaugcaccug

SEQ ID NO: 2712903 - RNA, 20 nt, Human
acacauuuuuuaaaugcacc

SEQ ID NO: 2712904 - RNA, 20 nt, Human
acacagcucuguccugggag

SEQ ID NO: 2712905 - RNA, 14 nt, Human
acacagcucugucc

SEQ ID NO: 2712906 - RNA, 19 nt, Human
acacagaggcugccucucc

SEQ ID NO: 2712907 - RNA, 13 nt, Human
aauuuuguuucug

SEQ ID NO: 2712908 - RNA, 20 nt, Human
acaaggcaaggcugucaauu

SEQ ID NO: 2712909 - RNA, 22 nt, Human
acaaaauguaggguuauaauaa

SEQ ID NO: 2712910 - RNA, 14 nt, Human
aauuuuguuucugu

SEQ ID NO: 2712911 - RNA, 17 nt, Human
acaaggauugcuacugu

SEQ ID NO: 2712912 - RNA, 12 nt, Human
acaaggcaaggc

SEQ ID NO: 2712913 - RNA, 14 nt, Human
acaaggcaaggcug

SEQ ID NO: 2712914 - RNA, 15 nt, Human
aaaggcuccaggagc

SEQ ID NO: 2712915 - RNA, 16 nt, Human
aaaggcuccaggagca

SEQ ID NO: 2712916 - RNA, 16 nt, Human
aaagccuccuccagcc

SEQ ID NO: 2712917 - RNA, 19 nt, Human
aaaggcuccaggagcagcc

SEQ ID NO: 2712918 - RNA, 20 nt, Human
aaaggcuccaggagcagcca

SEQ ID NO: 2712919 - RNA, 13 nt, Human
aaaguggaaaaau

SEQ ID NO: 2712920 - RNA, 10 nt, Human
aaauaaauaa

SEQ ID NO: 2712921 - RNA, 19 nt, Human
aaauaaaacuuuuuaaaau

SEQ ID NO: 2712922 - RNA, 16 nt, Human
aaauaaaacuuuuuaa

SEQ ID NO: 2712923 - RNA, 13 nt, Human
aaauaaaacuuuu

SEQ ID NO: 2712924 - RNA, 15 nt, Human
aaauauuuauuuuaa

SEQ ID NO: 2712925 - RNA, 13 nt, Human
aaauauuuauuuu

SEQ ID NO: 2712926 - RNA, 20 nt, Human
aaauauuuauuuuaauaaug

SEQ ID NO: 2712927 - RNA, 14 nt, Human
aaaucaaauaugca

SEQ ID NO: 2712928 - RNA, 12 nt, Human
aaaucaaauaug

SEQ ID NO: 2712929 - RNA, 15 nt, Human
aaaucaaauaugcaa

SEQ ID NO: 2712930 - RNA, 18 nt, Human
aaaucugugaacuugaaa

SEQ ID NO: 2712931 - RNA, 16 nt, Human
aaaucugugaacuuga

SEQ ID NO: 2712932 - RNA, 15 nt, Human
aaaucugugaacuug

SEQ ID NO: 2712933 - RNA, 19 nt, Human
aaauaguggugugauuugg

SEQ ID NO: 2712934 - RNA, 20 nt, Human
aaauagcuuuuuucucugau

SEQ ID NO: 2712935 - RNA, 17 nt, Human
aaauagcuuuuuucucu

SEQ ID NO: 2712936 - RNA, 24 nt, Human
aaauagcucaggugucccugcacu

SEQ ID NO: 2712937 - RNA, 18 nt, Human
aaauagcuagacugguga

SEQ ID NO: 2712938 - RNA, 15 nt, Human
aaagaaauguaaggg

SEQ ID NO: 2712939 - RNA, 14 nt, Human
aaagaguaggaaga

SEQ ID NO: 2712940 - RNA, 23 nt, Human
aaacugagaugugaacacaucag

SEQ ID NO: 2712941 - RNA, 21 nt, Human
aaacugagaugugaacacauc

SEQ ID NO: 2712942 - RNA, 16 nt, Human
aaagauauuuugcuuu

SEQ ID NO: 2712943 - RNA, 12 nt, Human
aaagauauuuug

SEQ ID NO: 2712944 - RNA, 17 nt, Human
aaagauauuuugcuuug

SEQ ID NO: 2712945 - RNA, 18 nt, Human
aaacucuccucugcugcu

SEQ ID NO: 2712946 - RNA, 20 nt, Human
aaaccaugggauaaaugcca

SEQ ID NO: 2712947 - RNA, 18 nt, Human
aaaccaucauugaaaucu

SEQ ID NO: 2712948 - RNA, 15 nt, Human
aaaccaugggauaaa

SEQ ID NO: 2712949 - RNA, 16 nt, Human
aaaaucucaauauuuc

SEQ ID NO: 2712950 - RNA, 22 nt, Human
aaaaucucaaauuucuaaaucu

SEQ ID NO: 2712951 - RNA, 19 nt, Human
aaaaucucaaauuucuaaa

SEQ ID NO: 2712952 - RNA, 21 nt, Human
aaaauugauguguuuauuuau

SEQ ID NO: 2712953 - RNA, 12 nt, Human
aaaauugaugug

SEQ ID NO: 2712954 - RNA, 14 nt, Human
aaaauugauguguu

SEQ ID NO: 2712955 - RNA, 16 nt, Human
aaacacuguucucugc

SEQ ID NO: 2712956 - RNA, 24 nt, Human
aaacacucaguuguucaauaauaa

SEQ ID NO: 2712957 - RNA, 22 nt, Human
aaaaucccuuaccucggugccu

SEQ ID NO: 2712958 - RNA, 17 nt, Human
aaaaucaguuguacagu

SEQ ID NO: 2712959 - RNA, 17 nt, Human
aaaauaaaacuuuuuaa

SEQ ID NO: 2712960 - RNA, 13 nt, Human
aaaaguugaauuu

SEQ ID NO: 2712961 - RNA, 16 nt, Human
aaaaagaaacauuugg

SEQ ID NO: 2712962 - RNA, 15 nt, Human
aaaaagaaaggaggg

SEQ ID NO: 2712963 - RNA, 22 nt, Human
aacuuuauacccagaaaguuau

SEQ ID NO: 2712964 - RNA, 23 nt, Human
aacuuuauacccagaaaguuauu

SEQ ID NO: 2712965 - RNA, 20 nt, Human
aacugagaugugaacacauc

SEQ ID NO: 2712966 - RNA, 19 nt, Human
aacugacucuuaagaagac

SEQ ID NO: 2712967 - RNA, 20 nt, Human
aacugacucuuaagaagacu

SEQ ID NO: 2712968 - RNA, 15 nt, Human
aacugacucuuaaga

SEQ ID NO: 2712969 - RNA, 18 nt, Human
aacugacucuuaagaaga

SEQ ID NO: 2712970 - RNA, 19 nt, Human
aacuuaaauaaugugaaac

SEQ ID NO: 2712971 - RNA, 14 nt, Human
aacugauaaagaug

SEQ ID NO: 2712972 - RNA, 18 nt, Human
aacuuaaucuaaauggaa

SEQ ID NO: 2712973 - RNA, 16 nt, Human
aacuuaaucuaaaugg

SEQ ID NO: 2712974 - RNA, 15 nt, Human
aacuuaaucuaaaug

SEQ ID NO: 2712975 - RNA, 17 nt, Human
aacggaugauuucuaug

SEQ ID NO: 2712976 - RNA, 16 nt, Human
aacggaugauuucuau

SEQ ID NO: 2712977 - RNA, 15 nt, Human
aacggaugauuucua

SEQ ID NO: 2712978 - RNA, 14 nt, Human
aacggaugauuucu

SEQ ID NO: 2712979 - RNA, 17 nt, Human
aaccuagggugauauua

SEQ ID NO: 2712980 - RNA, 21 nt, Human
aaccgaacugauguaaguaaa

SEQ ID NO: 2712981 - RNA, 22 nt, Human
aaccacuggaaaguuuaugguu

SEQ ID NO: 2712982 - RNA, 15 nt, Human
aaccacuucagcuga

SEQ ID NO: 2712983 - RNA, 13 nt, Human
aaccacgcuggac

SEQ ID NO: 2712984 - RNA, 21 nt, Human
aacagcuggugcccugcuuuc

SEQ ID NO: 2712985 - RNA, 20 nt, Human
aacagcuggugcccugcuuu

SEQ ID NO: 2712986 - RNA, 19 nt, Human
aacagcuggugcccugcuu

SEQ ID NO: 2712987 - RNA, 16 nt, Human
aacacaucagcuugcc

SEQ ID NO: 2712988 - RNA, 22 nt, Human
aaauguuguucucuucuuuaaa

SEQ ID NO: 2712989 - RNA, 17 nt, Human
aaaucuuauaauuuaaa

SEQ ID NO: 2712990 - RNA, 23 nt, Human
aaaugccuuacccucauguucuu

SEQ ID NO: 2712991 - RNA, 13 nt, Human
aaauucuuucauu

SEQ ID NO: 2712992 - RNA, 21 nt, Human
aaauucuugcaaaguaucccu

SEQ ID NO: 2712993 - RNA, 18 nt, Human
aaauucuugcaaaguauc

SEQ ID NO: 2712994 - RNA, 17 nt, Human
aagggaaacugccagca

SEQ ID NO: 2712995 - RNA, 16 nt, Human
aagggaaacugccagc

SEQ ID NO: 2712996 - RNA, 23 nt, Human
aagggaaacugccagcaacgcag

SEQ ID NO: 2712997 - RNA, 19 nt, Human
aaggucauuuuuuuuaaga

SEQ ID NO: 2712998 - RNA, 18 nt, Human
aaggucauuuuuuuuaag

SEQ ID NO: 2712999 - RNA, 21 nt, Human
aaguagggacuucugucuuca

SEQ ID NO: 2713000 - RNA, 21 nt, Human
aaguagaagucuuagauguau

SEQ ID NO: 2713001 - RNA, 17 nt, Human
aaguaucccuacuguaa

SEQ ID NO: 2713002 - RNA, 23 nt, Human
aaguaucccuacuguaauuugug

SEQ ID NO: 2713003 - RNA, 18 nt, Human
aaguaucccuacuguaau

SEQ ID NO: 2713004 - RNA, 20 nt, Human
aaguagaagucuuagaugua

SEQ ID NO: 2713005 - RNA, 19 nt, Human
aaguagaagucuuagaugu

SEQ ID NO: 2713006 - RNA, 17 nt, Human
aaguccaagcauaccaa

SEQ ID NO: 2713007 - RNA, 18 nt, Human
aaguccaagcauuuagau

SEQ ID NO: 2713008 - RNA, 18 nt, Human
aaguccucuuuucugaga

SEQ ID NO: 2713009 - RNA, 22 nt, Human
aaguccucuuuucugagaggac

SEQ ID NO: 2713010 - RNA, 19 nt, Human
aaguggaaaaauagccugc

SEQ ID NO: 2713011 - RNA, 21 nt, Human
aaguggaaaaauagccugccu

SEQ ID NO: 2713012 - RNA, 12 nt, Human
aaguugccuaaa

SEQ ID NO: 2713013 - RNA, 12 nt, Human
aaguugaauuuu

SEQ ID NO: 2713014 - RNA, 20 nt, Human
aaggcagcucuaaaugucaa

SEQ ID NO: 2713015 - RNA, 15 nt, Human
aaggauguucuagca

SEQ ID NO: 2713016 - RNA, 15 nt, Human
aaggauugcuacugu

SEQ ID NO: 2713017 - RNA, 15 nt, Human
aagcugggcagguug

SEQ ID NO: 2713018 - RNA, 18 nt, Human
aagcuggucccacucagu

SEQ ID NO: 2713019 - RNA, 21 nt, Human
aagcuggucccacucagucca

SEQ ID NO: 2713020 - RNA, 21 nt, Human
aaggacuucuuuaauuuugga

SEQ ID NO: 2713021 - RNA, 20 nt, Human
aaggacuucuuuaauuuugg

SEQ ID NO: 2713022 - RNA, 15 nt, Human
aaggacuucuuuaau

SEQ ID NO: 2713023 - RNA, 14 nt, Human
aaggacuucuuuaa

SEQ ID NO: 2713024 - RNA, 13 nt, Human
aaggacacuagaa

SEQ ID NO: 2713025 - RNA, 21 nt, Human
aagcgauucuucugcuucagc

SEQ ID NO: 2713026 - RNA, 17 nt, Human
aagcgauucuucugcuu

SEQ ID NO: 2713027 - RNA, 20 nt, Human
aagccagcaggcucucaggc

SEQ ID NO: 2713028 - RNA, 23 nt, Human
aagccagcaggcucucaggccag

SEQ ID NO: 2713029 - RNA, 14 nt, Human
aagcagcguuucua

SEQ ID NO: 2713030 - RNA, 20 nt, Human
aagcagcguuucuaugacac

SEQ ID NO: 2713031 - RNA, 17 nt, Human
aagcagcguuucuauga

SEQ ID NO: 2713032 - RNA, 20 nt, Human
aagcagauggaaugcugugu

SEQ ID NO: 2713033 - RNA, 17 nt, Human
aagcagauggaaugcug

SEQ ID NO: 2713034 - RNA, 19 nt, Human
aagcagauggaaugcugug

SEQ ID NO: 2713035 - RNA, 22 nt, Human
aagcagcguuucuaugacacau

SEQ ID NO: 2713036 - RNA, 21 nt, Human
aagcagcguuucuaugacaca

SEQ ID NO: 2713037 - RNA, 19 nt, Human
aagccagcaggcucucagg

SEQ ID NO: 2713038 - RNA, 13 nt, Human
aagauacugaaau

SEQ ID NO: 2713039 - RNA, 13 nt, Human
aagauaaaugugc

SEQ ID NO: 2713040 - RNA, 23 nt, Human
aagauacaguuacucagaauucu

SEQ ID NO: 2713041 - RNA, 12 nt, Human
aagauaaaugug

SEQ ID NO: 2713042 - RNA, 15 nt, Human
aaugauuaugaauua

SEQ ID NO: 2713043 - RNA, 21 nt, Human
aaugauuaugaauuacauuug

SEQ ID NO: 2713044 - RNA, 16 nt, Human
aaugauuaauuaaaac

SEQ ID NO: 2713045 - RNA, 19 nt, Human
aauccagacccggcugcgu

SEQ ID NO: 2713046 - RNA, 17 nt, Human
aauccagacccggcugc

SEQ ID NO: 2713047 - RNA, 15 nt, Human
aaucucaaauuucua

SEQ ID NO: 2713048 - RNA, 16 nt, Human
aaucucaaauuucuaa

SEQ ID NO: 2713049 - RNA, 18 nt, Human
aaucucaaauuucuaaau

SEQ ID NO: 2713050 - RNA, 17 nt, Human
aaucucaaauuucuaaa

SEQ ID NO: 2713051 - RNA, 20 nt, Human
aauacucuacccucuuagaa

SEQ ID NO: 2713052 - RNA, 22 nt, Human
aauacucuacccucuuagaaaa

SEQ ID NO: 2713053 - RNA, 13 nt, Human
aauacucuuauau

SEQ ID NO: 2713054 - RNA, 19 nt, Human
aaguugccuaaauccauuu

SEQ ID NO: 2713055 - RNA, 18 nt, Human
aaguugccuaaauccauu

SEQ ID NO: 2713056 - RNA, 17 nt, Human
aaguugccuaaauccau

SEQ ID NO: 2713057 - RNA, 16 nt, Human
aaguugccuaaaucca

SEQ ID NO: 2713058 - RNA, 15 nt, Human
aaguugccuaaaucc

SEQ ID NO: 2713059 - RNA, 15 nt, Human
aaucaccaaaggcuc

SEQ ID NO: 2713060 - RNA, 14 nt, Human
aaucaccgaaaacg

SEQ ID NO: 2713061 - RNA, 15 nt, Human
aaucaccgaaaacgu

SEQ ID NO: 2713062 - RNA, 13 nt, Human
aauagacaauuua

SEQ ID NO: 2713063 - RNA, 16 nt, Human
aauauguuucaaacuu

SEQ ID NO: 2713064 - RNA, 17 nt, Human
aauauguuucaaacuuu

SEQ ID NO: 2713065 - RNA, 13 nt, Human
aauauguuucaaa

SEQ ID NO: 2713066 - RNA, 15 nt, Human
aauauguuucaaacu

SEQ ID NO: 2713067 - RNA, 23 nt, Human
aauguuucaaacauauauaacaa

SEQ ID NO: 2713068 - RNA, 15 nt, Human
aauguuugccucugc

SEQ ID NO: 2713069 - RNA, 16 nt, Human
aauguuugccucugcc

SEQ ID NO: 2713070 - RNA, 15 nt, Human
aaugugaaaagaaaa

SEQ ID NO: 2713071 - RNA, 21 nt, Human
aaugcuagguuaauuccaauu

SEQ ID NO: 2713072 - RNA, 18 nt, Human
aaugcgugcauaccacuu

SEQ ID NO: 2713073 - RNA, 19 nt, Human
aaugcgugcauaccacuuu

SEQ ID NO: 2713074 - RNA, 18 nt, Human
aaugcuagguuaauucca

SEQ ID NO: 2713075 - RNA, 19 nt, Human
aaugcuagguuaauuccaa

SEQ ID NO: 2713076 - RNA, 23 nt, Human
aaugccuuacccucauguucuua

SEQ ID NO: 2713077 - RNA, 16 nt, Human
agcaguugaaaagacu

SEQ ID NO: 2713078 - RNA, 13 nt, Human
agcaguugaaaag

SEQ ID NO: 2713079 - RNA, 23 nt, Human
agcaguucagagcugcccucucc

SEQ ID NO: 2713080 - RNA, 20 nt, Human
agcaguucagagcugcccuc

SEQ ID NO: 2713081 - RNA, 18 nt, Human
agcauccuggcacccggc

SEQ ID NO: 2713082 - RNA, 22 nt, Human
agcauccuggcacccggccccu

SEQ ID NO: 2713083 - RNA, 23 nt, Human
agcauccuggcacccggccccug

SEQ ID NO: 2713084 - RNA, 20 nt, Human
agcaugccuggauggggcug

SEQ ID NO: 2713085 - RNA, 23 nt, Human
agcaugccuggauggggcugcac

SEQ ID NO: 2713086 - RNA, 23 nt, Human
agccaagugugguagagugugcc

SEQ ID NO: 2713087 - RNA, 16 nt, Human
agcacugacuucuaag

SEQ ID NO: 2713088 - RNA, 18 nt, Human
agcacugacagauuucca

SEQ ID NO: 2713089 - RNA, 13 nt, Human
agcacugacagau

SEQ ID NO: 2713090 - RNA, 14 nt, Human
agcacugacagauu

SEQ ID NO: 2713091 - RNA, 20 nt, Human
agcacagacccugcccugug

SEQ ID NO: 2713092 - RNA, 18 nt, Human
agcacagacccugcccug

SEQ ID NO: 2713093 - RNA, 19 nt, Human
agcacagacccugcccugu

SEQ ID NO: 2713094 - RNA, 23 nt, Human
agcacacuugacaucaacugcau

SEQ ID NO: 2713095 - RNA, 17 nt, Human
agcacagacccugcccu

SEQ ID NO: 2713096 - RNA, 13 nt, Human
agcagcguuucua

SEQ ID NO: 2713097 - RNA, 18 nt, Human
agcagugcaugcuguccc

SEQ ID NO: 2713098 - RNA, 19 nt, Human
agcagugcaugcugucccu

SEQ ID NO: 2713099 - RNA, 20 nt, Human
agcagugcaugcugucccuu

SEQ ID NO: 2713100 - RNA, 13 nt, Human
agccgcuggggcc

SEQ ID NO: 2713101 - RNA, 21 nt, Human
agccgccaugcuccuggccca

SEQ ID NO: 2713102 - RNA, 22 nt, Human
agccucccacgacugcccggca

SEQ ID NO: 2713103 - RNA, 21 nt, Human
agccucccaaagugcugggau

SEQ ID NO: 2713104 - RNA, 14 nt, Human
agccuccuccagcc

SEQ ID NO: 2713105 - RNA, 20 nt, Human
agccucccgaguagcuggga

SEQ ID NO: 2713106 - RNA, 18 nt, Human
agccucccgaguagcugg

SEQ ID NO: 2713107 - RNA, 19 nt, Human
agccucccgaguagcuggg

SEQ ID NO: 2713108 - RNA, 13 nt, Human
agccccagugccc

SEQ ID NO: 2713109 - RNA, 14 nt, Human
agccccagugccca

SEQ ID NO: 2713110 - RNA, 15 nt, Human
agccccagugcccac

SEQ ID NO: 2713111 - RNA, 13 nt, Human
agccccauucugc

SEQ ID NO: 2713112 - RNA, 16 nt, Human
agccccauucugccug

SEQ ID NO: 2713113 - RNA, 18 nt, Human
agccagcaggcucucagg

SEQ ID NO: 2713114 - RNA, 19 nt, Human
agccagcaggcucucaggc

SEQ ID NO: 2713115 - RNA, 17 nt, Human
agccagcaggcucucag

SEQ ID NO: 2713116 - RNA, 20 nt, Human
agccagcaggcucucaggcc

SEQ ID NO: 2713117 - RNA, 18 nt, Human
agacggagucccaccuug

SEQ ID NO: 2713118 - RNA, 22 nt, Human
agacgcugugcugcccugccca

SEQ ID NO: 2713119 - RNA, 12 nt, Human
agacagcugccu

SEQ ID NO: 2713120 - RNA, 11 nt, Human
agacagcucuu

SEQ ID NO: 2713121 - RNA, 12 nt, Human
agacagcucuua

SEQ ID NO: 2713122 - RNA, 21 nt, Human
agacgcugugcugcccugccc

SEQ ID NO: 2713123 - RNA, 14 nt, Human
agacagcccgggcu

SEQ ID NO: 2713124 - RNA, 15 nt, Human
agacagcccgggcuc

SEQ ID NO: 2713125 - RNA, 23 nt, Human
agacagagucucacuguugccca

SEQ ID NO: 2713126 - RNA, 21 nt, Human
agacugcauuauauuuauuac

SEQ ID NO: 2713127 - RNA, 19 nt, Human
agacuggaagcacagcuuc

SEQ ID NO: 2713128 - RNA, 17 nt, Human
agacuggaagcacagcu

SEQ ID NO: 2713129 - RNA, 16 nt, Human
agacuggaagcacagc

SEQ ID NO: 2713130 - RNA, 17 nt, Human
agagaacuuccagaucc

SEQ ID NO: 2713131 - RNA, 19 nt, Human
agagcccaccuuggcucaa

SEQ ID NO: 2713132 - RNA, 13 nt, Human
agagcccacgccc

SEQ ID NO: 2713133 - RNA, 16 nt, Human
agagcccacgccccca

SEQ ID NO: 2713134 - RNA, 22 nt, Human
agagaggguggugaccucugcc

SEQ ID NO: 2713135 - RNA, 20 nt, Human
agagaggguggugaccucug

SEQ ID NO: 2713136 - RNA, 21 nt, Human
agagaggguggugaccucugc

SEQ ID NO: 2713137 - RNA, 19 nt, Human
agauauaugcucugcaugu

SEQ ID NO: 2713138 - RNA, 14 nt, Human
agaucuucuguggg

SEQ ID NO: 2713139 - RNA, 11 nt, Human
agagugggagc

SEQ ID NO: 2713140 - RNA, 19 nt, Human
agaguggggauaugauuua

SEQ ID NO: 2713141 - RNA, 14 nt, Human
agagugugccugaa

SEQ ID NO: 2713142 - RNA, 13 nt, Human
agaguguugaaac

SEQ ID NO: 2713143 - RNA, 19 nt, Human
agaggguggugaccucugc

SEQ ID NO: 2713144 - RNA, 20 nt, Human
agaggguggugaccucugcc

SEQ ID NO: 2713145 - RNA, 22 nt, Human
agaggguggugaccucugccug

SEQ ID NO: 2713146 - RNA, 12 nt, Human
agagggcacaga

SEQ ID NO: 2713147 - RNA, 16 nt, Human
agaggaaggagaggag

SEQ ID NO: 2713148 - RNA, 15 nt, Human
agaggagagaggacc

SEQ ID NO: 2713149 - RNA, 16 nt, Human
agaggagagaggaccc

SEQ ID NO: 2713150 - RNA, 15 nt, Human
agagcccaggccucc

SEQ ID NO: 2713151 - RNA, 13 nt, Human
agagcccaggccu

SEQ ID NO: 2713152 - RNA, 14 nt, Human
agagcccaggccuc

SEQ ID NO: 2713153 - RNA, 23 nt, Human
aggaugguucccuugaugaagaa

SEQ ID NO: 2713154 - RNA, 15 nt, Human
aggauguucugggac

SEQ ID NO: 2713155 - RNA, 16 nt, Human
aggauguucugggaca

SEQ ID NO: 2713156 - RNA, 22 nt, Human
aggauguucuagcauggcugcc

SEQ ID NO: 2713157 - RNA, 18 nt, Human
aggauguucugggacaca

SEQ ID NO: 2713158 - RNA, 14 nt, Human
aggauuauuggaaa

SEQ ID NO: 2713159 - RNA, 13 nt, Human
aggaccucaggug

SEQ ID NO: 2713160 - RNA, 23 nt, Human
aggaugcuuguacauaaugcgug

SEQ ID NO: 2713161 - RNA, 21 nt, Human
aggaugcuuguacauaaugcg

SEQ ID NO: 2713162 - RNA, 20 nt, Human
aggaauccagacccggcugc

SEQ ID NO: 2713163 - RNA, 17 nt, Human
aggaauccagacccggc

SEQ ID NO: 2713164 - RNA, 21 nt, Human
aggaaucaugugccaagcaga

SEQ ID NO: 2713165 - RNA, 22 nt, Human
agcuccccucggagaagagcug

SEQ ID NO: 2713166 - RNA, 23 nt, Human
agcuccgcuuucuacccagcgag

SEQ ID NO: 2713167 - RNA, 20 nt, Human
agcuccgcuuucuacccagc

SEQ ID NO: 2713168 - RNA, 21 nt, Human
agcuccgcuuucuacccagcg

SEQ ID NO: 2713169 - RNA, 12 nt, Human
agcuccuucugu

SEQ ID NO: 2713170 - RNA, 13 nt, Human
agcuccuucuguc

SEQ ID NO: 2713171 - RNA, 21 nt, Human
agcugcgguccacccaggagc

SEQ ID NO: 2713172 - RNA, 23 nt, Human
agcugcgguccacccaggagccc

SEQ ID NO: 2713173 - RNA, 18 nt, Human
aggugcuacaaaaacaca

SEQ ID NO: 2713174 - RNA, 23 nt, Human
aggucuguucuuuccaaaguaca

SEQ ID NO: 2713175 - RNA, 22 nt, Human
aggucuguucuuuccaaaguac

SEQ ID NO: 2713176 - RNA, 22 nt, Human
aggugcuacaaaaacacagcaa

SEQ ID NO: 2713177 - RNA, 21 nt, Human
aggugcuacaaaaacacagca

SEQ ID NO: 2713178 - RNA, 20 nt, Human
aggugcuacaaaaacacagc

SEQ ID NO: 2713179 - RNA, 19 nt, Human
aggugcuacaaaaacacag

SEQ ID NO: 2713180 - RNA, 18 nt, Human
aggucuguucuuuccaaa

SEQ ID NO: 2713181 - RNA, 20 nt, Human
agguaaaagcaucacaugaa

SEQ ID NO: 2713182 - RNA, 24 nt, Human
aggugcuacaaaaacacagcaagg

SEQ ID NO: 2713183 - RNA, 23 nt, Human
aggugcuacaaaaacacagcaag

SEQ ID NO: 2713184 - RNA, 19 nt, Human
aggugcuaggaacacuccu

SEQ ID NO: 2713185 - RNA, 22 nt, Human
aggugcuaggaacacuccuuca

SEQ ID NO: 2713186 - RNA, 23 nt, Human
aggugcuaggaacacuccuucac

SEQ ID NO: 2713187 - RNA, 14 nt, Human
agguucaaagauau

SEQ ID NO: 2713188 - RNA, 22 nt, Human
agguucccuuugacgccauccc

SEQ ID NO: 2713189 - RNA, 13 nt, Human
agguucccuuuga

SEQ ID NO: 2713190 - RNA, 23 nt, Human
agguucccuuugacgccauccca

SEQ ID NO: 2713191 - RNA, 11 nt, Human
agggucccugg

SEQ ID NO: 2713192 - RNA, 19 nt, Human
aggguaucaggugcugcca

SEQ ID NO: 2713193 - RNA, 18 nt, Human
aggguaucaggugcugcc

SEQ ID NO: 2713194 - RNA, 21 nt, Human
aggguaucaggugcugccauc

SEQ ID NO: 2713195 - RNA, 15 nt, Human
aggguaucuggugac

SEQ ID NO: 2713196 - RNA, 19 nt, Human
aggggccucuuaugggcug

SEQ ID NO: 2713197 - RNA, 20 nt, Human
aggggccucuuaugggcugg

SEQ ID NO: 2713198 - RNA, 21 nt, Human
aggggccucuuaugggcuggg

SEQ ID NO: 2713199 - RNA, 17 nt, Human
aggcuacugucagcucc

SEQ ID NO: 2713200 - RNA, 22 nt, Human
aggcccuucucuccagccccug

SEQ ID NO: 2713201 - RNA, 23 nt, Human
aggcccuucucuccagccccugg

SEQ ID NO: 2713202 - RNA, 20 nt, Human
aggcccuucucuccagcccc

SEQ ID NO: 2713203 - RNA, 21 nt, Human
aggcccuucucuccagccccu

SEQ ID NO: 2713204 - RNA, 17 nt, Human
aggcuagauguauguac

SEQ ID NO: 2713205 - RNA, 15 nt, Human
aggcuagauguaugu

SEQ ID NO: 2713206 - RNA, 16 nt, Human
aggcuagauguaugua

SEQ ID NO: 2713207 - RNA, 13 nt, Human
aggcuguauccca

SEQ ID NO: 2713208 - RNA, 18 nt, Human
aggcuguaucccaugagc

SEQ ID NO: 2713209 - RNA, 20 nt, Human
aggcugucaauuacaggaag

SEQ ID NO: 2713210 - RNA, 19 nt, Human
aggcugucaauuacaggaa

SEQ ID NO: 2713211 - RNA, 23 nt, Human
agggacagaggggguggccuccc

SEQ ID NO: 2713212 - RNA, 22 nt, Human
agggacagaggggguggccucc

SEQ ID NO: 2713213 - RNA, 21 nt, Human
aggcugucaauuacaggaagu

SEQ ID NO: 2713214 - RNA, 14 nt, Human
auagucaaauugug

SEQ ID NO: 2713215 - RNA, 23 nt, Human
auaguauuugagaguucuaaauu

SEQ ID NO: 2713216 - RNA, 15 nt, Human
auagguuuaauaauu

SEQ ID NO: 2713217 - RNA, 14 nt, Human
auagguuuggacaa

SEQ ID NO: 2713218 - RNA, 17 nt, Human
auaguaugguggcuggg

SEQ ID NO: 2713219 - RNA, 18 nt, Human
auaguaugguggcugggu

SEQ ID NO: 2713220 - RNA, 20 nt, Human
auaguauuugagaguucuaa

SEQ ID NO: 2713221 - RNA, 21 nt, Human
auaguauuugagaguucuaaa

SEQ ID NO: 2713222 - RNA, 14 nt, Human
auaggugcuacaaa

SEQ ID NO: 2713223 - RNA, 23 nt, Human
auaggugcuacaaaaacacagca

SEQ ID NO: 2713224 - RNA, 21 nt, Human
auaggugcuacaaaaacacag

SEQ ID NO: 2713225 - RNA, 15 nt, Human
auaggugcuacaaaa

SEQ ID NO: 2713226 - RNA, 15 nt, Human
auagccaaggccaaa

SEQ ID NO: 2713227 - RNA, 21 nt, Human
auagccaaggccaaaggaagc

SEQ ID NO: 2713228 - RNA, 20 nt, Human
auaugcuucuguuuuauaau

SEQ ID NO: 2713229 - RNA, 22 nt, Human
auaugcuucuguuuuauaauuu

SEQ ID NO: 2713230 - RNA, 21 nt, Human
auaugcuuauacacuuacacu

SEQ ID NO: 2713231 - RNA, 23 nt, Human
auaugcuauuucuauauuuucau

SEQ ID NO: 2713232 - RNA, 22 nt, Human
auaugcuauuucuauauuuuca

SEQ ID NO: 2713233 - RNA, 22 nt, Human
auauuaccacagacauacuaac

SEQ ID NO: 2713234 - RNA, 19 nt, Human
auauuaccacagacauacu

SEQ ID NO: 2713235 - RNA, 15 nt, Human
auaugcuauuucuau

SEQ ID NO: 2713236 - RNA, 21 nt, Human
auaugcuauuucuauauuuuc

SEQ ID NO: 2713237 - RNA, 19 nt, Human
auaugcuauuucuauauuu

SEQ ID NO: 2713238 - RNA, 18 nt, Human
auaugcuauuucuauauu

SEQ ID NO: 2713239 - RNA, 16 nt, Human
auaugcuauuucuaua

SEQ ID NO: 2713240 - RNA, 16 nt, Human
auauuauguuaaaacu

SEQ ID NO: 2713241 - RNA, 13 nt, Human
auauuauguguuu

SEQ ID NO: 2713242 - RNA, 22 nt, Human
auauuuauuacuguaagaaaau

SEQ ID NO: 2713243 - RNA, 19 nt, Human
auauuuacuucuuauacau

SEQ ID NO: 2713244 - RNA, 13 nt, Human
auauuuauuuuaa

SEQ ID NO: 2713245 - RNA, 20 nt, Human
auauuuacuaaaauggacug

SEQ ID NO: 2713246 - RNA, 18 nt, Human
auauuuacuaaaauggac

SEQ ID NO: 2713247 - RNA, 19 nt, Human
auauauuuuuuucugaaau

SEQ ID NO: 2713248 - RNA, 18 nt, Human
auaaaggauuaaugucaa

SEQ ID NO: 2713249 - RNA, 15 nt, Human
auaacauaaaucugu

SEQ ID NO: 2713250 - RNA, 14 nt, Human
auaacauaaaucug

SEQ ID NO: 2713251 - RNA, 19 nt, Human
auaacauaaaucugugaac

SEQ ID NO: 2713252 - RNA, 18 nt, Human
auaacauaaaucugugaa

SEQ ID NO: 2713253 - RNA, 17 nt, Human
auaacauaaaucuguga

SEQ ID NO: 2713254 - RNA, 22 nt, Human
auaaaaauauuguguugugaau

SEQ ID NO: 2713255 - RNA, 17 nt, Human
auaaaacuuuuuaaaau

SEQ ID NO: 2713256 - RNA, 16 nt, Human
auaaacuuuaccuuuu

SEQ ID NO: 2713257 - RNA, 21 nt, Human
auaaacuuuaccuuuuuuaua

SEQ ID NO: 2713258 - RNA, 24 nt, Human
auaaacuuuaccuuuuuuauacau

SEQ ID NO: 2713259 - RNA, 14 nt, Human
auaaaaauauugug

SEQ ID NO: 2713260 - RNA, 11 nt, Human
auaaaacuuuu

SEQ ID NO: 2713261 - RNA, 15 nt, Human
auaaaacuuuuuaaa

SEQ ID NO: 2713262 - RNA, 13 nt, Human
auaaagcagcguu

SEQ ID NO: 2713263 - RNA, 20 nt, Human
auaaagcagcguuucuauga

SEQ ID NO: 2713264 - RNA, 19 nt, Human
auaaagcagcguuucuaug

SEQ ID NO: 2713265 - RNA, 18 nt, Human
auaaagcagcguuucuau

SEQ ID NO: 2713266 - RNA, 14 nt, Human
auaaagcagcguuu

SEQ ID NO: 2713267 - RNA, 18 nt, Human
auacaccacuacauucug

SEQ ID NO: 2713268 - RNA, 18 nt, Human
auacacacucaaaucaag

SEQ ID NO: 2713269 - RNA, 17 nt, Human
auacacacucaaaucaa

SEQ ID NO: 2713270 - RNA, 21 nt, Human
auacaccacuacauucuguua

SEQ ID NO: 2713271 - RNA, 20 nt, Human
auacaccacuacauucuguu

SEQ ID NO: 2713272 - RNA, 19 nt, Human
auacaccacuacauucugu

SEQ ID NO: 2713273 - RNA, 23 nt, Human
auaauguuucaaacauauauaac

SEQ ID NO: 2713274 - RNA, 15 nt, Human
auaauguaagcucua

SEQ ID NO: 2713275 - RNA, 20 nt, Human
auaauuaaauuuugaguucu

SEQ ID NO: 2713276 - RNA, 15 nt, Human
auaauuaacauguua

SEQ ID NO: 2713277 - RNA, 20 nt, Human
auaaugcgugcauaccacuu

SEQ ID NO: 2713278 - RNA, 21 nt, Human
auaaugcgugcauaccacuuu

SEQ ID NO: 2713279 - RNA, 14 nt, Human
auaauguaagcucu

SEQ ID NO: 2713280 - RNA, 15 nt, Human
auaaggaaaaguuua

SEQ ID NO: 2713281 - RNA, 16 nt, Human
auaaggaaaaguuuaa

SEQ ID NO: 2713282 - RNA, 17 nt, Human
auaccugucccccugac

SEQ ID NO: 2713283 - RNA, 18 nt, Human
auaccugucccccugaca

SEQ ID NO: 2713284 - RNA, 11 nt, Human
auacccacccc

SEQ ID NO: 2713285 - RNA, 12 nt, Human
auacccaccccc

SEQ ID NO: 2713286 - RNA, 15 nt, Human
agugucuuaauuaaa

SEQ ID NO: 2713287 - RNA, 18 nt, Human
aguguauuuuuuuacuaa

SEQ ID NO: 2713288 - RNA, 17 nt, Human
aguguauuuuuuuacua

SEQ ID NO: 2713289 - RNA, 16 nt, Human
agugggagcugccugu

SEQ ID NO: 2713290 - RNA, 15 nt, Human
agugggagcugccug

SEQ ID NO: 2713291 - RNA, 14 nt, Human
agugggagcugccu

SEQ ID NO: 2713292 - RNA, 23 nt, Human
aguggcuuaaaacaacacucaca

SEQ ID NO: 2713293 - RNA, 18 nt, Human
agugucuuaauuaaaaga

SEQ ID NO: 2713294 - RNA, 17 nt, Human
agugucuuaauuaaaag

SEQ ID NO: 2713295 - RNA, 23 nt, Human
aguugaaaaucuuauaauuuaaa

SEQ ID NO: 2713296 - RNA, 22 nt, Human
aguugaaaagacuccaaagaaa

SEQ ID NO: 2713297 - RNA, 16 nt, Human
aguuguguuugaagca

SEQ ID NO: 2713298 - RNA, 14 nt, Human
aguugaagacagag

SEQ ID NO: 2713299 - RNA, 20 nt, Human
aguuguuugauucagacagc

SEQ ID NO: 2713300 - RNA, 21 nt, Human
aguugaaaagacuccaaagaa

SEQ ID NO: 2713301 - RNA, 22 nt, Human
aguugaaaaucuuauaauuuaa

SEQ ID NO: 2713302 - RNA, 15 nt, Human
aguucauacauugua

SEQ ID NO: 2713303 - RNA, 22 nt, Human
aguucaucuugaauuguaagga

SEQ ID NO: 2713304 - RNA, 10 nt, Human
aguucauaca

SEQ ID NO: 2713305 - RNA, 11 nt, Human
aguucauacau

SEQ ID NO: 2713306 - RNA, 20 nt, Human
aguucagguaacaggcagau

SEQ ID NO: 2713307 - RNA, 19 nt, Human
aguucagguaacaggcaga

SEQ ID NO: 2713308 - RNA, 17 nt, Human
aguuacagacaaagcgu

SEQ ID NO: 2713309 - RNA, 12 nt, Human
aguuaaauaaau

SEQ ID NO: 2713310 - RNA, 18 nt, Human
aguuacacuaaaagguga

SEQ ID NO: 2713311 - RNA, 14 nt, Human
aguuacagacaaag

SEQ ID NO: 2713312 - RNA, 16 nt, Human
aguuacagacaaagcg

SEQ ID NO: 2713313 - RNA, 23 nt, Human
agucaaauugugugaaagguacu

SEQ ID NO: 2713314 - RNA, 19 nt, Human
agucaaauugugugaaagg

SEQ ID NO: 2713315 - RNA, 16 nt, Human
aguaugaaauuauaua

SEQ ID NO: 2713316 - RNA, 14 nt, Human
aguaugaaauuaua

SEQ ID NO: 2713317 - RNA, 16 nt, Human
aguaugaggcauuugu

SEQ ID NO: 2713318 - RNA, 15 nt, Human
aguaugaggcauuug

SEQ ID NO: 2713319 - RNA, 15 nt, Human
aguaucucagggccu

SEQ ID NO: 2713320 - RNA, 11 nt, Human
aguaucuugaa

SEQ ID NO: 2713321 - RNA, 12 nt, Human
aguaucuugaag

SEQ ID NO: 2713322 - RNA, 15 nt, Human
aguaucuugaagacu

SEQ ID NO: 2713323 - RNA, 12 nt, Human
aguccuguaaug

SEQ ID NO: 2713324 - RNA, 12 nt, Human
agucugaaggcu

SEQ ID NO: 2713325 - RNA, 16 nt, Human
agucugaaggcugggu

SEQ ID NO: 2713326 - RNA, 13 nt, Human
agucugaaggcug

SEQ ID NO: 2713327 - RNA, 15 nt, Human
agucugaaggcuggg

SEQ ID NO: 2713328 - RNA, 22 nt, Human
aguccuggcaugggaaugaaug

SEQ ID NO: 2713329 - RNA, 20 nt, Human
aguccuggcaugggaaugaa

SEQ ID NO: 2713330 - RNA, 21 nt, Human
aguccuggcaugggaaugaau

SEQ ID NO: 2713331 - RNA, 20 nt, Human
agugaacuugggccacugug

SEQ ID NO: 2713332 - RNA, 17 nt, Human
agucuggaaugcagugg

SEQ ID NO: 2713333 - RNA, 16 nt, Human
agucugauucccaagc

SEQ ID NO: 2713334 - RNA, 18 nt, Human
agucugauucccaagcuc

SEQ ID NO: 2713335 - RNA, 16 nt, Human
agugaagacaaugacu

SEQ ID NO: 2713336 - RNA, 14 nt, Human
agugaagacaauga

SEQ ID NO: 2713337 - RNA, 19 nt, Human
auguaagggaaacugccag

SEQ ID NO: 2713338 - RNA, 17 nt, Human
auguaauuaaguacuau

SEQ ID NO: 2713339 - RNA, 15 nt, Human
auguaauuaaguacu

SEQ ID NO: 2713340 - RNA, 16 nt, Human
auguaagggaaacugc

SEQ ID NO: 2713341 - RNA, 14 nt, Human
auguaagggaaacu

SEQ ID NO: 2713342 - RNA, 19 nt, Human
auguauucuagcuaaugua

SEQ ID NO: 2713343 - RNA, 20 nt, Human
auguauucuagcuaauguaa

SEQ ID NO: 2713344 - RNA, 19 nt, Human
auggucaccaaaucagcug

SEQ ID NO: 2713345 - RNA, 19 nt, Human
augguccgugcuaaggacu

SEQ ID NO: 2713346 - RNA, 21 nt, Human
augguccgugcuaaggacuug

SEQ ID NO: 2713347 - RNA, 20 nt, Human
augguccgugcuaaggacuu

SEQ ID NO: 2713348 - RNA, 14 nt, Human
augucuuuucuugc

SEQ ID NO: 2713349 - RNA, 23 nt, Human
augugaacaguuguguuugaagc

SEQ ID NO: 2713350 - RNA, 21 nt, Human
augugaacaguuguguuugaa

SEQ ID NO: 2713351 - RNA, 11 nt, Human
augugaacagu

SEQ ID NO: 2713352 - RNA, 22 nt, Human
augugaaacuggauuaaacuua

SEQ ID NO: 2713353 - RNA, 18 nt, Human
augugggcagugauguca

SEQ ID NO: 2713354 - RNA, 13 nt, Human
augugugaaguga

SEQ ID NO: 2713355 - RNA, 11 nt, Human
auguucuggga

SEQ ID NO: 2713356 - RNA, 12 nt, Human
auguucugggac

SEQ ID NO: 2713357 - RNA, 19 nt, Human
auguuugccucugccucug

SEQ ID NO: 2713358 - RNA, 22 nt, Human
auguuugccucugccucugaca

SEQ ID NO: 2713359 - RNA, 18 nt, Human
auguuugccucugccucu

SEQ ID NO: 2713360 - RNA, 13 nt, Human
auguucugggaca

SEQ ID NO: 2713361 - RNA, 12 nt, Human
auguuucaaacu

SEQ ID NO: 2713362 - RNA, 13 nt, Human
auguuucaaacuu

SEQ ID NO: 2713363 - RNA, 14 nt, Human
auguuucaaacuuu

SEQ ID NO: 2713364 - RNA, 17 nt, Human
auguuucaaacuuugga

SEQ ID NO: 2713365 - RNA, 19 nt, Human
augccucucucaggccaaa

SEQ ID NO: 2713366 - RNA, 17 nt, Human
augccucucucaggcca

SEQ ID NO: 2713367 - RNA, 16 nt, Human
augcaugaaguaauau

SEQ ID NO: 2713368 - RNA, 21 nt, Human
augcauagguuuagcaguaua

SEQ ID NO: 2713369 - RNA, 17 nt, Human
augcauagguuuagcag

SEQ ID NO: 2713370 - RNA, 18 nt, Human
augcacagaguuguuaca

SEQ ID NO: 2713371 - RNA, 17 nt, Human
augcacagaguuguuac

SEQ ID NO: 2713372 - RNA, 16 nt, Human
augcacagaguuguua

SEQ ID NO: 2713373 - RNA, 16 nt, Human
augcacaaacagaggc

SEQ ID NO: 2713374 - RNA, 17 nt, Human
augcacaaacagaggcc

SEQ ID NO: 2713375 - RNA, 15 nt, Human
augcacaaacagagg

SEQ ID NO: 2713376 - RNA, 24 nt, Human
augauguuuuccaugaguccccug

SEQ ID NO: 2713377 - RNA, 16 nt, Human
augaugccaugaggaa

SEQ ID NO: 2713378 - RNA, 17 nt, Human
augaugccaugaggaac

SEQ ID NO: 2713379 - RNA, 11 nt, Human
augcugcccug

SEQ ID NO: 2713380 - RNA, 16 nt, Human
augcucuuuacuucau

SEQ ID NO: 2713381 - RNA, 12 nt, Human
augcuuguacau

SEQ ID NO: 2713382 - RNA, 14 nt, Human
augcuuguacauaa

SEQ ID NO: 2713383 - RNA, 13 nt, Human
augcuuguacaua

SEQ ID NO: 2713384 - RNA, 15 nt, Human
auggauuuccagcca

SEQ ID NO: 2713385 - RNA, 23 nt, Human
aucagcugcugaaacaacaaaua

SEQ ID NO: 2713386 - RNA, 22 nt, Human
aucagcugcugaaacaacaaau

SEQ ID NO: 2713387 - RNA, 17 nt, Human
auauuuauuuuaauaau

SEQ ID NO: 2713388 - RNA, 14 nt, Human
auauuuauuuuaau

SEQ ID NO: 2713389 - RNA, 15 nt, Human
auauuuauuuuaaua

SEQ ID NO: 2713390 - RNA, 21 nt, Human
aucacagccucugaaaaccaa

SEQ ID NO: 2713391 - RNA, 18 nt, Human
aucaccaacgucugugcc

SEQ ID NO: 2713392 - RNA, 19 nt, Human
aucaccaacgucugugcca

SEQ ID NO: 2713393 - RNA, 23 nt, Human
aucacccgcuaagagggagggag

SEQ ID NO: 2713394 - RNA, 21 nt, Human
aucagcugcugaaacaacaaa

SEQ ID NO: 2713395 - RNA, 19 nt, Human
aucagccugcuccagcugu

SEQ ID NO: 2713396 - RNA, 17 nt, Human
aucagccugcuccagcu

SEQ ID NO: 2713397 - RNA, 18 nt, Human
aucagccugcuccagcug

SEQ ID NO: 2713398 - RNA, 23 nt, Human
aucagcacgauuucuguuuagau

SEQ ID NO: 2713399 - RNA, 20 nt, Human
aucagcacgauuucuguuua

SEQ ID NO: 2713400 - RNA, 19 nt, Human
aucagcacgauuucuguuu

SEQ ID NO: 2713401 - RNA, 14 nt, Human
aucaccgaaaacgu

SEQ ID NO: 2713402 - RNA, 19 nt, Human
aucaccgaaaacguggcug

SEQ ID NO: 2713403 - RNA, 21 nt, Human
aucaccgaaaacguggcugcu

SEQ ID NO: 2713404 - RNA, 20 nt, Human
auccucccaccucagccucc

SEQ ID NO: 2713405 - RNA, 18 nt, Human
auccucccaccucagccu

SEQ ID NO: 2713406 - RNA, 19 nt, Human
auccucccaccucagccuc

SEQ ID NO: 2713407 - RNA, 14 nt, Human
aucccauuuaaaaa

SEQ ID NO: 2713408 - RNA, 15 nt, Human
aucccauuuaaaaaa

SEQ ID NO: 2713409 - RNA, 15 nt, Human
auccagacccggcug

SEQ ID NO: 2713410 - RNA, 23 nt, Human
auccucauacccacccccaccca

SEQ ID NO: 2713411 - RNA, 11 nt, Human
auccuccaggu

SEQ ID NO: 2713412 - RNA, 15 nt, Human
auccucccaccucag

SEQ ID NO: 2713413 - RNA, 23 nt, Human
auccuccaggugcacaagcucca

SEQ ID NO: 2713414 - RNA, 15 nt, Human
auccccuguagagug

SEQ ID NO: 2713415 - RNA, 21 nt, Human
augaccuuucaauaggaaaaa

SEQ ID NO: 2713416 - RNA, 22 nt, Human
augaccuuucaauaggaaaaac

SEQ ID NO: 2713417 - RNA, 23 nt, Human
augaccuuucaauaggaaaaacu

SEQ ID NO: 2713418 - RNA, 19 nt, Human
augaaagacuguacaaagu

SEQ ID NO: 2713419 - RNA, 17 nt, Human
augaaagacuguacaaa

SEQ ID NO: 2713420 - RNA, 16 nt, Human
augaaagacuguacaa

SEQ ID NO: 2713421 - RNA, 13 nt, Human
augaaagacugua

SEQ ID NO: 2713422 - RNA, 17 nt, Human
aucuugaauuguaagga

SEQ ID NO: 2713423 - RNA, 14 nt, Human
aucuucuuuauaau

SEQ ID NO: 2713424 - RNA, 18 nt, Human
aucuugaagacuuuucuu

SEQ ID NO: 2713425 - RNA, 22 nt, Human
aucuucugaacuuggcgcugcc

SEQ ID NO: 2713426 - RNA, 22 nt, Human
aucugcuuuuuaaagaaugcuc

SEQ ID NO: 2713427 - RNA, 21 nt, Human
aucuauauuuuacauaaauuu

SEQ ID NO: 2713428 - RNA, 17 nt, Human
aucuauauuuuacauaa

SEQ ID NO: 2713429 - RNA, 14 nt, Human
aucuauauuuuaca

SEQ ID NO: 2713430 - RNA, 21 nt, Human
aucucccccagccccauccuc

SEQ ID NO: 2713431 - RNA, 17 nt, Human
caaugcaaaccaucauu

SEQ ID NO: 2713432 - RNA, 18 nt, Human
caaugcaaaccaucauug

SEQ ID NO: 2713433 - RNA, 23 nt, Human
caaugcacuuuguucuggcucuu

SEQ ID NO: 2713434 - RNA, 19 nt, Human
caaugcaaaccaucauuga

SEQ ID NO: 2713435 - RNA, 21 nt, Human
caauaggaaaaacugauuuuu

SEQ ID NO: 2713436 - RNA, 20 nt, Human
caauaggaaaaacugauuuu

SEQ ID NO: 2713437 - RNA, 11 nt, Human
cacaacagauu

SEQ ID NO: 2713438 - RNA, 16 nt, Human
cacaaaaguuucucuu

SEQ ID NO: 2713439 - RNA, 18 nt, Human
cacaaaaguuucucuuuu

SEQ ID NO: 2713440 - RNA, 19 nt, Human
cacacucaaaucaagaaac

SEQ ID NO: 2713441 - RNA, 14 nt, Human
cacacugaagaagc

SEQ ID NO: 2713442 - RNA, 21 nt, Human
cacacuugacaucaacugcau

SEQ ID NO: 2713443 - RNA, 22 nt, Human
cacagacccugcccugugggcc

SEQ ID NO: 2713444 - RNA, 17 nt, Human
cacagaguuguuacauu

SEQ ID NO: 2713445 - RNA, 16 nt, Human
cacagaguuguuacau

SEQ ID NO: 2713446 - RNA, 13 nt, Human
cacaacuauauug

SEQ ID NO: 2713447 - RNA, 14 nt, Human
cacaacuauuuuuc

SEQ ID NO: 2713448 - RNA, 19 nt, Human
cacaacuauuuuuccaaaa

SEQ ID NO: 2713449 - RNA, 14 nt, Human
cacacaccagagcc

SEQ ID NO: 2713450 - RNA, 12 nt, Human
cacacagcucug

SEQ ID NO: 2713451 - RNA, 19 nt, Human
cacacagaggcugccucuc

SEQ ID NO: 2713452 - RNA, 15 nt, Human
cacaccagagcccac

SEQ ID NO: 2713453 - RNA, 12 nt, Human
cacaccagagcc

SEQ ID NO: 2713454 - RNA, 13 nt, Human
cacaccagagccc

SEQ ID NO: 2713455 - RNA, 13 nt, Human
cacacccagccca

SEQ ID NO: 2713456 - RNA, 17 nt, Human
cacaccgggcacucaga

SEQ ID NO: 2713457 - RNA, 22 nt, Human
cacagcaguugaaaagacucca

SEQ ID NO: 2713458 - RNA, 20 nt, Human
cacagaguuguuacauuuuu

SEQ ID NO: 2713459 - RNA, 14 nt, Human
cacagaugggugcu

SEQ ID NO: 2713460 - RNA, 18 nt, Human
cacagaugggugcuugga

SEQ ID NO: 2713461 - RNA, 20 nt, Human
cacagaugggugcuuggagg

SEQ ID NO: 2713462 - RNA, 20 nt, Human
cacaggaaccacaagacugc

SEQ ID NO: 2713463 - RNA, 19 nt, Human
cacaggaaccacaagacug

SEQ ID NO: 2713464 - RNA, 12 nt, Human
cacaggaucagu

SEQ ID NO: 2713465 - RNA, 15 nt, Human
cacaggaucagucug

SEQ ID NO: 2713466 - RNA, 16 nt, Human
cacaggaucagucuga

SEQ ID NO: 2713467 - RNA, 10 nt, Human
cacaggcagg

SEQ ID NO: 2713468 - RNA, 16 nt, Human
cacaggcccggcucca

SEQ ID NO: 2713469 - RNA, 17 nt, Human
cacaggcccggcuccag

SEQ ID NO: 2713470 - RNA, 18 nt, Human
cacaggcccggcuccagg

SEQ ID NO: 2713471 - RNA, 19 nt, Human
cacaggcccggcuccaggc

SEQ ID NO: 2713472 - RNA, 14 nt, Human
cacaguuuucugag

SEQ ID NO: 2713473 - RNA, 15 nt, Human
cacaguuuucugaga

SEQ ID NO: 2713474 - RNA, 23 nt, Human
cacauaucuaguaugaaauuaua

SEQ ID NO: 2713475 - RNA, 17 nt, Human
cacauacacacacacgc

SEQ ID NO: 2713476 - RNA, 19 nt, Human
cacagugagucgaggacag

SEQ ID NO: 2713477 - RNA, 20 nt, Human
cacagugagucgaggacagg

SEQ ID NO: 2713478 - RNA, 18 nt, Human
cacagugagucgaggaca

SEQ ID NO: 2713479 - RNA, 20 nt, Human
cacaggcccggcuccaggcu

SEQ ID NO: 2713480 - RNA, 23 nt, Human
cacaggcccggcuccaggcuccu

SEQ ID NO: 2713481 - RNA, 17 nt, Human
cacauuggaaacaaguc

SEQ ID NO: 2713482 - RNA, 20 nt, Human
cacauugguguuguacucaa

SEQ ID NO: 2713483 - RNA, 15 nt, Human
caccaagcccaguua

SEQ ID NO: 2713484 - RNA, 17 nt, Human
caccacacccagcccac

SEQ ID NO: 2713485 - RNA, 13 nt, Human
caccacacccagc

SEQ ID NO: 2713486 - RNA, 15 nt, Human
caccacacccagccc

SEQ ID NO: 2713487 - RNA, 19 nt, Human
caccacaugugcacaugca

SEQ ID NO: 2713488 - RNA, 15 nt, Human
caccacaugugcaca

SEQ ID NO: 2713489 - RNA, 18 nt, Human
caccacaugugcacaugc

SEQ ID NO: 2713490 - RNA, 20 nt, Human
caccacuacauucuguuaau

SEQ ID NO: 2713491 - RNA, 19 nt, Human
caccacuacauucuguuaa

SEQ ID NO: 2713492 - RNA, 18 nt, Human
caccacuacauucuguua

SEQ ID NO: 2713493 - RNA, 17 nt, Human
caccacuacauucuguu

SEQ ID NO: 2713494 - RNA, 16 nt, Human
caccacuacauucugu

SEQ ID NO: 2713495 - RNA, 14 nt, Human
caccaccucuuugg

SEQ ID NO: 2713496 - RNA, 17 nt, Human
cacaugugcacaugcac

SEQ ID NO: 2713497 - RNA, 14 nt, Human
cacaugugcacaug

SEQ ID NO: 2713498 - RNA, 15 nt, Human
cacaugugcacaugc

SEQ ID NO: 2713499 - RNA, 16 nt, Human
cacauuccugaugcuu

SEQ ID NO: 2713500 - RNA, 16 nt, Human
cacauuccugaacagg

SEQ ID NO: 2713501 - RNA, 18 nt, Human
cacaucagcacgauuucu

SEQ ID NO: 2713502 - RNA, 12 nt, Human
cacauaucuguc

SEQ ID NO: 2713503 - RNA, 19 nt, Human
cacaucagcacgauuucug

SEQ ID NO: 2713504 - RNA, 13 nt, Human
cacaugccucucu

SEQ ID NO: 2713505 - RNA, 17 nt, Human
cacaugccucucucagg

SEQ ID NO: 2713506 - RNA, 18 nt, Human
cacaugccucucucaggc

SEQ ID NO: 2713507 - RNA, 23 nt, Human
cacauguccaagaagcccaggaa

SEQ ID NO: 2713508 - RNA, 19 nt, Human
cacaugccucucucaggcc

SEQ ID NO: 2713509 - RNA, 17 nt, Human
caaauaugcaaagcacu

SEQ ID NO: 2713510 - RNA, 16 nt, Human
caaauaugcaaagcac

SEQ ID NO: 2713511 - RNA, 18 nt, Human
caaauaugcaaagcacug

SEQ ID NO: 2713512 - RNA, 16 nt, Human
caaaucagcugcuacu

SEQ ID NO: 2713513 - RNA, 13 nt, Human
caaaucagcugcu

SEQ ID NO: 2713514 - RNA, 22 nt, Human
caaauucugcuugcuugcuuuu

SEQ ID NO: 2713515 - RNA, 14 nt, Human
caaauaugcaaagc

SEQ ID NO: 2713516 - RNA, 19 nt, Human
caaaguugccuaaauccau

SEQ ID NO: 2713517 - RNA, 21 nt, Human
caaaggaugcccaaagaugca

SEQ ID NO: 2713518 - RNA, 18 nt, Human
caaagcuaggccuggcca

SEQ ID NO: 2713519 - RNA, 16 nt, Human
caaagcuaggccuggc

SEQ ID NO: 2713520 - RNA, 17 nt, Human
caaagcuaggccuggcc

SEQ ID NO: 2713521 - RNA, 20 nt, Human
caaagccaaagcuaggccug

SEQ ID NO: 2713522 - RNA, 21 nt, Human
caaagccaaagcuaggccugg

SEQ ID NO: 2713523 - RNA, 15 nt, Human
caaagcuaggccugg

SEQ ID NO: 2713524 - RNA, 16 nt, Human
caaagcuuguuaagau

SEQ ID NO: 2713525 - RNA, 23 nt, Human
caaaaaaauauauuuaaugauaa

SEQ ID NO: 2713526 - RNA, 18 nt, Human
auuuuuuuacuaauagac

SEQ ID NO: 2713527 - RNA, 23 nt, Human
caacaggcugggcuucaguggca

SEQ ID NO: 2713528 - RNA, 24 nt, Human
caacaggcugggcuucaguggcag

SEQ ID NO: 2713529 - RNA, 22 nt, Human
caacaucuuggucagauuugaa

SEQ ID NO: 2713530 - RNA, 19 nt, Human
caacagguuuuccugaaga

SEQ ID NO: 2713531 - RNA, 18 nt, Human
caacaggguuuuuuucca

SEQ ID NO: 2713532 - RNA, 15 nt, Human
caacagguuuuccug

SEQ ID NO: 2713533 - RNA, 21 nt, Human
caaccccuucgcuccuguguc

SEQ ID NO: 2713534 - RNA, 18 nt, Human
caaccccuucgcuccugu

SEQ ID NO: 2713535 - RNA, 19 nt, Human
caaccccuucgcuccugug

SEQ ID NO: 2713536 - RNA, 19 nt, Human
caacucuccuccagaguca

SEQ ID NO: 2713537 - RNA, 16 nt, Human
caaccugauugugucu

SEQ ID NO: 2713538 - RNA, 12 nt, Human
caacccucauca

SEQ ID NO: 2713539 - RNA, 15 nt, Human
caacccucaucacca

SEQ ID NO: 2713540 - RNA, 18 nt, Human
caagaaaacaacuucaau

SEQ ID NO: 2713541 - RNA, 12 nt, Human
caacuuuauacc

SEQ ID NO: 2713542 - RNA, 16 nt, Human
caacugcauuggcuuu

SEQ ID NO: 2713543 - RNA, 20 nt, Human
caacucuccuccagagucag

SEQ ID NO: 2713544 - RNA, 21 nt, Human
caacucugaaggguaauuaua

SEQ ID NO: 2713545 - RNA, 17 nt, Human
caagcacuaaacaaaga

SEQ ID NO: 2713546 - RNA, 18 nt, Human
caagcaccuccugccucg

SEQ ID NO: 2713547 - RNA, 16 nt, Human
caagcgugagccacug

SEQ ID NO: 2713548 - RNA, 21 nt, Human
caagccaccaacauacuccca

SEQ ID NO: 2713549 - RNA, 17 nt, Human
caagcgugagccacugc

SEQ ID NO: 2713550 - RNA, 18 nt, Human
caagcgugagccacugca

SEQ ID NO: 2713551 - RNA, 13 nt, Human
caaggauccugag

SEQ ID NO: 2713552 - RNA, 22 nt, Human
caaggauccugagccagauuuc

SEQ ID NO: 2713553 - RNA, 21 nt, Human
caaggaugaucuaggaagacu

SEQ ID NO: 2713554 - RNA, 15 nt, Human
caaggauugcuacug

SEQ ID NO: 2713555 - RNA, 16 nt, Human
caagggccuggccuga

SEQ ID NO: 2713556 - RNA, 19 nt, Human
caagggccuggccugagcu

SEQ ID NO: 2713557 - RNA, 12 nt, Human
caaggugggagg

SEQ ID NO: 2713558 - RNA, 23 nt, Human
caaggugggaggauugcuugagc

SEQ ID NO: 2713559 - RNA, 22 nt, Human
caagugugguagagugugccug

SEQ ID NO: 2713560 - RNA, 22 nt, Human
caagugauucuccugccucagc

SEQ ID NO: 2713561 - RNA, 21 nt, Human
caagugauucuccugccucag

SEQ ID NO: 2713562 - RNA, 19 nt, Human
caagugaaaaaggaggaag

SEQ ID NO: 2713563 - RNA, 16 nt, Human
caagugauucuccugc

SEQ ID NO: 2713564 - RNA, 17 nt, Human
caagugauucuccugcc

SEQ ID NO: 2713565 - RNA, 12 nt, Human
caccccagcccc

SEQ ID NO: 2713566 - RNA, 13 nt, Human
caccccagcccca

SEQ ID NO: 2713567 - RNA, 15 nt, Human
cacccacccuuuuuu

SEQ ID NO: 2713568 - RNA, 20 nt, Human
cacccaccaucaugucuggc

SEQ ID NO: 2713569 - RNA, 22 nt, Human
cacccaccaucaugucuggcua

SEQ ID NO: 2713570 - RNA, 12 nt, Human
cacccaccucag

SEQ ID NO: 2713571 - RNA, 13 nt, Human
cacccaccucagc

SEQ ID NO: 2713572 - RNA, 14 nt, Human
cacccaccucagcc

SEQ ID NO: 2713573 - RNA, 16 nt, Human
cacccaccucagccuc

SEQ ID NO: 2713574 - RNA, 19 nt, Human
cacccaagggccuggccug

SEQ ID NO: 2713575 - RNA, 20 nt, Human
cacccaagggccuggccuga

SEQ ID NO: 2713576 - RNA, 21 nt, Human
cacccaagggccuggccugag

SEQ ID NO: 2713577 - RNA, 23 nt, Human
cacccaagggccuggccugagcu

SEQ ID NO: 2713578 - RNA, 16 nt, Human
cacccaagggccuggc

SEQ ID NO: 2713579 - RNA, 17 nt, Human
cacccaagggccuggcc

SEQ ID NO: 2713580 - RNA, 18 nt, Human
cacccaagggccuggccu

SEQ ID NO: 2713581 - RNA, 14 nt, Human
caccccggccaccu

SEQ ID NO: 2713582 - RNA, 15 nt, Human
caccccggccaccug

SEQ ID NO: 2713583 - RNA, 16 nt, Human
caccccggccaccugc

SEQ ID NO: 2713584 - RNA, 17 nt, Human
caccccggccaccugcg

SEQ ID NO: 2713585 - RNA, 22 nt, Human
cacccccacccaagggccuggc

SEQ ID NO: 2713586 - RNA, 19 nt, Human
ccaccucccugcaauaaaa

SEQ ID NO: 2713587 - RNA, 21 nt, Human
ccaccucccugcaauaaaaug

SEQ ID NO: 2713588 - RNA, 15 nt, Human
ccaccucccugcaau

SEQ ID NO: 2713589 - RNA, 12 nt, Human
ccacccugcucu

SEQ ID NO: 2713590 - RNA, 11 nt, Human
ccacccugcuc

SEQ ID NO: 2713591 - RNA, 19 nt, Human
ccaccucucucacuccuug

SEQ ID NO: 2713592 - RNA, 20 nt, Human
ccaccucucucacuccuuga

SEQ ID NO: 2713593 - RNA, 14 nt, Human
ccaccucucucacu

SEQ ID NO: 2713594 - RNA, 16 nt, Human
ccaccucucucacucc

SEQ ID NO: 2713595 - RNA, 12 nt, Human
ccaccugccagg

SEQ ID NO: 2713596 - RNA, 15 nt, Human
ccaccugccagggac

SEQ ID NO: 2713597 - RNA, 13 nt, Human
ccaccugccaggg

SEQ ID NO: 2713598 - RNA, 14 nt, Human
ccaccugccaggga

SEQ ID NO: 2713599 - RNA, 13 nt, Human
ccaccuggccucu

SEQ ID NO: 2713600 - RNA, 18 nt, Human
ccaccuggccucugcacu

SEQ ID NO: 2713601 - RNA, 20 nt, Human
ccaccuggccucugcacucc

SEQ ID NO: 2713602 - RNA, 14 nt, Human
ccacccuccuuuca

SEQ ID NO: 2713603 - RNA, 19 nt, Human
ccaccccucaacaccucug

SEQ ID NO: 2713604 - RNA, 19 nt, Human
ccacccccacccaagggcc

SEQ ID NO: 2713605 - RNA, 22 nt, Human
ccagacacauguccaagaagcc

SEQ ID NO: 2713606 - RNA, 17 nt, Human
ccagacacauguccaag

SEQ ID NO: 2713607 - RNA, 20 nt, Human
ccagacacauguccaagaag

SEQ ID NO: 2713608 - RNA, 14 nt, Human
ccagacccggcugc

SEQ ID NO: 2713609 - RNA, 15 nt, Human
ccagacccggcugcg

SEQ ID NO: 2713610 - RNA, 23 nt, Human
ccacuggugacaugucuuuucuu

SEQ ID NO: 2713611 - RNA, 14 nt, Human
ccacugugaagaga

SEQ ID NO: 2713612 - RNA, 15 nt, Human
ccacugugaagagaa

SEQ ID NO: 2713613 - RNA, 22 nt, Human
ccacugcuuuuggucuguguga

SEQ ID NO: 2713614 - RNA, 20 nt, Human
ccacugcuuuuggucugugu

SEQ ID NO: 2713615 - RNA, 11 nt, Human
ccacugcucug

SEQ ID NO: 2713616 - RNA, 12 nt, Human
ccacugcucugg

SEQ ID NO: 2713617 - RNA, 13 nt, Human
ccacugcucuggu

SEQ ID NO: 2713618 - RNA, 15 nt, Human
ccacugcucugguua

SEQ ID NO: 2713619 - RNA, 21 nt, Human
ccacugcaucguuucaucuuc

SEQ ID NO: 2713620 - RNA, 23 nt, Human
ccacugcaucguuucaucuucca

SEQ ID NO: 2713621 - RNA, 19 nt, Human
ccacugugccaugugccag

SEQ ID NO: 2713622 - RNA, 15 nt, Human
ccacugugccaugug

SEQ ID NO: 2713623 - RNA, 16 nt, Human
ccacugugccaugugc

SEQ ID NO: 2713624 - RNA, 22 nt, Human
ccagaagaaaauagugguguga

SEQ ID NO: 2713625 - RNA, 13 nt, Human
ccagccuggguga

SEQ ID NO: 2713626 - RNA, 23 nt, Human
ccagccuugaccauucuccaccu

SEQ ID NO: 2713627 - RNA, 13 nt, Human
ccagcgagcccug

SEQ ID NO: 2713628 - RNA, 16 nt, Human
ccagcccacuucugcc

SEQ ID NO: 2713629 - RNA, 17 nt, Human
ccagcccacuucugcca

SEQ ID NO: 2713630 - RNA, 19 nt, Human
ccagcaggcucucaggcca

SEQ ID NO: 2713631 - RNA, 20 nt, Human
ccagcaggcucucaggccag

SEQ ID NO: 2713632 - RNA, 21 nt, Human
ccagcaggcucucaggccagc

SEQ ID NO: 2713633 - RNA, 23 nt, Human
ccagcaggcucucaggccagcug

SEQ ID NO: 2713634 - RNA, 19 nt, Human
ccagccccaaaacucuccu

SEQ ID NO: 2713635 - RNA, 17 nt, Human
ccagccgagauagccaa

SEQ ID NO: 2713636 - RNA, 20 nt, Human
ccagccgagauagccaaggc

SEQ ID NO: 2713637 - RNA, 22 nt, Human
ccagccgagauagccaaggcca

SEQ ID NO: 2713638 - RNA, 17 nt, Human
ccagcaccaucucuccu

SEQ ID NO: 2713639 - RNA, 18 nt, Human
ccagcaccaucucuccuc

SEQ ID NO: 2713640 - RNA, 16 nt, Human
ccagcaggcucucagg

SEQ ID NO: 2713641 - RNA, 17 nt, Human
ccagcaggcucucaggc

SEQ ID NO: 2713642 - RNA, 18 nt, Human
ccagcaggcucucaggcc

SEQ ID NO: 2713643 - RNA, 17 nt, Human
ccagcaagugagagcug

SEQ ID NO: 2713644 - RNA, 18 nt, Human
ccagcaagugagagcugg

SEQ ID NO: 2713645 - RNA, 19 nt, Human
ccagcaagugagagcuggg

SEQ ID NO: 2713646 - RNA, 14 nt, Human
ccagauugcaacag

SEQ ID NO: 2713647 - RNA, 16 nt, Human
ccagauugcaacaggc

SEQ ID NO: 2713648 - RNA, 14 nt, Human
ccagagcccaccuu

SEQ ID NO: 2713649 - RNA, 23 nt, Human
ccagauugcaacaggcugggcuu

SEQ ID NO: 2713650 - RNA, 18 nt, Human
ccagauugcaacaggcug

SEQ ID NO: 2713651 - RNA, 22 nt, Human
ccagauugcaacaggcugggcu

SEQ ID NO: 2713652 - RNA, 18 nt, Human
ccagauuucacucuccuu

SEQ ID NO: 2713653 - RNA, 19 nt, Human
ccagauuucacucuccuug

SEQ ID NO: 2713654 - RNA, 15 nt, Human
ccagauuucacucuc

SEQ ID NO: 2713655 - RNA, 20 nt, Human
ccagguagaggguguguaag

SEQ ID NO: 2713656 - RNA, 13 nt, Human
ccaggcccucugc

SEQ ID NO: 2713657 - RNA, 14 nt, Human
ccaggcccucugcc

SEQ ID NO: 2713658 - RNA, 12 nt, Human
ccaggccagagg

SEQ ID NO: 2713659 - RNA, 14 nt, Human
ccaggccccugcca

SEQ ID NO: 2713660 - RNA, 15 nt, Human
ccaggccccugccac

SEQ ID NO: 2713661 - RNA, 16 nt, Human
ccaggccccugccacc

SEQ ID NO: 2713662 - RNA, 21 nt, Human
ccaggccacaagacccuugug

SEQ ID NO: 2713663 - RNA, 20 nt, Human
ccaggaggccagccuugacc

SEQ ID NO: 2713664 - RNA, 14 nt, Human
ccaggaggccagcc

SEQ ID NO: 2713665 - RNA, 15 nt, Human
ccaggaggccagccu

SEQ ID NO: 2713666 - RNA, 18 nt, Human
ccaggaggccagccuuga

SEQ ID NO: 2713667 - RNA, 14 nt, Human
ccaggcuggucuca

SEQ ID NO: 2713668 - RNA, 21 nt, Human
ccaggcuuagucacugagaca

SEQ ID NO: 2713669 - RNA, 22 nt, Human
ccaggcuuagucacugagacag

SEQ ID NO: 2713670 - RNA, 23 nt, Human
ccaggcuuagucacugagacagc

SEQ ID NO: 2713671 - RNA, 15 nt, Human
ccaggcccucugccc

SEQ ID NO: 2713672 - RNA, 23 nt, Human
ccaggcugggagagccuuccagg

SEQ ID NO: 2713673 - RNA, 17 nt, Human
ccaucauugaaaucuuu

SEQ ID NO: 2713674 - RNA, 14 nt, Human
ccaucauugaaauc

SEQ ID NO: 2713675 - RNA, 16 nt, Human
ccaucauugaaaucuu

SEQ ID NO: 2713676 - RNA, 15 nt, Human
ccaucucuccuccuu

SEQ ID NO: 2713677 - RNA, 20 nt, Human
ccaucucacacaugagcauc

SEQ ID NO: 2713678 - RNA, 21 nt, Human
ccaucucacacaugagcauca

SEQ ID NO: 2713679 - RNA, 14 nt, Human
ccaucucacacaug

SEQ ID NO: 2713680 - RNA, 15 nt, Human
ccaucucacacauga

SEQ ID NO: 2713681 - RNA, 17 nt, Human
ccaucucacacaugagc

SEQ ID NO: 2713682 - RNA, 18 nt, Human
ccaucucacacaugagca

SEQ ID NO: 2713683 - RNA, 12 nt, Human
ccaucaugucug

SEQ ID NO: 2713684 - RNA, 13 nt, Human
ccaucaugucugg

SEQ ID NO: 2713685 - RNA, 12 nt, Human
ccaucauugaaa

SEQ ID NO: 2713686 - RNA, 16 nt, Human
ccaucaagccaccaac

SEQ ID NO: 2713687 - RNA, 13 nt, Human
ccaucaagccacc

SEQ ID NO: 2713688 - RNA, 14 nt, Human
ccaucaagccacca

SEQ ID NO: 2713689 - RNA, 15 nt, Human
ccauaugccugggca

SEQ ID NO: 2713690 - RNA, 12 nt, Human
ccaucaagccac

SEQ ID NO: 2713691 - RNA, 13 nt, Human
ccauaugccuggg

SEQ ID NO: 2713692 - RNA, 14 nt, Human
ccagugugacaagg

SEQ ID NO: 2713693 - RNA, 23 nt, Human
ccagugugacaaggauugcuacu

SEQ ID NO: 2713694 - RNA, 13 nt, Human
ccaggugccaguu

SEQ ID NO: 2713695 - RNA, 12 nt, Human
ccaggugccagu

SEQ ID NO: 2713696 - RNA, 21 nt, Human
ccaggugcuaggaacacuccu

SEQ ID NO: 2713697 - RNA, 13 nt, Human
ccagguuuaagcu

SEQ ID NO: 2713698 - RNA, 16 nt, Human
ccagguuucuaugugu

SEQ ID NO: 2713699 - RNA, 22 nt, Human
ccaguaaaugggggugcauuug

SEQ ID NO: 2713700 - RNA, 21 nt, Human
ccaguaaaugggggugcauuu

SEQ ID NO: 2713701 - RNA, 20 nt, Human
ccaguaaaugggggugcauu

SEQ ID NO: 2713702 - RNA, 23 nt, Human
ccagugaauucuugaaggaaaau

SEQ ID NO: 2713703 - RNA, 12 nt, Human
cccaccucagcc

SEQ ID NO: 2713704 - RNA, 14 nt, Human
cccaccucagccuc

SEQ ID NO: 2713705 - RNA, 15 nt, Human
cccaccucagccucc

SEQ ID NO: 2713706 - RNA, 19 nt, Human
cccaccucucucacuccuu

SEQ ID NO: 2713707 - RNA, 12 nt, Human
cccaccuuggcu

SEQ ID NO: 2713708 - RNA, 21 nt, Human
cccaccucagccucccaaagu

SEQ ID NO: 2713709 - RNA, 13 nt, Human
cccaccucucuca

SEQ ID NO: 2713710 - RNA, 14 nt, Human
cccaccucucucac

SEQ ID NO: 2713711 - RNA, 17 nt, Human
cccaccucucucacucc

SEQ ID NO: 2713712 - RNA, 17 nt, Human
cccacgcccccacuggu

SEQ ID NO: 2713713 - RNA, 19 nt, Human
cccacgcccccacugguga

SEQ ID NO: 2713714 - RNA, 15 nt, Human
cccaccuuggcucaa

SEQ ID NO: 2713715 - RNA, 22 nt, Human
cccaccuuggcucaaguccucu

SEQ ID NO: 2713716 - RNA, 14 nt, Human
cccaccuuggcugc

SEQ ID NO: 2713717 - RNA, 15 nt, Human
cccaccuuggcugca

SEQ ID NO: 2713718 - RNA, 16 nt, Human
cccaagggccuggccu

SEQ ID NO: 2713719 - RNA, 17 nt, Human
cccacaggaucagucug

SEQ ID NO: 2713720 - RNA, 13 nt, Human
cccacaggaucag

SEQ ID NO: 2713721 - RNA, 12 nt, Human
cccaagggccug

SEQ ID NO: 2713722 - RNA, 14 nt, Human
cccaagggccuggc

SEQ ID NO: 2713723 - RNA, 21 nt, Human
ccauuuuguauuuuacuaaua

SEQ ID NO: 2713724 - RNA, 20 nt, Human
ccauuuugcugucccuuuuc

SEQ ID NO: 2713725 - RNA, 18 nt, Human
ccauguuuuguuuacggu

SEQ ID NO: 2713726 - RNA, 15 nt, Human
ccauucugccugccc

SEQ ID NO: 2713727 - RNA, 13 nt, Human
ccauuuggaaauc

SEQ ID NO: 2713728 - RNA, 13 nt, Human
ccauuugcuccuu

SEQ ID NO: 2713729 - RNA, 11 nt, Human
ccauuauucaa

SEQ ID NO: 2713730 - RNA, 23 nt, Human
cccucuccugggcagcugccucc

SEQ ID NO: 2713731 - RNA, 11 nt, Human
cccucugccca

SEQ ID NO: 2713732 - RNA, 15 nt, Human
cccucugcccacucc

SEQ ID NO: 2713733 - RNA, 18 nt, Human
cccucugcccacucccug

SEQ ID NO: 2713734 - RNA, 19 nt, Human
cccucugcccacucccugc

SEQ ID NO: 2713735 - RNA, 20 nt, Human
cccucuccugggcagcugcc

SEQ ID NO: 2713736 - RNA, 21 nt, Human
cccucuccugggcagcugccu

SEQ ID NO: 2713737 - RNA, 22 nt, Human
cccucuccugggcagcugccuc

SEQ ID NO: 2713738 - RNA, 12 nt, Human
cccucuuucccu

SEQ ID NO: 2713739 - RNA, 20 nt, Human
cccucuuucccucccuuccu

SEQ ID NO: 2713740 - RNA, 17 nt, Human
cccucuuucccucccuu

SEQ ID NO: 2713741 - RNA, 23 nt, Human
cccucccucuuucccucccuucc

SEQ ID NO: 2713742 - RNA, 20 nt, Human
cccugcagagggcacagaaa

SEQ ID NO: 2713743 - RNA, 12 nt, Human
cccugaggccca

SEQ ID NO: 2713744 - RNA, 11 nt, Human
cccugccuccu

SEQ ID NO: 2713745 - RNA, 22 nt, Human
cccugcucuccgaccagacacc

SEQ ID NO: 2713746 - RNA, 21 nt, Human
cccugcucuccgaccagacac

SEQ ID NO: 2713747 - RNA, 21 nt, Human
cccuguagagugggagcugag

SEQ ID NO: 2713748 - RNA, 14 nt, Human
cccugguggcagug

SEQ ID NO: 2713749 - RNA, 13 nt, Human
cccugguggcagu

SEQ ID NO: 2713750 - RNA, 21 nt, Human
cccugguggcagcucaccucu

SEQ ID NO: 2713751 - RNA, 21 nt, Human
cccuggugaccagcaccaucu

SEQ ID NO: 2713752 - RNA, 13 nt, Human
cccuguucuggca

SEQ ID NO: 2713753 - RNA, 14 nt, Human
cccuguucuggcag

SEQ ID NO: 2713754 - RNA, 16 nt, Human
cccuguuuguuucuga

SEQ ID NO: 2713755 - RNA, 19 nt, Human
cccuguuuguuucugaaag

SEQ ID NO: 2713756 - RNA, 17 nt, Human
cccuuaccugccaggaa

SEQ ID NO: 2713757 - RNA, 20 nt, Human
cccuuaccugccaggaagcc

SEQ ID NO: 2713758 - RNA, 23 nt, Human
cccuuaccugccaggaagccagc

SEQ ID NO: 2713759 - RNA, 12 nt, Human
cccuuccaugga

SEQ ID NO: 2713760 - RNA, 23 nt, Human
cccuuagcagggaaacagcuaau

SEQ ID NO: 2713761 - RNA, 14 nt, Human
cccuuagcagggaa

SEQ ID NO: 2713762 - RNA, 15 nt, Human
cccuuacgugagucc

SEQ ID NO: 2713763 - RNA, 17 nt, Human
cccuuacgugaguccug

SEQ ID NO: 2713764 - RNA, 18 nt, Human
ccuacaggagugagcacu

SEQ ID NO: 2713765 - RNA, 21 nt, Human
ccuacaguugaaaaacagcug

SEQ ID NO: 2713766 - RNA, 23 nt, Human
ccuaggcauuugcugaauacaga

SEQ ID NO: 2713767 - RNA, 18 nt, Human
ccuaggugacagagugag

SEQ ID NO: 2713768 - RNA, 11 nt, Human
ccgcuggggcc

SEQ ID NO: 2713769 - RNA, 14 nt, Human
ccgcuggggccagu

SEQ ID NO: 2713770 - RNA, 18 nt, Human
ccgugaggccagagacac

SEQ ID NO: 2713771 - RNA, 18 nt, Human
ccgggcucugccucccau

SEQ ID NO: 2713772 - RNA, 13 nt, Human
ccgggcucugccu

SEQ ID NO: 2713773 - RNA, 14 nt, Human
ccgggcucugccuc

SEQ ID NO: 2713774 - RNA, 15 nt, Human
ccgggcucugccucc

SEQ ID NO: 2713775 - RNA, 16 nt, Human
ccggcuccaggcuccu

SEQ ID NO: 2713776 - RNA, 21 nt, Human
ccggcuccaggcuccuuuagc

SEQ ID NO: 2713777 - RNA, 20 nt, Human
ccgggcacucagaagacacu

SEQ ID NO: 2713778 - RNA, 22 nt, Human
ccgggcacucagaagacacuga

SEQ ID NO: 2713779 - RNA, 13 nt, Human
ccgggccacagag

SEQ ID NO: 2713780 - RNA, 19 nt, Human
ccgagcuuugaaaauucag

SEQ ID NO: 2713781 - RNA, 14 nt, Human
ccgaguagcuggga

SEQ ID NO: 2713782 - RNA, 16 nt, Human
ccgaguagcugggacu

SEQ ID NO: 2713783 - RNA, 23 nt, Human
ccgcacugggcuuggggaccaga

SEQ ID NO: 2713784 - RNA, 21 nt, Human
ccgagauugcaccacugcacu

SEQ ID NO: 2713785 - RNA, 15 nt, Human
ccgagauugcaccac

SEQ ID NO: 2713786 - RNA, 19 nt, Human
ccgagauugcaccacugca

SEQ ID NO: 2713787 - RNA, 15 nt, Human
ccccucggagaagag

SEQ ID NO: 2713788 - RNA, 13 nt, Human
ccccuccucugcu

SEQ ID NO: 2713789 - RNA, 14 nt, Human
ccccuccucugcuu

SEQ ID NO: 2713790 - RNA, 17 nt, Human
ccccuccucugcuugcc

SEQ ID NO: 2713791 - RNA, 12 nt, Human
ccccuccaugug

SEQ ID NO: 2713792 - RNA, 16 nt, Human
ccccucagggucccug

SEQ ID NO: 2713793 - RNA, 17 nt, Human
cccccugacaacacuca

SEQ ID NO: 2713794 - RNA, 19 nt, Human
cccccugacaacacucauu

SEQ ID NO: 2713795 - RNA, 12 nt, Human
cccccagccugc

SEQ ID NO: 2713796 - RNA, 16 nt, Human
ccccucaacaccucug

SEQ ID NO: 2713797 - RNA, 23 nt, Human
ccccucaacucuccuccagaguc

SEQ ID NO: 2713798 - RNA, 15 nt, Human
ccccucaacaccucu

SEQ ID NO: 2713799 - RNA, 14 nt, Human
ccccagugcccaca

SEQ ID NO: 2713800 - RNA, 15 nt, Human
ccccagugcccacag

SEQ ID NO: 2713801 - RNA, 16 nt, Human
ccccagugcccacagg

SEQ ID NO: 2713802 - RNA, 20 nt, Human
ccccagugcccacaggauca

SEQ ID NO: 2713803 - RNA, 24 nt, Human
cccccacccaagggccuggccuga

SEQ ID NO: 2713804 - RNA, 13 nt, Human
cccccacccaagg

SEQ ID NO: 2713805 - RNA, 14 nt, Human
ccccauccucugua

SEQ ID NO: 2713806 - RNA, 15 nt, Human
cccccacuggugaca

SEQ ID NO: 2713807 - RNA, 11 nt, Human
cccccacuggu

SEQ ID NO: 2713808 - RNA, 13 nt, Human
cccccacugguga

SEQ ID NO: 2713809 - RNA, 22 nt, Human
cccgaauagcugggacuacagg

SEQ ID NO: 2713810 - RNA, 13 nt, Human
ccccuuccaugga

SEQ ID NO: 2713811 - RNA, 20 nt, Human
ccccuuccauggacuuuguu

SEQ ID NO: 2713812 - RNA, 20 nt, Human
cccgcccaggcuuagucacu

SEQ ID NO: 2713813 - RNA, 22 nt, Human
cccgcccaggcuuagucacuga

SEQ ID NO: 2713814 - RNA, 23 nt, Human
cccgcuaagagggagggagggcu

SEQ ID NO: 2713815 - RNA, 17 nt, Human
ccccugcccggcugcgg

SEQ ID NO: 2713816 - RNA, 19 nt, Human
ccccugcccggcugcggaa

SEQ ID NO: 2713817 - RNA, 15 nt, Human
ccccuggaugcagcc

SEQ ID NO: 2713818 - RNA, 18 nt, Human
ccccuggaugcagccuca

SEQ ID NO: 2713819 - RNA, 19 nt, Human
ccccuggaugcagccucac

SEQ ID NO: 2713820 - RNA, 14 nt, Human
ccccugcugggugu

SEQ ID NO: 2713821 - RNA, 17 nt, Human
ccccugcuggguguggc

SEQ ID NO: 2713822 - RNA, 11 nt, Human
ccccugcuggu

SEQ ID NO: 2713823 - RNA, 13 nt, Human
ccccugcugguuc

SEQ ID NO: 2713824 - RNA, 15 nt, Human
ccccugcugguucag

SEQ ID NO: 2713825 - RNA, 20 nt, Human
ccccugcugguucaggguug

SEQ ID NO: 2713826 - RNA, 19 nt, Human
ccccaccgcagacaggacc

SEQ ID NO: 2713827 - RNA, 15 nt, Human
ccccaccgcagacag

SEQ ID NO: 2713828 - RNA, 23 nt, Human
cccauuauucaaaguugccuaaa

SEQ ID NO: 2713829 - RNA, 18 nt, Human
cccauuauucaaaguugc

SEQ ID NO: 2713830 - RNA, 16 nt, Human
ccccacccugccucac

SEQ ID NO: 2713831 - RNA, 21 nt, Human
ccccacccaagggccuggccu

SEQ ID NO: 2713832 - RNA, 19 nt, Human
cccaucucuacaaaaagca

SEQ ID NO: 2713833 - RNA, 14 nt, Human
cccaguugggugga

SEQ ID NO: 2713834 - RNA, 12 nt, Human
cccaucugugaa

SEQ ID NO: 2713835 - RNA, 14 nt, Human
cccaugagccucag

SEQ ID NO: 2713836 - RNA, 22 nt, Human
cccaugagccucagcauccugg

SEQ ID NO: 2713837 - RNA, 17 nt, Human
cucauuuccaagcaagu

SEQ ID NO: 2713838 - RNA, 18 nt, Human
cucauuugucacacacuu

SEQ ID NO: 2713839 - RNA, 21 nt, Human
cucauuugucacacacuuugg

SEQ ID NO: 2713840 - RNA, 13 nt, Human
cucauuuccaagc

SEQ ID NO: 2713841 - RNA, 14 nt, Human
cucauuuccaagca

SEQ ID NO: 2713842 - RNA, 12 nt, Human
cucauuuccaag

SEQ ID NO: 2713843 - RNA, 18 nt, Human
cuccaaaauaaaacuuuu

SEQ ID NO: 2713844 - RNA, 17 nt, Human
cuccaagcucccaggca

SEQ ID NO: 2713845 - RNA, 19 nt, Human
cucauugaccugaggcccu

SEQ ID NO: 2713846 - RNA, 21 nt, Human
cucauugaccugaggcccuuc

SEQ ID NO: 2713847 - RNA, 17 nt, Human
cucauugaccugaggcc

SEQ ID NO: 2713848 - RNA, 22 nt, Human
cucauucuccuuguguuacuaa

SEQ ID NO: 2713849 - RNA, 18 nt, Human
cucauucuccuuguguua

SEQ ID NO: 2713850 - RNA, 21 nt, Human
cucauaaaaagccugcaauuu

SEQ ID NO: 2713851 - RNA, 15 nt, Human
cuccagcucaccagc

SEQ ID NO: 2713852 - RNA, 16 nt, Human
cuccagcucaccagcc

SEQ ID NO: 2713853 - RNA, 18 nt, Human
cuccagcucaccagcccc

SEQ ID NO: 2713854 - RNA, 11 nt, Human
cuccagccccu

SEQ ID NO: 2713855 - RNA, 13 nt, Human
cuccagccccugg

SEQ ID NO: 2713856 - RNA, 14 nt, Human
cuccagccccugga

SEQ ID NO: 2713857 - RNA, 16 nt, Human
cuccagagucagaagu

SEQ ID NO: 2713858 - RNA, 14 nt, Human
cuccccucggagaa

SEQ ID NO: 2713859 - RNA, 14 nt, Human
cuccccugcugggu

SEQ ID NO: 2713860 - RNA, 21 nt, Human
cuccccugcuggguguggcgc

SEQ ID NO: 2713861 - RNA, 23 nt, Human
cuccccugcuggguguggcgcag

SEQ ID NO: 2713862 - RNA, 20 nt, Human
cucccgaauagcugggacua

SEQ ID NO: 2713863 - RNA, 23 nt, Human
cucccgaauagcugggacuacag

SEQ ID NO: 2713864 - RNA, 19 nt, Human
cucccgaauagcugggacu

SEQ ID NO: 2713865 - RNA, 15 nt, Human
cucccuucauccuuc

SEQ ID NO: 2713866 - RNA, 16 nt, Human
cucccaucacuucccu

SEQ ID NO: 2713867 - RNA, 14 nt, Human
cucccaucacccgc

SEQ ID NO: 2713868 - RNA, 20 nt, Human
cuccauuuaauaauuauaug

SEQ ID NO: 2713869 - RNA, 16 nt, Human
cucccaaagugcuggg

SEQ ID NO: 2713870 - RNA, 23 nt, Human
cucccaaagugcugggauuacag

SEQ ID NO: 2713871 - RNA, 15 nt, Human
cucccacaaaggaga

SEQ ID NO: 2713872 - RNA, 14 nt, Human
cucccaacucaccc

SEQ ID NO: 2713873 - RNA, 15 nt, Human
cucccaacucacccc

SEQ ID NO: 2713874 - RNA, 13 nt, Human
cuccauuuaauaa

SEQ ID NO: 2713875 - RNA, 22 nt, Human
cucaggaaaucaaauaugcaaa

SEQ ID NO: 2713876 - RNA, 24 nt, Human
cucagggucccugguggcagcuca

SEQ ID NO: 2713877 - RNA, 18 nt, Human
cucagggucccugguggc

SEQ ID NO: 2713878 - RNA, 14 nt, Human
cucagggccugguc

SEQ ID NO: 2713879 - RNA, 20 nt, Human
cucagggucccugguggcag

SEQ ID NO: 2713880 - RNA, 21 nt, Human
cucagggucccugguggcagc

SEQ ID NO: 2713881 - RNA, 22 nt, Human
cucagggucccugguggcagcu

SEQ ID NO: 2713882 - RNA, 21 nt, Human
cucagguggggucacucuggc

SEQ ID NO: 2713883 - RNA, 19 nt, Human
cucagguggggucacucug

SEQ ID NO: 2713884 - RNA, 20 nt, Human
cucagguggggucacucugg

SEQ ID NO: 2713885 - RNA, 22 nt, Human
cucaggugauccacccaccuca

SEQ ID NO: 2713886 - RNA, 23 nt, Human
cucaggugauccacccaccucag

SEQ ID NO: 2713887 - RNA, 18 nt, Human
cucagggccuggcucagg

SEQ ID NO: 2713888 - RNA, 19 nt, Human
cucagggccuggcucaggu

SEQ ID NO: 2713889 - RNA, 20 nt, Human
cucagggccuggcucaggug

SEQ ID NO: 2713890 - RNA, 15 nt, Human
cucaggcagguggga

SEQ ID NO: 2713891 - RNA, 18 nt, Human
cucaggcaggugggaugg

SEQ ID NO: 2713892 - RNA, 16 nt, Human
cucagaucuucugugg

SEQ ID NO: 2713893 - RNA, 22 nt, Human
cucagauuuuauuauguaaauc

SEQ ID NO: 2713894 - RNA, 18 nt, Human
cucagagagggugggagu

SEQ ID NO: 2713895 - RNA, 19 nt, Human
cucagagagggugggagug

SEQ ID NO: 2713896 - RNA, 23 nt, Human
cucagagagggugggagugggcc

SEQ ID NO: 2713897 - RNA, 16 nt, Human
cucacuguugcccagg

SEQ ID NO: 2713898 - RNA, 17 nt, Human
cucacuguugcccaggc

SEQ ID NO: 2713899 - RNA, 18 nt, Human
cucacuguugcccaggcu

SEQ ID NO: 2713900 - RNA, 19 nt, Human
cucacuguugcccaggcug

SEQ ID NO: 2713901 - RNA, 15 nt, Human
cucacugcagccuca

SEQ ID NO: 2713902 - RNA, 16 nt, Human
cucacugcagccucaa

SEQ ID NO: 2713903 - RNA, 14 nt, Human
cucacugcagccuc

SEQ ID NO: 2713904 - RNA, 14 nt, Human
cucacuguugccca

SEQ ID NO: 2713905 - RNA, 15 nt, Human
cucacuguugcccag

SEQ ID NO: 2713906 - RNA, 19 nt, Human
cucagcaaaagaugcuucu

SEQ ID NO: 2713907 - RNA, 20 nt, Human
cucagcaaaagaugcuucuc

SEQ ID NO: 2713908 - RNA, 23 nt, Human
cucagauuuuauuauguaaaucc

SEQ ID NO: 2713909 - RNA, 16 nt, Human
cucagcaggggagggu

SEQ ID NO: 2713910 - RNA, 13 nt, Human
cucagcauccugg

SEQ ID NO: 2713911 - RNA, 21 nt, Human
cucagcauccuggcacccggc

SEQ ID NO: 2713912 - RNA, 22 nt, Human
cucagcauccuggcacccggcc

SEQ ID NO: 2713913 - RNA, 15 nt, Human
cucagcauccuggca

SEQ ID NO: 2713914 - RNA, 13 nt, Human
cucagcggggaca

SEQ ID NO: 2713915 - RNA, 23 nt, Human
cucagcggggacagcuccuucug

SEQ ID NO: 2713916 - RNA, 14 nt, Human
cucagcggggacag

SEQ ID NO: 2713917 - RNA, 15 nt, Human
cucagcggggacagc

SEQ ID NO: 2713918 - RNA, 16 nt, Human
cucagcggggacagcu

SEQ ID NO: 2713919 - RNA, 18 nt, Human
cucagcggggacagcucc

SEQ ID NO: 2713920 - RNA, 19 nt, Human
cucagcggggacagcuccu

SEQ ID NO: 2713921 - RNA, 20 nt, Human
cucagcggggacagcuccuu

SEQ ID NO: 2713922 - RNA, 21 nt, Human
cucagcggggacagcuccuuc

SEQ ID NO: 2713923 - RNA, 13 nt, Human
cuauaauuuaaau

SEQ ID NO: 2713924 - RNA, 12 nt, Human
cuauaauuuaaa

SEQ ID NO: 2713925 - RNA, 20 nt, Human
cuaggaacacuccuucacag

SEQ ID NO: 2713926 - RNA, 15 nt, Human
cuaggaagacuuugg

SEQ ID NO: 2713927 - RNA, 17 nt, Human
cuaggaagacuuuggaa

SEQ ID NO: 2713928 - RNA, 19 nt, Human
cuauagccuaggugacaga

SEQ ID NO: 2713929 - RNA, 18 nt, Human
cuauagccuaggugacag

SEQ ID NO: 2713930 - RNA, 20 nt, Human
cuauagccuaggugacagag

SEQ ID NO: 2713931 - RNA, 21 nt, Human
cuauagccuaggugacagagu

SEQ ID NO: 2713932 - RNA, 19 nt, Human
cuaugaaauauuauguuaa

SEQ ID NO: 2713933 - RNA, 21 nt, Human
cuaugcauuugaaaauuuuga

SEQ ID NO: 2713934 - RNA, 13 nt, Human
cuaugcugaguuu

SEQ ID NO: 2713935 - RNA, 15 nt, Human
cuaugcugaguuugu

SEQ ID NO: 2713936 - RNA, 14 nt, Human
cuaugcugaguuug

SEQ ID NO: 2713937 - RNA, 13 nt, Human
cuauguaucaaug

SEQ ID NO: 2713938 - RNA, 17 nt, Human
cuauucaguaauaacuc

SEQ ID NO: 2713939 - RNA, 21 nt, Human
cuauucaggagaguagaacag

SEQ ID NO: 2713940 - RNA, 23 nt, Human
cuauucaguaauaacucuacccu

SEQ ID NO: 2713941 - RNA, 23 nt, Human
cucacacggacacucaaaagcug

SEQ ID NO: 2713942 - RNA, 16 nt, Human
cucaacucuccuccag

SEQ ID NO: 2713943 - RNA, 18 nt, Human
cucaacucuccuccagag

SEQ ID NO: 2713944 - RNA, 14 nt, Human
cucaaauuucuaaa

SEQ ID NO: 2713945 - RNA, 19 nt, Human
cuauuucuauauuuucauu

SEQ ID NO: 2713946 - RNA, 20 nt, Human
cuauuucuauauuuucauuc

SEQ ID NO: 2713947 - RNA, 13 nt, Human
cucaaauuucuaa

SEQ ID NO: 2713948 - RNA, 12 nt, Human
cucaaauuugga

SEQ ID NO: 2713949 - RNA, 17 nt, Human
cucaaauuucuaaaucu

SEQ ID NO: 2713950 - RNA, 15 nt, Human
cucaaauuucuaaau

SEQ ID NO: 2713951 - RNA, 14 nt, Human
cucaacucuccucc

SEQ ID NO: 2713952 - RNA, 16 nt, Human
cuauugcugcuugagg

SEQ ID NO: 2713953 - RNA, 18 nt, Human
cuauuguuagucucuuga

SEQ ID NO: 2713954 - RNA, 18 nt, Human
cuagaguuuagcuggaaa

SEQ ID NO: 2713955 - RNA, 15 nt, Human
cuagagguucaaaga

SEQ ID NO: 2713956 - RNA, 19 nt, Human
cuagaguuuagcuggaaaa

SEQ ID NO: 2713957 - RNA, 17 nt, Human
cuagagguucaaagaua

SEQ ID NO: 2713958 - RNA, 21 nt, Human
cuagagguucaaagauauuuu

SEQ ID NO: 2713959 - RNA, 18 nt, Human
cuagagguucaaagauau

SEQ ID NO: 2713960 - RNA, 18 nt, Human
cuagacuggugacugauu

SEQ ID NO: 2713961 - RNA, 17 nt, Human
cuagacuggugacugau

SEQ ID NO: 2713962 - RNA, 15 nt, Human
cuagacuggugacug

SEQ ID NO: 2713963 - RNA, 14 nt, Human
cuagacuggugacu

SEQ ID NO: 2713964 - RNA, 23 nt, Human
cuagacuggugacugauucuuca

SEQ ID NO: 2713965 - RNA, 22 nt, Human
cuagacuggugacugauucuuc

SEQ ID NO: 2713966 - RNA, 19 nt, Human
cuagacuggugacugauuc

SEQ ID NO: 2713967 - RNA, 20 nt, Human
cuacuguccuacccacccuc

SEQ ID NO: 2713968 - RNA, 19 nt, Human
cuacuguccuacccacccu

SEQ ID NO: 2713969 - RNA, 21 nt, Human
cuacuguaauuugugauacaa

SEQ ID NO: 2713970 - RNA, 12 nt, Human
cuacucuguguc

SEQ ID NO: 2713971 - RNA, 15 nt, Human
cuacucgaguuacag

SEQ ID NO: 2713972 - RNA, 16 nt, Human
cuacucgaguuacaga

SEQ ID NO: 2713973 - RNA, 19 nt, Human
cuacucgaguuacagacaa

SEQ ID NO: 2713974 - RNA, 14 nt, Human
cuaggaaauauuua

SEQ ID NO: 2713975 - RNA, 15 nt, Human
cuaggaaauauuuau

SEQ ID NO: 2713976 - RNA, 19 nt, Human
cuaggaaauauuuauuuua

SEQ ID NO: 2713977 - RNA, 20 nt, Human
cuaggaaauauuuauuuuaa

SEQ ID NO: 2713978 - RNA, 22 nt, Human
cuagcuaauguaauaacuguga

SEQ ID NO: 2713979 - RNA, 22 nt, Human
cuagccuuagaagucacacagu

SEQ ID NO: 2713980 - RNA, 23 nt, Human
cuagccuuagaagucacacagua

SEQ ID NO: 2713981 - RNA, 24 nt, Human
cuagauacuguaucaugacaaaga

SEQ ID NO: 2713982 - RNA, 16 nt, Human
cuagauacuguaucau

SEQ ID NO: 2713983 - RNA, 13 nt, Human
cuagauacuguau

SEQ ID NO: 2713984 - RNA, 19 nt, Human
cuagccugugccucuggga

SEQ ID NO: 2713985 - RNA, 21 nt, Human
cuagccugugccucugggacu

SEQ ID NO: 2713986 - RNA, 22 nt, Human
cuagccugugccucugggacug

SEQ ID NO: 2713987 - RNA, 21 nt, Human
cuagccuuagaagucacacag

SEQ ID NO: 2713988 - RNA, 19 nt, Human
cuaaguaaaaccacagcag

SEQ ID NO: 2713989 - RNA, 18 nt, Human
cuaaguaaaaccacagca

SEQ ID NO: 2713990 - RNA, 14 nt, Human
cuaaguaaaaccac

SEQ ID NO: 2713991 - RNA, 17 nt, Human
cuaauagacaauuuauu

SEQ ID NO: 2713992 - RNA, 23 nt, Human
cuaauagacaauuuauuauggca

SEQ ID NO: 2713993 - RNA, 19 nt, Human
cuaauagacaauuuauuau

SEQ ID NO: 2713994 - RNA, 21 nt, Human
cuaagcuucacuguaaaauaa

SEQ ID NO: 2713995 - RNA, 22 nt, Human
cuaagcuauucaguaauaacuc

SEQ ID NO: 2713996 - RNA, 16 nt, Human
cuaaggacuucuuuaa

SEQ ID NO: 2713997 - RNA, 15 nt, Human
cuaaggacuucuuua

SEQ ID NO: 2713998 - RNA, 14 nt, Human
cuaaggacuucuuu

SEQ ID NO: 2713999 - RNA, 23 nt, Human
cuacacgagauacagaauuuuau

SEQ ID NO: 2714000 - RNA, 14 nt, Human
cuacacuaagagag

SEQ ID NO: 2714001 - RNA, 21 nt, Human
cuacacacugcauguuuguga

SEQ ID NO: 2714002 - RNA, 21 nt, Human
cuacacaggggaaaagaggag

SEQ ID NO: 2714003 - RNA, 12 nt, Human
cuaaugggacac

SEQ ID NO: 2714004 - RNA, 13 nt, Human
cuaaugggacacu

SEQ ID NO: 2714005 - RNA, 18 nt, Human
cuaauauguaacaagcca

SEQ ID NO: 2714006 - RNA, 23 nt, Human
cgggaggauguucugggacacag

SEQ ID NO: 2714007 - RNA, 21 nt, Human
cgggaggauguucugggacac

SEQ ID NO: 2714008 - RNA, 22 nt, Human
cuaaaugaaaaucgugacaaca

SEQ ID NO: 2714009 - RNA, 21 nt, Human
cuaaaucuccaaaauaaaacu

SEQ ID NO: 2714010 - RNA, 21 nt, Human
cuaaaauggacuguggugacu

SEQ ID NO: 2714011 - RNA, 22 nt, Human
cuaaaauggacuguggugacuu

SEQ ID NO: 2714012 - RNA, 14 nt, Human
cuaagagagaauga

SEQ ID NO: 2714013 - RNA, 15 nt, Human
cuaagagagaaugag

SEQ ID NO: 2714014 - RNA, 16 nt, Human
cuaagauaguaacaau

SEQ ID NO: 2714015 - RNA, 23 nt, Human
cuaagagggagggagggcuccag

SEQ ID NO: 2714016 - RNA, 13 nt, Human
cuaagagggaggg

SEQ ID NO: 2714017 - RNA, 15 nt, Human
cuaagagggagggag

SEQ ID NO: 2714018 - RNA, 22 nt, Human
cuaagagggagggagggcucca

SEQ ID NO: 2714019 - RNA, 19 nt, Human
cuaaauucuuucauuuuag

SEQ ID NO: 2714020 - RNA, 16 nt, Human
cuaaauucaugcugcu

SEQ ID NO: 2714021 - RNA, 20 nt, Human
cuaaauuuuauaucuuguag

SEQ ID NO: 2714022 - RNA, 15 nt, Human
cuaaauuuuauaucu

SEQ ID NO: 2714023 - RNA, 16 nt, Human
cuaaauuuuauaucuu

SEQ ID NO: 2714024 - RNA, 13 nt, Human
cuaaauuuuauau

SEQ ID NO: 2714025 - RNA, 12 nt, Human
cuaaccacgcug

SEQ ID NO: 2714026 - RNA, 14 nt, Human
cuaaccacgcugga

SEQ ID NO: 2714027 - RNA, 16 nt, Human
cuacaggugugaguca

SEQ ID NO: 2714028 - RNA, 14 nt, Human
cuacaggugugagu

SEQ ID NO: 2714029 - RNA, 20 nt, Human
cuacauggaguauaugucaa

SEQ ID NO: 2714030 - RNA, 18 nt, Human
cuacauggaguauauguc

SEQ ID NO: 2714031 - RNA, 13 nt, Human
cuacaguccuccc

SEQ ID NO: 2714032 - RNA, 15 nt, Human
cuacaggcacccacc

SEQ ID NO: 2714033 - RNA, 17 nt, Human
cuacaggcacccaccau

SEQ ID NO: 2714034 - RNA, 14 nt, Human
cuacaggagugagc

SEQ ID NO: 2714035 - RNA, 15 nt, Human
cuacaggagugagca

SEQ ID NO: 2714036 - RNA, 16 nt, Human
cuacaggagugagcac

SEQ ID NO: 2714037 - RNA, 23 nt, Human
cuacagcuugaccgugaggccag

SEQ ID NO: 2714038 - RNA, 19 nt, Human
cuacagcuugaccgugagg

SEQ ID NO: 2714039 - RNA, 22 nt, Human
cuacagcuugaccgugaggcca

SEQ ID NO: 2714040 - RNA, 22 nt, Human
cuacagaggccaugggccuccu

SEQ ID NO: 2714041 - RNA, 18 nt, Human
cuacagaggccaugggcc

SEQ ID NO: 2714042 - RNA, 20 nt, Human
cuacagaggccaugggccuc

SEQ ID NO: 2714043 - RNA, 17 nt, Human
cuacagaggccaugggc

SEQ ID NO: 2714044 - RNA, 17 nt, Human
cuacacugugcugaguc

SEQ ID NO: 2714045 - RNA, 13 nt, Human
cuacacugugcug

SEQ ID NO: 2714046 - RNA, 14 nt, Human
cuacacugugcuga

SEQ ID NO: 2714047 - RNA, 17 nt, Human
cuacccucuuagaaaaa

SEQ ID NO: 2714048 - RNA, 12 nt, Human
cuacccaggugc

SEQ ID NO: 2714049 - RNA, 18 nt, Human
cuacccagcgagcccugg

SEQ ID NO: 2714050 - RNA, 13 nt, Human
cuacccaggugcu

SEQ ID NO: 2714051 - RNA, 15 nt, Human
cuacccagcgagccc

SEQ ID NO: 2714052 - RNA, 17 nt, Human
cuacccagcgagcccug

SEQ ID NO: 2714053 - RNA, 14 nt, Human
cuacauucuguuaa

SEQ ID NO: 2714054 - RNA, 13 nt, Human
cuacauucuguua

SEQ ID NO: 2714055 - RNA, 22 nt, Human
cuacauuauaaaugucucuuua

SEQ ID NO: 2714056 - RNA, 18 nt, Human
cuaccauccccuguagag

SEQ ID NO: 2714057 - RNA, 13 nt, Human
ccuuccaggggug

SEQ ID NO: 2714058 - RNA, 17 nt, Human
ccuuccauggacuuugu

SEQ ID NO: 2714059 - RNA, 12 nt, Human
ccuucucuccag

SEQ ID NO: 2714060 - RNA, 13 nt, Human
ccuucucuccagc

SEQ ID NO: 2714061 - RNA, 15 nt, Human
ccuucucuccagccc

SEQ ID NO: 2714062 - RNA, 16 nt, Human
ccuucucuccagcccc

SEQ ID NO: 2714063 - RNA, 20 nt, Human
ccugugccucugggacugga

SEQ ID NO: 2714064 - RNA, 20 nt, Human
ccugugggcccccaaaugga

SEQ ID NO: 2714065 - RNA, 20 nt, Human
ccuguggaugauaaaacaca

SEQ ID NO: 2714066 - RNA, 15 nt, Human
ccuuggacucauuuu

SEQ ID NO: 2714067 - RNA, 15 nt, Human
ccuuggauugucccc

SEQ ID NO: 2714068 - RNA, 22 nt, Human
ccuuggcucaaguccucuuuuc

SEQ ID NO: 2714069 - RNA, 18 nt, Human
ccuugacagggcacaccg

SEQ ID NO: 2714070 - RNA, 21 nt, Human
ccuugacagggcacaccgggc

SEQ ID NO: 2714071 - RNA, 17 nt, Human
ccuucucuccagccccu

SEQ ID NO: 2714072 - RNA, 18 nt, Human
ccuucucuccagccccug

SEQ ID NO: 2714073 - RNA, 19 nt, Human
ccuuggugucgggcaugac

SEQ ID NO: 2714074 - RNA, 20 nt, Human
ccuuggugucgggcaugaca

SEQ ID NO: 2714075 - RNA, 14 nt, Human
ccuuggcugcaggg

SEQ ID NO: 2714076 - RNA, 16 nt, Human
ccuuggcugcagggag

SEQ ID NO: 2714077 - RNA, 14 nt, Human
ccuuggggagcagg

SEQ ID NO: 2714078 - RNA, 19 nt, Human
ccuucucuccagccccugg

SEQ ID NO: 2714079 - RNA, 15 nt, Human
ccuuuuuuggcugcu

SEQ ID NO: 2714080 - RNA, 19 nt, Human
ccuuuuuuauacauaaaca

SEQ ID NO: 2714081 - RNA, 14 nt, Human
ccuuugugaggaag

SEQ ID NO: 2714082 - RNA, 22 nt, Human
ccuuuguccccaccgcagacag

SEQ ID NO: 2714083 - RNA, 23 nt, Human
ccuuuguccccaccgcagacagg

SEQ ID NO: 2714084 - RNA, 15 nt, Human
ccuuugugaggaagc

SEQ ID NO: 2714085 - RNA, 16 nt, Human
ccuuugugaggaagcc

SEQ ID NO: 2714086 - RNA, 17 nt, Human
ccuuugugaggaagccg

SEQ ID NO: 2714087 - RNA, 23 nt, Human
ccuuugugaggaagccgcugggg

SEQ ID NO: 2714088 - RNA, 24 nt, Human
ccuuuguauucucuccuguaccuc

SEQ ID NO: 2714089 - RNA, 23 nt, Human
ccuuuguauucucuccuguaccu

SEQ ID NO: 2714090 - RNA, 22 nt, Human
ccuuuguauucucuccuguacc

SEQ ID NO: 2714091 - RNA, 14 nt, Human
ccuuuguccccacc

SEQ ID NO: 2714092 - RNA, 16 nt, Human
ccuuuguccccaccgc

SEQ ID NO: 2714093 - RNA, 18 nt, Human
ccuuuguccccaccgcag

SEQ ID NO: 2714094 - RNA, 23 nt, Human
cgaaagggacuuggaagcuccgc

SEQ ID NO: 2714095 - RNA, 17 nt, Human
ccuuuuuuggcugcuga

SEQ ID NO: 2714096 - RNA, 18 nt, Human
ccuuuuuuggcugcugaa

SEQ ID NO: 2714097 - RNA, 20 nt, Human
ccuuuuuuggcugcugaagg

SEQ ID NO: 2714098 - RNA, 22 nt, Human
ccuuuuuuggcugcugaaggcu

SEQ ID NO: 2714099 - RNA, 23 nt, Human
cgaacauguuuuucuucucccuc

SEQ ID NO: 2714100 - RNA, 21 nt, Human
cgaacauguuuuucuucuccc

SEQ ID NO: 2714101 - RNA, 23 nt, Human
cgaagaguauuuuugacagaaua

SEQ ID NO: 2714102 - RNA, 15 nt, Human
cgaauauugcugaug

SEQ ID NO: 2714103 - RNA, 17 nt, Human
cgaauauugcugauggu

SEQ ID NO: 2714104 - RNA, 15 nt, Human
cgaauagcugggacu

SEQ ID NO: 2714105 - RNA, 16 nt, Human
cgaauagcugggacua

SEQ ID NO: 2714106 - RNA, 11 nt, Human
cgaauauugcu

SEQ ID NO: 2714107 - RNA, 12 nt, Human
cgaauauugcug

SEQ ID NO: 2714108 - RNA, 14 nt, Human
cgaauauugcugau

SEQ ID NO: 2714109 - RNA, 19 nt, Human
cgcugugcugcccugccca

SEQ ID NO: 2714110 - RNA, 21 nt, Human
cgcugugcugcccugcccacc

SEQ ID NO: 2714111 - RNA, 23 nt, Human
cgcugugcugcccugcccaccug

SEQ ID NO: 2714112 - RNA, 11 nt, Human
cgcugugcugc

SEQ ID NO: 2714113 - RNA, 13 nt, Human
cgcugugcugccc

SEQ ID NO: 2714114 - RNA, 14 nt, Human
cgcugugcugcccu

SEQ ID NO: 2714115 - RNA, 14 nt, Human
cgcuuucuacccag

SEQ ID NO: 2714116 - RNA, 16 nt, Human
cgcuuucuacccagcg

SEQ ID NO: 2714117 - RNA, 20 nt, Human
cggacagccacggccaggcc

SEQ ID NO: 2714118 - RNA, 14 nt, Human
cggaauaguuggcu

SEQ ID NO: 2714119 - RNA, 16 nt, Human
cggaauaguuggcuag

SEQ ID NO: 2714120 - RNA, 17 nt, Human
cggaauaguuggcuagg

SEQ ID NO: 2714121 - RNA, 17 nt, Human
cggagaaaggaagggcu

SEQ ID NO: 2714122 - RNA, 15 nt, Human
cggagaaaggaaggg

SEQ ID NO: 2714123 - RNA, 21 nt, Human
cggacagccacggccaggcca

SEQ ID NO: 2714124 - RNA, 22 nt, Human
cggacagccacggccaggccag

SEQ ID NO: 2714125 - RNA, 18 nt, Human
cgcagcccugcagagggc

SEQ ID NO: 2714126 - RNA, 19 nt, Human
cgcagcccugcagagggca

SEQ ID NO: 2714127 - RNA, 13 nt, Human
cgcccagucugga

SEQ ID NO: 2714128 - RNA, 19 nt, Human
cgcccagucuggaaugcag

SEQ ID NO: 2714129 - RNA, 21 nt, Human
cgcccagucuggaaugcagug

SEQ ID NO: 2714130 - RNA, 12 nt, Human
cgcccagucugg

SEQ ID NO: 2714131 - RNA, 14 nt, Human
cgcgacaaugcaaa

SEQ ID NO: 2714132 - RNA, 19 nt, Human
cgcgguggcucacgccugu

SEQ ID NO: 2714133 - RNA, 17 nt, Human
cgcuacccgggaagggg

SEQ ID NO: 2714134 - RNA, 18 nt, Human
cgcuacccgggaaggggg

SEQ ID NO: 2714135 - RNA, 21 nt, Human
cgcuacccgggaagggggcug

SEQ ID NO: 2714136 - RNA, 24 nt, Human
cgcuacccgggaagggggcuggga

SEQ ID NO: 2714137 - RNA, 19 nt, Human
cgcuaaacuuuucugauag

SEQ ID NO: 2714138 - RNA, 18 nt, Human
cgcuaaacuuuucugaua

SEQ ID NO: 2714139 - RNA, 17 nt, Human
cgcuaaacuuuucugau

SEQ ID NO: 2714140 - RNA, 22 nt, Human
cgcguugaaauuguaauuauau

SEQ ID NO: 2714141 - RNA, 24 nt, Human
cgcguugaaauuguaauuauaucu

SEQ ID NO: 2714142 - RNA, 23 nt, Human
cggcuggcagcccaccccucaac

SEQ ID NO: 2714143 - RNA, 13 nt, Human
cggcuggccuggc

SEQ ID NO: 2714144 - RNA, 16 nt, Human
cgggaagggggcuggg

SEQ ID NO: 2714145 - RNA, 19 nt, Human
cgggaagggggcugggaca

SEQ ID NO: 2714146 - RNA, 20 nt, Human
cgggaagggggcugggacau

SEQ ID NO: 2714147 - RNA, 12 nt, Human
cggccaggccag

SEQ ID NO: 2714148 - RNA, 20 nt, Human
cggccaggccagagggagug

SEQ ID NO: 2714149 - RNA, 11 nt, Human
cggccaggcca

SEQ ID NO: 2714150 - RNA, 14 nt, Human
cggcuggcagccca

SEQ ID NO: 2714151 - RNA, 13 nt, Human
cgcacugggcuug

SEQ ID NO: 2714152 - RNA, 17 nt, Human
cgcacugggcuugggga

SEQ ID NO: 2714153 - RNA, 19 nt, Human
cgcagcauauucaggaagc

SEQ ID NO: 2714154 - RNA, 20 nt, Human
cgcagcauauucaggaagcu

SEQ ID NO: 2714155 - RNA, 15 nt, Human
cgcagcccugcagag

SEQ ID NO: 2714156 - RNA, 17 nt, Human
cgcagcccugcagaggg

SEQ ID NO: 2714157 - RNA, 16 nt, Human
cgaggacagggaggug

SEQ ID NO: 2714158 - RNA, 18 nt, Human
cgagcccugguggcagug

SEQ ID NO: 2714159 - RNA, 14 nt, Human
cgaggacagggagg

SEQ ID NO: 2714160 - RNA, 19 nt, Human
cgagcccugguggcagugg

SEQ ID NO: 2714161 - RNA, 13 nt, Human
ccugggcagcugc

SEQ ID NO: 2714162 - RNA, 14 nt, Human
ccugggcagcugcc

SEQ ID NO: 2714163 - RNA, 19 nt, Human
ccugggggcugggcagagg

SEQ ID NO: 2714164 - RNA, 20 nt, Human
ccugggggcugggcagagga

SEQ ID NO: 2714165 - RNA, 21 nt, Human
ccugggggcugggcagaggaa

SEQ ID NO: 2714166 - RNA, 18 nt, Human
ccugggggcugggcagag

SEQ ID NO: 2714167 - RNA, 22 nt, Human
ccugggaggucaaggcugcagu

SEQ ID NO: 2714168 - RNA, 16 nt, Human
ccugggagugagcugg

SEQ ID NO: 2714169 - RNA, 16 nt, Human
ccugggcagaaggaag

SEQ ID NO: 2714170 - RNA, 18 nt, Human
ccugggagugagcugguu

SEQ ID NO: 2714171 - RNA, 15 nt, Human
ccugggcagaaggaa

SEQ ID NO: 2714172 - RNA, 16 nt, Human
ccuggcccacugcauc

SEQ ID NO: 2714173 - RNA, 13 nt, Human
ccuggcccacugc

SEQ ID NO: 2714174 - RNA, 14 nt, Human
ccuggcccacugca

SEQ ID NO: 2714175 - RNA, 21 nt, Human
ccuggccagaugcaccagccc

SEQ ID NO: 2714176 - RNA, 23 nt, Human
ccuggccagaugcaccagcccuu

SEQ ID NO: 2714177 - RNA, 20 nt, Human
ccuggccagaugcaccagcc

SEQ ID NO: 2714178 - RNA, 13 nt, Human
ccuggcaugggaa

SEQ ID NO: 2714179 - RNA, 23 nt, Human
ccuggcaugggaaugaaugucag

SEQ ID NO: 2714180 - RNA, 13 nt, Human
ccuggcacugcuu

SEQ ID NO: 2714181 - RNA, 16 nt, Human
ccuggcacugcuucca

SEQ ID NO: 2714182 - RNA, 17 nt, Human
ccugcuaauuccccaga

SEQ ID NO: 2714183 - RNA, 21 nt, Human
ccugcuaauuccccagauugc

SEQ ID NO: 2714184 - RNA, 20 nt, Human
ccugccuguugggccaggag

SEQ ID NO: 2714185 - RNA, 18 nt, Human
ccugccuguugggccagg

SEQ ID NO: 2714186 - RNA, 19 nt, Human
ccugccuguugggccagga

SEQ ID NO: 2714187 - RNA, 19 nt, Human
ccuggcacccggccccugc

SEQ ID NO: 2714188 - RNA, 20 nt, Human
ccuggcacccggccccugcu

SEQ ID NO: 2714189 - RNA, 21 nt, Human
ccuggcacccggccccugcug

SEQ ID NO: 2714190 - RNA, 12 nt, Human
ccuggcacugcu

SEQ ID NO: 2714191 - RNA, 18 nt, Human
ccuggcacccggccccug

SEQ ID NO: 2714192 - RNA, 22 nt, Human
ccuggcacuauaauguaagcuc

SEQ ID NO: 2714193 - RNA, 14 nt, Human
ccuggcaugggaau

SEQ ID NO: 2714194 - RNA, 14 nt, Human
ccugguggcagcug

SEQ ID NO: 2714195 - RNA, 22 nt, Human
ccugguggcagcucaccucucc

SEQ ID NO: 2714196 - RNA, 19 nt, Human
ccugguggcagcucaccuc

SEQ ID NO: 2714197 - RNA, 21 nt, Human
ccugguggcagcucaccucuc

SEQ ID NO: 2714198 - RNA, 15 nt, Human
ccugguggcagcugc

SEQ ID NO: 2714199 - RNA, 16 nt, Human
ccugguggcagcugcg

SEQ ID NO: 2714200 - RNA, 17 nt, Human
ccugguggcagcugcgg

SEQ ID NO: 2714201 - RNA, 18 nt, Human
ccugguggcagcugcggu

SEQ ID NO: 2714202 - RNA, 15 nt, Human
ccuguagagugggag

SEQ ID NO: 2714203 - RNA, 16 nt, Human
ccuguagagugggagc

SEQ ID NO: 2714204 - RNA, 13 nt, Human
ccuguagcccuaa

SEQ ID NO: 2714205 - RNA, 13 nt, Human
ccugguggcagug

SEQ ID NO: 2714206 - RNA, 14 nt, Human
ccugguggcagugg

SEQ ID NO: 2714207 - RNA, 10 nt, Human
ccuguaccuc

SEQ ID NO: 2714208 - RNA, 12 nt, Human
ccugucccccug

SEQ ID NO: 2714209 - RNA, 13 nt, Human
ccugucccccuga

SEQ ID NO: 2714210 - RNA, 14 nt, Human
ccugucccccugac

SEQ ID NO: 2714211 - RNA, 15 nt, Human
ccugucccccugaca

SEQ ID NO: 2714212 - RNA, 14 nt, Human
ccugcccggcugcg

SEQ ID NO: 2714213 - RNA, 16 nt, Human
ccugcccggcugcgga

SEQ ID NO: 2714214 - RNA, 12 nt, Human
ccugccaggcau

SEQ ID NO: 2714215 - RNA, 22 nt, Human
ccugccagggacagagggggug

SEQ ID NO: 2714216 - RNA, 11 nt, Human
ccugcccugug

SEQ ID NO: 2714217 - RNA, 12 nt, Human
ccugcccugugg

SEQ ID NO: 2714218 - RNA, 14 nt, Human
ccugcccugugggc

SEQ ID NO: 2714219 - RNA, 15 nt, Human
ccugcccugugggcc

SEQ ID NO: 2714220 - RNA, 19 nt, Human
ccugcccuuaccugccagg

SEQ ID NO: 2714221 - RNA, 21 nt, Human
ccugcccuuaccugccaggaa

SEQ ID NO: 2714222 - RNA, 22 nt, Human
ccugcccuuaccugccaggaag

SEQ ID NO: 2714223 - RNA, 13 nt, Human
ccugccucagccu

SEQ ID NO: 2714224 - RNA, 14 nt, Human
ccugccucagccuc

SEQ ID NO: 2714225 - RNA, 12 nt, Human
ccugccucagcc

SEQ ID NO: 2714226 - RNA, 14 nt, Human
ccugccuguugggc

SEQ ID NO: 2714227 - RNA, 22 nt, Human
ccugccuguugggccaggagcc

SEQ ID NO: 2714228 - RNA, 15 nt, Human
ccugaggcugggcuc

SEQ ID NO: 2714229 - RNA, 13 nt, Human
ccugaggcugggc

SEQ ID NO: 2714230 - RNA, 14 nt, Human
ccugaggcugggcu

SEQ ID NO: 2714231 - RNA, 12 nt, Human
ccugagcuggga

SEQ ID NO: 2714232 - RNA, 15 nt, Human
ccugaggcccagagg

SEQ ID NO: 2714233 - RNA, 16 nt, Human
ccugaggcccagaggg

SEQ ID NO: 2714234 - RNA, 17 nt, Human
ccugaggcccagagggc

SEQ ID NO: 2714235 - RNA, 18 nt, Human
ccugaggcccagagggcc

SEQ ID NO: 2714236 - RNA, 22 nt, Human
ccugaagucuuuguacagacaa

SEQ ID NO: 2714237 - RNA, 20 nt, Human
ccugaagucacacagugagu

SEQ ID NO: 2714238 - RNA, 19 nt, Human
ccugaagucacacagugag

SEQ ID NO: 2714239 - RNA, 15 nt, Human
ccugagccagauuuc

SEQ ID NO: 2714240 - RNA, 12 nt, Human
ccugagccagau

SEQ ID NO: 2714241 - RNA, 16 nt, Human
ccugagccagauuuca

SEQ ID NO: 2714242 - RNA, 18 nt, Human
ccugagccagauuucacu

SEQ ID NO: 2714243 - RNA, 19 nt, Human
ccugccaauggacuaacuu

SEQ ID NO: 2714244 - RNA, 16 nt, Human
ccugccacccugggga

SEQ ID NO: 2714245 - RNA, 22 nt, Human
ccugccacccuggggagaaagu

SEQ ID NO: 2714246 - RNA, 14 nt, Human
ccugccacccuggg

SEQ ID NO: 2714247 - RNA, 12 nt, Human
ccugccacccug

SEQ ID NO: 2714248 - RNA, 13 nt, Human
ccugccacccugg

SEQ ID NO: 2714249 - RNA, 13 nt, Human
ccugaaagcccug

SEQ ID NO: 2714250 - RNA, 14 nt, Human
ccugaaagcccuga

SEQ ID NO: 2714251 - RNA, 18 nt, Human
ccugaaagcccugagcuu

SEQ ID NO: 2714252 - RNA, 14 nt, Human
ccugaaggccccgc

SEQ ID NO: 2714253 - RNA, 18 nt, Human
ccugaaggccccgcccag

SEQ ID NO: 2714254 - RNA, 19 nt, Human
ccugaaggccccgcccagg

SEQ ID NO: 2714255 - RNA, 22 nt, Human
ccugaaggccccgcccaggcuu

SEQ ID NO: 2714256 - RNA, 20 nt, Human
ccugaaggccccgcccaggc

SEQ ID NO: 2714257 - RNA, 21 nt, Human
ccugaaggccccgcccaggcu

SEQ ID NO: 2714258 - RNA, 15 nt, Human
ccugagcugggauga

SEQ ID NO: 2714259 - RNA, 16 nt, Human
gaaacacaacuauauu

SEQ ID NO: 2714260 - RNA, 11 nt, Human
gaaacauuugg

SEQ ID NO: 2714261 - RNA, 21 nt, Human
gaaacaagucagucauucaga

SEQ ID NO: 2714262 - RNA, 20 nt, Human
gaaaaugauacgcaacauaa

SEQ ID NO: 2714263 - RNA, 13 nt, Human
gaaacccagcucu

SEQ ID NO: 2714264 - RNA, 14 nt, Human
gaaacccagcucug

SEQ ID NO: 2714265 - RNA, 15 nt, Human
gaaacccagcucugg

SEQ ID NO: 2714266 - RNA, 16 nt, Human
gaaacccagcucuggu

SEQ ID NO: 2714267 - RNA, 18 nt, Human
gaaacccagcucuggucc

SEQ ID NO: 2714268 - RNA, 19 nt, Human
gaaacccagcucuggucca

SEQ ID NO: 2714269 - RNA, 23 nt, Human
gaaacucguuaauuuguaguguu

SEQ ID NO: 2714270 - RNA, 18 nt, Human
gaaacggaugauuucuau

SEQ ID NO: 2714271 - RNA, 17 nt, Human
gaaacggaugauuucua

SEQ ID NO: 2714272 - RNA, 23 nt, Human
gaaacccagcucugguccauaga

SEQ ID NO: 2714273 - RNA, 17 nt, Human
gaaagagaacuuccaga

SEQ ID NO: 2714274 - RNA, 19 nt, Human
gaaagacuuuuccaacccu

SEQ ID NO: 2714275 - RNA, 17 nt, Human
gaaagacuguacaaagu

SEQ ID NO: 2714276 - RNA, 20 nt, Human
gaaagaggcagcuugaaacu

SEQ ID NO: 2714277 - RNA, 15 nt, Human
gaaagaguaggaaga

SEQ ID NO: 2714278 - RNA, 16 nt, Human
gaaagaguaggaagac

SEQ ID NO: 2714279 - RNA, 21 nt, Human
gaaagcccugagcuuucugcu

SEQ ID NO: 2714280 - RNA, 22 nt, Human
gaaagcccugagcuuucugcua

SEQ ID NO: 2714281 - RNA, 17 nt, Human
gaaagcccugagcuuuc

SEQ ID NO: 2714282 - RNA, 18 nt, Human
gaaaaucuuauaauuuaa

SEQ ID NO: 2714283 - RNA, 20 nt, Human
gaaaaucagccugcuccagc

SEQ ID NO: 2714284 - RNA, 22 nt, Human
gaaaaucagccugcuccagcug

SEQ ID NO: 2714285 - RNA, 18 nt, Human
gaaaauauuuguaucaca

SEQ ID NO: 2714286 - RNA, 21 nt, Human
gaaaauauuauguguuuccau

SEQ ID NO: 2714287 - RNA, 23 nt, Human
gaaaaguuuaauauuaaagccau

SEQ ID NO: 2714288 - RNA, 22 nt, Human
gaaaacacuguucucugcccuc

SEQ ID NO: 2714289 - RNA, 24 nt, Human
gaaaacacuguucucugcccucca

SEQ ID NO: 2714290 - RNA, 19 nt, Human
gaaaagcugcugacagugu

SEQ ID NO: 2714291 - RNA, 19 nt, Human
gaaaacguggcugcuucaa

SEQ ID NO: 2714292 - RNA, 20 nt, Human
gaaaacguggcugcuucaag

SEQ ID NO: 2714293 - RNA, 22 nt, Human
gaaaacguggcugcuucaagga

SEQ ID NO: 2714294 - RNA, 14 nt, Human
gaaaaguugaauuu

SEQ ID NO: 2714295 - RNA, 15 nt, Human
gaaaaguugaauuuu

SEQ ID NO: 2714296 - RNA, 15 nt, Human
gaaaaguuuaauauu

SEQ ID NO: 2714297 - RNA, 22 nt, Human
gaaaaguuuaauauuaaagcca

SEQ ID NO: 2714298 - RNA, 21 nt, Human
gaaaaguuuaauauuaaagcc

SEQ ID NO: 2714299 - RNA, 20 nt, Human
gaaaaguuuaauauuaaagc

SEQ ID NO: 2714300 - RNA, 19 nt, Human
gaaaaguuuaauauuaaag

SEQ ID NO: 2714301 - RNA, 18 nt, Human
cuuuguuaguuucuccaa

SEQ ID NO: 2714302 - RNA, 12 nt, Human
cuuuuguucuug

SEQ ID NO: 2714303 - RNA, 11 nt, Human
cuuuuguucuu

SEQ ID NO: 2714304 - RNA, 16 nt, Human
cuuuuuuggcugcuga

SEQ ID NO: 2714305 - RNA, 12 nt, Human
gaaaaaggagga

SEQ ID NO: 2714306 - RNA, 15 nt, Human
gaaaaaggaggaaga

SEQ ID NO: 2714307 - RNA, 14 nt, Human
gaaaacacauuuuu

SEQ ID NO: 2714308 - RNA, 18 nt, Human
gaaaacacauuuuucuua

SEQ ID NO: 2714309 - RNA, 19 nt, Human
gaaaacacauuuuucuuag

SEQ ID NO: 2714310 - RNA, 20 nt, Human
cuuuuuggcauaacauaaau

SEQ ID NO: 2714311 - RNA, 16 nt, Human
cuuuuuggcauaacau

SEQ ID NO: 2714312 - RNA, 22 nt, Human
cuuuuuggcauaacauaaaucu

SEQ ID NO: 2714313 - RNA, 17 nt, Human
cuuuuuuggcugcugaa

SEQ ID NO: 2714314 - RNA, 20 nt, Human
cuuuuuuggcugcugaaggc

SEQ ID NO: 2714315 - RNA, 22 nt, Human
cuuuuuuggcugcugaaggcuc

SEQ ID NO: 2714316 - RNA, 19 nt, Human
cuugaguuuaaauuguaau

SEQ ID NO: 2714317 - RNA, 23 nt, Human
cuuggggggcugaggugggagga

SEQ ID NO: 2714318 - RNA, 22 nt, Human
cuuggggggcugaggugggagg

SEQ ID NO: 2714319 - RNA, 16 nt, Human
cuuguaaauagcucag

SEQ ID NO: 2714320 - RNA, 17 nt, Human
cuuguaaauagcucagg

SEQ ID NO: 2714321 - RNA, 18 nt, Human
cuuguaaauagcucaggu

SEQ ID NO: 2714322 - RNA, 12 nt, Human
cuuguacauaau

SEQ ID NO: 2714323 - RNA, 15 nt, Human
cuuguacauaaugcg

SEQ ID NO: 2714324 - RNA, 22 nt, Human
cuuguacauaaugcgugcauac

SEQ ID NO: 2714325 - RNA, 21 nt, Human
cuuguacauaaugcgugcaua

SEQ ID NO: 2714326 - RNA, 19 nt, Human
cuuguacauaaugcgugca

SEQ ID NO: 2714327 - RNA, 23 nt, Human
cuugucaauaaaauccauacauu

SEQ ID NO: 2714328 - RNA, 12 nt, Human
cuuguguaaaua

SEQ ID NO: 2714329 - RNA, 21 nt, Human
cuuguguaaauacaauuuugu

SEQ ID NO: 2714330 - RNA, 16 nt, Human
cuuguguaaauacaau

SEQ ID NO: 2714331 - RNA, 14 nt, Human
cuuguguaaauaca

SEQ ID NO: 2714332 - RNA, 22 nt, Human
cuuguuagaucuaguucacucu

SEQ ID NO: 2714333 - RNA, 13 nt, Human
cuuuacuauggcc

SEQ ID NO: 2714334 - RNA, 22 nt, Human
cuuuaccuuuuuuauacauaaa

SEQ ID NO: 2714335 - RNA, 21 nt, Human
cuuuaucaaagggugaaaauu

SEQ ID NO: 2714336 - RNA, 22 nt, Human
cuuuaucaaagggugaaaauua

SEQ ID NO: 2714337 - RNA, 19 nt, Human
cuuuauaauucuacuuuga

SEQ ID NO: 2714338 - RNA, 13 nt, Human
cuuuauaauucua

SEQ ID NO: 2714339 - RNA, 14 nt, Human
cuuuagcgcccagu

SEQ ID NO: 2714340 - RNA, 15 nt, Human
cuuuagcgcccaguu

SEQ ID NO: 2714341 - RNA, 15 nt, Human
cuuuaugcacaaaau

SEQ ID NO: 2714342 - RNA, 14 nt, Human
cuuuguccccaccg

SEQ ID NO: 2714343 - RNA, 19 nt, Human
cuuuggcuauuagagauca

SEQ ID NO: 2714344 - RNA, 20 nt, Human
cuuugucuacaccauuaugu

SEQ ID NO: 2714345 - RNA, 15 nt, Human
cuuuguccccaccgc

SEQ ID NO: 2714346 - RNA, 23 nt, Human
cuuugucuacaccauuaugugcg

SEQ ID NO: 2714347 - RNA, 22 nt, Human
cuuugugcugggguuaucugaa

SEQ ID NO: 2714348 - RNA, 20 nt, Human
cuuugugcugggguuaucug

SEQ ID NO: 2714349 - RNA, 15 nt, Human
cuuugugcugggguu

SEQ ID NO: 2714350 - RNA, 15 nt, Human
cuuugugaggaagcc

SEQ ID NO: 2714351 - RNA, 15 nt, Human
cuuugaccucugcag

SEQ ID NO: 2714352 - RNA, 14 nt, Human
cuuugaccucugca

SEQ ID NO: 2714353 - RNA, 24 nt, Human
cuuugaccucugcagcaauaaagc

SEQ ID NO: 2714354 - RNA, 20 nt, Human
cuuugaccucugcagcaaua

SEQ ID NO: 2714355 - RNA, 18 nt, Human
cuuugaccucugcagcaa

SEQ ID NO: 2714356 - RNA, 17 nt, Human
cuuugaccucugcagca

SEQ ID NO: 2714357 - RNA, 16 nt, Human
cuuugcagacaggcaa

SEQ ID NO: 2714358 - RNA, 13 nt, Human
cuuugaccucugc

SEQ ID NO: 2714359 - RNA, 20 nt, Human
cuuugcagacaggcaagcac

SEQ ID NO: 2714360 - RNA, 15 nt, Human
cuuuccaggaaggcu

SEQ ID NO: 2714361 - RNA, 15 nt, Human
cuuuccaucuacccu

SEQ ID NO: 2714362 - RNA, 12 nt, Human
cuuuccugaggc

SEQ ID NO: 2714363 - RNA, 16 nt, Human
cuuucccucccuuccu

SEQ ID NO: 2714364 - RNA, 14 nt, Human
cuuucccucccuuc

SEQ ID NO: 2714365 - RNA, 13 nt, Human
cuuucccucccuu

SEQ ID NO: 2714366 - RNA, 11 nt, Human
cuuucccuccc

SEQ ID NO: 2714367 - RNA, 16 nt, Human
cuuucugcuuguguua

SEQ ID NO: 2714368 - RNA, 16 nt, Human
cuuucucuuucguuac

SEQ ID NO: 2714369 - RNA, 13 nt, Human
cuuuccugaggcu

SEQ ID NO: 2714370 - RNA, 15 nt, Human
cuuuccugaggcugg

SEQ ID NO: 2714371 - RNA, 20 nt, Human
cuuucuggcuaugcauuuga

SEQ ID NO: 2714372 - RNA, 19 nt, Human
cuuucuggcuaugcauuug

SEQ ID NO: 2714373 - RNA, 18 nt, Human
cuuucuggcuaugcauuu

SEQ ID NO: 2714374 - RNA, 17 nt, Human
cuuucuggcuaugcauu

SEQ ID NO: 2714375 - RNA, 14 nt, Human
cuuauuucauuucu

SEQ ID NO: 2714376 - RNA, 18 nt, Human
cuuauuuaaugaaagacu

SEQ ID NO: 2714377 - RNA, 17 nt, Human
cuuauuuaaugaaagac

SEQ ID NO: 2714378 - RNA, 15 nt, Human
cuuauuucauuucuu

SEQ ID NO: 2714379 - RNA, 23 nt, Human
cuucacagaugggugcuuggagg

SEQ ID NO: 2714380 - RNA, 10 nt, Human
cuucaaggau

SEQ ID NO: 2714381 - RNA, 16 nt, Human
cuucaaggauccugag

SEQ ID NO: 2714382 - RNA, 13 nt, Human
cuucaaggauccu

SEQ ID NO: 2714383 - RNA, 15 nt, Human
cuucaaggauccuga

SEQ ID NO: 2714384 - RNA, 20 nt, Human
cuuagaugcaguucugaaga

SEQ ID NO: 2714385 - RNA, 16 nt, Human
cuguucuggcagaguu

SEQ ID NO: 2714386 - RNA, 22 nt, Human
cuuagaugcaguucugaagaag

SEQ ID NO: 2714387 - RNA, 13 nt, Human
cuuagauguauau

SEQ ID NO: 2714388 - RNA, 16 nt, Human
cuuagucacugagaca

SEQ ID NO: 2714389 - RNA, 18 nt, Human
cuuagucacugagacagc

SEQ ID NO: 2714390 - RNA, 19 nt, Human
cuuagucacugagacagcc

SEQ ID NO: 2714391 - RNA, 14 nt, Human
cuuagucacugaga

SEQ ID NO: 2714392 - RNA, 15 nt, Human
cuuauacauuugaua

SEQ ID NO: 2714393 - RNA, 19 nt, Human
cuuauaucuauauuuuaca

SEQ ID NO: 2714394 - RNA, 13 nt, Human
cuucccuuucugc

SEQ ID NO: 2714395 - RNA, 17 nt, Human
cuucccuacaguugaaa

SEQ ID NO: 2714396 - RNA, 21 nt, Human
cuuccaggggugggacacccu

SEQ ID NO: 2714397 - RNA, 17 nt, Human
cuuccaggggugggaca

SEQ ID NO: 2714398 - RNA, 14 nt, Human
cuuccagggguggg

SEQ ID NO: 2714399 - RNA, 15 nt, Human
cuuccagggguggga

SEQ ID NO: 2714400 - RNA, 19 nt, Human
cuuccaggcugggagagcc

SEQ ID NO: 2714401 - RNA, 15 nt, Human
cuuccaggcugggag

SEQ ID NO: 2714402 - RNA, 16 nt, Human
cuuccaggcugggaga

SEQ ID NO: 2714403 - RNA, 12 nt, Human
cuuccaggcugg

SEQ ID NO: 2714404 - RNA, 14 nt, Human
cuuccaggcuggga

SEQ ID NO: 2714405 - RNA, 16 nt, Human
cuuccacaagagccca

SEQ ID NO: 2714406 - RNA, 17 nt, Human
cuuccacaagagcccag

SEQ ID NO: 2714407 - RNA, 19 nt, Human
cuuccacaagagcccaggc

SEQ ID NO: 2714408 - RNA, 21 nt, Human
cuuccacaagagcccaggccu

SEQ ID NO: 2714409 - RNA, 20 nt, Human
cuucauucaacccaccugcg

SEQ ID NO: 2714410 - RNA, 17 nt, Human
cuucaguggcagcugcu

SEQ ID NO: 2714411 - RNA, 15 nt, Human
cuucaguaagccgug

SEQ ID NO: 2714412 - RNA, 18 nt, Human
cuucagugccuuauggaa

SEQ ID NO: 2714413 - RNA, 22 nt, Human
cuucagugccuuauggaacacu

SEQ ID NO: 2714414 - RNA, 13 nt, Human
cuucaguggcagc

SEQ ID NO: 2714415 - RNA, 14 nt, Human
cuucaguggcagcu

SEQ ID NO: 2714416 - RNA, 15 nt, Human
cuucaguggcagcug

SEQ ID NO: 2714417 - RNA, 16 nt, Human
cuucaguggcagcugc

SEQ ID NO: 2714418 - RNA, 16 nt, Human
cuucaguaagccguga

SEQ ID NO: 2714419 - RNA, 23 nt, Human
cuucaguaagccgugauuuucau

SEQ ID NO: 2714420 - RNA, 18 nt, Human
cuucugucuucacaacag

SEQ ID NO: 2714421 - RNA, 21 nt, Human
cuucuguccuacucuguguca

SEQ ID NO: 2714422 - RNA, 22 nt, Human
cuucugucuucacaacagauua

SEQ ID NO: 2714423 - RNA, 21 nt, Human
cuucugucuucacaacagauu

SEQ ID NO: 2714424 - RNA, 16 nt, Human
cuucuguccuacucug

SEQ ID NO: 2714425 - RNA, 17 nt, Human
cuucuguccuacucugu

SEQ ID NO: 2714426 - RNA, 18 nt, Human
cuucuguccuacucugug

SEQ ID NO: 2714427 - RNA, 19 nt, Human
cuucuguccuacucugugu

SEQ ID NO: 2714428 - RNA, 21 nt, Human
cuucuguacgucugacaggca

SEQ ID NO: 2714429 - RNA, 14 nt, Human
cuucuguacgucug

SEQ ID NO: 2714430 - RNA, 15 nt, Human
cuucuguacgucuga

SEQ ID NO: 2714431 - RNA, 18 nt, Human
cuucuguacgucugacag

SEQ ID NO: 2714432 - RNA, 20 nt, Human
cuucuguacgucugacaggc

SEQ ID NO: 2714433 - RNA, 13 nt, Human
cuucugcuucagc

SEQ ID NO: 2714434 - RNA, 12 nt, Human
cuucuccaggcu

SEQ ID NO: 2714435 - RNA, 13 nt, Human
cuucuccaggcug

SEQ ID NO: 2714436 - RNA, 11 nt, Human
cuucuccacuu

SEQ ID NO: 2714437 - RNA, 20 nt, Human
cuucuccacuuucuagccag

SEQ ID NO: 2714438 - RNA, 19 nt, Human
cuucuccuucaccuuuguc

SEQ ID NO: 2714439 - RNA, 12 nt, Human
cuucucuccagc

SEQ ID NO: 2714440 - RNA, 13 nt, Human
cuucucuccagcc

SEQ ID NO: 2714441 - RNA, 15 nt, Human
cuucucuccagcccc

SEQ ID NO: 2714442 - RNA, 17 nt, Human
cuucucuccagccccug

SEQ ID NO: 2714443 - RNA, 19 nt, Human
cuucucuccagccccugga

SEQ ID NO: 2714444 - RNA, 20 nt, Human
cuucugccauuucugagauc

SEQ ID NO: 2714445 - RNA, 13 nt, Human
cuucucugaagga

SEQ ID NO: 2714446 - RNA, 21 nt, Human
cuugaacuuugaccucugcag

SEQ ID NO: 2714447 - RNA, 17 nt, Human
cuugaacuuugaccucu

SEQ ID NO: 2714448 - RNA, 13 nt, Human
cuugaacuccugg

SEQ ID NO: 2714449 - RNA, 13 nt, Human
cuugaccucaggu

SEQ ID NO: 2714450 - RNA, 21 nt, Human
cuugaccgugaggccagagac

SEQ ID NO: 2714451 - RNA, 18 nt, Human
cuugaccgugaggccaga

SEQ ID NO: 2714452 - RNA, 20 nt, Human
cuugaccgugaggccagaga

SEQ ID NO: 2714453 - RNA, 17 nt, Human
cuugaccgugaggccag

SEQ ID NO: 2714454 - RNA, 22 nt, Human
cuugaccauucuccaccugcca

SEQ ID NO: 2714455 - RNA, 23 nt, Human
cuugaccauucuccaccugccag

SEQ ID NO: 2714456 - RNA, 16 nt, Human
cuugagccugggaggu

SEQ ID NO: 2714457 - RNA, 15 nt, Human
cuugagccuugaacu

SEQ ID NO: 2714458 - RNA, 18 nt, Human
cuugagccuugaacuuug

SEQ ID NO: 2714459 - RNA, 17 nt, Human
cuugagccuugaacuuu

SEQ ID NO: 2714460 - RNA, 13 nt, Human
cuugagcucagga

SEQ ID NO: 2714461 - RNA, 21 nt, Human
cuugaguugauucagcucugc

SEQ ID NO: 2714462 - RNA, 21 nt, Human
cuugaggguugggcugguguc

SEQ ID NO: 2714463 - RNA, 19 nt, Human
cuugaggguugggcuggug

SEQ ID NO: 2714464 - RNA, 20 nt, Human
cuugaggguugggcuggugu

SEQ ID NO: 2714465 - RNA, 18 nt, Human
cuucuuuaauuuuggaau

SEQ ID NO: 2714466 - RNA, 17 nt, Human
cuucuuuaauuuuggaa

SEQ ID NO: 2714467 - RNA, 16 nt, Human
cuucuuuaauuuugga

SEQ ID NO: 2714468 - RNA, 15 nt, Human
cuucuuuaauuuugg

SEQ ID NO: 2714469 - RNA, 14 nt, Human
cuucugugaaagua

SEQ ID NO: 2714470 - RNA, 13 nt, Human
cuucuguggguuu

SEQ ID NO: 2714471 - RNA, 14 nt, Human
cuucuguggguuuc

SEQ ID NO: 2714472 - RNA, 21 nt, Human
cuucuguggguuucuaaagcu

SEQ ID NO: 2714473 - RNA, 19 nt, Human
cuucuuuaauuuuggaauu

SEQ ID NO: 2714474 - RNA, 23 nt, Human
cuugaaaacacuguucucugccc

SEQ ID NO: 2714475 - RNA, 14 nt, Human
cuugaaaacacugu

SEQ ID NO: 2714476 - RNA, 20 nt, Human
cugcccucuccugggcagcu

SEQ ID NO: 2714477 - RNA, 21 nt, Human
cugcccucuccugggcagcug

SEQ ID NO: 2714478 - RNA, 16 nt, Human
cugcccucuccugggc

SEQ ID NO: 2714479 - RNA, 18 nt, Human
cugcccucuccugggcag

SEQ ID NO: 2714480 - RNA, 19 nt, Human
cugcccucuccugggcagc

SEQ ID NO: 2714481 - RNA, 12 nt, Human
cugcccuccaag

SEQ ID NO: 2714482 - RNA, 14 nt, Human
cucccuucccaccu

SEQ ID NO: 2714483 - RNA, 15 nt, Human
cucccuucccaccuc

SEQ ID NO: 2714484 - RNA, 16 nt, Human
cucccuucccaccucu

SEQ ID NO: 2714485 - RNA, 17 nt, Human
cucccuucccaccucuc

SEQ ID NO: 2714486 - RNA, 14 nt, Human
cugccgcagcccug

SEQ ID NO: 2714487 - RNA, 15 nt, Human
cugccgcagcccugc

SEQ ID NO: 2714488 - RNA, 17 nt, Human
cugccgcagcccugcag

SEQ ID NO: 2714489 - RNA, 18 nt, Human
cugccgcagcccugcaga

SEQ ID NO: 2714490 - RNA, 13 nt, Human
cugccuccccucc

SEQ ID NO: 2714491 - RNA, 15 nt, Human
cugccucugacacac

SEQ ID NO: 2714492 - RNA, 22 nt, Human
cugccucugacacacagcucug

SEQ ID NO: 2714493 - RNA, 23 nt, Human
cugccucugacacacagcucugu

SEQ ID NO: 2714494 - RNA, 12 nt, Human
cugccuaaggac

SEQ ID NO: 2714495 - RNA, 14 nt, Human
cugccuaaggacuu

SEQ ID NO: 2714496 - RNA, 13 nt, Human
cugccuaaggacu

SEQ ID NO: 2714497 - RNA, 15 nt, Human
cugccuaaggacuuc

SEQ ID NO: 2714498 - RNA, 11 nt, Human
cugccucccau

SEQ ID NO: 2714499 - RNA, 12 nt, Human
cugccucccauc

SEQ ID NO: 2714500 - RNA, 14 nt, Human
cugccucccaucac

SEQ ID NO: 2714501 - RNA, 16 nt, Human
cugccucccaucaccc

SEQ ID NO: 2714502 - RNA, 19 nt, Human
cugccucccaucacccgcu

SEQ ID NO: 2714503 - RNA, 20 nt, Human
cugccugcccaggccccugc

SEQ ID NO: 2714504 - RNA, 21 nt, Human
cugccugggaucccucauccu

SEQ ID NO: 2714505 - RNA, 15 nt, Human
cugccugaagucaca

SEQ ID NO: 2714506 - RNA, 16 nt, Human
cugccugcccaggccc

SEQ ID NO: 2714507 - RNA, 17 nt, Human
cugccugcccaggcccc

SEQ ID NO: 2714508 - RNA, 15 nt, Human
cugccucuucucuac

SEQ ID NO: 2714509 - RNA, 14 nt, Human
cugccucuucucua

SEQ ID NO: 2714510 - RNA, 18 nt, Human
cugcugaaacaacaaaua

SEQ ID NO: 2714511 - RNA, 11 nt, Human
cugcugaaggc

SEQ ID NO: 2714512 - RNA, 19 nt, Human
cugcgaccacaagaaggau

SEQ ID NO: 2714513 - RNA, 20 nt, Human
cugcuccagcuguucagcug

SEQ ID NO: 2714514 - RNA, 19 nt, Human
cugcuccagcuguucagcu

SEQ ID NO: 2714515 - RNA, 19 nt, Human
cugcucuccgaccagacac

SEQ ID NO: 2714516 - RNA, 15 nt, Human
cugcugcuggcuggu

SEQ ID NO: 2714517 - RNA, 14 nt, Human
cugcugcuggcugg

SEQ ID NO: 2714518 - RNA, 15 nt, Human
cugcuuccagugagg

SEQ ID NO: 2714519 - RNA, 16 nt, Human
cugcuuccagugaggc

SEQ ID NO: 2714520 - RNA, 18 nt, Human
cugcuuccagugaggcuc

SEQ ID NO: 2714521 - RNA, 19 nt, Human
cugcuuccagugaggcucu

SEQ ID NO: 2714522 - RNA, 20 nt, Human
cugcuuccagugaggcucug

SEQ ID NO: 2714523 - RNA, 21 nt, Human
cugcuuccagugaggcucugc

SEQ ID NO: 2714524 - RNA, 23 nt, Human
cugcuuccagugaggcucugccc

SEQ ID NO: 2714525 - RNA, 13 nt, Human
cugcugguucagg

SEQ ID NO: 2714526 - RNA, 15 nt, Human
cugcugguucagggu

SEQ ID NO: 2714527 - RNA, 23 nt, Human
cugcugguucaggguuggccccu

SEQ ID NO: 2714528 - RNA, 20 nt, Human
cuggcacaguuuucugagaa

SEQ ID NO: 2714529 - RNA, 20 nt, Human
cuggagugcagugagccgag

SEQ ID NO: 2714530 - RNA, 22 nt, Human
cuggcacaguuuucugagaaag

SEQ ID NO: 2714531 - RNA, 21 nt, Human
cuggcacaguuuucugagaaa

SEQ ID NO: 2714532 - RNA, 20 nt, Human
cuggcacccggccccugcug

SEQ ID NO: 2714533 - RNA, 21 nt, Human
cuggcacccggccccugcugg

SEQ ID NO: 2714534 - RNA, 19 nt, Human
cuggcacccggccccugcu

SEQ ID NO: 2714535 - RNA, 18 nt, Human
cuggcacugcuuccagug

SEQ ID NO: 2714536 - RNA, 19 nt, Human
cuggcacugcuuccaguga

SEQ ID NO: 2714537 - RNA, 20 nt, Human
cuggcacugcuuccagugag

SEQ ID NO: 2714538 - RNA, 23 nt, Human
cuggcacugcuuccagugaggcu

SEQ ID NO: 2714539 - RNA, 14 nt, Human
cuggccagaugcac

SEQ ID NO: 2714540 - RNA, 15 nt, Human
cuggcccacugcauc

SEQ ID NO: 2714541 - RNA, 24 nt, Human
cuggccuggccccucagggucccu

SEQ ID NO: 2714542 - RNA, 19 nt, Human
cuggccuggccccucaggg

SEQ ID NO: 2714543 - RNA, 16 nt, Human
cuggccucugcacucc

SEQ ID NO: 2714544 - RNA, 21 nt, Human
cuggccucugcacuccccugc

SEQ ID NO: 2714545 - RNA, 18 nt, Human
cuggccucugcacucccc

SEQ ID NO: 2714546 - RNA, 20 nt, Human
cuggccucugcacuccccug

SEQ ID NO: 2714547 - RNA, 14 nt, Human
cuggccugugucua

SEQ ID NO: 2714548 - RNA, 14 nt, Human
cuggcgugcagugg

SEQ ID NO: 2714549 - RNA, 15 nt, Human
cuggcgugcaguggu

SEQ ID NO: 2714550 - RNA, 24 nt, Human
cuggcucuuccaggcugggagagc

SEQ ID NO: 2714551 - RNA, 21 nt, Human
cuggcucuuccaggcugggag

SEQ ID NO: 2714552 - RNA, 22 nt, Human
cuggcucuuccaggcugggaga

SEQ ID NO: 2714553 - RNA, 22 nt, Human
cuggagguacgaaaagagggga

SEQ ID NO: 2714554 - RNA, 17 nt, Human
cuggagguacgaaaaga

SEQ ID NO: 2714555 - RNA, 14 nt, Human
cuggagugcaguga

SEQ ID NO: 2714556 - RNA, 15 nt, Human
cuggagugcagugag

SEQ ID NO: 2714557 - RNA, 16 nt, Human
cuggagugcagugagc

SEQ ID NO: 2714558 - RNA, 17 nt, Human
cuggagugcagugagcc

SEQ ID NO: 2714559 - RNA, 15 nt, Human
cuggacccuguggau

SEQ ID NO: 2714560 - RNA, 16 nt, Human
cuggaccuugaacugg

SEQ ID NO: 2714561 - RNA, 21 nt, Human
cuggaccuugaacuggguacu

SEQ ID NO: 2714562 - RNA, 17 nt, Human
cuggaccuugaacuggg

SEQ ID NO: 2714563 - RNA, 20 nt, Human
cuggaccuugaacuggguac

SEQ ID NO: 2714564 - RNA, 23 nt, Human
cuggacaggcauguucucugagg

SEQ ID NO: 2714565 - RNA, 14 nt, Human
cuggacaggcaugu

SEQ ID NO: 2714566 - RNA, 17 nt, Human
cuggacaggcauguucu

SEQ ID NO: 2714567 - RNA, 20 nt, Human
cuguauuuuaaaagaaugau

SEQ ID NO: 2714568 - RNA, 19 nt, Human
cuguauuuuaaaagaauga

SEQ ID NO: 2714569 - RNA, 22 nt, Human
cuguauuuuaaaagaaugauua

SEQ ID NO: 2714570 - RNA, 23 nt, Human
cuguaucccaugagccucagcau

SEQ ID NO: 2714571 - RNA, 13 nt, Human
cuguacagagccc

SEQ ID NO: 2714572 - RNA, 16 nt, Human
cuguauagauuagaau

SEQ ID NO: 2714573 - RNA, 20 nt, Human
cugucuacacuaagagagaa

SEQ ID NO: 2714574 - RNA, 22 nt, Human
cugucccuuacgugaguccugg

SEQ ID NO: 2714575 - RNA, 15 nt, Human
cuguccgagcuuuga

SEQ ID NO: 2714576 - RNA, 14 nt, Human
cuguccuacccacc

SEQ ID NO: 2714577 - RNA, 16 nt, Human
cugucucaaaaaaaga

SEQ ID NO: 2714578 - RNA, 23 nt, Human
cugucucaaaaaaacacaaaagu

SEQ ID NO: 2714579 - RNA, 18 nt, Human
cugucucaaaaaaagaaa

SEQ ID NO: 2714580 - RNA, 14 nt, Human
cuguccgagcuuug

SEQ ID NO: 2714581 - RNA, 20 nt, Human
cugucccuuacgugaguccu

SEQ ID NO: 2714582 - RNA, 22 nt, Human
cuguccccgcacugggcuuggg

SEQ ID NO: 2714583 - RNA, 18 nt, Human
cuguccccgcacugggcu

SEQ ID NO: 2714584 - RNA, 19 nt, Human
cuguccccgcacugggcuu

SEQ ID NO: 2714585 - RNA, 17 nt, Human
cuguccccgcacugggc

SEQ ID NO: 2714586 - RNA, 16 nt, Human
cugguuccauggccuc

SEQ ID NO: 2714587 - RNA, 20 nt, Human
cuguaauccuagcacuuugg

SEQ ID NO: 2714588 - RNA, 15 nt, Human
cuguacaaaguagaa

SEQ ID NO: 2714589 - RNA, 13 nt, Human
cuguacaaaguag

SEQ ID NO: 2714590 - RNA, 21 nt, Human
cugguggcagcucaccucucc

SEQ ID NO: 2714591 - RNA, 23 nt, Human
cugguggcagcucaccucucccu

SEQ ID NO: 2714592 - RNA, 13 nt, Human
cugguggcagcug

SEQ ID NO: 2714593 - RNA, 14 nt, Human
cugguggcagcugc

SEQ ID NO: 2714594 - RNA, 19 nt, Human
cugggggcugggcagagga

SEQ ID NO: 2714595 - RNA, 15 nt, Human
cugggggaagaagcu

SEQ ID NO: 2714596 - RNA, 13 nt, Human
cugggggaagaag

SEQ ID NO: 2714597 - RNA, 24 nt, Human
cugggcuucaguggcagcugcuuu

SEQ ID NO: 2714598 - RNA, 22 nt, Human
cuggguaacuagggaagauaau

SEQ ID NO: 2714599 - RNA, 20 nt, Human
cuggguaacuagggaagaua

SEQ ID NO: 2714600 - RNA, 14 nt, Human
cuggguucuaccca

SEQ ID NO: 2714601 - RNA, 15 nt, Human
cuggguucuacccag

SEQ ID NO: 2714602 - RNA, 16 nt, Human
cuggguucuacccagg

SEQ ID NO: 2714603 - RNA, 17 nt, Human
cuggguucuacccaggu

SEQ ID NO: 2714604 - RNA, 20 nt, Human
cuguuaaaagaugaaaauau

SEQ ID NO: 2714605 - RNA, 23 nt, Human
cuguuaaaagaugaaaauauuug

SEQ ID NO: 2714606 - RNA, 21 nt, Human
cuguuaaaagaugaaaauauu

SEQ ID NO: 2714607 - RNA, 18 nt, Human
cugugugugcgccuacag

SEQ ID NO: 2714608 - RNA, 20 nt, Human
cugugugugcgccuacagga

SEQ ID NO: 2714609 - RNA, 21 nt, Human
cugugucuugcaauggcagcc

SEQ ID NO: 2714610 - RNA, 20 nt, Human
cugugucuugcaauggcagc

SEQ ID NO: 2714611 - RNA, 22 nt, Human
cugugucuugcaauggcagccu

SEQ ID NO: 2714612 - RNA, 23 nt, Human
cugugucuugcaauggcagccuu

SEQ ID NO: 2714613 - RNA, 13 nt, Human
cuguucucugccc

SEQ ID NO: 2714614 - RNA, 20 nt, Human
cuguucucugcccuccaaga

SEQ ID NO: 2714615 - RNA, 18 nt, Human
cuguucucugcccuccaa

SEQ ID NO: 2714616 - RNA, 19 nt, Human
cuguucucugcccuccaag

SEQ ID NO: 2714617 - RNA, 14 nt, Human
cuguucucugcccu

SEQ ID NO: 2714618 - RNA, 15 nt, Human
cuguucucugcccuc

SEQ ID NO: 2714619 - RNA, 16 nt, Human
cuguucucugcccucc

SEQ ID NO: 2714620 - RNA, 17 nt, Human
cuguucucugcccucca

SEQ ID NO: 2714621 - RNA, 18 nt, Human
cuguucagcugguugagg

SEQ ID NO: 2714622 - RNA, 19 nt, Human
cuguucagcugguugaggu

SEQ ID NO: 2714623 - RNA, 21 nt, Human
cuguucagcugguugagguuu

SEQ ID NO: 2714624 - RNA, 17 nt, Human
cuguucaugaaagauuc

SEQ ID NO: 2714625 - RNA, 23 nt, Human
cuguucaugaaagauucaaugcc

SEQ ID NO: 2714626 - RNA, 18 nt, Human
cuguucaugaaagauuca

SEQ ID NO: 2714627 - RNA, 14 nt, Human
cugugggcccccaa

SEQ ID NO: 2714628 - RNA, 17 nt, Human
cuguggaugauaaaaca

SEQ ID NO: 2714629 - RNA, 21 nt, Human
cugugcugcccugcccaccug

SEQ ID NO: 2714630 - RNA, 17 nt, Human
cugugccucugggacug

SEQ ID NO: 2714631 - RNA, 22 nt, Human
cugugcugcccugcccaccugg

SEQ ID NO: 2714632 - RNA, 16 nt, Human
cugugccucugggacu

SEQ ID NO: 2714633 - RNA, 14 nt, Human
cugugccucuggga

SEQ ID NO: 2714634 - RNA, 18 nt, Human
cugugauggggcccugcc

SEQ ID NO: 2714635 - RNA, 17 nt, Human
cugugauggggcccugc

SEQ ID NO: 2714636 - RNA, 23 nt, Human
cugugaguacuacaguccuccca

SEQ ID NO: 2714637 - RNA, 20 nt, Human
cugugaguacuacaguccuc

SEQ ID NO: 2714638 - RNA, 21 nt, Human
cugugaguacuacaguccucc

SEQ ID NO: 2714639 - RNA, 18 nt, Human
cugucuccauguuugaug

SEQ ID NO: 2714640 - RNA, 19 nt, Human
cugugauggggcccugccu

SEQ ID NO: 2714641 - RNA, 20 nt, Human
cugugauggggcccugccuc

SEQ ID NO: 2714642 - RNA, 14 nt, Human
cugugccauuuugu

SEQ ID NO: 2714643 - RNA, 16 nt, Human
cugugccaugugccag

SEQ ID NO: 2714644 - RNA, 18 nt, Human
cugugccaugugccaggu

SEQ ID NO: 2714645 - RNA, 14 nt, Human
gaauugaagcagga

SEQ ID NO: 2714646 - RNA, 18 nt, Human
gaauucuugaaggaaaau

SEQ ID NO: 2714647 - RNA, 16 nt, Human
gaauuggagcucgugg

SEQ ID NO: 2714648 - RNA, 15 nt, Human
gaauguuaagcagau

SEQ ID NO: 2714649 - RNA, 13 nt, Human
gaauucuguauag

SEQ ID NO: 2714650 - RNA, 22 nt, Human
gaauucuguauagauuagaauu

SEQ ID NO: 2714651 - RNA, 21 nt, Human
gaauucuguauagauuagaau

SEQ ID NO: 2714652 - RNA, 14 nt, Human
gaauucuguauaga

SEQ ID NO: 2714653 - RNA, 16 nt, Human
gaauggcuuuguauag

SEQ ID NO: 2714654 - RNA, 14 nt, Human
gaauggcuuuguau

SEQ ID NO: 2714655 - RNA, 17 nt, Human
gaauggcuuuguauaga

SEQ ID NO: 2714656 - RNA, 14 nt, Human
gaauguuaagcaga

SEQ ID NO: 2714657 - RNA, 13 nt, Human
gaaugucagugug

SEQ ID NO: 2714658 - RNA, 20 nt, Human
gaaugcacaaacagaggccg

SEQ ID NO: 2714659 - RNA, 19 nt, Human
gaaucucauaauuuauaca

SEQ ID NO: 2714660 - RNA, 21 nt, Human
gaaugaaagggcccagagagg

SEQ ID NO: 2714661 - RNA, 13 nt, Human
gaaugcuguguua

SEQ ID NO: 2714662 - RNA, 21 nt, Human
gaaugcacaaacagaggccgc

SEQ ID NO: 2714663 - RNA, 14 nt, Human
gaaugcuguguuaa

SEQ ID NO: 2714664 - RNA, 18 nt, Human
gaauccagacccggcugc

SEQ ID NO: 2714665 - RNA, 20 nt, Human
gaauccagacccggcugcgu

SEQ ID NO: 2714666 - RNA, 18 nt, Human
gaaucucauaauuuauac

SEQ ID NO: 2714667 - RNA, 15 nt, Human
gacaagcucacagac

SEQ ID NO: 2714668 - RNA, 22 nt, Human
gacaacacucauugaccugagg

SEQ ID NO: 2714669 - RNA, 23 nt, Human
gacaacacucauugaccugaggc

SEQ ID NO: 2714670 - RNA, 20 nt, Human
gaauuugauaugugaacagu

SEQ ID NO: 2714671 - RNA, 22 nt, Human
gaauuucuuuugccguuauuaa

SEQ ID NO: 2714672 - RNA, 20 nt, Human
gaauuucuaggacugaauua

SEQ ID NO: 2714673 - RNA, 19 nt, Human
gaauuucuaggacugaauu

SEQ ID NO: 2714674 - RNA, 15 nt, Human
gaauuguaaggaaug

SEQ ID NO: 2714675 - RNA, 16 nt, Human
gacaaggaaaaaauaa

SEQ ID NO: 2714676 - RNA, 18 nt, Human
gacaaggauugcuacugu

SEQ ID NO: 2714677 - RNA, 21 nt, Human
gacaaggaugaucuaggaaga

SEQ ID NO: 2714678 - RNA, 19 nt, Human
gacaaggauugcuacuguc

SEQ ID NO: 2714679 - RNA, 21 nt, Human
gacaaggauugcuacuguccu

SEQ ID NO: 2714680 - RNA, 12 nt, Human
gacaaugugaaa

SEQ ID NO: 2714681 - RNA, 18 nt, Human
gacaaugugaaaagaaaa

SEQ ID NO: 2714682 - RNA, 22 nt, Human
gacaaugcaaaccaucauugaa

SEQ ID NO: 2714683 - RNA, 19 nt, Human
gacaaugugaaaagaaaaa

SEQ ID NO: 2714684 - RNA, 20 nt, Human
gacaaugugaaaagaaaaau

SEQ ID NO: 2714685 - RNA, 19 nt, Human
gacacaugcaaggucauuu

SEQ ID NO: 2714686 - RNA, 15 nt, Human
gacacauguccaaga

SEQ ID NO: 2714687 - RNA, 20 nt, Human
gacacauguccaagaagccc

SEQ ID NO: 2714688 - RNA, 23 nt, Human
gacacauguccaagaagcccagg

SEQ ID NO: 2714689 - RNA, 14 nt, Human
gacacaugcaaggu

SEQ ID NO: 2714690 - RNA, 20 nt, Human
gacacaggcccggcuccagg

SEQ ID NO: 2714691 - RNA, 21 nt, Human
gacacaggcccggcuccaggc

SEQ ID NO: 2714692 - RNA, 19 nt, Human
gacacaggcccggcuccag

SEQ ID NO: 2714693 - RNA, 13 nt, Human
gacacaacuauuu

SEQ ID NO: 2714694 - RNA, 16 nt, Human
gacacaagccuucggc

SEQ ID NO: 2714695 - RNA, 23 nt, Human
gacccugaggcccagagggccug

SEQ ID NO: 2714696 - RNA, 14 nt, Human
gaccccuccaugug

SEQ ID NO: 2714697 - RNA, 18 nt, Human
gaccccuccaugugggcu

SEQ ID NO: 2714698 - RNA, 21 nt, Human
gaccccuccaugugggcuagu

SEQ ID NO: 2714699 - RNA, 22 nt, Human
gacccugaggcccagagggccu

SEQ ID NO: 2714700 - RNA, 12 nt, Human
gacccugucuca

SEQ ID NO: 2714701 - RNA, 15 nt, Human
gacccuugugguccc

SEQ ID NO: 2714702 - RNA, 21 nt, Human
gacccuuguggucccacccca

SEQ ID NO: 2714703 - RNA, 19 nt, Human
gacccuuguggucccaccc

SEQ ID NO: 2714704 - RNA, 20 nt, Human
gacccuuguggucccacccc

SEQ ID NO: 2714705 - RNA, 18 nt, Human
gaccgugaggccagagac

SEQ ID NO: 2714706 - RNA, 16 nt, Human
gaccgugaggccagag

SEQ ID NO: 2714707 - RNA, 17 nt, Human
gaccgugaggccagaga

SEQ ID NO: 2714708 - RNA, 14 nt, Human
gaccacguuucuaa

SEQ ID NO: 2714709 - RNA, 24 nt, Human
gaccagacaccuugacagggcaca

SEQ ID NO: 2714710 - RNA, 11 nt, Human
gaccagagcug

SEQ ID NO: 2714711 - RNA, 16 nt, Human
gacaugggacauuugc

SEQ ID NO: 2714712 - RNA, 18 nt, Human
gacaugggaaaggggaag

SEQ ID NO: 2714713 - RNA, 19 nt, Human
gaccauucuccaccugcca

SEQ ID NO: 2714714 - RNA, 20 nt, Human
gaccauucuccaccugccag

SEQ ID NO: 2714715 - RNA, 17 nt, Human
gaccauucuccaccugc

SEQ ID NO: 2714716 - RNA, 21 nt, Human
gaccauucuccaccugccagg

SEQ ID NO: 2714717 - RNA, 22 nt, Human
gaccauucuccaccugccaggg

SEQ ID NO: 2714718 - RNA, 18 nt, Human
gaccagagcugccaccug

SEQ ID NO: 2714719 - RNA, 19 nt, Human
gaccagagcugccaccugc

SEQ ID NO: 2714720 - RNA, 13 nt, Human
gaccagagcugcc

SEQ ID NO: 2714721 - RNA, 14 nt, Human
gaccagagcugcca

SEQ ID NO: 2714722 - RNA, 15 nt, Human
gaccagagcugccac

SEQ ID NO: 2714723 - RNA, 17 nt, Human
gaccagagcugccaccu

SEQ ID NO: 2714724 - RNA, 16 nt, Human
gacagggaggugaccc

SEQ ID NO: 2714725 - RNA, 23 nt, Human
gacagggcacaccgggcacucag

SEQ ID NO: 2714726 - RNA, 14 nt, Human
gacaguuaagagaa

SEQ ID NO: 2714727 - RNA, 24 nt, Human
gacagggcacaccgggcacucaga

SEQ ID NO: 2714728 - RNA, 14 nt, Human
gacaggaccaggga

SEQ ID NO: 2714729 - RNA, 15 nt, Human
gacaggaccagggau

SEQ ID NO: 2714730 - RNA, 23 nt, Human
gacaggaccagggauuuccauga

SEQ ID NO: 2714731 - RNA, 22 nt, Human
gacaguuaagagaaaugagcuu

SEQ ID NO: 2714732 - RNA, 14 nt, Human
gacaugggaaaggg

SEQ ID NO: 2714733 - RNA, 14 nt, Human
gacaugaucuucuu

SEQ ID NO: 2714734 - RNA, 14 nt, Human
gacagaggcagccc

SEQ ID NO: 2714735 - RNA, 16 nt, Human
gacagaggcagcccca

SEQ ID NO: 2714736 - RNA, 21 nt, Human
gacagagcaagugagacccug

SEQ ID NO: 2714737 - RNA, 17 nt, Human
gacagaggcagccccau

SEQ ID NO: 2714738 - RNA, 15 nt, Human
gacagaggggguggc

SEQ ID NO: 2714739 - RNA, 18 nt, Human
gacagaggggguggccuc

SEQ ID NO: 2714740 - RNA, 19 nt, Human
gacagaggggguggccucc

SEQ ID NO: 2714741 - RNA, 14 nt, Human
gacagagucucacu

SEQ ID NO: 2714742 - RNA, 23 nt, Human
gacagaggggguggccucccaac

SEQ ID NO: 2714743 - RNA, 21 nt, Human
gacagaggggguggccuccca

SEQ ID NO: 2714744 - RNA, 22 nt, Human
gacagaggggguggccucccaa

SEQ ID NO: 2714745 - RNA, 13 nt, Human
gacagagggggug

SEQ ID NO: 2714746 - RNA, 20 nt, Human
gacagagugagacucugucu

SEQ ID NO: 2714747 - RNA, 22 nt, Human
gacagagugagacucugucuca

SEQ ID NO: 2714748 - RNA, 14 nt, Human
gacagccacggcca

SEQ ID NO: 2714749 - RNA, 17 nt, Human
gacagccacggccaggc

SEQ ID NO: 2714750 - RNA, 18 nt, Human
gacagccacggccaggcc

SEQ ID NO: 2714751 - RNA, 19 nt, Human
gacagccacggccaggcca

SEQ ID NO: 2714752 - RNA, 18 nt, Human
gacagcugccugggaucc

SEQ ID NO: 2714753 - RNA, 21 nt, Human
gacagcugccugggaucccuc

SEQ ID NO: 2714754 - RNA, 20 nt, Human
gacagccacggccaggccag

SEQ ID NO: 2714755 - RNA, 21 nt, Human
gacagccacggccaggccaga

SEQ ID NO: 2714756 - RNA, 16 nt, Human
gacagcugccugggau

SEQ ID NO: 2714757 - RNA, 17 nt, Human
gacagcugccugggauc

SEQ ID NO: 2714758 - RNA, 18 nt, Human
gacuggaagcacagcuuc

SEQ ID NO: 2714759 - RNA, 14 nt, Human
gacuggaagcacag

SEQ ID NO: 2714760 - RNA, 15 nt, Human
gacuggaagcacagc

SEQ ID NO: 2714761 - RNA, 16 nt, Human
gacuggaagcacagcu

SEQ ID NO: 2714762 - RNA, 14 nt, Human
gacugcauuauauu

SEQ ID NO: 2714763 - RNA, 16 nt, Human
gacugcauuauauuua

SEQ ID NO: 2714764 - RNA, 23 nt, Human
gacugaguacguugugcauuugg

SEQ ID NO: 2714765 - RNA, 13 nt, Human
gacugcccggcag

SEQ ID NO: 2714766 - RNA, 15 nt, Human
gacugcccggcaggg

SEQ ID NO: 2714767 - RNA, 17 nt, Human
gacucgcgacaaugcaa

SEQ ID NO: 2714768 - RNA, 22 nt, Human
gacugaguacguugugcauuug

SEQ ID NO: 2714769 - RNA, 21 nt, Human
gacugaguacguugugcauuu

SEQ ID NO: 2714770 - RNA, 15 nt, Human
gacuccaaagaaaug

SEQ ID NO: 2714771 - RNA, 12 nt, Human
gacuccaaagaa

SEQ ID NO: 2714772 - RNA, 11 nt, Human
gacuccaaaga

SEQ ID NO: 2714773 - RNA, 21 nt, Human
gacucauuuuaaaaaauggaa

SEQ ID NO: 2714774 - RNA, 16 nt, Human
gacuccaaagaaaugu

SEQ ID NO: 2714775 - RNA, 13 nt, Human
gacucgcgacaau

SEQ ID NO: 2714776 - RNA, 13 nt, Human
gacuccugcaggc

SEQ ID NO: 2714777 - RNA, 12 nt, Human
gacuccugcagg

SEQ ID NO: 2714778 - RNA, 14 nt, Human
gacucauucuucug

SEQ ID NO: 2714779 - RNA, 15 nt, Human
gacucauucuucugu

SEQ ID NO: 2714780 - RNA, 13 nt, Human
gacuacaggugug

SEQ ID NO: 2714781 - RNA, 18 nt, Human
gacuacaggugugaguca

SEQ ID NO: 2714782 - RNA, 21 nt, Human
gacuacaggugugagucacca

SEQ ID NO: 2714783 - RNA, 24 nt, Human
gacuucuaaguaaaaccacagcag

SEQ ID NO: 2714784 - RNA, 23 nt, Human
gacuucuaaguaaaaccacagca

SEQ ID NO: 2714785 - RNA, 19 nt, Human
gacuucuaaguaaaaccac

SEQ ID NO: 2714786 - RNA, 23 nt, Human
gacuucugucuucacaacagauu

SEQ ID NO: 2714787 - RNA, 20 nt, Human
gacuucugucuucacaacag

SEQ ID NO: 2714788 - RNA, 18 nt, Human
gacuucuaaguaaaacca

SEQ ID NO: 2714789 - RNA, 17 nt, Human
gacuucuaaguaaaacc

SEQ ID NO: 2714790 - RNA, 16 nt, Human
gacuucuaaguaaaac

SEQ ID NO: 2714791 - RNA, 19 nt, Human
gacuuaagcacacuugaca

SEQ ID NO: 2714792 - RNA, 21 nt, Human
gacuucuuuaauuuuggaauu

SEQ ID NO: 2714793 - RNA, 20 nt, Human
gacuucuuuaauuuuggaau

SEQ ID NO: 2714794 - RNA, 19 nt, Human
gacuucuuuaauuuuggaa

SEQ ID NO: 2714795 - RNA, 16 nt, Human
gacuucuuuaauuuug

SEQ ID NO: 2714796 - RNA, 18 nt, Human
gacuucuuuaauuuugga

SEQ ID NO: 2714797 - RNA, 17 nt, Human
gacuucuuuaauuuugg

SEQ ID NO: 2714798 - RNA, 17 nt, Human
gagaaugagagacacac

SEQ ID NO: 2714799 - RNA, 16 nt, Human
gagaagcagaggaagg

SEQ ID NO: 2714800 - RNA, 16 nt, Human
gagaagagaaugcaca

SEQ ID NO: 2714801 - RNA, 22 nt, Human
gagaacuuccagauccuggaaa

SEQ ID NO: 2714802 - RNA, 23 nt, Human
gagaacuuccagauccuggaaau

SEQ ID NO: 2714803 - RNA, 14 nt, Human
gagaagagaaugca

SEQ ID NO: 2714804 - RNA, 21 nt, Human
gagaaccuagggugauauuaa

SEQ ID NO: 2714805 - RNA, 22 nt, Human
gagaaccuagggugauauuaac

SEQ ID NO: 2714806 - RNA, 14 nt, Human
gagaaaugagcuug

SEQ ID NO: 2714807 - RNA, 16 nt, Human
gagaaagguugaagca

SEQ ID NO: 2714808 - RNA, 20 nt, Human
gagaaugagagacacacuga

SEQ ID NO: 2714809 - RNA, 21 nt, Human
gagaaugagagacacacugaa

SEQ ID NO: 2714810 - RNA, 23 nt, Human
gagaaugcacaaacagaggccgc

SEQ ID NO: 2714811 - RNA, 22 nt, Human
gagacaggguuuugccauguug

SEQ ID NO: 2714812 - RNA, 14 nt, Human
gagaccaucccuga

SEQ ID NO: 2714813 - RNA, 12 nt, Human
gagaccaucccu

SEQ ID NO: 2714814 - RNA, 18 nt, Human
gagaccaucccugaaggc

SEQ ID NO: 2714815 - RNA, 21 nt, Human
gagaccaucccugaaggcccc

SEQ ID NO: 2714816 - RNA, 18 nt, Human
gagacuccugcaggcagc

SEQ ID NO: 2714817 - RNA, 19 nt, Human
gagacuccugcaggcagcc

SEQ ID NO: 2714818 - RNA, 20 nt, Human
gagacuccugcaggcagcca

SEQ ID NO: 2714819 - RNA, 21 nt, Human
gagacuccugcaggcagccag

SEQ ID NO: 2714820 - RNA, 13 nt, Human
gagacucugucuc

SEQ ID NO: 2714821 - RNA, 20 nt, Human
gagacucgcgacaaugcaaa

SEQ ID NO: 2714822 - RNA, 21 nt, Human
gagacucgcgacaaugcaaac

SEQ ID NO: 2714823 - RNA, 15 nt, Human
gagaguagaacagau

SEQ ID NO: 2714824 - RNA, 13 nt, Human
gagaguguugaaa

SEQ ID NO: 2714825 - RNA, 13 nt, Human
gagaggggcacag

SEQ ID NO: 2714826 - RNA, 19 nt, Human
gagaggggaacagacugga

SEQ ID NO: 2714827 - RNA, 14 nt, Human
gagagggugggagu

SEQ ID NO: 2714828 - RNA, 20 nt, Human
gagagggugggagugggccc

SEQ ID NO: 2714829 - RNA, 16 nt, Human
gagagggugggagugg

SEQ ID NO: 2714830 - RNA, 16 nt, Human
gagcagagaauucucu

SEQ ID NO: 2714831 - RNA, 12 nt, Human
gagcagagacca

SEQ ID NO: 2714832 - RNA, 20 nt, Human
gagccagauuucacucuccu

SEQ ID NO: 2714833 - RNA, 19 nt, Human
gagccaauuuaaagaaaac

SEQ ID NO: 2714834 - RNA, 18 nt, Human
gagcccugguggcagugg

SEQ ID NO: 2714835 - RNA, 19 nt, Human
gagccagggucucacuaug

SEQ ID NO: 2714836 - RNA, 14 nt, Human
gagccagggucuca

SEQ ID NO: 2714837 - RNA, 23 nt, Human
gagccagauuucacucuccuugg

SEQ ID NO: 2714838 - RNA, 19 nt, Human
gagaucacgccacugcacu

SEQ ID NO: 2714839 - RNA, 18 nt, Human
gagaucacgccacugcac

SEQ ID NO: 2714840 - RNA, 14 nt, Human
gagauagccaaggc

SEQ ID NO: 2714841 - RNA, 23 nt, Human
gagaucaaccccuucgcuccugu

SEQ ID NO: 2714842 - RNA, 16 nt, Human
gagauagccaaggcca

SEQ ID NO: 2714843 - RNA, 20 nt, Human
gagcaccuuagacagucccu

SEQ ID NO: 2714844 - RNA, 21 nt, Human
gagcacuaaggugugcucuga

SEQ ID NO: 2714845 - RNA, 15 nt, Human
gagcacuaaggugug

SEQ ID NO: 2714846 - RNA, 21 nt, Human
gagcaccuuagacagucccug

SEQ ID NO: 2714847 - RNA, 22 nt, Human
gagcaccuuagacagucccugc

SEQ ID NO: 2714848 - RNA, 13 nt, Human
gaggaucucuuga

SEQ ID NO: 2714849 - RNA, 22 nt, Human
gaggaucucuugagccugggag

SEQ ID NO: 2714850 - RNA, 16 nt, Human
gaggaucucuugagcc

SEQ ID NO: 2714851 - RNA, 19 nt, Human
gaggaucucuugagccugg

SEQ ID NO: 2714852 - RNA, 20 nt, Human
gaggauugcuugagcucagg

SEQ ID NO: 2714853 - RNA, 21 nt, Human
gaggcagccccauucugccug

SEQ ID NO: 2714854 - RNA, 20 nt, Human
gaggcagccccauucugccu

SEQ ID NO: 2714855 - RNA, 9 nt, Human
gaggcaggg

SEQ ID NO: 2714856 - RNA, 19 nt, Human
gaggcagccccauucugcc

SEQ ID NO: 2714857 - RNA, 18 nt, Human
gaggcagccccauucugc

SEQ ID NO: 2714858 - RNA, 14 nt, Human
gaggccaugggccu

SEQ ID NO: 2714859 - RNA, 17 nt, Human
gaggccaugggccuccu

SEQ ID NO: 2714860 - RNA, 18 nt, Human
gaggccaugggccuccug

SEQ ID NO: 2714861 - RNA, 20 nt, Human
gaggccaugggccuccugug

SEQ ID NO: 2714862 - RNA, 21 nt, Human
gaggccaugggccuccugugu

SEQ ID NO: 2714863 - RNA, 23 nt, Human
gaggccaugggccuccugugugu

SEQ ID NO: 2714864 - RNA, 11 nt, Human
gaggcccagag

SEQ ID NO: 2714865 - RNA, 13 nt, Human
gaggcccagaggg

SEQ ID NO: 2714866 - RNA, 14 nt, Human
gaggcccagagggc

SEQ ID NO: 2714867 - RNA, 19 nt, Human
gaggcccagagggccugca

SEQ ID NO: 2714868 - RNA, 15 nt, Human
gaggcccagagggcc

SEQ ID NO: 2714869 - RNA, 16 nt, Human
gaggcccagagggccu

SEQ ID NO: 2714870 - RNA, 21 nt, Human
gaggcccuucucuccagcccc

SEQ ID NO: 2714871 - RNA, 15 nt, Human
gaggcccuucucucc

SEQ ID NO: 2714872 - RNA, 20 nt, Human
gaggcccuucucuccagccc

SEQ ID NO: 2714873 - RNA, 16 nt, Human
gaggcugggcucccuu

SEQ ID NO: 2714874 - RNA, 14 nt, Human
gaggcugccucucc

SEQ ID NO: 2714875 - RNA, 16 nt, Human
gaggccuucucugaag

SEQ ID NO: 2714876 - RNA, 18 nt, Human
gaggccuucucugaagga

SEQ ID NO: 2714877 - RNA, 19 nt, Human
gaggccuucucugaaggac

SEQ ID NO: 2714878 - RNA, 17 nt, Human
gaggggguggccuccca

SEQ ID NO: 2714879 - RNA, 13 nt, Human
gaggguaaggcug

SEQ ID NO: 2714880 - RNA, 21 nt, Human
gagggagugacagaggcagcc

SEQ ID NO: 2714881 - RNA, 22 nt, Human
gagggagugacagaggcagccc

SEQ ID NO: 2714882 - RNA, 18 nt, Human
gagggagugacagaggca

SEQ ID NO: 2714883 - RNA, 16 nt, Human
gagggagugacagagg

SEQ ID NO: 2714884 - RNA, 16 nt, Human
gagggagggcuccaga

SEQ ID NO: 2714885 - RNA, 20 nt, Human
gagggagggcuccagacaca

SEQ ID NO: 2714886 - RNA, 20 nt, Human
gaggcugggcucccuuccca

SEQ ID NO: 2714887 - RNA, 19 nt, Human
gagggagggcuccagacac

SEQ ID NO: 2714888 - RNA, 13 nt, Human
gagggucugagga

SEQ ID NO: 2714889 - RNA, 14 nt, Human
gagggucugaggaa

SEQ ID NO: 2714890 - RNA, 12 nt, Human
gaggguggaaua

SEQ ID NO: 2714891 - RNA, 21 nt, Human
gagggugaagugaagacaaug

SEQ ID NO: 2714892 - RNA, 14 nt, Human
gaggguggugaccu

SEQ ID NO: 2714893 - RNA, 15 nt, Human
gagggugggaguggg

SEQ ID NO: 2714894 - RNA, 21 nt, Human
gaggguggugaccucugccug

SEQ ID NO: 2714895 - RNA, 22 nt, Human
gagggugucccaaaaagaaagg

SEQ ID NO: 2714896 - RNA, 12 nt, Human
gaggucagagcc

SEQ ID NO: 2714897 - RNA, 13 nt, Human
gaggucagagccu

SEQ ID NO: 2714898 - RNA, 17 nt, Human
gaggucaaggcugcagu

SEQ ID NO: 2714899 - RNA, 14 nt, Human
gaggguugggcugg

SEQ ID NO: 2714900 - RNA, 15 nt, Human
gaggguugggcuggu

SEQ ID NO: 2714901 - RNA, 24 nt, Human
gagguaaggaauaccugucccccu

SEQ ID NO: 2714902 - RNA, 21 nt, Human
gagguaaggaauaccuguccc

SEQ ID NO: 2714903 - RNA, 22 nt, Human
gauaaauggcuuccuggcaaua

SEQ ID NO: 2714904 - RNA, 20 nt, Human
gauaaaugccaucaauaaaa

SEQ ID NO: 2714905 - RNA, 15 nt, Human
gauaaaugccaucaa

SEQ ID NO: 2714906 - RNA, 11 nt, Human
gauaaaugcca

SEQ ID NO: 2714907 - RNA, 21 nt, Human
gaguugaagacagagcuacac

SEQ ID NO: 2714908 - RNA, 15 nt, Human
gaguugaagacagag

SEQ ID NO: 2714909 - RNA, 17 nt, Human
gaguugaagacagagcu

SEQ ID NO: 2714910 - RNA, 13 nt, Human
gaguuacagacaa

SEQ ID NO: 2714911 - RNA, 15 nt, Human
gaguuacagacaaag

SEQ ID NO: 2714912 - RNA, 20 nt, Human
gaguucauacccuguuacca

SEQ ID NO: 2714913 - RNA, 14 nt, Human
gaguucaucuugaa

SEQ ID NO: 2714914 - RNA, 19 nt, Human
gaguucaucuugaauugua

SEQ ID NO: 2714915 - RNA, 20 nt, Human
gaguucaucuugaauuguaa

SEQ ID NO: 2714916 - RNA, 13 nt, Human
gagugggugaaua

SEQ ID NO: 2714917 - RNA, 17 nt, Human
gagugacagaggcagcc

SEQ ID NO: 2714918 - RNA, 18 nt, Human
gaguguacuuaacuauuc

SEQ ID NO: 2714919 - RNA, 20 nt, Human
gagugugccugaagucccag

SEQ ID NO: 2714920 - RNA, 12 nt, Human
gaguguugaaac

SEQ ID NO: 2714921 - RNA, 16 nt, Human
gaguguugaaacggau

SEQ ID NO: 2714922 - RNA, 12 nt, Human
gaguuacagaca

SEQ ID NO: 2714923 - RNA, 20 nt, Human
gauacaggaaaagcugcuga

SEQ ID NO: 2714924 - RNA, 22 nt, Human
gauaagaaccuuuugagugccu

SEQ ID NO: 2714925 - RNA, 19 nt, Human
gauacaggaaaagcugcug

SEQ ID NO: 2714926 - RNA, 21 nt, Human
gauacaggaaaagcugcugac

SEQ ID NO: 2714927 - RNA, 23 nt, Human
gauacaggaaaagcugcugacag

SEQ ID NO: 2714928 - RNA, 16 nt, Human
gauagcacagacccug

SEQ ID NO: 2714929 - RNA, 15 nt, Human
gauagcacagacccu

SEQ ID NO: 2714930 - RNA, 14 nt, Human
gauagccaaggcca

SEQ ID NO: 2714931 - RNA, 22 nt, Human
gauagccaaggccaaaggaagc

SEQ ID NO: 2714932 - RNA, 18 nt, Human
gaucacggcucacugcag

SEQ ID NO: 2714933 - RNA, 15 nt, Human
gaucacggcucacug

SEQ ID NO: 2714934 - RNA, 16 nt, Human
gaucacggcucacugc

SEQ ID NO: 2714935 - RNA, 24 nt, Human
gauaugauucaaaugucuauaaac

SEQ ID NO: 2714936 - RNA, 22 nt, Human
gauaugauucaaaugucuauaa

SEQ ID NO: 2714937 - RNA, 14 nt, Human
gauaugauucaaau

SEQ ID NO: 2714938 - RNA, 17 nt, Human
gaggucagagccugcag

SEQ ID NO: 2714939 - RNA, 20 nt, Human
gaggucagagccugcaguua

SEQ ID NO: 2714940 - RNA, 15 nt, Human
gagguugggaggcca

SEQ ID NO: 2714941 - RNA, 17 nt, Human
gagguugggaggccauu

SEQ ID NO: 2714942 - RNA, 16 nt, Human
gagguuucaaaccucc

SEQ ID NO: 2714943 - RNA, 20 nt, Human
gaguacuacaguccucccau

SEQ ID NO: 2714944 - RNA, 21 nt, Human
gaguacuacaguccucccauc

SEQ ID NO: 2714945 - RNA, 23 nt, Human
gaguacuacaguccucccaucuc

SEQ ID NO: 2714946 - RNA, 19 nt, Human
gaguagcugggacuacagg

SEQ ID NO: 2714947 - RNA, 22 nt, Human
gaguagcugggacuacaggcac

SEQ ID NO: 2714948 - RNA, 12 nt, Human
gaguaggaagac

SEQ ID NO: 2714949 - RNA, 13 nt, Human
gaguaggaagacu

SEQ ID NO: 2714950 - RNA, 17 nt, Human
gaguaggaagacuuugg

SEQ ID NO: 2714951 - RNA, 17 nt, Human
gagugaagcugggagaa

SEQ ID NO: 2714952 - RNA, 14 nt, Human
gagugacagaggca

SEQ ID NO: 2714953 - RNA, 15 nt, Human
gagugacagaggcag

SEQ ID NO: 2714954 - RNA, 16 nt, Human
gagugacagaggcagc

SEQ ID NO: 2714955 - RNA, 15 nt, Human
gagucugaaggcugg

SEQ ID NO: 2714956 - RNA, 14 nt, Human
gagucugaaggcug

SEQ ID NO: 2714957 - RNA, 12 nt, Human
gagucugaaggc

SEQ ID NO: 2714958 - RNA, 13 nt, Human
gagucugaaggcu

SEQ ID NO: 2714959 - RNA, 21 nt, Human
gagucuauuuacggaacucaa

SEQ ID NO: 2714960 - RNA, 18 nt, Human
gaguaggaagacuuugga

SEQ ID NO: 2714961 - RNA, 19 nt, Human
gaguaggaagacuuuggaa

SEQ ID NO: 2714962 - RNA, 11 nt, Human
gaguauauguc

SEQ ID NO: 2714963 - RNA, 15 nt, Human
gagucgaggacaggg

SEQ ID NO: 2714964 - RNA, 16 nt, Human
gagucgaggacaggga

SEQ ID NO: 2714965 - RNA, 19 nt, Human
gaguccgaaagggacuugg

SEQ ID NO: 2714966 - RNA, 14 nt, Human
gagucgaggacagg

SEQ ID NO: 2714967 - RNA, 15 nt, Human
gcacugacuucuaag

SEQ ID NO: 2714968 - RNA, 16 nt, Human
gcacgauuucuguuua

SEQ ID NO: 2714969 - RNA, 18 nt, Human
gcacugacuucuaaguaa

SEQ ID NO: 2714970 - RNA, 23 nt, Human
gcacugcuuccagugaggcucug

SEQ ID NO: 2714971 - RNA, 18 nt, Human
gcagacaggaccagggau

SEQ ID NO: 2714972 - RNA, 12 nt, Human
gcagacaggcaa

SEQ ID NO: 2714973 - RNA, 13 nt, Human
gcagacaggcaag

SEQ ID NO: 2714974 - RNA, 14 nt, Human
gcagacaggcaagc

SEQ ID NO: 2714975 - RNA, 18 nt, Human
gcagaaggaagacuucau

SEQ ID NO: 2714976 - RNA, 22 nt, Human
gcacagaguuguuacauuuuua

SEQ ID NO: 2714977 - RNA, 21 nt, Human
gcacagaguuguuacauuuuu

SEQ ID NO: 2714978 - RNA, 19 nt, Human
gcacagaguuguuacauuu

SEQ ID NO: 2714979 - RNA, 18 nt, Human
gcacagaguuguuacauu

SEQ ID NO: 2714980 - RNA, 16 nt, Human
gcacagaguuguuaca

SEQ ID NO: 2714981 - RNA, 12 nt, Human
gcaccauaacuu

SEQ ID NO: 2714982 - RNA, 19 nt, Human
gcaccuuagacagucccug

SEQ ID NO: 2714983 - RNA, 15 nt, Human
gcacgauuucuguuu

SEQ ID NO: 2714984 - RNA, 13 nt, Human
gcacgauuucugu

SEQ ID NO: 2714985 - RNA, 20 nt, Human
gcaccuuagacagucccugc

SEQ ID NO: 2714986 - RNA, 21 nt, Human
gcaccuuagacagucccugcc

SEQ ID NO: 2714987 - RNA, 20 nt, Human
gcacagaaaauggaagacag

SEQ ID NO: 2714988 - RNA, 20 nt, Human
gcacaccgggcacucagaag

SEQ ID NO: 2714989 - RNA, 18 nt, Human
gcacaagcuccaagcucc

SEQ ID NO: 2714990 - RNA, 15 nt, Human
gcacaagcuccaagc

SEQ ID NO: 2714991 - RNA, 17 nt, Human
gcacaagcuccaagcuc

SEQ ID NO: 2714992 - RNA, 23 nt, Human
gcacagaaaauggaagacagcuc

SEQ ID NO: 2714993 - RNA, 21 nt, Human
gcacagaaaauggaagacagc

SEQ ID NO: 2714994 - RNA, 22 nt, Human
gcacagaaaauggaagacagcu

SEQ ID NO: 2714995 - RNA, 14 nt, Human
gcacagacccugcc

SEQ ID NO: 2714996 - RNA, 15 nt, Human
gcacagacccugccc

SEQ ID NO: 2714997 - RNA, 16 nt, Human
gcacagacccugcccu

SEQ ID NO: 2714998 - RNA, 17 nt, Human
gcacagacccugcccug

SEQ ID NO: 2714999 - RNA, 15 nt, Human
gcacagaguuguuac

SEQ ID NO: 2715000 - RNA, 22 nt, Human
gcacagacccugcccugugggc

SEQ ID NO: 2715001 - RNA, 18 nt, Human
gcacagacccugcccugu

SEQ ID NO: 2715002 - RNA, 19 nt, Human
gcacagacccugcccugug

SEQ ID NO: 2715003 - RNA, 20 nt, Human
gcacagacccugcccugugg

SEQ ID NO: 2715004 - RNA, 21 nt, Human
gcacagacccugcccuguggg

SEQ ID NO: 2715005 - RNA, 15 nt, Human
gcaauggcagccuug

SEQ ID NO: 2715006 - RNA, 13 nt, Human
gcaacucugaagg

SEQ ID NO: 2715007 - RNA, 14 nt, Human
gcaacucaucuuag

SEQ ID NO: 2715008 - RNA, 14 nt, Human
gcaaugugauaaaa

SEQ ID NO: 2715009 - RNA, 14 nt, Human
gcaauuucauaugc

SEQ ID NO: 2715010 - RNA, 15 nt, Human
gcacaaacagaggcc

SEQ ID NO: 2715011 - RNA, 16 nt, Human
gcacaaacagaggccg

SEQ ID NO: 2715012 - RNA, 14 nt, Human
gcacaaacagaggc

SEQ ID NO: 2715013 - RNA, 19 nt, Human
gaugcccaaagaugcagcc

SEQ ID NO: 2715014 - RNA, 20 nt, Human
gaugcccaaagaugcagccg

SEQ ID NO: 2715015 - RNA, 22 nt, Human
gauggccgggcgcgguggcuca

SEQ ID NO: 2715016 - RNA, 20 nt, Human
gaugggcaacccccagccug

SEQ ID NO: 2715017 - RNA, 21 nt, Human
gaugggcaacccccagccugc

SEQ ID NO: 2715018 - RNA, 24 nt, Human
gauggggcccugccuccuuuguga

SEQ ID NO: 2715019 - RNA, 19 nt, Human
gaugggugcuuggaggaag

SEQ ID NO: 2715020 - RNA, 19 nt, Human
gauggggcugcaccggcug

SEQ ID NO: 2715021 - RNA, 15 nt, Human
gauggggcugcaccg

SEQ ID NO: 2715022 - RNA, 13 nt, Human
gauggggcugcac

SEQ ID NO: 2715023 - RNA, 22 nt, Human
gauuacaagcgugagccacugc

SEQ ID NO: 2715024 - RNA, 15 nt, Human
gauuaaacuuaaucu

SEQ ID NO: 2715025 - RNA, 23 nt, Human
gauuacaagcgugagccacugca

SEQ ID NO: 2715026 - RNA, 17 nt, Human
gauggugcaaugaccuu

SEQ ID NO: 2715027 - RNA, 15 nt, Human
gauggugcaaugacc

SEQ ID NO: 2715028 - RNA, 16 nt, Human
gauggugcaaugaccu

SEQ ID NO: 2715029 - RNA, 12 nt, Human
gauggugcaaug

SEQ ID NO: 2715030 - RNA, 14 nt, Human
gauggugcaaugac

SEQ ID NO: 2715031 - RNA, 16 nt, Human
gcaaauugucacagga

SEQ ID NO: 2715032 - RNA, 21 nt, Human
gcaaagcugaugacaacuucc

SEQ ID NO: 2715033 - RNA, 15 nt, Human
gcaaaccaucauuga

SEQ ID NO: 2715034 - RNA, 21 nt, Human
gauuuugaaauuuuuauuaaa

SEQ ID NO: 2715035 - RNA, 19 nt, Human
gauuuugauccaagcuggu

SEQ ID NO: 2715036 - RNA, 12 nt, Human
gcaaaccaucau

SEQ ID NO: 2715037 - RNA, 14 nt, Human
gauucuccugccuc

SEQ ID NO: 2715038 - RNA, 21 nt, Human
gauucaaugccccugaauuua

SEQ ID NO: 2715039 - RNA, 20 nt, Human
gauucaaugccccugaauuu

SEQ ID NO: 2715040 - RNA, 19 nt, Human
gauucaaugccccugaauu

SEQ ID NO: 2715041 - RNA, 22 nt, Human
gauuuccguuaaaauaccagcc

SEQ ID NO: 2715042 - RNA, 15 nt, Human
gauuuaacagaaaug

SEQ ID NO: 2715043 - RNA, 12 nt, Human
gauuuaaaucag

SEQ ID NO: 2715044 - RNA, 14 nt, Human
gauuuaacagaaau

SEQ ID NO: 2715045 - RNA, 13 nt, Human
gauuuaacagaaa

SEQ ID NO: 2715046 - RNA, 16 nt, Human
ggcaacccccagccug

SEQ ID NO: 2715047 - RNA, 17 nt, Human
ggcaacccccagccugc

SEQ ID NO: 2715048 - RNA, 17 nt, Human
ggauugcuacuguccua

SEQ ID NO: 2715049 - RNA, 16 nt, Human
ggauucuuaaaguuga

SEQ ID NO: 2715050 - RNA, 19 nt, Human
ggauucuuaaaguugaauu

SEQ ID NO: 2715051 - RNA, 18 nt, Human
ggauucuuaaaguugaau

SEQ ID NO: 2715052 - RNA, 23 nt, Human
ggauuacaagcgugagccacugc

SEQ ID NO: 2715053 - RNA, 16 nt, Human
ggauucuuauggacaa

SEQ ID NO: 2715054 - RNA, 20 nt, Human
ggauucuuaaaguugaauuu

SEQ ID NO: 2715055 - RNA, 14 nt, Human
ggcaaugcuggcug

SEQ ID NO: 2715056 - RNA, 15 nt, Human
ggcaaugcuggcugu

SEQ ID NO: 2715057 - RNA, 23 nt, Human
ggcaaugcuggcuguuggcuggg

SEQ ID NO: 2715058 - RNA, 18 nt, Human
ggcaacccccagccugcu

SEQ ID NO: 2715059 - RNA, 23 nt, Human
ggcacccaccaucaugucuggcu

SEQ ID NO: 2715060 - RNA, 22 nt, Human
ggcacccggccccugcugguuc

SEQ ID NO: 2715061 - RNA, 22 nt, Human
ggaucccucauccucauaccca

SEQ ID NO: 2715062 - RNA, 13 nt, Human
ggaucccucaucc

SEQ ID NO: 2715063 - RNA, 17 nt, Human
ggaucccucauccucau

SEQ ID NO: 2715064 - RNA, 14 nt, Human
ggagugcagugagc

SEQ ID NO: 2715065 - RNA, 12 nt, Human
ggagugcaguga

SEQ ID NO: 2715066 - RNA, 23 nt, Human
ggagugaguugauagcacagacc

SEQ ID NO: 2715067 - RNA, 18 nt, Human
ggauacaaaagcauguga

SEQ ID NO: 2715068 - RNA, 12 nt, Human
ggauccuccagg

SEQ ID NO: 2715069 - RNA, 13 nt, Human
ggauccuccaggu

SEQ ID NO: 2715070 - RNA, 23 nt, Human
ggaugcacagaguuguuacauuu

SEQ ID NO: 2715071 - RNA, 21 nt, Human
ggaugauuggaggggggaggu

SEQ ID NO: 2715072 - RNA, 16 nt, Human
ggaugcagccucacag

SEQ ID NO: 2715073 - RNA, 17 nt, Human
ggaugcagccucacagu

SEQ ID NO: 2715074 - RNA, 19 nt, Human
ggaugcagccucacagucc

SEQ ID NO: 2715075 - RNA, 15 nt, Human
ggaugcuuguacaua

SEQ ID NO: 2715076 - RNA, 19 nt, Human
ggauuacaagcgugagcca

SEQ ID NO: 2715077 - RNA, 14 nt, Human
ggcauggcugggaa

SEQ ID NO: 2715078 - RNA, 18 nt, Human
ggcaugggaaugaauguc

SEQ ID NO: 2715079 - RNA, 22 nt, Human
ggcaugggaaugaaugucagug

SEQ ID NO: 2715080 - RNA, 17 nt, Human
ggcauuccccaggaggc

SEQ ID NO: 2715081 - RNA, 16 nt, Human
ggcauuccccaggagg

SEQ ID NO: 2715082 - RNA, 18 nt, Human
ggcauuccccaggaggcc

SEQ ID NO: 2715083 - RNA, 19 nt, Human
ggcauuccccaggaggcca

SEQ ID NO: 2715084 - RNA, 23 nt, Human
ggccagcugcuugggcuucaucc

SEQ ID NO: 2715085 - RNA, 18 nt, Human
ggccaggcccucugccca

SEQ ID NO: 2715086 - RNA, 20 nt, Human
ggccagccuugaccauucuc

SEQ ID NO: 2715087 - RNA, 22 nt, Human
ggccagccuugaccauucucca

SEQ ID NO: 2715088 - RNA, 17 nt, Human
ggccagcugcuugggcu

SEQ ID NO: 2715089 - RNA, 16 nt, Human
ggccaugggccuccug

SEQ ID NO: 2715090 - RNA, 18 nt, Human
ggcaugacacgaauauug

SEQ ID NO: 2715091 - RNA, 19 nt, Human
ggcagggucucacucuguc

SEQ ID NO: 2715092 - RNA, 20 nt, Human
ggcagggucucacucugucg

SEQ ID NO: 2715093 - RNA, 13 nt, Human
ggcagugggagcu

SEQ ID NO: 2715094 - RNA, 14 nt, Human
ggcagugggagcug

SEQ ID NO: 2715095 - RNA, 16 nt, Human
ggcagugggagcugcc

SEQ ID NO: 2715096 - RNA, 13 nt, Human
ggcagcucagaga

SEQ ID NO: 2715097 - RNA, 21 nt, Human
ggcagcucagagaggguggga

SEQ ID NO: 2715098 - RNA, 22 nt, Human
ggcagcugcuuuugucuauggg

SEQ ID NO: 2715099 - RNA, 17 nt, Human
ggcagcuugaggguugg

SEQ ID NO: 2715100 - RNA, 12 nt, Human
ggcagcucaccu

SEQ ID NO: 2715101 - RNA, 14 nt, Human
ggcagcucaccucu

SEQ ID NO: 2715102 - RNA, 18 nt, Human
ggcgcugccccuggcagc

SEQ ID NO: 2715103 - RNA, 19 nt, Human
ggcgcugccccuggcagcc

SEQ ID NO: 2715104 - RNA, 21 nt, Human
ggcgcugccccuggcagcccc

SEQ ID NO: 2715105 - RNA, 23 nt, Human
ggcgcugccccuggcagccccug

SEQ ID NO: 2715106 - RNA, 19 nt, Human
ggccuggccugagcuggga

SEQ ID NO: 2715107 - RNA, 14 nt, Human
ggccugggggcugg

SEQ ID NO: 2715108 - RNA, 20 nt, Human
ggccugggggcugggcagag

SEQ ID NO: 2715109 - RNA, 22 nt, Human
ggccugggggcugggcagagga

SEQ ID NO: 2715110 - RNA, 16 nt, Human
ggcuaguugggcuucc

SEQ ID NO: 2715111 - RNA, 15 nt, Human
ggcuaguugggcuuc

SEQ ID NO: 2715112 - RNA, 23 nt, Human
ggcuagugugguguuuccuggca

SEQ ID NO: 2715113 - RNA, 15 nt, Human
ggcuaugcauuugaa

SEQ ID NO: 2715114 - RNA, 22 nt, Human
ggcuaggaccccuccauguggg

SEQ ID NO: 2715115 - RNA, 16 nt, Human
ggcuaggaccccucca

SEQ ID NO: 2715116 - RNA, 22 nt, Human
ggcuagagguucaaagauauuu

SEQ ID NO: 2715117 - RNA, 17 nt, Human
ggcuagagguucaaaga

SEQ ID NO: 2715118 - RNA, 15 nt, Human
ggcucaaguccucuu

SEQ ID NO: 2715119 - RNA, 21 nt, Human
ggcucaaguccucuuuucuga

SEQ ID NO: 2715120 - RNA, 12 nt, Human
ggcuccaggagc

SEQ ID NO: 2715121 - RNA, 13 nt, Human
ggcuccaggagca

SEQ ID NO: 2715122 - RNA, 19 nt, Human
ggcuccaggagcagccaca

SEQ ID NO: 2715123 - RNA, 15 nt, Human
ggcuccaggcuccuu

SEQ ID NO: 2715124 - RNA, 11 nt, Human
ggcuccaggcu

SEQ ID NO: 2715125 - RNA, 16 nt, Human
ggcuccaggcuccuuu

SEQ ID NO: 2715126 - RNA, 23 nt, Human
ggccuagcauacguacacauuuu

SEQ ID NO: 2715127 - RNA, 17 nt, Human
ggccucuuaugggcugg

SEQ ID NO: 2715128 - RNA, 18 nt, Human
ggccucuuaugggcuggg

SEQ ID NO: 2715129 - RNA, 13 nt, Human
ggccucugcacuc

SEQ ID NO: 2715130 - RNA, 14 nt, Human
ggccucugcacucc

SEQ ID NO: 2715131 - RNA, 15 nt, Human
ggccucugcacuccc

SEQ ID NO: 2715132 - RNA, 16 nt, Human
ggccucugcacucccc

SEQ ID NO: 2715133 - RNA, 11 nt, Human
ggcccagagag

SEQ ID NO: 2715134 - RNA, 12 nt, Human
ggcccagagagg

SEQ ID NO: 2715135 - RNA, 21 nt, Human
ggcccucugcccacucccugc

SEQ ID NO: 2715136 - RNA, 19 nt, Human
ggcccucugcccacucccu

SEQ ID NO: 2715137 - RNA, 20 nt, Human
ggcccucugcccacucccug

SEQ ID NO: 2715138 - RNA, 13 nt, Human
ggcccucugccca

SEQ ID NO: 2715139 - RNA, 15 nt, Human
ggcccucugcccacu

SEQ ID NO: 2715140 - RNA, 16 nt, Human
ggcccucugcccacuc

SEQ ID NO: 2715141 - RNA, 17 nt, Human
ggcccucugcccacucc

SEQ ID NO: 2715142 - RNA, 13 nt, Human
ggcccugccuccu

SEQ ID NO: 2715143 - RNA, 14 nt, Human
ggcccugccuccuu

SEQ ID NO: 2715144 - RNA, 15 nt, Human
ggcccugccuccuuu

SEQ ID NO: 2715145 - RNA, 14 nt, Human
ggacuguggugacu

SEQ ID NO: 2715146 - RNA, 17 nt, Human
ggagaagcggcuggcag

SEQ ID NO: 2715147 - RNA, 18 nt, Human
ggagaagcggcuggcagc

SEQ ID NO: 2715148 - RNA, 22 nt, Human
ggacuguggugacuuuggauaa

SEQ ID NO: 2715149 - RNA, 21 nt, Human
ggacuguggugacuuuggaua

SEQ ID NO: 2715150 - RNA, 17 nt, Human
ggacuguggugacuuug

SEQ ID NO: 2715151 - RNA, 15 nt, Human
ggacuguggugacuu

SEQ ID NO: 2715152 - RNA, 17 nt, Human
ggacacucaaaagcugg

SEQ ID NO: 2715153 - RNA, 22 nt, Human
ggacacucaaaagcugggcagg

SEQ ID NO: 2715154 - RNA, 15 nt, Human
ggacagccacggcca

SEQ ID NO: 2715155 - RNA, 19 nt, Human
ggacagccacggccaggcc

SEQ ID NO: 2715156 - RNA, 20 nt, Human
ggacagccacggccaggcca

SEQ ID NO: 2715157 - RNA, 21 nt, Human
ggacagccacggccaggccag

SEQ ID NO: 2715158 - RNA, 14 nt, Human
ggaccaaaaaccag

SEQ ID NO: 2715159 - RNA, 23 nt, Human
ggaccaaaaaccaguauuguaca

SEQ ID NO: 2715160 - RNA, 16 nt, Human
ggaccaaaaaccagua

SEQ ID NO: 2715161 - RNA, 14 nt, Human
ggacauggacaagg

SEQ ID NO: 2715162 - RNA, 20 nt, Human
ggacauugcggacagccacg

SEQ ID NO: 2715163 - RNA, 13 nt, Human
ggaccagagcugc

SEQ ID NO: 2715164 - RNA, 19 nt, Human
ggaccucaggugagaagca

SEQ ID NO: 2715165 - RNA, 20 nt, Human
ggaccucaggccugggggcu

SEQ ID NO: 2715166 - RNA, 23 nt, Human
ggaccucaggugagaagcagagg

SEQ ID NO: 2715167 - RNA, 15 nt, Human
ggaccuugaacuggg

SEQ ID NO: 2715168 - RNA, 17 nt, Human
ggaccuugaacugggua

SEQ ID NO: 2715169 - RNA, 17 nt, Human
ggacgcuacccgggaag

SEQ ID NO: 2715170 - RNA, 19 nt, Human
ggacgcuacccgggaaggg

SEQ ID NO: 2715171 - RNA, 20 nt, Human
ggacgcuacccgggaagggg

SEQ ID NO: 2715172 - RNA, 23 nt, Human
ggaauuucucccagucauuuaau

SEQ ID NO: 2715173 - RNA, 16 nt, Human
ggaauuggagcucgug

SEQ ID NO: 2715174 - RNA, 22 nt, Human
ggaauuggagcucgugggacag

SEQ ID NO: 2715175 - RNA, 17 nt, Human
ggacaaaauggaauacu

SEQ ID NO: 2715176 - RNA, 16 nt, Human
ggacaaaauggaauac

SEQ ID NO: 2715177 - RNA, 19 nt, Human
ggaauguuugccucugccu

SEQ ID NO: 2715178 - RNA, 17 nt, Human
ggaauucuguauagauu

SEQ ID NO: 2715179 - RNA, 15 nt, Human
ggaauucuguauaga

SEQ ID NO: 2715180 - RNA, 12 nt, Human
ggaauucuguau

SEQ ID NO: 2715181 - RNA, 14 nt, Human
ggaaugcuguguua

SEQ ID NO: 2715182 - RNA, 12 nt, Human
ggaaugcagugg

SEQ ID NO: 2715183 - RNA, 24 nt, Human
ggaaugauuaauuaaaacacaaca

SEQ ID NO: 2715184 - RNA, 14 nt, Human
ggaaugauuaauua

SEQ ID NO: 2715185 - RNA, 18 nt, Human
ggaaguacuggagaaaau

SEQ ID NO: 2715186 - RNA, 12 nt, Human
ggaaguacugga

SEQ ID NO: 2715187 - RNA, 16 nt, Human
ggaaguacuggagaaa

SEQ ID NO: 2715188 - RNA, 23 nt, Human
ggaaggggagauaaggguaucug

SEQ ID NO: 2715189 - RNA, 22 nt, Human
ggaaaggcuccaggagcagcca

SEQ ID NO: 2715190 - RNA, 17 nt, Human
ggaaaggcuccaggagc

SEQ ID NO: 2715191 - RNA, 19 nt, Human
ggaaaggcuccaggagcag

SEQ ID NO: 2715192 - RNA, 20 nt, Human
ggaaaggcuccaggagcagc

SEQ ID NO: 2715193 - RNA, 21 nt, Human
ggaaaggcuccaggagcagcc

SEQ ID NO: 2715194 - RNA, 23 nt, Human
ggaaaaucagccugcuccagcug

SEQ ID NO: 2715195 - RNA, 19 nt, Human
ggaaaaucagccugcucca

SEQ ID NO: 2715196 - RNA, 14 nt, Human
ggaaaaguuuaaua

SEQ ID NO: 2715197 - RNA, 12 nt, Human
ggaaaggcucca

SEQ ID NO: 2715198 - RNA, 13 nt, Human
ggaaaggcuccag

SEQ ID NO: 2715199 - RNA, 14 nt, Human
ggaaaggcuccagg

SEQ ID NO: 2715200 - RNA, 17 nt, Human
ggaaaucaaauaugcaa

SEQ ID NO: 2715201 - RNA, 14 nt, Human
ggaaaucaccgaaa

SEQ ID NO: 2715202 - RNA, 21 nt, Human
ggaaaucaccgaaaacguggc

SEQ ID NO: 2715203 - RNA, 16 nt, Human
ggaaaucaaauaugca

SEQ ID NO: 2715204 - RNA, 21 nt, Human
gcuuuguuuguugucagcuga

SEQ ID NO: 2715205 - RNA, 18 nt, Human
ggaaaacaugcuacacac

SEQ ID NO: 2715206 - RNA, 14 nt, Human
ggaaaagcugcuga

SEQ ID NO: 2715207 - RNA, 18 nt, Human
ggaaaagcugcugacagu

SEQ ID NO: 2715208 - RNA, 20 nt, Human
ggaaaagcugcugacagugu

SEQ ID NO: 2715209 - RNA, 15 nt, Human
gcuuugugauuuuug

SEQ ID NO: 2715210 - RNA, 18 nt, Human
gcuuucagauacuggauu

SEQ ID NO: 2715211 - RNA, 14 nt, Human
gcuuucagauacug

SEQ ID NO: 2715212 - RNA, 20 nt, Human
gcuuuguauagaaccucuuu

SEQ ID NO: 2715213 - RNA, 23 nt, Human
gcuuucagauacuggauuguacu

SEQ ID NO: 2715214 - RNA, 18 nt, Human
gcuugaggguugggcugg

SEQ ID NO: 2715215 - RNA, 20 nt, Human
gcuugaggguugggcuggug

SEQ ID NO: 2715216 - RNA, 20 nt, Human
gcugucuacacuaagagaga

SEQ ID NO: 2715217 - RNA, 15 nt, Human
gcugccaaugggagc

SEQ ID NO: 2715218 - RNA, 16 nt, Human
gcugccaaugggagcu

SEQ ID NO: 2715219 - RNA, 19 nt, Human
gcugccaaugggagcucau

SEQ ID NO: 2715220 - RNA, 21 nt, Human
gcuguucaugaaagauucaau

SEQ ID NO: 2715221 - RNA, 14 nt, Human
gcuguucagcuggu

SEQ ID NO: 2715222 - RNA, 13 nt, Human
gcuguucagcugg

SEQ ID NO: 2715223 - RNA, 12 nt, Human
gcuguucaugaa

SEQ ID NO: 2715224 - RNA, 21 nt, Human
gcuuagucacugagacagccc

SEQ ID NO: 2715225 - RNA, 19 nt, Human
gcuuagucacugagacagc

SEQ ID NO: 2715226 - RNA, 20 nt, Human
gcuuagucacugagacagcc

SEQ ID NO: 2715227 - RNA, 15 nt, Human
gcuuagucacugaga

SEQ ID NO: 2715228 - RNA, 17 nt, Human
gcuuagucacugagaca

SEQ ID NO: 2715229 - RNA, 16 nt, Human
gcuucaguggcagcug

SEQ ID NO: 2715230 - RNA, 12 nt, Human
gcuuauacacuu

SEQ ID NO: 2715231 - RNA, 13 nt, Human
gcuuaucucaggg

SEQ ID NO: 2715232 - RNA, 19 nt, Human
gcuuaucucaggggugugc

SEQ ID NO: 2715233 - RNA, 17 nt, Human
gcuucaguggcagcugc

SEQ ID NO: 2715234 - RNA, 18 nt, Human
gcuucaguggcagcugcu

SEQ ID NO: 2715235 - RNA, 13 nt, Human
gcuucauuuccug

SEQ ID NO: 2715236 - RNA, 16 nt, Human
gcuucauuuccugugu

SEQ ID NO: 2715237 - RNA, 12 nt, Human
gcuucauccucc

SEQ ID NO: 2715238 - RNA, 15 nt, Human
gcuucauccuccuca

SEQ ID NO: 2715239 - RNA, 16 nt, Human
gcuugaggguugggcu

SEQ ID NO: 2715240 - RNA, 15 nt, Human
gcuuccagugaggcu

SEQ ID NO: 2715241 - RNA, 17 nt, Human
gcuucauuuccuguguc

SEQ ID NO: 2715242 - RNA, 16 nt, Human
gcuuccagugaggcuc

SEQ ID NO: 2715243 - RNA, 19 nt, Human
gccgagauagccaaggcca

SEQ ID NO: 2715244 - RNA, 14 nt, Human
gccucaaccuccug

SEQ ID NO: 2715245 - RNA, 16 nt, Human
gccucaaccuccuggg

SEQ ID NO: 2715246 - RNA, 19 nt, Human
gccucaagugauucuccug

SEQ ID NO: 2715247 - RNA, 20 nt, Human
gccucaagugauucuccugc

SEQ ID NO: 2715248 - RNA, 21 nt, Human
gccucaagugauucuccugcc

SEQ ID NO: 2715249 - RNA, 12 nt, Human
gccucagugcca

SEQ ID NO: 2715250 - RNA, 14 nt, Human
gccucagugccacu

SEQ ID NO: 2715251 - RNA, 23 nt, Human
gccucagccucccaaagugcugg

SEQ ID NO: 2715252 - RNA, 21 nt, Human
gccucacaguccuuaccagca

SEQ ID NO: 2715253 - RNA, 23 nt, Human
gccucccgaauagcugggacuac

SEQ ID NO: 2715254 - RNA, 15 nt, Human
gccucccgaguagcu

SEQ ID NO: 2715255 - RNA, 14 nt, Human
gccucccacgacug

SEQ ID NO: 2715256 - RNA, 21 nt, Human
gccucccacgacugcccggca

SEQ ID NO: 2715257 - RNA, 21 nt, Human
gccucccgaauagcugggacu

SEQ ID NO: 2715258 - RNA, 22 nt, Human
gccucccaacucaccccagccc

SEQ ID NO: 2715259 - RNA, 23 nt, Human
gccucccaacucaccccagcccc

SEQ ID NO: 2715260 - RNA, 21 nt, Human
gccucccaacucaccccagcc

SEQ ID NO: 2715261 - RNA, 15 nt, Human
gccucagugccacua

SEQ ID NO: 2715262 - RNA, 21 nt, Human
gccugggggcugggcagagga

SEQ ID NO: 2715263 - RNA, 20 nt, Human
gccugggggcugggcagagg

SEQ ID NO: 2715264 - RNA, 18 nt, Human
gccugggcagaaggaaga

SEQ ID NO: 2715265 - RNA, 16 nt, Human
gccugggcagaaggaa

SEQ ID NO: 2715266 - RNA, 17 nt, Human
gccugggcagaaggaag

SEQ ID NO: 2715267 - RNA, 15 nt, Human
gccugggcagaagga

SEQ ID NO: 2715268 - RNA, 14 nt, Human
gccuggccagaugc

SEQ ID NO: 2715269 - RNA, 15 nt, Human
gccuggccagaugca

SEQ ID NO: 2715270 - RNA, 14 nt, Human
gccuggauggggcu

SEQ ID NO: 2715271 - RNA, 15 nt, Human
gccuggauggggcug

SEQ ID NO: 2715272 - RNA, 15 nt, Human
gccugcuccagcugu

SEQ ID NO: 2715273 - RNA, 13 nt, Human
gccugauuaaaga

SEQ ID NO: 2715274 - RNA, 16 nt, Human
gccugauuaaagaaug

SEQ ID NO: 2715275 - RNA, 23 nt, Human
gccugcacggugaauggcuuugu

SEQ ID NO: 2715276 - RNA, 16 nt, Human
gccugcuccagcuguu

SEQ ID NO: 2715277 - RNA, 18 nt, Human
gccugcuccagcuguuca

SEQ ID NO: 2715278 - RNA, 22 nt, Human
gccugaagucacacagugaguc

SEQ ID NO: 2715279 - RNA, 18 nt, Human
gccucugccucugacaca

SEQ ID NO: 2715280 - RNA, 12 nt, Human
gcccucuccugg

SEQ ID NO: 2715281 - RNA, 13 nt, Human
gcccucuccuggg

SEQ ID NO: 2715282 - RNA, 14 nt, Human
gcccucuccugggc

SEQ ID NO: 2715283 - RNA, 22 nt, Human
gcccucuccugggcagcugccu

SEQ ID NO: 2715284 - RNA, 23 nt, Human
gcccucuccugggcagcugccuc

SEQ ID NO: 2715285 - RNA, 12 nt, Human
gcccucugccca

SEQ ID NO: 2715286 - RNA, 16 nt, Human
gcccugagcuuucugc

SEQ ID NO: 2715287 - RNA, 17 nt, Human
gcccggcuccaggcucc

SEQ ID NO: 2715288 - RNA, 18 nt, Human
gcccggcuccaggcuccu

SEQ ID NO: 2715289 - RNA, 16 nt, Human
gcccggcuccaggcuc

SEQ ID NO: 2715290 - RNA, 13 nt, Human
gccccugccaccc

SEQ ID NO: 2715291 - RNA, 14 nt, Human
gccccugccacccu

SEQ ID NO: 2715292 - RNA, 15 nt, Human
gccccugccacccug

SEQ ID NO: 2715293 - RNA, 21 nt, Human
gccccuguucuggcagaguug

SEQ ID NO: 2715294 - RNA, 17 nt, Human
gccccuguucuggcaga

SEQ ID NO: 2715295 - RNA, 15 nt, Human
gcagacucuacagag

SEQ ID NO: 2715296 - RNA, 21 nt, Human
gcccuucucuccagccccugg

SEQ ID NO: 2715297 - RNA, 22 nt, Human
gcccuucucuccagccccugga

SEQ ID NO: 2715298 - RNA, 19 nt, Human
gcccuucucuccagccccu

SEQ ID NO: 2715299 - RNA, 18 nt, Human
gccgagauugcaccacug

SEQ ID NO: 2715300 - RNA, 17 nt, Human
gccgagauugcaccacu

SEQ ID NO: 2715301 - RNA, 18 nt, Human
gccgagaucacgccacug

SEQ ID NO: 2715302 - RNA, 19 nt, Human
gccgagaucacgccacugc

SEQ ID NO: 2715303 - RNA, 16 nt, Human
gccgagaucacgccac

SEQ ID NO: 2715304 - RNA, 14 nt, Human
gcccugguggcagu

SEQ ID NO: 2715305 - RNA, 17 nt, Human
gcccugguggcaguggg

SEQ ID NO: 2715306 - RNA, 18 nt, Human
gcccugguggcaguggga

SEQ ID NO: 2715307 - RNA, 19 nt, Human
gcccugguggcagugggag

SEQ ID NO: 2715308 - RNA, 20 nt, Human
gcccugguggcagugggagc

SEQ ID NO: 2715309 - RNA, 21 nt, Human
gcccugguggcagugggagcu

SEQ ID NO: 2715310 - RNA, 22 nt, Human
gcccugguggcagugggagcug

SEQ ID NO: 2715311 - RNA, 23 nt, Human
gcccugguggcagugggagcugc

SEQ ID NO: 2715312 - RNA, 14 nt, Human
gcuaagcauuccaa

SEQ ID NO: 2715313 - RNA, 23 nt, Human
gcuaagagggagggagggcucca

SEQ ID NO: 2715314 - RNA, 14 nt, Human
gcuacccgggaagg

SEQ ID NO: 2715315 - RNA, 15 nt, Human
gcuacccgggaaggg

SEQ ID NO: 2715316 - RNA, 21 nt, Human
gcuacccgggaagggggcugg

SEQ ID NO: 2715317 - RNA, 18 nt, Human
gcuagagguucaaagaua

SEQ ID NO: 2715318 - RNA, 21 nt, Human
gcuagagguucaaagauauuu

SEQ ID NO: 2715319 - RNA, 19 nt, Human
gcuagagguucaaagauau

SEQ ID NO: 2715320 - RNA, 23 nt, Human
gcuaucucccccagccccauccu

SEQ ID NO: 2715321 - RNA, 19 nt, Human
gcuaucucccccagcccca

SEQ ID NO: 2715322 - RNA, 20 nt, Human
gcuaucucccccagccccau

SEQ ID NO: 2715323 - RNA, 21 nt, Human
gcuaucucccccagccccauc

SEQ ID NO: 2715324 - RNA, 22 nt, Human
gcuaucucccccagccccaucc

SEQ ID NO: 2715325 - RNA, 16 nt, Human
gcuaucucccccagcc

SEQ ID NO: 2715326 - RNA, 17 nt, Human
gcuaucucccccagccc

SEQ ID NO: 2715327 - RNA, 18 nt, Human
gcuaucucccccagcccc

SEQ ID NO: 2715328 - RNA, 22 nt, Human
gcuagcagcagggagggcuucu

SEQ ID NO: 2715329 - RNA, 18 nt, Human
gcgguccacccaggagcc

SEQ ID NO: 2715330 - RNA, 19 nt, Human
gcgguccacccaggagccc

SEQ ID NO: 2715331 - RNA, 12 nt, Human
gcggggacagcu

SEQ ID NO: 2715332 - RNA, 15 nt, Human
gcgggcuuccuccug

SEQ ID NO: 2715333 - RNA, 13 nt, Human
gcggggacagcuc

SEQ ID NO: 2715334 - RNA, 16 nt, Human
gcgguccacccaggag

SEQ ID NO: 2715335 - RNA, 16 nt, Human
gcgugagccacugcac

SEQ ID NO: 2715336 - RNA, 18 nt, Human
gcgugagccacugcaccg

SEQ ID NO: 2715337 - RNA, 23 nt, Human
gcgugagccacugcaccgggcca

SEQ ID NO: 2715338 - RNA, 13 nt, Human
gcuaaaugugaau

SEQ ID NO: 2715339 - RNA, 16 nt, Human
gcuaaaugugaaugau

SEQ ID NO: 2715340 - RNA, 21 nt, Human
gcuaagagggagggagggcuc

SEQ ID NO: 2715341 - RNA, 22 nt, Human
gcuaagagggagggagggcucc

SEQ ID NO: 2715342 - RNA, 19 nt, Human
gcucaggugucccugcacu

SEQ ID NO: 2715343 - RNA, 15 nt, Human
gcucagcggggacag

SEQ ID NO: 2715344 - RNA, 20 nt, Human
gcucagcggggacagcuccu

SEQ ID NO: 2715345 - RNA, 21 nt, Human
gcucagcggggacagcuccuu

SEQ ID NO: 2715346 - RNA, 22 nt, Human
gcucagcggggacagcuccuuc

SEQ ID NO: 2715347 - RNA, 17 nt, Human
gcucaggugucccugca

SEQ ID NO: 2715348 - RNA, 18 nt, Human
gcucaggugucccugcac

SEQ ID NO: 2715349 - RNA, 20 nt, Human
gcucaccagccccagugccc

SEQ ID NO: 2715350 - RNA, 23 nt, Human
gcucaccagccccagugcccaca

SEQ ID NO: 2715351 - RNA, 18 nt, Human
gcucaccagccccagugc

SEQ ID NO: 2715352 - RNA, 19 nt, Human
gcucaccagccccagugcc

SEQ ID NO: 2715353 - RNA, 17 nt, Human
gcucagcaaaagaugcu

SEQ ID NO: 2715354 - RNA, 20 nt, Human
gcucagcaaaagaugcuucu

SEQ ID NO: 2715355 - RNA, 22 nt, Human
gcucagcaaaagaugcuucuca

SEQ ID NO: 2715356 - RNA, 23 nt, Human
gcucagcaaaagaugcuucucac

SEQ ID NO: 2715357 - RNA, 13 nt, Human
gcuccaagcuccc

SEQ ID NO: 2715358 - RNA, 14 nt, Human
gcuccaagcuccca

SEQ ID NO: 2715359 - RNA, 15 nt, Human
gcuccaagcucccag

SEQ ID NO: 2715360 - RNA, 14 nt, Human
gcuccaagaauuuc

SEQ ID NO: 2715361 - RNA, 21 nt, Human
gcuccaagcucccaggcauuc

SEQ ID NO: 2715362 - RNA, 16 nt, Human
gcuccaagcucccagg

SEQ ID NO: 2715363 - RNA, 17 nt, Human
gcuccaagcucccaggc

SEQ ID NO: 2715364 - RNA, 18 nt, Human
gcuccaagcucccaggca

SEQ ID NO: 2715365 - RNA, 19 nt, Human
gcuccaagcucccaggcau

SEQ ID NO: 2715366 - RNA, 11 nt, Human
gcuccagcugu

SEQ ID NO: 2715367 - RNA, 13 nt, Human
gcuccaggcuccu

SEQ ID NO: 2715368 - RNA, 16 nt, Human
gcuccaggcuccuuua

SEQ ID NO: 2715369 - RNA, 23 nt, Human
gcuccaggcuccuuuagcgccca

SEQ ID NO: 2715370 - RNA, 19 nt, Human
gcucuccgaccagacaccu

SEQ ID NO: 2715371 - RNA, 13 nt, Human
gcucuccgaccag

SEQ ID NO: 2715372 - RNA, 17 nt, Human
gcucuccgaccagacac

SEQ ID NO: 2715373 - RNA, 16 nt, Human
gcucgagcaugccugg

SEQ ID NO: 2715374 - RNA, 15 nt, Human
gcucccuucccaccu

SEQ ID NO: 2715375 - RNA, 16 nt, Human
gcucccuucccaccuc

SEQ ID NO: 2715376 - RNA, 18 nt, Human
gcucccuucccaccucuc

SEQ ID NO: 2715377 - RNA, 15 nt, Human
gcuccuucuguccua

SEQ ID NO: 2715378 - RNA, 19 nt, Human
gcucccuucccaccucucu

SEQ ID NO: 2715379 - RNA, 21 nt, Human
gcuccuucuguccuacucugu

SEQ ID NO: 2715380 - RNA, 14 nt, Human
gcucugcccuuggu

SEQ ID NO: 2715381 - RNA, 23 nt, Human
gcucugcccuugguuaggcauug

SEQ ID NO: 2715382 - RNA, 11 nt, Human
gcucugccucc

SEQ ID NO: 2715383 - RNA, 13 nt, Human
gcucugcuccucu

SEQ ID NO: 2715384 - RNA, 14 nt, Human
gcucugcuccucuc

SEQ ID NO: 2715385 - RNA, 13 nt, Human
gcucugccuccca

SEQ ID NO: 2715386 - RNA, 14 nt, Human
gcucugccucccau

SEQ ID NO: 2715387 - RNA, 15 nt, Human
gcucugccucccauc

SEQ ID NO: 2715388 - RNA, 22 nt, Human
gcucugccucccaucacccgcu

SEQ ID NO: 2715389 - RNA, 14 nt, Human
gcucuggacaggca

SEQ ID NO: 2715390 - RNA, 15 nt, Human
gcucuggacaggcau

SEQ ID NO: 2715391 - RNA, 16 nt, Human
gcucuggacaggcaug

SEQ ID NO: 2715392 - RNA, 21 nt, Human
gcucuggacaggcauguucuc

SEQ ID NO: 2715393 - RNA, 22 nt, Human
gcucuggacaggcauguucucu

SEQ ID NO: 2715394 - RNA, 19 nt, Human
gcucugcuccucuccccag

SEQ ID NO: 2715395 - RNA, 21 nt, Human
gcucugcuccucuccccagca

SEQ ID NO: 2715396 - RNA, 13 nt, Human
gcucugcugacag

SEQ ID NO: 2715397 - RNA, 14 nt, Human
gcucugcugacaga

SEQ ID NO: 2715398 - RNA, 18 nt, Human
gcucugcugacagacaca

SEQ ID NO: 2715399 - RNA, 19 nt, Human
gcucugcugacagacacag

SEQ ID NO: 2715400 - RNA, 20 nt, Human
gcucugcugacagacacagg

SEQ ID NO: 2715401 - RNA, 23 nt, Human
gcucugcugacagacacaggccc

SEQ ID NO: 2715402 - RNA, 21 nt, Human
gcugacagacacaggcccggc

SEQ ID NO: 2715403 - RNA, 20 nt, Human
gcugacagacacaggcccgg

SEQ ID NO: 2715404 - RNA, 22 nt, Human
gcucuuccaggcugggagagcc

SEQ ID NO: 2715405 - RNA, 12 nt, Human
gcucuucuccag

SEQ ID NO: 2715406 - RNA, 19 nt, Human
gcucuuccaggcugggaga

SEQ ID NO: 2715407 - RNA, 18 nt, Human
gcucuuccaggcugggag

SEQ ID NO: 2715408 - RNA, 14 nt, Human
gcucuucuccaggc

SEQ ID NO: 2715409 - RNA, 16 nt, Human
gcucuucuccaggcug

SEQ ID NO: 2715410 - RNA, 22 nt, Human
gcugagugggggaucacagccu

SEQ ID NO: 2715411 - RNA, 23 nt, Human
gcugagugggggaucacagccuc

SEQ ID NO: 2715412 - RNA, 15 nt, Human
gcugauggugcaaug

SEQ ID NO: 2715413 - RNA, 16 nt, Human
gcugauggugcaauga

SEQ ID NO: 2715414 - RNA, 19 nt, Human
gcugagucugaaggcuggg

SEQ ID NO: 2715415 - RNA, 16 nt, Human
gcugagucugaaggcu

SEQ ID NO: 2715416 - RNA, 18 nt, Human
gcugagucugaaggcugg

SEQ ID NO: 2715417 - RNA, 15 nt, Human
gcugagucugaaggc

SEQ ID NO: 2715418 - RNA, 18 nt, Human
gcugauggugcaaugacc

SEQ ID NO: 2715419 - RNA, 21 nt, Human
gcugauggugcaaugaccuuu

SEQ ID NO: 2715420 - RNA, 21 nt, Human
gcugcaguugccagucacccc

SEQ ID NO: 2715421 - RNA, 18 nt, Human
gcugcaguugccagucac

SEQ ID NO: 2715422 - RNA, 20 nt, Human
gcugcaguugccagucaccc

SEQ ID NO: 2715423 - RNA, 19 nt, Human
guaaugauaacuggaaacu

SEQ ID NO: 2715424 - RNA, 15 nt, Human
guaauuggaaaggca

SEQ ID NO: 2715425 - RNA, 18 nt, Human
guacacuguuucaaacuu

SEQ ID NO: 2715426 - RNA, 13 nt, Human
guaauucaagaaa

SEQ ID NO: 2715427 - RNA, 14 nt, Human
guaauucaagaaaa

SEQ ID NO: 2715428 - RNA, 20 nt, Human
guaauuaaguacuauguauc

SEQ ID NO: 2715429 - RNA, 17 nt, Human
guaauuaaguacuaugu

SEQ ID NO: 2715430 - RNA, 14 nt, Human
guaauuaaguacua

SEQ ID NO: 2715431 - RNA, 21 nt, Human
guaauuaaguacuauguauca

SEQ ID NO: 2715432 - RNA, 13 nt, Human
guaauuauaucug

SEQ ID NO: 2715433 - RNA, 15 nt, Human
guacccacugcucug

SEQ ID NO: 2715434 - RNA, 20 nt, Human
guacauaaugcgugcauacc

SEQ ID NO: 2715435 - RNA, 21 nt, Human
guacacuguuucaaacuuuac

SEQ ID NO: 2715436 - RNA, 20 nt, Human
guacacuguuucaaacuuua

SEQ ID NO: 2715437 - RNA, 19 nt, Human
guacacuguuucaaacuuu

SEQ ID NO: 2715438 - RNA, 16 nt, Human
guacagacaacaaacc

SEQ ID NO: 2715439 - RNA, 20 nt, Human
guacagcaaggagauuuaca

SEQ ID NO: 2715440 - RNA, 12 nt, Human
guacagagccca

SEQ ID NO: 2715441 - RNA, 18 nt, Human
guacagagcccacgcccc

SEQ ID NO: 2715442 - RNA, 22 nt, Human
guacagagcccacgcccccacu

SEQ ID NO: 2715443 - RNA, 16 nt, Human
guacccacugcucugg

SEQ ID NO: 2715444 - RNA, 22 nt, Human
guaccucuugagccuugaacuu

SEQ ID NO: 2715445 - RNA, 21 nt, Human
guaccucuugagccuugaacu

SEQ ID NO: 2715446 - RNA, 13 nt, Human
guaccucuugagc

SEQ ID NO: 2715447 - RNA, 14 nt, Human
guacuucuccaccc

SEQ ID NO: 2715448 - RNA, 15 nt, Human
guacuucuccacccu

SEQ ID NO: 2715449 - RNA, 17 nt, Human
guacguugugcauuugg

SEQ ID NO: 2715450 - RNA, 23 nt, Human
guacuaaggaaucuuucugcuuu

SEQ ID NO: 2715451 - RNA, 15 nt, Human
guacuaaggaaucuu

SEQ ID NO: 2715452 - RNA, 15 nt, Human
guacgaagaguauuu

SEQ ID NO: 2715453 - RNA, 14 nt, Human
guacgucugacagg

SEQ ID NO: 2715454 - RNA, 15 nt, Human
guacgucugacaggc

SEQ ID NO: 2715455 - RNA, 17 nt, Human
guacgucugacaggcaa

SEQ ID NO: 2715456 - RNA, 14 nt, Human
guacguugugcauu

SEQ ID NO: 2715457 - RNA, 16 nt, Human
guacguugugcauuug

SEQ ID NO: 2715458 - RNA, 15 nt, Human
guacguugugcauuu

SEQ ID NO: 2715459 - RNA, 16 nt, Human
guagagcggagaaagg

SEQ ID NO: 2715460 - RNA, 21 nt, Human
guacuuuuuggcauaacauaa

SEQ ID NO: 2715461 - RNA, 12 nt, Human
guacuuuuuggc

SEQ ID NO: 2715462 - RNA, 23 nt, Human
guacuuuauuuucuauaauuuaa

SEQ ID NO: 2715463 - RNA, 21 nt, Human
guacuuguggacacagcucuu

SEQ ID NO: 2715464 - RNA, 16 nt, Human
guacuuguggacacag

SEQ ID NO: 2715465 - RNA, 20 nt, Human
guacuuguggacacagcucu

SEQ ID NO: 2715466 - RNA, 20 nt, Human
guacuucuccacccugcucu

SEQ ID NO: 2715467 - RNA, 21 nt, Human
guacuucuccacccugcucuc

SEQ ID NO: 2715468 - RNA, 16 nt, Human
guacuucuccacccug

SEQ ID NO: 2715469 - RNA, 17 nt, Human
guacuucuccacccugc

SEQ ID NO: 2715470 - RNA, 18 nt, Human
guacuucuccacccugcu

SEQ ID NO: 2715471 - RNA, 19 nt, Human
guacuucuccacccugcuc

SEQ ID NO: 2715472 - RNA, 18 nt, Human
guaagggaaacugccagc

SEQ ID NO: 2715473 - RNA, 17 nt, Human
guaagggaaacugccag

SEQ ID NO: 2715474 - RNA, 22 nt, Human
guaaguauucuuauuuaaugaa

SEQ ID NO: 2715475 - RNA, 18 nt, Human
guaaggaauaccuguccc

SEQ ID NO: 2715476 - RNA, 20 nt, Human
guaaggaauaccuguccccc

SEQ ID NO: 2715477 - RNA, 21 nt, Human
guaaggaauaccugucccccu

SEQ ID NO: 2715478 - RNA, 23 nt, Human
guaaggaauaccugucccccuga

SEQ ID NO: 2715479 - RNA, 13 nt, Human
guaaggaaugauu

SEQ ID NO: 2715480 - RNA, 23 nt, Human
guaaauuaacuuuuauaaacuuu

SEQ ID NO: 2715481 - RNA, 15 nt, Human
guaaauuaacuuuua

SEQ ID NO: 2715482 - RNA, 22 nt, Human
guaaauuaacuuuuauaaacuu

SEQ ID NO: 2715483 - RNA, 21 nt, Human
guaaauuaacuuuuauaaacu

SEQ ID NO: 2715484 - RNA, 17 nt, Human
guaaauuaacuuuuaua

SEQ ID NO: 2715485 - RNA, 16 nt, Human
guaaauuaacuuuuau

SEQ ID NO: 2715486 - RNA, 21 nt, Human
guaaaucccauuauucaaagu

SEQ ID NO: 2715487 - RNA, 20 nt, Human
guaaaucccauuauucaaag

SEQ ID NO: 2715488 - RNA, 19 nt, Human
guaaaucccauuauucaaa

SEQ ID NO: 2715489 - RNA, 18 nt, Human
guaaaucccauuauucaa

SEQ ID NO: 2715490 - RNA, 17 nt, Human
guaaaucccauuauuca

SEQ ID NO: 2715491 - RNA, 16 nt, Human
guaaaucccauuauuc

SEQ ID NO: 2715492 - RNA, 20 nt, Human
guaaaugggggugcauuuga

SEQ ID NO: 2715493 - RNA, 19 nt, Human
guaaaugggggugcauuug

SEQ ID NO: 2715494 - RNA, 18 nt, Human
guaaaugggggugcauuu

SEQ ID NO: 2715495 - RNA, 15 nt, Human
guaaaucccauuauu

SEQ ID NO: 2715496 - RNA, 23 nt, Human
guaaauacaauuuuguuucugua

SEQ ID NO: 2715497 - RNA, 22 nt, Human
guaaauacaauuuuguuucugu

SEQ ID NO: 2715498 - RNA, 15 nt, Human
guaaauaguauuuga

SEQ ID NO: 2715499 - RNA, 16 nt, Human
guaaauaguauuugag

SEQ ID NO: 2715500 - RNA, 17 nt, Human
guaaauaguauuugaga

SEQ ID NO: 2715501 - RNA, 21 nt, Human
guaaauacaauuuuguuucug

SEQ ID NO: 2715502 - RNA, 18 nt, Human
guaaaaccacagcaguug

SEQ ID NO: 2715503 - RNA, 16 nt, Human
guaaaaccacagcagu

SEQ ID NO: 2715504 - RNA, 15 nt, Human
guaaaaccacagcag

SEQ ID NO: 2715505 - RNA, 14 nt, Human
guaaaaccacagca

SEQ ID NO: 2715506 - RNA, 23 nt, Human
guaaaaccacagcaguugaaaag

SEQ ID NO: 2715507 - RNA, 23 nt, Human
gguuuugccauguuggccaggcu

SEQ ID NO: 2715508 - RNA, 20 nt, Human
gguuuucacauuggaaacaa

SEQ ID NO: 2715509 - RNA, 15 nt, Human
gguuuucuguucuuu

SEQ ID NO: 2715510 - RNA, 13 nt, Human
gguuuucuguucu

SEQ ID NO: 2715511 - RNA, 12 nt, Human
gguuuucuguuc

SEQ ID NO: 2715512 - RNA, 14 nt, Human
gguugggcuggugu

SEQ ID NO: 2715513 - RNA, 13 nt, Human
gguuggugggggc

SEQ ID NO: 2715514 - RNA, 13 nt, Human
gguuuaagcuguu

SEQ ID NO: 2715515 - RNA, 13 nt, Human
gguggccucccaa

SEQ ID NO: 2715516 - RNA, 21 nt, Human
gguucaagcgauucuucugcu

SEQ ID NO: 2715517 - RNA, 17 nt, Human
gguggccucccaacuca

SEQ ID NO: 2715518 - RNA, 20 nt, Human
gguucacugcaaccuccgcc

SEQ ID NO: 2715519 - RNA, 22 nt, Human
gguucaagcgauucuucugcuu

SEQ ID NO: 2715520 - RNA, 23 nt, Human
gguucaagcgauucuucugcuuc

SEQ ID NO: 2715521 - RNA, 14 nt, Human
gguugaagcaccaa

SEQ ID NO: 2715522 - RNA, 15 nt, Human
gguagacacacauga

SEQ ID NO: 2715523 - RNA, 22 nt, Human
gguagacacacaugaaguccaa

SEQ ID NO: 2715524 - RNA, 12 nt, Human
ggucacucuggc

SEQ ID NO: 2715525 - RNA, 12 nt, Human
ggucagagccug

SEQ ID NO: 2715526 - RNA, 22 nt, Human
ggucacucuggcagcucagaga

SEQ ID NO: 2715527 - RNA, 16 nt, Human
ggucacucuggcagcu

SEQ ID NO: 2715528 - RNA, 20 nt, Human
ggucacucuggcagcucaga

SEQ ID NO: 2715529 - RNA, 13 nt, Human
ggucagagccugc

SEQ ID NO: 2715530 - RNA, 14 nt, Human
ggucagagccugca

SEQ ID NO: 2715531 - RNA, 15 nt, Human
ggucagagccugcag

SEQ ID NO: 2715532 - RNA, 16 nt, Human
ggucagagccugcagu

SEQ ID NO: 2715533 - RNA, 22 nt, Human
ggucccaccccacacacgccag

SEQ ID NO: 2715534 - RNA, 22 nt, Human
ggucccacucaguccauagcag

SEQ ID NO: 2715535 - RNA, 12 nt, Human
ggucccacucag

SEQ ID NO: 2715536 - RNA, 14 nt, Human
ggucccacucaguc

SEQ ID NO: 2715537 - RNA, 13 nt, Human
ggucccccuucca

SEQ ID NO: 2715538 - RNA, 18 nt, Human
ggucccccuuccauggac

SEQ ID NO: 2715539 - RNA, 23 nt, Human
ggucccccuuccauggacuuugu

SEQ ID NO: 2715540 - RNA, 22 nt, Human
gguacuucaaauccuugaagau

SEQ ID NO: 2715541 - RNA, 21 nt, Human
gguacuuguggacacagcucu

SEQ ID NO: 2715542 - RNA, 20 nt, Human
gguacuuguggacacagcuc

SEQ ID NO: 2715543 - RNA, 22 nt, Human
gguacuuguggacacagcucuu

SEQ ID NO: 2715544 - RNA, 17 nt, Human
gguacccacugcucugg

SEQ ID NO: 2715545 - RNA, 16 nt, Human
gguacccacugcucug

SEQ ID NO: 2715546 - RNA, 15 nt, Human
ggguugggcuggugu

SEQ ID NO: 2715547 - RNA, 23 nt, Human
ggguucccuuuuuuggcugcuga

SEQ ID NO: 2715548 - RNA, 17 nt, Human
ggguucuacccaggugc

SEQ ID NO: 2715549 - RNA, 22 nt, Human
ggguucuacccaggugcuagga

SEQ ID NO: 2715550 - RNA, 16 nt, Human
ggguuggccccugccc

SEQ ID NO: 2715551 - RNA, 19 nt, Human
ggguuggccccugcccggc

SEQ ID NO: 2715552 - RNA, 19 nt, Human
ggugcuacaaaaacacagc

SEQ ID NO: 2715553 - RNA, 15 nt, Human
ggugcgaucuggguu

SEQ ID NO: 2715554 - RNA, 22 nt, Human
ggugcuaucucccccagcccca

SEQ ID NO: 2715555 - RNA, 21 nt, Human
ggugcuaucucccccagcccc

SEQ ID NO: 2715556 - RNA, 23 nt, Human
ggugcuaucucccccagccccau

SEQ ID NO: 2715557 - RNA, 15 nt, Human
gguggcagcugcggu

SEQ ID NO: 2715558 - RNA, 23 nt, Human
gguggcagcugcgguccacccag

SEQ ID NO: 2715559 - RNA, 11 nt, Human
gguggcagcug

SEQ ID NO: 2715560 - RNA, 13 nt, Human
gguggcagcucac

SEQ ID NO: 2715561 - RNA, 12 nt, Human
gguggcagcugc

SEQ ID NO: 2715562 - RNA, 13 nt, Human
gguggcagcugcg

SEQ ID NO: 2715563 - RNA, 16 nt, Human
ggugaccucugccuga

SEQ ID NO: 2715564 - RNA, 14 nt, Human
ggugaccucugccu

SEQ ID NO: 2715565 - RNA, 19 nt, Human
ggugcccugcuuucagaua

SEQ ID NO: 2715566 - RNA, 14 nt, Human
ggucccugguggca

SEQ ID NO: 2715567 - RNA, 23 nt, Human
gguccuagaaauuccccacccug

SEQ ID NO: 2715568 - RNA, 22 nt, Human
ggucucacuauguugcccaggc

SEQ ID NO: 2715569 - RNA, 18 nt, Human
gguccgugcuaaggacuu

SEQ ID NO: 2715570 - RNA, 17 nt, Human
gguccgugcuaaggacu

SEQ ID NO: 2715571 - RNA, 22 nt, Human
ggucccugguggcagcucaccu

SEQ ID NO: 2715572 - RNA, 16 nt, Human
gguccgugcuaaggac

SEQ ID NO: 2715573 - RNA, 15 nt, Human
ggucugacccacugc

SEQ ID NO: 2715574 - RNA, 16 nt, Human
ggucugacccacugcu

SEQ ID NO: 2715575 - RNA, 21 nt, Human
ggucucacuauguugcccagg

SEQ ID NO: 2715576 - RNA, 12 nt, Human
ggucucacucug

SEQ ID NO: 2715577 - RNA, 16 nt, Human
ggucucacucugucgc

SEQ ID NO: 2715578 - RNA, 14 nt, Human
ggugaauggcuuug

SEQ ID NO: 2715579 - RNA, 20 nt, Human
ggugaauggcuuuguauaga

SEQ ID NO: 2715580 - RNA, 17 nt, Human
ggugaauggcuuuguau

SEQ ID NO: 2715581 - RNA, 18 nt, Human
ggugaagugaagacaaug

SEQ ID NO: 2715582 - RNA, 19 nt, Human
ggucugaggaauccagacc

SEQ ID NO: 2715583 - RNA, 16 nt, Human
ggugaacuugguuccc

SEQ ID NO: 2715584 - RNA, 18 nt, Human
ggguacccacugcucugg

SEQ ID NO: 2715585 - RNA, 13 nt, Human
ggguacccacugc

SEQ ID NO: 2715586 - RNA, 15 nt, Human
ggguacccacugcuc

SEQ ID NO: 2715587 - RNA, 19 nt, Human
ggguacuuguggacacagc

SEQ ID NO: 2715588 - RNA, 22 nt, Human
ggguacuuguggacacagcucu

SEQ ID NO: 2715589 - RNA, 23 nt, Human
ggguacuuguggacacagcucuu

SEQ ID NO: 2715590 - RNA, 23 nt, Human
ggguagagcggagaaaggaaggg

SEQ ID NO: 2715591 - RNA, 23 nt, Human
gggguucccuuuuuuggcugcug

SEQ ID NO: 2715592 - RNA, 13 nt, Human
ggggcugggacau

SEQ ID NO: 2715593 - RNA, 16 nt, Human
ggggcugggcagagga

SEQ ID NO: 2715594 - RNA, 17 nt, Human
ggggcugggcagaggaa

SEQ ID NO: 2715595 - RNA, 20 nt, Human
gggcuucauccuccucagau

SEQ ID NO: 2715596 - RNA, 20 nt, Human
gggcuuggggaccagagcug

SEQ ID NO: 2715597 - RNA, 19 nt, Human
gggcuucaguggcagcugc

SEQ ID NO: 2715598 - RNA, 20 nt, Human
gggcuucaguggcagcugcu

SEQ ID NO: 2715599 - RNA, 19 nt, Human
gggcuucauccuccucaga

SEQ ID NO: 2715600 - RNA, 15 nt, Human
gggcuucaguggcag

SEQ ID NO: 2715601 - RNA, 16 nt, Human
gggcuucaguggcagc

SEQ ID NO: 2715602 - RNA, 17 nt, Human
gggcuucaguggcagcu

SEQ ID NO: 2715603 - RNA, 18 nt, Human
gggcuucaguggcagcug

SEQ ID NO: 2715604 - RNA, 17 nt, Human
ggggaucacagccucug

SEQ ID NO: 2715605 - RNA, 21 nt, Human
gggcuuggggaccagagcugc

SEQ ID NO: 2715606 - RNA, 13 nt, Human
ggggaguggccac

SEQ ID NO: 2715607 - RNA, 18 nt, Human
gggccuggucguuuucaa

SEQ ID NO: 2715608 - RNA, 14 nt, Human
gggccuggcucagg

SEQ ID NO: 2715609 - RNA, 16 nt, Human
gggccuggcucaggug

SEQ ID NO: 2715610 - RNA, 19 nt, Human
gggccuggccugagcuggg

SEQ ID NO: 2715611 - RNA, 12 nt, Human
gggccuggcuca

SEQ ID NO: 2715612 - RNA, 16 nt, Human
gggcgcgguggcucac

SEQ ID NO: 2715613 - RNA, 13 nt, Human
gggcucccuuccc

SEQ ID NO: 2715614 - RNA, 14 nt, Human
gggcucccuuccca

SEQ ID NO: 2715615 - RNA, 17 nt, Human
gggcucccuucccaccu

SEQ ID NO: 2715616 - RNA, 18 nt, Human
gggcucccuucccaccuc

SEQ ID NO: 2715617 - RNA, 23 nt, Human
gggcucccuucccaccucucuca

SEQ ID NO: 2715618 - RNA, 13 nt, Human
gggcucugccucc

SEQ ID NO: 2715619 - RNA, 15 nt, Human
gggcucugccuccca

SEQ ID NO: 2715620 - RNA, 16 nt, Human
gggcucugccucccau

SEQ ID NO: 2715621 - RNA, 17 nt, Human
gggcucugccucccauc

SEQ ID NO: 2715622 - RNA, 20 nt, Human
gggcucugccucccaucacc

SEQ ID NO: 2715623 - RNA, 14 nt, Human
gggcuucaguggca

SEQ ID NO: 2715624 - RNA, 16 nt, Human
gggcugaggugggagg

SEQ ID NO: 2715625 - RNA, 14 nt, Human
gggcugcaccggcu

SEQ ID NO: 2715626 - RNA, 22 nt, Human
guauuucuaugaaauauuaugu

SEQ ID NO: 2715627 - RNA, 17 nt, Human
guauuucuaugaaauau

SEQ ID NO: 2715628 - RNA, 19 nt, Human
guauuugagaguucuaaau

SEQ ID NO: 2715629 - RNA, 21 nt, Human
guauuugagaguucuaaauuu

SEQ ID NO: 2715630 - RNA, 15 nt, Human
guagagugggagcug

SEQ ID NO: 2715631 - RNA, 20 nt, Human
guauuacaguggggaaugaa

SEQ ID NO: 2715632 - RNA, 13 nt, Human
guagagugggagc

SEQ ID NO: 2715633 - RNA, 22 nt, Human
guauuacaguggggaaugaaga

SEQ ID NO: 2715634 - RNA, 13 nt, Human
guauuacuucugc

SEQ ID NO: 2715635 - RNA, 14 nt, Human
guauuacuucugcu

SEQ ID NO: 2715636 - RNA, 15 nt, Human
guauuacuucugcua

SEQ ID NO: 2715637 - RNA, 14 nt, Human
guauuauaccuuuu

SEQ ID NO: 2715638 - RNA, 16 nt, Human
guauuuuaaaagaaug

SEQ ID NO: 2715639 - RNA, 17 nt, Human
guauuuuaaaagaauga

SEQ ID NO: 2715640 - RNA, 18 nt, Human
gucaagagggucugagga

SEQ ID NO: 2715641 - RNA, 19 nt, Human
gucaagagggucugaggaa

SEQ ID NO: 2715642 - RNA, 19 nt, Human
gucaagugaaaaaggagga

SEQ ID NO: 2715643 - RNA, 16 nt, Human
gucaagugaaaaagga

SEQ ID NO: 2715644 - RNA, 18 nt, Human
gucaagugaaaaaggagg

SEQ ID NO: 2715645 - RNA, 14 nt, Human
gucaccucauggaa

SEQ ID NO: 2715646 - RNA, 20 nt, Human
gucaccugaagacucauucu

SEQ ID NO: 2715647 - RNA, 13 nt, Human
gucaccccggcca

SEQ ID NO: 2715648 - RNA, 15 nt, Human
gucaauaaaauccau

SEQ ID NO: 2715649 - RNA, 21 nt, Human
gucaauaaaauccauacauuu

SEQ ID NO: 2715650 - RNA, 16 nt, Human
gucaauuacaggaagu

SEQ ID NO: 2715651 - RNA, 13 nt, Human
gucaauuacagga

SEQ ID NO: 2715652 - RNA, 15 nt, Human
gucaauuacaggaag

SEQ ID NO: 2715653 - RNA, 20 nt, Human
gucccagccagcaguucaga

SEQ ID NO: 2715654 - RNA, 17 nt, Human
gucccagauacuugggg

SEQ ID NO: 2715655 - RNA, 14 nt, Human
gucccacucagucc

SEQ ID NO: 2715656 - RNA, 15 nt, Human
gucccacucagucca

SEQ ID NO: 2715657 - RNA, 14 nt, Human
guccacccaggagc

SEQ ID NO: 2715658 - RNA, 13 nt, Human
guccacccaggag

SEQ ID NO: 2715659 - RNA, 15 nt, Human
guccacccaggagcc

SEQ ID NO: 2715660 - RNA, 16 nt, Human
guccacccaggagccc

SEQ ID NO: 2715661 - RNA, 21 nt, Human
gucauauaagauucauauuua

SEQ ID NO: 2715662 - RNA, 23 nt, Human
gucuacacuaagagagaaugaga

SEQ ID NO: 2715663 - RNA, 15 nt, Human
gucuacacugugcug

SEQ ID NO: 2715664 - RNA, 17 nt, Human
gucuacacuaagagaga

SEQ ID NO: 2715665 - RNA, 23 nt, Human
gucuaagauaguaacaaugaaga

SEQ ID NO: 2715666 - RNA, 15 nt, Human
guccuuaccagcaga

SEQ ID NO: 2715667 - RNA, 16 nt, Human
guccuuaccagcagag

SEQ ID NO: 2715668 - RNA, 17 nt, Human
guccuuaccagcagagc

SEQ ID NO: 2715669 - RNA, 20 nt, Human
gucucacuauguugcccagg

SEQ ID NO: 2715670 - RNA, 21 nt, Human
gucucacuauguugcccaggc

SEQ ID NO: 2715671 - RNA, 13 nt, Human
gucucacuguugc

SEQ ID NO: 2715672 - RNA, 23 nt, Human
gucucacuauguugcccaggcag

SEQ ID NO: 2715673 - RNA, 16 nt, Human
gucucacuguugccca

SEQ ID NO: 2715674 - RNA, 17 nt, Human
gucucacuguugcccag

SEQ ID NO: 2715675 - RNA, 18 nt, Human
gucucacuguugcccagg

SEQ ID NO: 2715676 - RNA, 19 nt, Human
gucucacuguugcccaggc

SEQ ID NO: 2715677 - RNA, 20 nt, Human
gucucacuguugcccaggcu

SEQ ID NO: 2715678 - RNA, 21 nt, Human
gucucacuguugcccaggcug

SEQ ID NO: 2715679 - RNA, 22 nt, Human
gucucacuguugcccaggcugg

SEQ ID NO: 2715680 - RNA, 23 nt, Human
gucucacuguugcccaggcuggc

SEQ ID NO: 2715681 - RNA, 13 nt, Human
gucucagauuuua

SEQ ID NO: 2715682 - RNA, 13 nt, Human
gucugacccacug

SEQ ID NO: 2715683 - RNA, 14 nt, Human
gucugacccacugc

SEQ ID NO: 2715684 - RNA, 15 nt, Human
gucugacccacugcu

SEQ ID NO: 2715685 - RNA, 18 nt, Human
gucugaggaauccagacc

SEQ ID NO: 2715686 - RNA, 19 nt, Human
gucugaggaauccagaccc

SEQ ID NO: 2715687 - RNA, 20 nt, Human
gucugauucccaagcucugc

SEQ ID NO: 2715688 - RNA, 21 nt, Human
gucugauucccaagcucugcu

SEQ ID NO: 2715689 - RNA, 21 nt, Human
gucugaggaauccagacccgg

SEQ ID NO: 2715690 - RNA, 17 nt, Human
gucugauucccaagcuc

SEQ ID NO: 2715691 - RNA, 18 nt, Human
gucugauucccaagcucu

SEQ ID NO: 2715692 - RNA, 19 nt, Human
gucugauucccaagcucug

SEQ ID NO: 2715693 - RNA, 19 nt, Human
guccugggagugagcuggu

SEQ ID NO: 2715694 - RNA, 17 nt, Human
guccugggagugagcug

SEQ ID NO: 2715695 - RNA, 18 nt, Human
guccugggagugagcugg

SEQ ID NO: 2715696 - RNA, 15 nt, Human
guccugggagugagc

SEQ ID NO: 2715697 - RNA, 16 nt, Human
guccugggagugagcu

SEQ ID NO: 2715698 - RNA, 17 nt, Human
guccuggcaugggaaug

SEQ ID NO: 2715699 - RNA, 12 nt, Human
guccucccaucu

SEQ ID NO: 2715700 - RNA, 13 nt, Human
guccucccaucuc

SEQ ID NO: 2715701 - RNA, 14 nt, Human
guccucccaucuca

SEQ ID NO: 2715702 - RNA, 23 nt, Human
guccucccaucucacacaugagc

SEQ ID NO: 2715703 - RNA, 12 nt, Human
gucccagugccg

SEQ ID NO: 2715704 - RNA, 23 nt, Human
guccuagaaauuccccacccuga

SEQ ID NO: 2715705 - RNA, 15 nt, Human
guccuacucuguguc

SEQ ID NO: 2715706 - RNA, 23 nt, Human
guccuacucugugucaggugggg

SEQ ID NO: 2715707 - RNA, 16 nt, Human
gucccugguggcagcu

SEQ ID NO: 2715708 - RNA, 13 nt, Human
guccuacucugug

SEQ ID NO: 2715709 - RNA, 17 nt, Human
gucccugguggcagcuc

SEQ ID NO: 2715710 - RNA, 18 nt, Human
gugcaaauugucacagga

SEQ ID NO: 2715711 - RNA, 19 nt, Human
gugcauaaguuaacuucca

SEQ ID NO: 2715712 - RNA, 20 nt, Human
gugccagguuuuuggucuga

SEQ ID NO: 2715713 - RNA, 22 nt, Human
gugccagguuuuuggucugacc

SEQ ID NO: 2715714 - RNA, 21 nt, Human
gugcauaccacuuuuguucuu

SEQ ID NO: 2715715 - RNA, 14 nt, Human
gugcauaccacuuu

SEQ ID NO: 2715716 - RNA, 13 nt, Human
gugcauaccacuu

SEQ ID NO: 2715717 - RNA, 20 nt, Human
gugcccacaggaucagucug

SEQ ID NO: 2715718 - RNA, 12 nt, Human
gugauuuucauu

SEQ ID NO: 2715719 - RNA, 23 nt, Human
gugauucuccugccucagccucc

SEQ ID NO: 2715720 - RNA, 14 nt, Human
gugauucuccugcc

SEQ ID NO: 2715721 - RNA, 16 nt, Human
gugauucuccugccuc

SEQ ID NO: 2715722 - RNA, 17 nt, Human
gugauucuccugccuca

SEQ ID NO: 2715723 - RNA, 18 nt, Human
gugauucuccugccucag

SEQ ID NO: 2715724 - RNA, 19 nt, Human
gugauucuccugccucagc

SEQ ID NO: 2715725 - RNA, 20 nt, Human
gugauucuccugccucagcc

SEQ ID NO: 2715726 - RNA, 22 nt, Human
gugauucuccugccucagccuc

SEQ ID NO: 2715727 - RNA, 20 nt, Human
gugauccucccaccucagcc

SEQ ID NO: 2715728 - RNA, 22 nt, Human
gugauccucccaccucagccuc

SEQ ID NO: 2715729 - RNA, 14 nt, Human
gugauccucccacc

SEQ ID NO: 2715730 - RNA, 15 nt, Human
gugauccucccaccu

SEQ ID NO: 2715731 - RNA, 18 nt, Human
gugauccucccaccucag

SEQ ID NO: 2715732 - RNA, 11 nt, Human
gugaggccaga

SEQ ID NO: 2715733 - RNA, 15 nt, Human
gugauccacccaccu

SEQ ID NO: 2715734 - RNA, 13 nt, Human
gugaggccagaga

SEQ ID NO: 2715735 - RNA, 18 nt, Human
gugauccacccaccucag

SEQ ID NO: 2715736 - RNA, 20 nt, Human
gugauccacccaccucagcc

SEQ ID NO: 2715737 - RNA, 20 nt, Human
gugaaacucguuaauuugua

SEQ ID NO: 2715738 - RNA, 12 nt, Human
gugaaacuggau

SEQ ID NO: 2715739 - RNA, 19 nt, Human
gugaaagaaaauaacaaua

SEQ ID NO: 2715740 - RNA, 14 nt, Human
gugaaaagaaaaau

SEQ ID NO: 2715741 - RNA, 23 nt, Human
gugaaaagaaaaaugagccuggc

SEQ ID NO: 2715742 - RNA, 12 nt, Human
gugaaaauuauu

SEQ ID NO: 2715743 - RNA, 15 nt, Human
gugaaaauuauuuug

SEQ ID NO: 2715744 - RNA, 19 nt, Human
gugaauggcuuuguauaga

SEQ ID NO: 2715745 - RNA, 18 nt, Human
gugaauggcuuuguauag

SEQ ID NO: 2715746 - RNA, 17 nt, Human
gugaauggcuuuguaua

SEQ ID NO: 2715747 - RNA, 14 nt, Human
gugaauggcuuugu

SEQ ID NO: 2715748 - RNA, 13 nt, Human
gugaauggcuuug

SEQ ID NO: 2715749 - RNA, 17 nt, Human
gugaaaguacauuugga

SEQ ID NO: 2715750 - RNA, 19 nt, Human
gugaaaggaaagagggagg

SEQ ID NO: 2715751 - RNA, 16 nt, Human
gugagcagucaggaaa

SEQ ID NO: 2715752 - RNA, 17 nt, Human
gugacugaucucucgug

SEQ ID NO: 2715753 - RNA, 13 nt, Human
gugagccacugca

SEQ ID NO: 2715754 - RNA, 14 nt, Human
gugagcuacaaaug

SEQ ID NO: 2715755 - RNA, 11 nt, Human
gugaggaagcc

SEQ ID NO: 2715756 - RNA, 16 nt, Human
gugaggaagccgcugg

SEQ ID NO: 2715757 - RNA, 19 nt, Human
gugaggaagccgcuggggc

SEQ ID NO: 2715758 - RNA, 16 nt, Human
gugacaacacuugugu

SEQ ID NO: 2715759 - RNA, 15 nt, Human
gugacugaauuucuu

SEQ ID NO: 2715760 - RNA, 18 nt, Human
gugacugaauuucuuuug

SEQ ID NO: 2715761 - RNA, 16 nt, Human
gugacugaauuucuuu

SEQ ID NO: 2715762 - RNA, 18 nt, Human
guggaaaaauagccugcc

SEQ ID NO: 2715763 - RNA, 11 nt, Human
gugcugcccug

SEQ ID NO: 2715764 - RNA, 22 nt, Human
gugcugccauccagguucagcu

SEQ ID NO: 2715765 - RNA, 12 nt, Human
gugcuuggagga

SEQ ID NO: 2715766 - RNA, 13 nt, Human
gugcuuggaggaa

SEQ ID NO: 2715767 - RNA, 15 nt, Human
gugcuuggaggaagg

SEQ ID NO: 2715768 - RNA, 23 nt, Human
gugcugaaugguuuucaaaauaa

SEQ ID NO: 2715769 - RNA, 20 nt, Human
gugcugaaugguuuucaaaa

SEQ ID NO: 2715770 - RNA, 19 nt, Human
gugcugaaugguuuucaaa

SEQ ID NO: 2715771 - RNA, 17 nt, Human
gugcucuggacaggcau

SEQ ID NO: 2715772 - RNA, 18 nt, Human
gugcucuggacaggcaug

SEQ ID NO: 2715773 - RNA, 15 nt, Human
gugcucuggacaggc

SEQ ID NO: 2715774 - RNA, 16 nt, Human
gugcucuggacaggca

SEQ ID NO: 2715775 - RNA, 21 nt, Human
gugccuuggggacaagagcag

SEQ ID NO: 2715776 - RNA, 12 nt, Human
gugcugcauuua

SEQ ID NO: 2715777 - RNA, 20 nt, Human
gugcugcauuuaaaagauac

SEQ ID NO: 2715778 - RNA, 19 nt, Human
gugcugcauuuaaaagaua

SEQ ID NO: 2715779 - RNA, 15 nt, Human
gugcugccauccagg

SEQ ID NO: 2715780 - RNA, 18 nt, Human
gugcugccauccagguuc

SEQ ID NO: 2715781 - RNA, 19 nt, Human
gugcugccauccagguuca

SEQ ID NO: 2715782 - RNA, 12 nt, Human
gugcugagucug

SEQ ID NO: 2715783 - RNA, 16 nt, Human
gugcugagucugaagg

SEQ ID NO: 2715784 - RNA, 17 nt, Human
gugcugagucugaaggc

SEQ ID NO: 2715785 - RNA, 18 nt, Human
gugcugagucugaaggcu

SEQ ID NO: 2715786 - RNA, 19 nt, Human
gugcugagucugaaggcug

SEQ ID NO: 2715787 - RNA, 15 nt, Human
guggcagugggagcu

SEQ ID NO: 2715788 - RNA, 16 nt, Human
guggcagugggagcug

SEQ ID NO: 2715789 - RNA, 17 nt, Human
guggcagugggagcugc

SEQ ID NO: 2715790 - RNA, 19 nt, Human
guggcagcugcgguccacc

SEQ ID NO: 2715791 - RNA, 20 nt, Human
guggaugccugguggcagcu

SEQ ID NO: 2715792 - RNA, 21 nt, Human
guggcagcugcgguccaccca

SEQ ID NO: 2715793 - RNA, 22 nt, Human
guggcagcugcgguccacccag

SEQ ID NO: 2715794 - RNA, 23 nt, Human
guggcagcugcgguccacccagg

SEQ ID NO: 2715795 - RNA, 12 nt, Human
guggcagcugcu

SEQ ID NO: 2715796 - RNA, 13 nt, Human
guggcagcugcuu

SEQ ID NO: 2715797 - RNA, 19 nt, Human
guggcagcugcuuuugucu

SEQ ID NO: 2715798 - RNA, 19 nt, Human
guggcagugggagcugccu

SEQ ID NO: 2715799 - RNA, 21 nt, Human
guggcagugggagcugccugu

SEQ ID NO: 2715800 - RNA, 17 nt, Human
guggaguucaucuugaa

SEQ ID NO: 2715801 - RNA, 16 nt, Human
guggaugccugguggc

SEQ ID NO: 2715802 - RNA, 18 nt, Human
guggaugccugguggcag

SEQ ID NO: 2715803 - RNA, 20 nt, Human
guggagaagcggcuggcagc

SEQ ID NO: 2715804 - RNA, 17 nt, Human
ucaaacauauauaacaa

SEQ ID NO: 2715805 - RNA, 22 nt, Human
ucaaacagucucaggaaaucaa

SEQ ID NO: 2715806 - RNA, 16 nt, Human
ucaaauccuugaagau

SEQ ID NO: 2715807 - RNA, 15 nt, Human
ucaaauccuugaaga

SEQ ID NO: 2715808 - RNA, 19 nt, Human
ucaaauaugcaaagcacug

SEQ ID NO: 2715809 - RNA, 18 nt, Human
ucaaauaugcaaagcacu

SEQ ID NO: 2715810 - RNA, 17 nt, Human
ucaaauaugcaaagcac

SEQ ID NO: 2715811 - RNA, 16 nt, Human
ucaaauaugcaaagca

SEQ ID NO: 2715812 - RNA, 12 nt, Human
ucaaagagguuu

SEQ ID NO: 2715813 - RNA, 23 nt, Human
ucaaagagguuuuaaaaaaaucc

SEQ ID NO: 2715814 - RNA, 20 nt, Human
ucaaagagagaaaauaaaga

SEQ ID NO: 2715815 - RNA, 15 nt, Human
ucaaagagagaaaau

SEQ ID NO: 2715816 - RNA, 22 nt, Human
ucaacuccaaacugacucuuaa

SEQ ID NO: 2715817 - RNA, 20 nt, Human
ucaacucuccuccagaguca

SEQ ID NO: 2715818 - RNA, 16 nt, Human
ucaaccuccugggcua

SEQ ID NO: 2715819 - RNA, 20 nt, Human
ucaaccccuucgcuccugug

SEQ ID NO: 2715820 - RNA, 15 nt, Human
ucaaccuccugggcu

SEQ ID NO: 2715821 - RNA, 18 nt, Human
ucaaccccuucgcuccug

SEQ ID NO: 2715822 - RNA, 19 nt, Human
ucaaccccuucgcuccugu

SEQ ID NO: 2715823 - RNA, 17 nt, Human
ucaagcgauucuucugc

SEQ ID NO: 2715824 - RNA, 12 nt, Human
ucaagccaccaa

SEQ ID NO: 2715825 - RNA, 20 nt, Human
ucaagccaccaacauacucc

SEQ ID NO: 2715826 - RNA, 21 nt, Human
ucaagcgauucuucugcuuca

SEQ ID NO: 2715827 - RNA, 18 nt, Human
ucaagcgauucuucugcu

SEQ ID NO: 2715828 - RNA, 19 nt, Human
ucaagcgauucuucugcuu

SEQ ID NO: 2715829 - RNA, 13 nt, Human
ucaaggauccuga

SEQ ID NO: 2715830 - RNA, 14 nt, Human
ucaaggauccugag

SEQ ID NO: 2715831 - RNA, 15 nt, Human
ucaaggauccugagc

SEQ ID NO: 2715832 - RNA, 16 nt, Human
ucaaggauccugagcc

SEQ ID NO: 2715833 - RNA, 17 nt, Human
ucaaggauccugagcca

SEQ ID NO: 2715834 - RNA, 13 nt, Human
ucaauaaaaaauu

SEQ ID NO: 2715835 - RNA, 16 nt, Human
ucaauaaaaaauuaug

SEQ ID NO: 2715836 - RNA, 14 nt, Human
ucaauaaaaaauua

SEQ ID NO: 2715837 - RNA, 12 nt, Human
ucacauuuaaau

SEQ ID NO: 2715838 - RNA, 17 nt, Human
ucacauuggaaacaagu

SEQ ID NO: 2715839 - RNA, 18 nt, Human
ucacauugguguuguacu

SEQ ID NO: 2715840 - RNA, 21 nt, Human
ucaccaaaucagcugcuacua

SEQ ID NO: 2715841 - RNA, 14 nt, Human
ucacauuuauucug

SEQ ID NO: 2715842 - RNA, 17 nt, Human
ucaccaacgucugugcc

SEQ ID NO: 2715843 - RNA, 18 nt, Human
ucaccaacgucugugcca

SEQ ID NO: 2715844 - RNA, 18 nt, Human
ucacccgcuaagagggag

SEQ ID NO: 2715845 - RNA, 16 nt, Human
ucaccacaugugcaca

SEQ ID NO: 2715846 - RNA, 13 nt, Human
ucaccaagcccag

SEQ ID NO: 2715847 - RNA, 22 nt, Human
ucaccgaaaacguggcugcuuc

SEQ ID NO: 2715848 - RNA, 23 nt, Human
ucaccgaaaacguggcugcuuca

SEQ ID NO: 2715849 - RNA, 15 nt, Human
ucaccgaaaacgugg

SEQ ID NO: 2715850 - RNA, 19 nt, Human
ucaccgaaaacguggcugc

SEQ ID NO: 2715851 - RNA, 20 nt, Human
ucaccgaaaacguggcugcu

SEQ ID NO: 2715852 - RNA, 21 nt, Human
ucaccgaaaacguggcugcuu

SEQ ID NO: 2715853 - RNA, 19 nt, Human
ucacccgcuaagagggagg

SEQ ID NO: 2715854 - RNA, 12 nt, Human
ucacccuuuucu

SEQ ID NO: 2715855 - RNA, 14 nt, Human
ucaccgaaaacgug

SEQ ID NO: 2715856 - RNA, 14 nt, Human
ucaauaaaauccau

SEQ ID NO: 2715857 - RNA, 19 nt, Human
ucaauaaaaaauuaugaca

SEQ ID NO: 2715858 - RNA, 14 nt, Human
ucacauuggaaaca

SEQ ID NO: 2715859 - RNA, 20 nt, Human
ucacauuccugaacaggaua

SEQ ID NO: 2715860 - RNA, 15 nt, Human
ucacacacuuuggcu

SEQ ID NO: 2715861 - RNA, 22 nt, Human
ucacacaugagcaucaggccag

SEQ ID NO: 2715862 - RNA, 23 nt, Human
ucacacaugagcaucaggccagg

SEQ ID NO: 2715863 - RNA, 17 nt, Human
uauuguuuaaaaucauu

SEQ ID NO: 2715864 - RNA, 16 nt, Human
uauuguuuaaaaucau

SEQ ID NO: 2715865 - RNA, 15 nt, Human
uauuguuuaaaauca

SEQ ID NO: 2715866 - RNA, 23 nt, Human
uauugugcgcuaaacuuuucuga

SEQ ID NO: 2715867 - RNA, 22 nt, Human
uauugugcgcuaaacuuuucug

SEQ ID NO: 2715868 - RNA, 19 nt, Human
uauugugcgcuaaacuuuu

SEQ ID NO: 2715869 - RNA, 23 nt, Human
uauugcugauggugcaaugaccu

SEQ ID NO: 2715870 - RNA, 22 nt, Human
uauugcugauggugcaaugacc

SEQ ID NO: 2715871 - RNA, 13 nt, Human
uauugcccacgcu

SEQ ID NO: 2715872 - RNA, 14 nt, Human
uauugcccacgcug

SEQ ID NO: 2715873 - RNA, 15 nt, Human
uauugcccacgcugg

SEQ ID NO: 2715874 - RNA, 20 nt, Human
uauugauaugcuuauacacu

SEQ ID NO: 2715875 - RNA, 23 nt, Human
uauugauaaguucauacauugua

SEQ ID NO: 2715876 - RNA, 14 nt, Human
uauugauaaguuca

SEQ ID NO: 2715877 - RNA, 16 nt, Human
uauugauaaguucaua

SEQ ID NO: 2715878 - RNA, 14 nt, Human
uauuuauuacugua

SEQ ID NO: 2715879 - RNA, 22 nt, Human
uauuuauuaaaugcccagcccc

SEQ ID NO: 2715880 - RNA, 13 nt, Human
uauuucuaugaaa

SEQ ID NO: 2715881 - RNA, 13 nt, Human
uauuuauuacugu

SEQ ID NO: 2715882 - RNA, 14 nt, Human
uauuucuaugaaau

SEQ ID NO: 2715883 - RNA, 15 nt, Human
uauuucuaugaaaua

SEQ ID NO: 2715884 - RNA, 20 nt, Human
uauuguuuaaaaucauuucu

SEQ ID NO: 2715885 - RNA, 17 nt, Human
uauuuaugggauccugg

SEQ ID NO: 2715886 - RNA, 16 nt, Human
uauuauguuaaaacug

SEQ ID NO: 2715887 - RNA, 22 nt, Human
uauuauguaaaucccauuauuc

SEQ ID NO: 2715888 - RNA, 15 nt, Human
uauuauguaaauccc

SEQ ID NO: 2715889 - RNA, 12 nt, Human
uauuauguaaau

SEQ ID NO: 2715890 - RNA, 12 nt, Human
uauuauguguuu

SEQ ID NO: 2715891 - RNA, 12 nt, Human
uauuaugaaacu

SEQ ID NO: 2715892 - RNA, 22 nt, Human
uauuaugaaacuuguguaaaua

SEQ ID NO: 2715893 - RNA, 21 nt, Human
uauuaugaaacuuguguaaau

SEQ ID NO: 2715894 - RNA, 20 nt, Human
uauuaugaaacuuguguaaa

SEQ ID NO: 2715895 - RNA, 17 nt, Human
uauuauauuuacaaaug

SEQ ID NO: 2715896 - RNA, 14 nt, Human
uauuauaccuuuuu

SEQ ID NO: 2715897 - RNA, 13 nt, Human
uauuauaccuuuu

SEQ ID NO: 2715898 - RNA, 12 nt, Human
uauuauaccuuu

SEQ ID NO: 2715899 - RNA, 14 nt, Human
uauuaaggaagaca

SEQ ID NO: 2715900 - RNA, 16 nt, Human
uauuaagcauauauuu

SEQ ID NO: 2715901 - RNA, 19 nt, Human
uauguuagugcaaauuguc

SEQ ID NO: 2715902 - RNA, 12 nt, Human
uauguuaaaacu

SEQ ID NO: 2715903 - RNA, 19 nt, Human
uauggaggcuuugcauaga

SEQ ID NO: 2715904 - RNA, 22 nt, Human
uauguucuuaguggauguucug

SEQ ID NO: 2715905 - RNA, 21 nt, Human
uauguugcccaggcaggucuu

SEQ ID NO: 2715906 - RNA, 16 nt, Human
uauuaagaaagacuau

SEQ ID NO: 2715907 - RNA, 15 nt, Human
uauuaaaugcccagc

SEQ ID NO: 2715908 - RNA, 17 nt, Human
uauuaaaugcccagccc

SEQ ID NO: 2715909 - RNA, 19 nt, Human
uauuaaaugcccagccccu

SEQ ID NO: 2715910 - RNA, 17 nt, Human
uauccuuucuaacaaaa

SEQ ID NO: 2715911 - RNA, 16 nt, Human
uaucuaaauguugaaa

SEQ ID NO: 2715912 - RNA, 19 nt, Human
uauauguuuuaagaggcag

SEQ ID NO: 2715913 - RNA, 22 nt, Human
uaucugaggaauucuguauaga

SEQ ID NO: 2715914 - RNA, 21 nt, Human
uaucugaggaauucuguauag

SEQ ID NO: 2715915 - RNA, 19 nt, Human
uaucugaggaauucuguau

SEQ ID NO: 2715916 - RNA, 18 nt, Human
uaucugaggaauucugua

SEQ ID NO: 2715917 - RNA, 16 nt, Human
uaucugaggaauucug

SEQ ID NO: 2715918 - RNA, 17 nt, Human
uaucugaggaauucugu

SEQ ID NO: 2715919 - RNA, 16 nt, Human
uaucgucacugcuuaa

SEQ ID NO: 2715920 - RNA, 21 nt, Human
uaucuaauauguaacaagcca

SEQ ID NO: 2715921 - RNA, 23 nt, Human
uaugaauuacauuuguauaaaau

SEQ ID NO: 2715922 - RNA, 17 nt, Human
uaugaauuacauuugua

SEQ ID NO: 2715923 - RNA, 22 nt, Human
uaugacacaugcaaggucauuu

SEQ ID NO: 2715924 - RNA, 12 nt, Human
uaugacacaugc

SEQ ID NO: 2715925 - RNA, 23 nt, Human
uaugacauaaaaacaacuuuaua

SEQ ID NO: 2715926 - RNA, 19 nt, Human
uaugacauaaaaacaacuu

SEQ ID NO: 2715927 - RNA, 22 nt, Human
uaugacauaaaaacaacuuuau

SEQ ID NO: 2715928 - RNA, 20 nt, Human
uaucugucauuugagcaggg

SEQ ID NO: 2715929 - RNA, 21 nt, Human
uaucugucauuugagcagggc

SEQ ID NO: 2715930 - RNA, 23 nt, Human
uaucugucauuugagcagggcuc

SEQ ID NO: 2715931 - RNA, 12 nt, Human
uaugcaaagcac

SEQ ID NO: 2715932 - RNA, 14 nt, Human
uaugcaaagcacug

SEQ ID NO: 2715933 - RNA, 13 nt, Human
uaugcaaagcacu

SEQ ID NO: 2715934 - RNA, 15 nt, Human
uaugcaaagcacuga

SEQ ID NO: 2715935 - RNA, 18 nt, Human
uaugcaaucaaaucugcu

SEQ ID NO: 2715936 - RNA, 14 nt, Human
uaugcacacauuuu

SEQ ID NO: 2715937 - RNA, 13 nt, Human
uaugcacacauuu

SEQ ID NO: 2715938 - RNA, 16 nt, Human
uaugauucccagccag

SEQ ID NO: 2715939 - RNA, 21 nt, Human
uaugauucaaaugucuauaaa

SEQ ID NO: 2715940 - RNA, 16 nt, Human
uaugauucaaaugucu

SEQ ID NO: 2715941 - RNA, 17 nt, Human
uaugacuccagaauuuc

SEQ ID NO: 2715942 - RNA, 23 nt, Human
uaugacuccagaauuucccaaag

SEQ ID NO: 2715943 - RNA, 16 nt, Human
uaugacuccagaauuu

SEQ ID NO: 2715944 - RNA, 15 nt, Human
uaugcuucuguuuua

SEQ ID NO: 2715945 - RNA, 16 nt, Human
uaugcuucuguuuuau

SEQ ID NO: 2715946 - RNA, 22 nt, Human
uaugcuuauacacuuacacuuu

SEQ ID NO: 2715947 - RNA, 18 nt, Human
uaugcaugaaguaauaug

SEQ ID NO: 2715948 - RNA, 13 nt, Human
uaugcaugaagua

SEQ ID NO: 2715949 - RNA, 17 nt, Human
uauggacaaugacccag

SEQ ID NO: 2715950 - RNA, 19 nt, Human
uauggaacacucugagacu

SEQ ID NO: 2715951 - RNA, 13 nt, Human
uauggaacacucu

SEQ ID NO: 2715952 - RNA, 16 nt, Human
uauggaacacucugag

SEQ ID NO: 2715953 - RNA, 17 nt, Human
uauggaacacucugaga

SEQ ID NO: 2715954 - RNA, 18 nt, Human
uauggaacacucugagac

SEQ ID NO: 2715955 - RNA, 13 nt, Human
uauaugcuucugu

SEQ ID NO: 2715956 - RNA, 21 nt, Human
uauaugcucugcauguuacau

SEQ ID NO: 2715957 - RNA, 20 nt, Human
uauaugcucugcauguuaca

SEQ ID NO: 2715958 - RNA, 13 nt, Human
uauauaacaaugc

SEQ ID NO: 2715959 - RNA, 21 nt, Human
uauaucuauauuuuacauaaa

SEQ ID NO: 2715960 - RNA, 18 nt, Human
uauaucugaggaauucug

SEQ ID NO: 2715961 - RNA, 22 nt, Human
uauaucugaggaauucuguaua

SEQ ID NO: 2715962 - RNA, 21 nt, Human
uauaucugaggaauucuguau

SEQ ID NO: 2715963 - RNA, 20 nt, Human
uauaucugaggaauucugua

SEQ ID NO: 2715964 - RNA, 19 nt, Human
uauaucugaggaauucugu

SEQ ID NO: 2715965 - RNA, 12 nt, Human
uauaauuaacau

SEQ ID NO: 2715966 - RNA, 14 nt, Human
uauaauuaacaugu

SEQ ID NO: 2715967 - RNA, 13 nt, Human
uauaauuaacaug

SEQ ID NO: 2715968 - RNA, 19 nt, Human
uauaauuaacauguuaaac

SEQ ID NO: 2715969 - RNA, 18 nt, Human
uauaauuaacauguuaaa

SEQ ID NO: 2715970 - RNA, 16 nt, Human
uauaauuaacauguua

SEQ ID NO: 2715971 - RNA, 15 nt, Human
uauaauuaacauguu

SEQ ID NO: 2715972 - RNA, 22 nt, Human
uauaauuaacauguuaaaccau

SEQ ID NO: 2715973 - RNA, 18 nt, Human
uauaaacuuuaccuuuuu

SEQ ID NO: 2715974 - RNA, 23 nt, Human
uaggugacagagugagacucugu

SEQ ID NO: 2715975 - RNA, 18 nt, Human
uaguauuucuaugaaaua

SEQ ID NO: 2715976 - RNA, 19 nt, Human
uaguauuucuaugaaauau

SEQ ID NO: 2715977 - RNA, 16 nt, Human
uaguauuucuaugaaa

SEQ ID NO: 2715978 - RNA, 15 nt, Human
uaguaugaaauuaua

SEQ ID NO: 2715979 - RNA, 23 nt, Human
uaguaugaaauuauauaaguauu

SEQ ID NO: 2715980 - RNA, 13 nt, Human
uaguaugaaauua

SEQ ID NO: 2715981 - RNA, 13 nt, Human
uagucaaauugug

SEQ ID NO: 2715982 - RNA, 14 nt, Human
uagucaaauugugu

SEQ ID NO: 2715983 - RNA, 14 nt, Human
uagugcaaauuguc

SEQ ID NO: 2715984 - RNA, 15 nt, Human
uagugcaaauuguca

SEQ ID NO: 2715985 - RNA, 18 nt, Human
uaggccuggccagaugca

SEQ ID NO: 2715986 - RNA, 15 nt, Human
uaggccuggccagau

SEQ ID NO: 2715987 - RNA, 16 nt, Human
uaggucagugcaaaua

SEQ ID NO: 2715988 - RNA, 11 nt, Human
uagggaaaaac

SEQ ID NO: 2715989 - RNA, 19 nt, Human
uagggaaaaaccagcgugu

SEQ ID NO: 2715990 - RNA, 20 nt, Human
uagggaaaaaccagcgugug

SEQ ID NO: 2715991 - RNA, 21 nt, Human
uagggaaaaaccagcguguga

SEQ ID NO: 2715992 - RNA, 17 nt, Human
uccaaagaaauguaagg

SEQ ID NO: 2715993 - RNA, 14 nt, Human
uccaaagaaaugua

SEQ ID NO: 2715994 - RNA, 13 nt, Human
uccaaaguacacu

SEQ ID NO: 2715995 - RNA, 22 nt, Human
uccaaaaagauuuucagaaaau

SEQ ID NO: 2715996 - RNA, 16 nt, Human
uccaaaccaaauaaaa

SEQ ID NO: 2715997 - RNA, 20 nt, Human
ucaguguacauggaauaaca

SEQ ID NO: 2715998 - RNA, 14 nt, Human
ucaucauccuaagc

SEQ ID NO: 2715999 - RNA, 19 nt, Human
ucaucuugaauuguaagga

SEQ ID NO: 2716000 - RNA, 18 nt, Human
ucauccacugugccaugu

SEQ ID NO: 2716001 - RNA, 14 nt, Human
ucauccacugugcc

SEQ ID NO: 2716002 - RNA, 17 nt, Human
ucauccacugugccaug

SEQ ID NO: 2716003 - RNA, 20 nt, Human
ucauggaacgcguugaaauu

SEQ ID NO: 2716004 - RNA, 22 nt, Human
ucauggaacgcguugaaauugu

SEQ ID NO: 2716005 - RNA, 21 nt, Human
ucauggaacgcguugaaauug

SEQ ID NO: 2716006 - RNA, 17 nt, Human
ucaugcuguucaugaaa

SEQ ID NO: 2716007 - RNA, 20 nt, Human
ucagguggggcagcuugagg

SEQ ID NO: 2716008 - RNA, 21 nt, Human
ucagucugauucccaagcucu

SEQ ID NO: 2716009 - RNA, 22 nt, Human
ucagucugauucccaagcucug

SEQ ID NO: 2716010 - RNA, 23 nt, Human
ucagucugauucccaagcucugc

SEQ ID NO: 2716011 - RNA, 23 nt, Human
ucaggugagaagcagaggaagga

SEQ ID NO: 2716012 - RNA, 16 nt, Human
ucaggugauccaccca

SEQ ID NO: 2716013 - RNA, 23 nt, Human
ucaggugauccacccaccucagc

SEQ ID NO: 2716014 - RNA, 18 nt, Human
ucagguggggcagcuuga

SEQ ID NO: 2716015 - RNA, 19 nt, Human
ucagguggggcagcuugag

SEQ ID NO: 2716016 - RNA, 21 nt, Human
ucaggccugggggcugggcag

SEQ ID NO: 2716017 - RNA, 23 nt, Human
ucagcuccagcucaccagcccca

SEQ ID NO: 2716018 - RNA, 24 nt, Human
ucagcuccagcucaccagccccag

SEQ ID NO: 2716019 - RNA, 23 nt, Human
ucagcucugcaagaauugaagca

SEQ ID NO: 2716020 - RNA, 23 nt, Human
ucaggaagcucagggccuggcuc

SEQ ID NO: 2716021 - RNA, 16 nt, Human
uccaaaguacacuguu

SEQ ID NO: 2716022 - RNA, 14 nt, Human
uccaaaguacacug

SEQ ID NO: 2716023 - RNA, 19 nt, Human
uccacuuucuagccagagg

SEQ ID NO: 2716024 - RNA, 20 nt, Human
uccacuuucuagccagagga

SEQ ID NO: 2716025 - RNA, 21 nt, Human
uccacuuucuagccagaggag

SEQ ID NO: 2716026 - RNA, 19 nt, Human
uccaggggugggacacccu

SEQ ID NO: 2716027 - RNA, 20 nt, Human
uccaggggugggacacccug

SEQ ID NO: 2716028 - RNA, 12 nt, Human
uccaggagcagc

SEQ ID NO: 2716029 - RNA, 13 nt, Human
uccaggagcagcc

SEQ ID NO: 2716030 - RNA, 14 nt, Human
uccaggagcagcca

SEQ ID NO: 2716031 - RNA, 15 nt, Human
uccaggagcagccac

SEQ ID NO: 2716032 - RNA, 14 nt, Human
uccagcagauuauu

SEQ ID NO: 2716033 - RNA, 16 nt, Human
uccagcagauuauuca

SEQ ID NO: 2716034 - RNA, 15 nt, Human
uccagcagauuauuc

SEQ ID NO: 2716035 - RNA, 20 nt, Human
uccaugggccauaugaaaag

SEQ ID NO: 2716036 - RNA, 15 nt, Human
uccauacauuugugu

SEQ ID NO: 2716037 - RNA, 14 nt, Human
uccauagagagcaa

SEQ ID NO: 2716038 - RNA, 15 nt, Human
uccauagagagcaag

SEQ ID NO: 2716039 - RNA, 19 nt, Human
uccagguagagggugugua

SEQ ID NO: 2716040 - RNA, 20 nt, Human
uccagguuuaagcuguuacu

SEQ ID NO: 2716041 - RNA, 20 nt, Human
uccaguuuuguuuggaccaa

SEQ ID NO: 2716042 - RNA, 12 nt, Human
uccauacauuug

SEQ ID NO: 2716043 - RNA, 17 nt, Human
uccaguuuuguuuggac

SEQ ID NO: 2716044 - RNA, 15 nt, Human
uccaguuuuguuugg

SEQ ID NO: 2716045 - RNA, 20 nt, Human
ucccaugagccucagcaucc

SEQ ID NO: 2716046 - RNA, 14 nt, Human
ucccauuauucaaa

SEQ ID NO: 2716047 - RNA, 13 nt, Human
ucccauuauucaa

SEQ ID NO: 2716048 - RNA, 13 nt, Human
uccccagauugca

SEQ ID NO: 2716049 - RNA, 18 nt, Human
uccccagauugcaacagg

SEQ ID NO: 2716050 - RNA, 19 nt, Human
ucccauuauucaaaguugc

SEQ ID NO: 2716051 - RNA, 18 nt, Human
ucccauuauucaaaguug

SEQ ID NO: 2716052 - RNA, 16 nt, Human
ucccauuauucaaagu

SEQ ID NO: 2716053 - RNA, 19 nt, Human
uccccagauugcaacaggc

SEQ ID NO: 2716054 - RNA, 20 nt, Human
uccccagauugcaacaggcu

SEQ ID NO: 2716055 - RNA, 22 nt, Human
uccccagauugcaacaggcugg

SEQ ID NO: 2716056 - RNA, 23 nt, Human
uccccagauugcaacaggcuggg

SEQ ID NO: 2716057 - RNA, 20 nt, Human
uccccagcaagugagagcug

SEQ ID NO: 2716058 - RNA, 21 nt, Human
uccccagcaagugagagcugg

SEQ ID NO: 2716059 - RNA, 22 nt, Human
uccccagcaagugagagcuggg

SEQ ID NO: 2716060 - RNA, 14 nt, Human
uccccaggaggcca

SEQ ID NO: 2716061 - RNA, 17 nt, Human
ucccccagccccauccu

SEQ ID NO: 2716062 - RNA, 15 nt, Human
uccccaggaggccag

SEQ ID NO: 2716063 - RNA, 16 nt, Human
uccccaggaggccagc

SEQ ID NO: 2716064 - RNA, 22 nt, Human
ucccccagccccauccucugua

SEQ ID NO: 2716065 - RNA, 20 nt, Human
ucccccagccccauccucug

SEQ ID NO: 2716066 - RNA, 21 nt, Human
ucccccagccccauccucugu

SEQ ID NO: 2716067 - RNA, 23 nt, Human
ucccaggcauuccccaggaggcc

SEQ ID NO: 2716068 - RNA, 24 nt, Human
ucccaggcauuccccaggaggcca

SEQ ID NO: 2716069 - RNA, 23 nt, Human
ucccagcugugcucuggacaggc

SEQ ID NO: 2716070 - RNA, 21 nt, Human
ucccagcugugcucuggacag

SEQ ID NO: 2716071 - RNA, 22 nt, Human
ucccagcugugcucuggacagg

SEQ ID NO: 2716072 - RNA, 15 nt, Human
ucccaucuuccaagg

SEQ ID NO: 2716073 - RNA, 21 nt, Human
ucccaucugugaaaggaaaga

SEQ ID NO: 2716074 - RNA, 18 nt, Human
ucccaugagccucagcau

SEQ ID NO: 2716075 - RNA, 19 nt, Human
ucccaugagccucagcauc

SEQ ID NO: 2716076 - RNA, 13 nt, Human
ucccaccuuggcu

SEQ ID NO: 2716077 - RNA, 16 nt, Human
ucccaccuuggcugca

SEQ ID NO: 2716078 - RNA, 17 nt, Human
ucccaccuuggcugcag

SEQ ID NO: 2716079 - RNA, 20 nt, Human
ucccagcugugcucuggaca

SEQ ID NO: 2716080 - RNA, 18 nt, Human
ucccaccuuggcugcagg

SEQ ID NO: 2716081 - RNA, 22 nt, Human
ucccaccucucucacuccuuga

SEQ ID NO: 2716082 - RNA, 20 nt, Human
uccaugugggcuaguugggc

SEQ ID NO: 2716083 - RNA, 18 nt, Human
uccucauuagcauuuugc

SEQ ID NO: 2716084 - RNA, 10 nt, Human
uccuccaggu

SEQ ID NO: 2716085 - RNA, 12 nt, Human
uccucccaccuc

SEQ ID NO: 2716086 - RNA, 23 nt, Human
uccuagugaaagaggcagcuuga

SEQ ID NO: 2716087 - RNA, 14 nt, Human
uccuagugaaagag

SEQ ID NO: 2716088 - RNA, 23 nt, Human
uccuauauuguuuucaguguaca

SEQ ID NO: 2716089 - RNA, 20 nt, Human
uccuaucaccugucuugccu

SEQ ID NO: 2716090 - RNA, 21 nt, Human
uccuauauuguuuucagugua

SEQ ID NO: 2716091 - RNA, 15 nt, Human
ucccccuuccaugga

SEQ ID NO: 2716092 - RNA, 16 nt, Human
ucccuuccucuuucca

SEQ ID NO: 2716093 - RNA, 15 nt, Human
ucccuuccucuuucc

SEQ ID NO: 2716094 - RNA, 16 nt, Human
uccgcuuucuacccag

SEQ ID NO: 2716095 - RNA, 21 nt, Human
uccuaagcuauucaguaauaa

SEQ ID NO: 2716096 - RNA, 20 nt, Human
uccuaagcuauucaguaaua

SEQ ID NO: 2716097 - RNA, 18 nt, Human
uccgcuuucuacccagcg

SEQ ID NO: 2716098 - RNA, 20 nt, Human
uccgcuuucuacccagcgag

SEQ ID NO: 2716099 - RNA, 14 nt, Human
uccgccucuugggu

SEQ ID NO: 2716100 - RNA, 13 nt, Human
uccugccaggcau

SEQ ID NO: 2716101 - RNA, 14 nt, Human
uccugccaggcaug

SEQ ID NO: 2716102 - RNA, 21 nt, Human
uccugagccagauuucacucu

SEQ ID NO: 2716103 - RNA, 23 nt, Human
uccuggcacccggccccugcugg

SEQ ID NO: 2716104 - RNA, 13 nt, Human
uccuggcacugcu

SEQ ID NO: 2716105 - RNA, 16 nt, Human
uccuggcacugcuucc

SEQ ID NO: 2716106 - RNA, 12 nt, Human
uccuggccucaa

SEQ ID NO: 2716107 - RNA, 22 nt, Human
uccuguaccucuugagccuuga

SEQ ID NO: 2716108 - RNA, 13 nt, Human
uccuguagcccua

SEQ ID NO: 2716109 - RNA, 11 nt, Human
uccuguagccc

SEQ ID NO: 2716110 - RNA, 20 nt, Human
uccugcccuuaccugccagg

SEQ ID NO: 2716111 - RNA, 17 nt, Human
uccugcccuuaccugcc

SEQ ID NO: 2716112 - RNA, 14 nt, Human
uccuggaguucugg

SEQ ID NO: 2716113 - RNA, 18 nt, Human
ucuaugaaauauuauguu

SEQ ID NO: 2716114 - RNA, 14 nt, Human
ucuaugacacaugc

SEQ ID NO: 2716115 - RNA, 17 nt, Human
ucuaugacacaugcaag

SEQ ID NO: 2716116 - RNA, 21 nt, Human
ucuaggaagacuuuggaaaga

SEQ ID NO: 2716117 - RNA, 19 nt, Human
ucuaggaagacuuuggaaa

SEQ ID NO: 2716118 - RNA, 15 nt, Human
ucuaggaagacuuug

SEQ ID NO: 2716119 - RNA, 16 nt, Human
ucuaggaagacuuugg

SEQ ID NO: 2716120 - RNA, 15 nt, Human
ucuacagaggccaug

SEQ ID NO: 2716121 - RNA, 16 nt, Human
ucuacagaggccaugg

SEQ ID NO: 2716122 - RNA, 14 nt, Human
ucuaccuuccugca

SEQ ID NO: 2716123 - RNA, 12 nt, Human
ucggagaagagc

SEQ ID NO: 2716124 - RNA, 16 nt, Human
ucggagaagagcuguu

SEQ ID NO: 2716125 - RNA, 14 nt, Human
ucggagaagagcug

SEQ ID NO: 2716126 - RNA, 13 nt, Human
ucgugacaacacu

SEQ ID NO: 2716127 - RNA, 20 nt, Human
ucuaaaggcuaccuuuguau

SEQ ID NO: 2716128 - RNA, 19 nt, Human
ucuaaaggcuaccuuugua

SEQ ID NO: 2716129 - RNA, 17 nt, Human
ucuaaaggcuaccuuug

SEQ ID NO: 2716130 - RNA, 18 nt, Human
ucuaaaggcuaccuuugu

SEQ ID NO: 2716131 - RNA, 19 nt, Human
ucuaugggacucaaugcac

SEQ ID NO: 2716132 - RNA, 12 nt, Human
ucuaugggacuc

SEQ ID NO: 2716133 - RNA, 13 nt, Human
ucuaugggacuca

SEQ ID NO: 2716134 - RNA, 18 nt, Human
ucucauacucaccucacc

SEQ ID NO: 2716135 - RNA, 16 nt, Human
ucucauacucaccuca

SEQ ID NO: 2716136 - RNA, 13 nt, Human
ucuccacccugcu

SEQ ID NO: 2716137 - RNA, 17 nt, Human
ucuccacccugcucucc

SEQ ID NO: 2716138 - RNA, 14 nt, Human
ucuccacccugcuc

SEQ ID NO: 2716139 - RNA, 16 nt, Human
ucuccacccugcucuc

SEQ ID NO: 2716140 - RNA, 14 nt, Human
ucuccaccugccag

SEQ ID NO: 2716141 - RNA, 15 nt, Human
ucuccaccugccagg

SEQ ID NO: 2716142 - RNA, 16 nt, Human
ucuccaccugccaggg

SEQ ID NO: 2716143 - RNA, 22 nt, Human
ucuccaccugccagggacagag

SEQ ID NO: 2716144 - RNA, 17 nt, Human
ucuccaccugccaggga

SEQ ID NO: 2716145 - RNA, 19 nt, Human
ucuccaccugccagggaca

SEQ ID NO: 2716146 - RNA, 22 nt, Human
ucuccagccccuggaugcagcc

SEQ ID NO: 2716147 - RNA, 16 nt, Human
ucuccagccccuggau

SEQ ID NO: 2716148 - RNA, 18 nt, Human
ucuccagccccuggaugc

SEQ ID NO: 2716149 - RNA, 12 nt, Human
ucuccagccccu

SEQ ID NO: 2716150 - RNA, 13 nt, Human
ucuccagccccug

SEQ ID NO: 2716151 - RNA, 14 nt, Human
ucuccagccccugg

SEQ ID NO: 2716152 - RNA, 15 nt, Human
ucuccagccccugga

SEQ ID NO: 2716153 - RNA, 23 nt, Human
ucucccucagucuggcccuuccu

SEQ ID NO: 2716154 - RNA, 18 nt, Human
ucucccucagucuggccc

SEQ ID NO: 2716155 - RNA, 12 nt, Human
ucucccccagcc

SEQ ID NO: 2716156 - RNA, 12 nt, Human
ugacaagcucac

SEQ ID NO: 2716157 - RNA, 15 nt, Human
ugacaagcucacaga

SEQ ID NO: 2716158 - RNA, 20 nt, Human
ugacaagcucacagaccuuu

SEQ ID NO: 2716159 - RNA, 18 nt, Human
ugacaaggauugcuacug

SEQ ID NO: 2716160 - RNA, 16 nt, Human
ugacagaauauguuuc

SEQ ID NO: 2716161 - RNA, 19 nt, Human
ugacagagugagacucugu

SEQ ID NO: 2716162 - RNA, 18 nt, Human
ugacagaggcagccccau

SEQ ID NO: 2716163 - RNA, 23 nt, Human
ugacagaggcagccccauucugc

SEQ ID NO: 2716164 - RNA, 14 nt, Human
ugacagagugagac

SEQ ID NO: 2716165 - RNA, 17 nt, Human
ugacagagugagacucu

SEQ ID NO: 2716166 - RNA, 13 nt, Human
ugacagaggcagc

SEQ ID NO: 2716167 - RNA, 20 nt, Human
ugacagacacaggcccggcu

SEQ ID NO: 2716168 - RNA, 23 nt, Human
ugacagacacaggcccggcucca

SEQ ID NO: 2716169 - RNA, 14 nt, Human
ugacagaggcagcc

SEQ ID NO: 2716170 - RNA, 15 nt, Human
ugacagaggcagccc

SEQ ID NO: 2716171 - RNA, 16 nt, Human
ugacagaggcagcccc

SEQ ID NO: 2716172 - RNA, 17 nt, Human
ugacagaggcagcccca

SEQ ID NO: 2716173 - RNA, 19 nt, Human
ugaccagcaccaucucucc

SEQ ID NO: 2716174 - RNA, 15 nt, Human
ugacaugucuuuucu

SEQ ID NO: 2716175 - RNA, 16 nt, Human
ugacaugggacauuug

SEQ ID NO: 2716176 - RNA, 17 nt, Human
ugacaugggacauuugc

SEQ ID NO: 2716177 - RNA, 17 nt, Human
ugacauagucuggcugu

SEQ ID NO: 2716178 - RNA, 16 nt, Human
ugacauagucuggcug

SEQ ID NO: 2716179 - RNA, 18 nt, Human
ugacaugggacauuugcu

SEQ ID NO: 2716180 - RNA, 13 nt, Human
ugacaugucuuuu

SEQ ID NO: 2716181 - RNA, 16 nt, Human
ugaccauucuccaccu

SEQ ID NO: 2716182 - RNA, 17 nt, Human
ugaccauucuccaccug

SEQ ID NO: 2716183 - RNA, 18 nt, Human
ugaccauucuccaccugc

SEQ ID NO: 2716184 - RNA, 19 nt, Human
ugaccauucuccaccugcc

SEQ ID NO: 2716185 - RNA, 13 nt, Human
ugaccgugaggcc

SEQ ID NO: 2716186 - RNA, 14 nt, Human
ugaccgugaggcca

SEQ ID NO: 2716187 - RNA, 16 nt, Human
ugaccgugaggccaga

SEQ ID NO: 2716188 - RNA, 20 nt, Human
ugaccgugaggccagagaca

SEQ ID NO: 2716189 - RNA, 11 nt, Human
ugaaguccaag

SEQ ID NO: 2716190 - RNA, 23 nt, Human
ugaagucagaucugccuaaggac

SEQ ID NO: 2716191 - RNA, 20 nt, Human
ugaagucagaucugccuaag

SEQ ID NO: 2716192 - RNA, 17 nt, Human
ugaaggccccgcccagg

SEQ ID NO: 2716193 - RNA, 13 nt, Human
ugaaguccaagca

SEQ ID NO: 2716194 - RNA, 18 nt, Human
ugaagauacugaaauaaa

SEQ ID NO: 2716195 - RNA, 16 nt, Human
ugaagauacugaaaua

SEQ ID NO: 2716196 - RNA, 15 nt, Human
ugaagauacugaaau

SEQ ID NO: 2716197 - RNA, 17 nt, Human
ugaacuccuggccucaa

SEQ ID NO: 2716198 - RNA, 14 nt, Human
ugaagauacugaaa

SEQ ID NO: 2716199 - RNA, 15 nt, Human
ugaaggccccgccca

SEQ ID NO: 2716200 - RNA, 16 nt, Human
ugaaggccccgcccag

SEQ ID NO: 2716201 - RNA, 22 nt, Human
ugaaggacauugcggacagcca

SEQ ID NO: 2716202 - RNA, 19 nt, Human
ugaaggacauugcggacag

SEQ ID NO: 2716203 - RNA, 20 nt, Human
ugaaggacauugcggacagc

SEQ ID NO: 2716204 - RNA, 15 nt, Human
ugaauuacauuugua

SEQ ID NO: 2716205 - RNA, 16 nt, Human
ugaauuacauuuguau

SEQ ID NO: 2716206 - RNA, 18 nt, Human
ugaauuacauuuguauaa

SEQ ID NO: 2716207 - RNA, 13 nt, Human
ugaauuaugaaac

SEQ ID NO: 2716208 - RNA, 17 nt, Human
ugaauuaugaaacuuuu

SEQ ID NO: 2716209 - RNA, 15 nt, Human
ugaauuaugaaacuu

SEQ ID NO: 2716210 - RNA, 15 nt, Human
ugaaagguacuucaa

SEQ ID NO: 2716211 - RNA, 16 nt, Human
ugaaagguacuucaaa

SEQ ID NO: 2716212 - RNA, 13 nt, Human
ugaaagggcccag

SEQ ID NO: 2716213 - RNA, 18 nt, Human
ugaaagaggcagcuugaa

SEQ ID NO: 2716214 - RNA, 18 nt, Human
ugaaagcccugagcuuuc

SEQ ID NO: 2716215 - RNA, 22 nt, Human
ugaaacaacaaauaggaauugu

SEQ ID NO: 2716216 - RNA, 14 nt, Human
ugaaacauuuuguc

SEQ ID NO: 2716217 - RNA, 13 nt, Human
ugaaaauuuugau

SEQ ID NO: 2716218 - RNA, 21 nt, Human
ugaaaauuuugauguuuuaag

SEQ ID NO: 2716219 - RNA, 19 nt, Human
ugaaaauuuugauguuuua

SEQ ID NO: 2716220 - RNA, 19 nt, Human
ugaaauggacuuuuguaca

SEQ ID NO: 2716221 - RNA, 16 nt, Human
ugaaauauugacuuuu

SEQ ID NO: 2716222 - RNA, 19 nt, Human
ugaacaguuguguuugaag

SEQ ID NO: 2716223 - RNA, 19 nt, Human
ugaaccacaucuugcucug

SEQ ID NO: 2716224 - RNA, 22 nt, Human
ugaaccaagaacuuuccaggaa

SEQ ID NO: 2716225 - RNA, 23 nt, Human
ugaaccacaucuugcucugcuga

SEQ ID NO: 2716226 - RNA, 17 nt, Human
ugaaccaccacacccag

SEQ ID NO: 2716227 - RNA, 20 nt, Human
ugaaccaccacacccagccc

SEQ ID NO: 2716228 - RNA, 16 nt, Human
ugaacuccuggccuca

SEQ ID NO: 2716229 - RNA, 17 nt, Human
ucuuucacauuuaaaua

SEQ ID NO: 2716230 - RNA, 23 nt, Human
ucuuucacccuuuucuguuugcu

SEQ ID NO: 2716231 - RNA, 21 nt, Human
ucuuguguguuuauugucaaa

SEQ ID NO: 2716232 - RNA, 16 nt, Human
ucuuguguguuuauug

SEQ ID NO: 2716233 - RNA, 23 nt, Human
ucuugcaauggcagccuuggcaa

SEQ ID NO: 2716234 - RNA, 16 nt, Human
ucucccuucauccuuc

SEQ ID NO: 2716235 - RNA, 20 nt, Human
ucuccucugcugcuggcugg

SEQ ID NO: 2716236 - RNA, 19 nt, Human
ucuugccuuuuucauuauu

SEQ ID NO: 2716237 - RNA, 15 nt, Human
ucuugccuuuuucau

SEQ ID NO: 2716238 - RNA, 17 nt, Human
ucuugccuuuuucauua

SEQ ID NO: 2716239 - RNA, 16 nt, Human
ucuugccuuuuucauu

SEQ ID NO: 2716240 - RNA, 19 nt, Human
ucuuuccacagaagcucca

SEQ ID NO: 2716241 - RNA, 14 nt, Human
ucuuuccaaaguac

SEQ ID NO: 2716242 - RNA, 13 nt, Human
ucuuuccaaagua

SEQ ID NO: 2716243 - RNA, 16 nt, Human
ucuuucagccaagaau

SEQ ID NO: 2716244 - RNA, 19 nt, Human
ucuuucagccaagaauucu

SEQ ID NO: 2716245 - RNA, 20 nt, Human
ucuuucagccaagaauucuu

SEQ ID NO: 2716246 - RNA, 21 nt, Human
ucuuucagccaagaauucuua

SEQ ID NO: 2716247 - RNA, 12 nt, Human
ucuuugccaagu

SEQ ID NO: 2716248 - RNA, 17 nt, Human
ucuuuggacacucacac

SEQ ID NO: 2716249 - RNA, 22 nt, Human
ugauguuuagaaacacaacuau

SEQ ID NO: 2716250 - RNA, 20 nt, Human
ugauguucuuucacccuuuu

SEQ ID NO: 2716251 - RNA, 13 nt, Human
ugauuauauguca

SEQ ID NO: 2716252 - RNA, 17 nt, Human
ugauuaugaauuacauu

SEQ ID NO: 2716253 - RNA, 19 nt, Human
ugauuaugaauuacauuug

SEQ ID NO: 2716254 - RNA, 21 nt, Human
ugauuaugaauuacauuugua

SEQ ID NO: 2716255 - RNA, 22 nt, Human
ugauuaugaauuacauuuguau

SEQ ID NO: 2716256 - RNA, 20 nt, Human
ugauucaacagguuuuccug

SEQ ID NO: 2716257 - RNA, 13 nt, Human
ugauucagacagc

SEQ ID NO: 2716258 - RNA, 14 nt, Human
ugauucagacagcu

SEQ ID NO: 2716259 - RNA, 15 nt, Human
ugauucagacagcug

SEQ ID NO: 2716260 - RNA, 16 nt, Human
ugauucagacagcugc

SEQ ID NO: 2716261 - RNA, 21 nt, Human
ugauucuucagcaaaaauauu

SEQ ID NO: 2716262 - RNA, 21 nt, Human
ugauucuccugccucagccuc

SEQ ID NO: 2716263 - RNA, 23 nt, Human
ugauucagacagcugccugggau

SEQ ID NO: 2716264 - RNA, 18 nt, Human
ugauucagacagcugccu

SEQ ID NO: 2716265 - RNA, 19 nt, Human
ugauucagacagcugccug

SEQ ID NO: 2716266 - RNA, 20 nt, Human
ugauucagacagcugccugg

SEQ ID NO: 2716267 - RNA, 21 nt, Human
ugauucagacagcugccuggg

SEQ ID NO: 2716268 - RNA, 16 nt, Human
ugauugugucucuugg

SEQ ID NO: 2716269 - RNA, 21 nt, Human
ugauuggaggggggagguggg

SEQ ID NO: 2716270 - RNA, 13 nt, Human
ugauuggaggggg

SEQ ID NO: 2716271 - RNA, 15 nt, Human
ugauggugguauguu

SEQ ID NO: 2716272 - RNA, 16 nt, Human
ugaugcuucuucagag

SEQ ID NO: 2716273 - RNA, 17 nt, Human
ugaugcuucuucagaga

SEQ ID NO: 2716274 - RNA, 14 nt, Human
ugauguguuuauuu

SEQ ID NO: 2716275 - RNA, 18 nt, Human
ugauguguuuauuuauag

SEQ ID NO: 2716276 - RNA, 16 nt, Human
ugauguguuaucucuu

SEQ ID NO: 2716277 - RNA, 20 nt, Human
ugaugcuacaggauuugaaa

SEQ ID NO: 2716278 - RNA, 23 nt, Human
ugaugcuacaggauuugaaauug

SEQ ID NO: 2716279 - RNA, 17 nt, Human
ugaucuuuaaaauacac

SEQ ID NO: 2716280 - RNA, 16 nt, Human
ugaucuuugcagacag

SEQ ID NO: 2716281 - RNA, 14 nt, Human
ugaucuuuaaaaua

SEQ ID NO: 2716282 - RNA, 20 nt, Human
ugaucuucuuuauaauucua

SEQ ID NO: 2716283 - RNA, 17 nt, Human
ugaucucucgugauuga

SEQ ID NO: 2716284 - RNA, 17 nt, Human
ugauccacccaccucag

SEQ ID NO: 2716285 - RNA, 18 nt, Human
ugauccacccaccucagc

SEQ ID NO: 2716286 - RNA, 19 nt, Human
ugauccacccaccucagcc

SEQ ID NO: 2716287 - RNA, 24 nt, Human
ugaucagcuuauugucuagugaaa

SEQ ID NO: 2716288 - RNA, 17 nt, Human
ugaucagcuuauugucu

SEQ ID NO: 2716289 - RNA, 13 nt, Human
ugauagcacagac

SEQ ID NO: 2716290 - RNA, 14 nt, Human
ugauagcacagacc

SEQ ID NO: 2716291 - RNA, 15 nt, Human
ugauagaggaagccu

SEQ ID NO: 2716292 - RNA, 13 nt, Human
ugauccaagcugg

SEQ ID NO: 2716293 - RNA, 14 nt, Human
ugauccaagcuggu

SEQ ID NO: 2716294 - RNA, 15 nt, Human
ugauccaagcugguc

SEQ ID NO: 2716295 - RNA, 16 nt, Human
ugauccacccaccuca

SEQ ID NO: 2716296 - RNA, 20 nt, Human
ugagacucgcgacaaugcaa

SEQ ID NO: 2716297 - RNA, 21 nt, Human
ugagacucgcgacaaugcaaa

SEQ ID NO: 2716298 - RNA, 22 nt, Human
ugagacucgcgacaaugcaaac

SEQ ID NO: 2716299 - RNA, 23 nt, Human
ugagacucgcgacaaugcaaacc

SEQ ID NO: 2716300 - RNA, 15 nt, Human
ugagaucaaaacggu

SEQ ID NO: 2716301 - RNA, 14 nt, Human
ugagaucagccugg

SEQ ID NO: 2716302 - RNA, 15 nt, Human
ugagaucagccuggg

SEQ ID NO: 2716303 - RNA, 12 nt, Human
ugagcagggcuc

SEQ ID NO: 2716304 - RNA, 13 nt, Human
ugagcagggcuca

SEQ ID NO: 2716305 - RNA, 14 nt, Human
ugagcagggcucag

SEQ ID NO: 2716306 - RNA, 15 nt, Human
ugagcagggcucagc

SEQ ID NO: 2716307 - RNA, 19 nt, Human
ugagacucgcgacaaugca

SEQ ID NO: 2716308 - RNA, 23 nt, Human
ugagacguuuuuggaagaguagu

SEQ ID NO: 2716309 - RNA, 20 nt, Human
ugaccucaggugauccaccc

SEQ ID NO: 2716310 - RNA, 21 nt, Human
ugaccucaggugauccaccca

SEQ ID NO: 2716311 - RNA, 20 nt, Human
ugagcaucaggccaggcccu

SEQ ID NO: 2716312 - RNA, 18 nt, Human
ugagcaucaggccaggcc

SEQ ID NO: 2716313 - RNA, 19 nt, Human
ugagcaucaggccaggccc

SEQ ID NO: 2716314 - RNA, 19 nt, Human
ugagcagggcucagcgggg

SEQ ID NO: 2716315 - RNA, 16 nt, Human
ugagcagggcucagcg

SEQ ID NO: 2716316 - RNA, 17 nt, Human
ugagcagggcucagcgg

SEQ ID NO: 2716317 - RNA, 16 nt, Human
ugagcaucaggccagg

SEQ ID NO: 2716318 - RNA, 22 nt, Human
ugagccucagcauccuggcacc

SEQ ID NO: 2716319 - RNA, 18 nt, Human
ugagccucagcauccugg

SEQ ID NO: 2716320 - RNA, 21 nt, Human
ugagccucagcauccuggcac

SEQ ID NO: 2716321 - RNA, 19 nt, Human
ugagccgagaucacgccac

SEQ ID NO: 2716322 - RNA, 21 nt, Human
ugagccgagaucacgccacug

SEQ ID NO: 2716323 - RNA, 17 nt, Human
ugagccucagcauccug

SEQ ID NO: 2716324 - RNA, 16 nt, Human
ugauaacuggaaacuu

SEQ ID NO: 2716325 - RNA, 14 nt, Human
ugagugagcaugcc

SEQ ID NO: 2716326 - RNA, 16 nt, Human
ugaguugauagcacag

SEQ ID NO: 2716327 - RNA, 20 nt, Human
ugaguugauagcacagaccc

SEQ ID NO: 2716328 - RNA, 13 nt, Human
ugaguccagaagu

SEQ ID NO: 2716329 - RNA, 19 nt, Human
ugaguccagaaguuugaga

SEQ ID NO: 2716330 - RNA, 19 nt, Human
ugagucgaggacagggagg

SEQ ID NO: 2716331 - RNA, 13 nt, Human
ugagucugaaggc

SEQ ID NO: 2716332 - RNA, 15 nt, Human
ugagucugaaggcug

SEQ ID NO: 2716333 - RNA, 17 nt, Human
ugagucugaaggcuggg

SEQ ID NO: 2716334 - RNA, 18 nt, Human
ugagucugaaggcugggu

SEQ ID NO: 2716335 - RNA, 13 nt, Human
ugaggcucugccc

SEQ ID NO: 2716336 - RNA, 14 nt, Human
ugaggcucugcccu

SEQ ID NO: 2716337 - RNA, 17 nt, Human
ugagggaacagagaggu

SEQ ID NO: 2716338 - RNA, 12 nt, Human
ugaggugggagg

SEQ ID NO: 2716339 - RNA, 13 nt, Human
ugaggugggagga

SEQ ID NO: 2716340 - RNA, 13 nt, Human
ugagcugggauga

SEQ ID NO: 2716341 - RNA, 12 nt, Human
ugaggcauuugu

SEQ ID NO: 2716342 - RNA, 20 nt, Human
ugaggcauuuguuugaacug

SEQ ID NO: 2716343 - RNA, 19 nt, Human
ugaggcauuuguuugaacu

SEQ ID NO: 2716344 - RNA, 23 nt, Human
ugaggcuagugugguguuuccug

SEQ ID NO: 2716345 - RNA, 21 nt, Human
ugaggcauuuguuugaacuga

SEQ ID NO: 2716346 - RNA, 17 nt, Human
ugaggcuaguguggugu

SEQ ID NO: 2716347 - RNA, 22 nt, Human
ugcuaggaacacuccuucacag

SEQ ID NO: 2716348 - RNA, 21 nt, Human
ugcuaggaacacuccuucaca

SEQ ID NO: 2716349 - RNA, 20 nt, Human
ugcuaggaacacuccuucac

SEQ ID NO: 2716350 - RNA, 17 nt, Human
ugcucacauaucuguca

SEQ ID NO: 2716351 - RNA, 23 nt, Human
ugcucuccgaccagacaccuuga

SEQ ID NO: 2716352 - RNA, 21 nt, Human
ugcuacuguccuacccacccu

SEQ ID NO: 2716353 - RNA, 22 nt, Human
ugcuacuguccuacccacccuc

SEQ ID NO: 2716354 - RNA, 21 nt, Human
ugcgcuaaacuuuucugauag

SEQ ID NO: 2716355 - RNA, 20 nt, Human
ugcgcuaaacuuuucugaua

SEQ ID NO: 2716356 - RNA, 19 nt, Human
ugcgcuaaacuuuucugau

SEQ ID NO: 2716357 - RNA, 17 nt, Human
ugcugggcuugucugua

SEQ ID NO: 2716358 - RNA, 22 nt, Human
ugcugguguaugugugaaguga

SEQ ID NO: 2716359 - RNA, 13 nt, Human
ugcugguguaugu

SEQ ID NO: 2716360 - RNA, 20 nt, Human
ugcugggguuaucugaaguc

SEQ ID NO: 2716361 - RNA, 17 nt, Human
ugcugggguuaucugaa

SEQ ID NO: 2716362 - RNA, 13 nt, Human
ugcuggguguggc

SEQ ID NO: 2716363 - RNA, 17 nt, Human
ugcuguucaugaaagau

SEQ ID NO: 2716364 - RNA, 16 nt, Human
ugcuguucaugaaaga

SEQ ID NO: 2716365 - RNA, 11 nt, Human
ugcuguguuaa

SEQ ID NO: 2716366 - RNA, 18 nt, Human
ugcuguguuaaauaaacc

SEQ ID NO: 2716367 - RNA, 12 nt, Human
ugcugcuugagg

SEQ ID NO: 2716368 - RNA, 19 nt, Human
ugcugcuugaggcaacuca

SEQ ID NO: 2716369 - RNA, 20 nt, Human
ugcugggauuacagguguga

SEQ ID NO: 2716370 - RNA, 17 nt, Human
ugcugcauuuaaaagau

SEQ ID NO: 2716371 - RNA, 19 nt, Human
ugcugcauuuaaaagauac

SEQ ID NO: 2716372 - RNA, 18 nt, Human
ugcugcauuuaaaagaua

SEQ ID NO: 2716373 - RNA, 14 nt, Human
ugcugcauuuaaaa

SEQ ID NO: 2716374 - RNA, 23 nt, Human
ugcugcauuuaaaagauacaguu

SEQ ID NO: 2716375 - RNA, 22 nt, Human
ugcaucaauuuuucuuauuuca

SEQ ID NO: 2716376 - RNA, 12 nt, Human
ugcaguucugaa

SEQ ID NO: 2716377 - RNA, 16 nt, Human
ugcaguugccagucac

SEQ ID NO: 2716378 - RNA, 16 nt, Human
ugcauagguuuagcag

SEQ ID NO: 2716379 - RNA, 20 nt, Human
ugcaguggugcgaucugggu

SEQ ID NO: 2716380 - RNA, 21 nt, Human
ugcaguggugcgaucuggguu

SEQ ID NO: 2716381 - RNA, 21 nt, Human
ugcaguuacacuaaaagguga

SEQ ID NO: 2716382 - RNA, 13 nt, Human
ugcagggaguccg

SEQ ID NO: 2716383 - RNA, 13 nt, Human
ugcaucagcugcu

SEQ ID NO: 2716384 - RNA, 21 nt, Human
ugcauuuggugguuucagaaa

SEQ ID NO: 2716385 - RNA, 23 nt, Human
ugcauuuggugguuucagaaaug

SEQ ID NO: 2716386 - RNA, 20 nt, Human
ugccaggaagccagcaggcu

SEQ ID NO: 2716387 - RNA, 22 nt, Human
ugccaggaagccagcaggcucu

SEQ ID NO: 2716388 - RNA, 10 nt, Human
ugccaggcau

SEQ ID NO: 2716389 - RNA, 14 nt, Human
ugccaggcauggug

SEQ ID NO: 2716390 - RNA, 20 nt, Human
ugccacccuggggagaaagu

SEQ ID NO: 2716391 - RNA, 23 nt, Human
ugccuaaauccauuuggaaaucu

SEQ ID NO: 2716392 - RNA, 22 nt, Human
ugccuaaauccauuuggaaauc

SEQ ID NO: 2716393 - RNA, 20 nt, Human
ugccuaaauccauuuggaaa

SEQ ID NO: 2716394 - RNA, 15 nt, Human
ugccucaagagaagg

SEQ ID NO: 2716395 - RNA, 14 nt, Human
ugccucaagagaag

SEQ ID NO: 2716396 - RNA, 20 nt, Human
ugccucacccacccuuuuuu

SEQ ID NO: 2716397 - RNA, 23 nt, Human
ugccucacccacccuuuuuuaaa

SEQ ID NO: 2716398 - RNA, 15 nt, Human
ugcccugcccaccug

SEQ ID NO: 2716399 - RNA, 14 nt, Human
ugcccugcccaccu

SEQ ID NO: 2716400 - RNA, 16 nt, Human
ugcccugcccaccugg

SEQ ID NO: 2716401 - RNA, 20 nt, Human
ugcccugcccaccuggccuc

SEQ ID NO: 2716402 - RNA, 13 nt, Human
ugccuaaauccau

SEQ ID NO: 2716403 - RNA, 19 nt, Human
ugccuaaauccauuuggaa

SEQ ID NO: 2716404 - RNA, 15 nt, Human
ugccuaaauccauuu

SEQ ID NO: 2716405 - RNA, 16 nt, Human
ugccccuggcagcccc

SEQ ID NO: 2716406 - RNA, 12 nt, Human
ugcccggcugcg

SEQ ID NO: 2716407 - RNA, 14 nt, Human
ugcccggcugcgga

SEQ ID NO: 2716408 - RNA, 18 nt, Human
ugcccaggcuggcgugca

SEQ ID NO: 2716409 - RNA, 19 nt, Human
ugcccaggcuggcgugcag

SEQ ID NO: 2716410 - RNA, 20 nt, Human
ugcccaggcuggcgugcagu

SEQ ID NO: 2716411 - RNA, 15 nt, Human
uggcacuaguauuuc

SEQ ID NO: 2716412 - RNA, 20 nt, Human
uggcaauagucaaauugugu

SEQ ID NO: 2716413 - RNA, 16 nt, Human
uggcacuauaauguaa

SEQ ID NO: 2716414 - RNA, 15 nt, Human
uggcacuauaaugua

SEQ ID NO: 2716415 - RNA, 12 nt, Human
uggcaaaaaggc

SEQ ID NO: 2716416 - RNA, 16 nt, Human
uggcaaaaaggcagga

SEQ ID NO: 2716417 - RNA, 20 nt, Human
uggauaauaaggaaaaguuu

SEQ ID NO: 2716418 - RNA, 21 nt, Human
uggaggaaggaaacccagcuc

SEQ ID NO: 2716419 - RNA, 23 nt, Human
uggaggaaggaaacccagcucug

SEQ ID NO: 2716420 - RNA, 22 nt, Human
uggaccaaaaaccaguauugua

SEQ ID NO: 2716421 - RNA, 17 nt, Human
uggaccaaaaaccagua

SEQ ID NO: 2716422 - RNA, 19 nt, Human
uggccagaugcaccagccc

SEQ ID NO: 2716423 - RNA, 17 nt, Human
uggccagaugcaccagc

SEQ ID NO: 2716424 - RNA, 18 nt, Human
uggccagaugcaccagcc

SEQ ID NO: 2716425 - RNA, 17 nt, Human
uggcagaguugaagaca

SEQ ID NO: 2716426 - RNA, 19 nt, Human
uggcagaguugaagacaga

SEQ ID NO: 2716427 - RNA, 21 nt, Human
uggcagaguggauucuugaac

SEQ ID NO: 2716428 - RNA, 15 nt, Human
uggcagaguugaaga

SEQ ID NO: 2716429 - RNA, 20 nt, Human
uggccccugcccggcugcgg

SEQ ID NO: 2716430 - RNA, 14 nt, Human
uggccccugcccgg

SEQ ID NO: 2716431 - RNA, 15 nt, Human
uggccccugcccggc

SEQ ID NO: 2716432 - RNA, 16 nt, Human
uggccccugcccggcu

SEQ ID NO: 2716433 - RNA, 13 nt, Human
uggccaggcuggu

SEQ ID NO: 2716434 - RNA, 11 nt, Human
uggcugcuuca

SEQ ID NO: 2716435 - RNA, 15 nt, Human
uggcugggggccuca

SEQ ID NO: 2716436 - RNA, 15 nt, Human
uggcugcuucaagga

SEQ ID NO: 2716437 - RNA, 23 nt, Human
uggcgcugccccuggcagccccu

SEQ ID NO: 2716438 - RNA, 16 nt, Human
uggcgcugccccuggc

SEQ ID NO: 2716439 - RNA, 22 nt, Human
uggcgcagcauauucaggaagc

SEQ ID NO: 2716440 - RNA, 23 nt, Human
uggcgcagcauauucaggaagcu

SEQ ID NO: 2716441 - RNA, 23 nt, Human
uggccucccaacucaccccagcc

SEQ ID NO: 2716442 - RNA, 13 nt, Human
ugguauguuuuca

SEQ ID NO: 2716443 - RNA, 16 nt, Human
uggucccagccagcag

SEQ ID NO: 2716444 - RNA, 13 nt, Human
uggucccacucag

SEQ ID NO: 2716445 - RNA, 14 nt, Human
uggucccccuucca

SEQ ID NO: 2716446 - RNA, 20 nt, Human
ugguccgugcuaaggacuug

SEQ ID NO: 2716447 - RNA, 19 nt, Human
ugguccgugcuaaggacuu

SEQ ID NO: 2716448 - RNA, 18 nt, Human
ugguccgugcuaaggacu

SEQ ID NO: 2716449 - RNA, 17 nt, Human
ugguccgugcuaaggac

SEQ ID NO: 2716450 - RNA, 15 nt, Human
uggucccccuuccau

SEQ ID NO: 2716451 - RNA, 16 nt, Human
uggucccccuuccaug

SEQ ID NO: 2716452 - RNA, 18 nt, Human
uggucccccuuccaugga

SEQ ID NO: 2716453 - RNA, 23 nt, Human
uggucccccuuccauggacuuug

SEQ ID NO: 2716454 - RNA, 17 nt, Human
ugguccuaaucuucuga

SEQ ID NO: 2716455 - RNA, 19 nt, Human
ugguccuaaucuucugaac

SEQ ID NO: 2716456 - RNA, 13 nt, Human
ugguccugcugca

SEQ ID NO: 2716457 - RNA, 15 nt, Human
ugguccugcugcagu

SEQ ID NO: 2716458 - RNA, 23 nt, Human
ugguccugcugcaguugccaguc

SEQ ID NO: 2716459 - RNA, 21 nt, Human
uggugcaaugaccuuucaaua

SEQ ID NO: 2716460 - RNA, 20 nt, Human
uggugcaaugaccuuucaau

SEQ ID NO: 2716461 - RNA, 19 nt, Human
uggugacugauucuucagc

SEQ ID NO: 2716462 - RNA, 19 nt, Human
uggugacuuuccucuuugg

SEQ ID NO: 2716463 - RNA, 16 nt, Human
uggugacugauucuuc

SEQ ID NO: 2716464 - RNA, 15 nt, Human
uggugacugauucuu

SEQ ID NO: 2716465 - RNA, 15 nt, Human
uggugaccucugccu

SEQ ID NO: 2716466 - RNA, 16 nt, Human
uggugaccucugccug

SEQ ID NO: 2716467 - RNA, 17 nt, Human
uggugaccucugccuga

SEQ ID NO: 2716468 - RNA, 22 nt, Human
uggugaccucugccugaaguca

SEQ ID NO: 2716469 - RNA, 14 nt, Human
uggucggaaaacau

SEQ ID NO: 2716470 - RNA, 17 nt, Human
uggucggaaaacaugcu

SEQ ID NO: 2716471 - RNA, 19 nt, Human
uggucuacacugugcugag

SEQ ID NO: 2716472 - RNA, 13 nt, Human
uggugaccucugc

SEQ ID NO: 2716473 - RNA, 14 nt, Human
uggugaccucugcc

SEQ ID NO: 2716474 - RNA, 15 nt, Human
uggucuacacugugc

SEQ ID NO: 2716475 - RNA, 16 nt, Human
uggucuacacugugcu

SEQ ID NO: 2716476 - RNA, 17 nt, Human
uggucuacacugugcug

SEQ ID NO: 2716477 - RNA, 18 nt, Human
uggucuacacugugcuga

SEQ ID NO: 2716478 - RNA, 17 nt, Human
ugggcagcugccucccc

SEQ ID NO: 2716479 - RNA, 19 nt, Human
ugggcagcugccuccccuc

SEQ ID NO: 2716480 - RNA, 12 nt, Human
ugggcagcugcc

SEQ ID NO: 2716481 - RNA, 13 nt, Human
ugggcagcugccu

SEQ ID NO: 2716482 - RNA, 14 nt, Human
ugggcagcugccuc

SEQ ID NO: 2716483 - RNA, 15 nt, Human
ugggcagcugccucc

SEQ ID NO: 2716484 - RNA, 23 nt, Human
ugggcagagcagagaccaucccu

SEQ ID NO: 2716485 - RNA, 14 nt, Human
ugggccuggcuccc

SEQ ID NO: 2716486 - RNA, 14 nt, Human
ugggagugggccca

SEQ ID NO: 2716487 - RNA, 16 nt, Human
ugggagugggcccaau

SEQ ID NO: 2716488 - RNA, 20 nt, Human
uggcugggggccucagugcc

SEQ ID NO: 2716489 - RNA, 16 nt, Human
uggcugggggccucag

SEQ ID NO: 2716490 - RNA, 17 nt, Human
uggcugggggccucagu

SEQ ID NO: 2716491 - RNA, 14 nt, Human
ugggauccuccagg

SEQ ID NO: 2716492 - RNA, 12 nt, Human
ugggauccucca

SEQ ID NO: 2716493 - RNA, 13 nt, Human
ugggauccuccag

SEQ ID NO: 2716494 - RNA, 22 nt, Human
ugggauuacaagcgugagccac

SEQ ID NO: 2716495 - RNA, 18 nt, Human
ugggcagagcagagacca

SEQ ID NO: 2716496 - RNA, 22 nt, Human
ugggcagagcagagaccauccc

SEQ ID NO: 2716497 - RNA, 17 nt, Human
uggguacuuguggacac

SEQ ID NO: 2716498 - RNA, 18 nt, Human
uggguacuuguggacaca

SEQ ID NO: 2716499 - RNA, 16 nt, Human
ugggggaguggccaca

SEQ ID NO: 2716500 - RNA, 15 nt, Human
uggggaugagaaagg

SEQ ID NO: 2716501 - RNA, 23 nt, Human
uggggaugagaaagguugaagca

SEQ ID NO: 2716502 - RNA, 20 nt, Human
uggggccaguuggucccccu

SEQ ID NO: 2716503 - RNA, 19 nt, Human
uuaaaauacacacucaaau

SEQ ID NO: 2716504 - RNA, 21 nt, Human
uuaaaauaccagccaguaaau

SEQ ID NO: 2716505 - RNA, 18 nt, Human
uuaaaagaugaaaauauu

SEQ ID NO: 2716506 - RNA, 15 nt, Human
uuaaaagaugaaaau

SEQ ID NO: 2716507 - RNA, 22 nt, Human
uuaaaagaauauuuuaacuucc

SEQ ID NO: 2716508 - RNA, 21 nt, Human
uuaaaagaauauuuuaacuuc

SEQ ID NO: 2716509 - RNA, 17 nt, Human
uuaaaagauacaguuac

SEQ ID NO: 2716510 - RNA, 14 nt, Human
uuaaaagauacagu

SEQ ID NO: 2716511 - RNA, 22 nt, Human
uguuuuaagaggcagggucuca

SEQ ID NO: 2716512 - RNA, 18 nt, Human
uguuuuaaggaugcuugu

SEQ ID NO: 2716513 - RNA, 19 nt, Human
uguuucaaacauauauaac

SEQ ID NO: 2716514 - RNA, 16 nt, Human
uguuuagauaauacac

SEQ ID NO: 2716515 - RNA, 21 nt, Human
uguuucaaacauauauaacaa

SEQ ID NO: 2716516 - RNA, 22 nt, Human
uguuucaaacauauauaacaau

SEQ ID NO: 2716517 - RNA, 15 nt, Human
uguuucaaacuuuac

SEQ ID NO: 2716518 - RNA, 23 nt, Human
uguuuccuggcacugcuuccagu

SEQ ID NO: 2716519 - RNA, 13 nt, Human
uguuugugauuga

SEQ ID NO: 2716520 - RNA, 20 nt, Human
uguuuuaagaggcagggucu

SEQ ID NO: 2716521 - RNA, 17 nt, Human
uuaaccacuucagcuga

SEQ ID NO: 2716522 - RNA, 16 nt, Human
uuaacuucacauauug

SEQ ID NO: 2716523 - RNA, 15 nt, Human
uuaacuuuuauaaac

SEQ ID NO: 2716524 - RNA, 17 nt, Human
uuaacuuuuauaaacuu

SEQ ID NO: 2716525 - RNA, 16 nt, Human
uuaacuuuuauaaacu

SEQ ID NO: 2716526 - RNA, 21 nt, Human
uuaagcagauggaaugcugug

SEQ ID NO: 2716527 - RNA, 18 nt, Human
uuaacuuuuauaaacuuu

SEQ ID NO: 2716528 - RNA, 21 nt, Human
uuacaagcgugagccacugca

SEQ ID NO: 2716529 - RNA, 20 nt, Human
uuacaagcgugagccacugc

SEQ ID NO: 2716530 - RNA, 17 nt, Human
uuaagcuguuacugucu

SEQ ID NO: 2716531 - RNA, 19 nt, Human
uuaagcauauauuuuuaua

SEQ ID NO: 2716532 - RNA, 13 nt, Human
uuaagcauauauu

SEQ ID NO: 2716533 - RNA, 18 nt, Human
uuaagcauauauuuuuau

SEQ ID NO: 2716534 - RNA, 15 nt, Human
uuaagcauauauuuu

SEQ ID NO: 2716535 - RNA, 20 nt, Human
uuaauauuaaagccauguuu

SEQ ID NO: 2716536 - RNA, 22 nt, Human
uuaauauuaaagccauguuuau

SEQ ID NO: 2716537 - RNA, 21 nt, Human
uuaauauuaaagccauguuua

SEQ ID NO: 2716538 - RNA, 13 nt, Human
uuaauauauuucc

SEQ ID NO: 2716539 - RNA, 14 nt, Human
uuaauauauuucca

SEQ ID NO: 2716540 - RNA, 17 nt, Human
uuaaugauaaguaaaug

SEQ ID NO: 2716541 - RNA, 21 nt, Human
uuaaugauaaguaaaugcuag

SEQ ID NO: 2716542 - RNA, 22 nt, Human
uuaauauugauaugcuuauaca

SEQ ID NO: 2716543 - RNA, 18 nt, Human
uuaauauugauaugcuua

SEQ ID NO: 2716544 - RNA, 17 nt, Human
uuaguagagacaggguu

SEQ ID NO: 2716545 - RNA, 18 nt, Human
uuaguaugaggcauuugu

SEQ ID NO: 2716546 - RNA, 16 nt, Human
uuaguaugaggcauuu

SEQ ID NO: 2716547 - RNA, 20 nt, Human
uuagaugcaguucugaagaa

SEQ ID NO: 2716548 - RNA, 21 nt, Human
uuagaugcaguucugaagaag

SEQ ID NO: 2716549 - RNA, 14 nt, Human
uuagaucuaguuca

SEQ ID NO: 2716550 - RNA, 13 nt, Human
uuagaucuaguuc

SEQ ID NO: 2716551 - RNA, 22 nt, Human
uuagauaauacaccacuacauu

SEQ ID NO: 2716552 - RNA, 12 nt, Human
uuagagauuuuu

SEQ ID NO: 2716553 - RNA, 18 nt, Human
uuagagaguguugaaacg

SEQ ID NO: 2716554 - RNA, 14 nt, Human
uuagaguugauacu

SEQ ID NO: 2716555 - RNA, 12 nt, Human
uuagcuggaaaa

SEQ ID NO: 2716556 - RNA, 13 nt, Human
uuagcuggaaaag

SEQ ID NO: 2716557 - RNA, 19 nt, Human
uuagaaacacaacuauauu

SEQ ID NO: 2716558 - RNA, 15 nt, Human
uuagacagucccugc

SEQ ID NO: 2716559 - RNA, 14 nt, Human
uuacuuuguguuca

SEQ ID NO: 2716560 - RNA, 17 nt, Human
uuacuuuaaaaggagcc

SEQ ID NO: 2716561 - RNA, 18 nt, Human
uuacuuuaaaaggagcca

SEQ ID NO: 2716562 - RNA, 16 nt, Human
uuagacagucccugcc

SEQ ID NO: 2716563 - RNA, 17 nt, Human
uuagacagucccugcca

SEQ ID NO: 2716564 - RNA, 18 nt, Human
uuagacagucccugccaa

SEQ ID NO: 2716565 - RNA, 14 nt, Human
uuagacagucccug

SEQ ID NO: 2716566 - RNA, 14 nt, Human
uuagagaguguuga

SEQ ID NO: 2716567 - RNA, 17 nt, Human
uuagagaguguugaaac

SEQ ID NO: 2716568 - RNA, 16 nt, Human
uuagagaguguugaaa

SEQ ID NO: 2716569 - RNA, 16 nt, Human
uuacuaauagacaauu

SEQ ID NO: 2716570 - RNA, 14 nt, Human
uuacuaaguuuuua

SEQ ID NO: 2716571 - RNA, 13 nt, Human
uuacuaaguuuuu

SEQ ID NO: 2716572 - RNA, 18 nt, Human
uuacuuagguguggggga

SEQ ID NO: 2716573 - RNA, 11 nt, Human
uuacuucugcu

SEQ ID NO: 2716574 - RNA, 23 nt, Human
uuacuucuuauacauuugauaaa

SEQ ID NO: 2716575 - RNA, 12 nt, Human
uuacuucugcua

SEQ ID NO: 2716576 - RNA, 21 nt, Human
uuacuuaaaccgccaaggcug

SEQ ID NO: 2716577 - RNA, 17 nt, Human
uucccuugaugaagaag

SEQ ID NO: 2716578 - RNA, 13 nt, Human
uuccucauuagca

SEQ ID NO: 2716579 - RNA, 20 nt, Human
uucccuuugacgccauccca

SEQ ID NO: 2716580 - RNA, 21 nt, Human
uucccuuugacgccaucccag

SEQ ID NO: 2716581 - RNA, 22 nt, Human
uucccuuugacgccaucccagc

SEQ ID NO: 2716582 - RNA, 20 nt, Human
uuccuuggacucauuuuaaa

SEQ ID NO: 2716583 - RNA, 17 nt, Human
uuccuuggacucauuuu

SEQ ID NO: 2716584 - RNA, 20 nt, Human
uucgggaggucgaggcagga

SEQ ID NO: 2716585 - RNA, 13 nt, Human
uucuaaagcugcc

SEQ ID NO: 2716586 - RNA, 17 nt, Human
uucuaaagcugccagcc

SEQ ID NO: 2716587 - RNA, 20 nt, Human
uuccuugaguugauucagcu

SEQ ID NO: 2716588 - RNA, 14 nt, Human
uuccuggcacugcu

SEQ ID NO: 2716589 - RNA, 17 nt, Human
uuccugccaggcauggu

SEQ ID NO: 2716590 - RNA, 15 nt, Human
uuccugaugcuucuu

SEQ ID NO: 2716591 - RNA, 18 nt, Human
uuccugaugcuucuucag

SEQ ID NO: 2716592 - RNA, 19 nt, Human
uuccugaugcuucuucaga

SEQ ID NO: 2716593 - RNA, 19 nt, Human
uuccagauccuggaaauca

SEQ ID NO: 2716594 - RNA, 13 nt, Human
uuccaaaauaauu

SEQ ID NO: 2716595 - RNA, 21 nt, Human
uuccaaaauaauuuuaagaaa

SEQ ID NO: 2716596 - RNA, 15 nt, Human
uuccaaauucugcuu

SEQ ID NO: 2716597 - RNA, 12 nt, Human
uuccaaaauaau

SEQ ID NO: 2716598 - RNA, 15 nt, Human
uucauuuccuguguc

SEQ ID NO: 2716599 - RNA, 16 nt, Human
uucauuuccugugucu

SEQ ID NO: 2716600 - RNA, 19 nt, Human
uucaugcauagguuuagca

SEQ ID NO: 2716601 - RNA, 15 nt, Human
uucaugaaagauuca

SEQ ID NO: 2716602 - RNA, 17 nt, Human
uucaugaaagauucaau

SEQ ID NO: 2716603 - RNA, 21 nt, Human
uucaucuugaauuguaaggaa

SEQ ID NO: 2716604 - RNA, 11 nt, Human
uucaggaagcu

SEQ ID NO: 2716605 - RNA, 13 nt, Human
uucaggaagcuca

SEQ ID NO: 2716606 - RNA, 17 nt, Human
uucaucuugaauuguaa

SEQ ID NO: 2716607 - RNA, 16 nt, Human
uucccauuugcuccuu

SEQ ID NO: 2716608 - RNA, 15 nt, Human
uuccccaggaggcca

SEQ ID NO: 2716609 - RNA, 16 nt, Human
uuccccaggaggccag

SEQ ID NO: 2716610 - RNA, 20 nt, Human
uucccucccuuccucuuucc

SEQ ID NO: 2716611 - RNA, 17 nt, Human
uucccucccuuccucuu

SEQ ID NO: 2716612 - RNA, 11 nt, Human
uucccucccuu

SEQ ID NO: 2716613 - RNA, 21 nt, Human
uuccccaggaggccagccuug

SEQ ID NO: 2716614 - RNA, 17 nt, Human
uuccccaggaggccagc

SEQ ID NO: 2716615 - RNA, 18 nt, Human
uuccccaggaggccagcc

SEQ ID NO: 2716616 - RNA, 19 nt, Human
uuccccaggaggccagccu

SEQ ID NO: 2716617 - RNA, 20 nt, Human
uuccccaggaggccagccuu

SEQ ID NO: 2716618 - RNA, 17 nt, Human
uucaaauccuugaagau

SEQ ID NO: 2716619 - RNA, 23 nt, Human
uucaaaguugccuaaauccauuu

SEQ ID NO: 2716620 - RNA, 17 nt, Human
uucaaaguugccuaaau

SEQ ID NO: 2716621 - RNA, 16 nt, Human
uucaaaguugccuaaa

SEQ ID NO: 2716622 - RNA, 15 nt, Human
uucaaaguugccuaa

SEQ ID NO: 2716623 - RNA, 11 nt, Human
uucaaaguugc

SEQ ID NO: 2716624 - RNA, 17 nt, Human
uuauuuuaauucaguug

SEQ ID NO: 2716625 - RNA, 13 nt, Human
uuauuuuauuaug

SEQ ID NO: 2716626 - RNA, 15 nt, Human
uuauugucuagugaa

SEQ ID NO: 2716627 - RNA, 18 nt, Human
uuauugucaaagugguga

SEQ ID NO: 2716628 - RNA, 17 nt, Human
uuauugucaaaguggug

SEQ ID NO: 2716629 - RNA, 15 nt, Human
uuauuuuaauaaugu

SEQ ID NO: 2716630 - RNA, 16 nt, Human
uuauuuuaauaauguu

SEQ ID NO: 2716631 - RNA, 22 nt, Human
uuauuggcuuuucugauccagu

SEQ ID NO: 2716632 - RNA, 18 nt, Human
uuauuggcuuuucugauc

SEQ ID NO: 2716633 - RNA, 16 nt, Human
uuauuggcuuuucuga

SEQ ID NO: 2716634 - RNA, 12 nt, Human
uuauuggcuuuu

SEQ ID NO: 2716635 - RNA, 13 nt, Human
uucagagcugccc

SEQ ID NO: 2716636 - RNA, 14 nt, Human
uucagagcugcccu

SEQ ID NO: 2716637 - RNA, 21 nt, Human
uucacucuccauuuaauaauu

SEQ ID NO: 2716638 - RNA, 19 nt, Human
uucagagacuccugcaggc

SEQ ID NO: 2716639 - RNA, 21 nt, Human
uucagacagcugccugggauc

SEQ ID NO: 2716640 - RNA, 13 nt, Human
uucacucuccuug

SEQ ID NO: 2716641 - RNA, 13 nt, Human
uucaauaggaaaa

SEQ ID NO: 2716642 - RNA, 15 nt, Human
uucaauaggaaaaac

SEQ ID NO: 2716643 - RNA, 18 nt, Human
uucaauaggaaaaacuga

SEQ ID NO: 2716644 - RNA, 20 nt, Human
uucaauaggaaaaacugauu

SEQ ID NO: 2716645 - RNA, 18 nt, Human
uucacggaagagccuugc

SEQ ID NO: 2716646 - RNA, 15 nt, Human
uucacgugguccuaa

SEQ ID NO: 2716647 - RNA, 17 nt, Human
uuauuacuguaagaaaa

SEQ ID NO: 2716648 - RNA, 18 nt, Human
uuauuacuguaagaaaau

SEQ ID NO: 2716649 - RNA, 16 nt, Human
uuauuacuguaagaaa

SEQ ID NO: 2716650 - RNA, 14 nt, Human
uuauuacaguauaa

SEQ ID NO: 2716651 - RNA, 17 nt, Human
uuauggcuauaggugcu

SEQ ID NO: 2716652 - RNA, 20 nt, Human
uuauugauaaguucauacau

SEQ ID NO: 2716653 - RNA, 15 nt, Human
uuauugauaaguuca

SEQ ID NO: 2716654 - RNA, 19 nt, Human
uuauugauaaguucauaca

SEQ ID NO: 2716655 - RNA, 15 nt, Human
uuauugcccacgcug

SEQ ID NO: 2716656 - RNA, 11 nt, Human
uuauucugcuc

SEQ ID NO: 2716657 - RNA, 21 nt, Human
uuauggcacuaguauuucuau

SEQ ID NO: 2716658 - RNA, 16 nt, Human
uuauggaacacucuga

SEQ ID NO: 2716659 - RNA, 16 nt, Human
uuaugcaugaaguaau

SEQ ID NO: 2716660 - RNA, 22 nt, Human
uuaugcaugaaguaauaugcac

SEQ ID NO: 2716661 - RNA, 17 nt, Human
uuaucuagauacuguau

SEQ ID NO: 2716662 - RNA, 17 nt, Human
uuaucugaagucagauc

SEQ ID NO: 2716663 - RNA, 16 nt, Human
uuaguuccucauuagc

SEQ ID NO: 2716664 - RNA, 14 nt, Human
uuaguuccuugagu

SEQ ID NO: 2716665 - RNA, 14 nt, Human
uuaucuagauacug

SEQ ID NO: 2716666 - RNA, 16 nt, Human
uuaucuagauacugua

SEQ ID NO: 2716667 - RNA, 14 nt, Human
uuuaauaauguuuc

SEQ ID NO: 2716668 - RNA, 15 nt, Human
uuuaauaauguuuca

SEQ ID NO: 2716669 - RNA, 19 nt, Human
uuuaauaauguuucaaaca

SEQ ID NO: 2716670 - RNA, 14 nt, Human
uuuaauaauuauau

SEQ ID NO: 2716671 - RNA, 15 nt, Human
uuuaacagaaaugua

SEQ ID NO: 2716672 - RNA, 14 nt, Human
uuuaacagaaaugu

SEQ ID NO: 2716673 - RNA, 14 nt, Human
uuuaaccucuaaau

SEQ ID NO: 2716674 - RNA, 14 nt, Human
uuuaauauuaaagc

SEQ ID NO: 2716675 - RNA, 21 nt, Human
uuuaauauuaaagccauguuu

SEQ ID NO: 2716676 - RNA, 20 nt, Human
uuuaauauuaaagccauguu

SEQ ID NO: 2716677 - RNA, 17 nt, Human
uuuaauauuaaagccau

SEQ ID NO: 2716678 - RNA, 15 nt, Human
uuuaauauuaaagcc

SEQ ID NO: 2716679 - RNA, 16 nt, Human
uuuacauggcuggagc

SEQ ID NO: 2716680 - RNA, 15 nt, Human
uuuauacaggucaua

SEQ ID NO: 2716681 - RNA, 20 nt, Human
uuuauacauaaacaagacca

SEQ ID NO: 2716682 - RNA, 12 nt, Human
uuuauacauaaa

SEQ ID NO: 2716683 - RNA, 18 nt, Human
uuuauaaacuuuaccuuu

SEQ ID NO: 2716684 - RNA, 19 nt, Human
uuuagacccuauugcugcu

SEQ ID NO: 2716685 - RNA, 22 nt, Human
uuuagacccuauugcugcuuga

SEQ ID NO: 2716686 - RNA, 19 nt, Human
uuuaaaauacacacucaaa

SEQ ID NO: 2716687 - RNA, 16 nt, Human
uuuaaaaucauuucug

SEQ ID NO: 2716688 - RNA, 14 nt, Human
uuuaaaagaaugau

SEQ ID NO: 2716689 - RNA, 17 nt, Human
uuuaaaagaaugauuau

SEQ ID NO: 2716690 - RNA, 13 nt, Human
uuuaaaagauaca

SEQ ID NO: 2716691 - RNA, 12 nt, Human
uuuaaaaugucu

SEQ ID NO: 2716692 - RNA, 13 nt, Human
uuuaacagaaaug

SEQ ID NO: 2716693 - RNA, 17 nt, Human
uuguuuaaaaucauuuc

SEQ ID NO: 2716694 - RNA, 18 nt, Human
uuguuuaaaaucauuucu

SEQ ID NO: 2716695 - RNA, 19 nt, Human
uuguucaauaauaaauauu

SEQ ID NO: 2716696 - RNA, 20 nt, Human
uugucuuuggacccugaggc

SEQ ID NO: 2716697 - RNA, 24 nt, Human
uugucuuuggacccugaggcccag

SEQ ID NO: 2716698 - RNA, 15 nt, Human
uugucuuuggacccu

SEQ ID NO: 2716699 - RNA, 12 nt, Human
uuguuucuguac

SEQ ID NO: 2716700 - RNA, 14 nt, Human
uuguuucuguacuu

SEQ ID NO: 2716701 - RNA, 20 nt, Human
uuguuuggggaugagaaagg

SEQ ID NO: 2716702 - RNA, 14 nt, Human
uuguuuguuuaguc

SEQ ID NO: 2716703 - RNA, 13 nt, Human
uuguuuguuuagu

SEQ ID NO: 2716704 - RNA, 21 nt, Human
uuugaaauuguauuacaaauc

SEQ ID NO: 2716705 - RNA, 18 nt, Human
uuugaagcacagugauca

SEQ ID NO: 2716706 - RNA, 19 nt, Human
uuucuuguguguuuauugu

SEQ ID NO: 2716707 - RNA, 13 nt, Human
uuugaguucuaca

SEQ ID NO: 2716708 - RNA, 16 nt, Human
uuugagaucagccugg

SEQ ID NO: 2716709 - RNA, 17 nt, Human
uuugagaucagccuggg

SEQ ID NO: 2716710 - RNA, 14 nt, Human
uuugagaguucuaa

SEQ ID NO: 2716711 - RNA, 16 nt, Human
uuugagaguucuaaau

SEQ ID NO: 2716712 - RNA, 18 nt, Human
uuugguaaggggaauuga

SEQ ID NO: 2716713 - RNA, 17 nt, Human
uuugauaugugaacagu

SEQ ID NO: 2716714 - RNA, 15 nt, Human
uuugauaugugaaca

SEQ ID NO: 2716715 - RNA, 14 nt, Human
uuugauaugugaac

SEQ ID NO: 2716716 - RNA, 15 nt, Human
uuuggacccugaggc

SEQ ID NO: 2716717 - RNA, 19 nt, Human
uuuggacccugaggcccag

SEQ ID NO: 2716718 - RNA, 12 nt, Human
uuucucuaggaa

SEQ ID NO: 2716719 - RNA, 22 nt, Human
uuucuacccagcgagcccuggu

SEQ ID NO: 2716720 - RNA, 15 nt, Human
uuucuacccagcgag

SEQ ID NO: 2716721 - RNA, 18 nt, Human
uuucuacccagcgagccc

SEQ ID NO: 2716722 - RNA, 13 nt, Human
uuucugauccagu

SEQ ID NO: 2716723 - RNA, 12 nt, Human
uuucugaaauuu

SEQ ID NO: 2716724 - RNA, 22 nt, Human
uuucugauccaguuuuguuugg

SEQ ID NO: 2716725 - RNA, 20 nt, Human
uuucugauccaguuuuguuu

SEQ ID NO: 2716726 - RNA, 16 nt, Human
uuucugauccaguuuu

SEQ ID NO: 2716727 - RNA, 15 nt, Human
uuucugauccaguuu

SEQ ID NO: 2716728 - RNA, 23 nt, Human
uuuccuggcacugcuuccaguga

SEQ ID NO: 2716729 - RNA, 19 nt, Human
uuuccuggcacugcuucca

SEQ ID NO: 2716730 - RNA, 21 nt, Human
uuucuaacaaaaaaauauauu

SEQ ID NO: 2716731 - RNA, 19 nt, Human
uuucuaaaucuccaaaaua

SEQ ID NO: 2716732 - RNA, 17 nt, Human
uuucagccaagaauucu

SEQ ID NO: 2716733 - RNA, 15 nt, Human
uuucacauaucuagu

SEQ ID NO: 2716734 - RNA, 21 nt, Human
uuucacauaucuaguaugaaa

SEQ ID NO: 2716735 - RNA, 16 nt, Human
uuucagccaagaauuc

SEQ ID NO: 2716736 - RNA, 21 nt, Human
uugaaaaucuuauaauuuaaa

SEQ ID NO: 2716737 - RNA, 21 nt, Human
uucuuuccugaggcugggcuc

SEQ ID NO: 2716738 - RNA, 18 nt, Human
uucuuuccacagaagcuc

SEQ ID NO: 2716739 - RNA, 12 nt, Human
uucuuuaauuuu

SEQ ID NO: 2716740 - RNA, 18 nt, Human
uucuuuaauuuuggaauu

SEQ ID NO: 2716741 - RNA, 17 nt, Human
uucuuuaauuuuggaau

SEQ ID NO: 2716742 - RNA, 15 nt, Human
uugaacuuugaccuc

SEQ ID NO: 2716743 - RNA, 19 nt, Human
uugaaacggaugauuucua

SEQ ID NO: 2716744 - RNA, 16 nt, Human
uugaaacggaugauuu

SEQ ID NO: 2716745 - RNA, 20 nt, Human
uugaagcacagugaucaagu

SEQ ID NO: 2716746 - RNA, 21 nt, Human
uugaagagguuuuaaagcuuc

SEQ ID NO: 2716747 - RNA, 18 nt, Human
uugaacuuugaccucugc

SEQ ID NO: 2716748 - RNA, 17 nt, Human
uugaacuuugaccucug

SEQ ID NO: 2716749 - RNA, 16 nt, Human
uugaagagguuuuaaa

SEQ ID NO: 2716750 - RNA, 14 nt, Human
uugaauguuaagca

SEQ ID NO: 2716751 - RNA, 17 nt, Human
uugaauguuaagcagau

SEQ ID NO: 2716752 - RNA, 12 nt, Human
uugaaugaugcc

SEQ ID NO: 2716753 - RNA, 16 nt, Human
uugaaugaugccauga

SEQ ID NO: 2716754 - RNA, 19 nt, Human
uucuuaggguuaugauuaa

SEQ ID NO: 2716755 - RNA, 17 nt, Human
uucuuagggaaggauac

SEQ ID NO: 2716756 - RNA, 13 nt, Human
uucuucagagacu

SEQ ID NO: 2716757 - RNA, 24 nt, Human
uucuaaguaaaaccacagcaguug

SEQ ID NO: 2716758 - RNA, 16 nt, Human
uucuggcuaugcauuu

SEQ ID NO: 2716759 - RNA, 20 nt, Human
uucuggcagaguugaagaca

SEQ ID NO: 2716760 - RNA, 14 nt, Human
uucuguauagauua

SEQ ID NO: 2716761 - RNA, 13 nt, Human
uucuguauagauu

SEQ ID NO: 2716762 - RNA, 11 nt, Human
uucuguauaga

SEQ ID NO: 2716763 - RNA, 23 nt, Human
uugcagacaggcaagcaccuccu

SEQ ID NO: 2716764 - RNA, 13 nt, Human
uugauucauaaug

SEQ ID NO: 2716765 - RNA, 17 nt, Human
uugauucauaaugacuu

SEQ ID NO: 2716766 - RNA, 22 nt, Human
uugccaucccucccuccaccuc

SEQ ID NO: 2716767 - RNA, 23 nt, Human
uugccaucccucccuccaccucc

SEQ ID NO: 2716768 - RNA, 14 nt, Human
uugccaucccuccc

SEQ ID NO: 2716769 - RNA, 16 nt, Human
uugccaucccucccuc

SEQ ID NO: 2716770 - RNA, 17 nt, Human
uugccaucccucccucc

SEQ ID NO: 2716771 - RNA, 18 nt, Human
uugccaucccucccucca

SEQ ID NO: 2716772 - RNA, 16 nt, Human
uugccauguuggccag

SEQ ID NO: 2716773 - RNA, 17 nt, Human
uugccauguuggccagg

SEQ ID NO: 2716774 - RNA, 18 nt, Human
uugccauguuggccaggc

SEQ ID NO: 2716775 - RNA, 19 nt, Human
uugccauguuggccaggcu

SEQ ID NO: 2716776 - RNA, 13 nt, Human
uugccaucccucc

SEQ ID NO: 2716777 - RNA, 20 nt, Human
uugauaugccuuuucccaac

SEQ ID NO: 2716778 - RNA, 16 nt, Human
uugauaugugaacagu

SEQ ID NO: 2716779 - RNA, 16 nt, Human
uugauaugcuuauaca

SEQ ID NO: 2716780 - RNA, 16 nt, Human
uugauucagcucugca

SEQ ID NO: 2716781 - RNA, 23 nt, Human
uugauucagacagcugccuggga

SEQ ID NO: 2716782 - RNA, 17 nt, Human
uugauucagacagcugc

SEQ ID NO: 2716783 - RNA, 21 nt, Human
uugauucagacagcugccugg

SEQ ID NO: 2716784 - RNA, 19 nt, Human
uugagccuugaacuuugac

SEQ ID NO: 2716785 - RNA, 14 nt, Human
uugagccugggagg

SEQ ID NO: 2716786 - RNA, 14 nt, Human
uugagccuugaacu

SEQ ID NO: 2716787 - RNA, 16 nt, Human
uugagccuugaacuuu

SEQ ID NO: 2716788 - RNA, 15 nt, Human
uugagccuugaacuu

SEQ ID NO: 2716789 - RNA, 13 nt, Human
uugguccugcugc

SEQ ID NO: 2716790 - RNA, 20 nt, Human
uuggucugacccacugcuuu

SEQ ID NO: 2716791 - RNA, 20 nt, Human
uugguaaggggaauugagga

SEQ ID NO: 2716792 - RNA, 18 nt, Human
uuggcauaacauaaaucu

SEQ ID NO: 2716793 - RNA, 23 nt, Human
uuggcauaacauaaaucugugaa

SEQ ID NO: 2716794 - RNA, 22 nt, Human
uuggcauaacauaaaucuguga

SEQ ID NO: 2716795 - RNA, 20 nt, Human
uuggcauaacauaaaucugu

SEQ ID NO: 2716796 - RNA, 19 nt, Human
uuggcauaacauaaaucug

SEQ ID NO: 2716797 - RNA, 23 nt, Human
uuggcuucacggaagagccuugc

SEQ ID NO: 2716798 - RNA, 16 nt, Human
uuguacgaagaguauu

SEQ ID NO: 2716799 - RNA, 19 nt, Human
uuguacgaagaguauuuuu

SEQ ID NO: 2716800 - RNA, 22 nt, Human
uuguagcacugacagauuucca

SEQ ID NO: 2716801 - RNA, 15 nt, Human
uuguagcauccugga

SEQ ID NO: 2716802 - RNA, 14 nt, Human
uuguagcacugaca

SEQ ID NO: 2716803 - RNA, 16 nt, Human
uuguagcacugacaga

SEQ ID NO: 2716804 - RNA, 17 nt, Human
uuguagcacugacagau

SEQ ID NO: 2716805 - RNA, 18 nt, Human
uuguagcacugacagauu

SEQ ID NO: 2716806 - RNA, 17 nt, Human
uuguagaagucacauuc

SEQ ID NO: 2716807 - RNA, 22 nt, Human
uuguagaagucacauuccugaa

SEQ ID NO: 2716808 - RNA, 20 nt, Human
uuguauuuuacuaauaaaau

SEQ ID NO: 2716809 - RNA, 14 nt, Human
uugucuaugggacu

SEQ ID NO: 2716810 - RNA, 22 nt, Human
uugucaaaguggugagaggcau

SEQ ID NO: 2716811 - RNA, 22 nt, Human
uugucuuaaaaaguggaaaaau

SEQ ID NO: 2716812 - RNA, 20 nt, Human
uugucuaugggacucaaugc

SEQ ID NO: 2716813 - RNA, 18 nt, Human
uugcuaagcauuccaacu

SEQ ID NO: 2716814 - RNA, 16 nt, Human
uugcuaagcauuccaa

SEQ ID NO: 2716815 - RNA, 14 nt, Human
uugcugcuugaggc

SEQ ID NO: 2716816 - RNA, 16 nt, Human
uugcugcuugaggcaa

SEQ ID NO: 2716817 - RNA, 16 nt, Human
uugcugucccuuuucc

SEQ ID NO: 2716818 - RNA, 18 nt, Human
uugcugucccuuuuccuu

SEQ ID NO: 2716819 - RNA, 13 nt, Human
uugccuuuuucau

SEQ ID NO: 2716820 - RNA, 12 nt, Human
uugccuuuuuca

SEQ ID NO: 2716821 - RNA, 17 nt, Human
uugccuuuuucauuauu

SEQ ID NO: 2716822 - RNA, 16 nt, Human
uugccuuuuucauuau

SEQ ID NO: 2716823 - RNA, 15 nt, Human
uugccuuuuucauua

SEQ ID NO: 2716824 - RNA, 14 nt, Human
uugccuuuuucauu

SEQ ID NO: 2716825 - RNA, 20 nt, Human
uugccauguuggccaggcug

SEQ ID NO: 2716826 - RNA, 21 nt, Human
uugccauguuggccaggcugg

SEQ ID NO: 2716827 - RNA, 18 nt, Human
uuggacaaaauggaauac

SEQ ID NO: 2716828 - RNA, 19 nt, Human
uuggaagcuccgcuuucua

SEQ ID NO: 2716829 - RNA, 15 nt, Human
uuggauuguccccga

SEQ ID NO: 2716830 - RNA, 15 nt, Human
uuggacccugaggcc

SEQ ID NO: 2716831 - RNA, 18 nt, Human
uuggacccugaggcccag

SEQ ID NO: 2716832 - RNA, 19 nt, Human
uuggacccugaggcccaga

SEQ ID NO: 2716833 - RNA, 21 nt, Human
uuggacccugaggcccagagg

SEQ ID NO: 2716834 - RNA, 12 nt, Human
cuccucugcuug

SEQ ID NO: 2716835 - RNA, 14 nt, Human
cuccucugcuugcc

SEQ ID NO: 2716836 - RNA, 18 nt, Human
cuccucugcugcuggcug

SEQ ID NO: 2716837 - RNA, 16 nt, Human
cuccucugcugcuggc

SEQ ID NO: 2716838 - RNA, 21 nt, Human
cuccucugcuugccaucccuc

SEQ ID NO: 2716839 - RNA, 15 nt, Human
cuccucugcuugcca

SEQ ID NO: 2716840 - RNA, 16 nt, Human
cuccucugcuugccau

SEQ ID NO: 2716841 - RNA, 17 nt, Human
cuccucugcuugccauc

SEQ ID NO: 2716842 - RNA, 20 nt, Human
cuccucugcuugccaucccu

SEQ ID NO: 2716843 - RNA, 22 nt, Human
cuccugggcagcugccuccccu

SEQ ID NO: 2716844 - RNA, 18 nt, Human
cuccugggcagcugccuc

SEQ ID NO: 2716845 - RNA, 19 nt, Human
cuccugggcagcugccucc

SEQ ID NO: 2716846 - RNA, 14 nt, Human
cuccugggcagcug

SEQ ID NO: 2716847 - RNA, 15 nt, Human
cuccugggcagcugc

SEQ ID NO: 2716848 - RNA, 16 nt, Human
cuccugggcagcugcc

SEQ ID NO: 2716849 - RNA, 17 nt, Human
cuccugggcagcugccu

SEQ ID NO: 2716850 - RNA, 12 nt, Human
cuccugggcagc

SEQ ID NO: 2716851 - RNA, 16 nt, Human
cuccuggcccacugca

SEQ ID NO: 2716852 - RNA, 18 nt, Human
cuccuggcccacugcauc

SEQ ID NO: 2716853 - RNA, 22 nt, Human
cucccccagccccauccucugu

SEQ ID NO: 2716854 - RNA, 15 nt, Human
cucccccagccccau

SEQ ID NO: 2716855 - RNA, 20 nt, Human
cucccccagccccauccucu

SEQ ID NO: 2716856 - RNA, 15 nt, Human
cucgaacuggcugca

SEQ ID NO: 2716857 - RNA, 13 nt, Human
cucgaacuggcug

SEQ ID NO: 2716858 - RNA, 14 nt, Human
cucgaacuggcugc

SEQ ID NO: 2716859 - RNA, 14 nt, Human
cucguuaauuugua

SEQ ID NO: 2716860 - RNA, 16 nt, Human
cuccacuuucuagcca

SEQ ID NO: 2716861 - RNA, 19 nt, Human
cuccacuuucuagccagag

SEQ ID NO: 2716862 - RNA, 19 nt, Human
cuccccaugauguuuagaa

SEQ ID NO: 2716863 - RNA, 13 nt, Human
cuccaagcuccca

SEQ ID NO: 2716864 - RNA, 14 nt, Human
cuccaagcucccag

SEQ ID NO: 2716865 - RNA, 15 nt, Human
cuccaagcucccagg

SEQ ID NO: 2716866 - RNA, 16 nt, Human
cuccaagcucccaggc

SEQ ID NO: 2716867 - RNA, 13 nt, Human
cuccaagaauuuc

SEQ ID NO: 2716868 - RNA, 21 nt, Human
cuccaagaccuucuccuucac

SEQ ID NO: 2716869 - RNA, 15 nt, Human
cuccaagaccuucuc

SEQ ID NO: 2716870 - RNA, 14 nt, Human
cuccaagaauuucu

SEQ ID NO: 2716871 - RNA, 22 nt, Human
cuccaagaccuucuccuucacc

SEQ ID NO: 2716872 - RNA, 13 nt, Human
cuccaagcaggac

SEQ ID NO: 2716873 - RNA, 14 nt, Human
cuccaagcaggaca

SEQ ID NO: 2716874 - RNA, 22 nt, Human
cuccaagcaggacauggacaag

SEQ ID NO: 2716875 - RNA, 24 nt, Human
cuccaagcaggacauggacaagga

SEQ ID NO: 2716876 - RNA, 21 nt, Human
cugagaucaaaacgguuuuac

SEQ ID NO: 2716877 - RNA, 14 nt, Human
cugagcuuucugcu

SEQ ID NO: 2716878 - RNA, 15 nt, Human
cugagcuuucugcua

SEQ ID NO: 2716879 - RNA, 23 nt, Human
cugaggacacuaaccacgcugga

SEQ ID NO: 2716880 - RNA, 21 nt, Human
cugaggaauccagacccggcu

SEQ ID NO: 2716881 - RNA, 20 nt, Human
cugaggacacuaaccacgcu

SEQ ID NO: 2716882 - RNA, 17 nt, Human
cugaggaauccagaccc

SEQ ID NO: 2716883 - RNA, 20 nt, Human
cugaggaauccagacccggc

SEQ ID NO: 2716884 - RNA, 14 nt, Human
cugaggaauccaga

SEQ ID NO: 2716885 - RNA, 21 nt, Human
cugaguacguugugcauuugg

SEQ ID NO: 2716886 - RNA, 20 nt, Human
cugaguacguugugcauuug

SEQ ID NO: 2716887 - RNA, 19 nt, Human
cugaguacguugugcauuu

SEQ ID NO: 2716888 - RNA, 17 nt, Human
cugaguacguugugcau

SEQ ID NO: 2716889 - RNA, 18 nt, Human
cugaguacguugugcauu

SEQ ID NO: 2716890 - RNA, 21 nt, Human
cugagaggacuuuucuuugug

SEQ ID NO: 2716891 - RNA, 22 nt, Human
cugagaggacuuuucuuugugg

SEQ ID NO: 2716892 - RNA, 17 nt, Human
cugagaguagagucacu

SEQ ID NO: 2716893 - RNA, 22 nt, Human
cugagacucgcgacaaugcaaa

SEQ ID NO: 2716894 - RNA, 21 nt, Human
cugacccaugcugcccuguga

SEQ ID NO: 2716895 - RNA, 22 nt, Human
cugacccaugcugcccugugag

SEQ ID NO: 2716896 - RNA, 23 nt, Human
cugagacagcccgggcucugccu

SEQ ID NO: 2716897 - RNA, 21 nt, Human
cugagacucgcgacaaugcaa

SEQ ID NO: 2716898 - RNA, 22 nt, Human
cucuuagaugcaguucugaaga

SEQ ID NO: 2716899 - RNA, 21 nt, Human
cucuuagaugcaguucugaag

SEQ ID NO: 2716900 - RNA, 13 nt, Human
cucuuauugccca

SEQ ID NO: 2716901 - RNA, 14 nt, Human
cucuuauugcccac

SEQ ID NO: 2716902 - RNA, 15 nt, Human
cucuuauugcccacg

SEQ ID NO: 2716903 - RNA, 19 nt, Human
cucuuauugcccacgcugg

SEQ ID NO: 2716904 - RNA, 20 nt, Human
cucuuauugcccacgcugga

SEQ ID NO: 2716905 - RNA, 14 nt, Human
cucuucaaucucuu

SEQ ID NO: 2716906 - RNA, 19 nt, Human
cucuucagaucucuaacuu

SEQ ID NO: 2716907 - RNA, 18 nt, Human
cucuucagaucucuaacu

SEQ ID NO: 2716908 - RNA, 21 nt, Human
cucugcacuccccugcugggu

SEQ ID NO: 2716909 - RNA, 18 nt, Human
cucugcacuccccugcug

SEQ ID NO: 2716910 - RNA, 20 nt, Human
cucugcacuccccugcuggg

SEQ ID NO: 2716911 - RNA, 13 nt, Human
cucugcuccucuc

SEQ ID NO: 2716912 - RNA, 18 nt, Human
cucugcuccucuccccag

SEQ ID NO: 2716913 - RNA, 20 nt, Human
cucugcuccucuccccagca

SEQ ID NO: 2716914 - RNA, 13 nt, Human
cucugcugacaga

SEQ ID NO: 2716915 - RNA, 14 nt, Human
cucugcugacagac

SEQ ID NO: 2716916 - RNA, 16 nt, Human
cucugcugacagacac

SEQ ID NO: 2716917 - RNA, 14 nt, Human
cucugguccauaga

SEQ ID NO: 2716918 - RNA, 15 nt, Human
cugaaacaacaaaua

SEQ ID NO: 2716919 - RNA, 13 nt, Human
cugaaacuucccu

SEQ ID NO: 2716920 - RNA, 22 nt, Human
cugacaacacucauugaccuga

SEQ ID NO: 2716921 - RNA, 23 nt, Human
cugacaacacucauugaccugag

SEQ ID NO: 2716922 - RNA, 18 nt, Human
cugaaggccccgcccagg

SEQ ID NO: 2716923 - RNA, 19 nt, Human
cugaaggccccgcccaggc

SEQ ID NO: 2716924 - RNA, 17 nt, Human
cugaaggcuggguucug

SEQ ID NO: 2716925 - RNA, 21 nt, Human
cugaaggccccgcccaggcuu

SEQ ID NO: 2716926 - RNA, 23 nt, Human
cugaaggacauugcggacagcca

SEQ ID NO: 2716927 - RNA, 17 nt, Human
cucuugagccuugaacu

SEQ ID NO: 2716928 - RNA, 16 nt, Human
cucuugagccuugaac

SEQ ID NO: 2716929 - RNA, 18 nt, Human
cucuugagccuugaacuu

SEQ ID NO: 2716930 - RNA, 20 nt, Human
cguguaaccauggacccaau

SEQ ID NO: 2716931 - RNA, 14 nt, Human
cgugcacacaccag

SEQ ID NO: 2716932 - RNA, 16 nt, Human
cgugaggccagagaca

SEQ ID NO: 2716933 - RNA, 17 nt, Human
cgugaguccuggcaugg

SEQ ID NO: 2716934 - RNA, 17 nt, Human
cgugaggccagagacac

SEQ ID NO: 2716935 - RNA, 16 nt, Human
cgugaguccuggcaug

SEQ ID NO: 2716936 - RNA, 16 nt, Human
cgguuuuacugcagcu

SEQ ID NO: 2716937 - RNA, 16 nt, Human
cggagucccaccuugg

SEQ ID NO: 2716938 - RNA, 12 nt, Human
cgggccacagag

SEQ ID NO: 2716939 - RNA, 14 nt, Human
cgggccacagagaa

SEQ ID NO: 2716940 - RNA, 13 nt, Human
cggcuccaggcuc

SEQ ID NO: 2716941 - RNA, 14 nt, Human
cggcuccaggcucc

SEQ ID NO: 2716942 - RNA, 15 nt, Human
cggcuccaggcuccu

SEQ ID NO: 2716943 - RNA, 16 nt, Human
cggcuccaggcuccuu

SEQ ID NO: 2716944 - RNA, 12 nt, Human
cggcuccaggcu

SEQ ID NO: 2716945 - RNA, 16 nt, Human
cggcucacugcagccu

SEQ ID NO: 2716946 - RNA, 17 nt, Human
cggcucacugcagccuc

SEQ ID NO: 2716947 - RNA, 18 nt, Human
cggagucccaccuuggcu

SEQ ID NO: 2716948 - RNA, 20 nt, Human
cggagucccaccuuggcugc

SEQ ID NO: 2716949 - RNA, 15 nt, Human
cggcucacugcagcc

SEQ ID NO: 2716950 - RNA, 14 nt, Human
cggcucacugcagc

SEQ ID NO: 2716951 - RNA, 13 nt, Human
cgguguggagaag

SEQ ID NO: 2716952 - RNA, 15 nt, Human
cggggacagcuccuu

SEQ ID NO: 2716953 - RNA, 18 nt, Human
cgguguggagaagcggcu

SEQ ID NO: 2716954 - RNA, 14 nt, Human
cggggacagcuccu

SEQ ID NO: 2716955 - RNA, 17 nt, Human
cgggcucugccucccau

SEQ ID NO: 2716956 - RNA, 15 nt, Human
cgggcucagcaaaag

SEQ ID NO: 2716957 - RNA, 13 nt, Human
cgggcucugccuc

SEQ ID NO: 2716958 - RNA, 14 nt, Human
cgggcucugccucc

SEQ ID NO: 2716959 - RNA, 16 nt, Human
cgggcucugccuccca

SEQ ID NO: 2716960 - RNA, 11 nt, Human
cgggcucagca

SEQ ID NO: 2716961 - RNA, 17 nt, Human
cgggccacagagaaagu

SEQ ID NO: 2716962 - RNA, 18 nt, Human
cgcaggcccccaggugcc

SEQ ID NO: 2716963 - RNA, 22 nt, Human
cgcaggauucuuccucccuccc

SEQ ID NO: 2716964 - RNA, 14 nt, Human
cgauagugguggug

SEQ ID NO: 2716965 - RNA, 23 nt, Human
cgccacuguuuugaaucucauaa

SEQ ID NO: 2716966 - RNA, 14 nt, Human
ccuuuaagagaaau

SEQ ID NO: 2716967 - RNA, 16 nt, Human
ccuugccgucuaccug

SEQ ID NO: 2716968 - RNA, 17 nt, Human
ccuuuugagugccuuac

SEQ ID NO: 2716969 - RNA, 15 nt, Human
ccuuuugagugccuu

SEQ ID NO: 2716970 - RNA, 21 nt, Human
ccuuucaauaggaaaaacuga

SEQ ID NO: 2716971 - RNA, 21 nt, Human
ccuuuuuuagaguugauacua

SEQ ID NO: 2716972 - RNA, 16 nt, Human
ccuuuuuuaaauaaau

SEQ ID NO: 2716973 - RNA, 13 nt, Human
cgacaaugcaaac

SEQ ID NO: 2716974 - RNA, 12 nt, Human
cgacaaugcaaa

SEQ ID NO: 2716975 - RNA, 17 nt, Human
cgacugcccggcagggu

SEQ ID NO: 2716976 - RNA, 19 nt, Human
cgacccuugccgucuaccu

SEQ ID NO: 2716977 - RNA, 20 nt, Human
cgacccuugccgucuaccug

SEQ ID NO: 2716978 - RNA, 17 nt, Human
cucaaaacugcacuguc

SEQ ID NO: 2716979 - RNA, 23 nt, Human
cucaaaauaccaugccauuuaaa

SEQ ID NO: 2716980 - RNA, 18 nt, Human
cucaaaagcugggcaggu

SEQ ID NO: 2716981 - RNA, 18 nt, Human
cuaucucccccagcccca

SEQ ID NO: 2716982 - RNA, 16 nt, Human
cuaucucccccagccc

SEQ ID NO: 2716983 - RNA, 17 nt, Human
cuaucucccccagcccc

SEQ ID NO: 2716984 - RNA, 13 nt, Human
cucaaugcacuga

SEQ ID NO: 2716985 - RNA, 15 nt, Human
cucaaugcacugaca

SEQ ID NO: 2716986 - RNA, 20 nt, Human
cucaaacucuugaccucagg

SEQ ID NO: 2716987 - RNA, 12 nt, Human
cuagccagagga

SEQ ID NO: 2716988 - RNA, 13 nt, Human
cuagccagaggag

SEQ ID NO: 2716989 - RNA, 15 nt, Human
cuagccagaggagag

SEQ ID NO: 2716990 - RNA, 13 nt, Human
cuaguuugauuaa

SEQ ID NO: 2716991 - RNA, 22 nt, Human
cuaguuguuugauucagacagc

SEQ ID NO: 2716992 - RNA, 23 nt, Human
cuaguuguuugauucagacagcu

SEQ ID NO: 2716993 - RNA, 21 nt, Human
cuaguuugauuaaauucuugc

SEQ ID NO: 2716994 - RNA, 22 nt, Human
cuaguuugauuaaauucuugca

SEQ ID NO: 2716995 - RNA, 15 nt, Human
cuaucucccccagcc

SEQ ID NO: 2716996 - RNA, 14 nt, Human
cuaucuaaauguug

SEQ ID NO: 2716997 - RNA, 15 nt, Human
cuacaaaaacacagc

SEQ ID NO: 2716998 - RNA, 18 nt, Human
cuacaaaaacacagcaag

SEQ ID NO: 2716999 - RNA, 19 nt, Human
cuacaguccucccaucuca

SEQ ID NO: 2717000 - RNA, 17 nt, Human
cuacaaaaacacagcaa

SEQ ID NO: 2717001 - RNA, 16 nt, Human
cuacaaaaacacagca

SEQ ID NO: 2717002 - RNA, 18 nt, Human
cuacauacuauggaauuu

SEQ ID NO: 2717003 - RNA, 22 nt, Human
cuacaguugaaaaacagcugag

SEQ ID NO: 2717004 - RNA, 20 nt, Human
cuacaguccucccaucucac

SEQ ID NO: 2717005 - RNA, 19 nt, Human
cuacaguugaaaaacagcu

SEQ ID NO: 2717006 - RNA, 21 nt, Human
cuacaguugaaaaacagcuga

SEQ ID NO: 2717007 - RNA, 17 nt, Human
cuaccuuuguauucucu

SEQ ID NO: 2717008 - RNA, 20 nt, Human
cuaaguaaaaccacagcagu

SEQ ID NO: 2717009 - RNA, 23 nt, Human
cuaaguaaaaccacagcaguuga

SEQ ID NO: 2717010 - RNA, 22 nt, Human
cuaaguaaaaccacagcaguug

SEQ ID NO: 2717011 - RNA, 23 nt, Human
cuaagugauccucccaccucagc

SEQ ID NO: 2717012 - RNA, 20 nt, Human
cuaaguuuuuauggcuuuug

SEQ ID NO: 2717013 - RNA, 21 nt, Human
cuaagugguacuaacuuuccu

SEQ ID NO: 2717014 - RNA, 23 nt, Human
cuaaguuuuuauggcuuuugugc

SEQ ID NO: 2717015 - RNA, 22 nt, Human
cuagaagauuuugaaauuuuua

SEQ ID NO: 2717016 - RNA, 23 nt, Human
cuagaauuugauaugugaacagu

SEQ ID NO: 2717017 - RNA, 23 nt, Human
cuagcauacguacacauuuuauu

SEQ ID NO: 2717018 - RNA, 21 nt, Human
cuagcauacguacacauuuua

SEQ ID NO: 2717019 - RNA, 15 nt, Human
ccugucuaaugaaac

SEQ ID NO: 2717020 - RNA, 22 nt, Human
ccugucuaaugaaaccuguguc

SEQ ID NO: 2717021 - RNA, 17 nt, Human
ccugucuugccuuuuuc

SEQ ID NO: 2717022 - RNA, 20 nt, Human
ccugucuugccuuuuucauu

SEQ ID NO: 2717023 - RNA, 19 nt, Human
ccugucuugccuuuuucau

SEQ ID NO: 2717024 - RNA, 21 nt, Human
ccugguggcagugggagcugc

SEQ ID NO: 2717025 - RNA, 22 nt, Human
ccuggccucugcacuccccugc

SEQ ID NO: 2717026 - RNA, 22 nt, Human
ccuggccuagcauacguacaca

SEQ ID NO: 2717027 - RNA, 20 nt, Human
ccuggccucugcacuccccu

SEQ ID NO: 2717028 - RNA, 21 nt, Human
ccuggccucugcacuccccug

SEQ ID NO: 2717029 - RNA, 11 nt, Human
ccucuuucccu

SEQ ID NO: 2717030 - RNA, 13 nt, Human
ccugcccaggccc

SEQ ID NO: 2717031 - RNA, 13 nt, Human
ccugcccaccugg

SEQ ID NO: 2717032 - RNA, 14 nt, Human
ccugcccaccuggc

SEQ ID NO: 2717033 - RNA, 20 nt, Human
ccugcccaccuggccucugc

SEQ ID NO: 2717034 - RNA, 12 nt, Human
ccugcccaccug

SEQ ID NO: 2717035 - RNA, 21 nt, Human
ccugcugcaguugccagucac

SEQ ID NO: 2717036 - RNA, 20 nt, Human
ccugcugcaguugccaguca

SEQ ID NO: 2717037 - RNA, 19 nt, Human
ccugccucgaacuggcugc

SEQ ID NO: 2717038 - RNA, 21 nt, Human
ccugccucgaacuggcugcaa

SEQ ID NO: 2717039 - RNA, 23 nt, Human
ccugccucgaacuggcugcaaag

SEQ ID NO: 2717040 - RNA, 17 nt, Human
ccugcugcaguugccag

SEQ ID NO: 2717041 - RNA, 19 nt, Human
ccugcugcaguugccaguc

SEQ ID NO: 2717042 - RNA, 18 nt, Human
ccugcacuugcagacucu

SEQ ID NO: 2717043 - RNA, 14 nt, Human
ccugcagagggcac

SEQ ID NO: 2717044 - RNA, 16 nt, Human
ccugcacuugcagacu

SEQ ID NO: 2717045 - RNA, 17 nt, Human
ccugcacuugcagacuc

SEQ ID NO: 2717046 - RNA, 13 nt, Human
ccucuuucccucc

SEQ ID NO: 2717047 - RNA, 23 nt, Human
ccucauggaauuggagcucgugg

SEQ ID NO: 2717048 - RNA, 15 nt, Human
ccucccaccucagcc

SEQ ID NO: 2717049 - RNA, 17 nt, Human
ccucccaccucagccuc

SEQ ID NO: 2717050 - RNA, 16 nt, Human
ccucccaucucacaca

SEQ ID NO: 2717051 - RNA, 13 nt, Human
ccucccaucucac

SEQ ID NO: 2717052 - RNA, 14 nt, Human
ccggccccugcugg

SEQ ID NO: 2717053 - RNA, 17 nt, Human
cccugugauggggcccu

SEQ ID NO: 2717054 - RNA, 13 nt, Human
cccuucgcuccug

SEQ ID NO: 2717055 - RNA, 20 nt, Human
cccugugauggggcccugcc

SEQ ID NO: 2717056 - RNA, 18 nt, Human
cccugugauggggcccug

SEQ ID NO: 2717057 - RNA, 19 nt, Human
cccugugauggggcccugc

SEQ ID NO: 2717058 - RNA, 20 nt, Human
cccugucucaaaaaaagaaa

SEQ ID NO: 2717059 - RNA, 23 nt, Human
cccugucucaaaaaaagaaaaag

SEQ ID NO: 2717060 - RNA, 16 nt, Human
cccugucuaaugaaac

SEQ ID NO: 2717061 - RNA, 13 nt, Human
cccugucuaauga

SEQ ID NO: 2717062 - RNA, 13 nt, Human
ccggccccugcug

SEQ ID NO: 2717063 - RNA, 21 nt, Human
cccuucucuccagccccugga

SEQ ID NO: 2717064 - RNA, 14 nt, Human
cccuucgcuccugu

SEQ ID NO: 2717065 - RNA, 15 nt, Human
cccuucgcuccugug

SEQ ID NO: 2717066 - RNA, 22 nt, Human
cccuucucuccagccccuggau

SEQ ID NO: 2717067 - RNA, 22 nt, Human
ccauuuaaagcuuauuaaaacu

SEQ ID NO: 2717068 - RNA, 14 nt, Human
ccaugggccuccug

SEQ ID NO: 2717069 - RNA, 15 nt, Human
ccaugggccuccugu

SEQ ID NO: 2717070 - RNA, 13 nt, Human
ccauacauuugug

SEQ ID NO: 2717071 - RNA, 14 nt, Human
ccauacauuugugu

SEQ ID NO: 2717072 - RNA, 23 nt, Human
ccaucccaaacccuucagugcca

SEQ ID NO: 2717073 - RNA, 12 nt, Human
ccaucccagccc

SEQ ID NO: 2717074 - RNA, 19 nt, Human
ccaguuuuguuuggaccaa

SEQ ID NO: 2717075 - RNA, 16 nt, Human
ccaguuuuguuuggac

SEQ ID NO: 2717076 - RNA, 16 nt, Human
ccauccccuguagagu

SEQ ID NO: 2717077 - RNA, 13 nt, Human
ccaugagccucag

SEQ ID NO: 2717078 - RNA, 14 nt, Human
ccaugagccucagc

SEQ ID NO: 2717079 - RNA, 18 nt, Human
ccaugagccucagcaucc

SEQ ID NO: 2717080 - RNA, 19 nt, Human
ccaugagccucagcauccu

SEQ ID NO: 2717081 - RNA, 13 nt, Human
ccaugaguccccu

SEQ ID NO: 2717082 - RNA, 13 nt, Human
ccaugggccuccu

SEQ ID NO: 2717083 - RNA, 16 nt, Human
ccaugaguccccuguu

SEQ ID NO: 2717084 - RNA, 14 nt, Human
ccaugaguccccug

SEQ ID NO: 2717085 - RNA, 15 nt, Human
ccaugaguccccugu

SEQ ID NO: 2717086 - RNA, 22 nt, Human
ccaguauuguacaaaguauuaa

SEQ ID NO: 2717087 - RNA, 20 nt, Human
ccaguauuguacaaaguauu

SEQ ID NO: 2717088 - RNA, 12 nt, Human
ccagucaccccg

SEQ ID NO: 2717089 - RNA, 13 nt, Human
ccagucaccccgg

SEQ ID NO: 2717090 - RNA, 20 nt, Human
ccagucaccccggccaccug

SEQ ID NO: 2717091 - RNA, 21 nt, Human
ccagucaccccggccaccugc

SEQ ID NO: 2717092 - RNA, 19 nt, Human
ccagucaccccggccaccu

SEQ ID NO: 2717093 - RNA, 22 nt, Human
ccaggcugggagagccuuccag

SEQ ID NO: 2717094 - RNA, 15 nt, Human
ccaggcugggagagc

SEQ ID NO: 2717095 - RNA, 17 nt, Human
ccaggcugggagagccu

SEQ ID NO: 2717096 - RNA, 18 nt, Human
ccaggcugggagagccuu

SEQ ID NO: 2717097 - RNA, 21 nt, Human
ccaggcugggagagccuucca

SEQ ID NO: 2717098 - RNA, 13 nt, Human
ccaggcugggaga

SEQ ID NO: 2717099 - RNA, 14 nt, Human
ccaggcugggagag

SEQ ID NO: 2717100 - RNA, 23 nt, Human
ccagcagagcaccuuagacaguc

SEQ ID NO: 2717101 - RNA, 19 nt, Human
ccagcagagcaccuuagac

SEQ ID NO: 2717102 - RNA, 16 nt, Human
ccagcuuaucucaggg

SEQ ID NO: 2717103 - RNA, 21 nt, Human
ccaggaaaggcuccaggagca

SEQ ID NO: 2717104 - RNA, 22 nt, Human
ccaggaaaggcuccaggagcag

SEQ ID NO: 2717105 - RNA, 23 nt, Human
ccaggaaaggcuccaggagcagc

SEQ ID NO: 2717106 - RNA, 19 nt, Human
ccagcagccuggacccugu

SEQ ID NO: 2717107 - RNA, 20 nt, Human
ccagcagccuggacccugug

SEQ ID NO: 2717108 - RNA, 15 nt, Human
ccagcagccuggacc

SEQ ID NO: 2717109 - RNA, 14 nt, Human
ccagcagccuggac

SEQ ID NO: 2717110 - RNA, 10 nt, Human
ccagccccuu

SEQ ID NO: 2717111 - RNA, 15 nt, Human
ccagcagauuauuca

SEQ ID NO: 2717112 - RNA, 21 nt, Human
ccagccccuggaugcagccuc

SEQ ID NO: 2717113 - RNA, 19 nt, Human
ccccuucgcuccugugucu

SEQ ID NO: 2717114 - RNA, 14 nt, Human
ccccuucgcuccug

SEQ ID NO: 2717115 - RNA, 15 nt, Human
ccccuucgcuccugu

SEQ ID NO: 2717116 - RNA, 17 nt, Human
ccccuucgcuccugugu

SEQ ID NO: 2717117 - RNA, 15 nt, Human
ccccauucugccugc

SEQ ID NO: 2717118 - RNA, 13 nt, Human
ccccauucugccu

SEQ ID NO: 2717119 - RNA, 14 nt, Human
ccccauucugccug

SEQ ID NO: 2717120 - RNA, 16 nt, Human
ccccuucugacccaug

SEQ ID NO: 2717121 - RNA, 17 nt, Human
ccccuucugacccaugc

SEQ ID NO: 2717122 - RNA, 12 nt, Human
cccgggaagggg

SEQ ID NO: 2717123 - RNA, 12 nt, Human
cccggcugcgga

SEQ ID NO: 2717124 - RNA, 20 nt, Human
cccucaacucuccuccagag

SEQ ID NO: 2717125 - RNA, 14 nt, Human
cccagcccacuucu

SEQ ID NO: 2717126 - RNA, 23 nt, Human
cccaggaaaggcuccaggagcag

SEQ ID NO: 2717127 - RNA, 21 nt, Human
cccaggaaaggcuccaggagc

SEQ ID NO: 2717128 - RNA, 22 nt, Human
cccaggaaaggcuccaggagca

SEQ ID NO: 2717129 - RNA, 19 nt, Human
cccaggaaaggcuccagga

SEQ ID NO: 2717130 - RNA, 21 nt, Human
cccagcugugcucuggacagg

SEQ ID NO: 2717131 - RNA, 23 nt, Human
cccagcugugcucuggacaggca

SEQ ID NO: 2717132 - RNA, 21 nt, Human
cccaggcuggcgugcaguggu

SEQ ID NO: 2717133 - RNA, 22 nt, Human
cccaggaauggagccugcacgg

SEQ ID NO: 2717134 - RNA, 20 nt, Human
cccaggaauggagccugcac

SEQ ID NO: 2717135 - RNA, 19 nt, Human
cccaggaauggagccugca

SEQ ID NO: 2717136 - RNA, 18 nt, Human
cccaggaauggagccugc

SEQ ID NO: 2717137 - RNA, 20 nt, Human
cccaggcuuagucacugaga

SEQ ID NO: 2717138 - RNA, 15 nt, Human
cccaggcuuagucac

SEQ ID NO: 2717139 - RNA, 21 nt, Human
ccccagauugcaacaggcugg

SEQ ID NO: 2717140 - RNA, 22 nt, Human
ccccagauugcaacaggcuggg

SEQ ID NO: 2717141 - RNA, 23 nt, Human
ccccagauugcaacaggcugggc

SEQ ID NO: 2717142 - RNA, 17 nt, Human
ccccagcaagugagagc

SEQ ID NO: 2717143 - RNA, 19 nt, Human
ccccagcaagugagagcug

SEQ ID NO: 2717144 - RNA, 20 nt, Human
ccccagcaagugagagcugg

SEQ ID NO: 2717145 - RNA, 17 nt, Human
ccccauccucuguacag

SEQ ID NO: 2717146 - RNA, 22 nt, Human
ccccauccucuguacagagccc

SEQ ID NO: 2717147 - RNA, 19 nt, Human
ccccauccucuguacagag

SEQ ID NO: 2717148 - RNA, 21 nt, Human
ccccauccucuguacagagcc

SEQ ID NO: 2717149 - RNA, 20 nt, Human
cccauucugccugcccaggc

SEQ ID NO: 2717150 - RNA, 21 nt, Human
cccauucugccugcccaggcc

SEQ ID NO: 2717151 - RNA, 22 nt, Human
cccauucugccugcccaggccc

SEQ ID NO: 2717152 - RNA, 14 nt, Human
ccaacucaccccag

SEQ ID NO: 2717153 - RNA, 23 nt, Human
ccaaauggaaaugggcagagcag

SEQ ID NO: 2717154 - RNA, 16 nt, Human
ccaacucaccccagcc

SEQ ID NO: 2717155 - RNA, 17 nt, Human
ccaacucaccccagccc

SEQ ID NO: 2717156 - RNA, 18 nt, Human
ccaacucaccccagcccc

SEQ ID NO: 2717157 - RNA, 17 nt, Human
ccaauauuuaccagacc

SEQ ID NO: 2717158 - RNA, 15 nt, Human
ccaaugauggucacc

SEQ ID NO: 2717159 - RNA, 14 nt, Human
ccaaugcacuuugu

SEQ ID NO: 2717160 - RNA, 18 nt, Human
ccaagcucugcuccucuc

SEQ ID NO: 2717161 - RNA, 12 nt, Human
ccaagcucugcu

SEQ ID NO: 2717162 - RNA, 17 nt, Human
ccaagcucugcuccucu

SEQ ID NO: 2717163 - RNA, 13 nt, Human
ccaagcucugcuc

SEQ ID NO: 2717164 - RNA, 14 nt, Human
ccaaugggagcuca

SEQ ID NO: 2717165 - RNA, 17 nt, Human
ccaaugggagcucaugg

SEQ ID NO: 2717166 - RNA, 19 nt, Human
cauuuguauaaaauaauuu

SEQ ID NO: 2717167 - RNA, 20 nt, Human
cauuuguauaaaauaauuuu

SEQ ID NO: 2717168 - RNA, 17 nt, Human
cauuuguauaaaauaau

SEQ ID NO: 2717169 - RNA, 20 nt, Human
cauuuguguugaagagguuu

SEQ ID NO: 2717170 - RNA, 16 nt, Human
cauuuguguugaagag

SEQ ID NO: 2717171 - RNA, 22 nt, Human
cauuuuuuuuaagaaaaaggau

SEQ ID NO: 2717172 - RNA, 20 nt, Human
ccaaaacucuccucugcugc

SEQ ID NO: 2717173 - RNA, 21 nt, Human
ccaaaacucuccucugcugcu

SEQ ID NO: 2717174 - RNA, 12 nt, Human
ccacagcaguug

SEQ ID NO: 2717175 - RNA, 18 nt, Human
ccacagcaguugaaaaga

SEQ ID NO: 2717176 - RNA, 17 nt, Human
ccacagcaguugaaaag

SEQ ID NO: 2717177 - RNA, 23 nt, Human
ccacagcaguugaaaagacucca

SEQ ID NO: 2717178 - RNA, 15 nt, Human
ccaccaucaagccac

SEQ ID NO: 2717179 - RNA, 17 nt, Human
ccaccacacccagccca

SEQ ID NO: 2717180 - RNA, 13 nt, Human
ccaccaucaagcc

SEQ ID NO: 2717181 - RNA, 14 nt, Human
ccaccaucaagcca

SEQ ID NO: 2717182 - RNA, 13 nt, Human
ccacgcccccacu

SEQ ID NO: 2717183 - RNA, 18 nt, Human
ccacgcccccacugguga

SEQ ID NO: 2717184 - RNA, 19 nt, Human
ccacgcccccacuggugac

SEQ ID NO: 2717185 - RNA, 16 nt, Human
ccacgcccccacuggu

SEQ ID NO: 2717186 - RNA, 17 nt, Human
ccacgcccccacuggug

SEQ ID NO: 2717187 - RNA, 21 nt, Human
ccaccuuugaagaaguaagga

SEQ ID NO: 2717188 - RNA, 13 nt, Human
ccaccgcagacag

SEQ ID NO: 2717189 - RNA, 22 nt, Human
ccaccgcagacaggaccaggga

SEQ ID NO: 2717190 - RNA, 19 nt, Human
ccaccgcagacaggaccag

SEQ ID NO: 2717191 - RNA, 17 nt, Human
ccacucccugcaaccug

SEQ ID NO: 2717192 - RNA, 14 nt, Human
caugauguuuagaa

SEQ ID NO: 2717193 - RNA, 13 nt, Human
caugauguuuucc

SEQ ID NO: 2717194 - RNA, 23 nt, Human
caugcuacacacugcauguuugu

SEQ ID NO: 2717195 - RNA, 20 nt, Human
caugcuacacacugcauguu

SEQ ID NO: 2717196 - RNA, 14 nt, Human
caugcuacacacug

SEQ ID NO: 2717197 - RNA, 14 nt, Human
caugggaaugaaug

SEQ ID NO: 2717198 - RNA, 15 nt, Human
caugggaaugaaugu

SEQ ID NO: 2717199 - RNA, 16 nt, Human
caugggaaugaauguc

SEQ ID NO: 2717200 - RNA, 17 nt, Human
caugggaaugaauguca

SEQ ID NO: 2717201 - RNA, 20 nt, Human
caugcuccuggcccacugca

SEQ ID NO: 2717202 - RNA, 14 nt, Human
cauguuggccaggc

SEQ ID NO: 2717203 - RNA, 15 nt, Human
cauguuggccaggcu

SEQ ID NO: 2717204 - RNA, 16 nt, Human
cauguuggccaggcug

SEQ ID NO: 2717205 - RNA, 13 nt, Human
cauucuccaccug

SEQ ID NO: 2717206 - RNA, 14 nt, Human
cauucuccaccugc

SEQ ID NO: 2717207 - RNA, 16 nt, Human
cauucuccaccugcca

SEQ ID NO: 2717208 - RNA, 22 nt, Human
cauccuggcacccggccccugc

SEQ ID NO: 2717209 - RNA, 12 nt, Human
cauccuggaaua

SEQ ID NO: 2717210 - RNA, 21 nt, Human
cauccccuguagagugggagc

SEQ ID NO: 2717211 - RNA, 14 nt, Human
caucacuucccuac

SEQ ID NO: 2717212 - RNA, 12 nt, Human
caucacuucccu

SEQ ID NO: 2717213 - RNA, 15 nt, Human
cauccuggcacccgg

SEQ ID NO: 2717214 - RNA, 23 nt, Human
cauaugcuguauauccuuucuaa

SEQ ID NO: 2717215 - RNA, 22 nt, Human
caguggugguuuucuguucuuu

SEQ ID NO: 2717216 - RNA, 21 nt, Human
caguggugguuuucuguucuu

SEQ ID NO: 2717217 - RNA, 20 nt, Human
caguggugguuuucuguucu

SEQ ID NO: 2717218 - RNA, 19 nt, Human
caguggugguuuucuguuc

SEQ ID NO: 2717219 - RNA, 19 nt, Human
cauauuaauauauuuccau

SEQ ID NO: 2717220 - RNA, 14 nt, Human
cauauuaauauauu

SEQ ID NO: 2717221 - RNA, 15 nt, Human
cauauuaauauauuu

SEQ ID NO: 2717222 - RNA, 17 nt, Human
cauauucuguuggccag

SEQ ID NO: 2717223 - RNA, 18 nt, Human
cauauucuguuggccagu

SEQ ID NO: 2717224 - RNA, 20 nt, Human
cagcuccccucggagaagag

SEQ ID NO: 2717225 - RNA, 22 nt, Human
cagcuccccucggagaagagcu

SEQ ID NO: 2717226 - RNA, 21 nt, Human
cagcuccccucggagaagagc

SEQ ID NO: 2717227 - RNA, 19 nt, Human
cagcuguucagcugguuga

SEQ ID NO: 2717228 - RNA, 24 nt, Human
cagcugugcucuggacaggcaugu

SEQ ID NO: 2717229 - RNA, 19 nt, Human
cagcugugcucuggacagg

SEQ ID NO: 2717230 - RNA, 20 nt, Human
cagcugugcucuggacaggc

SEQ ID NO: 2717231 - RNA, 19 nt, Human
cagcugagggugagugggu

SEQ ID NO: 2717232 - RNA, 12 nt, Human
cagcugccuggg

SEQ ID NO: 2717233 - RNA, 13 nt, Human
cagcugccuggga

SEQ ID NO: 2717234 - RNA, 14 nt, Human
cagcugccugggau

SEQ ID NO: 2717235 - RNA, 18 nt, Human
caggaaaagcugcugaca

SEQ ID NO: 2717236 - RNA, 15 nt, Human
caggaaaagcugcug

SEQ ID NO: 2717237 - RNA, 16 nt, Human
caggaaaagcugcuga

SEQ ID NO: 2717238 - RNA, 18 nt, Human
cagcggggacagcuccuu

SEQ ID NO: 2717239 - RNA, 19 nt, Human
cagcggggacagcuccuuc

SEQ ID NO: 2717240 - RNA, 21 nt, Human
cagcggggacagcuccuucug

SEQ ID NO: 2717241 - RNA, 12 nt, Human
cagccugcucca

SEQ ID NO: 2717242 - RNA, 19 nt, Human
cagccugcuaauuccccag

SEQ ID NO: 2717243 - RNA, 17 nt, Human
cagccucugaaaaccaa

SEQ ID NO: 2717244 - RNA, 19 nt, Human
cagccgagauagccaaggc

SEQ ID NO: 2717245 - RNA, 12 nt, Human
cagauccuggaa

SEQ ID NO: 2717246 - RNA, 22 nt, Human
cagaggggguggccucccaacu

SEQ ID NO: 2717247 - RNA, 23 nt, Human
cagaggggguggccucccaacuc

SEQ ID NO: 2717248 - RNA, 15 nt, Human
cagauucuuuccuga

SEQ ID NO: 2717249 - RNA, 17 nt, Human
cagauucuuuccugagg

SEQ ID NO: 2717250 - RNA, 18 nt, Human
cagauucuuuccugaggc

SEQ ID NO: 2717251 - RNA, 19 nt, Human
cagauucuuuccugaggcu

SEQ ID NO: 2717252 - RNA, 13 nt, Human
cagcaguucagag

SEQ ID NO: 2717253 - RNA, 17 nt, Human
cagauugcaacaggcug

SEQ ID NO: 2717254 - RNA, 20 nt, Human
cagauucuuuccugaggcug

SEQ ID NO: 2717255 - RNA, 22 nt, Human
cagauucuuuccugaggcuggg

SEQ ID NO: 2717256 - RNA, 20 nt, Human
cagcacgauuucuguuuaga

SEQ ID NO: 2717257 - RNA, 19 nt, Human
cagcacgauuucuguuuag

SEQ ID NO: 2717258 - RNA, 18 nt, Human
cagcacgauuucuguuua

SEQ ID NO: 2717259 - RNA, 16 nt, Human
cagcacgauuucuguu

SEQ ID NO: 2717260 - RNA, 20 nt, Human
cagcaucauggagguuugaa

SEQ ID NO: 2717261 - RNA, 20 nt, Human
cagucugacuguuuccauca

SEQ ID NO: 2717262 - RNA, 13 nt, Human
cagugcaugcugu

SEQ ID NO: 2717263 - RNA, 14 nt, Human
cagugcaugcuguc

SEQ ID NO: 2717264 - RNA, 15 nt, Human
cagucuggaaugcag

SEQ ID NO: 2717265 - RNA, 17 nt, Human
cagucuggaaugcagug

SEQ ID NO: 2717266 - RNA, 20 nt, Human
caguggugcgaucuggguuc

SEQ ID NO: 2717267 - RNA, 21 nt, Human
caguggugcgaucuggguuca

SEQ ID NO: 2717268 - RNA, 18 nt, Human
caguggugguuuucuguu

SEQ ID NO: 2717269 - RNA, 14 nt, Human
caguggggaaugaa

SEQ ID NO: 2717270 - RNA, 13 nt, Human
cagugcccacagg

SEQ ID NO: 2717271 - RNA, 15 nt, Human
cagugcccacaggau

SEQ ID NO: 2717272 - RNA, 16 nt, Human
cagugcaugcuguccc

SEQ ID NO: 2717273 - RNA, 17 nt, Human
cagugcaugcugucccu

SEQ ID NO: 2717274 - RNA, 17 nt, Human
cagugcccacaggauca

SEQ ID NO: 2717275 - RNA, 20 nt, Human
cagugggagcugccuguuca

SEQ ID NO: 2717276 - RNA, 23 nt, Human
cagugggagcugccuguucagcu

SEQ ID NO: 2717277 - RNA, 19 nt, Human
cagucaccucauggaauug

SEQ ID NO: 2717278 - RNA, 15 nt, Human
cagucaccucaugga

SEQ ID NO: 2717279 - RNA, 16 nt, Human
cagucaccucauggaa

SEQ ID NO: 2717280 - RNA, 19 nt, Human
caggugccaguuauggcua

SEQ ID NO: 2717281 - RNA, 21 nt, Human
caggugcacaagcuccaagcu

SEQ ID NO: 2717282 - RNA, 22 nt, Human
caggugcacaagcuccaagcuc

SEQ ID NO: 2717283 - RNA, 21 nt, Human
cagguuggugggggccucggu

SEQ ID NO: 2717284 - RNA, 14 nt, Human
cagguuuaagcugu

SEQ ID NO: 2717285 - RNA, 12 nt, Human
cagguuuuccug

SEQ ID NO: 2717286 - RNA, 16 nt, Human
cagguuuuccugaaga

SEQ ID NO: 2717287 - RNA, 15 nt, Human
caggugcacaagcuc

SEQ ID NO: 2717288 - RNA, 22 nt, Human
caggugauccacccaccucagc

SEQ ID NO: 2717289 - RNA, 23 nt, Human
caggugauccacccaccucagcc

SEQ ID NO: 2717290 - RNA, 17 nt, Human
caggugcacaagcucca

SEQ ID NO: 2717291 - RNA, 18 nt, Human
caggugcacaagcuccaa

SEQ ID NO: 2717292 - RNA, 19 nt, Human
caggugcacaagcuccaag

SEQ ID NO: 2717293 - RNA, 20 nt, Human
caggugcacaagcuccaagc

SEQ ID NO: 2717294 - RNA, 21 nt, Human
caggugauccacccaccucag

SEQ ID NO: 2717295 - RNA, 20 nt, Human
caggugauccacccaccuca

SEQ ID NO: 2717296 - RNA, 21 nt, Human
caggcugggcuucaguggcag

SEQ ID NO: 2717297 - RNA, 22 nt, Human
caggcugggcuucaguggcagc

SEQ ID NO: 2717298 - RNA, 20 nt, Human
caggcugggcuucaguggca

SEQ ID NO: 2717299 - RNA, 15 nt, Human
caggcugggagagcc

SEQ ID NO: 2717300 - RNA, 12 nt, Human
caggcugggaga

SEQ ID NO: 2717301 - RNA, 14 nt, Human
caggcugggagagc

SEQ ID NO: 2717302 - RNA, 20 nt, Human
caggggaaaaucagccugcu

SEQ ID NO: 2717303 - RNA, 19 nt, Human
caggggaaaaucagccugc

SEQ ID NO: 2717304 - RNA, 21 nt, Human
cagggcucagcggggacagcu

SEQ ID NO: 2717305 - RNA, 23 nt, Human
cagggcucagcggggacagcucc

SEQ ID NO: 2717306 - RNA, 20 nt, Human
caggccaggcccucugccca

SEQ ID NO: 2717307 - RNA, 19 nt, Human
caggccaggcccucugccc

SEQ ID NO: 2717308 - RNA, 17 nt, Human
caggccaggcccucugc

SEQ ID NO: 2717309 - RNA, 18 nt, Human
caggccaggcccucugcc

SEQ ID NO: 2717310 - RNA, 17 nt, Human
caggccagcugcuuggg

SEQ ID NO: 2717311 - RNA, 19 nt, Human
caggccagcugcuugggcu

SEQ ID NO: 2717312 - RNA, 21 nt, Human
caggccagcugcuugggcuuc

SEQ ID NO: 2717313 - RNA, 23 nt, Human
caggccagcugcuugggcuucau

SEQ ID NO: 2717314 - RNA, 18 nt, Human
caggcagauacaggaaaa

SEQ ID NO: 2717315 - RNA, 13 nt, Human
caggccagaggga

SEQ ID NO: 2717316 - RNA, 15 nt, Human
caggccagagggagu

SEQ ID NO: 2717317 - RNA, 20 nt, Human
auuucuaugaaauauuaugu

SEQ ID NO: 2717318 - RNA, 15 nt, Human
auuucuaugaaauau

SEQ ID NO: 2717319 - RNA, 18 nt, Human
auuucuaugaaauauuau

SEQ ID NO: 2717320 - RNA, 12 nt, Human
auuucuguuuag

SEQ ID NO: 2717321 - RNA, 16 nt, Human
auuucuguuuagauaa

SEQ ID NO: 2717322 - RNA, 14 nt, Human
auuucuguuuagau

SEQ ID NO: 2717323 - RNA, 19 nt, Human
auuuauacaggucauauua

SEQ ID NO: 2717324 - RNA, 14 nt, Human
auuuaaugaaagac

SEQ ID NO: 2717325 - RNA, 22 nt, Human
auuuaaugauaaguaaaugcua

SEQ ID NO: 2717326 - RNA, 19 nt, Human
auuguuuaaaaucauuucu

SEQ ID NO: 2717327 - RNA, 23 nt, Human
auuguacaaaguauuaagcauau

SEQ ID NO: 2717328 - RNA, 20 nt, Human
auuguacaaaguauuaagca

SEQ ID NO: 2717329 - RNA, 22 nt, Human
auuguacaaaguauuaagcaua

SEQ ID NO: 2717330 - RNA, 19 nt, Human
auuguucuuaguuugcagu

SEQ ID NO: 2717331 - RNA, 17 nt, Human
auuguaaaugugcuuuu

SEQ ID NO: 2717332 - RNA, 15 nt, Human
auuguaaaugugcuu

SEQ ID NO: 2717333 - RNA, 14 nt, Human
auuguaaaugugcu

SEQ ID NO: 2717334 - RNA, 15 nt, Human
auuguaaggaaugau

SEQ ID NO: 2717335 - RNA, 16 nt, Human
auuguaaggaaugauu

SEQ ID NO: 2717336 - RNA, 22 nt, Human
auucaagaaaacaacuucaaua

SEQ ID NO: 2717337 - RNA, 20 nt, Human
auuaaauuuugaguucuaca

SEQ ID NO: 2717338 - RNA, 18 nt, Human
auuaaauucuugcaaagu

SEQ ID NO: 2717339 - RNA, 14 nt, Human
auuaaauucuugca

SEQ ID NO: 2717340 - RNA, 20 nt, Human
auuaaauucuugcaaaguau

SEQ ID NO: 2717341 - RNA, 18 nt, Human
auuaaauuuugaguucua

SEQ ID NO: 2717342 - RNA, 19 nt, Human
auucauauuuacuucuuau

SEQ ID NO: 2717343 - RNA, 18 nt, Human
auucauauuuacuucuua

SEQ ID NO: 2717344 - RNA, 20 nt, Human
auucauauuuacuucuuaua

SEQ ID NO: 2717345 - RNA, 18 nt, Human
auugacuuuuuauggcac

SEQ ID NO: 2717346 - RNA, 17 nt, Human
auucuugccaaauauaa

SEQ ID NO: 2717347 - RNA, 16 nt, Human
auucucuccuguaccu

SEQ ID NO: 2717348 - RNA, 13 nt, Human
auuccugaacagg

SEQ ID NO: 2717349 - RNA, 21 nt, Human
auuccugaugcuucuucagag

SEQ ID NO: 2717350 - RNA, 21 nt, Human
auucucuccuguaccucuuga

SEQ ID NO: 2717351 - RNA, 19 nt, Human
auucucuccuguaccucuu

SEQ ID NO: 2717352 - RNA, 17 nt, Human
auucuuuccugaggcug

SEQ ID NO: 2717353 - RNA, 22 nt, Human
auucuuuccugaggcugggcuc

SEQ ID NO: 2717354 - RNA, 15 nt, Human
caaauccuugaagau

SEQ ID NO: 2717355 - RNA, 17 nt, Human
caaaucagcugcuacua

SEQ ID NO: 2717356 - RNA, 21 nt, Human
caaaguauuaagcauauauuu

SEQ ID NO: 2717357 - RNA, 19 nt, Human
caaaguauuaagcauauau

SEQ ID NO: 2717358 - RNA, 17 nt, Human
caaaguauuaagcauau

SEQ ID NO: 2717359 - RNA, 16 nt, Human
caaaguauuaagcaua

SEQ ID NO: 2717360 - RNA, 13 nt, Human
caaagaugcagcc

SEQ ID NO: 2717361 - RNA, 14 nt, Human
caaagaugcagccg

SEQ ID NO: 2717362 - RNA, 20 nt, Human
caaaguacacuguuucaaac

SEQ ID NO: 2717363 - RNA, 16 nt, Human
caaaguacacuguuuc

SEQ ID NO: 2717364 - RNA, 21 nt, Human
caaaguacacuguuucaaacu

SEQ ID NO: 2717365 - RNA, 15 nt, Human
caaaguauuaagcau

SEQ ID NO: 2717366 - RNA, 14 nt, Human
caaaguauuaagca

SEQ ID NO: 2717367 - RNA, 21 nt, Human
caaaucugcuuuuuaaagaau

SEQ ID NO: 2717368 - RNA, 23 nt, Human
caacaaaccuguuucugcagcca

SEQ ID NO: 2717369 - RNA, 15 nt, Human
caacacgagcaggcu

SEQ ID NO: 2717370 - RNA, 20 nt, Human
caacaccuuguuucccucuc

SEQ ID NO: 2717371 - RNA, 22 nt, Human
caacaccucugcacaagcugca

SEQ ID NO: 2717372 - RNA, 21 nt, Human
caacuaucucauuuccaagca

SEQ ID NO: 2717373 - RNA, 20 nt, Human
caacuauuuuuccaaaauaa

SEQ ID NO: 2717374 - RNA, 15 nt, Human
caacccccagccugc

SEQ ID NO: 2717375 - RNA, 16 nt, Human
caacccccagccugcu

SEQ ID NO: 2717376 - RNA, 17 nt, Human
caacccccagccugcua

SEQ ID NO: 2717377 - RNA, 22 nt, Human
caagacccuuguggucccaccc

SEQ ID NO: 2717378 - RNA, 18 nt, Human
caagacccuugugguccc

SEQ ID NO: 2717379 - RNA, 19 nt, Human
caagacccuugugguccca

SEQ ID NO: 2717380 - RNA, 23 nt, Human
caagaauuucuaggacugaauua

SEQ ID NO: 2717381 - RNA, 16 nt, Human
caacucaccccagccc

SEQ ID NO: 2717382 - RNA, 13 nt, Human
caacucaccccag

SEQ ID NO: 2717383 - RNA, 15 nt, Human
caacucaccccagcc

SEQ ID NO: 2717384 - RNA, 20 nt, Human
caagaauuucuaggacugaa

SEQ ID NO: 2717385 - RNA, 18 nt, Human
caaccacugcgaccacaa

SEQ ID NO: 2717386 - RNA, 18 nt, Human
auuuugauccaagcuggu

SEQ ID NO: 2717387 - RNA, 16 nt, Human
auuuguuugaacugau

SEQ ID NO: 2717388 - RNA, 14 nt, Human
auuuguuugaacug

SEQ ID NO: 2717389 - RNA, 13 nt, Human
auuuguuugaacu

SEQ ID NO: 2717390 - RNA, 15 nt, Human
caaaagcugggcagg

SEQ ID NO: 2717391 - RNA, 13 nt, Human
auuuuuaagugcu

SEQ ID NO: 2717392 - RNA, 12 nt, Human
auuuuuuuuucc

SEQ ID NO: 2717393 - RNA, 13 nt, Human
auuuuuuuuuccu

SEQ ID NO: 2717394 - RNA, 16 nt, Human
auuuuuuuuuccuuca

SEQ ID NO: 2717395 - RNA, 18 nt, Human
caaaaaaauauauuuaau

SEQ ID NO: 2717396 - RNA, 17 nt, Human
auuuuuuuuuccuucag

SEQ ID NO: 2717397 - RNA, 19 nt, Human
cacuguuucaaacuuuacu

SEQ ID NO: 2717398 - RNA, 17 nt, Human
cacuguugcccaggcug

SEQ ID NO: 2717399 - RNA, 17 nt, Human
cacuggugacaugucuu

SEQ ID NO: 2717400 - RNA, 14 nt, Human
cacuguugcccagg

SEQ ID NO: 2717401 - RNA, 15 nt, Human
cacuguugcccaggc

SEQ ID NO: 2717402 - RNA, 16 nt, Human
cacuguugcccaggcu

SEQ ID NO: 2717403 - RNA, 23 nt, Human
cacugggcuuggggaccagagcu

SEQ ID NO: 2717404 - RNA, 22 nt, Human
cacugggcuuggggaccagagc

SEQ ID NO: 2717405 - RNA, 20 nt, Human
cacugggcuuggggaccaga

SEQ ID NO: 2717406 - RNA, 22 nt, Human
cagaaguuucugccgcagcccu

SEQ ID NO: 2717407 - RNA, 20 nt, Human
cagaaguuucugccgcagcc

SEQ ID NO: 2717408 - RNA, 21 nt, Human
cagaaguuucugccgcagccc

SEQ ID NO: 2717409 - RNA, 12 nt, Human
cagaauauguuu

SEQ ID NO: 2717410 - RNA, 13 nt, Human
cagaauauugcuu

SEQ ID NO: 2717411 - RNA, 18 nt, Human
cagaauauguuucaaacu

SEQ ID NO: 2717412 - RNA, 20 nt, Human
cagaauauguuucaaacuuu

SEQ ID NO: 2717413 - RNA, 13 nt, Human
cagaauauguuuc

SEQ ID NO: 2717414 - RNA, 14 nt, Human
cagaauauguuuca

SEQ ID NO: 2717415 - RNA, 15 nt, Human
cagaauauguuucaa

SEQ ID NO: 2717416 - RNA, 17 nt, Human
cagaauauguuucaaac

SEQ ID NO: 2717417 - RNA, 17 nt, Human
cagaaauguguuaucac

SEQ ID NO: 2717418 - RNA, 23 nt, Human
caccucaaaauaccaugccauuu

SEQ ID NO: 2717419 - RNA, 13 nt, Human
caccugccaggga

SEQ ID NO: 2717420 - RNA, 14 nt, Human
caccugccagggac

SEQ ID NO: 2717421 - RNA, 16 nt, Human
caccugccagggacag

SEQ ID NO: 2717422 - RNA, 19 nt, Human
caccuugacagggcacacc

SEQ ID NO: 2717423 - RNA, 17 nt, Human
caccugccagggacaga

SEQ ID NO: 2717424 - RNA, 13 nt, Human
caccuuggcucaa

SEQ ID NO: 2717425 - RNA, 14 nt, Human
caccuuugaagaag

SEQ ID NO: 2717426 - RNA, 17 nt, Human
caccuuuguccccaccg

SEQ ID NO: 2717427 - RNA, 14 nt, Human
caccuuugucccca

SEQ ID NO: 2717428 - RNA, 15 nt, Human
caccuuuguccccac

SEQ ID NO: 2717429 - RNA, 20 nt, Human
cacggagggugacgggggug

SEQ ID NO: 2717430 - RNA, 14 nt, Human
cacggccaggccag

SEQ ID NO: 2717431 - RNA, 15 nt, Human
cacggccaggccaga

SEQ ID NO: 2717432 - RNA, 16 nt, Human
cacggccaggccagag

SEQ ID NO: 2717433 - RNA, 23 nt, Human
cacuacggaauaguuggcuagga

SEQ ID NO: 2717434 - RNA, 17 nt, Human
cacucuuauugcccacg

SEQ ID NO: 2717435 - RNA, 18 nt, Human
cacucuuauugcccacgc

SEQ ID NO: 2717436 - RNA, 19 nt, Human
cacucuuauugcccacgcu

SEQ ID NO: 2717437 - RNA, 14 nt, Human
caaguauuagaaua

SEQ ID NO: 2717438 - RNA, 20 nt, Human
caaguauuagaauaccacag

SEQ ID NO: 2717439 - RNA, 13 nt, Human
caauaaaaaauua

SEQ ID NO: 2717440 - RNA, 17 nt, Human
caauaaaaaauuaugac

SEQ ID NO: 2717441 - RNA, 16 nt, Human
caauaaaaaauuauga

SEQ ID NO: 2717442 - RNA, 12 nt, Human
caauauuucaga

SEQ ID NO: 2717443 - RNA, 20 nt, Human
caauauuucagauaaucaca

SEQ ID NO: 2717444 - RNA, 21 nt, Human
caauauuucagauaaucacaa

SEQ ID NO: 2717445 - RNA, 14 nt, Human
caaugcuguauuuu

SEQ ID NO: 2717446 - RNA, 23 nt, Human
caaugcuguauuuuaaaagaaug

SEQ ID NO: 2717447 - RNA, 22 nt, Human
caaugcuggcuguuggcugggg

SEQ ID NO: 2717448 - RNA, 23 nt, Human
caaugcuggcuguuggcuggggg

SEQ ID NO: 2717449 - RNA, 22 nt, Human
caaugcugugcccuaaagugua

SEQ ID NO: 2717450 - RNA, 14 nt, Human
cacaagacccuugu

SEQ ID NO: 2717451 - RNA, 16 nt, Human
cacaagacccuugugg

SEQ ID NO: 2717452 - RNA, 16 nt, Human
cacaagacugcacauc

SEQ ID NO: 2717453 - RNA, 14 nt, Human
cacaagccuucggc

SEQ ID NO: 2717454 - RNA, 15 nt, Human
caccagcagccugga

SEQ ID NO: 2717455 - RNA, 21 nt, Human
caccagcccuuagcagggaaa

SEQ ID NO: 2717456 - RNA, 23 nt, Human
caccaacauacucccaucuguga

SEQ ID NO: 2717457 - RNA, 14 nt, Human
caccagcagccugg

SEQ ID NO: 2717458 - RNA, 12 nt, Human
caccagcagccu

SEQ ID NO: 2717459 - RNA, 16 nt, Human
cacccagcccacuucu

SEQ ID NO: 2717460 - RNA, 17 nt, Human
cacccagcccacuucug

SEQ ID NO: 2717461 - RNA, 24 nt, Human
cacccaggagccccgaggccuucu

SEQ ID NO: 2717462 - RNA, 19 nt, Human
cacccagcccacuucugcc

SEQ ID NO: 2717463 - RNA, 20 nt, Human
cacccaggagccccgaggcc

SEQ ID NO: 2717464 - RNA, 23 nt, Human
cacccaggagccccgaggccuuc

SEQ ID NO: 2717465 - RNA, 15 nt, Human
cacauuuuauuuuau

SEQ ID NO: 2717466 - RNA, 18 nt, Human
cacaucuugcucugcuga

SEQ ID NO: 2717467 - RNA, 17 nt, Human
caccaacauacucccau

SEQ ID NO: 2717468 - RNA, 20 nt, Human
caccaacauacucccaucug

SEQ ID NO: 2717469 - RNA, 21 nt, Human
caccaacauacucccaucugu

SEQ ID NO: 2717470 - RNA, 21 nt, Human
cacauuuuuuaaaugcaccug

SEQ ID NO: 2717471 - RNA, 17 nt, Human
cacauuuuuuaaaugca

SEQ ID NO: 2717472 - RNA, 14 nt, Human
cacauuuuucuuag

SEQ ID NO: 2717473 - RNA, 13 nt, Human
cacauuuuucuua

SEQ ID NO: 2717474 - RNA, 22 nt, Human
cacaucagcacgauuucuguuu

SEQ ID NO: 2717475 - RNA, 16 nt, Human
cacaucuugcucugcu

SEQ ID NO: 2717476 - RNA, 17 nt, Human
cacaucuugcucugcug

SEQ ID NO: 2717477 - RNA, 21 nt, Human
cacaucagcacgauuucuguu

SEQ ID NO: 2717478 - RNA, 20 nt, Human
cacaucagcacgauuucugu

SEQ ID NO: 2717479 - RNA, 15 nt, Human
cacagcuaacaugga

SEQ ID NO: 2717480 - RNA, 16 nt, Human
cacagcuaacauggaa

SEQ ID NO: 2717481 - RNA, 19 nt, Human
cacagacccugcccugugg

SEQ ID NO: 2717482 - RNA, 20 nt, Human
cacagacccugcccuguggg

SEQ ID NO: 2717483 - RNA, 21 nt, Human
cacagacccugcccugugggc

SEQ ID NO: 2717484 - RNA, 22 nt, Human
cacagcuaacauggaaguacua

SEQ ID NO: 2717485 - RNA, 20 nt, Human
cacagcucuguccugggagu

SEQ ID NO: 2717486 - RNA, 23 nt, Human
cacagcucuguccugggagugag

SEQ ID NO: 2717487 - RNA, 10 nt, Human
cacagcucuu

SEQ ID NO: 2717488 - RNA, 19 nt, Human
cacagcucuguccugggag

SEQ ID NO: 2717489 - RNA, 16 nt, Human
cacaguauuacuucug

SEQ ID NO: 2717490 - RNA, 18 nt, Human
cacaguauuacuucugcu

SEQ ID NO: 2717491 - RNA, 19 nt, Human
cacaguauuacuucugcua

SEQ ID NO: 2717492 - RNA, 14 nt, Human
gaaaauuuuaaaaa

SEQ ID NO: 2717493 - RNA, 18 nt, Human
gaaaauuuugauguuuua

SEQ ID NO: 2717494 - RNA, 18 nt, Human
gaaaagacuccaaagaaa

SEQ ID NO: 2717495 - RNA, 20 nt, Human
gaaaagacuccaaagaaaug

SEQ ID NO: 2717496 - RNA, 21 nt, Human
gaaaagacuccaaagaaaugu

SEQ ID NO: 2717497 - RNA, 18 nt, Human
cuuuugccguuauuaaaa

SEQ ID NO: 2717498 - RNA, 16 nt, Human
cuuuugccguuauuaa

SEQ ID NO: 2717499 - RNA, 15 nt, Human
cuuuuggucugugug

SEQ ID NO: 2717500 - RNA, 16 nt, Human
cuuuuggucuguguga

SEQ ID NO: 2717501 - RNA, 17 nt, Human
cuuuugucuaugggacu

SEQ ID NO: 2717502 - RNA, 19 nt, Human
cuuuuguagaagucacauu

SEQ ID NO: 2717503 - RNA, 19 nt, Human
gaaaaaauauuuuccugcc

SEQ ID NO: 2717504 - RNA, 21 nt, Human
cuuuuuuuuuuuuuuugacaa

SEQ ID NO: 2717505 - RNA, 18 nt, Human
cuuuugugcauuaucuag

SEQ ID NO: 2717506 - RNA, 14 nt, Human
cuuuugugcauuau

SEQ ID NO: 2717507 - RNA, 21 nt, Human
gaacaaggcaaggcugucaau

SEQ ID NO: 2717508 - RNA, 14 nt, Human
gaacaaggcaaggc

SEQ ID NO: 2717509 - RNA, 15 nt, Human
gaacaaggcaaggcu

SEQ ID NO: 2717510 - RNA, 17 nt, Human
gaacaaggcaaggcugu

SEQ ID NO: 2717511 - RNA, 18 nt, Human
gaacaaggcaaggcuguc

SEQ ID NO: 2717512 - RNA, 23 nt, Human
gaaacuucagcgguuuauauaag

SEQ ID NO: 2717513 - RNA, 20 nt, Human
gaaacuuguguaaauacaau

SEQ ID NO: 2717514 - RNA, 16 nt, Human
gaaacuuguguaaaua

SEQ ID NO: 2717515 - RNA, 14 nt, Human
gaaacuuguguaaa

SEQ ID NO: 2717516 - RNA, 16 nt, Human
gaaaucaaauaugcaa

SEQ ID NO: 2717517 - RNA, 19 nt, Human
gaaaucaaagagagaaaau

SEQ ID NO: 2717518 - RNA, 21 nt, Human
gaaaucaaauaugcaaagcac

SEQ ID NO: 2717519 - RNA, 21 nt, Human
gaaaguacuucuccacccugc

SEQ ID NO: 2717520 - RNA, 16 nt, Human
gaaaggcuccaggagc

SEQ ID NO: 2717521 - RNA, 18 nt, Human
gaaagacuaucuaaaugu

SEQ ID NO: 2717522 - RNA, 19 nt, Human
gaaaggcuccaggagcagc

SEQ ID NO: 2717523 - RNA, 17 nt, Human
gaaaggcuccaggagca

SEQ ID NO: 2717524 - RNA, 18 nt, Human
gaaaggcuccaggagcag

SEQ ID NO: 2717525 - RNA, 17 nt, Human
gaaaucaccgaaaacgu

SEQ ID NO: 2717526 - RNA, 23 nt, Human
gaaaucaaauaugcaaagcacug

SEQ ID NO: 2717527 - RNA, 18 nt, Human
gaaauuuuuauuaaauua

SEQ ID NO: 2717528 - RNA, 19 nt, Human
gaaauuuuuauuaaauuau

SEQ ID NO: 2717529 - RNA, 16 nt, Human
gaacaagaugguucua

SEQ ID NO: 2717530 - RNA, 18 nt, Human
cuucugacccaugcugcc

SEQ ID NO: 2717531 - RNA, 16 nt, Human
cuucugacccaugcug

SEQ ID NO: 2717532 - RNA, 17 nt, Human
cuucugacccaugcugc

SEQ ID NO: 2717533 - RNA, 16 nt, Human
cuucuuauacauuuga

SEQ ID NO: 2717534 - RNA, 13 nt, Human
cuucuuauacauu

SEQ ID NO: 2717535 - RNA, 19 nt, Human
cuucugaacuuggcgcugc

SEQ ID NO: 2717536 - RNA, 15 nt, Human
cuucugacccaugcu

SEQ ID NO: 2717537 - RNA, 22 nt, Human
cuucugaacuuggcgcugcccc

SEQ ID NO: 2717538 - RNA, 14 nt, Human
cuuccucccucccu

SEQ ID NO: 2717539 - RNA, 13 nt, Human
cuuccucccuccc

SEQ ID NO: 2717540 - RNA, 12 nt, Human
cuuccucccucc

SEQ ID NO: 2717541 - RNA, 23 nt, Human
cuuggcgcugccccuggcagccc

SEQ ID NO: 2717542 - RNA, 21 nt, Human
cuuggcgcugccccuggcagc

SEQ ID NO: 2717543 - RNA, 22 nt, Human
cuuggcgcugccccuggcagcc

SEQ ID NO: 2717544 - RNA, 15 nt, Human
cuuggauuguccccg

SEQ ID NO: 2717545 - RNA, 18 nt, Human
cuuggauuguccccgacc

SEQ ID NO: 2717546 - RNA, 20 nt, Human
cuuggauuguccccgacccu

SEQ ID NO: 2717547 - RNA, 15 nt, Human
cuugauguguuaucu

SEQ ID NO: 2717548 - RNA, 19 nt, Human
cuugauucauaaugacuua

SEQ ID NO: 2717549 - RNA, 19 nt, Human
cuugccgucuaccugaggg

SEQ ID NO: 2717550 - RNA, 18 nt, Human
cuugccgucuaccugagg

SEQ ID NO: 2717551 - RNA, 17 nt, Human
cuuucaauaggaaaaac

SEQ ID NO: 2717552 - RNA, 21 nt, Human
cuugucuuuggacccugaggc

SEQ ID NO: 2717553 - RNA, 22 nt, Human
cuugucuuuggacccugaggcc

SEQ ID NO: 2717554 - RNA, 22 nt, Human
cuuuaaugucacaggcaggucc

SEQ ID NO: 2717555 - RNA, 14 nt, Human
cuuucaauaggaaa

SEQ ID NO: 2717556 - RNA, 15 nt, Human
cuuucaauaggaaaa

SEQ ID NO: 2717557 - RNA, 17 nt, Human
cuuuaaugucacaggca

SEQ ID NO: 2717558 - RNA, 18 nt, Human
cuuuaaugucacaggcag

SEQ ID NO: 2717559 - RNA, 19 nt, Human
cuuuaaugucacaggcagg

SEQ ID NO: 2717560 - RNA, 20 nt, Human
cuuuaaugucacaggcaggu

SEQ ID NO: 2717561 - RNA, 15 nt, Human
cuugguccugcugca

SEQ ID NO: 2717562 - RNA, 16 nt, Human
cuugguccugcugcag

SEQ ID NO: 2717563 - RNA, 17 nt, Human
cuugguccugcugcagu

SEQ ID NO: 2717564 - RNA, 18 nt, Human
cuugguccugcugcaguu

SEQ ID NO: 2717565 - RNA, 20 nt, Human
cuugguccugcugcaguugc

SEQ ID NO: 2717566 - RNA, 22 nt, Human
cuugguccugcugcaguugcca

SEQ ID NO: 2717567 - RNA, 20 nt, Human
cuugguucccauuugcuccu

SEQ ID NO: 2717568 - RNA, 16 nt, Human
cuugguucccauuugc

SEQ ID NO: 2717569 - RNA, 13 nt, Human
cuugucuguagau

SEQ ID NO: 2717570 - RNA, 20 nt, Human
cuugucuuuggacccugagg

SEQ ID NO: 2717571 - RNA, 21 nt, Human
cuugucucagauuuuauuaug

SEQ ID NO: 2717572 - RNA, 22 nt, Human
cugcccuuaccugccaggaagc

SEQ ID NO: 2717573 - RNA, 23 nt, Human
cugcccuuaccugccaggaagcc

SEQ ID NO: 2717574 - RNA, 11 nt, Human
cugcccugugg

SEQ ID NO: 2717575 - RNA, 12 nt, Human
cugcccuguggg

SEQ ID NO: 2717576 - RNA, 19 nt, Human
cugcccuuaccugccagga

SEQ ID NO: 2717577 - RNA, 24 nt, Human
cugcccugugaguacuacaguccu

SEQ ID NO: 2717578 - RNA, 17 nt, Human
cugcuaucaaagagguu

SEQ ID NO: 2717579 - RNA, 24 nt, Human
cugcugaaggcucgagcaugccug

SEQ ID NO: 2717580 - RNA, 23 nt, Human
cugcugaaggcucgagcaugccu

SEQ ID NO: 2717581 - RNA, 18 nt, Human
cugcugaaggcucgagca

SEQ ID NO: 2717582 - RNA, 20 nt, Human
cugccuguucagcuccagcu

SEQ ID NO: 2717583 - RNA, 23 nt, Human
cugccuguucagcuccagcucac

SEQ ID NO: 2717584 - RNA, 17 nt, Human
cugccuccccuccucug

SEQ ID NO: 2717585 - RNA, 18 nt, Human
cugccuccccuccucugc

SEQ ID NO: 2717586 - RNA, 14 nt, Human
cugccuccccuccu

SEQ ID NO: 2717587 - RNA, 21 nt, Human
cugccuccccuccucugcuug

SEQ ID NO: 2717588 - RNA, 19 nt, Human
cugccuccccuccucugcu

SEQ ID NO: 2717589 - RNA, 20 nt, Human
cugccuccccuccucugcuu

SEQ ID NO: 2717590 - RNA, 14 nt, Human
cugccuccuuugug

SEQ ID NO: 2717591 - RNA, 14 nt, Human
cugccucgaacugg

SEQ ID NO: 2717592 - RNA, 23 nt, Human
cugccuccuuugugaggaagccg

SEQ ID NO: 2717593 - RNA, 17 nt, Human
cugccuccuuugugagg

SEQ ID NO: 2717594 - RNA, 21 nt, Human
cugccuccuuugugaggaagc

SEQ ID NO: 2717595 - RNA, 19 nt, Human
cugccucgaacuggcugca

SEQ ID NO: 2717596 - RNA, 20 nt, Human
cugccucgaacuggcugcaa

SEQ ID NO: 2717597 - RNA, 20 nt, Human
cuggcagaguugaagacaga

SEQ ID NO: 2717598 - RNA, 21 nt, Human
cuggcagaguugaagacagag

SEQ ID NO: 2717599 - RNA, 23 nt, Human
cuggcagccccuguucuggcaga

SEQ ID NO: 2717600 - RNA, 22 nt, Human
cuggcagaguugaagacagagc

SEQ ID NO: 2717601 - RNA, 13 nt, Human
cuggcucuuccag

SEQ ID NO: 2717602 - RNA, 14 nt, Human
cuggcucuuccagg

SEQ ID NO: 2717603 - RNA, 15 nt, Human
cuggcucuuccaggc

SEQ ID NO: 2717604 - RNA, 17 nt, Human
cugggacuacaggcacc

SEQ ID NO: 2717605 - RNA, 21 nt, Human
cugggacuacaggcacccacc

SEQ ID NO: 2717606 - RNA, 17 nt, Human
cugggacuacaggugug

SEQ ID NO: 2717607 - RNA, 16 nt, Human
cuggcagcucagagag

SEQ ID NO: 2717608 - RNA, 17 nt, Human
cuggcagcucagagagg

SEQ ID NO: 2717609 - RNA, 19 nt, Human
cuggcagcucagagagggu

SEQ ID NO: 2717610 - RNA, 18 nt, Human
cuggaugcagccucacag

SEQ ID NO: 2717611 - RNA, 15 nt, Human
cuggaugcagccuca

SEQ ID NO: 2717612 - RNA, 16 nt, Human
cuggaugcagccucac

SEQ ID NO: 2717613 - RNA, 17 nt, Human
cuggaugcagccucaca

SEQ ID NO: 2717614 - RNA, 20 nt, Human
cugcuucaaggauccugagc

SEQ ID NO: 2717615 - RNA, 19 nt, Human
cugcuucaaggauccugag

SEQ ID NO: 2717616 - RNA, 14 nt, Human
cugcuucaaggauc

SEQ ID NO: 2717617 - RNA, 16 nt, Human
cugcuucaaggauccu

SEQ ID NO: 2717618 - RNA, 23 nt, Human
cuggaaaaguauguuagugcaaa

SEQ ID NO: 2717619 - RNA, 23 nt, Human
cugcuucagccucccgaguagcu

SEQ ID NO: 2717620 - RNA, 14 nt, Human
cugcuuccagugag

SEQ ID NO: 2717621 - RNA, 21 nt, Human
cuggagaaaauggacguguua

SEQ ID NO: 2717622 - RNA, 18 nt, Human
cuguugcccaggcuggcg

SEQ ID NO: 2717623 - RNA, 12 nt, Human
cuguuggccagu

SEQ ID NO: 2717624 - RNA, 15 nt, Human
cuguuggccagugug

SEQ ID NO: 2717625 - RNA, 19 nt, Human
cuuaaauaaugugaaacug

SEQ ID NO: 2717626 - RNA, 16 nt, Human
cuuaaauaaugugaaa

SEQ ID NO: 2717627 - RNA, 14 nt, Human
cuuaaauaauguga

SEQ ID NO: 2717628 - RNA, 13 nt, Human
cuuaaauaaugug

SEQ ID NO: 2717629 - RNA, 19 nt, Human
cuguucacagccagacugg

SEQ ID NO: 2717630 - RNA, 12 nt, Human
cuguucacagcc

SEQ ID NO: 2717631 - RNA, 22 nt, Human
cuguucacagccagacuggcac

SEQ ID NO: 2717632 - RNA, 15 nt, Human
cuguucagcuccagc

SEQ ID NO: 2717633 - RNA, 12 nt, Human
cuguucagcugg

SEQ ID NO: 2717634 - RNA, 16 nt, Human
cuguucagcuccagcu

SEQ ID NO: 2717635 - RNA, 18 nt, Human
cuguucagcuccagcuca

SEQ ID NO: 2717636 - RNA, 19 nt, Human
cuguucagcuccagcucac

SEQ ID NO: 2717637 - RNA, 22 nt, Human
cuguucagcuccagcucaccag

SEQ ID NO: 2717638 - RNA, 18 nt, Human
cugugcucuggacaggca

SEQ ID NO: 2717639 - RNA, 19 nt, Human
cugugcucuggacaggcau

SEQ ID NO: 2717640 - RNA, 22 nt, Human
cugugucagguggggcagcuug

SEQ ID NO: 2717641 - RNA, 17 nt, Human
cuguuacugucuucagu

SEQ ID NO: 2717642 - RNA, 13 nt, Human
cuguuacugucuu

SEQ ID NO: 2717643 - RNA, 17 nt, Human
cugugcucuggacaggc

SEQ ID NO: 2717644 - RNA, 15 nt, Human
cugugcucuggacag

SEQ ID NO: 2717645 - RNA, 15 nt, Human
cugugaacuugaaau

SEQ ID NO: 2717646 - RNA, 18 nt, Human
cugugaaguuuacauugu

SEQ ID NO: 2717647 - RNA, 23 nt, Human
cugugaaguuuacauuguaaaua

SEQ ID NO: 2717648 - RNA, 17 nt, Human
cugugaacuugaaauuu

SEQ ID NO: 2717649 - RNA, 16 nt, Human
cugugaacuugaaauu

SEQ ID NO: 2717650 - RNA, 22 nt, Human
cuggugacaugucuuuucuugc

SEQ ID NO: 2717651 - RNA, 17 nt, Human
cuggugacugauucuuc

SEQ ID NO: 2717652 - RNA, 15 nt, Human
cuggugacugauucu

SEQ ID NO: 2717653 - RNA, 14 nt, Human
cuggugacugauuc

SEQ ID NO: 2717654 - RNA, 13 nt, Human
cuggugacugauu

SEQ ID NO: 2717655 - RNA, 23 nt, Human
cuggugcccugcuuucagauacu

SEQ ID NO: 2717656 - RNA, 21 nt, Human
cuggugcccugcuuucagaua

SEQ ID NO: 2717657 - RNA, 19 nt, Human
cuggugcccugcuuucaga

SEQ ID NO: 2717658 - RNA, 16 nt, Human
cuggugcccugcuuuc

SEQ ID NO: 2717659 - RNA, 15 nt, Human
cuggugcccugcuuu

SEQ ID NO: 2717660 - RNA, 18 nt, Human
cuggugacugauucuuca

SEQ ID NO: 2717661 - RNA, 20 nt, Human
cuguaagaaaauaucacuug

SEQ ID NO: 2717662 - RNA, 15 nt, Human
cuguagagugggagc

SEQ ID NO: 2717663 - RNA, 22 nt, Human
cugucuaaugaaaccugugucu

SEQ ID NO: 2717664 - RNA, 20 nt, Human
cuguccugggagugagcugg

SEQ ID NO: 2717665 - RNA, 13 nt, Human
cuguccugggagu

SEQ ID NO: 2717666 - RNA, 14 nt, Human
cuguccugggagug

SEQ ID NO: 2717667 - RNA, 14 nt, Human
cugucauuugagca

SEQ ID NO: 2717668 - RNA, 23 nt, Human
gacgcuacccgggaagggggcug

SEQ ID NO: 2717669 - RNA, 22 nt, Human
gacgcuacccgggaagggggcu

SEQ ID NO: 2717670 - RNA, 15 nt, Human
gacgcugugcugccc

SEQ ID NO: 2717671 - RNA, 18 nt, Human
gacgcugugcugcccugc

SEQ ID NO: 2717672 - RNA, 16 nt, Human
gacgcugugcugcccu

SEQ ID NO: 2717673 - RNA, 17 nt, Human
gacgcugugcugcccug

SEQ ID NO: 2717674 - RNA, 21 nt, Human
gacgccaucccagccccaaug

SEQ ID NO: 2717675 - RNA, 19 nt, Human
gacgccaucccagccccaa

SEQ ID NO: 2717676 - RNA, 13 nt, Human
gaccucugccuga

SEQ ID NO: 2717677 - RNA, 12 nt, Human
gacgccauccca

SEQ ID NO: 2717678 - RNA, 13 nt, Human
gacgccaucccag

SEQ ID NO: 2717679 - RNA, 22 nt, Human
gaccucugcagcaauaaagcag

SEQ ID NO: 2717680 - RNA, 18 nt, Human
gaccucugcagcaauaaa

SEQ ID NO: 2717681 - RNA, 16 nt, Human
gaccucugcagcaaua

SEQ ID NO: 2717682 - RNA, 14 nt, Human
gaccucaggccugg

SEQ ID NO: 2717683 - RNA, 21 nt, Human
gaccucaggugagaagcagag

SEQ ID NO: 2717684 - RNA, 19 nt, Human
gaccucaggugauccaccc

SEQ ID NO: 2717685 - RNA, 20 nt, Human
gaccucaggugauccaccca

SEQ ID NO: 2717686 - RNA, 21 nt, Human
gaccucaggugauccacccac

SEQ ID NO: 2717687 - RNA, 18 nt, Human
gaccucaggugagaagca

SEQ ID NO: 2717688 - RNA, 19 nt, Human
gaccucaggugagaagcag

SEQ ID NO: 2717689 - RNA, 19 nt, Human
gaccucaggccugggggcu

SEQ ID NO: 2717690 - RNA, 19 nt, Human
gacagcuccuucuguccua

SEQ ID NO: 2717691 - RNA, 10 nt, Human
gacagcucuu

SEQ ID NO: 2717692 - RNA, 18 nt, Human
gacagucaccucauggaa

SEQ ID NO: 2717693 - RNA, 11 nt, Human
gacagcucuua

SEQ ID NO: 2717694 - RNA, 12 nt, Human
gacagucccugc

SEQ ID NO: 2717695 - RNA, 14 nt, Human
gacagucccugcca

SEQ ID NO: 2717696 - RNA, 15 nt, Human
gacagucccugccaa

SEQ ID NO: 2717697 - RNA, 16 nt, Human
gacagucccugccaau

SEQ ID NO: 2717698 - RNA, 20 nt, Human
gacagucccugccaauggac

SEQ ID NO: 2717699 - RNA, 16 nt, Human
gacagcuccuucuguc

SEQ ID NO: 2717700 - RNA, 16 nt, Human
gacagcccgggcucug

SEQ ID NO: 2717701 - RNA, 17 nt, Human
gacagcuccuucugucc

SEQ ID NO: 2717702 - RNA, 18 nt, Human
gacagcuccuucuguccu

SEQ ID NO: 2717703 - RNA, 14 nt, Human
gacagcccgggcuc

SEQ ID NO: 2717704 - RNA, 17 nt, Human
gacauugcggacagcca

SEQ ID NO: 2717705 - RNA, 23 nt, Human
gacauugcggacagccacggcca

SEQ ID NO: 2717706 - RNA, 22 nt, Human
gaauauugcugauggugcaaug

SEQ ID NO: 2717707 - RNA, 23 nt, Human
gaauauugcugauggugcaauga

SEQ ID NO: 2717708 - RNA, 22 nt, Human
gaauauugcuuuggucauauga

SEQ ID NO: 2717709 - RNA, 24 nt, Human
gaauauugcugauggugcaaugac

SEQ ID NO: 2717710 - RNA, 15 nt, Human
gaauauauaaccagu

SEQ ID NO: 2717711 - RNA, 11 nt, Human
gaauauugcug

SEQ ID NO: 2717712 - RNA, 12 nt, Human
gaauauugcuga

SEQ ID NO: 2717713 - RNA, 13 nt, Human
gaauauugcugau

SEQ ID NO: 2717714 - RNA, 22 nt, Human
gaauaucuccgucaacucauau

SEQ ID NO: 2717715 - RNA, 21 nt, Human
gacacagcucuucuccaggcu

SEQ ID NO: 2717716 - RNA, 12 nt, Human
gacacagcucuu

SEQ ID NO: 2717717 - RNA, 19 nt, Human
gacacagcucuucuccagg

SEQ ID NO: 2717718 - RNA, 20 nt, Human
gacacagcucuucuccaggc

SEQ ID NO: 2717719 - RNA, 14 nt, Human
gaauuaugaaacuu

SEQ ID NO: 2717720 - RNA, 14 nt, Human
gaaugauuaugaau

SEQ ID NO: 2717721 - RNA, 14 nt, Human
gaaugauuaauuaa

SEQ ID NO: 2717722 - RNA, 20 nt, Human
gaaugaugauccuaggcauu

SEQ ID NO: 2717723 - RNA, 14 nt, Human
gaaugaugccauga

SEQ ID NO: 2717724 - RNA, 22 nt, Human
gaaugauuaugaauuacauuug

SEQ ID NO: 2717725 - RNA, 18 nt, Human
gaaugcacaaacagaggc

SEQ ID NO: 2717726 - RNA, 15 nt, Human
gaauguuugccucug

SEQ ID NO: 2717727 - RNA, 19 nt, Human
gaaugcacaaacagaggcc

SEQ ID NO: 2717728 - RNA, 16 nt, Human
gaauguuugccucugc

SEQ ID NO: 2717729 - RNA, 17 nt, Human
gaauguuugccucugcc

SEQ ID NO: 2717730 - RNA, 18 nt, Human
gaauguuugccucugccu

SEQ ID NO: 2717731 - RNA, 19 nt, Human
gaauguuugccucugccuc

SEQ ID NO: 2717732 - RNA, 13 nt, Human
gaauuacauuugu

SEQ ID NO: 2717733 - RNA, 15 nt, Human
gaauuacauuuguau

SEQ ID NO: 2717734 - RNA, 18 nt, Human
gaauuacauuuguauaaa

SEQ ID NO: 2717735 - RNA, 20 nt, Human
gaauuacauuuguauaaaau

SEQ ID NO: 2717736 - RNA, 22 nt, Human
gacuuuuuauggcacuaguauu

SEQ ID NO: 2717737 - RNA, 19 nt, Human
gacuuuuccaacccucauc

SEQ ID NO: 2717738 - RNA, 14 nt, Human
gacuuuuccaaccc

SEQ ID NO: 2717739 - RNA, 20 nt, Human
gacuuuuccaacccucauca

SEQ ID NO: 2717740 - RNA, 21 nt, Human
gagacccugucucaaaaaaag

SEQ ID NO: 2717741 - RNA, 15 nt, Human
gagaaugaaagggcc

SEQ ID NO: 2717742 - RNA, 23 nt, Human
gagaaugaaagggcccagagagg

SEQ ID NO: 2717743 - RNA, 18 nt, Human
gagacgggggcagagagg

SEQ ID NO: 2717744 - RNA, 16 nt, Human
gagacggagucccacc

SEQ ID NO: 2717745 - RNA, 19 nt, Human
gagacggagucccaccuug

SEQ ID NO: 2717746 - RNA, 14 nt, Human
gagacggaguccca

SEQ ID NO: 2717747 - RNA, 21 nt, Human
gagauugcaccacugcacucc

SEQ ID NO: 2717748 - RNA, 14 nt, Human
gagauuggaaggaa

SEQ ID NO: 2717749 - RNA, 15 nt, Human
gagaggacccccuga

SEQ ID NO: 2717750 - RNA, 12 nt, Human
gagaggaaauca

SEQ ID NO: 2717751 - RNA, 20 nt, Human
gagagcugggugucaagagg

SEQ ID NO: 2717752 - RNA, 13 nt, Human
gagacuccugcag

SEQ ID NO: 2717753 - RNA, 14 nt, Human
gagacuccugcagg

SEQ ID NO: 2717754 - RNA, 15 nt, Human
gagagccuuccaggg

SEQ ID NO: 2717755 - RNA, 16 nt, Human
gagagccuuccagggg

SEQ ID NO: 2717756 - RNA, 15 nt, Human
gagagcuagcagcag

SEQ ID NO: 2717757 - RNA, 21 nt, Human
gagagcuagcagcagggaggg

SEQ ID NO: 2717758 - RNA, 13 nt, Human
gagagcugggugu

SEQ ID NO: 2717759 - RNA, 18 nt, Human
gagagccuuccaggggug

SEQ ID NO: 2717760 - RNA, 20 nt, Human
gagagccuuccagggguggg

SEQ ID NO: 2717761 - RNA, 22 nt, Human
gagcuguucacagccagacugg

SEQ ID NO: 2717762 - RNA, 20 nt, Human
gagcuguucacagccagacu

SEQ ID NO: 2717763 - RNA, 17 nt, Human
gagcuguucacagccag

SEQ ID NO: 2717764 - RNA, 13 nt, Human
gagcccugguggc

SEQ ID NO: 2717765 - RNA, 14 nt, Human
gagcccugguggca

SEQ ID NO: 2717766 - RNA, 13 nt, Human
gagccccgaggcc

SEQ ID NO: 2717767 - RNA, 14 nt, Human
gagccccgaggccu

SEQ ID NO: 2717768 - RNA, 17 nt, Human
gagccccgaggccuucu

SEQ ID NO: 2717769 - RNA, 14 nt, Human
gagcagucaggaaa

SEQ ID NO: 2717770 - RNA, 14 nt, Human
gagcaucaggccag

SEQ ID NO: 2717771 - RNA, 21 nt, Human
gagcagggcucagcggggaca

SEQ ID NO: 2717772 - RNA, 13 nt, Human
gagcaucaggcca

SEQ ID NO: 2717773 - RNA, 15 nt, Human
gagcaucaggccagg

SEQ ID NO: 2717774 - RNA, 16 nt, Human
gagcaucaggccaggc

SEQ ID NO: 2717775 - RNA, 13 nt, Human
gagcaugccugga

SEQ ID NO: 2717776 - RNA, 21 nt, Human
gagcaugccuggauggggcug

SEQ ID NO: 2717777 - RNA, 16 nt, Human
gaggacuuuucuuugu

SEQ ID NO: 2717778 - RNA, 20 nt, Human
gaggacuuuucuuuguggcu

SEQ ID NO: 2717779 - RNA, 23 nt, Human
gaggacuuuucuuuguggcuucc

SEQ ID NO: 2717780 - RNA, 12 nt, Human
gaggagagagga

SEQ ID NO: 2717781 - RNA, 14 nt, Human
gaggagagaggacc

SEQ ID NO: 2717782 - RNA, 15 nt, Human
gaggagagaggaccc

SEQ ID NO: 2717783 - RNA, 19 nt, Human
gaggcagggucucacucug

SEQ ID NO: 2717784 - RNA, 20 nt, Human
gaggcagggucucacucugu

SEQ ID NO: 2717785 - RNA, 18 nt, Human
gaggcagggucucacucu

SEQ ID NO: 2717786 - RNA, 14 nt, Human
gagggccugcaagg

SEQ ID NO: 2717787 - RNA, 17 nt, Human
gagggccugcaagggag

SEQ ID NO: 2717788 - RNA, 21 nt, Human
gagggccugcaagggagugag

SEQ ID NO: 2717789 - RNA, 21 nt, Human
gaggcauuuguuugaacugau

SEQ ID NO: 2717790 - RNA, 19 nt, Human
gaggcauuuguuugaacug

SEQ ID NO: 2717791 - RNA, 22 nt, Human
gaggcaugugaugagaggaaau

SEQ ID NO: 2717792 - RNA, 20 nt, Human
gaggcaugugaugagaggaa

SEQ ID NO: 2717793 - RNA, 21 nt, Human
gaggcaugugaugagaggaaa

SEQ ID NO: 2717794 - RNA, 15 nt, Human
gaucugccuaaggac

SEQ ID NO: 2717795 - RNA, 12 nt, Human
gaucugccuaag

SEQ ID NO: 2717796 - RNA, 16 nt, Human
gaucugccuaaggacu

SEQ ID NO: 2717797 - RNA, 18 nt, Human
gauccagcagauuauuca

SEQ ID NO: 2717798 - RNA, 19 nt, Human
gauccagcagauuauucac

SEQ ID NO: 2717799 - RNA, 15 nt, Human
gaucucuaacuucac

SEQ ID NO: 2717800 - RNA, 18 nt, Human
gaucucuugagccuggga

SEQ ID NO: 2717801 - RNA, 19 nt, Human
gaucucuugagccugggag

SEQ ID NO: 2717802 - RNA, 22 nt, Human
gaugauuggaggggggaggugg

SEQ ID NO: 2717803 - RNA, 13 nt, Human
gaugauccuaggc

SEQ ID NO: 2717804 - RNA, 14 nt, Human
gaugauccuaggca

SEQ ID NO: 2717805 - RNA, 23 nt, Human
gaugcuucucacugccaugccag

SEQ ID NO: 2717806 - RNA, 21 nt, Human
gaugcuucuucagagacuccu

SEQ ID NO: 2717807 - RNA, 17 nt, Human
gaugcuucuucagagac

SEQ ID NO: 2717808 - RNA, 20 nt, Human
gaugcuucuucagagacucc

SEQ ID NO: 2717809 - RNA, 12 nt, Human
gaugauuucuau

SEQ ID NO: 2717810 - RNA, 23 nt, Human
gaugauuucuaugcugaguuugu

SEQ ID NO: 2717811 - RNA, 13 nt, Human
gaugauuucuaug

SEQ ID NO: 2717812 - RNA, 16 nt, Human
gauacaguuacucaga

SEQ ID NO: 2717813 - RNA, 23 nt, Human
gauacaguuacucagaauucucu

SEQ ID NO: 2717814 - RNA, 19 nt, Human
gauacaguuacucagaauu

SEQ ID NO: 2717815 - RNA, 12 nt, Human
gauacugaaaua

SEQ ID NO: 2717816 - RNA, 21 nt, Human
gauacuguaucaugacaaaga

SEQ ID NO: 2717817 - RNA, 17 nt, Human
gauacuguaucaugaca

SEQ ID NO: 2717818 - RNA, 20 nt, Human
gauacuggauuguacuuugu

SEQ ID NO: 2717819 - RNA, 16 nt, Human
gauacuggauuguacu

SEQ ID NO: 2717820 - RNA, 12 nt, Human
gauccaagcugg

SEQ ID NO: 2717821 - RNA, 16 nt, Human
gauccaagcugguccc

SEQ ID NO: 2717822 - RNA, 17 nt, Human
gauccaagcugguccca

SEQ ID NO: 2717823 - RNA, 19 nt, Human
gauccaagcuggucccacu

SEQ ID NO: 2717824 - RNA, 22 nt, Human
gauccacccaccucagccuccc

SEQ ID NO: 2717825 - RNA, 20 nt, Human
gauccacccaccucagccuc

SEQ ID NO: 2717826 - RNA, 21 nt, Human
gauccacccaccucagccucc

SEQ ID NO: 2717827 - RNA, 21 nt, Human
gauccaagcuggucccacuca

SEQ ID NO: 2717828 - RNA, 18 nt, Human
gauccacccaccucagcc

SEQ ID NO: 2717829 - RNA, 19 nt, Human
gauccacccaccucagccu

SEQ ID NO: 2717830 - RNA, 23 nt, Human
gaucaaaagguuaauaaaguaau

SEQ ID NO: 2717831 - RNA, 20 nt, Human
gaucaaaagguuaauaaagu

SEQ ID NO: 2717832 - RNA, 17 nt, Human
gauauuuuuuucuuuuc

SEQ ID NO: 2717833 - RNA, 16 nt, Human
gcaagugagagcuggg

SEQ ID NO: 2717834 - RNA, 15 nt, Human
gcaagugagagcugg

SEQ ID NO: 2717835 - RNA, 20 nt, Human
gcaaccuccgccucuugggu

SEQ ID NO: 2717836 - RNA, 14 nt, Human
gcaacccccagccu

SEQ ID NO: 2717837 - RNA, 15 nt, Human
gcaacccccagccug

SEQ ID NO: 2717838 - RNA, 16 nt, Human
gcaacccccagccugc

SEQ ID NO: 2717839 - RNA, 19 nt, Human
gcaaccuccgccucuuggg

SEQ ID NO: 2717840 - RNA, 14 nt, Human
gcaacaggcugggc

SEQ ID NO: 2717841 - RNA, 15 nt, Human
gcaacaggcugggcu

SEQ ID NO: 2717842 - RNA, 13 nt, Human
gcaacaggcuggg

SEQ ID NO: 2717843 - RNA, 16 nt, Human
gcaacaggcugggcuu

SEQ ID NO: 2717844 - RNA, 19 nt, Human
gcaacaggcugggcuucag

SEQ ID NO: 2717845 - RNA, 13 nt, Human
gcaaccaccacca

SEQ ID NO: 2717846 - RNA, 16 nt, Human
gcaaccaccaccaacc

SEQ ID NO: 2717847 - RNA, 18 nt, Human
gcaaccaccaccaaccac

SEQ ID NO: 2717848 - RNA, 12 nt, Human
gauucuucugcu

SEQ ID NO: 2717849 - RNA, 13 nt, Human
gauucuucugcuu

SEQ ID NO: 2717850 - RNA, 15 nt, Human
gauucuucugcuuca

SEQ ID NO: 2717851 - RNA, 19 nt, Human
gauuuaacagaaauguaca

SEQ ID NO: 2717852 - RNA, 20 nt, Human
gauucuucugcuucagccuc

SEQ ID NO: 2717853 - RNA, 16 nt, Human
gauuuaacagaaaugu

SEQ ID NO: 2717854 - RNA, 18 nt, Human
gauuuaacagaaauguac

SEQ ID NO: 2717855 - RNA, 17 nt, Human
gauuuaacagaaaugua

SEQ ID NO: 2717856 - RNA, 11 nt, Human
gauuucacucu

SEQ ID NO: 2717857 - RNA, 16 nt, Human
gauuuuuuuuuccuuc

SEQ ID NO: 2717858 - RNA, 12 nt, Human
gauuucacucuc

SEQ ID NO: 2717859 - RNA, 17 nt, Human
gauuuuuuuuuccuuca

SEQ ID NO: 2717860 - RNA, 18 nt, Human
gauuuuuuuuuccuucag

SEQ ID NO: 2717861 - RNA, 17 nt, Human
gcaaaagaugcuucuca

SEQ ID NO: 2717862 - RNA, 22 nt, Human
gcaaaagaugcuucucacugcc

SEQ ID NO: 2717863 - RNA, 14 nt, Human
gcaaaaaggcagga

SEQ ID NO: 2717864 - RNA, 21 nt, Human
gauuuuuuuuuccuucagugc

SEQ ID NO: 2717865 - RNA, 18 nt, Human
gcauacguacacauuuua

SEQ ID NO: 2717866 - RNA, 13 nt, Human
gcagugaugucac

SEQ ID NO: 2717867 - RNA, 22 nt, Human
gcaguuguugcccacagcugua

SEQ ID NO: 2717868 - RNA, 15 nt, Human
gcauacguacacauu

SEQ ID NO: 2717869 - RNA, 17 nt, Human
gcauacguacacauuuu

SEQ ID NO: 2717870 - RNA, 16 nt, Human
gcauacguacacauuu

SEQ ID NO: 2717871 - RNA, 13 nt, Human
gcauccuggcacc

SEQ ID NO: 2717872 - RNA, 21 nt, Human
gcauggcugccaaugggagcu

SEQ ID NO: 2717873 - RNA, 18 nt, Human
gcaugugaugagaggaaa

SEQ ID NO: 2717874 - RNA, 19 nt, Human
gcaugugaugagaggaaau

SEQ ID NO: 2717875 - RNA, 21 nt, Human
gcaugugaugagaggaaauca

SEQ ID NO: 2717876 - RNA, 13 nt, Human
gcauugugggaag

SEQ ID NO: 2717877 - RNA, 15 nt, Human
gcauugugggaaggg

SEQ ID NO: 2717878 - RNA, 15 nt, Human
gcauuuacuuugugu

SEQ ID NO: 2717879 - RNA, 22 nt, Human
gcauuuaaaagauacaguuacu

SEQ ID NO: 2717880 - RNA, 18 nt, Human
gcauuuaaaagauacagu

SEQ ID NO: 2717881 - RNA, 17 nt, Human
gcauuuaaaagauacag

SEQ ID NO: 2717882 - RNA, 16 nt, Human
gcauuuaaaagauaca

SEQ ID NO: 2717883 - RNA, 16 nt, Human
gcauugugggaagggg

SEQ ID NO: 2717884 - RNA, 18 nt, Human
gcauugugggaaggggag

SEQ ID NO: 2717885 - RNA, 18 nt, Human
gcauccaguaucuugaag

SEQ ID NO: 2717886 - RNA, 14 nt, Human
gcauccaguaucuu

SEQ ID NO: 2717887 - RNA, 17 nt, Human
gcauccaguaucuugaa

SEQ ID NO: 2717888 - RNA, 20 nt, Human
gcacucagaagacacugaug

SEQ ID NO: 2717889 - RNA, 17 nt, Human
gcacucagaagacacug

SEQ ID NO: 2717890 - RNA, 18 nt, Human
gcaagugagagcugggug

SEQ ID NO: 2717891 - RNA, 19 nt, Human
gcaagugagagcugggugu

SEQ ID NO: 2717892 - RNA, 22 nt, Human
gcacuuuguucuggcucuucca

SEQ ID NO: 2717893 - RNA, 14 nt, Human
gcacuccagccugg

SEQ ID NO: 2717894 - RNA, 13 nt, Human
gcacuccccugcu

SEQ ID NO: 2717895 - RNA, 14 nt, Human
gcacuccccugcug

SEQ ID NO: 2717896 - RNA, 12 nt, Human
gcacuccccugc

SEQ ID NO: 2717897 - RNA, 15 nt, Human
gcacuccccugcugg

SEQ ID NO: 2717898 - RNA, 18 nt, Human
gcacuuuguucuggcucu

SEQ ID NO: 2717899 - RNA, 19 nt, Human
gcacuuuguucuggcucuu

SEQ ID NO: 2717900 - RNA, 21 nt, Human
gcagaggaaagcaaaggagau

SEQ ID NO: 2717901 - RNA, 13 nt, Human
gcagaggaaagca

SEQ ID NO: 2717902 - RNA, 14 nt, Human
gcagaggaaagcaa

SEQ ID NO: 2717903 - RNA, 18 nt, Human
gcagaggaaagcaaagga

SEQ ID NO: 2717904 - RNA, 20 nt, Human
gcagaggaaagcaaaggaga

SEQ ID NO: 2717905 - RNA, 14 nt, Human
gcagagggcacaga

SEQ ID NO: 2717906 - RNA, 17 nt, Human
gcagcauauucaggaag

SEQ ID NO: 2717907 - RNA, 18 nt, Human
gcagcauauucaggaagc

SEQ ID NO: 2717908 - RNA, 19 nt, Human
gcagcauauucaggaagcu

SEQ ID NO: 2717909 - RNA, 23 nt, Human
gcagcauauucaggaagcucagg

SEQ ID NO: 2717910 - RNA, 18 nt, Human
gcagcccaccccucaaca

SEQ ID NO: 2717911 - RNA, 15 nt, Human
gcagccacauuccug

SEQ ID NO: 2717912 - RNA, 20 nt, Human
gcuggguucuacccaggugc

SEQ ID NO: 2717913 - RNA, 21 nt, Human
gcuggguucuacccaggugcu

SEQ ID NO: 2717914 - RNA, 22 nt, Human
gcugggguggggaccucaggcc

SEQ ID NO: 2717915 - RNA, 23 nt, Human
gcugggguggggaccucaggccu

SEQ ID NO: 2717916 - RNA, 18 nt, Human
gcuggguucuacccaggu

SEQ ID NO: 2717917 - RNA, 17 nt, Human
gcuggguucuacccagg

SEQ ID NO: 2717918 - RNA, 14 nt, Human
gcugggcagguugg

SEQ ID NO: 2717919 - RNA, 17 nt, Human
gcuggcuguuggcuggg

SEQ ID NO: 2717920 - RNA, 20 nt, Human
gcuggcuguuggcugggggc

SEQ ID NO: 2717921 - RNA, 23 nt, Human
gcuggcuguuggcugggggccuc

SEQ ID NO: 2717922 - RNA, 17 nt, Human
gcugggguggggaccuc

SEQ ID NO: 2717923 - RNA, 19 nt, Human
gcugggguggggaccucag

SEQ ID NO: 2717924 - RNA, 14 nt, Human
gcuggcgugcagug

SEQ ID NO: 2717925 - RNA, 15 nt, Human
gcuggcgugcagugg

SEQ ID NO: 2717926 - RNA, 18 nt, Human
gcuggcgugcaguggugc

SEQ ID NO: 2717927 - RNA, 18 nt, Human
gcuggcuguuggcugggg

SEQ ID NO: 2717928 - RNA, 19 nt, Human
gcuggcuguuggcuggggg

SEQ ID NO: 2717929 - RNA, 12 nt, Human
gcugcugaaggc

SEQ ID NO: 2717930 - RNA, 13 nt, Human
gcugcugaaacaa

SEQ ID NO: 2717931 - RNA, 17 nt, Human
gcuguaucccaugagcc

SEQ ID NO: 2717932 - RNA, 19 nt, Human
gcuguaucccaugagccuc

SEQ ID NO: 2717933 - RNA, 21 nt, Human
gcuguauuuuaaaagaaugau

SEQ ID NO: 2717934 - RNA, 20 nt, Human
gcuguauuuuaaaagaauga

SEQ ID NO: 2717935 - RNA, 18 nt, Human
gcuguauuuuaaaagaau

SEQ ID NO: 2717936 - RNA, 13 nt, Human
gcugugcucugga

SEQ ID NO: 2717937 - RNA, 18 nt, Human
gcugugcucuggacaggc

SEQ ID NO: 2717938 - RNA, 14 nt, Human
gcugugcugcccug

SEQ ID NO: 2717939 - RNA, 15 nt, Human
gcugugcucuggaca

SEQ ID NO: 2717940 - RNA, 16 nt, Human
gcugugcucuggacag

SEQ ID NO: 2717941 - RNA, 16 nt, Human
gcuguuggcugggggc

SEQ ID NO: 2717942 - RNA, 20 nt, Human
gcuguuggcugggggccuca

SEQ ID NO: 2717943 - RNA, 15 nt, Human
gcuguuggcuggggg

SEQ ID NO: 2717944 - RNA, 17 nt, Human
gcugugcugcccugccc

SEQ ID NO: 2717945 - RNA, 15 nt, Human
gcugugcugcccugc

SEQ ID NO: 2717946 - RNA, 16 nt, Human
gcugugcugcccugcc

SEQ ID NO: 2717947 - RNA, 18 nt, Human
gcugagggugagugggug

SEQ ID NO: 2717948 - RNA, 23 nt, Human
gcugagggugagugggugaauaa

SEQ ID NO: 2717949 - RNA, 14 nt, Human
gcugaggugggagg

SEQ ID NO: 2717950 - RNA, 18 nt, Human
gcugcacccucaggcagg

SEQ ID NO: 2717951 - RNA, 19 nt, Human
gcugcacccucaggcaggu

SEQ ID NO: 2717952 - RNA, 13 nt, Human
gcugcaccggcug

SEQ ID NO: 2717953 - RNA, 14 nt, Human
gcugccuccccucc

SEQ ID NO: 2717954 - RNA, 20 nt, Human
gcugccugggaucccucauc

SEQ ID NO: 2717955 - RNA, 16 nt, Human
gcugccucucccauca

SEQ ID NO: 2717956 - RNA, 21 nt, Human
gcugccugggaucccucaucc

SEQ ID NO: 2717957 - RNA, 17 nt, Human
gcugccuguucagcucc

SEQ ID NO: 2717958 - RNA, 12 nt, Human
gcugccuguuca

SEQ ID NO: 2717959 - RNA, 13 nt, Human
gcugccuguucag

SEQ ID NO: 2717960 - RNA, 17 nt, Human
gcugccccuggcagccc

SEQ ID NO: 2717961 - RNA, 20 nt, Human
gcugccccuggcagccccug

SEQ ID NO: 2717962 - RNA, 18 nt, Human
gcugccccuggcagcccc

SEQ ID NO: 2717963 - RNA, 19 nt, Human
gcugccccuggcagccccu

SEQ ID NO: 2717964 - RNA, 21 nt, Human
ggaagccagcaggcucucagg

SEQ ID NO: 2717965 - RNA, 18 nt, Human
ggaagccgcuggggccag

SEQ ID NO: 2717966 - RNA, 22 nt, Human
ggaagccagcaggcucucaggc

SEQ ID NO: 2717967 - RNA, 23 nt, Human
ggaagccagcaggcucucaggcc

SEQ ID NO: 2717968 - RNA, 19 nt, Human
ggaaaucaggguuaguauu

SEQ ID NO: 2717969 - RNA, 23 nt, Human
ggaaaucaccgaaaacguggcug

SEQ ID NO: 2717970 - RNA, 13 nt, Human
ggacauggacaag

SEQ ID NO: 2717971 - RNA, 17 nt, Human
ggacagucaccucaugg

SEQ ID NO: 2717972 - RNA, 18 nt, Human
ggacagucaccucaugga

SEQ ID NO: 2717973 - RNA, 21 nt, Human
ggacagucaccucauggaauu

SEQ ID NO: 2717974 - RNA, 13 nt, Human
ggacacccuguga

SEQ ID NO: 2717975 - RNA, 23 nt, Human
ggacacccugugauggggcccug

SEQ ID NO: 2717976 - RNA, 23 nt, Human
ggacaggcauguucucugaggac

SEQ ID NO: 2717977 - RNA, 17 nt, Human
ggacagggaggugaccc

SEQ ID NO: 2717978 - RNA, 16 nt, Human
ggaauauauaaccagu

SEQ ID NO: 2717979 - RNA, 19 nt, Human
ggaauacucuuauaucuau

SEQ ID NO: 2717980 - RNA, 16 nt, Human
ggaauaccuguccccc

SEQ ID NO: 2717981 - RNA, 19 nt, Human
ggaauaccugucccccuga

SEQ ID NO: 2717982 - RNA, 15 nt, Human
ggaagccugauuaaa

SEQ ID NO: 2717983 - RNA, 16 nt, Human
ggaagcucagggccug

SEQ ID NO: 2717984 - RNA, 17 nt, Human
ggaagcucagggccugg

SEQ ID NO: 2717985 - RNA, 15 nt, Human
ggaauaccugucccc

SEQ ID NO: 2717986 - RNA, 22 nt, Human
ggaagcucagggccuggcucag

SEQ ID NO: 2717987 - RNA, 21 nt, Human
ggaagcucagggccuggcuca

SEQ ID NO: 2717988 - RNA, 12 nt, Human
ggacacagcucu

SEQ ID NO: 2717989 - RNA, 19 nt, Human
ggaaugaaugucaguguga

SEQ ID NO: 2717990 - RNA, 13 nt, Human
ggacacagcucuu

SEQ ID NO: 2717991 - RNA, 12 nt, Human
ggacacccugug

SEQ ID NO: 2717992 - RNA, 17 nt, Human
gcuuaacuucacauauu

SEQ ID NO: 2717993 - RNA, 16 nt, Human
gcuucuucagagacuc

SEQ ID NO: 2717994 - RNA, 16 nt, Human
gcuuaacuucacauau

SEQ ID NO: 2717995 - RNA, 19 nt, Human
gcuucuucagagacuccug

SEQ ID NO: 2717996 - RNA, 21 nt, Human
gcuucuucagagacuccugca

SEQ ID NO: 2717997 - RNA, 16 nt, Human
gcuugaccgugaggcc

SEQ ID NO: 2717998 - RNA, 23 nt, Human
gcuucuucagagacuccugcagg

SEQ ID NO: 2717999 - RNA, 17 nt, Human
gcuugaccgugaggcca

SEQ ID NO: 2718000 - RNA, 18 nt, Human
gcuugaccgugaggccag

SEQ ID NO: 2718001 - RNA, 19 nt, Human
gcuugaccgugaggccaga

SEQ ID NO: 2718002 - RNA, 23 nt, Human
gcuugggcuucauccuccucaga

SEQ ID NO: 2718003 - RNA, 16 nt, Human
gcuuggggaccagagc

SEQ ID NO: 2718004 - RNA, 22 nt, Human
gcuuggggaccagagcugccac

SEQ ID NO: 2718005 - RNA, 17 nt, Human
gcuuggggaccagagcu

SEQ ID NO: 2718006 - RNA, 18 nt, Human
gcuuggggaccagagcug

SEQ ID NO: 2718007 - RNA, 20 nt, Human
gcuuggggaccagagcugcc

SEQ ID NO: 2718008 - RNA, 21 nt, Human
gcuuggggaccagagcugcca

SEQ ID NO: 2718009 - RNA, 23 nt, Human
gcuuucuacccagcgagcccugg

SEQ ID NO: 2718010 - RNA, 13 nt, Human
gcuuucuacccag

SEQ ID NO: 2718011 - RNA, 19 nt, Human
gcuuucuacccagcgagcc

SEQ ID NO: 2718012 - RNA, 22 nt, Human
gcuuucuacccagcgagcccug

SEQ ID NO: 2718013 - RNA, 16 nt, Human
ggaaaaaauaacaaug

SEQ ID NO: 2718014 - RNA, 15 nt, Human
gcuuuuuaauauuga

SEQ ID NO: 2718015 - RNA, 19 nt, Human
gcuuuugugcauuaucuag

SEQ ID NO: 2718016 - RNA, 13 nt, Human
gcuuuugugcauu

SEQ ID NO: 2718017 - RNA, 13 nt, Human
ggaaacugccagc

SEQ ID NO: 2718018 - RNA, 20 nt, Human
ggaaacagcuaaugggacac

SEQ ID NO: 2718019 - RNA, 15 nt, Human
ggaaacccagcucug

SEQ ID NO: 2718020 - RNA, 19 nt, Human
ggaaagcaaaggagauugg

SEQ ID NO: 2718021 - RNA, 16 nt, Human
ggaaagaguaggaaga

SEQ ID NO: 2718022 - RNA, 17 nt, Human
ggaaagaguaggaagac

SEQ ID NO: 2718023 - RNA, 20 nt, Human
ggaaagacuuuuccaacccu

SEQ ID NO: 2718024 - RNA, 14 nt, Human
ggaaagaggcucug

SEQ ID NO: 2718025 - RNA, 21 nt, Human
gccccaaaacucuccucugcu

SEQ ID NO: 2718026 - RNA, 20 nt, Human
gccccaaaacucuccucugc

SEQ ID NO: 2718027 - RNA, 12 nt, Human
gccccugcuggu

SEQ ID NO: 2718028 - RNA, 15 nt, Human
gccccugcugguuca

SEQ ID NO: 2718029 - RNA, 16 nt, Human
gccccugcugguucag

SEQ ID NO: 2718030 - RNA, 12 nt, Human
gccccuggcagc

SEQ ID NO: 2718031 - RNA, 15 nt, Human
gccccuggcagcccc

SEQ ID NO: 2718032 - RNA, 11 nt, Human
gcccaggcagg

SEQ ID NO: 2718033 - RNA, 11 nt, Human
gcccaggcccc

SEQ ID NO: 2718034 - RNA, 12 nt, Human
gcccaggccccu

SEQ ID NO: 2718035 - RNA, 20 nt, Human
gcccaggccccugccacccu

SEQ ID NO: 2718036 - RNA, 21 nt, Human
gcccaggccccugccacccug

SEQ ID NO: 2718037 - RNA, 18 nt, Human
gcccaggccccugccacc

SEQ ID NO: 2718038 - RNA, 22 nt, Human
gcccaggccccugccacccugg

SEQ ID NO: 2718039 - RNA, 12 nt, Human
gcauuuagaugu

SEQ ID NO: 2718040 - RNA, 18 nt, Human
gcauuuacuuuguguuca

SEQ ID NO: 2718041 - RNA, 13 nt, Human
gcauuuagaugua

SEQ ID NO: 2718042 - RNA, 11 nt, Human
gccauguuuau

SEQ ID NO: 2718043 - RNA, 13 nt, Human
gccauguuuauua

SEQ ID NO: 2718044 - RNA, 22 nt, Human
gccauguuuauuacaguauaau

SEQ ID NO: 2718045 - RNA, 18 nt, Human
gccauguuuauuacagua

SEQ ID NO: 2718046 - RNA, 14 nt, Human
gccauguuuauuac

SEQ ID NO: 2718047 - RNA, 15 nt, Human
gcccacgcccccacu

SEQ ID NO: 2718048 - RNA, 16 nt, Human
gcccacgcccccacug

SEQ ID NO: 2718049 - RNA, 17 nt, Human
gcccacgcccccacugg

SEQ ID NO: 2718050 - RNA, 21 nt, Human
gcccacgcccccacuggugac

SEQ ID NO: 2718051 - RNA, 23 nt, Human
gcccacgcuggagugcagugagc

SEQ ID NO: 2718052 - RNA, 19 nt, Human
gcccacgcuggagugcagu

SEQ ID NO: 2718053 - RNA, 21 nt, Human
gcccacgcuggagugcaguga

SEQ ID NO: 2718054 - RNA, 13 nt, Human
gcccacuucugcc

SEQ ID NO: 2718055 - RNA, 24 nt, Human
gcccaggaaaggcuccaggagcag

SEQ ID NO: 2718056 - RNA, 22 nt, Human
gcccaggaaaggcuccaggagc

SEQ ID NO: 2718057 - RNA, 23 nt, Human
gcccaggaaaggcuccaggagca

SEQ ID NO: 2718058 - RNA, 16 nt, Human
gccccuggcagccccu

SEQ ID NO: 2718059 - RNA, 17 nt, Human
gccccuggcagccccug

SEQ ID NO: 2718060 - RNA, 16 nt, Human
gccuacaggagugagc

SEQ ID NO: 2718061 - RNA, 14 nt, Human
gcccugcccaccug

SEQ ID NO: 2718062 - RNA, 15 nt, Human
gcccugcccaccugg

SEQ ID NO: 2718063 - RNA, 23 nt, Human
gcccuuaccugccaggaagccag

SEQ ID NO: 2718064 - RNA, 16 nt, Human
gcccugugggccccca

SEQ ID NO: 2718065 - RNA, 17 nt, Human
gcccugugggcccccaa

SEQ ID NO: 2718066 - RNA, 21 nt, Human
gcccuuaccugccaggaagcc

SEQ ID NO: 2718067 - RNA, 22 nt, Human
gcccuuaccugccaggaagcca

SEQ ID NO: 2718068 - RNA, 19 nt, Human
gccuagcauacguacacau

SEQ ID NO: 2718069 - RNA, 12 nt, Human
gccuagcauacg

SEQ ID NO: 2718070 - RNA, 17 nt, Human
gccuacaggagugagca

SEQ ID NO: 2718071 - RNA, 14 nt, Human
gccucugggacugg

SEQ ID NO: 2718072 - RNA, 16 nt, Human
gccucgaacuggcugc

SEQ ID NO: 2718073 - RNA, 13 nt, Human
gccucgaacuggc

SEQ ID NO: 2718074 - RNA, 22 nt, Human
gccuccuuugugaggaagccgc

SEQ ID NO: 2718075 - RNA, 20 nt, Human
gcucagggccuggcucaggu

SEQ ID NO: 2718076 - RNA, 13 nt, Human
gcucaggaguuug

SEQ ID NO: 2718077 - RNA, 18 nt, Human
gcucagggccuggcucag

SEQ ID NO: 2718078 - RNA, 19 nt, Human
gcucagggccuggcucagg

SEQ ID NO: 2718079 - RNA, 18 nt, Human
gcuaagugauccucccac

SEQ ID NO: 2718080 - RNA, 22 nt, Human
gcuaagugauccucccaccuca

SEQ ID NO: 2718081 - RNA, 22 nt, Human
gcuaggaccccuccaugugggc

SEQ ID NO: 2718082 - RNA, 20 nt, Human
gcuaggaccccuccaugugg

SEQ ID NO: 2718083 - RNA, 20 nt, Human
gcuauuucuauauuuucauu

SEQ ID NO: 2718084 - RNA, 19 nt, Human
gcuauuucuauauuuucau

SEQ ID NO: 2718085 - RNA, 18 nt, Human
gcuauuucuauauuuuca

SEQ ID NO: 2718086 - RNA, 16 nt, Human
gcuauuucuauauuuu

SEQ ID NO: 2718087 - RNA, 15 nt, Human
gcuauuucuauauuu

SEQ ID NO: 2718088 - RNA, 13 nt, Human
gcuauuucuauau

SEQ ID NO: 2718089 - RNA, 11 nt, Human
gcuauuucuau

SEQ ID NO: 2718090 - RNA, 14 nt, Human
gcuaguugggcuuc

SEQ ID NO: 2718091 - RNA, 16 nt, Human
gcuaguugggcuuccu

SEQ ID NO: 2718092 - RNA, 16 nt, Human
gcggccuuuggcuuca

SEQ ID NO: 2718093 - RNA, 22 nt, Human
gcguucauggaacgcguugaaa

SEQ ID NO: 2718094 - RNA, 23 nt, Human
gcuaaggacuuguuagaucuagu

SEQ ID NO: 2718095 - RNA, 12 nt, Human
gcguugaaauug

SEQ ID NO: 2718096 - RNA, 12 nt, Human
gcuaaggacuug

SEQ ID NO: 2718097 - RNA, 11 nt, Human
gcuaaggacuu

SEQ ID NO: 2718098 - RNA, 15 nt, Human
gcggcuggcagccca

SEQ ID NO: 2718099 - RNA, 23 nt, Human
gccuugaccauucuccaccugcc

SEQ ID NO: 2718100 - RNA, 22 nt, Human
gcgauucuucugcuucagccuc

SEQ ID NO: 2718101 - RNA, 17 nt, Human
gcgauucuucugcuuca

SEQ ID NO: 2718102 - RNA, 23 nt, Human
gccuugaacuuugaccucugcag

SEQ ID NO: 2718103 - RNA, 16 nt, Human
gccuugaccauucucc

SEQ ID NO: 2718104 - RNA, 21 nt, Human
gccuugaccauucuccaccug

SEQ ID NO: 2718105 - RNA, 22 nt, Human
gccuugaccauucuccaccugc

SEQ ID NO: 2718106 - RNA, 21 nt, Human
gcgcagcauauucaggaagcu

SEQ ID NO: 2718107 - RNA, 20 nt, Human
gcgcagcauauucaggaagc

SEQ ID NO: 2718108 - RNA, 23 nt, Human
gcgauucuucugcuucagccucc

SEQ ID NO: 2718109 - RNA, 15 nt, Human
gccuucucugaagga

SEQ ID NO: 2718110 - RNA, 16 nt, Human
gccuucucugaaggac

SEQ ID NO: 2718111 - RNA, 15 nt, Human
gccuguucagcucca

SEQ ID NO: 2718112 - RNA, 14 nt, Human
gccuguucagcucc

SEQ ID NO: 2718113 - RNA, 16 nt, Human
gccuguucagcuccag

SEQ ID NO: 2718114 - RNA, 17 nt, Human
gccuguucagcuccagc

SEQ ID NO: 2718115 - RNA, 14 nt, Human
gccuugaacuuuga

SEQ ID NO: 2718116 - RNA, 19 nt, Human
gccugugccucugggacug

SEQ ID NO: 2718117 - RNA, 11 nt, Human
gccugggcaga

SEQ ID NO: 2718118 - RNA, 23 nt, Human
gccugggaucccucauccucaua

SEQ ID NO: 2718119 - RNA, 15 nt, Human
ggcaaaaaggcagga

SEQ ID NO: 2718120 - RNA, 18 nt, Human
ggcacaccgggcacucag

SEQ ID NO: 2718121 - RNA, 18 nt, Human
ggcacaucagcacgauuu

SEQ ID NO: 2718122 - RNA, 16 nt, Human
ggcacugcuuccagug

SEQ ID NO: 2718123 - RNA, 16 nt, Human
ggcagccccauucugc

SEQ ID NO: 2718124 - RNA, 20 nt, Human
ggcagccccauucugccugc

SEQ ID NO: 2718125 - RNA, 21 nt, Human
ggcagccccauucugccugcc

SEQ ID NO: 2718126 - RNA, 22 nt, Human
ggcagccccauucugccugccc

SEQ ID NO: 2718127 - RNA, 13 nt, Human
ggcagccaggcca

SEQ ID NO: 2718128 - RNA, 20 nt, Human
ggcacugcuuccagugaggc

SEQ ID NO: 2718129 - RNA, 18 nt, Human
ggcaggaggaucacuuga

SEQ ID NO: 2718130 - RNA, 19 nt, Human
ggccaaaggaagcacaugc

SEQ ID NO: 2718131 - RNA, 13 nt, Human
ggccaaaggaagc

SEQ ID NO: 2718132 - RNA, 17 nt, Human
ggcauuuguuugaacug

SEQ ID NO: 2718133 - RNA, 14 nt, Human
ggccaaaggaagca

SEQ ID NO: 2718134 - RNA, 16 nt, Human
ggccaaaggaagcaca

SEQ ID NO: 2718135 - RNA, 18 nt, Human
ggccagagacacaagccu

SEQ ID NO: 2718136 - RNA, 17 nt, Human
ggccagagggagugaca

SEQ ID NO: 2718137 - RNA, 19 nt, Human
ggccagagggagugacaga

SEQ ID NO: 2718138 - RNA, 17 nt, Human
ggccagagacacaagcc

SEQ ID NO: 2718139 - RNA, 14 nt, Human
ggcauuugcugaau

SEQ ID NO: 2718140 - RNA, 15 nt, Human
ggaguggccacagaa

SEQ ID NO: 2718141 - RNA, 22 nt, Human
ggagugggcccaaugcacuuug

SEQ ID NO: 2718142 - RNA, 16 nt, Human
ggaguggccacagaaa

SEQ ID NO: 2718143 - RNA, 12 nt, Human
ggagugggccca

SEQ ID NO: 2718144 - RNA, 18 nt, Human
ggaucucuugagccuggg

SEQ ID NO: 2718145 - RNA, 23 nt, Human
ggaucuucaucugacuaugacau

SEQ ID NO: 2718146 - RNA, 16 nt, Human
ggaguucaucuugaau

SEQ ID NO: 2718147 - RNA, 15 nt, Human
ggauccugagccaga

SEQ ID NO: 2718148 - RNA, 16 nt, Human
ggauccugagccagau

SEQ ID NO: 2718149 - RNA, 18 nt, Human
ggauccugagccagauuu

SEQ ID NO: 2718150 - RNA, 19 nt, Human
ggauccugagccagauuuc

SEQ ID NO: 2718151 - RNA, 20 nt, Human
ggauccugagccagauuuca

SEQ ID NO: 2718152 - RNA, 23 nt, Human
ggauccugagccagauuucacuc

SEQ ID NO: 2718153 - RNA, 22 nt, Human
ggauuuaacagaaauguacagc

SEQ ID NO: 2718154 - RNA, 17 nt, Human
ggauuuaacagaaaugu

SEQ ID NO: 2718155 - RNA, 16 nt, Human
ggauuuaacagaaaug

SEQ ID NO: 2718156 - RNA, 12 nt, Human
ggauuuaacaga

SEQ ID NO: 2718157 - RNA, 16 nt, Human
ggauuguccccgaccc

SEQ ID NO: 2718158 - RNA, 20 nt, Human
ggauuguccccgacccuugc

SEQ ID NO: 2718159 - RNA, 14 nt, Human
ggaugaaaaaauaa

SEQ ID NO: 2718160 - RNA, 13 nt, Human
ggauuguccccga

SEQ ID NO: 2718161 - RNA, 13 nt, Human
ggaggggggaggu

SEQ ID NO: 2718162 - RNA, 14 nt, Human
ggaggggggaggug

SEQ ID NO: 2718163 - RNA, 21 nt, Human
ggagggugacgggggugaacu

SEQ ID NO: 2718164 - RNA, 22 nt, Human
ggagguaaggaauaccuguccc

SEQ ID NO: 2718165 - RNA, 22 nt, Human
ggaggugggauccuccaggugc

SEQ ID NO: 2718166 - RNA, 23 nt, Human
ggaggugggauccuccaggugca

SEQ ID NO: 2718167 - RNA, 13 nt, Human
ggcucacugcagc

SEQ ID NO: 2718168 - RNA, 14 nt, Human
ggcucacugcagcc

SEQ ID NO: 2718169 - RNA, 15 nt, Human
ggcucacugcagccu

SEQ ID NO: 2718170 - RNA, 13 nt, Human
ggcucccuuccca

SEQ ID NO: 2718171 - RNA, 14 nt, Human
ggcucuuccaggcu

SEQ ID NO: 2718172 - RNA, 15 nt, Human
ggcucuuccaggcug

SEQ ID NO: 2718173 - RNA, 17 nt, Human
ggcucuuccaggcuggg

SEQ ID NO: 2718174 - RNA, 18 nt, Human
ggcucuuccaggcuggga

SEQ ID NO: 2718175 - RNA, 13 nt, Human
ggcuggccuggcc

SEQ ID NO: 2718176 - RNA, 14 nt, Human
ggcuggccuggccc

SEQ ID NO: 2718177 - RNA, 15 nt, Human
ggcuggccuggcccc

SEQ ID NO: 2718178 - RNA, 23 nt, Human
aaaaagauuuucagaaaauauua

SEQ ID NO: 2718179 - RNA, 22 nt, Human
aaaaaacugcugacuguuuucu

SEQ ID NO: 2718180 - RNA, 14 nt, Human
ggcuggguuggagg

SEQ ID NO: 2718181 - RNA, 22 nt, Human
ggcuggguucuacccaggugcu

SEQ ID NO: 2718182 - RNA, 12 nt, Human
aaaaaggcagga

SEQ ID NO: 2718183 - RNA, 21 nt, Human
aaaaaggaugcacagaguugu

SEQ ID NO: 2718184 - RNA, 14 nt, Human
aaaaaggaggaaga

SEQ ID NO: 2718185 - RNA, 20 nt, Human
aaaaagccugcaauuucaua

SEQ ID NO: 2718186 - RNA, 15 nt, Human
ggccagaugcaccag

SEQ ID NO: 2718187 - RNA, 16 nt, Human
ggccagaugcaccagc

SEQ ID NO: 2718188 - RNA, 23 nt, Human
ggccucccaacucaccccagccc

SEQ ID NO: 2718189 - RNA, 20 nt, Human
ggccucccaacucaccccag

SEQ ID NO: 2718190 - RNA, 22 nt, Human
ggccucccaacucaccccagcc

SEQ ID NO: 2718191 - RNA, 13 nt, Human
ggccucagugcca

SEQ ID NO: 2718192 - RNA, 17 nt, Human
ggccucccaacucaccc

SEQ ID NO: 2718193 - RNA, 18 nt, Human
ggccucccaacucacccc

SEQ ID NO: 2718194 - RNA, 19 nt, Human
ggccucccaacucacccca

SEQ ID NO: 2718195 - RNA, 16 nt, Human
ggccugcaagggagug

SEQ ID NO: 2718196 - RNA, 16 nt, Human
ggccuggccagaugca

SEQ ID NO: 2718197 - RNA, 12 nt, Human
ggccuggccaga

SEQ ID NO: 2718198 - RNA, 15 nt, Human
ggccuggccagaugc

SEQ ID NO: 2718199 - RNA, 20 nt, Human
ggcuaagcuucacuguaaaa

SEQ ID NO: 2718200 - RNA, 16 nt, Human
ggcuaauguacugcau

SEQ ID NO: 2718201 - RNA, 20 nt, Human
ggcuaagugauccucccacc

SEQ ID NO: 2718202 - RNA, 13 nt, Human
ggcuaccuuugua

SEQ ID NO: 2718203 - RNA, 16 nt, Human
ggcuagagguucaaag

SEQ ID NO: 2718204 - RNA, 14 nt, Human
ggcuaccuuuguau

SEQ ID NO: 2718205 - RNA, 19 nt, Human
gguuuuauuguuuaaaauc

SEQ ID NO: 2718206 - RNA, 17 nt, Human
gguuuucacauuggaaa

SEQ ID NO: 2718207 - RNA, 20 nt, Human
gguuuguaaauuaacuuuua

SEQ ID NO: 2718208 - RNA, 22 nt, Human
gguuucuaaagcugccagccga

SEQ ID NO: 2718209 - RNA, 16 nt, Human
gguuucuaaagcugcc

SEQ ID NO: 2718210 - RNA, 15 nt, Human
gguuucagaaaugug

SEQ ID NO: 2718211 - RNA, 21 nt, Human
aaaguguauuuuuuuacuaau

SEQ ID NO: 2718212 - RNA, 14 nt, Human
aaaguguauuuuuu

SEQ ID NO: 2718213 - RNA, 21 nt, Human
aaaguaucccuacuguaauuu

SEQ ID NO: 2718214 - RNA, 22 nt, Human
aaaguagaagucuuagauguau

SEQ ID NO: 2718215 - RNA, 20 nt, Human
aaaguagaagucuuagaugu

SEQ ID NO: 2718216 - RNA, 19 nt, Human
aaaguacacuguuucaaac

SEQ ID NO: 2718217 - RNA, 18 nt, Human
aaaguacacuguuucaaa

SEQ ID NO: 2718218 - RNA, 17 nt, Human
gguguuuuaaaaaaucu

SEQ ID NO: 2718219 - RNA, 17 nt, Human
gguucccauuugcuccu

SEQ ID NO: 2718220 - RNA, 19 nt, Human
gguguuuccuggcacugcu

SEQ ID NO: 2718221 - RNA, 17 nt, Human
gguguuuccuggcacug

SEQ ID NO: 2718222 - RNA, 20 nt, Human
gguguuguacucaauuuuaa

SEQ ID NO: 2718223 - RNA, 19 nt, Human
gguguuguacucaauuuua

SEQ ID NO: 2718224 - RNA, 20 nt, Human
gguucuagcauggcauauuu

SEQ ID NO: 2718225 - RNA, 23 nt, Human
gguucccuuugacgccaucccag

SEQ ID NO: 2718226 - RNA, 22 nt, Human
gguucccuuuuuuggcugcuga

SEQ ID NO: 2718227 - RNA, 13 nt, Human
ggugggggccucg

SEQ ID NO: 2718228 - RNA, 14 nt, Human
gguguggagaagcg

SEQ ID NO: 2718229 - RNA, 23 nt, Human
gguguggagaagcggcuggcagc

SEQ ID NO: 2718230 - RNA, 12 nt, Human
gguguggagaag

SEQ ID NO: 2718231 - RNA, 11 nt, Human
gguguggggga

SEQ ID NO: 2718232 - RNA, 13 nt, Human
ggugugggggaag

SEQ ID NO: 2718233 - RNA, 20 nt, Human
aaagggcccagagagggugg

SEQ ID NO: 2718234 - RNA, 20 nt, Human
aaagggcuguuauaaucuuu

SEQ ID NO: 2718235 - RNA, 22 nt, Human
aaagggcuguuauaaucuuuca

SEQ ID NO: 2718236 - RNA, 19 nt, Human
gguggggaccucaggccug

SEQ ID NO: 2718237 - RNA, 20 nt, Human
ggugggaggaucucuugagc

SEQ ID NO: 2718238 - RNA, 17 nt, Human
ggugggacacccuguga

SEQ ID NO: 2718239 - RNA, 13 nt, Human
ggugggacacccu

SEQ ID NO: 2718240 - RNA, 16 nt, Human
ggugggacacccugug

SEQ ID NO: 2718241 - RNA, 18 nt, Human
gguggcuggguuggaggg

SEQ ID NO: 2718242 - RNA, 12 nt, Human
gguggcuggguu

SEQ ID NO: 2718243 - RNA, 14 nt, Human
gguggcaccagcag

SEQ ID NO: 2718244 - RNA, 20 nt, Human
gguggcaccagcagccugga

SEQ ID NO: 2718245 - RNA, 13 nt, Human
aaagcagugcaug

SEQ ID NO: 2718246 - RNA, 14 nt, Human
aaagcuaggccugg

SEQ ID NO: 2718247 - RNA, 16 nt, Human
aaagcuaggccuggcc

SEQ ID NO: 2718248 - RNA, 12 nt, Human
aaagcugccagc

SEQ ID NO: 2718249 - RNA, 13 nt, Human
aaagcugccagcc

SEQ ID NO: 2718250 - RNA, 22 nt, Human
aaagcugccagccgagauagcc

SEQ ID NO: 2718251 - RNA, 19 nt, Human
guaauagagcaaaauugau

SEQ ID NO: 2718252 - RNA, 15 nt, Human
guaauagagcaaaau

SEQ ID NO: 2718253 - RNA, 23 nt, Human
guaauccuagcacuuugggaggc

SEQ ID NO: 2718254 - RNA, 20 nt, Human
guaauuugugauacaaugcu

SEQ ID NO: 2718255 - RNA, 17 nt, Human
guaauuugugauacaau

SEQ ID NO: 2718256 - RNA, 15 nt, Human
guaauuugugauaca

SEQ ID NO: 2718257 - RNA, 21 nt, Human
guacaaaguauuaagcauaua

SEQ ID NO: 2718258 - RNA, 20 nt, Human
guacaaaguauuaagcauau

SEQ ID NO: 2718259 - RNA, 21 nt, Human
guaauuuuuuuaucgucacug

SEQ ID NO: 2718260 - RNA, 20 nt, Human
guaacaggaaaauuuuaaaa

SEQ ID NO: 2718261 - RNA, 19 nt, Human
guaacaggaaaauuuuaaa

SEQ ID NO: 2718262 - RNA, 16 nt, Human
guaacaagccacccca

SEQ ID NO: 2718263 - RNA, 14 nt, Human
aaauaaugugaaac

SEQ ID NO: 2718264 - RNA, 22 nt, Human
aaauaaugugaaacuggauuaa

SEQ ID NO: 2718265 - RNA, 22 nt, Human
aaaguguauuuuuuuacuaaua

SEQ ID NO: 2718266 - RNA, 22 nt, Human
aaauaucacuugucaauaaaau

SEQ ID NO: 2718267 - RNA, 15 nt, Human
aaauauauuuaauga

SEQ ID NO: 2718268 - RNA, 18 nt, Human
aaauauaugcuaagucuu

SEQ ID NO: 2718269 - RNA, 14 nt, Human
aaauauauuuaaug

SEQ ID NO: 2718270 - RNA, 21 nt, Human
aaauaccaugccauuuaaagc

SEQ ID NO: 2718271 - RNA, 21 nt, Human
aaauaccagccaguaaauggg

SEQ ID NO: 2718272 - RNA, 20 nt, Human
aaauaccagccaguaaaugg

SEQ ID NO: 2718273 - RNA, 16 nt, Human
guacacacacauacac

SEQ ID NO: 2718274 - RNA, 19 nt, Human
aaauaccagccaguaaaug

SEQ ID NO: 2718275 - RNA, 15 nt, Human
aaauauaggaacuua

SEQ ID NO: 2718276 - RNA, 21 nt, Human
aaauacgugggcauucaaaug

SEQ ID NO: 2718277 - RNA, 20 nt, Human
aaauacgugggcauucaaau

SEQ ID NO: 2718278 - RNA, 17 nt, Human
aaauaugcaaagcacug

SEQ ID NO: 2718279 - RNA, 16 nt, Human
aaauaugcaaagcacu

SEQ ID NO: 2718280 - RNA, 15 nt, Human
aaauaugcaaagcac

SEQ ID NO: 2718281 - RNA, 13 nt, Human
aaauaugcaaagc

SEQ ID NO: 2718282 - RNA, 23 nt, Human
aaauaucugaaaauguaugugua

SEQ ID NO: 2718283 - RNA, 22 nt, Human
aaauaucugaaaauguaugugu

SEQ ID NO: 2718284 - RNA, 21 nt, Human
aaauaucugaaaauguaugug

SEQ ID NO: 2718285 - RNA, 19 nt, Human
aaauaucugaaaauguaug

SEQ ID NO: 2718286 - RNA, 18 nt, Human
aaauaucugaaaauguau

SEQ ID NO: 2718287 - RNA, 17 nt, Human
aaauaucugaaaaugua

SEQ ID NO: 2718288 - RNA, 14 nt, Human
aaauaucugaaaau

SEQ ID NO: 2718289 - RNA, 12 nt, Human
aaauaucugaaa

SEQ ID NO: 2718290 - RNA, 19 nt, Human
aaaucagccugcuccagcu

SEQ ID NO: 2718291 - RNA, 21 nt, Human
aaaucagccugcuccagcugu

SEQ ID NO: 2718292 - RNA, 20 nt, Human
aaauauuguguugugaaugu

SEQ ID NO: 2718293 - RNA, 23 nt, Human
aaaucagccugcuccagcuguuc

SEQ ID NO: 2718294 - RNA, 20 nt, Human
ggguuuuauuguuuaaaauc

SEQ ID NO: 2718295 - RNA, 20 nt, Human
ggguuuugccauguuggcca

SEQ ID NO: 2718296 - RNA, 23 nt, Human
ggguuuugccauguuggccaggc

SEQ ID NO: 2718297 - RNA, 18 nt, Human
gguaacuagggaagauaa

SEQ ID NO: 2718298 - RNA, 15 nt, Human
gggugggacacccug

SEQ ID NO: 2718299 - RNA, 18 nt, Human
gggugggacacccuguga

SEQ ID NO: 2718300 - RNA, 19 nt, Human
aaacuuaaucuaaauggaa

SEQ ID NO: 2718301 - RNA, 20 nt, Human
aaacguggcugcuucaagga

SEQ ID NO: 2718302 - RNA, 21 nt, Human
aaacguggcugcuucaaggau

SEQ ID NO: 2718303 - RNA, 19 nt, Human
aaacuguuaauaguucagg

SEQ ID NO: 2718304 - RNA, 14 nt, Human
ggucagugcaaaua

SEQ ID NO: 2718305 - RNA, 19 nt, Human
gguaucaggugcugccauc

SEQ ID NO: 2718306 - RNA, 21 nt, Human
aaacuucccuuucugcuugug

SEQ ID NO: 2718307 - RNA, 18 nt, Human
aaacuuuacuauggcccu

SEQ ID NO: 2718308 - RNA, 22 nt, Human
aaacuugauguguuaucucuua

SEQ ID NO: 2718309 - RNA, 20 nt, Human
gguaaggaauaccugucccc

SEQ ID NO: 2718310 - RNA, 20 nt, Human
gguaggguaagugagagagg

SEQ ID NO: 2718311 - RNA, 14 nt, Human
gguaucaggugcug

SEQ ID NO: 2718312 - RNA, 17 nt, Human
gggggaucacagccucu

SEQ ID NO: 2718313 - RNA, 11 nt, Human
gggggcuggga

SEQ ID NO: 2718314 - RNA, 13 nt, Human
ggggguggccucc

SEQ ID NO: 2718315 - RNA, 15 nt, Human
gggggcugggcagag

SEQ ID NO: 2718316 - RNA, 21 nt, Human
ggggucacucuggcagcucag

SEQ ID NO: 2718317 - RNA, 12 nt, Human
ggggaccagagc

SEQ ID NO: 2718318 - RNA, 13 nt, Human
ggggaccagagcu

SEQ ID NO: 2718319 - RNA, 18 nt, Human
aaaauguauguguaagua

SEQ ID NO: 2718320 - RNA, 19 nt, Human
ggggccaguuggucccccu

SEQ ID NO: 2718321 - RNA, 14 nt, Human
ggggaccagagcug

SEQ ID NO: 2718322 - RNA, 22 nt, Human
aaaccugugucucugagaguag

SEQ ID NO: 2718323 - RNA, 19 nt, Human
aaacauuuugucauauaag

SEQ ID NO: 2718324 - RNA, 14 nt, Human
gggucacucuggca

SEQ ID NO: 2718325 - RNA, 20 nt, Human
gggucacucuggcagcucag

SEQ ID NO: 2718326 - RNA, 14 nt, Human
aaaauacacacuca

SEQ ID NO: 2718327 - RNA, 16 nt, Human
aaaauaauuuuuauau

SEQ ID NO: 2718328 - RNA, 17 nt, Human
aaaauaauuuuuauauu

SEQ ID NO: 2718329 - RNA, 11 nt, Human
aaaauaauuuu

SEQ ID NO: 2718330 - RNA, 11 nt, Human
aaaaggcagga

SEQ ID NO: 2718331 - RNA, 17 nt, Human
aaaagguuaauaaagua

SEQ ID NO: 2718332 - RNA, 16 nt, Human
aaaagguuaauaaagu

SEQ ID NO: 2718333 - RNA, 22 nt, Human
aaaaggagccaauuuaaagaaa

SEQ ID NO: 2718334 - RNA, 13 nt, Human
aaaaggaugcaca

SEQ ID NO: 2718335 - RNA, 22 nt, Human
aaaaggaugcacagaguuguua

SEQ ID NO: 2718336 - RNA, 19 nt, Human
aaaaggaugcacagaguug

SEQ ID NO: 2718337 - RNA, 15 nt, Human
aaaaggaugcacaga

SEQ ID NO: 2718338 - RNA, 14 nt, Human
aaaaggaugcacag

SEQ ID NO: 2718339 - RNA, 17 nt, Human
aaaaucucaauauuuca

SEQ ID NO: 2718340 - RNA, 16 nt, Human
aaaauauuuuccugcc

SEQ ID NO: 2718341 - RNA, 18 nt, Human
aaaauauuuuaugaucca

SEQ ID NO: 2718342 - RNA, 15 nt, Human
aaaauauuuuaugau

SEQ ID NO: 2718343 - RNA, 16 nt, Human
aaaauauauuuaauga

SEQ ID NO: 2718344 - RNA, 15 nt, Human
aaaauauauuuaaug

SEQ ID NO: 2718345 - RNA, 20 nt, Human
aaaauggaagacagcucuua

SEQ ID NO: 2718346 - RNA, 16 nt, Human
aaaauggguuuuacug

SEQ ID NO: 2718347 - RNA, 17 nt, Human
gggcuggguucuaccca

SEQ ID NO: 2718348 - RNA, 20 nt, Human
gggcugcaccggcuggccug

SEQ ID NO: 2718349 - RNA, 21 nt, Human
gggcugcaccggcuggccugg

SEQ ID NO: 2718350 - RNA, 12 nt, Human
gggcugggcaga

SEQ ID NO: 2718351 - RNA, 15 nt, Human
gggcugggcagagga

SEQ ID NO: 2718352 - RNA, 17 nt, Human
gggcucagcggggacag

SEQ ID NO: 2718353 - RNA, 19 nt, Human
gggcucagcggggacagcu

SEQ ID NO: 2718354 - RNA, 22 nt, Human
gggcucagcaaaagaugcuucu

SEQ ID NO: 2718355 - RNA, 18 nt, Human
gggcuaguugggcuuccu

SEQ ID NO: 2718356 - RNA, 15 nt, Human
gggcuaguugggcuu

SEQ ID NO: 2718357 - RNA, 17 nt, Human
gggcugcaccggcuggc

SEQ ID NO: 2718358 - RNA, 19 nt, Human
gggcugcaccggcuggccu

SEQ ID NO: 2718359 - RNA, 21 nt, Human
gggcucagcggggacagcucc

SEQ ID NO: 2718360 - RNA, 10 nt, Human
gggcuccaga

SEQ ID NO: 2718361 - RNA, 13 nt, Human
gggcuccagacac

SEQ ID NO: 2718362 - RNA, 22 nt, Human
gggccucgguguggagaagcgg

SEQ ID NO: 2718363 - RNA, 18 nt, Human
gggccucuuaugggcugg

SEQ ID NO: 2718364 - RNA, 15 nt, Human
gggccucagugccac

SEQ ID NO: 2718365 - RNA, 13 nt, Human
gggccucagugcc

SEQ ID NO: 2718366 - RNA, 14 nt, Human
gggccucagugcca

SEQ ID NO: 2718367 - RNA, 21 nt, Human
gggcggugagaggggaacaga

SEQ ID NO: 2718368 - RNA, 13 nt, Human
gggccaggagccu

SEQ ID NO: 2718369 - RNA, 14 nt, Human
gggccaggagccuc

SEQ ID NO: 2718370 - RNA, 12 nt, Human
gggccaggagcc

SEQ ID NO: 2718371 - RNA, 17 nt, Human
aagggcuguuauaaucu

SEQ ID NO: 2718372 - RNA, 17 nt, Human
aaggggaauugaggaca

SEQ ID NO: 2718373 - RNA, 15 nt, Human
aagggcuguuauaau

SEQ ID NO: 2718374 - RNA, 16 nt, Human
aaggcugggggaagaa

SEQ ID NO: 2718375 - RNA, 14 nt, Human
aaggcugggggaag

SEQ ID NO: 2718376 - RNA, 13 nt, Human
guuucagaaaugu

SEQ ID NO: 2718377 - RNA, 11 nt, Human
guuucagaaau

SEQ ID NO: 2718378 - RNA, 19 nt, Human
aaggcugggggaagaagcu

SEQ ID NO: 2718379 - RNA, 22 nt, Human
aaggcugggggaagaagcucuc

SEQ ID NO: 2718380 - RNA, 20 nt, Human
aaggcugucaauuacaggaa

SEQ ID NO: 2718381 - RNA, 13 nt, Human
aaggggagaguaa

SEQ ID NO: 2718382 - RNA, 12 nt, Human
aagggggcuggg

SEQ ID NO: 2718383 - RNA, 23 nt, Human
aagggggcugggacaugggaaag

SEQ ID NO: 2718384 - RNA, 12 nt, Human
aaguaaaugcua

SEQ ID NO: 2718385 - RNA, 18 nt, Human
guuuaauauuaaagccau

SEQ ID NO: 2718386 - RNA, 15 nt, Human
guuuaauauuaaagc

SEQ ID NO: 2718387 - RNA, 14 nt, Human
guuuaauauuaaag

SEQ ID NO: 2718388 - RNA, 13 nt, Human
guuuaauauuaaa

SEQ ID NO: 2718389 - RNA, 17 nt, Human
guuuauuacaguauaau

SEQ ID NO: 2718390 - RNA, 13 nt, Human
guuuauuacagua

SEQ ID NO: 2718391 - RNA, 17 nt, Human
guuucaaacuuuacuau

SEQ ID NO: 2718392 - RNA, 12 nt, Human
guuguuuguuua

SEQ ID NO: 2718393 - RNA, 21 nt, Human
guuuaagugacugauggcuaa

SEQ ID NO: 2718394 - RNA, 12 nt, Human
aaggaaaaguuu

SEQ ID NO: 2718395 - RNA, 17 nt, Human
aaggaaacccagcucug

SEQ ID NO: 2718396 - RNA, 22 nt, Human
aaggaaacccagcucuggucca

SEQ ID NO: 2718397 - RNA, 16 nt, Human
aaggaaacccagcucu

SEQ ID NO: 2718398 - RNA, 20 nt, Human
guuguuugauucagacagcu

SEQ ID NO: 2718399 - RNA, 23 nt, Human
guuguuugauucagacagcugcc

SEQ ID NO: 2718400 - RNA, 18 nt, Human
aaguauguuagugcaaau

SEQ ID NO: 2718401 - RNA, 19 nt, Human
aaguauguuagugcaaauu

SEQ ID NO: 2718402 - RNA, 19 nt, Human
aaguauguguaaaauguga

SEQ ID NO: 2718403 - RNA, 15 nt, Human
aaguauuauaccuuu

SEQ ID NO: 2718404 - RNA, 18 nt, Human
aaguacuucuccacccug

SEQ ID NO: 2718405 - RNA, 19 nt, Human
aaguacuucuccacccugc

SEQ ID NO: 2718406 - RNA, 20 nt, Human
aaguacuucuccacccugcu

SEQ ID NO: 2718407 - RNA, 13 nt, Human
aaguacuauguau

SEQ ID NO: 2718408 - RNA, 17 nt, Human
aaguacuauaauuuacc

SEQ ID NO: 2718409 - RNA, 14 nt, Human
aaguacuauaauuu

SEQ ID NO: 2718410 - RNA, 18 nt, Human
aagucagaucugccuaag

SEQ ID NO: 2718411 - RNA, 22 nt, Human
aagucagaucugccuaaggacu

SEQ ID NO: 2718412 - RNA, 21 nt, Human
aagucagaucugccuaaggac

SEQ ID NO: 2718413 - RNA, 23 nt, Human
aaguauucuuauuuaaugaaaga

SEQ ID NO: 2718414 - RNA, 21 nt, Human
aaguauucuuauuuaaugaaa

SEQ ID NO: 2718415 - RNA, 19 nt, Human
aaguauuauaccuuuuuua

SEQ ID NO: 2718416 - RNA, 16 nt, Human
aaguauuauaccuuuu

SEQ ID NO: 2718417 - RNA, 15 nt, Human
guuuuaaagcuucca

SEQ ID NO: 2718418 - RNA, 19 nt, Human
guuuggacaaaauggaaua

SEQ ID NO: 2718419 - RNA, 18 nt, Human
guuuggaccaaaaaccag

SEQ ID NO: 2718420 - RNA, 21 nt, Human
aaguaauaugcacacauuuuu

SEQ ID NO: 2718421 - RNA, 17 nt, Human
aaguaauaugcacacau

SEQ ID NO: 2718422 - RNA, 20 nt, Human
aaguaauaugcacacauuuu

SEQ ID NO: 2718423 - RNA, 18 nt, Human
aaguaauaugcacacauu

SEQ ID NO: 2718424 - RNA, 12 nt, Human
guuuucuguucu

SEQ ID NO: 2718425 - RNA, 14 nt, Human
guuuucuguucuuu

SEQ ID NO: 2718426 - RNA, 16 nt, Human
guuuucuguucuuucu

SEQ ID NO: 2718427 - RNA, 15 nt, Human
guuuucuguucuuuc

SEQ ID NO: 2718428 - RNA, 22 nt, Human
guuuuaaggaugcuuguacaua

SEQ ID NO: 2718429 - RNA, 20 nt, Human
aaguuugagaucagccuggg

SEQ ID NO: 2718430 - RNA, 11 nt, Human
uaaaaugugaa

SEQ ID NO: 2718431 - RNA, 13 nt, Human
uaaaaugugaagu

SEQ ID NO: 2718432 - RNA, 19 nt, Human
aaguuauuuuuaauuuggu

SEQ ID NO: 2718433 - RNA, 19 nt, Human
aaguuucugccgcagcccu

SEQ ID NO: 2718434 - RNA, 21 nt, Human
aaguuucugccgcagcccugc

SEQ ID NO: 2718435 - RNA, 13 nt, Human
aagugugguagag

SEQ ID NO: 2718436 - RNA, 23 nt, Human
aaguguauuuuuuuacuaauaga

SEQ ID NO: 2718437 - RNA, 22 nt, Human
uaaaauaauuuuuauauuugaa

SEQ ID NO: 2718438 - RNA, 21 nt, Human
uaaaauacacacucaaaucaa

SEQ ID NO: 2718439 - RNA, 13 nt, Human
uaaaagaauauuu

SEQ ID NO: 2718440 - RNA, 19 nt, Human
uaaaaggugaccaaugaug

SEQ ID NO: 2718441 - RNA, 13 nt, Human
uaaaagucuugug

SEQ ID NO: 2718442 - RNA, 13 nt, Human
aagugauccuccc

SEQ ID NO: 2718443 - RNA, 19 nt, Human
aagugauccucccaccuca

SEQ ID NO: 2718444 - RNA, 20 nt, Human
aagugauccucccaccucag

SEQ ID NO: 2718445 - RNA, 23 nt, Human
aagugauccucccaccucagccu

SEQ ID NO: 2718446 - RNA, 20 nt, Human
aagugauucuccugccucag

SEQ ID NO: 2718447 - RNA, 18 nt, Human
uaaaaaaaaaauugggga

SEQ ID NO: 2718448 - RNA, 14 nt, Human
uaaaaaaaaaauug

SEQ ID NO: 2718449 - RNA, 19 nt, Human
uaaaaagccugcaauuuca

SEQ ID NO: 2718450 - RNA, 22 nt, Human
uaaaaagccugcaauuucauau

SEQ ID NO: 2718451 - RNA, 23 nt, Human
aagucagaucugccuaaggacuu

SEQ ID NO: 2718452 - RNA, 14 nt, Human
uaaaaauauugugu

SEQ ID NO: 2718453 - RNA, 15 nt, Human
uaaaaccacagcagu

SEQ ID NO: 2718454 - RNA, 13 nt, Human
uaaaaccacagca

SEQ ID NO: 2718455 - RNA, 14 nt, Human
uaaaaccacagcag

SEQ ID NO: 2718456 - RNA, 22 nt, Human
uaaaaaugagguacucuccugg

SEQ ID NO: 2718457 - RNA, 15 nt, Human
uaaaaaugagguacu

SEQ ID NO: 2718458 - RNA, 23 nt, Human
uaaaaaucucaaauuucuaaauc

SEQ ID NO: 2718459 - RNA, 21 nt, Human
uaaaaauauuguguugugaau

SEQ ID NO: 2718460 - RNA, 22 nt, Human
uaaaaauauuguguugugaaug

SEQ ID NO: 2718461 - RNA, 13 nt, Human
uaaaacccaagug

SEQ ID NO: 2718462 - RNA, 15 nt, Human
uaaaacuuuuuaaaa

SEQ ID NO: 2718463 - RNA, 12 nt, Human
uaaaacuuuuua

SEQ ID NO: 2718464 - RNA, 16 nt, Human
aagcacuaaacaaaga

SEQ ID NO: 2718465 - RNA, 17 nt, Human
aagcaccuccugccucg

SEQ ID NO: 2718466 - RNA, 17 nt, Human
aagcacugacuucuaag

SEQ ID NO: 2718467 - RNA, 16 nt, Human
aagcacugacuucuaa

SEQ ID NO: 2718468 - RNA, 21 nt, Human
aagcacaugccucucucaggc

SEQ ID NO: 2718469 - RNA, 13 nt, Human
aagcaccuccugc

SEQ ID NO: 2718470 - RNA, 14 nt, Human
aagcaccuccugcc

SEQ ID NO: 2718471 - RNA, 15 nt, Human
aagcaccuccugccu

SEQ ID NO: 2718472 - RNA, 16 nt, Human
aagcaccuccugccuc

SEQ ID NO: 2718473 - RNA, 14 nt, Human
aagcacaugccucu

SEQ ID NO: 2718474 - RNA, 15 nt, Human
aagcacaugccucuc

SEQ ID NO: 2718475 - RNA, 16 nt, Human
aagcacaugccucucu

SEQ ID NO: 2718476 - RNA, 19 nt, Human
aagcacaugccucucucag

SEQ ID NO: 2718477 - RNA, 20 nt, Human
aagcacaugccucucucagg

SEQ ID NO: 2718478 - RNA, 16 nt, Human
aagcacacuugacauc

SEQ ID NO: 2718479 - RNA, 12 nt, Human
guguuugaagca

SEQ ID NO: 2718480 - RNA, 19 nt, Human
aagcauuguaaaugugcuu

SEQ ID NO: 2718481 - RNA, 20 nt, Human
aagccaaagcuaggccuggc

SEQ ID NO: 2718482 - RNA, 17 nt, Human
aagccaaagcuaggccu

SEQ ID NO: 2718483 - RNA, 18 nt, Human
aagccaaagcuaggccug

SEQ ID NO: 2718484 - RNA, 15 nt, Human
aagccauguuuauua

SEQ ID NO: 2718485 - RNA, 17 nt, Human
aagccauguuuauuaca

SEQ ID NO: 2718486 - RNA, 16 nt, Human
aagccauguuuauuac

SEQ ID NO: 2718487 - RNA, 20 nt, Human
aagcacugacuucuaaguaa

SEQ ID NO: 2718488 - RNA, 19 nt, Human
aagcacugacuucuaagua

SEQ ID NO: 2718489 - RNA, 23 nt, Human
aagcauauauuuuuauauuuacu

SEQ ID NO: 2718490 - RNA, 18 nt, Human
aagcauuguaaaugugcu

SEQ ID NO: 2718491 - RNA, 12 nt, Human
aagcaugugaga

SEQ ID NO: 2718492 - RNA, 23 nt, Human
aagaucaaaagguuaauaaagua

SEQ ID NO: 2718493 - RNA, 20 nt, Human
aagaucaaaagguuaauaaa

SEQ ID NO: 2718494 - RNA, 22 nt, Human
gugucuuaauuaaaagaauauu

SEQ ID NO: 2718495 - RNA, 19 nt, Human
gugucagguggggcagcuu

SEQ ID NO: 2718496 - RNA, 23 nt, Human
gugugaaccaccacacccagccc

SEQ ID NO: 2718497 - RNA, 22 nt, Human
gugucaccugaagacucauucu

SEQ ID NO: 2718498 - RNA, 14 nt, Human
gugucagguggggc

SEQ ID NO: 2718499 - RNA, 18 nt, Human
gugucagguggggcagcu

SEQ ID NO: 2718500 - RNA, 14 nt, Human
gugucaccugaaga

SEQ ID NO: 2718501 - RNA, 14 nt, Human
aagauagcagggca

SEQ ID NO: 2718502 - RNA, 15 nt, Human
aagauagcagggcau

SEQ ID NO: 2718503 - RNA, 22 nt, Human
aagagggucugaggaauccaga

SEQ ID NO: 2718504 - RNA, 14 nt, Human
aagaggcagggucu

SEQ ID NO: 2718505 - RNA, 11 nt, Human
aagaggcaggg

SEQ ID NO: 2718506 - RNA, 21 nt, Human
aagagggagggagggcuccag

SEQ ID NO: 2718507 - RNA, 22 nt, Human
aagagggagggagggcuccaga

SEQ ID NO: 2718508 - RNA, 22 nt, Human
guguaaauacaauuuuguuucu

SEQ ID NO: 2718509 - RNA, 21 nt, Human
guguaaauacaauuuuguuuc

SEQ ID NO: 2718510 - RNA, 18 nt, Human
guguaaauacaauuuugu

SEQ ID NO: 2718511 - RNA, 15 nt, Human
guguaaaaugugaag

SEQ ID NO: 2718512 - RNA, 15 nt, Human
gugguuucagaaaug

SEQ ID NO: 2718513 - RNA, 23 nt, Human
gugcugcccugcccaccuggccu

SEQ ID NO: 2718514 - RNA, 19 nt, Human
guuauuauauuuacaaaug

SEQ ID NO: 2718515 - RNA, 19 nt, Human
guuagagguucccuuugac

SEQ ID NO: 2718516 - RNA, 18 nt, Human
guuagagauuuuuuuguu

SEQ ID NO: 2718517 - RNA, 17 nt, Human
guuauuauauuuacaaa

SEQ ID NO: 2718518 - RNA, 22 nt, Human
guuauugauaaguucauacauu

SEQ ID NO: 2718519 - RNA, 21 nt, Human
guuauugauaaguucauacau

SEQ ID NO: 2718520 - RNA, 19 nt, Human
guuaauuccaauuauauga

SEQ ID NO: 2718521 - RNA, 18 nt, Human
guuaaucauuagguguga

SEQ ID NO: 2718522 - RNA, 23 nt, Human
aagccauguuuauuacaguauaa

SEQ ID NO: 2718523 - RNA, 22 nt, Human
aagccauguuuauuacaguaua

SEQ ID NO: 2718524 - RNA, 21 nt, Human
aagccauguuuauuacaguau

SEQ ID NO: 2718525 - RNA, 20 nt, Human
aagccauguuuauuacagua

SEQ ID NO: 2718526 - RNA, 21 nt, Human
aagccuuggggcugaugcagu

SEQ ID NO: 2718527 - RNA, 16 nt, Human
aagccucccacgacug

SEQ ID NO: 2718528 - RNA, 15 nt, Human
aagccuccuccagcc

SEQ ID NO: 2718529 - RNA, 23 nt, Human
guucagcuuguaaauagcucagg

SEQ ID NO: 2718530 - RNA, 20 nt, Human
guucaggguuggccccugcc

SEQ ID NO: 2718531 - RNA, 21 nt, Human
guucaggguuggccccugccc

SEQ ID NO: 2718532 - RNA, 22 nt, Human
guucaggguuggccccugcccg

SEQ ID NO: 2718533 - RNA, 21 nt, Human
aagccgugauuuucauugcug

SEQ ID NO: 2718534 - RNA, 17 nt, Human
guucagguaacaggcag

SEQ ID NO: 2718535 - RNA, 18 nt, Human
guucagguaacaggcaga

SEQ ID NO: 2718536 - RNA, 18 nt, Human
guucccuugaugaagaag

SEQ ID NO: 2718537 - RNA, 19 nt, Human
guucuagcauggcauauuu

SEQ ID NO: 2718538 - RNA, 22 nt, Human
guucuagcauggcauauuuuuc

SEQ ID NO: 2718539 - RNA, 21 nt, Human
guucccuuuuuuggcugcuga

SEQ ID NO: 2718540 - RNA, 22 nt, Human
guucccuuuuuuggcugcugaa

SEQ ID NO: 2718541 - RNA, 18 nt, Human
aagcuuauuaaaacucau

SEQ ID NO: 2718542 - RNA, 17 nt, Human
aagcucugcuccucucc

SEQ ID NO: 2718543 - RNA, 15 nt, Human
guucucucuucucca

SEQ ID NO: 2718544 - RNA, 12 nt, Human
guucucugagga

SEQ ID NO: 2718545 - RNA, 14 nt, Human
guucucugaggaca

SEQ ID NO: 2718546 - RNA, 13 nt, Human
guucucugcccuc

SEQ ID NO: 2718547 - RNA, 15 nt, Human
guucucugcccucca

SEQ ID NO: 2718548 - RNA, 13 nt, Human
guucucuccuucu

SEQ ID NO: 2718549 - RNA, 19 nt, Human
guucuagcauggcugccaa

SEQ ID NO: 2718550 - RNA, 13 nt, Human
guucuuaauucuu

SEQ ID NO: 2718551 - RNA, 17 nt, Human
guucucugcccuccaag

SEQ ID NO: 2718552 - RNA, 18 nt, Human
guucucugcccuccaaga

SEQ ID NO: 2718553 - RNA, 17 nt, Human
guucuuaauucuuagcu

SEQ ID NO: 2718554 - RNA, 14 nt, Human
guucuuaauucuua

SEQ ID NO: 2718555 - RNA, 14 nt, Human
guugauagcacaga

SEQ ID NO: 2718556 - RNA, 19 nt, Human
guugauagcacagacccug

SEQ ID NO: 2718557 - RNA, 18 nt, Human
guucuugguuuguaaauu

SEQ ID NO: 2718558 - RNA, 15 nt, Human
guucuugguuuguaa

SEQ ID NO: 2718559 - RNA, 14 nt, Human
guucuugguuugua

SEQ ID NO: 2718560 - RNA, 15 nt, Human
aaaugugcuuuuaaa

SEQ ID NO: 2718561 - RNA, 18 nt, Human
aaaugugccuucauuuuu

SEQ ID NO: 2718562 - RNA, 17 nt, Human
aaauuguauuacaaauc

SEQ ID NO: 2718563 - RNA, 17 nt, Human
aaauuccaagugauuga

SEQ ID NO: 2718564 - RNA, 18 nt, Human
guauucucuccuguaccu

SEQ ID NO: 2718565 - RNA, 19 nt, Human
guauucuagcuaauguaau

SEQ ID NO: 2718566 - RNA, 21 nt, Human
guauucuaaauuuuauaucuu

SEQ ID NO: 2718567 - RNA, 24 nt, Human
guauucuaaauuuuauaucuugua

SEQ ID NO: 2718568 - RNA, 23 nt, Human
guauuguacaaaguauuaagcau

SEQ ID NO: 2718569 - RNA, 22 nt, Human
guauuguacaaaguauuaagca

SEQ ID NO: 2718570 - RNA, 21 nt, Human
guauuguacaaaguauuaagc

SEQ ID NO: 2718571 - RNA, 19 nt, Human
guauuguacaaaguauuaa

SEQ ID NO: 2718572 - RNA, 21 nt, Human
aaaugucucuuuaaugucaca

SEQ ID NO: 2718573 - RNA, 14 nt, Human
gucaggaaagagaa

SEQ ID NO: 2718574 - RNA, 13 nt, Human
gucaggaaagaga

SEQ ID NO: 2718575 - RNA, 21 nt, Human
gucagaaguuucugccgcagc

SEQ ID NO: 2718576 - RNA, 21 nt, Human
gucacugcuuaacuucacaua

SEQ ID NO: 2718577 - RNA, 15 nt, Human
gucacugcuuaacuu

SEQ ID NO: 2718578 - RNA, 16 nt, Human
gucagguggggcagcu

SEQ ID NO: 2718579 - RNA, 17 nt, Human
gucagguggggcagcuu

SEQ ID NO: 2718580 - RNA, 18 nt, Human
gucagguggggcagcuug

SEQ ID NO: 2718581 - RNA, 22 nt, Human
gucagguggggcagcuugaggg

SEQ ID NO: 2718582 - RNA, 12 nt, Human
aaauuucuaaau

SEQ ID NO: 2718583 - RNA, 15 nt, Human
aaauuucuaaaucuc

SEQ ID NO: 2718584 - RNA, 13 nt, Human
aaauuucuaaauc

SEQ ID NO: 2718585 - RNA, 12 nt, Human
gucacaggcagg

SEQ ID NO: 2718586 - RNA, 22 nt, Human
gucaccaaaucagcugcuacua

SEQ ID NO: 2718587 - RNA, 18 nt, Human
gucacauuccugaacagg

SEQ ID NO: 2718588 - RNA, 22 nt, Human
gucaauuacaggaaguacugga

SEQ ID NO: 2718589 - RNA, 22 nt, Human
gucacucuggcagcucagagag

SEQ ID NO: 2718590 - RNA, 14 nt, Human
gucacugagacagc

SEQ ID NO: 2718591 - RNA, 15 nt, Human
gucacugagacagcc

SEQ ID NO: 2718592 - RNA, 16 nt, Human
gucacugagacagccc

SEQ ID NO: 2718593 - RNA, 12 nt, Human
gucaccaagccc

SEQ ID NO: 2718594 - RNA, 15 nt, Human
gucaccaagcccagu

SEQ ID NO: 2718595 - RNA, 23 nt, Human
gucacucuggcagcucagagagg

SEQ ID NO: 2718596 - RNA, 10 nt, Human
gucacugcuu

SEQ ID NO: 2718597 - RNA, 17 nt, Human
gucacugagacagcccg

SEQ ID NO: 2718598 - RNA, 18 nt, Human
gucacugagacagcccgg

SEQ ID NO: 2718599 - RNA, 21 nt, Human
gucacugagacagcccgggcu

SEQ ID NO: 2718600 - RNA, 23 nt, Human
gucacugagacagcccgggcucu

SEQ ID NO: 2718601 - RNA, 13 nt, Human
aacagucucagga

SEQ ID NO: 2718602 - RNA, 15 nt, Human
guccgugcuaaggac

SEQ ID NO: 2718603 - RNA, 17 nt, Human
guccgugcuaaggacuu

SEQ ID NO: 2718604 - RNA, 16 nt, Human
guccgugcuaaggacu

SEQ ID NO: 2718605 - RNA, 14 nt, Human
aacauaaaauacaa

SEQ ID NO: 2718606 - RNA, 14 nt, Human
aacagucucaggaa

SEQ ID NO: 2718607 - RNA, 12 nt, Human
aacauauauaac

SEQ ID NO: 2718608 - RNA, 16 nt, Human
aacauguuaaaccaug

SEQ ID NO: 2718609 - RNA, 15 nt, Human
aacauguuaaaccau

SEQ ID NO: 2718610 - RNA, 14 nt, Human
aacauguuaaacca

SEQ ID NO: 2718611 - RNA, 20 nt, Human
gucuauuuacggaacucaaa

SEQ ID NO: 2718612 - RNA, 22 nt, Human
gucuaugggacucaaugcacug

SEQ ID NO: 2718613 - RNA, 14 nt, Human
gucuaccugagggg

SEQ ID NO: 2718614 - RNA, 13 nt, Human
gucuaccugaggg

SEQ ID NO: 2718615 - RNA, 15 nt, Human
gucuaccugaggggc

SEQ ID NO: 2718616 - RNA, 16 nt, Human
gucuaccugaggggcc

SEQ ID NO: 2718617 - RNA, 12 nt, Human
gucgaggcagga

SEQ ID NO: 2718618 - RNA, 16 nt, Human
gucgaggacagggagg

SEQ ID NO: 2718619 - RNA, 14 nt, Human
guccucuuuucuga

SEQ ID NO: 2718620 - RNA, 19 nt, Human
guccugcugcaguugccag

SEQ ID NO: 2718621 - RNA, 17 nt, Human
guccugcugcaguugcc

SEQ ID NO: 2718622 - RNA, 16 nt, Human
guccuggcaugggaau

SEQ ID NO: 2718623 - RNA, 18 nt, Human
aacacagcaagggugaug

SEQ ID NO: 2718624 - RNA, 20 nt, Human
aacacagcaagggugauggg

SEQ ID NO: 2718625 - RNA, 17 nt, Human
aacacaacuauauuguu

SEQ ID NO: 2718626 - RNA, 19 nt, Human
aacacaaacgggcucagca

SEQ ID NO: 2718627 - RNA, 22 nt, Human
aaauuugaauuuuguguuagag

SEQ ID NO: 2718628 - RNA, 15 nt, Human
aaauuugaauuuugu

SEQ ID NO: 2718629 - RNA, 12 nt, Human
aaauuugaauuu

SEQ ID NO: 2718630 - RNA, 19 nt, Human
aaauuucuaaaucuccaaa

SEQ ID NO: 2718631 - RNA, 21 nt, Human
aacacucacauuuauucugcu

SEQ ID NO: 2718632 - RNA, 17 nt, Human
gucauuugagcagggcu

SEQ ID NO: 2718633 - RNA, 19 nt, Human
aacacuguucucugcccuc

SEQ ID NO: 2718634 - RNA, 16 nt, Human
aacacuguucucugcc

SEQ ID NO: 2718635 - RNA, 17 nt, Human
aacacuguucucugccc

SEQ ID NO: 2718636 - RNA, 18 nt, Human
aacacuguucucugcccu

SEQ ID NO: 2718637 - RNA, 19 nt, Human
gucauuugagcagggcuca

SEQ ID NO: 2718638 - RNA, 15 nt, Human
gucccaccccacaca

SEQ ID NO: 2718639 - RNA, 22 nt, Human
guccccaccgcagacaggacca

SEQ ID NO: 2718640 - RNA, 20 nt, Human
gucccaccccacacacgcca

SEQ ID NO: 2718641 - RNA, 18 nt, Human
guccccaccgcagacagg

SEQ ID NO: 2718642 - RNA, 18 nt, Human
guccccuguuuguuucug

SEQ ID NO: 2718643 - RNA, 22 nt, Human
guccccuguuuguuucugaaag

SEQ ID NO: 2718644 - RNA, 18 nt, Human
gucccuuacgugaguccu

SEQ ID NO: 2718645 - RNA, 19 nt, Human
gucccuuacgugaguccug

SEQ ID NO: 2718646 - RNA, 18 nt, Human
gucccugguggcagcuca

SEQ ID NO: 2718647 - RNA, 19 nt, Human
gucccugguggcagcucac

SEQ ID NO: 2718648 - RNA, 18 nt, Human
aacuucagcgguuuauau

SEQ ID NO: 2718649 - RNA, 22 nt, Human
aacuuccuuggacucauuuuaa

SEQ ID NO: 2718650 - RNA, 23 nt, Human
aacuuccuuggacucauuuuaaa

SEQ ID NO: 2718651 - RNA, 12 nt, Human
aacuugaaauuu

SEQ ID NO: 2718652 - RNA, 19 nt, Human
aacuugaaauuugaauuuu

SEQ ID NO: 2718653 - RNA, 18 nt, Human
aacuugaaauuugaauuu

SEQ ID NO: 2718654 - RNA, 13 nt, Human
aacuugaaauuug

SEQ ID NO: 2718655 - RNA, 17 nt, Human
aacugugaaguuuacau

SEQ ID NO: 2718656 - RNA, 19 nt, Human
aacugugaaguuuacauug

SEQ ID NO: 2718657 - RNA, 14 nt, Human
aacuucacauauug

SEQ ID NO: 2718658 - RNA, 22 nt, Human
aacuucaccauauuaccacaga

SEQ ID NO: 2718659 - RNA, 22 nt, Human
aacuucacauauugauuuccgu

SEQ ID NO: 2718660 - RNA, 23 nt, Human
gugauccucccaccucagccucc

SEQ ID NO: 2718661 - RNA, 19 nt, Human
gugcauuugaggucuguuc

SEQ ID NO: 2718662 - RNA, 17 nt, Human
gugcauuugaggucugu

SEQ ID NO: 2718663 - RNA, 23 nt, Human
gugccaaaaacaacaacaaaaug

SEQ ID NO: 2718664 - RNA, 21 nt, Human
gugcauuuggugguuucagaa

SEQ ID NO: 2718665 - RNA, 21 nt, Human
gugcacaugcacgugugugca

SEQ ID NO: 2718666 - RNA, 23 nt, Human
gugcacaagcuccaagcucccag

SEQ ID NO: 2718667 - RNA, 18 nt, Human
gugcaaugaccuuucaau

SEQ ID NO: 2718668 - RNA, 13 nt, Human
gugcacaagcucc

SEQ ID NO: 2718669 - RNA, 16 nt, Human
gugcacaagcuccaag

SEQ ID NO: 2718670 - RNA, 21 nt, Human
gugcacaagcuccaagcuccc

SEQ ID NO: 2718671 - RNA, 22 nt, Human
gugcuacaaaaacacagcaagg

SEQ ID NO: 2718672 - RNA, 21 nt, Human
gugcuacaaaaacacagcaag

SEQ ID NO: 2718673 - RNA, 15 nt, Human
gugcuaucuccccca

SEQ ID NO: 2718674 - RNA, 18 nt, Human
gugcuaucucccccagcc

SEQ ID NO: 2718675 - RNA, 16 nt, Human
gugcucugaucaucca

SEQ ID NO: 2718676 - RNA, 13 nt, Human
gugcucuggacag

SEQ ID NO: 2718677 - RNA, 14 nt, Human
gugcucuggacagg

SEQ ID NO: 2718678 - RNA, 12 nt, Human
gugcugcccugc

SEQ ID NO: 2718679 - RNA, 13 nt, Human
gugcugcccugcc

SEQ ID NO: 2718680 - RNA, 14 nt, Human
gugcugcccugccc

SEQ ID NO: 2718681 - RNA, 15 nt, Human
gugcugcccugccca

SEQ ID NO: 2718682 - RNA, 11 nt, Human
aagaaacauuu

SEQ ID NO: 2718683 - RNA, 22 nt, Human
aagaaaauaguggugugauuug

SEQ ID NO: 2718684 - RNA, 21 nt, Human
aagaaaauaguggugugauuu

SEQ ID NO: 2718685 - RNA, 15 nt, Human
aagaaaauaguggug

SEQ ID NO: 2718686 - RNA, 17 nt, Human
aagaaaaaugagccugg

SEQ ID NO: 2718687 - RNA, 18 nt, Human
aagaaaaaugagccuggc

SEQ ID NO: 2718688 - RNA, 14 nt, Human
aagaaaacaacuuc

SEQ ID NO: 2718689 - RNA, 19 nt, Human
aagaaaaaauauuuucccu

SEQ ID NO: 2718690 - RNA, 13 nt, Human
aagaaaaagaaaa

SEQ ID NO: 2718691 - RNA, 18 nt, Human
aagaaaaagaaaaagaaa

SEQ ID NO: 2718692 - RNA, 23 nt, Human
aacuuuaccuuuuuuauacauaa

SEQ ID NO: 2718693 - RNA, 22 nt, Human
aacuuuaccuuuuuuauacaua

SEQ ID NO: 2718694 - RNA, 21 nt, Human
aacuuuaccuuuuuuauacau

SEQ ID NO: 2718695 - RNA, 19 nt, Human
gucuuauauauuguagaua

SEQ ID NO: 2718696 - RNA, 14 nt, Human
gucuuaauuaaaag

SEQ ID NO: 2718697 - RNA, 18 nt, Human
gucuggaaugcaguggua

SEQ ID NO: 2718698 - RNA, 15 nt, Human
gucuggaaugcagug

SEQ ID NO: 2718699 - RNA, 16 nt, Human
gucuggaaugcagugg

SEQ ID NO: 2718700 - RNA, 23 nt, Human
gucuugucucagauuuuauuaug

SEQ ID NO: 2718701 - RNA, 17 nt, Human
gucucaaaaaaagaaaa

SEQ ID NO: 2718702 - RNA, 14 nt, Human
gucucaaaaaaaca

SEQ ID NO: 2718703 - RNA, 20 nt, Human
gucugacaggcaaugcuggc

SEQ ID NO: 2718704 - RNA, 15 nt, Human
gucugacaggcaaug

SEQ ID NO: 2718705 - RNA, 18 nt, Human
gucugacaggcaaugcug

SEQ ID NO: 2718706 - RNA, 12 nt, Human
gucugacaggca

SEQ ID NO: 2718707 - RNA, 13 nt, Human
gucugacaggcaa

SEQ ID NO: 2718708 - RNA, 14 nt, Human
gucugacaggcaau

SEQ ID NO: 2718709 - RNA, 21 nt, Human
aacucauuuuuguuuucauua

SEQ ID NO: 2718710 - RNA, 24 nt, Human
aacucauuuuuguuuucauuaucu

SEQ ID NO: 2718711 - RNA, 23 nt, Human
aacuauucaggagaguagaacag

SEQ ID NO: 2718712 - RNA, 17 nt, Human
aacuagggaagauaaua

SEQ ID NO: 2718713 - RNA, 12 nt, Human
aacguggcugcu

SEQ ID NO: 2718714 - RNA, 13 nt, Human
aacguggcugcuu

SEQ ID NO: 2718715 - RNA, 13 nt, Human
aacgucugugcca

SEQ ID NO: 2718716 - RNA, 14 nt, Human
aacgucuuaaauau

SEQ ID NO: 2718717 - RNA, 12 nt, Human
aacgucuuaaau

SEQ ID NO: 2718718 - RNA, 15 nt, Human
aacgucuuaaauauu

SEQ ID NO: 2718719 - RNA, 22 nt, Human
aacucuccucugcugcuggcug

SEQ ID NO: 2718720 - RNA, 23 nt, Human
aacucuccucugcugcuggcugg

SEQ ID NO: 2718721 - RNA, 16 nt, Human
aacugcauuggcuuug

SEQ ID NO: 2718722 - RNA, 22 nt, Human
aacugauuuuuuuuuccuucag

SEQ ID NO: 2718723 - RNA, 23 nt, Human
aacugauuuuuuuuuccuucagu

SEQ ID NO: 2718724 - RNA, 20 nt, Human
aacugauuuuuuuuuccuuc

SEQ ID NO: 2718725 - RNA, 21 nt, Human
aacugauuuuuuuuuccuuca

SEQ ID NO: 2718726 - RNA, 18 nt, Human
gugaggcucugcccuugg

SEQ ID NO: 2718727 - RNA, 17 nt, Human
gugagucaccaagccca

SEQ ID NO: 2718728 - RNA, 23 nt, Human
gugaguacuacaguccucccauc

SEQ ID NO: 2718729 - RNA, 19 nt, Human
gugagucaccaagcccagu

SEQ ID NO: 2718730 - RNA, 21 nt, Human
gugaguacuacaguccuccca

SEQ ID NO: 2718731 - RNA, 17 nt, Human
aacucuccucugcugcu

SEQ ID NO: 2718732 - RNA, 19 nt, Human
aacucuccucugcugcugg

SEQ ID NO: 2718733 - RNA, 21 nt, Human
aacucuccucugcugcuggcu

SEQ ID NO: 2718734 - RNA, 18 nt, Human
gugagacucugucucaaa

SEQ ID NO: 2718735 - RNA, 12 nt, Human
gugaggcucugc

SEQ ID NO: 2718736 - RNA, 13 nt, Human
gugaggcucugcc

SEQ ID NO: 2718737 - RNA, 14 nt, Human
gugaggcucugccc

SEQ ID NO: 2718738 - RNA, 15 nt, Human
gugaggcucugcccu

SEQ ID NO: 2718739 - RNA, 16 nt, Human
gugaggcucugcccuu

SEQ ID NO: 2718740 - RNA, 17 nt, Human
gugaggcucugcccuug

SEQ ID NO: 2718741 - RNA, 23 nt, Human
gugaauaauacaguaucucaggg

SEQ ID NO: 2718742 - RNA, 14 nt, Human
gugaaguuuacauu

SEQ ID NO: 2718743 - RNA, 23 nt, Human
gugacagaggcagccccauucug

SEQ ID NO: 2718744 - RNA, 20 nt, Human
gugacagagugagacucugu

SEQ ID NO: 2718745 - RNA, 22 nt, Human
gugacagagugagacucugucu

SEQ ID NO: 2718746 - RNA, 22 nt, Human
gugagacccugucucaaaaaaa

SEQ ID NO: 2718747 - RNA, 14 nt, Human
gugagacucugucu

SEQ ID NO: 2718748 - RNA, 16 nt, Human
gugagacucugucuca

SEQ ID NO: 2718749 - RNA, 12 nt, Human
gugacuuuggau

SEQ ID NO: 2718750 - RNA, 15 nt, Human
gugacuuuggauaau

SEQ ID NO: 2718751 - RNA, 19 nt, Human
gugacaugucuuuucuugc

SEQ ID NO: 2718752 - RNA, 15 nt, Human
uagggagagaagaua

SEQ ID NO: 2718753 - RNA, 14 nt, Human
uagggagagaagau

SEQ ID NO: 2718754 - RNA, 21 nt, Human
uagggaaggauacaaaagcau

SEQ ID NO: 2718755 - RNA, 16 nt, Human
uaggcauuugcugaau

SEQ ID NO: 2718756 - RNA, 20 nt, Human
uaggcauuugcugaauacag

SEQ ID NO: 2718757 - RNA, 14 nt, Human
uaggcauuguggga

SEQ ID NO: 2718758 - RNA, 18 nt, Human
uaggcaaccuuuauuuuu

SEQ ID NO: 2718759 - RNA, 18 nt, Human
uaggaaauauuuauuuua

SEQ ID NO: 2718760 - RNA, 19 nt, Human
uaggaaauauuuauuuuaa

SEQ ID NO: 2718761 - RNA, 23 nt, Human
acaauacaucccuuaccugggaa

SEQ ID NO: 2718762 - RNA, 13 nt, Human
acaagacugcaca

SEQ ID NO: 2718763 - RNA, 14 nt, Human
acaagacugcacau

SEQ ID NO: 2718764 - RNA, 18 nt, Human
acaagaccacguuucuaa

SEQ ID NO: 2718765 - RNA, 12 nt, Human
acaaugacuuac

SEQ ID NO: 2718766 - RNA, 18 nt, Human
acaaugacuuacuguaca

SEQ ID NO: 2718767 - RNA, 17 nt, Human
acaaugacuuacuguac

SEQ ID NO: 2718768 - RNA, 12 nt, Human
uagcuaauguaa

SEQ ID NO: 2718769 - RNA, 19 nt, Human
uagcuaauguaauaacugu

SEQ ID NO: 2718770 - RNA, 22 nt, Human
uagcuagacuggugacugauuc

SEQ ID NO: 2718771 - RNA, 21 nt, Human
uagcuagacuggugacugauu

SEQ ID NO: 2718772 - RNA, 18 nt, Human
acaaaaggauaaugaaua

SEQ ID NO: 2718773 - RNA, 22 nt, Human
acaaaagcaugugagacugguu

SEQ ID NO: 2718774 - RNA, 11 nt, Human
acaaaagcaug

SEQ ID NO: 2718775 - RNA, 22 nt, Human
acaaaggaugcccaaagaugca

SEQ ID NO: 2718776 - RNA, 22 nt, Human
uagagcaaaauugauguguuua

SEQ ID NO: 2718777 - RNA, 23 nt, Human
uagagauuuuuuuguuguuuguu

SEQ ID NO: 2718778 - RNA, 14 nt, Human
uagagcaaaauuga

SEQ ID NO: 2718779 - RNA, 21 nt, Human
uagagcaaaauugauguguuu

SEQ ID NO: 2718780 - RNA, 15 nt, Human
uagauauaugcucug

SEQ ID NO: 2718781 - RNA, 19 nt, Human
uagauauaugcucugcaug

SEQ ID NO: 2718782 - RNA, 15 nt, Human
uagaugcaguucuga

SEQ ID NO: 2718783 - RNA, 22 nt, Human
uagcauggcauauuuuucacau

SEQ ID NO: 2718784 - RNA, 19 nt, Human
uagcauggcugccaauggg

SEQ ID NO: 2718785 - RNA, 21 nt, Human
uagcauggcauauuuuucaca

SEQ ID NO: 2718786 - RNA, 22 nt, Human
uagcauuuugcuaaaugugaau

SEQ ID NO: 2718787 - RNA, 14 nt, Human
uagccaaggccaaa

SEQ ID NO: 2718788 - RNA, 21 nt, Human
uagccaaggccaaaggaagca

SEQ ID NO: 2718789 - RNA, 16 nt, Human
uagcauuuugcuaaau

SEQ ID NO: 2718790 - RNA, 19 nt, Human
acaagacccuugugguccc

SEQ ID NO: 2718791 - RNA, 19 nt, Human
acaagaccacguuucuaaa

SEQ ID NO: 2718792 - RNA, 23 nt, Human
acaacacucauugaccugaggcc

SEQ ID NO: 2718793 - RNA, 21 nt, Human
acaacacucauugaccugagg

SEQ ID NO: 2718794 - RNA, 11 nt, Human
uagccagagga

SEQ ID NO: 2718795 - RNA, 15 nt, Human
uagccagaggagaga

SEQ ID NO: 2718796 - RNA, 22 nt, Human
uagugaaacucguuaauuugua

SEQ ID NO: 2718797 - RNA, 23 nt, Human
uaguguuggagaagaacugaaau

SEQ ID NO: 2718798 - RNA, 13 nt, Human
acacagugagucg

SEQ ID NO: 2718799 - RNA, 19 nt, Human
acacaguauuacuucugcu

SEQ ID NO: 2718800 - RNA, 22 nt, Human
acacaguauuacuucugcuaca

SEQ ID NO: 2718801 - RNA, 18 nt, Human
acacaguauuacuucugc

SEQ ID NO: 2718802 - RNA, 16 nt, Human
acacaguauuacuucu

SEQ ID NO: 2718803 - RNA, 15 nt, Human
acacacucaaaucaa

SEQ ID NO: 2718804 - RNA, 21 nt, Human
acacacugcauguuugugauu

SEQ ID NO: 2718805 - RNA, 14 nt, Human
acacaccagagccc

SEQ ID NO: 2718806 - RNA, 15 nt, Human
acacaccagagccca

SEQ ID NO: 2718807 - RNA, 20 nt, Human
acacaccagagcccaccuug

SEQ ID NO: 2718808 - RNA, 21 nt, Human
acacacgcgugcacacaccag

SEQ ID NO: 2718809 - RNA, 22 nt, Human
acacacacgcgugcacacacca

SEQ ID NO: 2718810 - RNA, 17 nt, Human
acacacagcucuguccu

SEQ ID NO: 2718811 - RNA, 13 nt, Human
acacacagcucug

SEQ ID NO: 2718812 - RNA, 14 nt, Human
acacacagcucugu

SEQ ID NO: 2718813 - RNA, 18 nt, Human
acaaugcuguauuuuaaa

SEQ ID NO: 2718814 - RNA, 22 nt, Human
acaaugcuguauuuuaaaagaa

SEQ ID NO: 2718815 - RNA, 21 nt, Human
acaaugcugugcccuaaagug

SEQ ID NO: 2718816 - RNA, 24 nt, Human
acaaugcugugcccuaaaguguau

SEQ ID NO: 2718817 - RNA, 23 nt, Human
acaaugcugugcccuaaagugua

SEQ ID NO: 2718818 - RNA, 22 nt, Human
acaaugcugugcccuaaagugu

SEQ ID NO: 2718819 - RNA, 17 nt, Human
acaaugugaaaagaaaa

SEQ ID NO: 2718820 - RNA, 19 nt, Human
acaaugugaaaagaaaaau

SEQ ID NO: 2718821 - RNA, 14 nt, Human
acacacacauacac

SEQ ID NO: 2718822 - RNA, 19 nt, Human
acacucaaaucaagaaacu

SEQ ID NO: 2718823 - RNA, 15 nt, Human
acacucaaaagcugg

SEQ ID NO: 2718824 - RNA, 14 nt, Human
acacuaagagagaa

SEQ ID NO: 2718825 - RNA, 13 nt, Human
acacuaagagaga

SEQ ID NO: 2718826 - RNA, 20 nt, Human
acacucacauuuauucugcu

SEQ ID NO: 2718827 - RNA, 22 nt, Human
acacucacauuuauucugcuca

SEQ ID NO: 2718828 - RNA, 19 nt, Human
acaccucugcacaagcugc

SEQ ID NO: 2718829 - RNA, 21 nt, Human
acaccucugcacaagcugcac

SEQ ID NO: 2718830 - RNA, 16 nt, Human
acaccgggcacucaga

SEQ ID NO: 2718831 - RNA, 19 nt, Human
acacccugugauggggccc

SEQ ID NO: 2718832 - RNA, 20 nt, Human
acacuaaccacgcuggaccu

SEQ ID NO: 2718833 - RNA, 21 nt, Human
acacaugagcaucaggccagg

SEQ ID NO: 2718834 - RNA, 15 nt, Human
acacaugaaguccaa

SEQ ID NO: 2718835 - RNA, 15 nt, Human
acacaucagcuugcc

SEQ ID NO: 2718836 - RNA, 20 nt, Human
acacauuuuauuuuauuaug

SEQ ID NO: 2718837 - RNA, 19 nt, Human
acacauuuuauuuuauuau

SEQ ID NO: 2718838 - RNA, 14 nt, Human
acacauuuuauuuu

SEQ ID NO: 2718839 - RNA, 13 nt, Human
acacauuuuauuu

SEQ ID NO: 2718840 - RNA, 17 nt, Human
acaccauuaugugcgcu

SEQ ID NO: 2718841 - RNA, 21 nt, Human
acaccauuaugugcgcugaua

SEQ ID NO: 2718842 - RNA, 20 nt, Human
uaguuccaccaucaagccac

SEQ ID NO: 2718843 - RNA, 17 nt, Human
uaucucaaaacugcacu

SEQ ID NO: 2718844 - RNA, 23 nt, Human
uaucuauauuuuacauaaauuua

SEQ ID NO: 2718845 - RNA, 13 nt, Human
uaucucccccagc

SEQ ID NO: 2718846 - RNA, 14 nt, Human
uaucucccccagcc

SEQ ID NO: 2718847 - RNA, 11 nt, Human
acagagaaagu

SEQ ID NO: 2718848 - RNA, 18 nt, Human
acagagaaaguacuucuc

SEQ ID NO: 2718849 - RNA, 19 nt, Human
uauccaaaccaaauaaaaa

SEQ ID NO: 2718850 - RNA, 15 nt, Human
uaucuauauuuuaca

SEQ ID NO: 2718851 - RNA, 15 nt, Human
uauauuguuugcuaa

SEQ ID NO: 2718852 - RNA, 19 nt, Human
uauauuuacuaaaauggac

SEQ ID NO: 2718853 - RNA, 21 nt, Human
uauauuuacuaaaauggacug

SEQ ID NO: 2718854 - RNA, 20 nt, Human
uauauuuacuaaaauggacu

SEQ ID NO: 2718855 - RNA, 13 nt, Human
acagacccugccc

SEQ ID NO: 2718856 - RNA, 14 nt, Human
acagacccugcccu

SEQ ID NO: 2718857 - RNA, 15 nt, Human
acagacccugcccug

SEQ ID NO: 2718858 - RNA, 19 nt, Human
uauaauuuugugaagcaaa

SEQ ID NO: 2718859 - RNA, 17 nt, Human
acagaaauguacagcaa

SEQ ID NO: 2718860 - RNA, 16 nt, Human
acagaaauguacagca

SEQ ID NO: 2718861 - RNA, 14 nt, Human
acagaaauguacag

SEQ ID NO: 2718862 - RNA, 20 nt, Human
acagaaaauggaagacagcu

SEQ ID NO: 2718863 - RNA, 13 nt, Human
acagaaauguaca

SEQ ID NO: 2718864 - RNA, 17 nt, Human
acagaaaauucuucucc

SEQ ID NO: 2718865 - RNA, 16 nt, Human
acagccucuuagaugc

SEQ ID NO: 2718866 - RNA, 15 nt, Human
uaugcuuauacacuu

SEQ ID NO: 2718867 - RNA, 15 nt, Human
uaugcugaguuugug

SEQ ID NO: 2718868 - RNA, 17 nt, Human
uauggcuuuugugcauu

SEQ ID NO: 2718869 - RNA, 21 nt, Human
uauggcuuuugugcauuaucu

SEQ ID NO: 2718870 - RNA, 18 nt, Human
uauggcuuuugugcauua

SEQ ID NO: 2718871 - RNA, 19 nt, Human
uaugccccauucaacaucu

SEQ ID NO: 2718872 - RNA, 15 nt, Human
uaugccccauucaac

SEQ ID NO: 2718873 - RNA, 17 nt, Human
uaugccugggcagaagg

SEQ ID NO: 2718874 - RNA, 21 nt, Human
uaugauuaaguaaugauaacu

SEQ ID NO: 2718875 - RNA, 11 nt, Human
uaugcauuuga

SEQ ID NO: 2718876 - RNA, 24 nt, Human
uaugcauuugaaaauuuugauguu

SEQ ID NO: 2718877 - RNA, 23 nt, Human
uaugcauuugaaaauuuugaugu

SEQ ID NO: 2718878 - RNA, 16 nt, Human
uaugauuaaguaauga

SEQ ID NO: 2718879 - RNA, 20 nt, Human
uaugauuaaguaaugauaac

SEQ ID NO: 2718880 - RNA, 19 nt, Human
uaugaaauuauauaaguau

SEQ ID NO: 2718881 - RNA, 20 nt, Human
acagcccgggcucugccucc

SEQ ID NO: 2718882 - RNA, 18 nt, Human
acagcccgggcucugccu

SEQ ID NO: 2718883 - RNA, 19 nt, Human
acagcccgggcucugccuc

SEQ ID NO: 2718884 - RNA, 16 nt, Human
acagcaaggagauuua

SEQ ID NO: 2718885 - RNA, 21 nt, Human
acagcaaggagauuuacaacu

SEQ ID NO: 2718886 - RNA, 17 nt, Human
acagcccgggcucugcc

SEQ ID NO: 2718887 - RNA, 20 nt, Human
acagauuuccauccuaguca

SEQ ID NO: 2718888 - RNA, 17 nt, Human
acagcaaggagauuuac

SEQ ID NO: 2718889 - RNA, 14 nt, Human
acagagcccacgcc

SEQ ID NO: 2718890 - RNA, 15 nt, Human
acagagcccacgccc

SEQ ID NO: 2718891 - RNA, 18 nt, Human
acagagcccacgccccca

SEQ ID NO: 2718892 - RNA, 19 nt, Human
acagagcccacgcccccac

SEQ ID NO: 2718893 - RNA, 12 nt, Human
acaggcugggcu

SEQ ID NO: 2718894 - RNA, 22 nt, Human
acaggcugggcuucaguggcag

SEQ ID NO: 2718895 - RNA, 23 nt, Human
acaggcugggcuucaguggcagc

SEQ ID NO: 2718896 - RNA, 17 nt, Human
acagucaccucauggaa

SEQ ID NO: 2718897 - RNA, 18 nt, Human
acagucaccucauggaau

SEQ ID NO: 2718898 - RNA, 16 nt, Human
acagucaccucaugga

SEQ ID NO: 2718899 - RNA, 20 nt, Human
acaguauaauuaacauguua

SEQ ID NO: 2718900 - RNA, 15 nt, Human
acaguauaauuaaca

SEQ ID NO: 2718901 - RNA, 13 nt, Human
acaguauaauuaa

SEQ ID NO: 2718902 - RNA, 12 nt, Human
acagggcacacc

SEQ ID NO: 2718903 - RNA, 20 nt, Human
acagggcacaccgggcacuc

SEQ ID NO: 2718904 - RNA, 14 nt, Human
uauuacuguaagaa

SEQ ID NO: 2718905 - RNA, 13 nt, Human
uauuacuucugcu

SEQ ID NO: 2718906 - RNA, 14 nt, Human
uauuacuucugcua

SEQ ID NO: 2718907 - RNA, 15 nt, Human
uauucaaacagucuc

SEQ ID NO: 2718908 - RNA, 23 nt, Human
uauucaaacagucucaggaaauc

SEQ ID NO: 2718909 - RNA, 16 nt, Human
uauucaaaguugccua

SEQ ID NO: 2718910 - RNA, 13 nt, Human
uauucaaaguugc

SEQ ID NO: 2718911 - RNA, 12 nt, Human
uauucaaaguug

SEQ ID NO: 2718912 - RNA, 20 nt, Human
uauucaguaauaacucuacc

SEQ ID NO: 2718913 - RNA, 14 nt, Human
uauucaggaagcuc

SEQ ID NO: 2718914 - RNA, 13 nt, Human
acaggaaguacug

SEQ ID NO: 2718915 - RNA, 22 nt, Human
acaggaaccacaagacugcaca

SEQ ID NO: 2718916 - RNA, 17 nt, Human
acaggaaaagcugcuga

SEQ ID NO: 2718917 - RNA, 15 nt, Human
acaggaaaagcugcu

SEQ ID NO: 2718918 - RNA, 16 nt, Human
acaggaaaagcugcug

SEQ ID NO: 2718919 - RNA, 13 nt, Human
acagcuaacaugg

SEQ ID NO: 2718920 - RNA, 14 nt, Human
acaggcauguucuc

SEQ ID NO: 2718921 - RNA, 14 nt, Human
acaggcagguccag

SEQ ID NO: 2718922 - RNA, 16 nt, Human
acaggcagguccaggg

SEQ ID NO: 2718923 - RNA, 16 nt, Human
acaggagugagcacua

SEQ ID NO: 2718924 - RNA, 14 nt, Human
acaggaucagucug

SEQ ID NO: 2718925 - RNA, 13 nt, Human
acaggcaggucca

SEQ ID NO: 2718926 - RNA, 23 nt, Human
acaggaccagggauuuccaugau

SEQ ID NO: 2718927 - RNA, 21 nt, Human
uauguuuucaggcuagaugua

SEQ ID NO: 2718928 - RNA, 14 nt, Human
uaugugugaaguga

SEQ ID NO: 2718929 - RNA, 12 nt, Human
uaugugugaagu

SEQ ID NO: 2718930 - RNA, 16 nt, Human
uauuaaaacucauuuu

SEQ ID NO: 2718931 - RNA, 22 nt, Human
acaggcauguucucugaggaca

SEQ ID NO: 2718932 - RNA, 15 nt, Human
acaggcauguucucu

SEQ ID NO: 2718933 - RNA, 18 nt, Human
acaggcauguucucugag

SEQ ID NO: 2718934 - RNA, 19 nt, Human
acaggcauguucucugagg

SEQ ID NO: 2718935 - RNA, 20 nt, Human
acaggcauguucucugagga

SEQ ID NO: 2718936 - RNA, 20 nt, Human
uauguggaguucaucuugaa

SEQ ID NO: 2718937 - RNA, 22 nt, Human
uaugugaacaguuguguuugaa

SEQ ID NO: 2718938 - RNA, 12 nt, Human
uaugugaacagu

SEQ ID NO: 2718939 - RNA, 18 nt, Human
uacuguacaugaaaacac

SEQ ID NO: 2718940 - RNA, 22 nt, Human
uacuguacaugaaaacacauuu

SEQ ID NO: 2718941 - RNA, 23 nt, Human
uacuguaauuugugauacaaugc

SEQ ID NO: 2718942 - RNA, 21 nt, Human
uacuguacaugaaaacacauu

SEQ ID NO: 2718943 - RNA, 13 nt, Human
aauugauguguuu

SEQ ID NO: 2718944 - RNA, 14 nt, Human
aauugauguguuua

SEQ ID NO: 2718945 - RNA, 14 nt, Human
uacuguaagaaaau

SEQ ID NO: 2718946 - RNA, 18 nt, Human
uacuguaauuugugauac

SEQ ID NO: 2718947 - RNA, 20 nt, Human
uacuguaauuugugauacaa

SEQ ID NO: 2718948 - RNA, 19 nt, Human
uacuguaauuugugauaca

SEQ ID NO: 2718949 - RNA, 14 nt, Human
uacuggauuguacu

SEQ ID NO: 2718950 - RNA, 16 nt, Human
uacuggagaaaaugga

SEQ ID NO: 2718951 - RNA, 12 nt, Human
uacucuguguca

SEQ ID NO: 2718952 - RNA, 13 nt, Human
uacuacuccugua

SEQ ID NO: 2718953 - RNA, 17 nt, Human
uacuacuccuguaggaa

SEQ ID NO: 2718954 - RNA, 23 nt, Human
uacuauggcccuggccuagcaua

SEQ ID NO: 2718955 - RNA, 13 nt, Human
uacuauguaucaa

SEQ ID NO: 2718956 - RNA, 12 nt, Human
uacuauguauca

SEQ ID NO: 2718957 - RNA, 23 nt, Human
uacucuccuggaaauauuaagaa

SEQ ID NO: 2718958 - RNA, 22 nt, Human
uacucuccuggaaauauuaaga

SEQ ID NO: 2718959 - RNA, 14 nt, Human
uacuauguaucaau

SEQ ID NO: 2718960 - RNA, 22 nt, Human
uacgccaggggaaaaucagccu

SEQ ID NO: 2718961 - RNA, 18 nt, Human
uacgggaggguaaggcug

SEQ ID NO: 2718962 - RNA, 12 nt, Human
uacguacacauu

SEQ ID NO: 2718963 - RNA, 16 nt, Human
uacguugugcauuugg

SEQ ID NO: 2718964 - RNA, 15 nt, Human
uacguugugcauuug

SEQ ID NO: 2718965 - RNA, 13 nt, Human
uacguacacauuu

SEQ ID NO: 2718966 - RNA, 14 nt, Human
aauuccccacccug

SEQ ID NO: 2718967 - RNA, 12 nt, Human
aauuccccagau

SEQ ID NO: 2718968 - RNA, 18 nt, Human
aauuccaagugauugaaa

SEQ ID NO: 2718969 - RNA, 15 nt, Human
aauucagaaggaucu

SEQ ID NO: 2718970 - RNA, 16 nt, Human
aauuauuuuguucaua

SEQ ID NO: 2718971 - RNA, 18 nt, Human
aauuauuuuguucauaca

SEQ ID NO: 2718972 - RNA, 19 nt, Human
aauuauuuuguucauacau

SEQ ID NO: 2718973 - RNA, 20 nt, Human
aauuauuuuguucauacaua

SEQ ID NO: 2718974 - RNA, 21 nt, Human
aauuauuuuguucauacauau

SEQ ID NO: 2718975 - RNA, 22 nt, Human
aauuauuuuguucauacauauu

SEQ ID NO: 2718976 - RNA, 19 nt, Human
uacauuguacgaagaguau

SEQ ID NO: 2718977 - RNA, 23 nt, Human
uaccugccaggaagccagcaggc

SEQ ID NO: 2718978 - RNA, 18 nt, Human
uaccugccaggaagccag

SEQ ID NO: 2718979 - RNA, 20 nt, Human
uaccugccaggaagccagca

SEQ ID NO: 2718980 - RNA, 10 nt, Human
uaccuguccc

SEQ ID NO: 2718981 - RNA, 13 nt, Human
uaccugucccccu

SEQ ID NO: 2718982 - RNA, 14 nt, Human
uaccugucccccug

SEQ ID NO: 2718983 - RNA, 16 nt, Human
uaccugucccccugac

SEQ ID NO: 2718984 - RNA, 17 nt, Human
uaccugucccccugaca

SEQ ID NO: 2718985 - RNA, 11 nt, Human
aauuacaggaa

SEQ ID NO: 2718986 - RNA, 15 nt, Human
aauuagccaagugug

SEQ ID NO: 2718987 - RNA, 16 nt, Human
aaugcuguauuuuaaa

SEQ ID NO: 2718988 - RNA, 13 nt, Human
aaugcuguguuaa

SEQ ID NO: 2718989 - RNA, 11 nt, Human
aaugcccagcc

SEQ ID NO: 2718990 - RNA, 12 nt, Human
aaugcccagccc

SEQ ID NO: 2718991 - RNA, 21 nt, Human
aauggacguguuaugacucca

SEQ ID NO: 2718992 - RNA, 14 nt, Human
aauggaaccacucu

SEQ ID NO: 2718993 - RNA, 23 nt, Human
aauggacguguuaugacuccaga

SEQ ID NO: 2718994 - RNA, 20 nt, Human
aauggacuaacuugucuuug

SEQ ID NO: 2718995 - RNA, 20 nt, Human
aauggaaaugggcagagcag

SEQ ID NO: 2718996 - RNA, 21 nt, Human
aauggaaaugggcagagcaga

SEQ ID NO: 2718997 - RNA, 21 nt, Human
aaugcacuuuguucuggcucu

SEQ ID NO: 2718998 - RNA, 21 nt, Human
uacaaugcugugcccuaaagu

SEQ ID NO: 2718999 - RNA, 18 nt, Human
aaugaccuuucaauagga

SEQ ID NO: 2719000 - RNA, 16 nt, Human
aaugaccuuucaauag

SEQ ID NO: 2719001 - RNA, 17 nt, Human
aaugaccuuucaauagg

SEQ ID NO: 2719002 - RNA, 22 nt, Human
aaugcacuuuguucuggcucuu

SEQ ID NO: 2719003 - RNA, 23 nt, Human
aaugccaucaauaaaaaauuaug

SEQ ID NO: 2719004 - RNA, 21 nt, Human
aaugccaucaauaaaaaauua

SEQ ID NO: 2719005 - RNA, 16 nt, Human
aaugccaucaauaaaa

SEQ ID NO: 2719006 - RNA, 14 nt, Human
uacacuaagagaga

SEQ ID NO: 2719007 - RNA, 18 nt, Human
uacacuaagagagaauga

SEQ ID NO: 2719008 - RNA, 15 nt, Human
uacacuaaaagguga

SEQ ID NO: 2719009 - RNA, 23 nt, Human
uacacauuuuauuuuauuaugca

SEQ ID NO: 2719010 - RNA, 19 nt, Human
uacacauuuuauuuuauua

SEQ ID NO: 2719011 - RNA, 22 nt, Human
uacacauuuuauuuuauuaugc

SEQ ID NO: 2719012 - RNA, 21 nt, Human
uacacauuuuauuuuauuaug

SEQ ID NO: 2719013 - RNA, 22 nt, Human
uacagacaacaaaccuguuucu

SEQ ID NO: 2719014 - RNA, 19 nt, Human
uacagacaaagcguggugg

SEQ ID NO: 2719015 - RNA, 12 nt, Human
aauggcagccuu

SEQ ID NO: 2719016 - RNA, 16 nt, Human
aauggcagccuuggca

SEQ ID NO: 2719017 - RNA, 16 nt, Human
aauggacuguggugac

SEQ ID NO: 2719018 - RNA, 20 nt, Human
uacaucccuuaccugggaaa

SEQ ID NO: 2719019 - RNA, 16 nt, Human
uacaggugugagucac

SEQ ID NO: 2719020 - RNA, 23 nt, Human
uacaggucauauuaauauauuuc

SEQ ID NO: 2719021 - RNA, 24 nt, Human
uacauaaugcgugcauaccacuuu

SEQ ID NO: 2719022 - RNA, 23 nt, Human
uacauaaugcgugcauaccacuu

SEQ ID NO: 2719023 - RNA, 21 nt, Human
uacauaaugcgugcauaccac

SEQ ID NO: 2719024 - RNA, 19 nt, Human
aauguauguguaaguauuc

SEQ ID NO: 2719025 - RNA, 20 nt, Human
aauguauguguaaguauucu

SEQ ID NO: 2719026 - RNA, 17 nt, Human
aaugugaaaagaaaaau

SEQ ID NO: 2719027 - RNA, 22 nt, Human
aauguauuacaguggggaauga

SEQ ID NO: 2719028 - RNA, 19 nt, Human
aaugugaaaagaaaaauga

SEQ ID NO: 2719029 - RNA, 14 nt, Human
aaugugaaacugga

SEQ ID NO: 2719030 - RNA, 15 nt, Human
aaugugaaacuggau

SEQ ID NO: 2719031 - RNA, 18 nt, Human
uaccaccagucugacugu

SEQ ID NO: 2719032 - RNA, 17 nt, Human
uacauuguaaauaguau

SEQ ID NO: 2719033 - RNA, 13 nt, Human
uacauucuguuaa

SEQ ID NO: 2719034 - RNA, 21 nt, Human
aauguucucucuucuccaccu

SEQ ID NO: 2719035 - RNA, 11 nt, Human
aauuaacuuuu

SEQ ID NO: 2719036 - RNA, 20 nt, Human
aauuaacauguuaaaccaug

SEQ ID NO: 2719037 - RNA, 19 nt, Human
aauuaacauguuaaaccau

SEQ ID NO: 2719038 - RNA, 13 nt, Human
aauguuaagcaga

SEQ ID NO: 2719039 - RNA, 15 nt, Human
aaucauuagguguga

SEQ ID NO: 2719040 - RNA, 23 nt, Human
aaucauuaggugugacugaauuu

SEQ ID NO: 2719041 - RNA, 17 nt, Human
aaucauuaggugugacu

SEQ ID NO: 2719042 - RNA, 19 nt, Human
aaucuuauaauuuaaaaua

SEQ ID NO: 2719043 - RNA, 22 nt, Human
aaucugugaacuugaaauuuga

SEQ ID NO: 2719044 - RNA, 21 nt, Human
aaucugugaacuugaaauuug

SEQ ID NO: 2719045 - RNA, 20 nt, Human
aaucugugaacuugaaauuu

SEQ ID NO: 2719046 - RNA, 19 nt, Human
uaaguaaugauaacuggaa

SEQ ID NO: 2719047 - RNA, 16 nt, Human
uaaggaaaaguuuaau

SEQ ID NO: 2719048 - RNA, 13 nt, Human
uaaguaaaugcua

SEQ ID NO: 2719049 - RNA, 16 nt, Human
uaagcuuguauuccuu

SEQ ID NO: 2719050 - RNA, 19 nt, Human
uaaguauucuuauuuaaug

SEQ ID NO: 2719051 - RNA, 16 nt, Human
uaaguauucuaaauuu

SEQ ID NO: 2719052 - RNA, 20 nt, Human
uaaguauucuuauuuaauga

SEQ ID NO: 2719053 - RNA, 17 nt, Human
uaaguacuauguaucaa

SEQ ID NO: 2719054 - RNA, 16 nt, Human
uaaguacuauguauca

SEQ ID NO: 2719055 - RNA, 13 nt, Human
uaaguacuaugua

SEQ ID NO: 2719056 - RNA, 12 nt, Human
aaucaugaauua

SEQ ID NO: 2719057 - RNA, 15 nt, Human
aaucaugaauuaguu

SEQ ID NO: 2719058 - RNA, 13 nt, Human
uaaucuuucacag

SEQ ID NO: 2719059 - RNA, 17 nt, Human
uaaugaaugaaacauuu

SEQ ID NO: 2719060 - RNA, 12 nt, Human
uaauagagcaaa

SEQ ID NO: 2719061 - RNA, 21 nt, Human
uaauagagcaaaauugaugug

SEQ ID NO: 2719062 - RNA, 22 nt, Human
uaauagacaauuuauuauggca

SEQ ID NO: 2719063 - RNA, 18 nt, Human
uaauagacaauuuauuau

SEQ ID NO: 2719064 - RNA, 14 nt, Human
uaauacaccacuac

SEQ ID NO: 2719065 - RNA, 16 nt, Human
uaauacaccacuacau

SEQ ID NO: 2719066 - RNA, 16 nt, Human
uaauagacaauuuauu

SEQ ID NO: 2719067 - RNA, 14 nt, Human
uaauagacaauuua

SEQ ID NO: 2719068 - RNA, 19 nt, Human
uaauacaccacuacauucu

SEQ ID NO: 2719069 - RNA, 18 nt, Human
uaauacaccacuacauuc

SEQ ID NO: 2719070 - RNA, 13 nt, Human
aaugaaugucagu

SEQ ID NO: 2719071 - RNA, 15 nt, Human
aaugaccuuucaaua

SEQ ID NO: 2719072 - RNA, 22 nt, Human
aaugaaugucagugugacugau

SEQ ID NO: 2719073 - RNA, 17 nt, Human
aaugaaacauuuuguca

SEQ ID NO: 2719074 - RNA, 19 nt, Human
aaugaaacacucaguuguu

SEQ ID NO: 2719075 - RNA, 17 nt, Human
aaugaaagacuguacaa

SEQ ID NO: 2719076 - RNA, 16 nt, Human
aaugaaagacuguaca

SEQ ID NO: 2719077 - RNA, 17 nt, Human
aaugaaaccugugucuc

SEQ ID NO: 2719078 - RNA, 18 nt, Human
uaaugucacaggcagguc

SEQ ID NO: 2719079 - RNA, 13 nt, Human
uaauguacugcau

SEQ ID NO: 2719080 - RNA, 18 nt, Human
uaauguaauaacugugaa

SEQ ID NO: 2719081 - RNA, 18 nt, Human
aauauuuauuuuaauaau

SEQ ID NO: 2719082 - RNA, 19 nt, Human
aauauuuauuuuaauaaug

SEQ ID NO: 2719083 - RNA, 17 nt, Human
aauauuguguugugaau

SEQ ID NO: 2719084 - RNA, 21 nt, Human
aauaugccccauucaacaucu

SEQ ID NO: 2719085 - RNA, 24 nt, Human
aauaugccccauucaacaucuagu

SEQ ID NO: 2719086 - RNA, 22 nt, Human
aauaugcacacauuuuuuaaau

SEQ ID NO: 2719087 - RNA, 17 nt, Human
aauaugcacacauuuuu

SEQ ID NO: 2719088 - RNA, 16 nt, Human
aauaugcacacauuuu

SEQ ID NO: 2719089 - RNA, 15 nt, Human
uaagagaaaugagcu

SEQ ID NO: 2719090 - RNA, 22 nt, Human
aaucaggguuaguauuguccag

SEQ ID NO: 2719091 - RNA, 16 nt, Human
aaucaggguuaguauu

SEQ ID NO: 2719092 - RNA, 21 nt, Human
aaucaggguuaguauugucca

SEQ ID NO: 2719093 - RNA, 22 nt, Human
uaagcuguuacugucuucagua

SEQ ID NO: 2719094 - RNA, 18 nt, Human
uaagcacacuugacauca

SEQ ID NO: 2719095 - RNA, 20 nt, Human
aauaucacuugucaauaaaa

SEQ ID NO: 2719096 - RNA, 22 nt, Human
aauaucacuugucaauaaaauc

SEQ ID NO: 2719097 - RNA, 12 nt, Human
uaacauaaaucu

SEQ ID NO: 2719098 - RNA, 18 nt, Human
uaacauggacaugaucuu

SEQ ID NO: 2719099 - RNA, 23 nt, Human
uaacauggacaugaucuucuuua

SEQ ID NO: 2719100 - RNA, 16 nt, Human
aauagucaaauugugu

SEQ ID NO: 2719101 - RNA, 20 nt, Human
aauaguauuugagaguucua

SEQ ID NO: 2719102 - RNA, 22 nt, Human
aauaguauuugagaguucuaaa

SEQ ID NO: 2719103 - RNA, 22 nt, Human
aauaguggugugauuuggggau

SEQ ID NO: 2719104 - RNA, 16 nt, Human
aauaguggugugauuu

SEQ ID NO: 2719105 - RNA, 23 nt, Human
aauaguauuugagaguucuaaau

SEQ ID NO: 2719106 - RNA, 13 nt, Human
aauaguuggcuag

SEQ ID NO: 2719107 - RNA, 20 nt, Human
uaacgauaaaagacagugaa

SEQ ID NO: 2719108 - RNA, 13 nt, Human
uaacuucacauau

SEQ ID NO: 2719109 - RNA, 21 nt, Human
uaacuucacauauugauuucc

SEQ ID NO: 2719110 - RNA, 17 nt, Human
uaacuuccaauuuacau

SEQ ID NO: 2719111 - RNA, 14 nt, Human
uaacuucaccauau

SEQ ID NO: 2719112 - RNA, 14 nt, Human
accagucugacugu

SEQ ID NO: 2719113 - RNA, 23 nt, Human
accaguauuguacaaaguauuaa

SEQ ID NO: 2719114 - RNA, 17 nt, Human
accaguguuguggauuu

SEQ ID NO: 2719115 - RNA, 15 nt, Human
accaguguuguggau

SEQ ID NO: 2719116 - RNA, 10 nt, Human
ucacuugagu

SEQ ID NO: 2719117 - RNA, 22 nt, Human
accaguauuguacaaaguauua

SEQ ID NO: 2719118 - RNA, 20 nt, Human
accaguauuguacaaaguau

SEQ ID NO: 2719119 - RNA, 15 nt, Human
accaguauuguacaa

SEQ ID NO: 2719120 - RNA, 14 nt, Human
accaguauuguaca

SEQ ID NO: 2719121 - RNA, 23 nt, Human
ucacuguugcccaggcuggcgug

SEQ ID NO: 2719122 - RNA, 19 nt, Human
ucacuguugcccaggcugg

SEQ ID NO: 2719123 - RNA, 15 nt, Human
ucacugcagccucaa

SEQ ID NO: 2719124 - RNA, 13 nt, Human
ucacugcagccuc

SEQ ID NO: 2719125 - RNA, 16 nt, Human
ucacugagacagcccg

SEQ ID NO: 2719126 - RNA, 14 nt, Human
ucacugcagccuca

SEQ ID NO: 2719127 - RNA, 22 nt, Human
ucacugagacagcccgggcucu

SEQ ID NO: 2719128 - RNA, 17 nt, Human
ucacugagacagcccgg

SEQ ID NO: 2719129 - RNA, 21 nt, Human
ucacugagacagcccgggcuc

SEQ ID NO: 2719130 - RNA, 12 nt, Human
ucaccucaugga

SEQ ID NO: 2719131 - RNA, 13 nt, Human
ucaccucauggaa

SEQ ID NO: 2719132 - RNA, 14 nt, Human
ucaccucauggaau

SEQ ID NO: 2719133 - RNA, 20 nt, Human
ucaccugucuugccuuuuuc

SEQ ID NO: 2719134 - RNA, 19 nt, Human
ucaccugucuugccuuuuu

SEQ ID NO: 2719135 - RNA, 22 nt, Human
accagcgugugacuacuccccc

SEQ ID NO: 2719136 - RNA, 17 nt, Human
accacuacauucuguua

SEQ ID NO: 2719137 - RNA, 15 nt, Human
accacuacauucugu

SEQ ID NO: 2719138 - RNA, 16 nt, Human
accacuacauucuguu

SEQ ID NO: 2719139 - RNA, 21 nt, Human
ucacaacagauuauuaccuua

SEQ ID NO: 2719140 - RNA, 17 nt, Human
ucacaaaggaugcccaa

SEQ ID NO: 2719141 - RNA, 16 nt, Human
ucaauucuugccaaau

SEQ ID NO: 2719142 - RNA, 13 nt, Human
ucacagccucuga

SEQ ID NO: 2719143 - RNA, 16 nt, Human
ucacaguucucuccuu

SEQ ID NO: 2719144 - RNA, 20 nt, Human
ucacaguucucuccuucuuc

SEQ ID NO: 2719145 - RNA, 20 nt, Human
ucacagaugggugcuuggag

SEQ ID NO: 2719146 - RNA, 17 nt, Human
accacaucuugcucugc

SEQ ID NO: 2719147 - RNA, 18 nt, Human
accacaucuugcucugcu

SEQ ID NO: 2719148 - RNA, 19 nt, Human
accacaucuugcucugcug

SEQ ID NO: 2719149 - RNA, 18 nt, Human
accacaugugcacaugca

SEQ ID NO: 2719150 - RNA, 16 nt, Human
accacaucuugcucug

SEQ ID NO: 2719151 - RNA, 15 nt, Human
accaccacacccagc

SEQ ID NO: 2719152 - RNA, 20 nt, Human
accaccacacccagcccacu

SEQ ID NO: 2719153 - RNA, 14 nt, Human
ucacauaucuagua

SEQ ID NO: 2719154 - RNA, 18 nt, Human
ucaauauccaaaccaaau

SEQ ID NO: 2719155 - RNA, 22 nt, Human
ucaaguccucuuuucugagagg

SEQ ID NO: 2719156 - RNA, 17 nt, Human
ucaagaaaacaacuuca

SEQ ID NO: 2719157 - RNA, 19 nt, Human
acauucuuccaaaaagauu

SEQ ID NO: 2719158 - RNA, 15 nt, Human
ucaauauuucagaua

SEQ ID NO: 2719159 - RNA, 19 nt, Human
ucaauauuucagauaauca

SEQ ID NO: 2719160 - RNA, 23 nt, Human
accaaaaaucucaauauuucaga

SEQ ID NO: 2719161 - RNA, 21 nt, Human
acauuuuuuaaaugcaccugg

SEQ ID NO: 2719162 - RNA, 17 nt, Human
acauuuuuuaaaugcac

SEQ ID NO: 2719163 - RNA, 16 nt, Human
acauuuuuuaaaugca

SEQ ID NO: 2719164 - RNA, 14 nt, Human
acauuuuuuaaaug

SEQ ID NO: 2719165 - RNA, 19 nt, Human
acauuuuuaagugcugcau

SEQ ID NO: 2719166 - RNA, 23 nt, Human
acauuuuuaagugcugcauuuaa

SEQ ID NO: 2719167 - RNA, 22 nt, Human
acauuuuuaagugcugcauuua

SEQ ID NO: 2719168 - RNA, 21 nt, Human
acauuuuuaagugcugcauuu

SEQ ID NO: 2719169 - RNA, 20 nt, Human
acauuuuauuuuauuaugca

SEQ ID NO: 2719170 - RNA, 19 nt, Human
acauuuuauuuuauuaugc

SEQ ID NO: 2719171 - RNA, 14 nt, Human
acauuuuauuuuau

SEQ ID NO: 2719172 - RNA, 18 nt, Human
acauuuuauuuuauuaug

SEQ ID NO: 2719173 - RNA, 18 nt, Human
ucaaauugugugaaaggu

SEQ ID NO: 2719174 - RNA, 15 nt, Human
ucaaauugugugaaa

SEQ ID NO: 2719175 - RNA, 14 nt, Human
acauuccugaugcu

SEQ ID NO: 2719176 - RNA, 15 nt, Human
acauuccugaacagg

SEQ ID NO: 2719177 - RNA, 14 nt, Human
acauuccugaacag

SEQ ID NO: 2719178 - RNA, 23 nt, Human
acauguaauuaaguacuauguau

SEQ ID NO: 2719179 - RNA, 15 nt, Human
acauguccaagaagc

SEQ ID NO: 2719180 - RNA, 20 nt, Human
ucaacugcaucaagauguga

SEQ ID NO: 2719181 - RNA, 14 nt, Human
ucaaccagcagaug

SEQ ID NO: 2719182 - RNA, 13 nt, Human
ucaaauuucuaaa

SEQ ID NO: 2719183 - RNA, 21 nt, Human
acaugcuacacacugcauguu

SEQ ID NO: 2719184 - RNA, 15 nt, Human
acaugcuacacacug

SEQ ID NO: 2719185 - RNA, 16 nt, Human
acaugaaguccaagca

SEQ ID NO: 2719186 - RNA, 21 nt, Human
acaugggacauuugcucaugg

SEQ ID NO: 2719187 - RNA, 15 nt, Human
acaugggacauuugc

SEQ ID NO: 2719188 - RNA, 20 nt, Human
acaugggacauuugcucaug

SEQ ID NO: 2719189 - RNA, 11 nt, Human
acaugggacau

SEQ ID NO: 2719190 - RNA, 14 nt, Human
acaugggacauuug

SEQ ID NO: 2719191 - RNA, 22 nt, Human
acauggcuggagcuagaauuug

SEQ ID NO: 2719192 - RNA, 15 nt, Human
acauguaauuaagua

SEQ ID NO: 2719193 - RNA, 22 nt, Human
acauguaauuaaguacuaugua

SEQ ID NO: 2719194 - RNA, 21 nt, Human
acauguaauuaaguacuaugu

SEQ ID NO: 2719195 - RNA, 19 nt, Human
acauguaauuaaguacuau

SEQ ID NO: 2719196 - RNA, 17 nt, Human
acauguaauuaaguacu

SEQ ID NO: 2719197 - RNA, 17 nt, Human
ucaguuuuugugaaaag

SEQ ID NO: 2719198 - RNA, 22 nt, Human
ucauaaaaagccugcaauuuca

SEQ ID NO: 2719199 - RNA, 15 nt, Human
ucaguuuuugugaaa

SEQ ID NO: 2719200 - RNA, 12 nt, Human
ucaguggcagcu

SEQ ID NO: 2719201 - RNA, 11 nt, Human
ucaguggcagc

SEQ ID NO: 2719202 - RNA, 18 nt, Human
ucagugccuuauggaaca

SEQ ID NO: 2719203 - RNA, 16 nt, Human
ucagugccuuauggaa

SEQ ID NO: 2719204 - RNA, 9 nt, Human
ucagugccu

SEQ ID NO: 2719205 - RNA, 10 nt, Human
ucagugccuu

SEQ ID NO: 2719206 - RNA, 11 nt, Human
ucagugccuua

SEQ ID NO: 2719207 - RNA, 12 nt, Human
ucagugccuuau

SEQ ID NO: 2719208 - RNA, 14 nt, Human
ucagugccuuaugg

SEQ ID NO: 2719209 - RNA, 15 nt, Human
ucagugccuuaugga

SEQ ID NO: 2719210 - RNA, 17 nt, Human
accgaaaacguggcugc

SEQ ID NO: 2719211 - RNA, 19 nt, Human
accgaaaacguggcugcuu

SEQ ID NO: 2719212 - RNA, 12 nt, Human
ucagugccacua

SEQ ID NO: 2719213 - RNA, 16 nt, Human
ucagugccaaaaacaa

SEQ ID NO: 2719214 - RNA, 15 nt, Human
ucauauuuucaugcu

SEQ ID NO: 2719215 - RNA, 23 nt, Human
ucauauuuacuucuuauacauuu

SEQ ID NO: 2719216 - RNA, 15 nt, Human
ucauauuuacuucuu

SEQ ID NO: 2719217 - RNA, 15 nt, Human
ucauaguaugguggc

SEQ ID NO: 2719218 - RNA, 18 nt, Human
ucauaguaugguggcugg

SEQ ID NO: 2719219 - RNA, 19 nt, Human
ucauaguaugguggcuggg

SEQ ID NO: 2719220 - RNA, 14 nt, Human
ucauaaccuagccu

SEQ ID NO: 2719221 - RNA, 18 nt, Human
ucauauaagauucauauu

SEQ ID NO: 2719222 - RNA, 21 nt, Human
ucauaguaugguggcuggguu

SEQ ID NO: 2719223 - RNA, 16 nt, Human
accuagggugauauua

SEQ ID NO: 2719224 - RNA, 16 nt, Human
accucaaaaugucuaa

SEQ ID NO: 2719225 - RNA, 17 nt, Human
accgcagacaggaccag

SEQ ID NO: 2719226 - RNA, 12 nt, Human
accgcagacagg

SEQ ID NO: 2719227 - RNA, 16 nt, Human
accgcagacaggacca

SEQ ID NO: 2719228 - RNA, 20 nt, Human
accucccacaaaggagagcu

SEQ ID NO: 2719229 - RNA, 17 nt, Human
ucaugaaagauucaaug

SEQ ID NO: 2719230 - RNA, 16 nt, Human
ucaugaaagauucaau

SEQ ID NO: 2719231 - RNA, 12 nt, Human
acccgggaaggg

SEQ ID NO: 2719232 - RNA, 13 nt, Human
acccgggaagggg

SEQ ID NO: 2719233 - RNA, 22 nt, Human
acccggccccugcugguucagg

SEQ ID NO: 2719234 - RNA, 17 nt, Human
acccggccccugcuggu

SEQ ID NO: 2719235 - RNA, 20 nt, Human
acccggccccugcugguuca

SEQ ID NO: 2719236 - RNA, 23 nt, Human
ucagguaacaggcagauacagga

SEQ ID NO: 2719237 - RNA, 21 nt, Human
ucagguaacaggcagauacag

SEQ ID NO: 2719238 - RNA, 22 nt, Human
ucagguaacaggcagauacagg

SEQ ID NO: 2719239 - RNA, 14 nt, Human
acccggccccugcu

SEQ ID NO: 2719240 - RNA, 15 nt, Human
acccggccccugcug

SEQ ID NO: 2719241 - RNA, 16 nt, Human
acccggccccugcugg

SEQ ID NO: 2719242 - RNA, 20 nt, Human
ucaggccaggcccucugccc

SEQ ID NO: 2719243 - RNA, 21 nt, Human
ucaggccaggcccucugccca

SEQ ID NO: 2719244 - RNA, 22 nt, Human
ucaggccaggcccucugcccac

SEQ ID NO: 2719245 - RNA, 14 nt, Human
ucagcuccagcuca

SEQ ID NO: 2719246 - RNA, 21 nt, Human
ucagcuuguaaauagcucagg

SEQ ID NO: 2719247 - RNA, 22 nt, Human
ucagcuuguaaauagcucaggu

SEQ ID NO: 2719248 - RNA, 23 nt, Human
ucaggccaggcccucugcccacu

SEQ ID NO: 2719249 - RNA, 16 nt, Human
ucaggguuggccccug

SEQ ID NO: 2719250 - RNA, 19 nt, Human
ucagggucccugguggcag

SEQ ID NO: 2719251 - RNA, 16 nt, Human
acccugaaagcccuga

SEQ ID NO: 2719252 - RNA, 18 nt, Human
acccugaaagcccugagc

SEQ ID NO: 2719253 - RNA, 14 nt, Human
acccugaggcccag

SEQ ID NO: 2719254 - RNA, 17 nt, Human
acccugcccugugggcc

SEQ ID NO: 2719255 - RNA, 22 nt, Human
acccugcccugugggcccccaa

SEQ ID NO: 2719256 - RNA, 15 nt, Human
acccugaggcccaga

SEQ ID NO: 2719257 - RNA, 16 nt, Human
acccugaggcccagag

SEQ ID NO: 2719258 - RNA, 15 nt, Human
acccugcccuguggg

SEQ ID NO: 2719259 - RNA, 15 nt, Human
accgaaaacguggcu

SEQ ID NO: 2719260 - RNA, 17 nt, Human
acccuugccgucuaccu

SEQ ID NO: 2719261 - RNA, 20 nt, Human
acccuuguggucccacccca

SEQ ID NO: 2719262 - RNA, 23 nt, Human
acccuuguggucccaccccacac

SEQ ID NO: 2719263 - RNA, 19 nt, Human
acccaggagccccgaggcc

SEQ ID NO: 2719264 - RNA, 23 nt, Human
acccaggagccccgaggccuucu

SEQ ID NO: 2719265 - RNA, 17 nt, Human
accccacacacgccaga

SEQ ID NO: 2719266 - RNA, 13 nt, Human
accccagccccaa

SEQ ID NO: 2719267 - RNA, 22 nt, Human
accccagccccaaaacucuccu

SEQ ID NO: 2719268 - RNA, 21 nt, Human
ucagauuugaacucuucaauc

SEQ ID NO: 2719269 - RNA, 12 nt, Human
ucagauuugaac

SEQ ID NO: 2719270 - RNA, 18 nt, Human
accaguguuguggauuua

SEQ ID NO: 2719271 - RNA, 15 nt, Human
ucagcaaaagaugcu

SEQ ID NO: 2719272 - RNA, 20 nt, Human
ucagcaaaaauauuuuauga

SEQ ID NO: 2719273 - RNA, 19 nt, Human
ucagcaaaaauauuuuaug

SEQ ID NO: 2719274 - RNA, 22 nt, Human
ucagauuuuauuauguaaaucc

SEQ ID NO: 2719275 - RNA, 23 nt, Human
ucagauuuuauuauguaaauccc

SEQ ID NO: 2719276 - RNA, 12 nt, Human
ucagcuccagcu

SEQ ID NO: 2719277 - RNA, 19 nt, Human
ucagcggggacagcuccuu

SEQ ID NO: 2719278 - RNA, 20 nt, Human
ucagcggggacagcuccuuc

SEQ ID NO: 2719279 - RNA, 21 nt, Human
ucagcggggacagcuccuucu

SEQ ID NO: 2719280 - RNA, 23 nt, Human
ucagcggggacagcuccuucugu

SEQ ID NO: 2719281 - RNA, 18 nt, Human
ucagcggggacagcuccu

SEQ ID NO: 2719282 - RNA, 14 nt, Human
accccugcuucuga

SEQ ID NO: 2719283 - RNA, 18 nt, Human
accccaucucuacaaaaa

SEQ ID NO: 2719284 - RNA, 13 nt, Human
acucaccccagcc

SEQ ID NO: 2719285 - RNA, 16 nt, Human
acucaccccagcccca

SEQ ID NO: 2719286 - RNA, 14 nt, Human
acucaccccagccc

SEQ ID NO: 2719287 - RNA, 15 nt, Human
acucaccccagcccc

SEQ ID NO: 2719288 - RNA, 12 nt, Human
acuccugcaggc

SEQ ID NO: 2719289 - RNA, 14 nt, Human
acuccugcaggcag

SEQ ID NO: 2719290 - RNA, 22 nt, Human
acuccugcaggcagccaggcca

SEQ ID NO: 2719291 - RNA, 15 nt, Human
acuccugcaggcagc

SEQ ID NO: 2719292 - RNA, 16 nt, Human
acuccugcaggcagcc

SEQ ID NO: 2719293 - RNA, 11 nt, Human
acuccuggccu

SEQ ID NO: 2719294 - RNA, 16 nt, Human
ucccugguggcagcuc

SEQ ID NO: 2719295 - RNA, 17 nt, Human
ucccugguggcagcuca

SEQ ID NO: 2719296 - RNA, 18 nt, Human
ucccugguggcagcucac

SEQ ID NO: 2719297 - RNA, 19 nt, Human
ucccugguggcagcucacc

SEQ ID NO: 2719298 - RNA, 20 nt, Human
ucccugguggcagcucaccu

SEQ ID NO: 2719299 - RNA, 21 nt, Human
ucccugguggcagcucaccuc

SEQ ID NO: 2719300 - RNA, 22 nt, Human
ucccugguggcagcucaccucu

SEQ ID NO: 2719301 - RNA, 19 nt, Human
ucccuuggauuguccccga

SEQ ID NO: 2719302 - RNA, 20 nt, Human
ucccuuggauuguccccgac

SEQ ID NO: 2719303 - RNA, 16 nt, Human
ucccuuugacgccauc

SEQ ID NO: 2719304 - RNA, 18 nt, Human
ucccuuugacgccauccc

SEQ ID NO: 2719305 - RNA, 23 nt, Human
ucccuuuuuuggcugcugaaggc

SEQ ID NO: 2719306 - RNA, 20 nt, Human
ucccuuuuuuggcugcugaa

SEQ ID NO: 2719307 - RNA, 22 nt, Human
ucccuuuuuuggcugcugaagg

SEQ ID NO: 2719308 - RNA, 19 nt, Human
ucccuuugacgccauccca

SEQ ID NO: 2719309 - RNA, 17 nt, Human
ucccuuuuuuggcugcu

SEQ ID NO: 2719310 - RNA, 19 nt, Human
ucccuuuuuuggcugcuga

SEQ ID NO: 2719311 - RNA, 13 nt, Human
uccuaggcauuug

SEQ ID NO: 2719312 - RNA, 12 nt, Human
acuccuggccuc

SEQ ID NO: 2719313 - RNA, 13 nt, Human
acuccuggccuca

SEQ ID NO: 2719314 - RNA, 14 nt, Human
acuccuggccucaa

SEQ ID NO: 2719315 - RNA, 15 nt, Human
uccuacucuguguca

SEQ ID NO: 2719316 - RNA, 13 nt, Human
uccuacucugugu

SEQ ID NO: 2719317 - RNA, 14 nt, Human
uccuacucuguguc

SEQ ID NO: 2719318 - RNA, 21 nt, Human
acucuuaagaagacugcauua

SEQ ID NO: 2719319 - RNA, 16 nt, Human
acucuuauaucuauau

SEQ ID NO: 2719320 - RNA, 18 nt, Human
acucuuauaucuauauuu

SEQ ID NO: 2719321 - RNA, 17 nt, Human
acucuuauaucuauauu

SEQ ID NO: 2719322 - RNA, 14 nt, Human
acucuugaccucag

SEQ ID NO: 2719323 - RNA, 19 nt, Human
acucuuauaucuauauuuu

SEQ ID NO: 2719324 - RNA, 15 nt, Human
acucuugaccucagg

SEQ ID NO: 2719325 - RNA, 16 nt, Human
acucuugaccucaggu

SEQ ID NO: 2719326 - RNA, 23 nt, Human
uccucauacccacccccacccaa

SEQ ID NO: 2719327 - RNA, 22 nt, Human
uccucauaguaugguggcuggg

SEQ ID NO: 2719328 - RNA, 13 nt, Human
acucuggcagcuc

SEQ ID NO: 2719329 - RNA, 15 nt, Human
acucuggcagcucag

SEQ ID NO: 2719330 - RNA, 16 nt, Human
acucuccuuggugucg

SEQ ID NO: 2719331 - RNA, 23 nt, Human
acucuccuuggugucgggcauga

SEQ ID NO: 2719332 - RNA, 11 nt, Human
acucugagacu

SEQ ID NO: 2719333 - RNA, 22 nt, Human
acucugagacucgcgacaaugc

SEQ ID NO: 2719334 - RNA, 18 nt, Human
acucuccuggaaauauua

SEQ ID NO: 2719335 - RNA, 15 nt, Human
acucuccuugguguc

SEQ ID NO: 2719336 - RNA, 16 nt, Human
acucuccucugcugcu

SEQ ID NO: 2719337 - RNA, 21 nt, Human
acucuccucugcugcuggcug

SEQ ID NO: 2719338 - RNA, 12 nt, Human
acucuccucugc

SEQ ID NO: 2719339 - RNA, 13 nt, Human
acucuccucugcu

SEQ ID NO: 2719340 - RNA, 14 nt, Human
acucuccucugcug

SEQ ID NO: 2719341 - RNA, 14 nt, Human
acucuccuccagag

SEQ ID NO: 2719342 - RNA, 17 nt, Human
acucuccuccagaguca

SEQ ID NO: 2719343 - RNA, 23 nt, Human
acuccuugaaaacacuguucucu

SEQ ID NO: 2719344 - RNA, 24 nt, Human
acuccuugaaaacacuguucucug

SEQ ID NO: 2719345 - RNA, 16 nt, Human
uccuggaaaucagggu

SEQ ID NO: 2719346 - RNA, 15 nt, Human
uccuggaaauauuaa

SEQ ID NO: 2719347 - RNA, 22 nt, Human
uccuggaauaucuccgucaacu

SEQ ID NO: 2719348 - RNA, 15 nt, Human
uccugggagcuuuug

SEQ ID NO: 2719349 - RNA, 12 nt, Human
uccugggaguga

SEQ ID NO: 2719350 - RNA, 14 nt, Human
uccugggagugagc

SEQ ID NO: 2719351 - RNA, 17 nt, Human
uccugggagugagcugg

SEQ ID NO: 2719352 - RNA, 12 nt, Human
uccugcaggcag

SEQ ID NO: 2719353 - RNA, 13 nt, Human
uccugcaggcagc

SEQ ID NO: 2719354 - RNA, 21 nt, Human
uccugccucgaacuggcugca

SEQ ID NO: 2719355 - RNA, 14 nt, Human
uccugcaggcagcc

SEQ ID NO: 2719356 - RNA, 21 nt, Human
uccugcugcaguugccaguca

SEQ ID NO: 2719357 - RNA, 19 nt, Human
uccugaugcuucuucagag

SEQ ID NO: 2719358 - RNA, 20 nt, Human
uccugaugcuucuucagaga

SEQ ID NO: 2719359 - RNA, 21 nt, Human
uccugaugcuucuucagagac

SEQ ID NO: 2719360 - RNA, 14 nt, Human
acugcacuccagcc

SEQ ID NO: 2719361 - RNA, 21 nt, Human
acugcacuauagccuagguga

SEQ ID NO: 2719362 - RNA, 17 nt, Human
acugcacuccagccugg

SEQ ID NO: 2719363 - RNA, 18 nt, Human
acugcacuccagccuggg

SEQ ID NO: 2719364 - RNA, 19 nt, Human
acugcacuccagccugggu

SEQ ID NO: 2719365 - RNA, 20 nt, Human
acugcacuccagccugggug

SEQ ID NO: 2719366 - RNA, 14 nt, Human
acugcaccgggcca

SEQ ID NO: 2719367 - RNA, 16 nt, Human
acugcaccgggccaca

SEQ ID NO: 2719368 - RNA, 20 nt, Human
acugcacuauagccuaggug

SEQ ID NO: 2719369 - RNA, 21 nt, Human
acugauaaagaugagugagca

SEQ ID NO: 2719370 - RNA, 13 nt, Human
acugauaaagaug

SEQ ID NO: 2719371 - RNA, 17 nt, Human
acugagaugugaacaca

SEQ ID NO: 2719372 - RNA, 22 nt, Human
acugagaugugaacacaucagc

SEQ ID NO: 2719373 - RNA, 22 nt, Human
acugagacagcccgggcucugc

SEQ ID NO: 2719374 - RNA, 23 nt, Human
acugagacagcccgggcucugcc

SEQ ID NO: 2719375 - RNA, 15 nt, Human
acugagacagcccgg

SEQ ID NO: 2719376 - RNA, 18 nt, Human
acugagacagcccgggcu

SEQ ID NO: 2719377 - RNA, 21 nt, Human
acugagacagcccgggcucug

SEQ ID NO: 2719378 - RNA, 22 nt, Human
acugacuucuaaguaaaaccac

SEQ ID NO: 2719379 - RNA, 16 nt, Human
acugacuucuaaguaa

SEQ ID NO: 2719380 - RNA, 15 nt, Human
acugacuucuaagua

SEQ ID NO: 2719381 - RNA, 13 nt, Human
acugacuucuaag

SEQ ID NO: 2719382 - RNA, 17 nt, Human
acugacucuuaagaaga

SEQ ID NO: 2719383 - RNA, 18 nt, Human
acugacucuuaagaagac

SEQ ID NO: 2719384 - RNA, 20 nt, Human
acugacucuuaagaagacug

SEQ ID NO: 2719385 - RNA, 13 nt, Human
acugacucuuaag

SEQ ID NO: 2719386 - RNA, 14 nt, Human
acugacucuuaaga

SEQ ID NO: 2719387 - RNA, 15 nt, Human
acugacucuuaagaa

SEQ ID NO: 2719388 - RNA, 16 nt, Human
acugacucuuaagaag

SEQ ID NO: 2719389 - RNA, 12 nt, Human
acugaagaagca

SEQ ID NO: 2719390 - RNA, 22 nt, Human
uccucuuuggucuacacugugc

SEQ ID NO: 2719391 - RNA, 12 nt, Human
uccucuuuccau

SEQ ID NO: 2719392 - RNA, 11 nt, Human
uccucuuucca

SEQ ID NO: 2719393 - RNA, 14 nt, Human
uccucccucccucu

SEQ ID NO: 2719394 - RNA, 11 nt, Human
uccucccuccc

SEQ ID NO: 2719395 - RNA, 19 nt, Human
uccucuuuccaucuacccu

SEQ ID NO: 2719396 - RNA, 19 nt, Human
uccucuuuggucuacacug

SEQ ID NO: 2719397 - RNA, 21 nt, Human
uccucuuuggucuacacugug

SEQ ID NO: 2719398 - RNA, 20 nt, Human
accuugaacuggguacuugu

SEQ ID NO: 2719399 - RNA, 18 nt, Human
accuuuggagcaaagcug

SEQ ID NO: 2719400 - RNA, 18 nt, Human
accuuuguccccaccgca
